United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 205

SEQ ID NO: 8513230 - DNA, 22 bp, Homo sapiens
aggaaggtgcagtagggtgtgc

SEQ ID NO: 8513231 - DNA, 22 bp, Homo sapiens
aggaagtgaaagggaaggagtt

SEQ ID NO: 8513232 - DNA, 22 bp, Homo sapiens
caggctgtctgaatggaggccc

SEQ ID NO: 8513233 - DNA, 22 bp, Homo sapiens
caggctgtgaaactgagatgcg

SEQ ID NO: 8513234 - DNA, 22 bp, Homo sapiens
caggctgtgaaactgagatgcg

SEQ ID NO: 8513235 - DNA, 22 bp, Homo sapiens
caggctgtggatcaggagcctt

SEQ ID NO: 8513236 - DNA, 22 bp, Homo sapiens
caggctgtgggagtcaggaccc

SEQ ID NO: 8513237 - DNA, 22 bp, Homo sapiens
caggctgtgggagtcaggaccc

SEQ ID NO: 8513238 - DNA, 22 bp, Homo sapiens
caggctgtgttcctggaacccc

SEQ ID NO: 8513239 - DNA, 22 bp, Homo sapiens
caggctgtgaaactgagatgcg

SEQ ID NO: 8513240 - DNA, 22 bp, Homo sapiens
caggctggagttcagtggtgtg

SEQ ID NO: 8513241 - DNA, 22 bp, Homo sapiens
agctggtgctgaagctcttgag

SEQ ID NO: 8513242 - DNA, 22 bp, Homo sapiens
agctggtgctgaagctcttgag

SEQ ID NO: 8513243 - DNA, 22 bp, Homo sapiens
agctggtgctgaagctcttgag

SEQ ID NO: 8513244 - DNA, 22 bp, Homo sapiens
agctggtgctcggggagctggc

SEQ ID NO: 8513245 - DNA, 22 bp, Homo sapiens
agctggtgctcggggagctggc

SEQ ID NO: 8513246 - DNA, 22 bp, Homo sapiens
caggcttcatgaattatgcacc

SEQ ID NO: 8513247 - DNA, 22 bp, Homo sapiens
caggcttgattattcagacaat

SEQ ID NO: 8513248 - DNA, 22 bp, Homo sapiens
caggcttgagggcaggcccagt

SEQ ID NO: 8513249 - DNA, 22 bp, Homo sapiens
caggcttgctgctagagcactt

SEQ ID NO: 8513250 - DNA, 22 bp, Homo sapiens
agcttctcaggagtctgaggca

SEQ ID NO: 8513251 - DNA, 22 bp, Homo sapiens
agcttctcaggagtctgaggca

SEQ ID NO: 8513252 - DNA, 23 bp, Homo sapiens
agcttctggttcaggtcaagcag

SEQ ID NO: 8513253 - DNA, 22 bp, Homo sapiens
agcttctggaaggcaaggcttg

SEQ ID NO: 8513254 - DNA, 22 bp, Homo sapiens
agcttctggaaggcaaggcttg

SEQ ID NO: 8513255 - DNA, 22 bp, Homo sapiens
agcttctgttcatcttccaggc

SEQ ID NO: 8513256 - DNA, 22 bp, Homo sapiens
agcttctggaaggcaaggcttg

SEQ ID NO: 8513257 - DNA, 22 bp, Homo sapiens
agcttctggaagcctggcagca

SEQ ID NO: 8513258 - DNA, 20 bp, Homo sapiens
agcttctgctgcctttcggc

SEQ ID NO: 8513259 - DNA, 22 bp, Homo sapiens
agcttctgcccgtgtttgctct

SEQ ID NO: 8513260 - DNA, 22 bp, Homo sapiens
agcttctgcatcttttcttccc

SEQ ID NO: 8513261 - DNA, 17 bp, Homo sapiens
agcttctgccctttctt

SEQ ID NO: 8513262 - DNA, 22 bp, Homo sapiens
agcttctgcccgtgtttgctct

SEQ ID NO: 8513263 - DNA, 22 bp, Homo sapiens
agcttctctggtcttctgccaa

SEQ ID NO: 8513264 - DNA, 22 bp, Homo sapiens
agcttctgcatcttttcttccc

SEQ ID NO: 8513265 - DNA, 22 bp, Homo sapiens
agcttctcctggtacagaactg

SEQ ID NO: 8513266 - DNA, 22 bp, Homo sapiens
agcttctccctttcctattggt

SEQ ID NO: 8513267 - DNA, 22 bp, Homo sapiens
agcttctcctggtacagaactg

SEQ ID NO: 8513268 - DNA, 22 bp, Homo sapiens
agcttctctcagggtatctttc

SEQ ID NO: 8513269 - DNA, 22 bp, Homo sapiens
agcttctctctttgcactcaca

SEQ ID NO: 8513270 - DNA, 22 bp, Homo sapiens
agcttctctctttgcactcaca

SEQ ID NO: 8513271 - DNA, 22 bp, Homo sapiens
agctttattcatgatttcaggg

SEQ ID NO: 8513272 - DNA, 22 bp, Homo sapiens
agctttatatttaatgaattct

SEQ ID NO: 8513273 - DNA, 22 bp, Homo sapiens
agcttctgttcatcttccaggc

SEQ ID NO: 8513274 - DNA, 22 bp, Homo sapiens
agcttctgttcatcttccaggc

SEQ ID NO: 8513275 - DNA, 22 bp, Homo sapiens
agctttatttgtcattcacggc

SEQ ID NO: 8513276 - DNA, 22 bp, Homo sapiens
agctttcacgatttggaacagg

SEQ ID NO: 8513277 - DNA, 22 bp, Homo sapiens
agctttcacgatttggaacagg

SEQ ID NO: 8513278 - DNA, 22 bp, Homo sapiens
agctttcaggataatgaaaaag

SEQ ID NO: 8513279 - DNA, 22 bp, Homo sapiens
agctttcgttccttagacacat

SEQ ID NO: 8513280 - DNA, 22 bp, Homo sapiens
agctttccactatcttaggggt

SEQ ID NO: 8513281 - DNA, 22 bp, Homo sapiens
agctttcagtctctgaaggaac

SEQ ID NO: 8513282 - DNA, 22 bp, Homo sapiens
cagggacaggggagaaaagatg

SEQ ID NO: 8513283 - DNA, 22 bp, Homo sapiens
cagggacatgactggtctctgt

SEQ ID NO: 8513284 - DNA, 22 bp, Homo sapiens
cagggacataagaggaacatgg

SEQ ID NO: 8513285 - DNA, 22 bp, Homo sapiens
agctttctccctgacgctttgg

SEQ ID NO: 8513286 - DNA, 22 bp, Homo sapiens
agctttctagtttagccatctt

SEQ ID NO: 8513287 - DNA, 22 bp, Homo sapiens
agctttctatatatgagttgct

SEQ ID NO: 8513288 - DNA, 22 bp, Homo sapiens
agctttctctcagccaggctgc

SEQ ID NO: 8513289 - DNA, 22 bp, Homo sapiens
agctttctcttctttagaaagt

SEQ ID NO: 8513290 - DNA, 22 bp, Homo sapiens
agctttgggggtaggtatagag

SEQ ID NO: 8513291 - DNA, 22 bp, Homo sapiens
cagggactgagatccagactgt

SEQ ID NO: 8513292 - DNA, 22 bp, Homo sapiens
cagggactcccagggtagctcc

SEQ ID NO: 8513293 - DNA, 22 bp, Homo sapiens
cagggactacagccagccctcc

SEQ ID NO: 8513294 - DNA, 22 bp, Homo sapiens
cagggacatttccaagagaatt

SEQ ID NO: 8513295 - DNA, 22 bp, Homo sapiens
cagggacattggtggccaggtt

SEQ ID NO: 8513296 - DNA, 22 bp, Homo sapiens
cagggacattggtggccaggtt

SEQ ID NO: 8513297 - DNA, 22 bp, Homo sapiens
cagggacattggtggccaggtt

SEQ ID NO: 8513298 - DNA, 22 bp, Homo sapiens
aggaaaatggaccagagttgtt

SEQ ID NO: 8513299 - DNA, 22 bp, Homo sapiens
aggaaaatggaccagagttgtt

SEQ ID NO: 8513300 - DNA, 21 bp, Homo sapiens
aggaaaattgagggttgttgt

SEQ ID NO: 8513301 - DNA, 22 bp, Homo sapiens
aggaaacaacttggcatgagcc

SEQ ID NO: 8513302 - DNA, 22 bp, Homo sapiens
aggaaaatgaaacagcaactgt

SEQ ID NO: 8513303 - DNA, 22 bp, Homo sapiens
aggaaaatgatattctgctgtt

SEQ ID NO: 8513304 - DNA, 22 bp, Homo sapiens
aggaaaatggaccagagttgtt

SEQ ID NO: 8513305 - DNA, 22 bp, Homo sapiens
aggaaaatcaatgtctttttaa

SEQ ID NO: 8513306 - DNA, 22 bp, Homo sapiens
aggaaaatcgagtctggaggca

SEQ ID NO: 8513307 - DNA, 22 bp, Homo sapiens
aggaaaacacagtattgatgga

SEQ ID NO: 8513308 - DNA, 20 bp, Homo sapiens
aggaaaaatggaaactggag

SEQ ID NO: 8513309 - DNA, 22 bp, Homo sapiens
aggaaaacacagtattgatgga

SEQ ID NO: 8513310 - DNA, 22 bp, Homo sapiens
aggaaaagtgtgaagtatggag

SEQ ID NO: 8513311 - DNA, 20 bp, Homo sapiens
aggaaaagggtggtggtaga

SEQ ID NO: 8513312 - DNA, 22 bp, Homo sapiens
aggaaaaataaggcagcagggc

SEQ ID NO: 8513313 - DNA, 22 bp, Homo sapiens
aggaaaaataaggcagcagggc

SEQ ID NO: 8513314 - DNA, 22 bp, Homo sapiens
aggaaaaataaggcagcagggc

SEQ ID NO: 8513315 - DNA, 22 bp, Homo sapiens
aggaaaaataaggcagcagggc

SEQ ID NO: 8513316 - DNA, 20 bp, Homo sapiens
aggaaaaatggaaactggag

SEQ ID NO: 8513317 - DNA, 19 bp, Homo sapiens
agctggagattggagggca

SEQ ID NO: 8513318 - DNA, 19 bp, Homo sapiens
agctggagattggagggca

SEQ ID NO: 8513319 - DNA, 19 bp, Homo sapiens
agctggagattggagggca

SEQ ID NO: 8513320 - DNA, 22 bp, Homo sapiens
agctggagattctggggacagt

SEQ ID NO: 8513321 - DNA, 22 bp, Homo sapiens
agctggagattctggggacagt

SEQ ID NO: 8513322 - DNA, 19 bp, Homo sapiens
agctggagattggagggca

SEQ ID NO: 8513323 - DNA, 22 bp, Homo sapiens
agctggagcttcaagcaggtaa

SEQ ID NO: 8513324 - DNA, 22 bp, Homo sapiens
agctggagccagtgtgaggctt

SEQ ID NO: 8513325 - DNA, 22 bp, Homo sapiens
agctggagccagtgtgaggctt

SEQ ID NO: 8513326 - DNA, 22 bp, Homo sapiens
agctggagcttcaagcaggtaa

SEQ ID NO: 8513327 - DNA, 22 bp, Homo sapiens
agctggagcttcaagcaggtaa

SEQ ID NO: 8513328 - DNA, 22 bp, Homo sapiens
agctggagcttcaagcaggtaa

SEQ ID NO: 8513329 - DNA, 22 bp, Homo sapiens
agctggagaaacctgggagggt

SEQ ID NO: 8513330 - DNA, 22 bp, Homo sapiens
agctggagaaacctgggagggt

SEQ ID NO: 8513331 - DNA, 21 bp, Homo sapiens
agctggaatctggctgtgctt

SEQ ID NO: 8513332 - DNA, 22 bp, Homo sapiens
agctggaattacaggagcccat

SEQ ID NO: 8513333 - DNA, 22 bp, Homo sapiens
agctggagaaacctgggagggt

SEQ ID NO: 8513334 - DNA, 22 bp, Homo sapiens
agctggaattacaggcacgcac

SEQ ID NO: 8513335 - DNA, 20 bp, Homo sapiens
agctggagaagggcccttcc

SEQ ID NO: 8513336 - DNA, 22 bp, Homo sapiens
agctggagatcatgctgatact

SEQ ID NO: 8513337 - DNA, 22 bp, Homo sapiens
agctggagatgcccagcaccgg

SEQ ID NO: 8513338 - DNA, 22 bp, Homo sapiens
agctggagatgcccagcaccgg

SEQ ID NO: 8513339 - DNA, 22 bp, Homo sapiens
agctggagagtttccaggaagg

SEQ ID NO: 8513340 - DNA, 22 bp, Homo sapiens
agctggagatcatgctgatact

SEQ ID NO: 8513341 - DNA, 21 bp, Homo sapiens
agctgggcctcagcctgcagt

SEQ ID NO: 8513342 - DNA, 21 bp, Homo sapiens
agctgggcctcagcctgcagt

SEQ ID NO: 8513343 - DNA, 22 bp, Homo sapiens
agctgggcctgagctggaagct

SEQ ID NO: 8513344 - DNA, 22 bp, Homo sapiens
agctgggcctgagctggaagct

SEQ ID NO: 8513345 - DNA, 22 bp, Homo sapiens
agctgggcctgagctggaagct

SEQ ID NO: 8513346 - DNA, 22 bp, Homo sapiens
agctgggcctgatttgcagggg

SEQ ID NO: 8513347 - DNA, 22 bp, Homo sapiens
agctgggctgatgactcatgtt

SEQ ID NO: 8513348 - DNA, 22 bp, Homo sapiens
agctgggcgcagtggctggtga

SEQ ID NO: 8513349 - DNA, 22 bp, Homo sapiens
agctgggcgcagtggctggtga

SEQ ID NO: 8513350 - DNA, 22 bp, Homo sapiens
agctgggctccaagagggatct

SEQ ID NO: 8513351 - DNA, 22 bp, Homo sapiens
agctgggcaccccgctgcgtct

SEQ ID NO: 8513352 - DNA, 22 bp, Homo sapiens
agctgggactcaactgtctggg

SEQ ID NO: 8513353 - DNA, 22 bp, Homo sapiens
agctgggactcaactgtctggg

SEQ ID NO: 8513354 - DNA, 22 bp, Homo sapiens
agctggaggagtttctcctagc

SEQ ID NO: 8513355 - DNA, 22 bp, Homo sapiens
agctggaggagtttctcctagc

SEQ ID NO: 8513356 - DNA, 22 bp, Homo sapiens
agctgggactcaactgtctggg

SEQ ID NO: 8513357 - DNA, 22 bp, Homo sapiens
agctgggcagactgcagtggtt

SEQ ID NO: 8513358 - DNA, 22 bp, Homo sapiens
agctgggcagtgcttggattca

SEQ ID NO: 8513359 - DNA, 22 bp, Homo sapiens
agctgggcagactgcagtggtt

SEQ ID NO: 8513360 - DNA, 23 bp, Homo sapiens
agctgggccaggtggtcagacct

SEQ ID NO: 8513361 - DNA, 23 bp, Homo sapiens
agctgggccaggtggtcagacct

SEQ ID NO: 8513362 - DNA, 21 bp, Homo sapiens
agctgggcctcagcctgcagt

SEQ ID NO: 8513363 - DNA, 22 bp, Homo sapiens
caggcagagtcagattagactt

SEQ ID NO: 8513364 - DNA, 20 bp, Homo sapiens
caggcagaggatgctgacca

SEQ ID NO: 8513365 - DNA, 22 bp, Homo sapiens
agctgggtggcctctcctcggg

SEQ ID NO: 8513366 - DNA, 23 bp, Homo sapiens
agctgggtggcctgcgtgaagct

SEQ ID NO: 8513367 - DNA, 22 bp, Homo sapiens
agctgggtggagggcccacggt

SEQ ID NO: 8513368 - DNA, 22 bp, Homo sapiens
agctgggtgcggtggctcatgc

SEQ ID NO: 8513369 - DNA, 19 bp, Homo sapiens
agctggggcggtgtgtgtt

SEQ ID NO: 8513370 - DNA, 22 bp, Homo sapiens
caggcagagtgagaagcccttg

SEQ ID NO: 8513371 - DNA, 22 bp, Homo sapiens
caggcagagtgagaagcccttg

SEQ ID NO: 8513372 - DNA, 22 bp, Homo sapiens
agctggtctgctgcatggagtg

SEQ ID NO: 8513373 - DNA, 22 bp, Homo sapiens
agctggtctgctgcatggagtg

SEQ ID NO: 8513374 - DNA, 18 bp, Homo sapiens
agctggtgaaatccagta

SEQ ID NO: 8513375 - DNA, 22 bp, Homo sapiens
agctggtcttaaatgtgtccag

SEQ ID NO: 8513376 - DNA, 22 bp, Homo sapiens
agctggtgaacctgaggcacag

SEQ ID NO: 8513377 - DNA, 20 bp, Homo sapiens
agctggtgaattaaagactg

SEQ ID NO: 8513378 - DNA, 20 bp, Homo sapiens
agctggtgaattaaagactg

SEQ ID NO: 8513379 - DNA, 22 bp, Homo sapiens
agctggtgatggcctaagaagg

SEQ ID NO: 8513380 - DNA, 22 bp, Homo sapiens
agctggtgatgtggtccctcac

SEQ ID NO: 8513381 - DNA, 22 bp, Homo sapiens
agctggtgatggcctaagaagg

SEQ ID NO: 8513382 - DNA, 22 bp, Homo sapiens
agctggtgagggttgaggggta

SEQ ID NO: 8513383 - DNA, 22 bp, Homo sapiens
agctggtgctcaggggcatgga

SEQ ID NO: 8513384 - DNA, 22 bp, Homo sapiens
agctggtgctcaggggcatgga

SEQ ID NO: 8513385 - DNA, 22 bp, Homo sapiens
agctgggtgttcttgggcctaa

SEQ ID NO: 8513386 - DNA, 22 bp, Homo sapiens
agctgggtgtgtatcagataaa

SEQ ID NO: 8513387 - DNA, 22 bp, Homo sapiens
agctggtcagagtggggataga

SEQ ID NO: 8513388 - DNA, 22 bp, Homo sapiens
agctggtatttgttagggagtt

SEQ ID NO: 8513389 - DNA, 20 bp, Homo sapiens
agctggtccccaagcctctc

SEQ ID NO: 8513390 - DNA, 22 bp, Homo sapiens
agctggtatttgttagggagtt

SEQ ID NO: 8513391 - DNA, 22 bp, Homo sapiens
agctggtatgaacaggatagga

SEQ ID NO: 8513392 - DNA, 22 bp, Homo sapiens
agctggtaagtggcagagattc

SEQ ID NO: 8513393 - DNA, 22 bp, Homo sapiens
agctggtatgaacaggatagga

SEQ ID NO: 8513394 - DNA, 22 bp, Homo sapiens
agctggtaagtggcagagattc

SEQ ID NO: 8513395 - DNA, 22 bp, Homo sapiens
agctgggtttctggcaggctta

SEQ ID NO: 8513396 - DNA, 22 bp, Homo sapiens
agctgaaacccaggcctcagct

SEQ ID NO: 8513397 - DNA, 22 bp, Homo sapiens
agctgaaacccaggcctcagct

SEQ ID NO: 8513398 - DNA, 22 bp, Homo sapiens
agctgaaattttactgagtata

SEQ ID NO: 8513399 - DNA, 17 bp, Homo sapiens
agctgaaattgctgaag

SEQ ID NO: 8513400 - DNA, 22 bp, Homo sapiens
agctgaacgtgcttctgcagca

SEQ ID NO: 8513401 - DNA, 22 bp, Homo sapiens
agctgaaattcacaaggatcca

SEQ ID NO: 8513402 - DNA, 22 bp, Homo sapiens
agctgaaattctttgtcctcag

SEQ ID NO: 8513403 - DNA, 23 bp, Homo sapiens
agctgaaagcttgcaacgaggca

SEQ ID NO: 8513404 - DNA, 22 bp, Homo sapiens
agctgaaagggtgttggagtgt

SEQ ID NO: 8513405 - DNA, 22 bp, Homo sapiens
caggaaatatctcaacacttta

SEQ ID NO: 8513406 - DNA, 17 bp, Homo sapiens
caggaaaatatgagtga

SEQ ID NO: 8513407 - DNA, 17 bp, Homo sapiens
caggaaaatatgagtga

SEQ ID NO: 8513408 - DNA, 22 bp, Homo sapiens
caggaaatcactctgattttgg

SEQ ID NO: 8513409 - DNA, 21 bp, Homo sapiens
caggaaatcagtgtgaattag

SEQ ID NO: 8513410 - DNA, 22 bp, Homo sapiens
caggaaatatctcctggcagag

SEQ ID NO: 8513411 - DNA, 22 bp, Homo sapiens
caggaaatatctcctggcagag

SEQ ID NO: 8513412 - DNA, 23 bp, Homo sapiens
caggaaatcaattcttccagcat

SEQ ID NO: 8513413 - DNA, 22 bp, Homo sapiens
caggaagaccagggctgtggct

SEQ ID NO: 8513414 - DNA, 22 bp, Homo sapiens
caggaagaagggtggtgagtcc

SEQ ID NO: 8513415 - DNA, 22 bp, Homo sapiens
caggaagaagggtggtgagtcc

SEQ ID NO: 8513416 - DNA, 22 bp, Homo sapiens
caggaagaagggtggtgagtcc

SEQ ID NO: 8513417 - DNA, 22 bp, Homo sapiens
caggaagaaagaggtgaggtgt

SEQ ID NO: 8513418 - DNA, 22 bp, Homo sapiens
caggaagaaagaggtgaggtgt

SEQ ID NO: 8513419 - DNA, 22 bp, Homo sapiens
caggaagaaagaggtgaggtgt

SEQ ID NO: 8513420 - DNA, 22 bp, Homo sapiens
caggaacctgtgcgtagggatg

SEQ ID NO: 8513421 - DNA, 22 bp, Homo sapiens
caggaaatgaacaggaatgaac

SEQ ID NO: 8513422 - DNA, 23 bp, Homo sapiens
caggaaatgaatccaggaggatg

SEQ ID NO: 8513423 - DNA, 22 bp, Homo sapiens
caggaaatgctatcatagctga

SEQ ID NO: 8513424 - DNA, 22 bp, Homo sapiens
caggaaatgcgtagttgaactt

SEQ ID NO: 8513425 - DNA, 22 bp, Homo sapiens
caggaacctaaagagacattac

SEQ ID NO: 8513426 - DNA, 22 bp, Homo sapiens
caggaacctaatgaaggctcac

SEQ ID NO: 8513427 - DNA, 22 bp, Homo sapiens
caggaacctaatgaaggctcac

SEQ ID NO: 8513428 - DNA, 20 bp, Homo sapiens
caggaaccaaagaggactcc

SEQ ID NO: 8513429 - DNA, 22 bp, Homo sapiens
agctgcccccagggctgtgctt

SEQ ID NO: 8513430 - DNA, 22 bp, Homo sapiens
agctgcccccagggctgtgctt

SEQ ID NO: 8513431 - DNA, 22 bp, Homo sapiens
agctgcccctcattttcaccac

SEQ ID NO: 8513432 - DNA, 22 bp, Homo sapiens
agctgccccgaggcggcgggaa

SEQ ID NO: 8513433 - DNA, 22 bp, Homo sapiens
agctgccagatgacagtgctat

SEQ ID NO: 8513434 - DNA, 22 bp, Homo sapiens
agctgccagatgacagtgctat

SEQ ID NO: 8513435 - DNA, 20 bp, Homo sapiens
agctgcccctgggcactgcc

SEQ ID NO: 8513436 - DNA, 20 bp, Homo sapiens
agctgcccctgggcactgcc

SEQ ID NO: 8513437 - DNA, 22 bp, Homo sapiens
agctgccctcgctggggccaga

SEQ ID NO: 8513438 - DNA, 22 bp, Homo sapiens
agctgccctggcggagctgctc

SEQ ID NO: 8513439 - DNA, 22 bp, Homo sapiens
agctgccctggcggagctgctc

SEQ ID NO: 8513440 - DNA, 18 bp, Homo sapiens
agctgccctgggctggag

SEQ ID NO: 8513441 - DNA, 22 bp, Homo sapiens
agctgccctgggctggagatgg

SEQ ID NO: 8513442 - DNA, 22 bp, Homo sapiens
agctgccctgggtcttgctgct

SEQ ID NO: 8513443 - DNA, 22 bp, Homo sapiens
agctgccctgggtcttgctgct

SEQ ID NO: 8513444 - DNA, 22 bp, Homo sapiens
agctgccctgggtcttgctgct

SEQ ID NO: 8513445 - DNA, 22 bp, Homo sapiens
agctgccctggtaagattgatg

SEQ ID NO: 8513446 - DNA, 22 bp, Homo sapiens
agctgcccttaataggcattca

SEQ ID NO: 8513447 - DNA, 22 bp, Homo sapiens
agctgccctgtggggagggttg

SEQ ID NO: 8513448 - DNA, 22 bp, Homo sapiens
agctgcccttctcttgcccttg

SEQ ID NO: 8513449 - DNA, 22 bp, Homo sapiens
agctgcccttctcttgcccttg

SEQ ID NO: 8513450 - DNA, 22 bp, Homo sapiens
agctgccctttatgatgctgaa

SEQ ID NO: 8513451 - DNA, 21 bp, Homo sapiens
agctgcctccacttctgaggc

SEQ ID NO: 8513452 - DNA, 21 bp, Homo sapiens
agctgcctccacttctgaggc

SEQ ID NO: 8513453 - DNA, 22 bp, Homo sapiens
agctgcctcagtcactcatggc

SEQ ID NO: 8513454 - DNA, 22 bp, Homo sapiens
agctgcctcagcaacacagacc

SEQ ID NO: 8513455 - DNA, 22 bp, Homo sapiens
agctgcctcagcaacacagacc

SEQ ID NO: 8513456 - DNA, 22 bp, Homo sapiens
agctgcctagtagattgattgg

SEQ ID NO: 8513457 - DNA, 22 bp, Homo sapiens
agctgcctcagcaacacagacc

SEQ ID NO: 8513458 - DNA, 20 bp, Homo sapiens
agctgcccttttcacatgtt

SEQ ID NO: 8513459 - DNA, 20 bp, Homo sapiens
agctgcccttttcacatgtt

SEQ ID NO: 8513460 - DNA, 22 bp, Homo sapiens
agctgcctccatggtcaaagat

SEQ ID NO: 8513461 - DNA, 22 bp, Homo sapiens
agctgcctccatggtcaaagat

SEQ ID NO: 8513462 - DNA, 22 bp, Homo sapiens
agctgcctccatggtcaaagat

SEQ ID NO: 8513463 - DNA, 22 bp, Homo sapiens
agctgcctccctgtgcttgtcc

SEQ ID NO: 8513464 - DNA, 22 bp, Homo sapiens
agctgcctcctggtgccccatc

SEQ ID NO: 8513465 - DNA, 17 bp, Homo sapiens
agctgcctctcccacca

SEQ ID NO: 8513466 - DNA, 22 bp, Homo sapiens
agctgcctctcttgaggttacg

SEQ ID NO: 8513467 - DNA, 22 bp, Homo sapiens
agctgcctgccatgccgctggt

SEQ ID NO: 8513468 - DNA, 21 bp, Homo sapiens
agctgcctgctctggacctgg

SEQ ID NO: 8513469 - DNA, 22 bp, Homo sapiens
agctgcctgctgcactcggtgc

SEQ ID NO: 8513470 - DNA, 22 bp, Homo sapiens
agctgcctgcttatgagctcca

SEQ ID NO: 8513471 - DNA, 22 bp, Homo sapiens
agctgcctctcttgaggttacg

SEQ ID NO: 8513472 - DNA, 22 bp, Homo sapiens
agctgcctctgaactttaattc

SEQ ID NO: 8513473 - DNA, 22 bp, Homo sapiens
agctgcctctgctggtttagaa

SEQ ID NO: 8513474 - DNA, 22 bp, Homo sapiens
agctgcctgcatttatatcctg

SEQ ID NO: 8513475 - DNA, 21 bp, Homo sapiens
agctgctttcagctcctagag

SEQ ID NO: 8513476 - DNA, 21 bp, Homo sapiens
agctgctttcagctcctagag

SEQ ID NO: 8513477 - DNA, 22 bp, Homo sapiens
agctgctttgccaatgcgttcc

SEQ ID NO: 8513478 - DNA, 22 bp, Homo sapiens
agctgctttgccaatgcgttcc

SEQ ID NO: 8513479 - DNA, 22 bp, Homo sapiens
agctgctttgctgggcaggccc

SEQ ID NO: 8513480 - DNA, 21 bp, Homo sapiens
agctgctttcagctcctagag

SEQ ID NO: 8513481 - DNA, 22 bp, Homo sapiens
agctgcctgcttatgagctcca

SEQ ID NO: 8513482 - DNA, 22 bp, Homo sapiens
agctgcctggagccagagttga

SEQ ID NO: 8513483 - DNA, 22 bp, Homo sapiens
agctgctgggaccccagatcca

SEQ ID NO: 8513484 - DNA, 22 bp, Homo sapiens
agctgcctggagtcatttcctg

SEQ ID NO: 8513485 - DNA, 22 bp, Homo sapiens
agctgcctggagccagagttga

SEQ ID NO: 8513486 - DNA, 22 bp, Homo sapiens
agctgcctggagtcatttcctg

SEQ ID NO: 8513487 - DNA, 23 bp, Homo sapiens
agctggaaatggccgagctctgc

SEQ ID NO: 8513488 - DNA, 22 bp, Homo sapiens
agctggaacccgggtgggcagc

SEQ ID NO: 8513489 - DNA, 22 bp, Homo sapiens
agctggaacccgggtgggcagc

SEQ ID NO: 8513490 - DNA, 22 bp, Homo sapiens
agctggaaagaaggtggcagcc

SEQ ID NO: 8513491 - DNA, 22 bp, Homo sapiens
agctggaaaatccaagaccttg

SEQ ID NO: 8513492 - DNA, 22 bp, Homo sapiens
agctgcttttagggccgggctc

SEQ ID NO: 8513493 - DNA, 18 bp, Homo sapiens
agctgcttttggcttaaa

SEQ ID NO: 8513494 - DNA, 18 bp, Homo sapiens
agctgcttttggcttaaa

SEQ ID NO: 8513495 - DNA, 22 bp, Homo sapiens
agctggaagctgatgagcacag

SEQ ID NO: 8513496 - DNA, 22 bp, Homo sapiens
agctggaagctgatgagcacag

SEQ ID NO: 8513497 - DNA, 21 bp, Homo sapiens
agctggaatctggctgtgctt

SEQ ID NO: 8513498 - DNA, 22 bp, Homo sapiens
agctggaagtgcatttctcact

SEQ ID NO: 8513499 - DNA, 22 bp, Homo sapiens
agctggaatcctacttctaaca

SEQ ID NO: 8513500 - DNA, 22 bp, Homo sapiens
agctggaactgggtttgttgga

SEQ ID NO: 8513501 - DNA, 22 bp, Homo sapiens
agctggaacgtcacaggagcag

SEQ ID NO: 8513502 - DNA, 22 bp, Homo sapiens
agctggaagatcctggttttgt

SEQ ID NO: 8513503 - DNA, 21 bp, Homo sapiens
cagttctcttagatttccagt

SEQ ID NO: 8513504 - DNA, 22 bp, Homo sapiens
cagttcctatgggcaaaacaca

SEQ ID NO: 8513505 - DNA, 22 bp, Homo sapiens
cagttccctaatgtgtagaaga

SEQ ID NO: 8513506 - DNA, 22 bp, Homo sapiens
cagttccctaatgtgtagaaga

SEQ ID NO: 8513507 - DNA, 22 bp, Homo sapiens
catcactacaaatttaagaaat

SEQ ID NO: 8513508 - DNA, 22 bp, Homo sapiens
catcacccggaactgtgtctgc

SEQ ID NO: 8513509 - DNA, 19 bp, Homo sapiens
catatttttgggctggcat

SEQ ID NO: 8513510 - DNA, 22 bp, Homo sapiens
catcacatttaaggggaaggac

SEQ ID NO: 8513511 - DNA, 22 bp, Homo sapiens
catcacatttaattaaaatgtc

SEQ ID NO: 8513512 - DNA, 22 bp, Homo sapiens
catattttagttgctgaacagc

SEQ ID NO: 8513513 - DNA, 22 bp, Homo sapiens
cagttctctttccactggaggc

SEQ ID NO: 8513514 - DNA, 19 bp, Homo sapiens
catatttttgggctggcat

SEQ ID NO: 8513515 - DNA, 22 bp, Homo sapiens
catattttagttgctgaacagc

SEQ ID NO: 8513516 - DNA, 17 bp, Homo sapiens
aggagctgggggtggtg

SEQ ID NO: 8513517 - DNA, 17 bp, Homo sapiens
aggagctgggggtggtg

SEQ ID NO: 8513518 - DNA, 22 bp, Homo sapiens
cagttataggagccattgtata

SEQ ID NO: 8513519 - DNA, 22 bp, Homo sapiens
cagttattatgaggtcattagg

SEQ ID NO: 8513520 - DNA, 21 bp, Homo sapiens
cagttattcttgatgtgtgtg

SEQ ID NO: 8513521 - DNA, 22 bp, Homo sapiens
cagttcacactgtgctatctgc

SEQ ID NO: 8513522 - DNA, 23 bp, Homo sapiens
cagttcccactgtctgtcacaag

SEQ ID NO: 8513523 - DNA, 22 bp, Homo sapiens
catcagacctgccagactaggt

SEQ ID NO: 8513524 - DNA, 22 bp, Homo sapiens
catcagaggtacttaatgaatg

SEQ ID NO: 8513525 - DNA, 23 bp, Homo sapiens
catcagaggttgccactccctgg

SEQ ID NO: 8513526 - DNA, 22 bp, Homo sapiens
aggaggctgcaaccctgaggcc

SEQ ID NO: 8513527 - DNA, 22 bp, Homo sapiens
catcagagtcagagctctttct

SEQ ID NO: 8513528 - DNA, 22 bp, Homo sapiens
aggaggctgcaaccctgaggcc

SEQ ID NO: 8513529 - DNA, 22 bp, Homo sapiens
aggaggctggttcaggccatat

SEQ ID NO: 8513530 - DNA, 22 bp, Homo sapiens
aggaggctgggcacagtggcct

SEQ ID NO: 8513531 - DNA, 22 bp, Homo sapiens
aggaggctgggcacagtggcct

SEQ ID NO: 8513532 - DNA, 22 bp, Homo sapiens
aggaggctgcaaccctgaggcc

SEQ ID NO: 8513533 - DNA, 22 bp, Homo sapiens
aggaggctgcaaccctgaggcc

SEQ ID NO: 8513534 - DNA, 22 bp, Homo sapiens
aggaggctgggcacagtggcct

SEQ ID NO: 8513535 - DNA, 22 bp, Homo sapiens
catcagaatctgagtctctgcc

SEQ ID NO: 8513536 - DNA, 22 bp, Homo sapiens
catcagaagaaagacaaatgat

SEQ ID NO: 8513537 - DNA, 22 bp, Homo sapiens
catcagaagaaagacaaatgat

SEQ ID NO: 8513538 - DNA, 22 bp, Homo sapiens
catcagaagatggctctggaaa

SEQ ID NO: 8513539 - DNA, 22 bp, Homo sapiens
catcacttttaaaggtgatcga

SEQ ID NO: 8513540 - DNA, 22 bp, Homo sapiens
catcatgccccgctacagtgca

SEQ ID NO: 8513541 - DNA, 22 bp, Homo sapiens
aggaggtgagcggtcatgtggt

SEQ ID NO: 8513542 - DNA, 22 bp, Homo sapiens
aggaggtgacagcctgcatctg

SEQ ID NO: 8513543 - DNA, 22 bp, Homo sapiens
aggaggtcagagccccatgctg

SEQ ID NO: 8513544 - DNA, 22 bp, Homo sapiens
aggagggtttcaatgggatgag

SEQ ID NO: 8513545 - DNA, 22 bp, Homo sapiens
aggagggtttcaatgggatgag

SEQ ID NO: 8513546 - DNA, 22 bp, Homo sapiens
aggagggttgaggaggatactt

SEQ ID NO: 8513547 - DNA, 22 bp, Homo sapiens
aggagggttctctggacagagg

SEQ ID NO: 8513548 - DNA, 22 bp, Homo sapiens
aggagggttctctggacagagg

SEQ ID NO: 8513549 - DNA, 22 bp, Homo sapiens
aggaggctggttcaggccatat

SEQ ID NO: 8513550 - DNA, 22 bp, Homo sapiens
aggaggctggttcaggccatat

SEQ ID NO: 8513551 - DNA, 22 bp, Homo sapiens
aggaggggcaatgatagtctgg

SEQ ID NO: 8513552 - DNA, 22 bp, Homo sapiens
aggaggggcaatgatagtctgg

SEQ ID NO: 8513553 - DNA, 22 bp, Homo sapiens
aggagggtggcctcatgtgagt

SEQ ID NO: 8513554 - DNA, 22 bp, Homo sapiens
aggagggtggcctcatgtgagt

SEQ ID NO: 8513555 - DNA, 22 bp, Homo sapiens
aggagggtggcctcatgtgagt

SEQ ID NO: 8513556 - DNA, 22 bp, Homo sapiens
aggagggtggggtctgcctgtc

SEQ ID NO: 8513557 - DNA, 22 bp, Homo sapiens
aggagggtgggaagcagtttta

SEQ ID NO: 8513558 - DNA, 22 bp, Homo sapiens
aggagggtgggaagcagtttta

SEQ ID NO: 8513559 - DNA, 22 bp, Homo sapiens
aggagggtggggtctgcctgtc

SEQ ID NO: 8513560 - DNA, 22 bp, Homo sapiens
aggagggttctctggacagagg

SEQ ID NO: 8513561 - DNA, 22 bp, Homo sapiens
catcatttgttcacttgattcc

SEQ ID NO: 8513562 - DNA, 20 bp, Homo sapiens
catcattttaaaatctctcc

SEQ ID NO: 8513563 - DNA, 22 bp, Homo sapiens
catcattttattaaccaagaaa

SEQ ID NO: 8513564 - DNA, 22 bp, Homo sapiens
catcatttgtttgcatgcagga

SEQ ID NO: 8513565 - DNA, 23 bp, Homo sapiens
catcattgttatgggtgctacta

SEQ ID NO: 8513566 - DNA, 22 bp, Homo sapiens
catcatttaattataggggctg

SEQ ID NO: 8513567 - DNA, 23 bp, Homo sapiens
catcattgttatgggtgctacta

SEQ ID NO: 8513568 - DNA, 22 bp, Homo sapiens
catcattgttagggactctaac

SEQ ID NO: 8513569 - DNA, 22 bp, Homo sapiens
catcattgcctgtttcccttgg

SEQ ID NO: 8513570 - DNA, 22 bp, Homo sapiens
catcatttcacttagatgaagt

SEQ ID NO: 8513571 - DNA, 22 bp, Homo sapiens
catcattgaacacttcttcctg

SEQ ID NO: 8513572 - DNA, 22 bp, Homo sapiens
aggagtggtgcaggacctgcca

SEQ ID NO: 8513573 - DNA, 22 bp, Homo sapiens
aggagtgggggcgagaagttaa

SEQ ID NO: 8513574 - DNA, 22 bp, Homo sapiens
aggagtgtggccagggctctgg

SEQ ID NO: 8513575 - DNA, 22 bp, Homo sapiens
aggagtggtgcaggacctgcca

SEQ ID NO: 8513576 - DNA, 22 bp, Homo sapiens
aggagtggtgcaggacctgcca

SEQ ID NO: 8513577 - DNA, 22 bp, Homo sapiens
aggaggttgccagtctgggggt

SEQ ID NO: 8513578 - DNA, 22 bp, Homo sapiens
aggagtggaattactgggttct

SEQ ID NO: 8513579 - DNA, 22 bp, Homo sapiens
aggagtggaattactgggttct

SEQ ID NO: 8513580 - DNA, 22 bp, Homo sapiens
catcattttattaaccaagaaa

SEQ ID NO: 8513581 - DNA, 22 bp, Homo sapiens
catcattttgtatccaagggga

SEQ ID NO: 8513582 - DNA, 22 bp, Homo sapiens
catcatttttgtaagctggtag

SEQ ID NO: 8513583 - DNA, 22 bp, Homo sapiens
cagtggaagactcagctctccc

SEQ ID NO: 8513584 - DNA, 22 bp, Homo sapiens
aggagctggcctagaaaggaga

SEQ ID NO: 8513585 - DNA, 22 bp, Homo sapiens
aggagctggcctagaaaggaga

SEQ ID NO: 8513586 - DNA, 22 bp, Homo sapiens
aggagctgatagtctatggaga

SEQ ID NO: 8513587 - DNA, 22 bp, Homo sapiens
aggagctggccactaggatgca

SEQ ID NO: 8513588 - DNA, 22 bp, Homo sapiens
aggagctgggcccaaggatgct

SEQ ID NO: 8513589 - DNA, 22 bp, Homo sapiens
aggagctgggagaaggactaaa

SEQ ID NO: 8513590 - DNA, 22 bp, Homo sapiens
aggagctgggagaaggactaaa

SEQ ID NO: 8513591 - DNA, 22 bp, Homo sapiens
aggagctgggagaaggactaaa

SEQ ID NO: 8513592 - DNA, 22 bp, Homo sapiens
aggagctgggagaaggactaaa

SEQ ID NO: 8513593 - DNA, 22 bp, Homo sapiens
aggagctgggctgctgctggga

SEQ ID NO: 8513594 - DNA, 22 bp, Homo sapiens
aggagctgggctgctgctggga

SEQ ID NO: 8513595 - DNA, 22 bp, Homo sapiens
aggagctgggctgctgctggga

SEQ ID NO: 8513596 - DNA, 22 bp, Homo sapiens
aggagctgggctgctgctggga

SEQ ID NO: 8513597 - DNA, 22 bp, Homo sapiens
aggagccaaattttagactctg

SEQ ID NO: 8513598 - DNA, 22 bp, Homo sapiens
aggagccaagatgctgtctggc

SEQ ID NO: 8513599 - DNA, 22 bp, Homo sapiens
aggagccaagatggggcaagta

SEQ ID NO: 8513600 - DNA, 22 bp, Homo sapiens
aggagccaagatggggcaagta

SEQ ID NO: 8513601 - DNA, 22 bp, Homo sapiens
aggagccaaggaaaacagtatt

SEQ ID NO: 8513602 - DNA, 22 bp, Homo sapiens
aggagccacctaggagctgttt

SEQ ID NO: 8513603 - DNA, 22 bp, Homo sapiens
aggagccaagcagaactaagga

SEQ ID NO: 8513604 - DNA, 22 bp, Homo sapiens
aggagccacctaggagctgttt

SEQ ID NO: 8513605 - DNA, 22 bp, Homo sapiens
cagtgcttttaaaacaacatca

SEQ ID NO: 8513606 - DNA, 22 bp, Homo sapiens
cagtgctttgggaggctgagga

SEQ ID NO: 8513607 - DNA, 22 bp, Homo sapiens
aggagccaaattactagctctg

SEQ ID NO: 8513608 - DNA, 22 bp, Homo sapiens
aggagccaaattttagactctg

SEQ ID NO: 8513609 - DNA, 22 bp, Homo sapiens
aggagccaaacatattgagaga

SEQ ID NO: 8513610 - DNA, 22 bp, Homo sapiens
aggagccaaacatattgagaga

SEQ ID NO: 8513611 - DNA, 22 bp, Homo sapiens
aggagccaaaagctgaacaaga

SEQ ID NO: 8513612 - DNA, 22 bp, Homo sapiens
aggagcagcttctgaaccatgt

SEQ ID NO: 8513613 - DNA, 22 bp, Homo sapiens
aggagcagcttctgaaccatgt

SEQ ID NO: 8513614 - DNA, 22 bp, Homo sapiens
aggagcagattggtaagatcat

SEQ ID NO: 8513615 - DNA, 22 bp, Homo sapiens
aggagcagattggtaagatcat

SEQ ID NO: 8513616 - DNA, 22 bp, Homo sapiens
aggagatggagctcagtgggca

SEQ ID NO: 8513617 - DNA, 22 bp, Homo sapiens
aggagcagcccactcctgtcct

SEQ ID NO: 8513618 - DNA, 22 bp, Homo sapiens
aggagcagcccactcctgtcct

SEQ ID NO: 8513619 - DNA, 22 bp, Homo sapiens
aggagcagcccactcctgtcct

SEQ ID NO: 8513620 - DNA, 22 bp, Homo sapiens
aggagcagcccactcctgtcct

SEQ ID NO: 8513621 - DNA, 22 bp, Homo sapiens
aggagcagcccactcctgtcct

SEQ ID NO: 8513622 - DNA, 22 bp, Homo sapiens
aggagcagcccactcctgtcct

SEQ ID NO: 8513623 - DNA, 22 bp, Homo sapiens
cagtgcagccaaggacaggcac

SEQ ID NO: 8513624 - DNA, 22 bp, Homo sapiens
cagtgcagccaaggacaggcac

SEQ ID NO: 8513625 - DNA, 22 bp, Homo sapiens
cagtgcaggaagtgagatgcct

SEQ ID NO: 8513626 - DNA, 22 bp, Homo sapiens
cagtgcaggaagtgagatgcct

SEQ ID NO: 8513627 - DNA, 22 bp, Homo sapiens
cagtgcaggaagtgagatgcct

SEQ ID NO: 8513628 - DNA, 23 bp, Homo sapiens
cagtgcagggcaactcagactcc

SEQ ID NO: 8513629 - DNA, 23 bp, Homo sapiens
cagtgcagggcaactcagactcc

SEQ ID NO: 8513630 - DNA, 22 bp, Homo sapiens
cagtgagggcattcagtgctgg

SEQ ID NO: 8513631 - DNA, 22 bp, Homo sapiens
cagtgagggcattcagtgctgg

SEQ ID NO: 8513632 - DNA, 17 bp, Homo sapiens
cagtgcagataagtgag

SEQ ID NO: 8513633 - DNA, 17 bp, Homo sapiens
cagtgaggcctttcctc

SEQ ID NO: 8513634 - DNA, 21 bp, Homo sapiens
cagtgaggccctcctgttccc

SEQ ID NO: 8513635 - DNA, 21 bp, Homo sapiens
cagtgaggccctcctgttccc

SEQ ID NO: 8513636 - DNA, 22 bp, Homo sapiens
cagtgaggctctgctgagcggt

SEQ ID NO: 8513637 - DNA, 22 bp, Homo sapiens
cagtgagggaagatctcagcac

SEQ ID NO: 8513638 - DNA, 22 bp, Homo sapiens
cagtgagggaagatctcagcac

SEQ ID NO: 8513639 - DNA, 22 bp, Homo sapiens
aggaattgagatcctaggtttt

SEQ ID NO: 8513640 - DNA, 22 bp, Homo sapiens
aggaattgagatcctaggtttt

SEQ ID NO: 8513641 - DNA, 22 bp, Homo sapiens
aggaattcctgggaaggcacag

SEQ ID NO: 8513642 - DNA, 22 bp, Homo sapiens
aggaattcaagaccagctgggc

SEQ ID NO: 8513643 - DNA, 22 bp, Homo sapiens
aggaattactcatctgtggtat

SEQ ID NO: 8513644 - DNA, 22 bp, Homo sapiens
aggaatttaagggctcagagag

SEQ ID NO: 8513645 - DNA, 19 bp, Homo sapiens
aggaatttctcagggaggc

SEQ ID NO: 8513646 - DNA, 22 bp, Homo sapiens
aggaatttgagtgctgtaggaa

SEQ ID NO: 8513647 - DNA, 22 bp, Homo sapiens
aggaatttgctggaacacagat

SEQ ID NO: 8513648 - DNA, 22 bp, Homo sapiens
aggaatttagacagggcataaa

SEQ ID NO: 8513649 - DNA, 22 bp, Homo sapiens
aggaattgtgttgtagtggaga

SEQ ID NO: 8513650 - DNA, 22 bp, Homo sapiens
aggaattggttcaaggtttatc

SEQ ID NO: 8513651 - DNA, 22 bp, Homo sapiens
aggaattggttcaaggtttatc

SEQ ID NO: 8513652 - DNA, 22 bp, Homo sapiens
aggaattttgtatggatactgt

SEQ ID NO: 8513653 - DNA, 22 bp, Homo sapiens
aggaatttggggttacatgatg

SEQ ID NO: 8513654 - DNA, 22 bp, Homo sapiens
aggaattttacaagctggttgc

SEQ ID NO: 8513655 - DNA, 22 bp, Homo sapiens
aggaattttacatctcagagag

SEQ ID NO: 8513656 - DNA, 22 bp, Homo sapiens
aggaattttcacagttgggtat

SEQ ID NO: 8513657 - DNA, 22 bp, Homo sapiens
aggaattttaatatgcttgtct

SEQ ID NO: 8513658 - DNA, 22 bp, Homo sapiens
aggaattttaatatgcttgtct

SEQ ID NO: 8513659 - DNA, 22 bp, Homo sapiens
aggaatttggaatttttcctgt

SEQ ID NO: 8513660 - DNA, 22 bp, Homo sapiens
cagtgaggatgataattaaggt

SEQ ID NO: 8513661 - DNA, 22 bp, Homo sapiens
aggacaaaggaccagatctgga

SEQ ID NO: 8513662 - DNA, 22 bp, Homo sapiens
aggacaagacaaggaccagaga

SEQ ID NO: 8513663 - DNA, 22 bp, Homo sapiens
aggaatttttctagccggagtt

SEQ ID NO: 8513664 - DNA, 22 bp, Homo sapiens
aggacaagacaaggaccagaga

SEQ ID NO: 8513665 - DNA, 22 bp, Homo sapiens
cagtctgaacactgggctactc

SEQ ID NO: 8513666 - DNA, 22 bp, Homo sapiens
cagtctgaacactgggctactc

SEQ ID NO: 8513667 - DNA, 22 bp, Homo sapiens
aggcagagctgggttttgaaat

SEQ ID NO: 8513668 - DNA, 22 bp, Homo sapiens
aggcagagctgggttttgaaat

SEQ ID NO: 8513669 - DNA, 22 bp, Homo sapiens
aggcagagctgggttttgaaat

SEQ ID NO: 8513670 - DNA, 22 bp, Homo sapiens
aggcagagctgggttttgaaat

SEQ ID NO: 8513671 - DNA, 22 bp, Homo sapiens
aggcagaggaagggtggatttg

SEQ ID NO: 8513672 - DNA, 22 bp, Homo sapiens
aggcagaggaagggtggatttg

SEQ ID NO: 8513673 - DNA, 22 bp, Homo sapiens
aggcagaggagaatgatcttcc

SEQ ID NO: 8513674 - DNA, 22 bp, Homo sapiens
aggcagaggagaatgatcttcc

SEQ ID NO: 8513675 - DNA, 22 bp, Homo sapiens
aggcagaggagaatgatcttcc

SEQ ID NO: 8513676 - DNA, 22 bp, Homo sapiens
aggcagaggaagggtggatttg

SEQ ID NO: 8513677 - DNA, 22 bp, Homo sapiens
aggcagaggagaatgatcttcc

SEQ ID NO: 8513678 - DNA, 22 bp, Homo sapiens
aggcagaggagaatgatcttcc

SEQ ID NO: 8513679 - DNA, 22 bp, Homo sapiens
aggcagagctaggaagaattgt

SEQ ID NO: 8513680 - DNA, 22 bp, Homo sapiens
aggcagagctaggaagaattgt

SEQ ID NO: 8513681 - DNA, 22 bp, Homo sapiens
aggcagagctgatgttctgtga

SEQ ID NO: 8513682 - DNA, 22 bp, Homo sapiens
aggcagagctgatgttctgtga

SEQ ID NO: 8513683 - DNA, 22 bp, Homo sapiens
aggcagagctgatgttctgtga

SEQ ID NO: 8513684 - DNA, 22 bp, Homo sapiens
aggcagagctgatgttctgtga

SEQ ID NO: 8513685 - DNA, 20 bp, Homo sapiens
aggcagagcgcacttttaga

SEQ ID NO: 8513686 - DNA, 20 bp, Homo sapiens
aggcagagcgcacttttaga

SEQ ID NO: 8513687 - DNA, 20 bp, Homo sapiens
aggcagagcgcacttttaga

SEQ ID NO: 8513688 - DNA, 23 bp, Homo sapiens
aggcagagccaaggtcaaaaccc

SEQ ID NO: 8513689 - DNA, 23 bp, Homo sapiens
aggcagagccaaggtcaaaaccc

SEQ ID NO: 8513690 - DNA, 23 bp, Homo sapiens
aggcagagccaaggtcaaaaccc

SEQ ID NO: 8513691 - DNA, 22 bp, Homo sapiens
aggcagcttaagccctggccca

SEQ ID NO: 8513692 - DNA, 22 bp, Homo sapiens
aggcagcttctgattagcagcg

SEQ ID NO: 8513693 - DNA, 22 bp, Homo sapiens
ccaaaataacagcccaattcac

SEQ ID NO: 8513694 - DNA, 19 bp, Homo sapiens
aggcagaggcttggctagc

SEQ ID NO: 8513695 - DNA, 19 bp, Homo sapiens
aggcagaggcttggctagc

SEQ ID NO: 8513696 - DNA, 22 bp, Homo sapiens
aggcagctggcagcacccaggg

SEQ ID NO: 8513697 - DNA, 22 bp, Homo sapiens
aggcagctgtgaggactggatt

SEQ ID NO: 8513698 - DNA, 20 bp, Homo sapiens
aggcagctggccaggcaggt

SEQ ID NO: 8513699 - DNA, 22 bp, Homo sapiens
aggcaggccctctggaaaggta

SEQ ID NO: 8513700 - DNA, 22 bp, Homo sapiens
aggcaggccctgggccatcccg

SEQ ID NO: 8513701 - DNA, 22 bp, Homo sapiens
aggcaggccctgggccatcccg

SEQ ID NO: 8513702 - DNA, 22 bp, Homo sapiens
aggcaggccctgggccatcccg

SEQ ID NO: 8513703 - DNA, 22 bp, Homo sapiens
aggcaggccgtgtccctcctca

SEQ ID NO: 8513704 - DNA, 22 bp, Homo sapiens
aggcaggcctacacaatgggag

SEQ ID NO: 8513705 - DNA, 22 bp, Homo sapiens
aggcaggcctacacaatgggag

SEQ ID NO: 8513706 - DNA, 22 bp, Homo sapiens
aggcaggctcaatgcccagtct

SEQ ID NO: 8513707 - DNA, 22 bp, Homo sapiens
aggcaggctagtcgcttgagcc

SEQ ID NO: 8513708 - DNA, 22 bp, Homo sapiens
aggcaggctctgggtatgtgca

SEQ ID NO: 8513709 - DNA, 22 bp, Homo sapiens
aggcaggctcaggcccatgctt

SEQ ID NO: 8513710 - DNA, 22 bp, Homo sapiens
aggcaggctcaggcccatgctt

SEQ ID NO: 8513711 - DNA, 22 bp, Homo sapiens
aggcaggctctgggtatgtgca

SEQ ID NO: 8513712 - DNA, 22 bp, Homo sapiens
aggcaggctctgggtatgtgca

SEQ ID NO: 8513713 - DNA, 22 bp, Homo sapiens
aggcaggcccctgagaatagac

SEQ ID NO: 8513714 - DNA, 21 bp, Homo sapiens
aggcaggattcaaacacagag

SEQ ID NO: 8513715 - DNA, 21 bp, Homo sapiens
aggcaggattcaaacacagag

SEQ ID NO: 8513716 - DNA, 23 bp, Homo sapiens
aggcaggcagttcagctgttgtt

SEQ ID NO: 8513717 - DNA, 23 bp, Homo sapiens
aggcaggcagttcagctgttgtt

SEQ ID NO: 8513718 - DNA, 18 bp, Homo sapiens
aggcaggatcctggcctc

SEQ ID NO: 8513719 - DNA, 21 bp, Homo sapiens
aggcaggattcaaacacagag

SEQ ID NO: 8513720 - DNA, 22 bp, Homo sapiens
ccaaagaaacccaagctcaggg

SEQ ID NO: 8513721 - DNA, 21 bp, Homo sapiens
ccaaagaactgccatttgtca

SEQ ID NO: 8513722 - DNA, 22 bp, Homo sapiens
ccaaacatttcaaatttagaga

SEQ ID NO: 8513723 - DNA, 22 bp, Homo sapiens
ccaaacaaatccccattcttag

SEQ ID NO: 8513724 - DNA, 22 bp, Homo sapiens
ccaaaattattacatttgtagg

SEQ ID NO: 8513725 - DNA, 22 bp, Homo sapiens
ccaaaattattacatttgtagg

SEQ ID NO: 8513726 - DNA, 22 bp, Homo sapiens
ccaaacaaatccccattcttag

SEQ ID NO: 8513727 - DNA, 22 bp, Homo sapiens
ccaaaccatccatctccaggct

SEQ ID NO: 8513728 - DNA, 22 bp, Homo sapiens
ccaaagaaacccaagctcaggg

SEQ ID NO: 8513729 - DNA, 22 bp, Homo sapiens
ccaaaattaagcctcttatgtt

SEQ ID NO: 8513730 - DNA, 22 bp, Homo sapiens
ccaaaattaagcctcttatgtt

SEQ ID NO: 8513731 - DNA, 22 bp, Homo sapiens
ccaaaattaagcctcttatgtt

SEQ ID NO: 8513732 - DNA, 22 bp, Homo sapiens
ccaaaatgtttgaatgcatgtg

SEQ ID NO: 8513733 - DNA, 22 bp, Homo sapiens
ccaaaatgtttgaatgcatgtg

SEQ ID NO: 8513734 - DNA, 22 bp, Homo sapiens
ccaaaatattagtgcttaagta

SEQ ID NO: 8513735 - DNA, 22 bp, Homo sapiens
ccaaaataacagcccaattcac

SEQ ID NO: 8513736 - DNA, 16 bp, Homo sapiens
aggcagagatttaccc

SEQ ID NO: 8513737 - DNA, 22 bp, Homo sapiens
aggcagagagcagtggccgtct

SEQ ID NO: 8513738 - DNA, 16 bp, Homo sapiens
aggcagagatttaccc

SEQ ID NO: 8513739 - DNA, 22 bp, Homo sapiens
aggcagagagcagtggccgtct

SEQ ID NO: 8513740 - DNA, 22 bp, Homo sapiens
aggcagagagcagtggccgtct

SEQ ID NO: 8513741 - DNA, 22 bp, Homo sapiens
aggcagagagcagtggccgtct

SEQ ID NO: 8513742 - DNA, 22 bp, Homo sapiens
aggcactgattctcagagttac

SEQ ID NO: 8513743 - DNA, 22 bp, Homo sapiens
aggcactttaggatcaggttga

SEQ ID NO: 8513744 - DNA, 22 bp, Homo sapiens
aggcactttccttgaggagttt

SEQ ID NO: 8513745 - DNA, 22 bp, Homo sapiens
aggcactgactcaagggagcca

SEQ ID NO: 8513746 - DNA, 22 bp, Homo sapiens
aggcactgactcaagggagcca

SEQ ID NO: 8513747 - DNA, 22 bp, Homo sapiens
aggcactgacaattctggactg

SEQ ID NO: 8513748 - DNA, 22 bp, Homo sapiens
aggcactgacagattctgtgtc

SEQ ID NO: 8513749 - DNA, 22 bp, Homo sapiens
aggcactgaagaactctttttg

SEQ ID NO: 8513750 - DNA, 20 bp, Homo sapiens
aggcacagttcctagttggg

SEQ ID NO: 8513751 - DNA, 22 bp, Homo sapiens
aggcactgaagtggtaaatgta

SEQ ID NO: 8513752 - DNA, 19 bp, Homo sapiens
aggcacaggttgtctggac

SEQ ID NO: 8513753 - DNA, 19 bp, Homo sapiens
aggcacaggttgtctggac

SEQ ID NO: 8513754 - DNA, 19 bp, Homo sapiens
aggcacaggttgtctggac

SEQ ID NO: 8513755 - DNA, 22 bp, Homo sapiens
aggcacagtgcctggaatcaaa

SEQ ID NO: 8513756 - DNA, 22 bp, Homo sapiens
aggcacagtgcctggaatcaaa

SEQ ID NO: 8513757 - DNA, 22 bp, Homo sapiens
aggatacatgttttttatcaat

SEQ ID NO: 8513758 - DNA, 22 bp, Homo sapiens
aggatacacggggatttatgta

SEQ ID NO: 8513759 - DNA, 22 bp, Homo sapiens
aggatacaagtctcagaatgct

SEQ ID NO: 8513760 - DNA, 22 bp, Homo sapiens
aggatagaagccccatgttctt

SEQ ID NO: 8513761 - DNA, 23 bp, Homo sapiens
aggatatgacttgtctgccaacc

SEQ ID NO: 8513762 - DNA, 21 bp, Homo sapiens
aggatattaggtgatttgggt

SEQ ID NO: 8513763 - DNA, 22 bp, Homo sapiens
aggatcagggtggtggaagtca

SEQ ID NO: 8513764 - DNA, 22 bp, Homo sapiens
aggatcagtgaatactcagggt

SEQ ID NO: 8513765 - DNA, 22 bp, Homo sapiens
aggatcatgtggtcattcctga

SEQ ID NO: 8513766 - DNA, 22 bp, Homo sapiens
aggatcctccttagaaaagacc

SEQ ID NO: 8513767 - DNA, 22 bp, Homo sapiens
aggatcagtgaatactcagggt

SEQ ID NO: 8513768 - DNA, 22 bp, Homo sapiens
aggatcatataagctccagcta

SEQ ID NO: 8513769 - DNA, 22 bp, Homo sapiens
aggatcatgtggtcattcctga

SEQ ID NO: 8513770 - DNA, 22 bp, Homo sapiens
aggatcatataagctccagcta

SEQ ID NO: 8513771 - DNA, 22 bp, Homo sapiens
aggataaaggtcattattccca

SEQ ID NO: 8513772 - DNA, 22 bp, Homo sapiens
aggataaattctccaaagtgtg

SEQ ID NO: 8513773 - DNA, 22 bp, Homo sapiens
aggagtttcaaagcttccatgt

SEQ ID NO: 8513774 - DNA, 22 bp, Homo sapiens
aggagtgttgcttcagggaagc

SEQ ID NO: 8513775 - DNA, 22 bp, Homo sapiens
aggagtgttgagttgggttttg

SEQ ID NO: 8513776 - DNA, 22 bp, Homo sapiens
aggagttatggcagaatcaaat

SEQ ID NO: 8513777 - DNA, 21 bp, Homo sapiens
aggagttgctgtggcctggtt

SEQ ID NO: 8513778 - DNA, 22 bp, Homo sapiens
aggcacaggtggacttcacagt

SEQ ID NO: 8513779 - DNA, 22 bp, Homo sapiens
catgtgtggtctgtggctatct

SEQ ID NO: 8513780 - DNA, 22 bp, Homo sapiens
catgtgtgggacccttaggttg

SEQ ID NO: 8513781 - DNA, 22 bp, Homo sapiens
catgtgtggtctgtggctatct

SEQ ID NO: 8513782 - DNA, 22 bp, Homo sapiens
aggcacagggatgcggagccag

SEQ ID NO: 8513783 - DNA, 22 bp, Homo sapiens
aggcacagggatgcggagccag

SEQ ID NO: 8513784 - DNA, 22 bp, Homo sapiens
catgtgtggtctgtggctatct

SEQ ID NO: 8513785 - DNA, 22 bp, Homo sapiens
catgtgtggagggcatgcatgg

SEQ ID NO: 8513786 - DNA, 22 bp, Homo sapiens
catgtgtgagtgagcagtcttc

SEQ ID NO: 8513787 - DNA, 23 bp, Homo sapiens
catgtgtgacagtatcactgttt

SEQ ID NO: 8513788 - DNA, 22 bp, Homo sapiens
catgtgtgagtatatcttatcc

SEQ ID NO: 8513789 - DNA, 23 bp, Homo sapiens
catgtgtgacagtatcactgttt

SEQ ID NO: 8513790 - DNA, 22 bp, Homo sapiens
catgtgtgacaaactgcctgca

SEQ ID NO: 8513791 - DNA, 23 bp, Homo sapiens
catgtgtgacagtatcactgttt

SEQ ID NO: 8513792 - DNA, 22 bp, Homo sapiens
catgtgtgaatcttgtgatcat

SEQ ID NO: 8513793 - DNA, 22 bp, Homo sapiens
catgtgtgacaaactgcctgca

SEQ ID NO: 8513794 - DNA, 22 bp, Homo sapiens
catgtccttctcattgcctcat

SEQ ID NO: 8513795 - DNA, 22 bp, Homo sapiens
aggatgagaagattggaatctt

SEQ ID NO: 8513796 - DNA, 22 bp, Homo sapiens
aggatgactggaacccaagtga

SEQ ID NO: 8513797 - DNA, 22 bp, Homo sapiens
catgtgtgaatcttgtgatcat

SEQ ID NO: 8513798 - DNA, 22 bp, Homo sapiens
catgtgtgaatcttgtgatcat

SEQ ID NO: 8513799 - DNA, 22 bp, Homo sapiens
catgtgtgaagactgcgggcca

SEQ ID NO: 8513800 - DNA, 22 bp, Homo sapiens
catgtgtctttatggagccaca

SEQ ID NO: 8513801 - DNA, 22 bp, Homo sapiens
ccctcagctcaagcccctgtgc

SEQ ID NO: 8513802 - DNA, 22 bp, Homo sapiens
ccctcagctcaagcccctgtgc

SEQ ID NO: 8513803 - DNA, 22 bp, Homo sapiens
ccctcagctccaccctcagcag

SEQ ID NO: 8513804 - DNA, 22 bp, Homo sapiens
ccctccatgagtgtgctgctgg

SEQ ID NO: 8513805 - DNA, 22 bp, Homo sapiens
ccctcagctccaccctcagcag

SEQ ID NO: 8513806 - DNA, 22 bp, Homo sapiens
ccctccattaaaacagacctat

SEQ ID NO: 8513807 - DNA, 22 bp, Homo sapiens
ccctcccaagcactctgacata

SEQ ID NO: 8513808 - DNA, 22 bp, Homo sapiens
ccctcccaagcactctgacata

SEQ ID NO: 8513809 - DNA, 22 bp, Homo sapiens
ccctcccaagcactctgacata

SEQ ID NO: 8513810 - DNA, 20 bp, Homo sapiens
ccctcccagatgcttcccaa

SEQ ID NO: 8513811 - DNA, 20 bp, Homo sapiens
ccctcccagatgcttcccaa

SEQ ID NO: 8513812 - DNA, 20 bp, Homo sapiens
ccctcccagatgcttcccaa

SEQ ID NO: 8513813 - DNA, 20 bp, Homo sapiens
ccctcccagatgcttcccaa

SEQ ID NO: 8513814 - DNA, 22 bp, Homo sapiens
ccctgatggcacagtggcaggc

SEQ ID NO: 8513815 - DNA, 22 bp, Homo sapiens
ccctcccaggagtggccagaga

SEQ ID NO: 8513816 - DNA, 22 bp, Homo sapiens
ccctcccaggagtggccagaga

SEQ ID NO: 8513817 - DNA, 22 bp, Homo sapiens
ccctgcacactcgtgtcttgac

SEQ ID NO: 8513818 - DNA, 22 bp, Homo sapiens
ccctgatgttttctctgccttt

SEQ ID NO: 8513819 - DNA, 22 bp, Homo sapiens
ccctcccagatgggcttgaggt

SEQ ID NO: 8513820 - DNA, 22 bp, Homo sapiens
ccctcccaggagtggccagaga

SEQ ID NO: 8513821 - DNA, 22 bp, Homo sapiens
ccctcccagatgggcttgaggt

SEQ ID NO: 8513822 - DNA, 22 bp, Homo sapiens
ccctcccagatgggcttgaggt

SEQ ID NO: 8513823 - DNA, 22 bp, Homo sapiens
ccctcccagatgggcttgaggt

SEQ ID NO: 8513824 - DNA, 22 bp, Homo sapiens
ccctcccagatgggcttgaggt

SEQ ID NO: 8513825 - DNA, 22 bp, Homo sapiens
ccctcccagatgggcttgaggt

SEQ ID NO: 8513826 - DNA, 18 bp, Homo sapiens
ccctgccagctcccagca

SEQ ID NO: 8513827 - DNA, 17 bp, Homo sapiens
ccctgccaccaggaagc

SEQ ID NO: 8513828 - DNA, 22 bp, Homo sapiens
ccctgccagatgtgcttcagtt

SEQ ID NO: 8513829 - DNA, 22 bp, Homo sapiens
ccctgccaatcccgtctctctg

SEQ ID NO: 8513830 - DNA, 22 bp, Homo sapiens
ccctgccaatcccgtctctctg

SEQ ID NO: 8513831 - DNA, 22 bp, Homo sapiens
ccctgcagtgtgacctcaccta

SEQ ID NO: 8513832 - DNA, 23 bp, Homo sapiens
ccctgcatctgtccctcaccagt

SEQ ID NO: 8513833 - DNA, 23 bp, Homo sapiens
ccctgcccattgagcaggacgtc

SEQ ID NO: 8513834 - DNA, 22 bp, Homo sapiens
ccctgccccaggcggcttcact

SEQ ID NO: 8513835 - DNA, 22 bp, Homo sapiens
ccctgcccaccacatgctggga

SEQ ID NO: 8513836 - DNA, 22 bp, Homo sapiens
ccctgcccatcggggcggcctg

SEQ ID NO: 8513837 - DNA, 22 bp, Homo sapiens
ccctgccctggagacacttaaa

SEQ ID NO: 8513838 - DNA, 22 bp, Homo sapiens
ccctgccctgggcagaagtggg

SEQ ID NO: 8513839 - DNA, 22 bp, Homo sapiens
ccctgctgtcaggtgctgggag

SEQ ID NO: 8513840 - DNA, 22 bp, Homo sapiens
ccctgctgtcaggtgctgggag

SEQ ID NO: 8513841 - DNA, 22 bp, Homo sapiens
ccctcactgtccttgggccctt

SEQ ID NO: 8513842 - DNA, 22 bp, Homo sapiens
ccctcactctgcctcctggggt

SEQ ID NO: 8513843 - DNA, 22 bp, Homo sapiens
ccctcaccaggctccaggcatg

SEQ ID NO: 8513844 - DNA, 22 bp, Homo sapiens
ccctcaccaggctccaggcatg

SEQ ID NO: 8513845 - DNA, 22 bp, Homo sapiens
ccctcacagtctaggagcagct

SEQ ID NO: 8513846 - DNA, 22 bp, Homo sapiens
ccctcacagtctaggagcagct

SEQ ID NO: 8513847 - DNA, 22 bp, Homo sapiens
ccctagggctaagcaggactgc

SEQ ID NO: 8513848 - DNA, 22 bp, Homo sapiens
ccctagggtttggccagagccc

SEQ ID NO: 8513849 - DNA, 22 bp, Homo sapiens
ccccttccaggaagcagaatcg

SEQ ID NO: 8513850 - DNA, 22 bp, Homo sapiens
ccccttccaggaagcagaatcg

SEQ ID NO: 8513851 - DNA, 22 bp, Homo sapiens
ccctaggctgaggccagggtgc

SEQ ID NO: 8513852 - DNA, 22 bp, Homo sapiens
ccccttccacagtgcttcctaa

SEQ ID NO: 8513853 - DNA, 22 bp, Homo sapiens
ccccttccacagtgcttcctaa

SEQ ID NO: 8513854 - DNA, 22 bp, Homo sapiens
ccccagcacaggctcctcagat

SEQ ID NO: 8513855 - DNA, 22 bp, Homo sapiens
ccccagcactctgactcttacc

SEQ ID NO: 8513856 - DNA, 21 bp, Homo sapiens
ccccagcaccttgccagcctg

SEQ ID NO: 8513857 - DNA, 22 bp, Homo sapiens
ccccagcactaccagaagccag

SEQ ID NO: 8513858 - DNA, 22 bp, Homo sapiens
cccatgcaccctctaagaagga

SEQ ID NO: 8513859 - DNA, 22 bp, Homo sapiens
cccatgagtgctgctcagaggc

SEQ ID NO: 8513860 - DNA, 22 bp, Homo sapiens
cccatgagtgctgctcagaggc

SEQ ID NO: 8513861 - DNA, 22 bp, Homo sapiens
cccatgcaccctctaagaagga

SEQ ID NO: 8513862 - DNA, 22 bp, Homo sapiens
cccatgcaccctctaagaagga

SEQ ID NO: 8513863 - DNA, 22 bp, Homo sapiens
cccatgagattctgaatttggc

SEQ ID NO: 8513864 - DNA, 22 bp, Homo sapiens
cccatggcagtcagagataaga

SEQ ID NO: 8513865 - DNA, 22 bp, Homo sapiens
cccatgctgtgcctagagagca

SEQ ID NO: 8513866 - DNA, 22 bp, Homo sapiens
cccatggagtgcctgagggcca

SEQ ID NO: 8513867 - DNA, 22 bp, Homo sapiens
cccattcatcctcgcttccttc

SEQ ID NO: 8513868 - DNA, 22 bp, Homo sapiens
cccattcatcctcgcttccttc

SEQ ID NO: 8513869 - DNA, 22 bp, Homo sapiens
ccccagaaggggacagagggta

SEQ ID NO: 8513870 - DNA, 22 bp, Homo sapiens
ccccagaaggggacagagggta

SEQ ID NO: 8513871 - DNA, 22 bp, Homo sapiens
ccccagagaaagtcagcagcat

SEQ ID NO: 8513872 - DNA, 22 bp, Homo sapiens
ccccagaagtttgcacaagaga

SEQ ID NO: 8513873 - DNA, 22 bp, Homo sapiens
ccccagaagtttgcacaagaga

SEQ ID NO: 8513874 - DNA, 22 bp, Homo sapiens
ccccagagagcaccatgaagcc

SEQ ID NO: 8513875 - DNA, 22 bp, Homo sapiens
cccagtacctctgttccctgct

SEQ ID NO: 8513876 - DNA, 22 bp, Homo sapiens
cccagtacctctgttccctgct

SEQ ID NO: 8513877 - DNA, 22 bp, Homo sapiens
cccaggcttttctcttgcccca

SEQ ID NO: 8513878 - DNA, 22 bp, Homo sapiens
cccaggcttttaagttagacag

SEQ ID NO: 8513879 - DNA, 22 bp, Homo sapiens
cccaggcttttctcttgcccca

SEQ ID NO: 8513880 - DNA, 22 bp, Homo sapiens
cccatgaactgtcttgctgtag

SEQ ID NO: 8513881 - DNA, 22 bp, Homo sapiens
cccatctcagtcgtgctaaggg

SEQ ID NO: 8513882 - DNA, 22 bp, Homo sapiens
cccatcaggaacccaggagccc

SEQ ID NO: 8513883 - DNA, 22 bp, Homo sapiens
cccatcacagacactgggttat

SEQ ID NO: 8513884 - DNA, 22 bp, Homo sapiens
cccaggcttttaagttagacag

SEQ ID NO: 8513885 - DNA, 18 bp, Homo sapiens
cccaggctttgtgggtct

SEQ ID NO: 8513886 - DNA, 18 bp, Homo sapiens
cccaggctttgtgggtct

SEQ ID NO: 8513887 - DNA, 22 bp, Homo sapiens
cccaggcttcccaatcagaagg

SEQ ID NO: 8513888 - DNA, 22 bp, Homo sapiens
cccaggctgtgcaaacttcaaa

SEQ ID NO: 8513889 - DNA, 22 bp, Homo sapiens
cccaggctggaattccaggcct

SEQ ID NO: 8513890 - DNA, 22 bp, Homo sapiens
cccaggctggaattccaggcct

SEQ ID NO: 8513891 - DNA, 22 bp, Homo sapiens
cccaggctggaattccaggcct

SEQ ID NO: 8513892 - DNA, 22 bp, Homo sapiens
cccaggctgcgtatccacaata

SEQ ID NO: 8513893 - DNA, 22 bp, Homo sapiens
cccaggctgtctgtcctttgct

SEQ ID NO: 8513894 - DNA, 22 bp, Homo sapiens
cccaggaggtcgaagctgcagt

SEQ ID NO: 8513895 - DNA, 22 bp, Homo sapiens
cccaggaggtcgaagctgcagt

SEQ ID NO: 8513896 - DNA, 22 bp, Homo sapiens
cccaggaggtcgaagctgcagt

SEQ ID NO: 8513897 - DNA, 23 bp, Homo sapiens
cccaggctacaaattatgctctg

SEQ ID NO: 8513898 - DNA, 22 bp, Homo sapiens
cccaggaggtggagcttgcagt

SEQ ID NO: 8513899 - DNA, 22 bp, Homo sapiens
cccaggaggtcaaggctgcagt

SEQ ID NO: 8513900 - DNA, 22 bp, Homo sapiens
cccaggaggtcaaggctgcagt

SEQ ID NO: 8513901 - DNA, 22 bp, Homo sapiens
cccaggaggtcaaggctgcagt

SEQ ID NO: 8513902 - DNA, 22 bp, Homo sapiens
cccaggaggtcgaagctgcagt

SEQ ID NO: 8513903 - DNA, 22 bp, Homo sapiens
cccaggaggtcgaagctgcagt

SEQ ID NO: 8513904 - DNA, 22 bp, Homo sapiens
cccaggctgatgttcagcgggt

SEQ ID NO: 8513905 - DNA, 22 bp, Homo sapiens
cccaggctgatgttcagcgggt

SEQ ID NO: 8513906 - DNA, 22 bp, Homo sapiens
cccaggctgatgttcagcgggt

SEQ ID NO: 8513907 - DNA, 22 bp, Homo sapiens
cccaggctgatgggatgggcca

SEQ ID NO: 8513908 - DNA, 22 bp, Homo sapiens
cccaggctgatgggatgggcca

SEQ ID NO: 8513909 - DNA, 22 bp, Homo sapiens
cccaggctgatgggatgggcca

SEQ ID NO: 8513910 - DNA, 22 bp, Homo sapiens
cccaggctgcatgagtccatgg

SEQ ID NO: 8513911 - DNA, 22 bp, Homo sapiens
cccaggctgatgttcagcgggt

SEQ ID NO: 8513912 - DNA, 22 bp, Homo sapiens
cccaggctgccacgattactgc

SEQ ID NO: 8513913 - DNA, 22 bp, Homo sapiens
cccaggctgccacgattactgc

SEQ ID NO: 8513914 - DNA, 22 bp, Homo sapiens
cccaggctgcgtatccacaata

SEQ ID NO: 8513915 - DNA, 19 bp, Homo sapiens
cccaggagcagtattgatg

SEQ ID NO: 8513916 - DNA, 23 bp, Homo sapiens
cccaggagcctgagtcctctctg

SEQ ID NO: 8513917 - DNA, 22 bp, Homo sapiens
cccaggagatggaggttgcagt

SEQ ID NO: 8513918 - DNA, 22 bp, Homo sapiens
cccaggagatggtgcgtggtct

SEQ ID NO: 8513919 - DNA, 22 bp, Homo sapiens
cccaggagatgcactccattgg

SEQ ID NO: 8513920 - DNA, 22 bp, Homo sapiens
cccaggagatggaggttgcagt

SEQ ID NO: 8513921 - DNA, 22 bp, Homo sapiens
cccaggagatggaggttgcagt

SEQ ID NO: 8513922 - DNA, 22 bp, Homo sapiens
cccaggagatctggatctcgtc

SEQ ID NO: 8513923 - DNA, 22 bp, Homo sapiens
cccaggagggtggcctctgccc

SEQ ID NO: 8513924 - DNA, 22 bp, Homo sapiens
cccaggaggtagaggttgcagt

SEQ ID NO: 8513925 - DNA, 22 bp, Homo sapiens
cccaggagcttctctctgcctc

SEQ ID NO: 8513926 - DNA, 22 bp, Homo sapiens
cccaggagggtggcctctgccc

SEQ ID NO: 8513927 - DNA, 22 bp, Homo sapiens
cccaggaggtagaggttgcagt

SEQ ID NO: 8513928 - DNA, 22 bp, Homo sapiens
cccaggaggtagaggttgcagt

SEQ ID NO: 8513929 - DNA, 22 bp, Homo sapiens
cccaggaggtcaaggctgcagt

SEQ ID NO: 8513930 - DNA, 23 bp, Homo sapiens
cccaggagcctgagtcctctctg

SEQ ID NO: 8513931 - DNA, 23 bp, Homo sapiens
cccaggagcctgagtcctctctg

SEQ ID NO: 8513932 - DNA, 23 bp, Homo sapiens
cccaggagcctgagtcctctctg

SEQ ID NO: 8513933 - DNA, 20 bp, Homo sapiens
cccaggagctgtgccccatc

SEQ ID NO: 8513934 - DNA, 20 bp, Homo sapiens
cccaggagctgtgccccatc

SEQ ID NO: 8513935 - DNA, 22 bp, Homo sapiens
cccaggagcttctctctgcctc

SEQ ID NO: 8513936 - DNA, 21 bp, Homo sapiens
aggctgtcctttgccagccct

SEQ ID NO: 8513937 - DNA, 22 bp, Homo sapiens
aggctgtctgaccccagagccc

SEQ ID NO: 8513938 - DNA, 22 bp, Homo sapiens
aggctgtctcacctcaggaggg

SEQ ID NO: 8513939 - DNA, 22 bp, Homo sapiens
aggctgtgacagggtcatggag

SEQ ID NO: 8513940 - DNA, 22 bp, Homo sapiens
cccaggaatgaggggcggaggc

SEQ ID NO: 8513941 - DNA, 22 bp, Homo sapiens
aggctgtgaaatgtggcaagga

SEQ ID NO: 8513942 - DNA, 22 bp, Homo sapiens
aggctgtgaaggttaaagacga

SEQ ID NO: 8513943 - DNA, 22 bp, Homo sapiens
aggctgtgaactctatgctgaa

SEQ ID NO: 8513944 - DNA, 22 bp, Homo sapiens
aggctgtgaactctatgctgaa

SEQ ID NO: 8513945 - DNA, 22 bp, Homo sapiens
aggctggtctatacggagacga

SEQ ID NO: 8513946 - DNA, 22 bp, Homo sapiens
aggctggtctatacggagacga

SEQ ID NO: 8513947 - DNA, 22 bp, Homo sapiens
aggctggtctgttggcattttt

SEQ ID NO: 8513948 - DNA, 22 bp, Homo sapiens
aggctggtgattagaagcagcc

SEQ ID NO: 8513949 - DNA, 22 bp, Homo sapiens
aggctggtgattagaagcagcc

SEQ ID NO: 8513950 - DNA, 22 bp, Homo sapiens
aggctggtgattagaagcagcc

SEQ ID NO: 8513951 - DNA, 22 bp, Homo sapiens
aggctgtagatctagacatgta

SEQ ID NO: 8513952 - DNA, 22 bp, Homo sapiens
aggctgtcatctttgcaggcag

SEQ ID NO: 8513953 - DNA, 22 bp, Homo sapiens
aggctgtagtgcatgtgctatg

SEQ ID NO: 8513954 - DNA, 22 bp, Homo sapiens
aggctggtgtgtcctgaagcct

SEQ ID NO: 8513955 - DNA, 22 bp, Homo sapiens
aggctggtgtctctgtcctgtc

SEQ ID NO: 8513956 - DNA, 22 bp, Homo sapiens
aggctggtgtgtcctgaagcct

SEQ ID NO: 8513957 - DNA, 22 bp, Homo sapiens
aggctggtgcttcctagggcag

SEQ ID NO: 8513958 - DNA, 22 bp, Homo sapiens
aggctggtgcctgcagtgaatc

SEQ ID NO: 8513959 - DNA, 22 bp, Homo sapiens
aggctggtgcctgcagtgaatc

SEQ ID NO: 8513960 - DNA, 22 bp, Homo sapiens
aggctggtgcttcctagggcag

SEQ ID NO: 8513961 - DNA, 22 bp, Homo sapiens
aggctggtgcttcctagggcag

SEQ ID NO: 8513962 - DNA, 22 bp, Homo sapiens
cctgaacagtctgaaaggagac

SEQ ID NO: 8513963 - DNA, 22 bp, Homo sapiens
cctgaactctaaatagagcagt

SEQ ID NO: 8513964 - DNA, 22 bp, Homo sapiens
cctgaaatttgaagacctgaat

SEQ ID NO: 8513965 - DNA, 22 bp, Homo sapiens
cctgaacaaatggcatagccaa

SEQ ID NO: 8513966 - DNA, 22 bp, Homo sapiens
cctgaacaaatggcatagccaa

SEQ ID NO: 8513967 - DNA, 22 bp, Homo sapiens
cctgaaatgagttctgctcact

SEQ ID NO: 8513968 - DNA, 21 bp, Homo sapiens
cctgaaattctcactagctta

SEQ ID NO: 8513969 - DNA, 22 bp, Homo sapiens
cctgaaacatcttctgtaaata

SEQ ID NO: 8513970 - DNA, 22 bp, Homo sapiens
cctgaaatccatagtttacact

SEQ ID NO: 8513971 - DNA, 22 bp, Homo sapiens
cctgaaatgactccagctgagt

SEQ ID NO: 8513972 - DNA, 20 bp, Homo sapiens
cctgaagagtttctctttct

SEQ ID NO: 8513973 - DNA, 22 bp, Homo sapiens
cctgaagatccattatagacac

SEQ ID NO: 8513974 - DNA, 22 bp, Homo sapiens
cctgaagatgctgtggcctggt

SEQ ID NO: 8513975 - DNA, 22 bp, Homo sapiens
cctgaagatccattatagacac

SEQ ID NO: 8513976 - DNA, 22 bp, Homo sapiens
cctgaagatgagggacagctaa

SEQ ID NO: 8513977 - DNA, 22 bp, Homo sapiens
cctgaagatgagggacagctaa

SEQ ID NO: 8513978 - DNA, 22 bp, Homo sapiens
cctgaagaattcaaatccagat

SEQ ID NO: 8513979 - DNA, 22 bp, Homo sapiens
cctgaagagcactctagagttg

SEQ ID NO: 8513980 - DNA, 22 bp, Homo sapiens
cctgaagagtgaatgtggcagt

SEQ ID NO: 8513981 - DNA, 22 bp, Homo sapiens
cctgaagagcactctagagttg

SEQ ID NO: 8513982 - DNA, 22 bp, Homo sapiens
cctgaagagcactctagagttg

SEQ ID NO: 8513983 - DNA, 22 bp, Homo sapiens
cctgagagggggccctagaaat

SEQ ID NO: 8513984 - DNA, 22 bp, Homo sapiens
cctgagagtaggtgtctcttta

SEQ ID NO: 8513985 - DNA, 22 bp, Homo sapiens
cctgagaggccctctcactgtc

SEQ ID NO: 8513986 - DNA, 22 bp, Homo sapiens
cctgagaggccctctcactgtc

SEQ ID NO: 8513987 - DNA, 22 bp, Homo sapiens
cctgagaggccctctcactgtc

SEQ ID NO: 8513988 - DNA, 22 bp, Homo sapiens
cctgagagcattccacactgaa

SEQ ID NO: 8513989 - DNA, 22 bp, Homo sapiens
cctgagagcattccacactgaa

SEQ ID NO: 8513990 - DNA, 22 bp, Homo sapiens
cctgagagagtgagccctgaca

SEQ ID NO: 8513991 - DNA, 22 bp, Homo sapiens
cctgagagcagcttcctgctta

SEQ ID NO: 8513992 - DNA, 22 bp, Homo sapiens
cctgagagcagcttcctgctta

SEQ ID NO: 8513993 - DNA, 22 bp, Homo sapiens
cctgaagatgctgtggcctggt

SEQ ID NO: 8513994 - DNA, 22 bp, Homo sapiens
cctgagagtgagtgccacctta

SEQ ID NO: 8513995 - DNA, 22 bp, Homo sapiens
cctgagagtgagggcctcctta

SEQ ID NO: 8513996 - DNA, 22 bp, Homo sapiens
cctgagagtaggtgtctcttta

SEQ ID NO: 8513997 - DNA, 22 bp, Homo sapiens
agggtagctacccaactccaga

SEQ ID NO: 8513998 - DNA, 22 bp, Homo sapiens
aggggtgaaggcccgataggag

SEQ ID NO: 8513999 - DNA, 22 bp, Homo sapiens
cctgagagtgagtgcctcctta

SEQ ID NO: 8514000 - DNA, 22 bp, Homo sapiens
agggtaggaactgagtggaagg

SEQ ID NO: 8514001 - DNA, 22 bp, Homo sapiens
agggtagggcccggagacagac

SEQ ID NO: 8514002 - DNA, 22 bp, Homo sapiens
agggtaggaactgagtggaagg

SEQ ID NO: 8514003 - DNA, 22 bp, Homo sapiens
agggtagggcccggagacagac

SEQ ID NO: 8514004 - DNA, 22 bp, Homo sapiens
agggtagggcccggagacagac

SEQ ID NO: 8514005 - DNA, 22 bp, Homo sapiens
agggtagggccgtagggccatg

SEQ ID NO: 8514006 - DNA, 22 bp, Homo sapiens
agggtaggtgtaagatagccct

SEQ ID NO: 8514007 - DNA, 22 bp, Homo sapiens
agggtagggtaaatgatgcatc

SEQ ID NO: 8514008 - DNA, 22 bp, Homo sapiens
agggtagggtaaatgatgcatc

SEQ ID NO: 8514009 - DNA, 22 bp, Homo sapiens
agggtagggtaaatgatgcatc

SEQ ID NO: 8514010 - DNA, 22 bp, Homo sapiens
agggtagggccgtagggccatg

SEQ ID NO: 8514011 - DNA, 22 bp, Homo sapiens
agggtatgtttttatctactgt

SEQ ID NO: 8514012 - DNA, 22 bp, Homo sapiens
agggtcaaatgggcaggaagag

SEQ ID NO: 8514013 - DNA, 22 bp, Homo sapiens
agggtcaacattctaaaatctg

SEQ ID NO: 8514014 - DNA, 22 bp, Homo sapiens
agggtcaacactttaaacatat

SEQ ID NO: 8514015 - DNA, 22 bp, Homo sapiens
agggtcacctgcttgccagggc

SEQ ID NO: 8514016 - DNA, 22 bp, Homo sapiens
agggtcaccagttcataggcac

SEQ ID NO: 8514017 - DNA, 22 bp, Homo sapiens
cctgaggtctagagtcagggtg

SEQ ID NO: 8514018 - DNA, 22 bp, Homo sapiens
aggggagcaacatagtcactct

SEQ ID NO: 8514019 - DNA, 22 bp, Homo sapiens
aggggagcaacatagtcactct

SEQ ID NO: 8514020 - DNA, 22 bp, Homo sapiens
aggggagagttaatgtgaatgt

SEQ ID NO: 8514021 - DNA, 22 bp, Homo sapiens
aggggagcaacatagtcactct

SEQ ID NO: 8514022 - DNA, 22 bp, Homo sapiens
aggggagagttaatgtgaatgt

SEQ ID NO: 8514023 - DNA, 22 bp, Homo sapiens
agggctggctccgttaccttga

SEQ ID NO: 8514024 - DNA, 22 bp, Homo sapiens
agggctggctaggtgcgttccc

SEQ ID NO: 8514025 - DNA, 22 bp, Homo sapiens
agggctggctaggtgcgttccc

SEQ ID NO: 8514026 - DNA, 22 bp, Homo sapiens
agggctggctaggtgcgttccc

SEQ ID NO: 8514027 - DNA, 22 bp, Homo sapiens
agggctggccacatgatttggt

SEQ ID NO: 8514028 - DNA, 22 bp, Homo sapiens
agggctggccacatgatttggt

SEQ ID NO: 8514029 - DNA, 22 bp, Homo sapiens
agggctggcatctctaatgctg

SEQ ID NO: 8514030 - DNA, 22 bp, Homo sapiens
agggctggcatctctaatgctg

SEQ ID NO: 8514031 - DNA, 22 bp, Homo sapiens
agggctggcatctctaatgctg

SEQ ID NO: 8514032 - DNA, 22 bp, Homo sapiens
aggggaggcagcgataaacctg

SEQ ID NO: 8514033 - DNA, 22 bp, Homo sapiens
aggggaggcagcgataaacctg

SEQ ID NO: 8514034 - DNA, 22 bp, Homo sapiens
aggggaggcagcgataaacctg

SEQ ID NO: 8514035 - DNA, 22 bp, Homo sapiens
aggggaggagcttttcttgcct

SEQ ID NO: 8514036 - DNA, 22 bp, Homo sapiens
aggggaggagcttttcttgcct

SEQ ID NO: 8514037 - DNA, 22 bp, Homo sapiens
aggggaggtgtccccaaatctc

SEQ ID NO: 8514038 - DNA, 22 bp, Homo sapiens
aggggaggtgtccccaaatctc

SEQ ID NO: 8514039 - DNA, 22 bp, Homo sapiens
aggggatgcctagtggagtctc

SEQ ID NO: 8514040 - DNA, 22 bp, Homo sapiens
aggggatgatcctcccgcagcg

SEQ ID NO: 8514041 - DNA, 22 bp, Homo sapiens
aggggatgcctgaggatctgta

SEQ ID NO: 8514042 - DNA, 22 bp, Homo sapiens
aggggatggagctggaaggcag

SEQ ID NO: 8514043 - DNA, 19 bp, Homo sapiens
aggggcactgtctctagag

SEQ ID NO: 8514044 - DNA, 22 bp, Homo sapiens
aggggcactagaatgggagact

SEQ ID NO: 8514045 - DNA, 22 bp, Homo sapiens
aggggcactagaatgggagact

SEQ ID NO: 8514046 - DNA, 22 bp, Homo sapiens
aggggcaaatgtgagcctggaa

SEQ ID NO: 8514047 - DNA, 22 bp, Homo sapiens
aggggatggagctggaaggcag

SEQ ID NO: 8514048 - DNA, 23 bp, Homo sapiens
aggggcagcaagttttggtgtta

SEQ ID NO: 8514049 - DNA, 23 bp, Homo sapiens
aggggcagcaagttttggtgtta

SEQ ID NO: 8514050 - DNA, 19 bp, Homo sapiens
aggggcactgtctctagag

SEQ ID NO: 8514051 - DNA, 22 bp, Homo sapiens
aggggcacttctcaggctgtgg

SEQ ID NO: 8514052 - DNA, 23 bp, Homo sapiens
aggggcagcaagttttggtgtta

SEQ ID NO: 8514053 - DNA, 22 bp, Homo sapiens
aggggcacttctcaggctgtgg

SEQ ID NO: 8514054 - DNA, 22 bp, Homo sapiens
cctcttcaggcactcgaaggcc

SEQ ID NO: 8514055 - DNA, 22 bp, Homo sapiens
aggggcagcctcacaatcctct

SEQ ID NO: 8514056 - DNA, 22 bp, Homo sapiens
cctgaaacagtccttgccctca

SEQ ID NO: 8514057 - DNA, 22 bp, Homo sapiens
cctcttcatcctggaagctgct

SEQ ID NO: 8514058 - DNA, 22 bp, Homo sapiens
cctcttcatcctggaagctgct

SEQ ID NO: 8514059 - DNA, 22 bp, Homo sapiens
cctcttccactgggccccatcc

SEQ ID NO: 8514060 - DNA, 22 bp, Homo sapiens
agggctggagccacagctggga

SEQ ID NO: 8514061 - DNA, 22 bp, Homo sapiens
agggctggagccacagctggga

SEQ ID NO: 8514062 - DNA, 22 bp, Homo sapiens
agggctggagccacagctggga

SEQ ID NO: 8514063 - DNA, 22 bp, Homo sapiens
agggctggagccacagctggga

SEQ ID NO: 8514064 - DNA, 22 bp, Homo sapiens
agggctggagggtactagttta

SEQ ID NO: 8514065 - DNA, 22 bp, Homo sapiens
agggctggcaagggattgaaat

SEQ ID NO: 8514066 - DNA, 22 bp, Homo sapiens
agggctggcaagggattgaaat

SEQ ID NO: 8514067 - DNA, 22 bp, Homo sapiens
agggctgctgaggaagccttgc

SEQ ID NO: 8514068 - DNA, 22 bp, Homo sapiens
agggctgcatctgcctggtgaa

SEQ ID NO: 8514069 - DNA, 22 bp, Homo sapiens
agggctgcatctgcctggtgaa

SEQ ID NO: 8514070 - DNA, 22 bp, Homo sapiens
agggctagagttgagatgggga

SEQ ID NO: 8514071 - DNA, 22 bp, Homo sapiens
agggctagagttgagatgggga

SEQ ID NO: 8514072 - DNA, 22 bp, Homo sapiens
agggctggagccacagctggga

SEQ ID NO: 8514073 - DNA, 22 bp, Homo sapiens
agggctggagccacagctggga

SEQ ID NO: 8514074 - DNA, 22 bp, Homo sapiens
agggctggagccacagctggga

SEQ ID NO: 8514075 - DNA, 22 bp, Homo sapiens
cctcaggccagggggcggccag

SEQ ID NO: 8514076 - DNA, 20 bp, Homo sapiens
cctcaggccagttttaaagt

SEQ ID NO: 8514077 - DNA, 22 bp, Homo sapiens
cctcaggccagggggcggccag

SEQ ID NO: 8514078 - DNA, 22 bp, Homo sapiens
cctcaggccagggggcggccag

SEQ ID NO: 8514079 - DNA, 22 bp, Homo sapiens
cctcaggcagtggtatggatgg

SEQ ID NO: 8514080 - DNA, 22 bp, Homo sapiens
cctcaggccctgtccctgcgcc

SEQ ID NO: 8514081 - DNA, 22 bp, Homo sapiens
cctcaggccctgtccctgcgcc

SEQ ID NO: 8514082 - DNA, 22 bp, Homo sapiens
cctcaggccctgtccctgcgcc

SEQ ID NO: 8514083 - DNA, 22 bp, Homo sapiens
cctcaggcaagtcacttaacat

SEQ ID NO: 8514084 - DNA, 22 bp, Homo sapiens
cctcaggcaagtcacttaacat

SEQ ID NO: 8514085 - DNA, 20 bp, Homo sapiens
cctcaggatgagggtgagca

SEQ ID NO: 8514086 - DNA, 22 bp, Homo sapiens
cctcaggcaggaaactgtcccg

SEQ ID NO: 8514087 - DNA, 22 bp, Homo sapiens
cctcaggcaggaaactgtcccg

SEQ ID NO: 8514088 - DNA, 22 bp, Homo sapiens
cctcaggatacaggagccacag

SEQ ID NO: 8514089 - DNA, 22 bp, Homo sapiens
cctcaggatccgcaggtgcagt

SEQ ID NO: 8514090 - DNA, 20 bp, Homo sapiens
cctcaggatgagggtgagca

SEQ ID NO: 8514091 - DNA, 22 bp, Homo sapiens
agggcgggctcatcacatgctc

SEQ ID NO: 8514092 - DNA, 22 bp, Homo sapiens
agggcgggctcatcacatgctc

SEQ ID NO: 8514093 - DNA, 19 bp, Homo sapiens
agggcggggcccaggcaca

SEQ ID NO: 8514094 - DNA, 19 bp, Homo sapiens
agggcgtggtggcacatgt

SEQ ID NO: 8514095 - DNA, 22 bp, Homo sapiens
agggcgtggtggtgctggagca

SEQ ID NO: 8514096 - DNA, 22 bp, Homo sapiens
agggcgacaatggagagcgttt

SEQ ID NO: 8514097 - DNA, 22 bp, Homo sapiens
agggcgaggagacggaggcaca

SEQ ID NO: 8514098 - DNA, 22 bp, Homo sapiens
agggcgaggagacggaggcaca

SEQ ID NO: 8514099 - DNA, 22 bp, Homo sapiens
agggcgaggagacggaggcaca

SEQ ID NO: 8514100 - DNA, 22 bp, Homo sapiens
ccctgctttgcacccaggctgg

SEQ ID NO: 8514101 - DNA, 22 bp, Homo sapiens
agggcctgagctggctgacctc

SEQ ID NO: 8514102 - DNA, 22 bp, Homo sapiens
agggcctgagctggctgacctc

SEQ ID NO: 8514103 - DNA, 22 bp, Homo sapiens
agggcctgaggctgacggggag

SEQ ID NO: 8514104 - DNA, 23 bp, Homo sapiens
agggcctgatggctcccgctggc

SEQ ID NO: 8514105 - DNA, 22 bp, Homo sapiens
agggcctgcatcaggagcttgg

SEQ ID NO: 8514106 - DNA, 19 bp, Homo sapiens
agggcctgcagctcaagct

SEQ ID NO: 8514107 - DNA, 19 bp, Homo sapiens
agggcctgcagctcaagct

SEQ ID NO: 8514108 - DNA, 20 bp, Homo sapiens
agggcctggagtacagcagg

SEQ ID NO: 8514109 - DNA, 20 bp, Homo sapiens
agggcctggagtacagcagg

SEQ ID NO: 8514110 - DNA, 22 bp, Homo sapiens
agggcctggcgcgtggccgccg

SEQ ID NO: 8514111 - DNA, 22 bp, Homo sapiens
agggcctggcgcgtggccgccg

SEQ ID NO: 8514112 - DNA, 22 bp, Homo sapiens
cctcagcttgatttctgcagag

SEQ ID NO: 8514113 - DNA, 20 bp, Homo sapiens
agggcctgctctgtggtgtc

SEQ ID NO: 8514114 - DNA, 22 bp, Homo sapiens
agggcctgctctatcactctca

SEQ ID NO: 8514115 - DNA, 22 bp, Homo sapiens
agggcctggaactgtgggcagg

SEQ ID NO: 8514116 - DNA, 22 bp, Homo sapiens
agggcctggaactggagaccac

SEQ ID NO: 8514117 - DNA, 22 bp, Homo sapiens
agggcctggaactggagaccac

SEQ ID NO: 8514118 - DNA, 22 bp, Homo sapiens
ccagggctggtgggagatgctg

SEQ ID NO: 8514119 - DNA, 22 bp, Homo sapiens
ccagggctggtgggagatgctg

SEQ ID NO: 8514120 - DNA, 22 bp, Homo sapiens
ccagggctggtgggagatgctg

SEQ ID NO: 8514121 - DNA, 22 bp, Homo sapiens
aggctgaggatcgtactttcca

SEQ ID NO: 8514122 - DNA, 22 bp, Homo sapiens
aggctgaggatccctgtgttct

SEQ ID NO: 8514123 - DNA, 22 bp, Homo sapiens
aggctgaggatccctgtgttct

SEQ ID NO: 8514124 - DNA, 22 bp, Homo sapiens
ccagggctggtggctgcagagg

SEQ ID NO: 8514125 - DNA, 22 bp, Homo sapiens
ccagggctggtgggagatgctg

SEQ ID NO: 8514126 - DNA, 22 bp, Homo sapiens
ccagggctggtggctgcagagg

SEQ ID NO: 8514127 - DNA, 22 bp, Homo sapiens
ccagggctgggtttgtcggtgt

SEQ ID NO: 8514128 - DNA, 22 bp, Homo sapiens
aggctgaggatcgtactttcca

SEQ ID NO: 8514129 - DNA, 22 bp, Homo sapiens
aggctgaggatcgtactttcca

SEQ ID NO: 8514130 - DNA, 22 bp, Homo sapiens
aggctgaggcaagaggatcact

SEQ ID NO: 8514131 - DNA, 22 bp, Homo sapiens
aggctgaggcaagaggatcact

SEQ ID NO: 8514132 - DNA, 22 bp, Homo sapiens
ccaggtctggaaccaccagggc

SEQ ID NO: 8514133 - DNA, 22 bp, Homo sapiens
ccaggtctggaaccaccagggc

SEQ ID NO: 8514134 - DNA, 22 bp, Homo sapiens
aggctgaggcaggtggatcacc

SEQ ID NO: 8514135 - DNA, 22 bp, Homo sapiens
aggctgaggcaggtggatcacc

SEQ ID NO: 8514136 - DNA, 22 bp, Homo sapiens
aggctgaggcaggtggatcacc

SEQ ID NO: 8514137 - DNA, 22 bp, Homo sapiens
ccagggctcaggctcccagtgg

SEQ ID NO: 8514138 - DNA, 22 bp, Homo sapiens
ccagggctccattgctcatcct

SEQ ID NO: 8514139 - DNA, 20 bp, Homo sapiens
ccagggctggctcctgggat

SEQ ID NO: 8514140 - DNA, 20 bp, Homo sapiens
ccagggctggctcctgggat

SEQ ID NO: 8514141 - DNA, 20 bp, Homo sapiens
ccagggctggctcctgggat

SEQ ID NO: 8514142 - DNA, 20 bp, Homo sapiens
ccagggctggctcctgggat

SEQ ID NO: 8514143 - DNA, 20 bp, Homo sapiens
ccagggctggctcctgggat

SEQ ID NO: 8514144 - DNA, 22 bp, Homo sapiens
ccaggctgtaaacaccttcaaa

SEQ ID NO: 8514145 - DNA, 22 bp, Homo sapiens
ccagggcagcgcccctccacgc

SEQ ID NO: 8514146 - DNA, 22 bp, Homo sapiens
ccagggcagcgcccctccacgc

SEQ ID NO: 8514147 - DNA, 22 bp, Homo sapiens
ccagggcaggagaaagactcac

SEQ ID NO: 8514148 - DNA, 22 bp, Homo sapiens
ccagggcctcgtgttctgagtg

SEQ ID NO: 8514149 - DNA, 22 bp, Homo sapiens
ccagggcctcgtgttctgagtg

SEQ ID NO: 8514150 - DNA, 22 bp, Homo sapiens
ccagggcctgccacttagcaag

SEQ ID NO: 8514151 - DNA, 22 bp, Homo sapiens
ccagggcctgccacttagcaag

SEQ ID NO: 8514152 - DNA, 23 bp, Homo sapiens
ccagggctacgggcaccgtcctg

SEQ ID NO: 8514153 - DNA, 22 bp, Homo sapiens
ccaggctggtctgaatttctag

SEQ ID NO: 8514154 - DNA, 22 bp, Homo sapiens
ccaggctggtctgaatttctag

SEQ ID NO: 8514155 - DNA, 15 bp, Homo sapiens
ccaggctgggtgagc

SEQ ID NO: 8514156 - DNA, 22 bp, Homo sapiens
ccaggctgggctacaagttgag

SEQ ID NO: 8514157 - DNA, 22 bp, Homo sapiens
ccaggctgggctacaagttgag

SEQ ID NO: 8514158 - DNA, 22 bp, Homo sapiens
ccaggctgggctacaagttgag

SEQ ID NO: 8514159 - DNA, 22 bp, Homo sapiens
ccaggctgggcggggaacctgg

SEQ ID NO: 8514160 - DNA, 22 bp, Homo sapiens
ccaggctgggctacaagttgag

SEQ ID NO: 8514161 - DNA, 21 bp, Homo sapiens
ccaggctgggagggcagttcc

SEQ ID NO: 8514162 - DNA, 22 bp, Homo sapiens
ccaggctgggcggggaacctgg

SEQ ID NO: 8514163 - DNA, 21 bp, Homo sapiens
ccaggctgggagggcagttcc

SEQ ID NO: 8514164 - DNA, 22 bp, Homo sapiens
ccaggctggaatcaatattctg

SEQ ID NO: 8514165 - DNA, 22 bp, Homo sapiens
ccaggctgctttattactctgt

SEQ ID NO: 8514166 - DNA, 22 bp, Homo sapiens
ccaggctgctttattactctgt

SEQ ID NO: 8514167 - DNA, 22 bp, Homo sapiens
ccaggctgcttagccttatctt

SEQ ID NO: 8514168 - DNA, 22 bp, Homo sapiens
ccaggctgcttagccttatctt

SEQ ID NO: 8514169 - DNA, 22 bp, Homo sapiens
ccaggctgcttagccttatctt

SEQ ID NO: 8514170 - DNA, 22 bp, Homo sapiens
ccaggctggagtatagtggcgc

SEQ ID NO: 8514171 - DNA, 22 bp, Homo sapiens
ccaggctggaatcaatattctg

SEQ ID NO: 8514172 - DNA, 22 bp, Homo sapiens
ccaggctggagtatagtggcgc

SEQ ID NO: 8514173 - DNA, 22 bp, Homo sapiens
ccaggctggagtatagtggcgc

SEQ ID NO: 8514174 - DNA, 22 bp, Homo sapiens
ccaggctggagtatagtggcgc

SEQ ID NO: 8514175 - DNA, 22 bp, Homo sapiens
ccaggctggagtatagtggcgc

SEQ ID NO: 8514176 - DNA, 19 bp, Homo sapiens
aggctaaagagtcttgcgt

SEQ ID NO: 8514177 - DNA, 22 bp, Homo sapiens
aggctaagatgtggtctgagca

SEQ ID NO: 8514178 - DNA, 22 bp, Homo sapiens
aggcgtgggaggatctgaggcc

SEQ ID NO: 8514179 - DNA, 22 bp, Homo sapiens
aggctaaaagagaatcatttag

SEQ ID NO: 8514180 - DNA, 22 bp, Homo sapiens
aggcgtggttgaggcgagcata

SEQ ID NO: 8514181 - DNA, 22 bp, Homo sapiens
aggcgtggttgaggcgagcata

SEQ ID NO: 8514182 - DNA, 22 bp, Homo sapiens
aggctaagatgtggtctgagca

SEQ ID NO: 8514183 - DNA, 22 bp, Homo sapiens
aggctaaggagtgtgatgctca

SEQ ID NO: 8514184 - DNA, 22 bp, Homo sapiens
aggctaagggatgactggagtg

SEQ ID NO: 8514185 - DNA, 22 bp, Homo sapiens
aggctaaggtgggaggatcgct

SEQ ID NO: 8514186 - DNA, 22 bp, Homo sapiens
aggctaagtgggtgtcagggcc

SEQ ID NO: 8514187 - DNA, 22 bp, Homo sapiens
aggctaatatttatgaaaccaa

SEQ ID NO: 8514188 - DNA, 22 bp, Homo sapiens
aggctaatatggcacatgaaca

SEQ ID NO: 8514189 - DNA, 22 bp, Homo sapiens
aggctacagcctcaagagtgca

SEQ ID NO: 8514190 - DNA, 22 bp, Homo sapiens
aggctacttctagagggacaat

SEQ ID NO: 8514191 - DNA, 22 bp, Homo sapiens
aggctagactttggcgaagcac

SEQ ID NO: 8514192 - DNA, 22 bp, Homo sapiens
ccaggctgctgttggtgtccgc

SEQ ID NO: 8514193 - DNA, 22 bp, Homo sapiens
ccaggctgctgttggtgtccgc

SEQ ID NO: 8514194 - DNA, 22 bp, Homo sapiens
ccaggctgctgttggtgtccgc

SEQ ID NO: 8514195 - DNA, 22 bp, Homo sapiens
ccaggctgctgttggtgtccgc

SEQ ID NO: 8514196 - DNA, 22 bp, Homo sapiens
ccaggctctgcgctggacatgg

SEQ ID NO: 8514197 - DNA, 22 bp, Homo sapiens
aggctagaggcttctggcttca

SEQ ID NO: 8514198 - DNA, 22 bp, Homo sapiens
ccaggctctgcgctggacatgg

SEQ ID NO: 8514199 - DNA, 17 bp, Homo sapiens
aggctggccttcacagt

SEQ ID NO: 8514200 - DNA, 22 bp, Homo sapiens
aggctggccctactggctgcct

SEQ ID NO: 8514201 - DNA, 22 bp, Homo sapiens
aggctggccctactggctgcct

SEQ ID NO: 8514202 - DNA, 22 bp, Homo sapiens
aggctggccctactggctgcct

SEQ ID NO: 8514203 - DNA, 22 bp, Homo sapiens
aggctggccctactggctgcct

SEQ ID NO: 8514204 - DNA, 22 bp, Homo sapiens
aggctggccctactggctgcct

SEQ ID NO: 8514205 - DNA, 22 bp, Homo sapiens
aggctggccctactggctgcct

SEQ ID NO: 8514206 - DNA, 22 bp, Homo sapiens
aggctggcgacatctggcgggc

SEQ ID NO: 8514207 - DNA, 22 bp, Homo sapiens
aggctggcgacatctggcgggc

SEQ ID NO: 8514208 - DNA, 22 bp, Homo sapiens
aggctggcggtgactgctctga

SEQ ID NO: 8514209 - DNA, 22 bp, Homo sapiens
aggctggcgacatctggcgggc

SEQ ID NO: 8514210 - DNA, 22 bp, Homo sapiens
aggctggcgacatctggcgggc

SEQ ID NO: 8514211 - DNA, 22 bp, Homo sapiens
aggctggcgacatctggcgggc

SEQ ID NO: 8514212 - DNA, 22 bp, Homo sapiens
ccatttcattgcctgtaaagtg

SEQ ID NO: 8514213 - DNA, 18 bp, Homo sapiens
ccatttcatgattattac

SEQ ID NO: 8514214 - DNA, 22 bp, Homo sapiens
aggctggcggtgactgctctga

SEQ ID NO: 8514215 - DNA, 22 bp, Homo sapiens
aggctggcggtgactgctctga

SEQ ID NO: 8514216 - DNA, 22 bp, Homo sapiens
aggctgggaaggtaaagttgta

SEQ ID NO: 8514217 - DNA, 22 bp, Homo sapiens
aggctgggcaccgttttgatcc

SEQ ID NO: 8514218 - DNA, 22 bp, Homo sapiens
aggctgggcaccgttttgatcc

SEQ ID NO: 8514219 - DNA, 22 bp, Homo sapiens
aggctgggctccgcccaactcc

SEQ ID NO: 8514220 - DNA, 22 bp, Homo sapiens
aggctgggctccgcccaactcc

SEQ ID NO: 8514221 - DNA, 22 bp, Homo sapiens
aggctgggctccgcccaactcc

SEQ ID NO: 8514222 - DNA, 20 bp, Homo sapiens
aggctggggtgttttgccca

SEQ ID NO: 8514223 - DNA, 22 bp, Homo sapiens
aggctggggaattgaatttgct

SEQ ID NO: 8514224 - DNA, 22 bp, Homo sapiens
aggctggggaattgaatttgct

SEQ ID NO: 8514225 - DNA, 22 bp, Homo sapiens
aggctgggtacctgtcatatgc

SEQ ID NO: 8514226 - DNA, 22 bp, Homo sapiens
aggctgggtacctgtcatatgc

SEQ ID NO: 8514227 - DNA, 20 bp, Homo sapiens
aggctggggtgttttgccca

SEQ ID NO: 8514228 - DNA, 22 bp, Homo sapiens
aggctgggtacctgtcatatgc

SEQ ID NO: 8514229 - DNA, 20 bp, Homo sapiens
aggctggggtgttttgccca

SEQ ID NO: 8514230 - DNA, 22 bp, Homo sapiens
ccatttgtggtttatttgctct

SEQ ID NO: 8514231 - DNA, 22 bp, Homo sapiens
ccatttgtggtttatttgctct

SEQ ID NO: 8514232 - DNA, 22 bp, Homo sapiens
ccatttgtattactgccccagg

SEQ ID NO: 8514233 - DNA, 22 bp, Homo sapiens
ccatttgttttcgctaccatgg

SEQ ID NO: 8514234 - DNA, 22 bp, Homo sapiens
aggctggctggcaggggacaca

SEQ ID NO: 8514235 - DNA, 22 bp, Homo sapiens
aggctggctggcaggggacaca

SEQ ID NO: 8514236 - DNA, 22 bp, Homo sapiens
aggctggctggcaggggacaca

SEQ ID NO: 8514237 - DNA, 22 bp, Homo sapiens
aggctgggaaggtaaagttgta

SEQ ID NO: 8514238 - DNA, 22 bp, Homo sapiens
aggctgggaaggtaaagttgta

SEQ ID NO: 8514239 - DNA, 22 bp, Homo sapiens
aggctggagtgctggagtgctg

SEQ ID NO: 8514240 - DNA, 22 bp, Homo sapiens
aggctggagtgcagtggtgtga

SEQ ID NO: 8514241 - DNA, 22 bp, Homo sapiens
aggctggagtgcagttgcatga

SEQ ID NO: 8514242 - DNA, 22 bp, Homo sapiens
aggctggagtgtagcagtgcag

SEQ ID NO: 8514243 - DNA, 22 bp, Homo sapiens
aggctggagtgctggagtgctg

SEQ ID NO: 8514244 - DNA, 22 bp, Homo sapiens
aggctggagtgcaatggcgtga

SEQ ID NO: 8514245 - DNA, 22 bp, Homo sapiens
aggctggagtacagtggctatt

SEQ ID NO: 8514246 - DNA, 22 bp, Homo sapiens
aggctggagtacagtggctatt

SEQ ID NO: 8514247 - DNA, 22 bp, Homo sapiens
aggctggagtacagtggctatt

SEQ ID NO: 8514248 - DNA, 22 bp, Homo sapiens
aggctggagtgcaatggcgtga

SEQ ID NO: 8514249 - DNA, 22 bp, Homo sapiens
aggctggagtgcagtggcgtga

SEQ ID NO: 8514250 - DNA, 22 bp, Homo sapiens
aggctggccagtgctgcagtgg

SEQ ID NO: 8514251 - DNA, 22 bp, Homo sapiens
aggctggccagtgctgcagtgg

SEQ ID NO: 8514252 - DNA, 22 bp, Homo sapiens
aggctggagtgtagcagtgcag

SEQ ID NO: 8514253 - DNA, 22 bp, Homo sapiens
aggctggagtgtgcagtggcgc

SEQ ID NO: 8514254 - DNA, 22 bp, Homo sapiens
aggctggagcaagggggcatat

SEQ ID NO: 8514255 - DNA, 22 bp, Homo sapiens
aggctggagggcaatggcaaga

SEQ ID NO: 8514256 - DNA, 22 bp, Homo sapiens
aggctggaggtttgttgcggct

SEQ ID NO: 8514257 - DNA, 22 bp, Homo sapiens
aggctggagtacagtggctatt

SEQ ID NO: 8514258 - DNA, 22 bp, Homo sapiens
aggctggagcaagggggcatat

SEQ ID NO: 8514259 - DNA, 22 bp, Homo sapiens
aggctggagcaagggggcatat

SEQ ID NO: 8514260 - DNA, 22 bp, Homo sapiens
aggctggagcaagggggcatat

SEQ ID NO: 8514261 - DNA, 22 bp, Homo sapiens
aggctggagagtgcagtggcgt

SEQ ID NO: 8514262 - DNA, 22 bp, Homo sapiens
aggctggagagtgcagtggcgt

SEQ ID NO: 8514263 - DNA, 22 bp, Homo sapiens
aggctggagagtgcagtggcgt

SEQ ID NO: 8514264 - DNA, 22 bp, Homo sapiens
aggctggagacccgccaagaaa

SEQ ID NO: 8514265 - DNA, 22 bp, Homo sapiens
aggctggagagtgcagtggcgt

SEQ ID NO: 8514266 - DNA, 19 bp, Homo sapiens
aggctggagacaccaggcc

SEQ ID NO: 8514267 - DNA, 22 bp, Homo sapiens
aggctggagacccgccaagaaa

SEQ ID NO: 8514268 - DNA, 22 bp, Homo sapiens
aggctggagacccgccaagaaa

SEQ ID NO: 8514269 - DNA, 22 bp, Homo sapiens
aggctggagacccgccaagaaa

SEQ ID NO: 8514270 - DNA, 21 bp, Homo sapiens
ccaggtcttggtccttggact

SEQ ID NO: 8514271 - DNA, 22 bp, Homo sapiens
ccaggtctttgactaatatgct

SEQ ID NO: 8514272 - DNA, 22 bp, Homo sapiens
ccaggtctggaaccaccagggc

SEQ ID NO: 8514273 - DNA, 22 bp, Homo sapiens
ccaggtcttcactttactgaag

SEQ ID NO: 8514274 - DNA, 22 bp, Homo sapiens
ccaggtcttcactttactgaag

SEQ ID NO: 8514275 - DNA, 22 bp, Homo sapiens
ccaggtctgtcttcttagctca

SEQ ID NO: 8514276 - DNA, 22 bp, Homo sapiens
aggctgctctgcgaagtcagct

SEQ ID NO: 8514277 - DNA, 22 bp, Homo sapiens
aggctggacccgacacctgccc

SEQ ID NO: 8514278 - DNA, 19 bp, Homo sapiens
aggctggagacaccaggcc

SEQ ID NO: 8514279 - DNA, 22 bp, Homo sapiens
aggctggacccgacacctgccc

SEQ ID NO: 8514280 - DNA, 19 bp, Homo sapiens
aggctggagacaccaggcc

SEQ ID NO: 8514281 - DNA, 22 bp, Homo sapiens
aggctggaaatcactagattcc

SEQ ID NO: 8514282 - DNA, 22 bp, Homo sapiens
aggctggaaagggaccagagtg

SEQ ID NO: 8514283 - DNA, 22 bp, Homo sapiens
aggctggaaagggaccagagtg

SEQ ID NO: 8514284 - DNA, 22 bp, Homo sapiens
ccaggacaagccagagggacag

SEQ ID NO: 8514285 - DNA, 22 bp, Homo sapiens
ccaggacaagccagagggacag

SEQ ID NO: 8514286 - DNA, 22 bp, Homo sapiens
aggcctggtgtgccggatgcag

SEQ ID NO: 8514287 - DNA, 22 bp, Homo sapiens
ccaggaagtatgacccaacaga

SEQ ID NO: 8514288 - DNA, 22 bp, Homo sapiens
ccaggaaggtgtttaactagag

SEQ ID NO: 8514289 - DNA, 22 bp, Homo sapiens
aggcggctggtgtcctgcaggt

SEQ ID NO: 8514290 - DNA, 22 bp, Homo sapiens
aggcgtgggaggatctgaggcc

SEQ ID NO: 8514291 - DNA, 22 bp, Homo sapiens
aggcggtggccaaggagcggga

SEQ ID NO: 8514292 - DNA, 22 bp, Homo sapiens
aggcgggtaccctggctcgaaa

SEQ ID NO: 8514293 - DNA, 22 bp, Homo sapiens
aggcctggctttggtttgctga

SEQ ID NO: 8514294 - DNA, 22 bp, Homo sapiens
aggcctggcctttatgttcaag

SEQ ID NO: 8514295 - DNA, 22 bp, Homo sapiens
aggcctggcctgggcggcattg

SEQ ID NO: 8514296 - DNA, 22 bp, Homo sapiens
aggcctggcctgggcggcattg

SEQ ID NO: 8514297 - DNA, 22 bp, Homo sapiens
aggcctggcctttatgttcaag

SEQ ID NO: 8514298 - DNA, 22 bp, Homo sapiens
aggcctggccccagttgctagg

SEQ ID NO: 8514299 - DNA, 22 bp, Homo sapiens
aggcctggccccagttgctagg

SEQ ID NO: 8514300 - DNA, 22 bp, Homo sapiens
aggcctggcatgagacctgaga

SEQ ID NO: 8514301 - DNA, 22 bp, Homo sapiens
aggcctggcatgagacctgaga

SEQ ID NO: 8514302 - DNA, 22 bp, Homo sapiens
aggcctggcatgagacctgaga

SEQ ID NO: 8514303 - DNA, 22 bp, Homo sapiens
aggcctggccccagttgctagg

SEQ ID NO: 8514304 - DNA, 22 bp, Homo sapiens
ccaggaaggcaggcctccccgc

SEQ ID NO: 8514305 - DNA, 22 bp, Homo sapiens
ccaggaaggcctggatgccccc

SEQ ID NO: 8514306 - DNA, 22 bp, Homo sapiens
ccaggaaggtatgggaagaaaa

SEQ ID NO: 8514307 - DNA, 22 bp, Homo sapiens
ccaggaagggctctttaaagac

SEQ ID NO: 8514308 - DNA, 22 bp, Homo sapiens
ccaggaaggcgttgttcctctc

SEQ ID NO: 8514309 - DNA, 22 bp, Homo sapiens
aggcctgggacgggagccgtga

SEQ ID NO: 8514310 - DNA, 18 bp, Homo sapiens
aggcctgggaagctgagg

SEQ ID NO: 8514311 - DNA, 18 bp, Homo sapiens
aggcctgggaagctgagg

SEQ ID NO: 8514312 - DNA, 18 bp, Homo sapiens
aggcctgggaagctgagg

SEQ ID NO: 8514313 - DNA, 18 bp, Homo sapiens
aggcctgggaagctgagg

SEQ ID NO: 8514314 - DNA, 22 bp, Homo sapiens
ccagctggcccagctgtgctcc

SEQ ID NO: 8514315 - DNA, 22 bp, Homo sapiens
ccagctggcccagctgtgctcc

SEQ ID NO: 8514316 - DNA, 22 bp, Homo sapiens
aggcctctgggtctcctctgac

SEQ ID NO: 8514317 - DNA, 22 bp, Homo sapiens
aggcctgctgtcttgaggccaa

SEQ ID NO: 8514318 - DNA, 22 bp, Homo sapiens
ccagctggcactgtggctgccc

SEQ ID NO: 8514319 - DNA, 22 bp, Homo sapiens
ccagctggcactgtggctgccc

SEQ ID NO: 8514320 - DNA, 22 bp, Homo sapiens
ccagctggcactgtggctgccc

SEQ ID NO: 8514321 - DNA, 22 bp, Homo sapiens
ccagctggcactgtggctgccc

SEQ ID NO: 8514322 - DNA, 22 bp, Homo sapiens
ccagctggcaggagagtcaggg

SEQ ID NO: 8514323 - DNA, 22 bp, Homo sapiens
ccagctggcaggagagtcaggg

SEQ ID NO: 8514324 - DNA, 22 bp, Homo sapiens
ccagctggcaggagagtcaggg

SEQ ID NO: 8514325 - DNA, 22 bp, Homo sapiens
ccagctggcaggagagtcaggg

SEQ ID NO: 8514326 - DNA, 22 bp, Homo sapiens
ccagctggaaacaaatagagtg

SEQ ID NO: 8514327 - DNA, 22 bp, Homo sapiens
ccagctgagaagtgtaaagtga

SEQ ID NO: 8514328 - DNA, 22 bp, Homo sapiens
ccagctggaacggcagcccagc

SEQ ID NO: 8514329 - DNA, 22 bp, Homo sapiens
ccagctggaacggcagcccagc

SEQ ID NO: 8514330 - DNA, 22 bp, Homo sapiens
ccagctgacgatgcctggtctc

SEQ ID NO: 8514331 - DNA, 22 bp, Homo sapiens
ccagctcttttggctgagtgag

SEQ ID NO: 8514332 - DNA, 22 bp, Homo sapiens
ccagctcttttggctgagtgag

SEQ ID NO: 8514333 - DNA, 22 bp, Homo sapiens
ccagctggagctcgcagatagg

SEQ ID NO: 8514334 - DNA, 22 bp, Homo sapiens
ccagctggagctcgcagatagg

SEQ ID NO: 8514335 - DNA, 22 bp, Homo sapiens
ccagctggagccaaggtggact

SEQ ID NO: 8514336 - DNA, 22 bp, Homo sapiens
ccagctggagccaaggtggact

SEQ ID NO: 8514337 - DNA, 22 bp, Homo sapiens
ccagctggaagagtgcagaact

SEQ ID NO: 8514338 - DNA, 22 bp, Homo sapiens
ccagctggaagagtgcagaact

SEQ ID NO: 8514339 - DNA, 22 bp, Homo sapiens
ccagctggaagagtgcagaact

SEQ ID NO: 8514340 - DNA, 22 bp, Homo sapiens
ccagctggagccaaggtggact

SEQ ID NO: 8514341 - DNA, 22 bp, Homo sapiens
ccagctggagccaaggtggact

SEQ ID NO: 8514342 - DNA, 21 bp, Homo sapiens
ccagctctgcctccagttggt

SEQ ID NO: 8514343 - DNA, 21 bp, Homo sapiens
ccagctctgcctccagttggt

SEQ ID NO: 8514344 - DNA, 21 bp, Homo sapiens
ccagctctgcctccagttggt

SEQ ID NO: 8514345 - DNA, 23 bp, Homo sapiens
ccagctccgtgagcctcgggctc

SEQ ID NO: 8514346 - DNA, 22 bp, Homo sapiens
ccagcaggagactagcaacata

SEQ ID NO: 8514347 - DNA, 22 bp, Homo sapiens
ccagcaggagatgcctgtgtct

SEQ ID NO: 8514348 - DNA, 22 bp, Homo sapiens
ccagcaggagatgcctgtgtct

SEQ ID NO: 8514349 - DNA, 22 bp, Homo sapiens
ccagcaggagatgcctgtgtct

SEQ ID NO: 8514350 - DNA, 22 bp, Homo sapiens
ccagctcttggtgcacttacat

SEQ ID NO: 8514351 - DNA, 22 bp, Homo sapiens
ccagctctgtaagctgtgaaat

SEQ ID NO: 8514352 - DNA, 22 bp, Homo sapiens
ccagctctgtaagctgtgaaat

SEQ ID NO: 8514353 - DNA, 22 bp, Homo sapiens
ccagctctgtaagctgtgaaat

SEQ ID NO: 8514354 - DNA, 22 bp, Homo sapiens
ccagctctggcttcttgctggg

SEQ ID NO: 8514355 - DNA, 22 bp, Homo sapiens
ccagctctggcttcttgctggg

SEQ ID NO: 8514356 - DNA, 22 bp, Homo sapiens
ccagctcttttggctgagtgag

SEQ ID NO: 8514357 - DNA, 22 bp, Homo sapiens
ccagctcttttggctgagtgag

SEQ ID NO: 8514358 - DNA, 22 bp, Homo sapiens
ccagctcttggtgcacttacat

SEQ ID NO: 8514359 - DNA, 22 bp, Homo sapiens
ccagctcttggtgcacttacat

SEQ ID NO: 8514360 - DNA, 22 bp, Homo sapiens
ccagctcttggtgcacttacat

SEQ ID NO: 8514361 - DNA, 22 bp, Homo sapiens
ccagctcttggtgcacttacat

SEQ ID NO: 8514362 - DNA, 22 bp, Homo sapiens
ccagctcttttggctgagtgag

SEQ ID NO: 8514363 - DNA, 22 bp, Homo sapiens
ccagctctgcttgcccagtcag

SEQ ID NO: 8514364 - DNA, 22 bp, Homo sapiens
ccagctctgcttgcccagtcag

SEQ ID NO: 8514365 - DNA, 21 bp, Homo sapiens
ccagctctgcctccagttggt

SEQ ID NO: 8514366 - DNA, 22 bp, Homo sapiens
ccagctctggcttcttgctggg

SEQ ID NO: 8514367 - DNA, 22 bp, Homo sapiens
ccagctctggcttcttgctggg

SEQ ID NO: 8514368 - DNA, 22 bp, Homo sapiens
ccagctctggcttcttgctggg

SEQ ID NO: 8514369 - DNA, 22 bp, Homo sapiens
ccagctctgcttgcccagtcag

SEQ ID NO: 8514370 - DNA, 22 bp, Homo sapiens
ccagctctgcttgcccagtcag

SEQ ID NO: 8514371 - DNA, 22 bp, Homo sapiens
ccagaaagactttttaggtacg

SEQ ID NO: 8514372 - DNA, 22 bp, Homo sapiens
ccagaaagactttttaggtacg

SEQ ID NO: 8514373 - DNA, 22 bp, Homo sapiens
ccagaaagataggaaatcaagt

SEQ ID NO: 8514374 - DNA, 22 bp, Homo sapiens
ccagaaaatgcagaacatagaa

SEQ ID NO: 8514375 - DNA, 22 bp, Homo sapiens
ccagaaaatgcagaacatagaa

SEQ ID NO: 8514376 - DNA, 22 bp, Homo sapiens
ccagaaaatgcagaacatagaa

SEQ ID NO: 8514377 - DNA, 22 bp, Homo sapiens
ccagaaaatatggctaaggtga

SEQ ID NO: 8514378 - DNA, 22 bp, Homo sapiens
ccagaaaatatggctaaggtga

SEQ ID NO: 8514379 - DNA, 22 bp, Homo sapiens
ccactgggggctgctcccaggt

SEQ ID NO: 8514380 - DNA, 22 bp, Homo sapiens
ccactgggggctgctcccaggt

SEQ ID NO: 8514381 - DNA, 22 bp, Homo sapiens
ccactgggggctgcaggcactc

SEQ ID NO: 8514382 - DNA, 22 bp, Homo sapiens
ccactgggggctgcaggcactc

SEQ ID NO: 8514383 - DNA, 22 bp, Homo sapiens
ccactgggggctgcaggcactc

SEQ ID NO: 8514384 - DNA, 22 bp, Homo sapiens
aggcaggctgctatggagtaga

SEQ ID NO: 8514385 - DNA, 22 bp, Homo sapiens
ccactgggggctgcaggcactc

SEQ ID NO: 8514386 - DNA, 22 bp, Homo sapiens
ccagaaagttcagctgtgaatg

SEQ ID NO: 8514387 - DNA, 22 bp, Homo sapiens
ccagaacagacctgcctgacct

SEQ ID NO: 8514388 - DNA, 22 bp, Homo sapiens
ccagaactgggcaacagaaagt

SEQ ID NO: 8514389 - DNA, 22 bp, Homo sapiens
ccagaagaccccgtccacctcc

SEQ ID NO: 8514390 - DNA, 22 bp, Homo sapiens
aggccacagtcagtgggtgctg

SEQ ID NO: 8514391 - DNA, 22 bp, Homo sapiens
aggccacagtcagtgggtgctg

SEQ ID NO: 8514392 - DNA, 22 bp, Homo sapiens
aggccacagttgaggccagcaa

SEQ ID NO: 8514393 - DNA, 22 bp, Homo sapiens
aggccacaagaactaccccatc

SEQ ID NO: 8514394 - DNA, 22 bp, Homo sapiens
aggccacaagaactaccccatc

SEQ ID NO: 8514395 - DNA, 22 bp, Homo sapiens
aggccacagtactttgcagacc

SEQ ID NO: 8514396 - DNA, 22 bp, Homo sapiens
aggccacagtactttgcagacc

SEQ ID NO: 8514397 - DNA, 22 bp, Homo sapiens
aggccacagtcagtgggtgctg

SEQ ID NO: 8514398 - DNA, 22 bp, Homo sapiens
ccagactgtggagttcctggtg

SEQ ID NO: 8514399 - DNA, 22 bp, Homo sapiens
ccagactgtggagttcctggtg

SEQ ID NO: 8514400 - DNA, 22 bp, Homo sapiens
ccagacttttagtagtgagtta

SEQ ID NO: 8514401 - DNA, 21 bp, Homo sapiens
ccagacttgagtgtatgttgt

SEQ ID NO: 8514402 - DNA, 22 bp, Homo sapiens
ccagagaaagctcacaggcagt

SEQ ID NO: 8514403 - DNA, 22 bp, Homo sapiens
ccagagaaaagaggccaaggat

SEQ ID NO: 8514404 - DNA, 22 bp, Homo sapiens
ccagaccaccctggccatgcac

SEQ ID NO: 8514405 - DNA, 22 bp, Homo sapiens
ccagaccctccattcaagctcc

SEQ ID NO: 8514406 - DNA, 22 bp, Homo sapiens
ccagacatgtgcccttgaggaa

SEQ ID NO: 8514407 - DNA, 22 bp, Homo sapiens
ccagaccaccctggccatgcac

SEQ ID NO: 8514408 - DNA, 22 bp, Homo sapiens
ccagaagaccggggagtcaggg

SEQ ID NO: 8514409 - DNA, 22 bp, Homo sapiens
ccagacagttccttgaggttca

SEQ ID NO: 8514410 - DNA, 22 bp, Homo sapiens
ccagactgagggtccctgagct

SEQ ID NO: 8514411 - DNA, 21 bp, Homo sapiens
ccagactggcctatgtggtag

SEQ ID NO: 8514412 - DNA, 21 bp, Homo sapiens
ccagactggcctatgtggtag

SEQ ID NO: 8514413 - DNA, 22 bp, Homo sapiens
ccagactgcttgcttcccagcc

SEQ ID NO: 8514414 - DNA, 22 bp, Homo sapiens
aggccagtgcctttccagggct

SEQ ID NO: 8514415 - DNA, 22 bp, Homo sapiens
aggccagtgcagctggaacaga

SEQ ID NO: 8514416 - DNA, 22 bp, Homo sapiens
aggccagtgcagctggaacaga

SEQ ID NO: 8514417 - DNA, 22 bp, Homo sapiens
aggccagtgtggctggagcaca

SEQ ID NO: 8514418 - DNA, 22 bp, Homo sapiens
aggccaggttcctcaatcttga

SEQ ID NO: 8514419 - DNA, 22 bp, Homo sapiens
aggccaggttcctcaatcttga

SEQ ID NO: 8514420 - DNA, 22 bp, Homo sapiens
aggccaggtggtcatgcttgct

SEQ ID NO: 8514421 - DNA, 22 bp, Homo sapiens
aggccaggtggtcatgcttgct

SEQ ID NO: 8514422 - DNA, 22 bp, Homo sapiens
aggcccagactcagcggggcgg

SEQ ID NO: 8514423 - DNA, 23 bp, Homo sapiens
aggcccaactctgtgagggctgc

SEQ ID NO: 8514424 - DNA, 19 bp, Homo sapiens
ccagcagctttgattctct

SEQ ID NO: 8514425 - DNA, 22 bp, Homo sapiens
aggcccagactcagcggggcgg

SEQ ID NO: 8514426 - DNA, 22 bp, Homo sapiens
aggccatgtggccccagagtct

SEQ ID NO: 8514427 - DNA, 22 bp, Homo sapiens
aggcccaaaagaaaccactggg

SEQ ID NO: 8514428 - DNA, 22 bp, Homo sapiens
ccagagcctggcatctgcataa

SEQ ID NO: 8514429 - DNA, 22 bp, Homo sapiens
ccagagcctggcatctgcataa

SEQ ID NO: 8514430 - DNA, 21 bp, Homo sapiens
ccagagcctgctgagccccct

SEQ ID NO: 8514431 - DNA, 21 bp, Homo sapiens
ccagagcctgctgagccccct

SEQ ID NO: 8514432 - DNA, 22 bp, Homo sapiens
aggccagaaatgtcagggagtg

SEQ ID NO: 8514433 - DNA, 22 bp, Homo sapiens
aggccagaaatgtcagggagtg

SEQ ID NO: 8514434 - DNA, 22 bp, Homo sapiens
aggccagaaatgtcagggagtg

SEQ ID NO: 8514435 - DNA, 22 bp, Homo sapiens
aggccagaaaaagacagctcca

SEQ ID NO: 8514436 - DNA, 22 bp, Homo sapiens
aggccacattgtgattcccgca

SEQ ID NO: 8514437 - DNA, 22 bp, Homo sapiens
aggccacatagcttgcatgtag

SEQ ID NO: 8514438 - DNA, 22 bp, Homo sapiens
aggccacatagcttgcatgtag

SEQ ID NO: 8514439 - DNA, 22 bp, Homo sapiens
aggccacagttgaggccagcaa

SEQ ID NO: 8514440 - DNA, 22 bp, Homo sapiens
aggccacatagcttgcatgtag

SEQ ID NO: 8514441 - DNA, 22 bp, Homo sapiens
ccagagctgaggagatgggctt

SEQ ID NO: 8514442 - DNA, 22 bp, Homo sapiens
ccagagctccagggctacagaa

SEQ ID NO: 8514443 - DNA, 22 bp, Homo sapiens
ccagagctccagggctacagaa

SEQ ID NO: 8514444 - DNA, 22 bp, Homo sapiens
ccagagctccagggctacagaa

SEQ ID NO: 8514445 - DNA, 22 bp, Homo sapiens
ccagagctgaggagatgggctt

SEQ ID NO: 8514446 - DNA, 22 bp, Homo sapiens
ccagagctgaggagatgggctt

SEQ ID NO: 8514447 - DNA, 22 bp, Homo sapiens
ccagagctccagggctacagaa

SEQ ID NO: 8514448 - DNA, 22 bp, Homo sapiens
ccagagctccagggctacagaa

SEQ ID NO: 8514449 - DNA, 17 bp, Homo sapiens
ccagagctactgagact

SEQ ID NO: 8514450 - DNA, 17 bp, Homo sapiens
ccagagctactgagact

SEQ ID NO: 8514451 - DNA, 17 bp, Homo sapiens
ccagagctactgagact

SEQ ID NO: 8514452 - DNA, 22 bp, Homo sapiens
ccagagctaaacacacaggctg

SEQ ID NO: 8514453 - DNA, 22 bp, Homo sapiens
ccagagctaaacacacaggctg

SEQ ID NO: 8514454 - DNA, 22 bp, Homo sapiens
ccagagctaaacacacaggctg

SEQ ID NO: 8514455 - DNA, 22 bp, Homo sapiens
attttctgtgtgcagataaata

SEQ ID NO: 8514456 - DNA, 22 bp, Homo sapiens
attttctgtgtgcagataaata

SEQ ID NO: 8514457 - DNA, 22 bp, Homo sapiens
attttcttctctccctggctgc

SEQ ID NO: 8514458 - DNA, 22 bp, Homo sapiens
attttcttctctccctggctgc

SEQ ID NO: 8514459 - DNA, 22 bp, Homo sapiens
attttcttctctccctggctgc

SEQ ID NO: 8514460 - DNA, 22 bp, Homo sapiens
attttgaaaagcatttgagtaa

SEQ ID NO: 8514461 - DNA, 22 bp, Homo sapiens
attttgaaaagcatttgagtaa

SEQ ID NO: 8514462 - DNA, 22 bp, Homo sapiens
attttgaaaccaagttatttcc

SEQ ID NO: 8514463 - DNA, 22 bp, Homo sapiens
attttgaaaccaagttatttcc

SEQ ID NO: 8514464 - DNA, 22 bp, Homo sapiens
attttgaaaccaagttatttcc

SEQ ID NO: 8514465 - DNA, 22 bp, Homo sapiens
attttgaaaccaagttatttcc

SEQ ID NO: 8514466 - DNA, 22 bp, Homo sapiens
attttgaaatacttgaaggaaa

SEQ ID NO: 8514467 - DNA, 22 bp, Homo sapiens
attttgaaaagcatttgagtaa

SEQ ID NO: 8514468 - DNA, 22 bp, Homo sapiens
attttgaaaagcatttgagtaa

SEQ ID NO: 8514469 - DNA, 22 bp, Homo sapiens
attttgaaaagcatttgagtaa

SEQ ID NO: 8514470 - DNA, 22 bp, Homo sapiens
attttgaaaagcatttgagtaa

SEQ ID NO: 8514471 - DNA, 22 bp, Homo sapiens
gcctggctcacagagcagcctt

SEQ ID NO: 8514472 - DNA, 22 bp, Homo sapiens
attttgaagggaattgaagttc

SEQ ID NO: 8514473 - DNA, 22 bp, Homo sapiens
gcctggctcctaagagcacaac

SEQ ID NO: 8514474 - DNA, 22 bp, Homo sapiens
gcctggctcctaagagcacaac

SEQ ID NO: 8514475 - DNA, 22 bp, Homo sapiens
gcctggctccctctgcagctcc

SEQ ID NO: 8514476 - DNA, 22 bp, Homo sapiens
attttgaagggaattgaagttc

SEQ ID NO: 8514477 - DNA, 18 bp, Homo sapiens
attttgaactgggaatat

SEQ ID NO: 8514478 - DNA, 18 bp, Homo sapiens
attttgaactgggaatat

SEQ ID NO: 8514479 - DNA, 18 bp, Homo sapiens
attttgaactgggaatat

SEQ ID NO: 8514480 - DNA, 18 bp, Homo sapiens
attttgaactgggaatat

SEQ ID NO: 8514481 - DNA, 22 bp, Homo sapiens
attttgaaatacttgaaggaaa

SEQ ID NO: 8514482 - DNA, 22 bp, Homo sapiens
attttgaaatacttgaaggaaa

SEQ ID NO: 8514483 - DNA, 18 bp, Homo sapiens
attttgaacaatgctgta

SEQ ID NO: 8514484 - DNA, 18 bp, Homo sapiens
attttgaacaatgctgta

SEQ ID NO: 8514485 - DNA, 22 bp, Homo sapiens
gcctgcctagaattgcagcttt

SEQ ID NO: 8514486 - DNA, 22 bp, Homo sapiens
gcctgcctagaattgcagcttt

SEQ ID NO: 8514487 - DNA, 22 bp, Homo sapiens
gcctgcctagaattgcagcttt

SEQ ID NO: 8514488 - DNA, 22 bp, Homo sapiens
gcctgcctagaattgcagcttt

SEQ ID NO: 8514489 - DNA, 21 bp, Homo sapiens
gcctgccctctgtgatggcca

SEQ ID NO: 8514490 - DNA, 21 bp, Homo sapiens
gcctgccctctgtgatggcca

SEQ ID NO: 8514491 - DNA, 22 bp, Homo sapiens
gcctgccccttcctgggcaggg

SEQ ID NO: 8514492 - DNA, 22 bp, Homo sapiens
gcctgccccttcctgggcaggg

SEQ ID NO: 8514493 - DNA, 22 bp, Homo sapiens
attttacataaggaaggtttaa

SEQ ID NO: 8514494 - DNA, 22 bp, Homo sapiens
attttacataaggaaggtttaa

SEQ ID NO: 8514495 - DNA, 22 bp, Homo sapiens
attttacataaggaaggtttaa

SEQ ID NO: 8514496 - DNA, 23 bp, Homo sapiens
attttacaggtcagttccttgaa

SEQ ID NO: 8514497 - DNA, 23 bp, Homo sapiens
attttacaggtcagttccttgaa

SEQ ID NO: 8514498 - DNA, 22 bp, Homo sapiens
attttactaagtggatatctgt

SEQ ID NO: 8514499 - DNA, 22 bp, Homo sapiens
gcctgcccacggggctggcata

SEQ ID NO: 8514500 - DNA, 22 bp, Homo sapiens
gcctgcccacggggctggcata

SEQ ID NO: 8514501 - DNA, 22 bp, Homo sapiens
gcctgcccacggggctggcata

SEQ ID NO: 8514502 - DNA, 22 bp, Homo sapiens
atttgcaaagtcgtatctgtga

SEQ ID NO: 8514503 - DNA, 22 bp, Homo sapiens
atttgcaaaggttaacagcagt

SEQ ID NO: 8514504 - DNA, 22 bp, Homo sapiens
atttgcaaaggttaacagcagt

SEQ ID NO: 8514505 - DNA, 22 bp, Homo sapiens
atttgcaagagtaagaatttct

SEQ ID NO: 8514506 - DNA, 22 bp, Homo sapiens
atttgcaagcatgcacaaaagc

SEQ ID NO: 8514507 - DNA, 22 bp, Homo sapiens
atttgcaattactcatgtcatt

SEQ ID NO: 8514508 - DNA, 22 bp, Homo sapiens
atttgcataatagtgatttgta

SEQ ID NO: 8514509 - DNA, 22 bp, Homo sapiens
atttgcataatagtgatttgta

SEQ ID NO: 8514510 - DNA, 22 bp, Homo sapiens
atttgcaggtgtcgattagtct

SEQ ID NO: 8514511 - DNA, 22 bp, Homo sapiens
atttgcataaggatgctactgt

SEQ ID NO: 8514512 - DNA, 18 bp, Homo sapiens
atttgcaggcatgcaggc

SEQ ID NO: 8514513 - DNA, 22 bp, Homo sapiens
atttgcagattctgtcaggttt

SEQ ID NO: 8514514 - DNA, 22 bp, Homo sapiens
atttgcagagctctgaattttg

SEQ ID NO: 8514515 - DNA, 22 bp, Homo sapiens
atttgcagaagggagggggacc

SEQ ID NO: 8514516 - DNA, 22 bp, Homo sapiens
atttgacattgacacacctatg

SEQ ID NO: 8514517 - DNA, 22 bp, Homo sapiens
atttgattagctgtgtaatttt

SEQ ID NO: 8514518 - DNA, 22 bp, Homo sapiens
atttgattagctgtgtaatttt

SEQ ID NO: 8514519 - DNA, 23 bp, Homo sapiens
atttgagaaagtatttttaagac

SEQ ID NO: 8514520 - DNA, 23 bp, Homo sapiens
atttgagaaagtatttttaagac

SEQ ID NO: 8514521 - DNA, 23 bp, Homo sapiens
atttgagaaagtatttttaagac

SEQ ID NO: 8514522 - DNA, 22 bp, Homo sapiens
atttgagatggtaaataacttt

SEQ ID NO: 8514523 - DNA, 22 bp, Homo sapiens
atttgaggatagttgggtactc

SEQ ID NO: 8514524 - DNA, 22 bp, Homo sapiens
atttgattagctgtgtaatttt

SEQ ID NO: 8514525 - DNA, 20 bp, Homo sapiens
atttgcatctgaataactta

SEQ ID NO: 8514526 - DNA, 20 bp, Homo sapiens
atttgcatctgaataactta

SEQ ID NO: 8514527 - DNA, 23 bp, Homo sapiens
atttgcatggccggattatggat

SEQ ID NO: 8514528 - DNA, 22 bp, Homo sapiens
atttgcatttacatagcataga

SEQ ID NO: 8514529 - DNA, 22 bp, Homo sapiens
atttgcatttagaaagatcact

SEQ ID NO: 8514530 - DNA, 21 bp, Homo sapiens
atttgcattaaaatattacgc

SEQ ID NO: 8514531 - DNA, 22 bp, Homo sapiens
atttgcctgtaagacaaggcct

SEQ ID NO: 8514532 - DNA, 22 bp, Homo sapiens
atttgccatgaagagtgtttga

SEQ ID NO: 8514533 - DNA, 22 bp, Homo sapiens
atttgcatttagaaagatcact

SEQ ID NO: 8514534 - DNA, 22 bp, Homo sapiens
atttgcctttcgaatcaacagg

SEQ ID NO: 8514535 - DNA, 22 bp, Homo sapiens
atttgccttttaaactcacaat

SEQ ID NO: 8514536 - DNA, 22 bp, Homo sapiens
atttgtctgcttgctgccttcc

SEQ ID NO: 8514537 - DNA, 22 bp, Homo sapiens
atttgtctttgagtgccctgct

SEQ ID NO: 8514538 - DNA, 23 bp, Homo sapiens
attttaaccttgactaacatgca

SEQ ID NO: 8514539 - DNA, 23 bp, Homo sapiens
attttaaccttgactaacatgca

SEQ ID NO: 8514540 - DNA, 22 bp, Homo sapiens
atttgtctttggacctgtgaga

SEQ ID NO: 8514541 - DNA, 22 bp, Homo sapiens
attttaaggcttatttaaaggc

SEQ ID NO: 8514542 - DNA, 23 bp, Homo sapiens
attttaaccttgactaacatgca

SEQ ID NO: 8514543 - DNA, 22 bp, Homo sapiens
attttaataagatccatttggt

SEQ ID NO: 8514544 - DNA, 22 bp, Homo sapiens
attttaataagattcccaagta

SEQ ID NO: 8514545 - DNA, 22 bp, Homo sapiens
attttaataagattcccaagta

SEQ ID NO: 8514546 - DNA, 22 bp, Homo sapiens
attttaaggcttatttaaaggc

SEQ ID NO: 8514547 - DNA, 22 bp, Homo sapiens
attttaaggcttatttaaaggc

SEQ ID NO: 8514548 - DNA, 22 bp, Homo sapiens
attttaataagatccatttggt

SEQ ID NO: 8514549 - DNA, 22 bp, Homo sapiens
gcccaggaggttgggctgtgca

SEQ ID NO: 8514550 - DNA, 22 bp, Homo sapiens
gcccaggaggttgggctgtgca

SEQ ID NO: 8514551 - DNA, 22 bp, Homo sapiens
gcccaggaggttgggctgtgca

SEQ ID NO: 8514552 - DNA, 22 bp, Homo sapiens
gcccaggagttcaaggctgcag

SEQ ID NO: 8514553 - DNA, 22 bp, Homo sapiens
gcccaggagttcaaggctgcag

SEQ ID NO: 8514554 - DNA, 22 bp, Homo sapiens
gcccaggaggtggaggtgcagt

SEQ ID NO: 8514555 - DNA, 22 bp, Homo sapiens
gcccaggaggtggaggtgcagt

SEQ ID NO: 8514556 - DNA, 22 bp, Homo sapiens
gcccaggaggtcaagtagctat

SEQ ID NO: 8514557 - DNA, 22 bp, Homo sapiens
gcccagcccctgggtggacgtg

SEQ ID NO: 8514558 - DNA, 22 bp, Homo sapiens
gcccaggagttgaagggctgac

SEQ ID NO: 8514559 - DNA, 22 bp, Homo sapiens
gccccctctttggagccagcca

SEQ ID NO: 8514560 - DNA, 22 bp, Homo sapiens
gcccaggagttgaagggctgac

SEQ ID NO: 8514561 - DNA, 22 bp, Homo sapiens
gcccaggagttcaagtctagtg

SEQ ID NO: 8514562 - DNA, 22 bp, Homo sapiens
gcccaggagttcaagtctagtg

SEQ ID NO: 8514563 - DNA, 22 bp, Homo sapiens
gccctccaccagagcccttctc

SEQ ID NO: 8514564 - DNA, 22 bp, Homo sapiens
gcccctccatccatcaccgggg

SEQ ID NO: 8514565 - DNA, 22 bp, Homo sapiens
gccctccatgagacacagtgta

SEQ ID NO: 8514566 - DNA, 22 bp, Homo sapiens
gccctccatgagacacagtgta

SEQ ID NO: 8514567 - DNA, 22 bp, Homo sapiens
gccctgcagtgcggaggtggca

SEQ ID NO: 8514568 - DNA, 19 bp, Homo sapiens
gccctgcaggaggtggggc

SEQ ID NO: 8514569 - DNA, 19 bp, Homo sapiens
gccctgcaggaggtggggc

SEQ ID NO: 8514570 - DNA, 22 bp, Homo sapiens
gccctgccctctcggcactcgc

SEQ ID NO: 8514571 - DNA, 22 bp, Homo sapiens
atttcttcctctgtcagtaact

SEQ ID NO: 8514572 - DNA, 22 bp, Homo sapiens
gccctcccctctgggtggtgag

SEQ ID NO: 8514573 - DNA, 22 bp, Homo sapiens
gccctcccctctgggtggtgag

SEQ ID NO: 8514574 - DNA, 23 bp, Homo sapiens
gccctccctcccaggtgggtgtt

SEQ ID NO: 8514575 - DNA, 22 bp, Homo sapiens
gccctccctacagcctatttct

SEQ ID NO: 8514576 - DNA, 22 bp, Homo sapiens
gccctccctacagcctatttct

SEQ ID NO: 8514577 - DNA, 22 bp, Homo sapiens
gccctgagttgagccttccaaa

SEQ ID NO: 8514578 - DNA, 19 bp, Homo sapiens
gccctcctcactgagctct

SEQ ID NO: 8514579 - DNA, 23 bp, Homo sapiens
gccctccctcccaggtgggtgtt

SEQ ID NO: 8514580 - DNA, 22 bp, Homo sapiens
gcccagcaggggatggcagctc

SEQ ID NO: 8514581 - DNA, 22 bp, Homo sapiens
gcccagcaggacagagtggttt

SEQ ID NO: 8514582 - DNA, 22 bp, Homo sapiens
gcccagcaggacagagtggttt

SEQ ID NO: 8514583 - DNA, 22 bp, Homo sapiens
gcccagcaggggatggcagctc

SEQ ID NO: 8514584 - DNA, 22 bp, Homo sapiens
gcccagccacagtcactttcat

SEQ ID NO: 8514585 - DNA, 22 bp, Homo sapiens
gcccagcccagaaaggttcgga

SEQ ID NO: 8514586 - DNA, 22 bp, Homo sapiens
gcccagccagagctgtgtgatg

SEQ ID NO: 8514587 - DNA, 22 bp, Homo sapiens
gcccagccacagtcactttcat

SEQ ID NO: 8514588 - DNA, 19 bp, Homo sapiens
gcccacggccctgctctgc

SEQ ID NO: 8514589 - DNA, 22 bp, Homo sapiens
gccagaggttcaacaactgtct

SEQ ID NO: 8514590 - DNA, 22 bp, Homo sapiens
gcccactccagcttctcccaca

SEQ ID NO: 8514591 - DNA, 20 bp, Homo sapiens
gcccactctaatccactgtc

SEQ ID NO: 8514592 - DNA, 18 bp, Homo sapiens
gccagaggtactactgat

SEQ ID NO: 8514593 - DNA, 22 bp, Homo sapiens
gccagaggggctcgaaggcgcg

SEQ ID NO: 8514594 - DNA, 22 bp, Homo sapiens
gccagaggggctcgaaggcgcg

SEQ ID NO: 8514595 - DNA, 22 bp, Homo sapiens
gccagagggattcctggtgtgt

SEQ ID NO: 8514596 - DNA, 18 bp, Homo sapiens
gccagagggcccaaggtc

SEQ ID NO: 8514597 - DNA, 18 bp, Homo sapiens
gccagagggcccaaggtc

SEQ ID NO: 8514598 - DNA, 18 bp, Homo sapiens
gccagagggaagcaggtg

SEQ ID NO: 8514599 - DNA, 18 bp, Homo sapiens
gccagagggaagcaggtg

SEQ ID NO: 8514600 - DNA, 18 bp, Homo sapiens
gccagagggaagcaggtg

SEQ ID NO: 8514601 - DNA, 18 bp, Homo sapiens
gccagagggaagcaggtg

SEQ ID NO: 8514602 - DNA, 22 bp, Homo sapiens
atttaccatcctgtgaatggcc

SEQ ID NO: 8514603 - DNA, 18 bp, Homo sapiens
gccagagggaagcaggtg

SEQ ID NO: 8514604 - DNA, 18 bp, Homo sapiens
gccagagggaagcaggtg

SEQ ID NO: 8514605 - DNA, 22 bp, Homo sapiens
atttactaatgtcatatcgcgt

SEQ ID NO: 8514606 - DNA, 17 bp, Homo sapiens
atttacattgtcaccga

SEQ ID NO: 8514607 - DNA, 17 bp, Homo sapiens
atttacattgtcaccga

SEQ ID NO: 8514608 - DNA, 22 bp, Homo sapiens
atttacatttatttgagaaggt

SEQ ID NO: 8514609 - DNA, 22 bp, Homo sapiens
atttacatttatttgagaaggt

SEQ ID NO: 8514610 - DNA, 22 bp, Homo sapiens
atttaccagctgtgcactgata

SEQ ID NO: 8514611 - DNA, 22 bp, Homo sapiens
atttaccatatgtactgagtat

SEQ ID NO: 8514612 - DNA, 22 bp, Homo sapiens
atttaccagctgtgcactgata

SEQ ID NO: 8514613 - DNA, 22 bp, Homo sapiens
atttacagacgtggattagtgc

SEQ ID NO: 8514614 - DNA, 22 bp, Homo sapiens
atttacagaccctcccactaag

SEQ ID NO: 8514615 - DNA, 22 bp, Homo sapiens
atttacagtgtgcctactatat

SEQ ID NO: 8514616 - DNA, 23 bp, Homo sapiens
atttacaggttaaatgaaatcag

SEQ ID NO: 8514617 - DNA, 22 bp, Homo sapiens
atttacagtttagcatttcaag

SEQ ID NO: 8514618 - DNA, 22 bp, Homo sapiens
atttacagtgtgcctactatat

SEQ ID NO: 8514619 - DNA, 22 bp, Homo sapiens
atttacagtttagcatttcaag

SEQ ID NO: 8514620 - DNA, 22 bp, Homo sapiens
atttacataatagactttaggt

SEQ ID NO: 8514621 - DNA, 22 bp, Homo sapiens
atttacattccatggtggttac

SEQ ID NO: 8514622 - DNA, 22 bp, Homo sapiens
atttacattccatggtggttac

SEQ ID NO: 8514623 - DNA, 17 bp, Homo sapiens
gctccaggcgtgagtga

SEQ ID NO: 8514624 - DNA, 22 bp, Homo sapiens
gctccaggcgagctggaccaga

SEQ ID NO: 8514625 - DNA, 22 bp, Homo sapiens
gctccaggcgagctggaccaga

SEQ ID NO: 8514626 - DNA, 22 bp, Homo sapiens
gctccaggcgagctggaccaga

SEQ ID NO: 8514627 - DNA, 22 bp, Homo sapiens
gctccaggcgagctggaccaga

SEQ ID NO: 8514628 - DNA, 22 bp, Homo sapiens
gctccaggccccagcgttccgc

SEQ ID NO: 8514629 - DNA, 22 bp, Homo sapiens
gctccaggccccagcgttccgc

SEQ ID NO: 8514630 - DNA, 22 bp, Homo sapiens
gctccaggccccagcgttccgc

SEQ ID NO: 8514631 - DNA, 22 bp, Homo sapiens
gctccaggccacggcttcttgg

SEQ ID NO: 8514632 - DNA, 22 bp, Homo sapiens
gctccaggccacggcttcttgg

SEQ ID NO: 8514633 - DNA, 22 bp, Homo sapiens
gctccaggcagcatagtggatg

SEQ ID NO: 8514634 - DNA, 22 bp, Homo sapiens
gctccaggcagcatagtggatg

SEQ ID NO: 8514635 - DNA, 22 bp, Homo sapiens
gctccaggcagcatagtggatg

SEQ ID NO: 8514636 - DNA, 20 bp, Homo sapiens
gctcaggtgacagtcaggag

SEQ ID NO: 8514637 - DNA, 20 bp, Homo sapiens
gctcaggtttgggctttgtg

SEQ ID NO: 8514638 - DNA, 22 bp, Homo sapiens
gctccaggcagcatagtggatg

SEQ ID NO: 8514639 - DNA, 22 bp, Homo sapiens
gctccaggcagcatagtggatg

SEQ ID NO: 8514640 - DNA, 22 bp, Homo sapiens
gctcaggtcttacccatgcctg

SEQ ID NO: 8514641 - DNA, 22 bp, Homo sapiens
gctcaggtcttacccatgcctg

SEQ ID NO: 8514642 - DNA, 18 bp, Homo sapiens
gctcaggtatagacaggg

SEQ ID NO: 8514643 - DNA, 22 bp, Homo sapiens
gctcaggtagatggggttgtcc

SEQ ID NO: 8514644 - DNA, 20 bp, Homo sapiens
gctcaggtgacagtcaggag

SEQ ID NO: 8514645 - DNA, 22 bp, Homo sapiens
gctcaggtgttacctcctctag

SEQ ID NO: 8514646 - DNA, 23 bp, Homo sapiens
gctcaggtggctcagggactgat

SEQ ID NO: 8514647 - DNA, 22 bp, Homo sapiens
gctcagggctaaggctgagggg

SEQ ID NO: 8514648 - DNA, 22 bp, Homo sapiens
gctcaggggaatgggctgccgt

SEQ ID NO: 8514649 - DNA, 22 bp, Homo sapiens
gctcaggggaatgggctgccgt

SEQ ID NO: 8514650 - DNA, 22 bp, Homo sapiens
gctcagggtcccttggtgctgg

SEQ ID NO: 8514651 - DNA, 22 bp, Homo sapiens
gctcagggtcccttggtgctgg

SEQ ID NO: 8514652 - DNA, 22 bp, Homo sapiens
gctcgcgccgcaccggtccacc

SEQ ID NO: 8514653 - DNA, 22 bp, Homo sapiens
gctccttctggctcccttttgg

SEQ ID NO: 8514654 - DNA, 17 bp, Homo sapiens
gctccttctaacttcca

SEQ ID NO: 8514655 - DNA, 22 bp, Homo sapiens
gctcctggatgttcaagtcggc

SEQ ID NO: 8514656 - DNA, 22 bp, Homo sapiens
gctcggtggccagcctgaggcc

SEQ ID NO: 8514657 - DNA, 22 bp, Homo sapiens
gctccaggctgctctgtcccat

SEQ ID NO: 8514658 - DNA, 22 bp, Homo sapiens
gctccaggctgctctgtcccat

SEQ ID NO: 8514659 - DNA, 22 bp, Homo sapiens
gctccaggctgctctgtcccat

SEQ ID NO: 8514660 - DNA, 17 bp, Homo sapiens
gctccaggcgtgagtga

SEQ ID NO: 8514661 - DNA, 17 bp, Homo sapiens
gctccaggcgtgagtga

SEQ ID NO: 8514662 - DNA, 17 bp, Homo sapiens
gctccaggcgtgagtga

SEQ ID NO: 8514663 - DNA, 17 bp, Homo sapiens
gctccaggcgtgagtga

SEQ ID NO: 8514664 - DNA, 19 bp, Homo sapiens
gctctaaaagattttgaag

SEQ ID NO: 8514665 - DNA, 22 bp, Homo sapiens
gctctaaagaacccagaggagt

SEQ ID NO: 8514666 - DNA, 20 bp, Homo sapiens
gctctaaaccacaaagccca

SEQ ID NO: 8514667 - DNA, 20 bp, Homo sapiens
gctctaaagccacagattga

SEQ ID NO: 8514668 - DNA, 20 bp, Homo sapiens
gctctaaagccacagattga

SEQ ID NO: 8514669 - DNA, 20 bp, Homo sapiens
gctctaaagccacagattga

SEQ ID NO: 8514670 - DNA, 22 bp, Homo sapiens
gctctagtaggaatgtccctct

SEQ ID NO: 8514671 - DNA, 22 bp, Homo sapiens
gctctaggttcctagccaagtc

SEQ ID NO: 8514672 - DNA, 22 bp, Homo sapiens
gctatttttgagccatttataa

SEQ ID NO: 8514673 - DNA, 22 bp, Homo sapiens
gctcaaagaccagacagaggag

SEQ ID NO: 8514674 - DNA, 22 bp, Homo sapiens
gctcaaagaatattcagaatga

SEQ ID NO: 8514675 - DNA, 22 bp, Homo sapiens
gctatttattaaaatggtgaag

SEQ ID NO: 8514676 - DNA, 22 bp, Homo sapiens
gctatttattaaaatggtgaag

SEQ ID NO: 8514677 - DNA, 22 bp, Homo sapiens
gctatttccaaagctgctgttc

SEQ ID NO: 8514678 - DNA, 23 bp, Homo sapiens
gctcaggcatcattcttcctggc

SEQ ID NO: 8514679 - DNA, 22 bp, Homo sapiens
gctatgttagacattctcattt

SEQ ID NO: 8514680 - DNA, 22 bp, Homo sapiens
gctacagactgagcatggctct

SEQ ID NO: 8514681 - DNA, 22 bp, Homo sapiens
gctatgcaggagcctaatgaca

SEQ ID NO: 8514682 - DNA, 22 bp, Homo sapiens
gctattgtgacagcttttcgcc

SEQ ID NO: 8514683 - DNA, 22 bp, Homo sapiens
gctattgtttattttgaatcta

SEQ ID NO: 8514684 - DNA, 22 bp, Homo sapiens
gctatttattaaaatagtgaag

SEQ ID NO: 8514685 - DNA, 22 bp, Homo sapiens
gctatgtgtgttttgctgcagc

SEQ ID NO: 8514686 - DNA, 22 bp, Homo sapiens
gctaatcaatgttaaggctgtg

SEQ ID NO: 8514687 - DNA, 22 bp, Homo sapiens
gcctggctcctaagagcacaac

SEQ ID NO: 8514688 - DNA, 22 bp, Homo sapiens
gcctggctcctaaggactggct

SEQ ID NO: 8514689 - DNA, 21 bp, Homo sapiens
gcctggctctcactggcctgg

SEQ ID NO: 8514690 - DNA, 22 bp, Homo sapiens
gcctggctcctaaggactggct

SEQ ID NO: 8514691 - DNA, 22 bp, Homo sapiens
gcgcaggagccgcggagggccg

SEQ ID NO: 8514692 - DNA, 22 bp, Homo sapiens
gcgccccatctacagtactttt

SEQ ID NO: 8514693 - DNA, 21 bp, Homo sapiens
gcctggctctcactggcctgg

SEQ ID NO: 8514694 - DNA, 22 bp, Homo sapiens
gcctggctctgagggagctcct

SEQ ID NO: 8514695 - DNA, 22 bp, Homo sapiens
gcctggctctgagggagctcct

SEQ ID NO: 8514696 - DNA, 22 bp, Homo sapiens
gcctggctctgagtttctctcc

SEQ ID NO: 8514697 - DNA, 22 bp, Homo sapiens
gcgtgtgtgatatgcctctgca

SEQ ID NO: 8514698 - DNA, 22 bp, Homo sapiens
gcgtgtgtgatatgcctctgca

SEQ ID NO: 8514699 - DNA, 22 bp, Homo sapiens
gcgtgtttgcccagtgagtggc

SEQ ID NO: 8514700 - DNA, 22 bp, Homo sapiens
gcgtttgttttgctggcgccag

SEQ ID NO: 8514701 - DNA, 22 bp, Homo sapiens
gcgtttaagtgatgatcgtctt

SEQ ID NO: 8514702 - DNA, 22 bp, Homo sapiens
gcgtttaaagatagctaataag

SEQ ID NO: 8514703 - DNA, 22 bp, Homo sapiens
gcgtggtgctgccctgcacaca

SEQ ID NO: 8514704 - DNA, 22 bp, Homo sapiens
gcgtgtatgcaggtctgtgcag

SEQ ID NO: 8514705 - DNA, 22 bp, Homo sapiens
gcgtgtatgcaggtctgtgcag

SEQ ID NO: 8514706 - DNA, 22 bp, Homo sapiens
gctaaatctcctacaatgcaca

SEQ ID NO: 8514707 - DNA, 22 bp, Homo sapiens
gctaaataatcttcttctgaca

SEQ ID NO: 8514708 - DNA, 22 bp, Homo sapiens
gctaagaggctatatctttctc

SEQ ID NO: 8514709 - DNA, 22 bp, Homo sapiens
gctctgagaggatgctgagcag

SEQ ID NO: 8514710 - DNA, 22 bp, Homo sapiens
gctctgagaggatgctgagcag

SEQ ID NO: 8514711 - DNA, 22 bp, Homo sapiens
gctctgagaggatgctgagcag

SEQ ID NO: 8514712 - DNA, 22 bp, Homo sapiens
caaatagactctagaatttatt

SEQ ID NO: 8514713 - DNA, 19 bp, Homo sapiens
gctctgagaggggcatggg

SEQ ID NO: 8514714 - DNA, 22 bp, Homo sapiens
caaatattccaggtacatccct

SEQ ID NO: 8514715 - DNA, 22 bp, Homo sapiens
caaatattccaggtacatccct

SEQ ID NO: 8514716 - DNA, 22 bp, Homo sapiens
caaatcaccacttaatgggtta

SEQ ID NO: 8514717 - DNA, 22 bp, Homo sapiens
caaatcaccacttaatgggtta

SEQ ID NO: 8514718 - DNA, 20 bp, Homo sapiens
caaatcacaggtaattgcaa

SEQ ID NO: 8514719 - DNA, 22 bp, Homo sapiens
caaatcacaatgtgagactgag

SEQ ID NO: 8514720 - DNA, 22 bp, Homo sapiens
caaatcacaatgtgagactgag

SEQ ID NO: 8514721 - DNA, 20 bp, Homo sapiens
caaatcacaggtaattgcaa

SEQ ID NO: 8514722 - DNA, 22 bp, Homo sapiens
caaatattccaggtacatccct

SEQ ID NO: 8514723 - DNA, 22 bp, Homo sapiens
caaatattccaggtacatccct

SEQ ID NO: 8514724 - DNA, 22 bp, Homo sapiens
caaatattccaggtacatccct

SEQ ID NO: 8514725 - DNA, 22 bp, Homo sapiens
caaatagacttaagcatctgta

SEQ ID NO: 8514726 - DNA, 22 bp, Homo sapiens
gctctgagagagcaaagtcacc

SEQ ID NO: 8514727 - DNA, 22 bp, Homo sapiens
gctctgacttcctgcgctccag

SEQ ID NO: 8514728 - DNA, 22 bp, Homo sapiens
gctctgactggtgggccacagt

SEQ ID NO: 8514729 - DNA, 22 bp, Homo sapiens
gctctgacacatttgttctacc

SEQ ID NO: 8514730 - DNA, 22 bp, Homo sapiens
gctctgaatcaatcagataagg

SEQ ID NO: 8514731 - DNA, 22 bp, Homo sapiens
gctctgaagggtgagctgttcg

SEQ ID NO: 8514732 - DNA, 22 bp, Homo sapiens
gctctgaacttccaccttttca

SEQ ID NO: 8514733 - DNA, 22 bp, Homo sapiens
caaatccagatcccagtcgtag

SEQ ID NO: 8514734 - DNA, 20 bp, Homo sapiens
caaatccctgctctgtgctg

SEQ ID NO: 8514735 - DNA, 22 bp, Homo sapiens
caaatcatggctctagcttaca

SEQ ID NO: 8514736 - DNA, 22 bp, Homo sapiens
caaatcatggaataactagaga

SEQ ID NO: 8514737 - DNA, 22 bp, Homo sapiens
caaatcctggagccatggtaac

SEQ ID NO: 8514738 - DNA, 20 bp, Homo sapiens
caaatccctgctctgtgctg

SEQ ID NO: 8514739 - DNA, 22 bp, Homo sapiens
gctctgggtgaacttggagcaa

SEQ ID NO: 8514740 - DNA, 22 bp, Homo sapiens
caaatgaagaaccttctcacct

SEQ ID NO: 8514741 - DNA, 22 bp, Homo sapiens
gctgaggagcgagaactctgct

SEQ ID NO: 8514742 - DNA, 22 bp, Homo sapiens
caaatgaagggagctgaagtct

SEQ ID NO: 8514743 - DNA, 22 bp, Homo sapiens
caaatgtgttttttcttctaca

SEQ ID NO: 8514744 - DNA, 22 bp, Homo sapiens
caaatgtgtagagcttttgggg

SEQ ID NO: 8514745 - DNA, 22 bp, Homo sapiens
gctgagctgggacagtcctggg

SEQ ID NO: 8514746 - DNA, 22 bp, Homo sapiens
gctgaggaaaccaatgctcaga

SEQ ID NO: 8514747 - DNA, 22 bp, Homo sapiens
gctgaggaaaccaatgctcaga

SEQ ID NO: 8514748 - DNA, 22 bp, Homo sapiens
gctgaggaaaggctggaaggga

SEQ ID NO: 8514749 - DNA, 22 bp, Homo sapiens
gctgaggacatcatggaaggaa

SEQ ID NO: 8514750 - DNA, 20 bp, Homo sapiens
gctgaggagcagtgtggttg

SEQ ID NO: 8514751 - DNA, 22 bp, Homo sapiens
gctgaggacatacacattgtgc

SEQ ID NO: 8514752 - DNA, 22 bp, Homo sapiens
gctgaggaagtcaggtggccca

SEQ ID NO: 8514753 - DNA, 22 bp, Homo sapiens
gctgagctgggacagtcctggg

SEQ ID NO: 8514754 - DNA, 22 bp, Homo sapiens
gctgagctgggacagtcctggg

SEQ ID NO: 8514755 - DNA, 22 bp, Homo sapiens
gctgagctgggacagtcctggg

SEQ ID NO: 8514756 - DNA, 22 bp, Homo sapiens
gctgagctgctgttcatcctgc

SEQ ID NO: 8514757 - DNA, 22 bp, Homo sapiens
gctgagctgctgttcatcctgc

SEQ ID NO: 8514758 - DNA, 22 bp, Homo sapiens
gctgagaaatgcagacatgctg

SEQ ID NO: 8514759 - DNA, 22 bp, Homo sapiens
gctgagctgaggcagggctggg

SEQ ID NO: 8514760 - DNA, 22 bp, Homo sapiens
gctgagctgctgttcatcctgc

SEQ ID NO: 8514761 - DNA, 22 bp, Homo sapiens
gctgagctgaggcagggctggg

SEQ ID NO: 8514762 - DNA, 22 bp, Homo sapiens
gctctggtgagtgtagttcagg

SEQ ID NO: 8514763 - DNA, 22 bp, Homo sapiens
atttaaatgcttaagagggttt

SEQ ID NO: 8514764 - DNA, 22 bp, Homo sapiens
atttaaatgcttaagagggttt

SEQ ID NO: 8514765 - DNA, 22 bp, Homo sapiens
atttaaattttctgatggagag

SEQ ID NO: 8514766 - DNA, 22 bp, Homo sapiens
atttaaattttctgatggagag

SEQ ID NO: 8514767 - DNA, 22 bp, Homo sapiens
atttaaattttctgatggagag

SEQ ID NO: 8514768 - DNA, 22 bp, Homo sapiens
atttaaatgcttaagagggttt

SEQ ID NO: 8514769 - DNA, 22 bp, Homo sapiens
atttaaatgcttaagagggttt

SEQ ID NO: 8514770 - DNA, 22 bp, Homo sapiens
atttaaatgcttaagagggttt

SEQ ID NO: 8514771 - DNA, 22 bp, Homo sapiens
atttaaatgcttaagagggttt

SEQ ID NO: 8514772 - DNA, 22 bp, Homo sapiens
atttaaatgcttaagagggttt

SEQ ID NO: 8514773 - DNA, 22 bp, Homo sapiens
atttaaatgcttaagagggttt

SEQ ID NO: 8514774 - DNA, 23 bp, Homo sapiens
attgtttttggctctcagggaat

SEQ ID NO: 8514775 - DNA, 22 bp, Homo sapiens
attgttttccaaagatgctgct

SEQ ID NO: 8514776 - DNA, 20 bp, Homo sapiens
attgtttcatttaatgtaca

SEQ ID NO: 8514777 - DNA, 22 bp, Homo sapiens
attgtttccccggaattattca

SEQ ID NO: 8514778 - DNA, 22 bp, Homo sapiens
attgtttccccggaattattca

SEQ ID NO: 8514779 - DNA, 22 bp, Homo sapiens
attgttttaattccattgtgaa

SEQ ID NO: 8514780 - DNA, 22 bp, Homo sapiens
attgtttctgctttatttaggg

SEQ ID NO: 8514781 - DNA, 22 bp, Homo sapiens
gccactggcgctgtgcagagtg

SEQ ID NO: 8514782 - DNA, 22 bp, Homo sapiens
gcattcatcaaaaatgttcctc

SEQ ID NO: 8514783 - DNA, 22 bp, Homo sapiens
gcattcatctagtatcactctg

SEQ ID NO: 8514784 - DNA, 22 bp, Homo sapiens
gcattcatcttcatgaaagcac

SEQ ID NO: 8514785 - DNA, 22 bp, Homo sapiens
gcattcatcttcatgaaagcac

SEQ ID NO: 8514786 - DNA, 22 bp, Homo sapiens
gcattcatatggaaggaaacta

SEQ ID NO: 8514787 - DNA, 22 bp, Homo sapiens
gcattcaggaaccggaagggta

SEQ ID NO: 8514788 - DNA, 22 bp, Homo sapiens
gcattcaggaaccggaagggta

SEQ ID NO: 8514789 - DNA, 22 bp, Homo sapiens
gcattcctgagaatgcagagtg

SEQ ID NO: 8514790 - DNA, 22 bp, Homo sapiens
gcattcattcattcattaggta

SEQ ID NO: 8514791 - DNA, 22 bp, Homo sapiens
gcattcccaaaagacacttacc

SEQ ID NO: 8514792 - DNA, 22 bp, Homo sapiens
gcattcattcaggctcccaggg

SEQ ID NO: 8514793 - DNA, 22 bp, Homo sapiens
gcattcatgcctgtgtgagctc

SEQ ID NO: 8514794 - DNA, 21 bp, Homo sapiens
gccactgcactccagcctggg

SEQ ID NO: 8514795 - DNA, 22 bp, Homo sapiens
gccactgcactccagcccaggc

SEQ ID NO: 8514796 - DNA, 22 bp, Homo sapiens
gccactgattccaagtcaattt

SEQ ID NO: 8514797 - DNA, 22 bp, Homo sapiens
gccacagtgggctggggccaga

SEQ ID NO: 8514798 - DNA, 22 bp, Homo sapiens
gccaccttccaaaataatcaca

SEQ ID NO: 8514799 - DNA, 20 bp, Homo sapiens
gccacagttttctcactgca

SEQ ID NO: 8514800 - DNA, 19 bp, Homo sapiens
gccactcctgatgctgccc

SEQ ID NO: 8514801 - DNA, 19 bp, Homo sapiens
gccactcctgatgctgccc

SEQ ID NO: 8514802 - DNA, 22 bp, Homo sapiens
gccactcatgggaggtgtgcaa

SEQ ID NO: 8514803 - DNA, 22 bp, Homo sapiens
gccactgaacattagagctagt

SEQ ID NO: 8514804 - DNA, 22 bp, Homo sapiens
gccactgagcccggccattgtt

SEQ ID NO: 8514805 - DNA, 22 bp, Homo sapiens
gccactgaacattagagctagt

SEQ ID NO: 8514806 - DNA, 22 bp, Homo sapiens
attgttctggatatttacattg

SEQ ID NO: 8514807 - DNA, 22 bp, Homo sapiens
attgttctaagggtttaattaa

SEQ ID NO: 8514808 - DNA, 22 bp, Homo sapiens
attgttgagtgcttcagctgta

SEQ ID NO: 8514809 - DNA, 22 bp, Homo sapiens
attgttctgtagtgacatgtag

SEQ ID NO: 8514810 - DNA, 18 bp, Homo sapiens
attgttctgtgacatgtc

SEQ ID NO: 8514811 - DNA, 20 bp, Homo sapiens
attgttgctgctgctgttga

SEQ ID NO: 8514812 - DNA, 22 bp, Homo sapiens
attgtttacactaacttcataa

SEQ ID NO: 8514813 - DNA, 22 bp, Homo sapiens
gcattattaatagctgcatgag

SEQ ID NO: 8514814 - DNA, 22 bp, Homo sapiens
attgttcatgtatgaataaata

SEQ ID NO: 8514815 - DNA, 22 bp, Homo sapiens
attgttcagagtagggctctgt

SEQ ID NO: 8514816 - DNA, 22 bp, Homo sapiens
attgttcactgtgaatcttgat

SEQ ID NO: 8514817 - DNA, 22 bp, Homo sapiens
attgttatgaaaataagatgtt

SEQ ID NO: 8514818 - DNA, 22 bp, Homo sapiens
attgttcaaagtgctttgcatg

SEQ ID NO: 8514819 - DNA, 22 bp, Homo sapiens
attgttatgaaaataagatgtt

SEQ ID NO: 8514820 - DNA, 22 bp, Homo sapiens
attgttcaaagtgctttgcatg

SEQ ID NO: 8514821 - DNA, 22 bp, Homo sapiens
attgttcaatgtaataattttg

SEQ ID NO: 8514822 - DNA, 21 bp, Homo sapiens
attgttatcattgtgctgtgt

SEQ ID NO: 8514823 - DNA, 18 bp, Homo sapiens
attgttaatagagtactt

SEQ ID NO: 8514824 - DNA, 22 bp, Homo sapiens
attgttaatgttgcactaaggt

SEQ ID NO: 8514825 - DNA, 22 bp, Homo sapiens
attgttaatgttgcactaaggt

SEQ ID NO: 8514826 - DNA, 22 bp, Homo sapiens
attgttaatgttgcactaaggt

SEQ ID NO: 8514827 - DNA, 22 bp, Homo sapiens
attgttaatgttgcactaaggt

SEQ ID NO: 8514828 - DNA, 22 bp, Homo sapiens
attgtgcagaattggaattgca

SEQ ID NO: 8514829 - DNA, 22 bp, Homo sapiens
attgtgcagctctgctcttatt

SEQ ID NO: 8514830 - DNA, 21 bp, Homo sapiens
gcagtgcagcttggagggtag

SEQ ID NO: 8514831 - DNA, 22 bp, Homo sapiens
attgtacaatgcctggaacatt

SEQ ID NO: 8514832 - DNA, 22 bp, Homo sapiens
attgtacaatgcctggaacatt

SEQ ID NO: 8514833 - DNA, 22 bp, Homo sapiens
attgtacaatgcctggaacatt

SEQ ID NO: 8514834 - DNA, 22 bp, Homo sapiens
attgtacaatgctgaggtttgg

SEQ ID NO: 8514835 - DNA, 22 bp, Homo sapiens
attgtacaatgctgaggtttgg

SEQ ID NO: 8514836 - DNA, 22 bp, Homo sapiens
attgtacaatgctgaggtttgg

SEQ ID NO: 8514837 - DNA, 22 bp, Homo sapiens
attgtacactagtggcagcagt

SEQ ID NO: 8514838 - DNA, 22 bp, Homo sapiens
attgtacaactgagggtggaat

SEQ ID NO: 8514839 - DNA, 22 bp, Homo sapiens
attgtaattttagagaaagtgg

SEQ ID NO: 8514840 - DNA, 22 bp, Homo sapiens
attgtacaaaaaagtagacctt

SEQ ID NO: 8514841 - DNA, 22 bp, Homo sapiens
attgtacaatgcctggaacatt

SEQ ID NO: 8514842 - DNA, 22 bp, Homo sapiens
attgtacaatgcctggaacatt

SEQ ID NO: 8514843 - DNA, 22 bp, Homo sapiens
attgtacaatgcctggaacatt

SEQ ID NO: 8514844 - DNA, 22 bp, Homo sapiens
attgtaagaggtttggctgtgt

SEQ ID NO: 8514845 - DNA, 22 bp, Homo sapiens
attgtaacaacaatagtttagg

SEQ ID NO: 8514846 - DNA, 22 bp, Homo sapiens
attgtaacaggatccctgtggc

SEQ ID NO: 8514847 - DNA, 22 bp, Homo sapiens
attgtaagtagaaatgttatgg

SEQ ID NO: 8514848 - DNA, 18 bp, Homo sapiens
gcagtgccagcctctcct

SEQ ID NO: 8514849 - DNA, 22 bp, Homo sapiens
gcagtgccttgcttctctgtct

SEQ ID NO: 8514850 - DNA, 20 bp, Homo sapiens
gcagtgctggtgcctctgct

SEQ ID NO: 8514851 - DNA, 22 bp, Homo sapiens
gcagtgctgagaggtgatcgga

SEQ ID NO: 8514852 - DNA, 22 bp, Homo sapiens
gcagtgctgagaggtgatcgga

SEQ ID NO: 8514853 - DNA, 22 bp, Homo sapiens
gcaggattgggcagagggtgaa

SEQ ID NO: 8514854 - DNA, 22 bp, Homo sapiens
gcaggcgtgtttcacgtgccag

SEQ ID NO: 8514855 - DNA, 14 bp, Homo sapiens
gcaggcggatcact

SEQ ID NO: 8514856 - DNA, 22 bp, Homo sapiens
gcaggatggtgccctttctgcc

SEQ ID NO: 8514857 - DNA, 22 bp, Homo sapiens
gcaggatgggagcttcactctg

SEQ ID NO: 8514858 - DNA, 22 bp, Homo sapiens
gcaggatgggagcttcactttg

SEQ ID NO: 8514859 - DNA, 21 bp, Homo sapiens
gcaggatgcatcttggtgtct

SEQ ID NO: 8514860 - DNA, 22 bp, Homo sapiens
gcaggatgagtgagtacattta

SEQ ID NO: 8514861 - DNA, 18 bp, Homo sapiens
gcaggagatgggtggggt

SEQ ID NO: 8514862 - DNA, 18 bp, Homo sapiens
gcaggagatgggtggggt

SEQ ID NO: 8514863 - DNA, 22 bp, Homo sapiens
gcaggagcaaactgcagtgtgg

SEQ ID NO: 8514864 - DNA, 22 bp, Homo sapiens
gcaggagcagtcaggggcagct

SEQ ID NO: 8514865 - DNA, 22 bp, Homo sapiens
gcaggagcagtcaggggcagct

SEQ ID NO: 8514866 - DNA, 22 bp, Homo sapiens
gcaggagcagtcaggggcagct

SEQ ID NO: 8514867 - DNA, 22 bp, Homo sapiens
gcaggagcagtcaggggcagct

SEQ ID NO: 8514868 - DNA, 22 bp, Homo sapiens
gcaggagccacttcagggatgc

SEQ ID NO: 8514869 - DNA, 22 bp, Homo sapiens
gcaggatgaaggcagaggctga

SEQ ID NO: 8514870 - DNA, 22 bp, Homo sapiens
gcaggagccacttcagggatgc

SEQ ID NO: 8514871 - DNA, 22 bp, Homo sapiens
gcaggagccacttcagggatgc

SEQ ID NO: 8514872 - DNA, 23 bp, Homo sapiens
gcaggagttcctggactccagga

SEQ ID NO: 8514873 - DNA, 22 bp, Homo sapiens
gcaggctgtctaaagttagagt

SEQ ID NO: 8514874 - DNA, 22 bp, Homo sapiens
gcaggctggtctgaccatccct

SEQ ID NO: 8514875 - DNA, 22 bp, Homo sapiens
gcaggctgtagacaccaaacta

SEQ ID NO: 8514876 - DNA, 22 bp, Homo sapiens
gcaggctgtagacaccaaacta

SEQ ID NO: 8514877 - DNA, 22 bp, Homo sapiens
gcaggctggtctgaccatccct

SEQ ID NO: 8514878 - DNA, 22 bp, Homo sapiens
gcaggctgtgaggctcagatgg

SEQ ID NO: 8514879 - DNA, 22 bp, Homo sapiens
gcaggctgtgaggctcagatgg

SEQ ID NO: 8514880 - DNA, 22 bp, Homo sapiens
gcaggctgtctaaagttagagt

SEQ ID NO: 8514881 - DNA, 22 bp, Homo sapiens
gcaggctgtctaaagttagagt

SEQ ID NO: 8514882 - DNA, 22 bp, Homo sapiens
gcaggctgtgaggctcagatgg

SEQ ID NO: 8514883 - DNA, 22 bp, Homo sapiens
gcaggctgtgaggctcagatgg

SEQ ID NO: 8514884 - DNA, 22 bp, Homo sapiens
gcagggagggcctttcatgaca

SEQ ID NO: 8514885 - DNA, 22 bp, Homo sapiens
gcagggaggaagagatgcttcc

SEQ ID NO: 8514886 - DNA, 22 bp, Homo sapiens
gcaggctgtggtatgttgggca

SEQ ID NO: 8514887 - DNA, 22 bp, Homo sapiens
gcagggacgccagggacagcaa

SEQ ID NO: 8514888 - DNA, 22 bp, Homo sapiens
gcagggactgtgatctcacaga

SEQ ID NO: 8514889 - DNA, 22 bp, Homo sapiens
gcaggtggatcacctgaggtca

SEQ ID NO: 8514890 - DNA, 22 bp, Homo sapiens
gcaggtggatcacctgaggtca

SEQ ID NO: 8514891 - DNA, 22 bp, Homo sapiens
gcaggtggatcacctgaggtca

SEQ ID NO: 8514892 - DNA, 22 bp, Homo sapiens
gcagggtgaaggtcacatagaa

SEQ ID NO: 8514893 - DNA, 22 bp, Homo sapiens
gcagggtgaaggtcacatagaa

SEQ ID NO: 8514894 - DNA, 22 bp, Homo sapiens
gcaggtggatcaccacgtcagg

SEQ ID NO: 8514895 - DNA, 22 bp, Homo sapiens
attgtaaatagtgccacaataa

SEQ ID NO: 8514896 - DNA, 22 bp, Homo sapiens
attgtaaaagtattctaagatt

SEQ ID NO: 8514897 - DNA, 22 bp, Homo sapiens
attggtggtgaggacatgccag

SEQ ID NO: 8514898 - DNA, 22 bp, Homo sapiens
attggttaagacgcatcatgct

SEQ ID NO: 8514899 - DNA, 22 bp, Homo sapiens
attggttaccactttaaatctt

SEQ ID NO: 8514900 - DNA, 22 bp, Homo sapiens
attggcagggccagcatctccc

SEQ ID NO: 8514901 - DNA, 21 bp, Homo sapiens
gcagggtcctttccattccta

SEQ ID NO: 8514902 - DNA, 22 bp, Homo sapiens
gcagggtcgctctaggagatca

SEQ ID NO: 8514903 - DNA, 22 bp, Homo sapiens
gcagggtctgaggccacagagg

SEQ ID NO: 8514904 - DNA, 22 bp, Homo sapiens
gcagggtctgaggccacagagg

SEQ ID NO: 8514905 - DNA, 22 bp, Homo sapiens
gcagggtcttgagaggcagcca

SEQ ID NO: 8514906 - DNA, 22 bp, Homo sapiens
gcagggtcttgagaggcagcca

SEQ ID NO: 8514907 - DNA, 22 bp, Homo sapiens
gcagggtaggtgacaggtagtc

SEQ ID NO: 8514908 - DNA, 22 bp, Homo sapiens
gcagggtataatacttaggtga

SEQ ID NO: 8514909 - DNA, 22 bp, Homo sapiens
gcagggtacattgggatgggat

SEQ ID NO: 8514910 - DNA, 22 bp, Homo sapiens
gcaggggttttctgacttgagt

SEQ ID NO: 8514911 - DNA, 22 bp, Homo sapiens
gcagggtccatggaggcagccc

SEQ ID NO: 8514912 - DNA, 22 bp, Homo sapiens
gcagggtccatggaggcagccc

SEQ ID NO: 8514913 - DNA, 22 bp, Homo sapiens
gcagggaggtttgctgacctgg

SEQ ID NO: 8514914 - DNA, 22 bp, Homo sapiens
gcagggaggtttgctgacctgg

SEQ ID NO: 8514915 - DNA, 22 bp, Homo sapiens
gcagggatgctgaggctcagtg

SEQ ID NO: 8514916 - DNA, 22 bp, Homo sapiens
gcagggaggtttgctgacctgg

SEQ ID NO: 8514917 - DNA, 22 bp, Homo sapiens
gcagggaggtttgctgacctgg

SEQ ID NO: 8514918 - DNA, 22 bp, Homo sapiens
gcagggctgggatttgagccca

SEQ ID NO: 8514919 - DNA, 22 bp, Homo sapiens
gcagggattgtgcagggggcta

SEQ ID NO: 8514920 - DNA, 22 bp, Homo sapiens
gcagggctgggatttgagccca

SEQ ID NO: 8514921 - DNA, 22 bp, Homo sapiens
gcaggggtagtgtcttcctgag

SEQ ID NO: 8514922 - DNA, 22 bp, Homo sapiens
gcagaggctctttaatgcttag

SEQ ID NO: 8514923 - DNA, 22 bp, Homo sapiens
gcagaggctctttaatgcttag

SEQ ID NO: 8514924 - DNA, 22 bp, Homo sapiens
gcagaggctctttaatgcttag

SEQ ID NO: 8514925 - DNA, 22 bp, Homo sapiens
gcagaggctgggtgtcccagtc

SEQ ID NO: 8514926 - DNA, 22 bp, Homo sapiens
gcagaggctgggtgtcccagtc

SEQ ID NO: 8514927 - DNA, 22 bp, Homo sapiens
gcagaggctgtagggaaggttg

SEQ ID NO: 8514928 - DNA, 22 bp, Homo sapiens
gcagaggctgggtgtcccagtc

SEQ ID NO: 8514929 - DNA, 22 bp, Homo sapiens
gcagaggctgggtgtcccagtc

SEQ ID NO: 8514930 - DNA, 22 bp, Homo sapiens
gcagaggcctgaaggtggcggg

SEQ ID NO: 8514931 - DNA, 22 bp, Homo sapiens
gcagaggcctaggtggaaggcc

SEQ ID NO: 8514932 - DNA, 22 bp, Homo sapiens
gcagaggcctaggtggaaggcc

SEQ ID NO: 8514933 - DNA, 22 bp, Homo sapiens
gcagaggcctgaaggtggcggg

SEQ ID NO: 8514934 - DNA, 22 bp, Homo sapiens
gcagaggctccattttacagat

SEQ ID NO: 8514935 - DNA, 22 bp, Homo sapiens
gcagaggctccattttacagat

SEQ ID NO: 8514936 - DNA, 22 bp, Homo sapiens
gcagaggggaagctgaggaatt

SEQ ID NO: 8514937 - DNA, 22 bp, Homo sapiens
gcagaggggaagctgaggaatt

SEQ ID NO: 8514938 - DNA, 22 bp, Homo sapiens
gcagaggggaagctgaggaatt

SEQ ID NO: 8514939 - DNA, 22 bp, Homo sapiens
gcagaggctgtagggaaggttg

SEQ ID NO: 8514940 - DNA, 22 bp, Homo sapiens
gcagaggctgtagggaaggttg

SEQ ID NO: 8514941 - DNA, 22 bp, Homo sapiens
gcagatagggtattaggagtaa

SEQ ID NO: 8514942 - DNA, 19 bp, Homo sapiens
gcagatgatgaggctggtc

SEQ ID NO: 8514943 - DNA, 22 bp, Homo sapiens
gcagaggccatcaactttgcca

SEQ ID NO: 8514944 - DNA, 22 bp, Homo sapiens
gcagaggccatcaactttgcca

SEQ ID NO: 8514945 - DNA, 22 bp, Homo sapiens
gcagaggcctaggtggaaggcc

SEQ ID NO: 8514946 - DNA, 16 bp, Homo sapiens
gcagaggaaaggggag

SEQ ID NO: 8514947 - DNA, 22 bp, Homo sapiens
gcagaatgtaggccttcagtgt

SEQ ID NO: 8514948 - DNA, 22 bp, Homo sapiens
gcagaatactgagagctgattg

SEQ ID NO: 8514949 - DNA, 22 bp, Homo sapiens
gcagaagtcagaccatctgaat

SEQ ID NO: 8514950 - DNA, 22 bp, Homo sapiens
gcagaaggtctggcacttcagg

SEQ ID NO: 8514951 - DNA, 22 bp, Homo sapiens
gcagaagggaataaggagcttt

SEQ ID NO: 8514952 - DNA, 22 bp, Homo sapiens
gcagaagggaataaggagcttt

SEQ ID NO: 8514953 - DNA, 22 bp, Homo sapiens
gcactgtgacccagagcaggtg

SEQ ID NO: 8514954 - DNA, 22 bp, Homo sapiens
gcagccaggaagcctttccctc

SEQ ID NO: 8514955 - DNA, 22 bp, Homo sapiens
gcagccaggaagcccaggacac

SEQ ID NO: 8514956 - DNA, 22 bp, Homo sapiens
gcagccaggaagcccaggacac

SEQ ID NO: 8514957 - DNA, 22 bp, Homo sapiens
gcagatgctgctcctctctaga

SEQ ID NO: 8514958 - DNA, 22 bp, Homo sapiens
gcagatgctgagatttatttct

SEQ ID NO: 8514959 - DNA, 22 bp, Homo sapiens
gcagatgccagatcatgcaggg

SEQ ID NO: 8514960 - DNA, 22 bp, Homo sapiens
gcagatgccagatcatgcaggg

SEQ ID NO: 8514961 - DNA, 19 bp, Homo sapiens
gcagatgatgaggctggtc

SEQ ID NO: 8514962 - DNA, 19 bp, Homo sapiens
gcagatgatgaggctggtc

SEQ ID NO: 8514963 - DNA, 22 bp, Homo sapiens
gcagatgcaactgcaggtgagt

SEQ ID NO: 8514964 - DNA, 19 bp, Homo sapiens
gcagccaggtgctctacct

SEQ ID NO: 8514965 - DNA, 19 bp, Homo sapiens
gcagccaggtgctctacct

SEQ ID NO: 8514966 - DNA, 22 bp, Homo sapiens
gcagccaggtttgaggaccact

SEQ ID NO: 8514967 - DNA, 22 bp, Homo sapiens
gcagccaggggctgtgacctgt

SEQ ID NO: 8514968 - DNA, 22 bp, Homo sapiens
gcagccagggagagaaccaggg

SEQ ID NO: 8514969 - DNA, 22 bp, Homo sapiens
gcagccagggagagaaccaggg

SEQ ID NO: 8514970 - DNA, 22 bp, Homo sapiens
gcagccagggagagaaccaggg

SEQ ID NO: 8514971 - DNA, 22 bp, Homo sapiens
gcagccaggctacagcgggctt

SEQ ID NO: 8514972 - DNA, 22 bp, Homo sapiens
gcagccaggtttgaggaccact

SEQ ID NO: 8514973 - DNA, 17 bp, Homo sapiens
gcagcctcttggtagtg

SEQ ID NO: 8514974 - DNA, 17 bp, Homo sapiens
gcagcctcttggtagtg

SEQ ID NO: 8514975 - DNA, 22 bp, Homo sapiens
gcagcctgatgatctgggttgt

SEQ ID NO: 8514976 - DNA, 22 bp, Homo sapiens
gcagcctgaggccctttctggc

SEQ ID NO: 8514977 - DNA, 22 bp, Homo sapiens
gcagcctgatgatctgggttgt

SEQ ID NO: 8514978 - DNA, 22 bp, Homo sapiens
gcagcctgatgatctgggttgt

SEQ ID NO: 8514979 - DNA, 22 bp, Homo sapiens
gcagcctgttgtaccagcctgt

SEQ ID NO: 8514980 - DNA, 22 bp, Homo sapiens
gcagcctgttgtaccagcctgt

SEQ ID NO: 8514981 - DNA, 22 bp, Homo sapiens
gcagcctgttgtaccagcctgt

SEQ ID NO: 8514982 - DNA, 22 bp, Homo sapiens
gcagcctgggcaacagagtgag

SEQ ID NO: 8514983 - DNA, 22 bp, Homo sapiens
gcagcctgggcaacagagtgag

SEQ ID NO: 8514984 - DNA, 22 bp, Homo sapiens
gcagcctgggcaacagagtgag

SEQ ID NO: 8514985 - DNA, 22 bp, Homo sapiens
gcagcctgggcaacagagtgag

SEQ ID NO: 8514986 - DNA, 22 bp, Homo sapiens
gcagcctgggcaacagagtgag

SEQ ID NO: 8514987 - DNA, 22 bp, Homo sapiens
gcagcctgggcaacagagtgag

SEQ ID NO: 8514988 - DNA, 22 bp, Homo sapiens
gcaggagagtctgtgccaggtt

SEQ ID NO: 8514989 - DNA, 22 bp, Homo sapiens
gcaggagagtctgtgccaggtt

SEQ ID NO: 8514990 - DNA, 18 bp, Homo sapiens
gcaggagatgggtggggt

SEQ ID NO: 8514991 - DNA, 18 bp, Homo sapiens
gcaggagatgggtggggt

SEQ ID NO: 8514992 - DNA, 22 bp, Homo sapiens
gcaggagagtctgtgccaggtt

SEQ ID NO: 8514993 - DNA, 22 bp, Homo sapiens
gcaaaaaccacaattacttttg

SEQ ID NO: 8514994 - DNA, 22 bp, Homo sapiens
gcaaaaaccacaattacttttg

SEQ ID NO: 8514995 - DNA, 22 bp, Homo sapiens
gcaaaaactgcaattacttttg

SEQ ID NO: 8514996 - DNA, 22 bp, Homo sapiens
gcaaaaactgcaattacttttg

SEQ ID NO: 8514997 - DNA, 22 bp, Homo sapiens
gcaaaaaccacaattactttta

SEQ ID NO: 8514998 - DNA, 22 bp, Homo sapiens
gcaaaaaccacaattactttta

SEQ ID NO: 8514999 - DNA, 22 bp, Homo sapiens
gcaaaaaatgcttgttgcttag

SEQ ID NO: 8515000 - DNA, 22 bp, Homo sapiens
gatttctgtaacacttcagata

SEQ ID NO: 8515001 - DNA, 22 bp, Homo sapiens
atgtttctagttgtatgtcact

SEQ ID NO: 8515002 - DNA, 22 bp, Homo sapiens
gatttctgggctttatttcaga

SEQ ID NO: 8515003 - DNA, 22 bp, Homo sapiens
atgtttctagttgtatgtcact

SEQ ID NO: 8515004 - DNA, 22 bp, Homo sapiens
atgtttctacagcgtccactga

SEQ ID NO: 8515005 - DNA, 22 bp, Homo sapiens
atgtttctaaaacttgcatggc

SEQ ID NO: 8515006 - DNA, 22 bp, Homo sapiens
gcaaaaattccagggacgactc

SEQ ID NO: 8515007 - DNA, 22 bp, Homo sapiens
gcaaaatttacactccttcttc

SEQ ID NO: 8515008 - DNA, 22 bp, Homo sapiens
gcaaacaagctgcctgaagatt

SEQ ID NO: 8515009 - DNA, 22 bp, Homo sapiens
gcaaacaagctgcctgaagatt

SEQ ID NO: 8515010 - DNA, 22 bp, Homo sapiens
gcaaaattaaacttagcatcat

SEQ ID NO: 8515011 - DNA, 22 bp, Homo sapiens
gcaaaattaaacttagcatcat

SEQ ID NO: 8515012 - DNA, 22 bp, Homo sapiens
gcaaaagtacagccggatttct

SEQ ID NO: 8515013 - DNA, 20 bp, Homo sapiens
gcaaaataggctctgttggt

SEQ ID NO: 8515014 - DNA, 20 bp, Homo sapiens
gcaaaataggctctgttggt

SEQ ID NO: 8515015 - DNA, 22 bp, Homo sapiens
gcaacacagatcttctttgttg

SEQ ID NO: 8515016 - DNA, 22 bp, Homo sapiens
gcaacacagatcttctttgttg

SEQ ID NO: 8515017 - DNA, 22 bp, Homo sapiens
gcaaacaagctgcctgaagatt

SEQ ID NO: 8515018 - DNA, 22 bp, Homo sapiens
gcaaacaaggacatacatcctg

SEQ ID NO: 8515019 - DNA, 22 bp, Homo sapiens
gcaaacaaggacatacatcctg

SEQ ID NO: 8515020 - DNA, 22 bp, Homo sapiens
gcaaacaaggacatacatcctg

SEQ ID NO: 8515021 - DNA, 22 bp, Homo sapiens
gcaaatggagtgaagagctgga

SEQ ID NO: 8515022 - DNA, 22 bp, Homo sapiens
gcaaatgctctccttggtcagg

SEQ ID NO: 8515023 - DNA, 22 bp, Homo sapiens
gcaaatgtggcttcctttctag

SEQ ID NO: 8515024 - DNA, 21 bp, Homo sapiens
gcaaccagaccacagggcagt

SEQ ID NO: 8515025 - DNA, 22 bp, Homo sapiens
gcacacaggggagttctcagaa

SEQ ID NO: 8515026 - DNA, 22 bp, Homo sapiens
gcaactgtgatttgttatcttg

SEQ ID NO: 8515027 - DNA, 22 bp, Homo sapiens
gcacaggctgttggccttcaga

SEQ ID NO: 8515028 - DNA, 21 bp, Homo sapiens
gcacagggacagatcatcaca

SEQ ID NO: 8515029 - DNA, 22 bp, Homo sapiens
gcacagggagacagccgtggcc

SEQ ID NO: 8515030 - DNA, 22 bp, Homo sapiens
gcacagggagacagccgtggcc

SEQ ID NO: 8515031 - DNA, 22 bp, Homo sapiens
gcacagggagcaggtctctggt

SEQ ID NO: 8515032 - DNA, 22 bp, Homo sapiens
gcacagggagcaggtctctggt

SEQ ID NO: 8515033 - DNA, 22 bp, Homo sapiens
gcacagggagcaggtctctggt

SEQ ID NO: 8515034 - DNA, 22 bp, Homo sapiens
gcacagaggatgaggcagctct

SEQ ID NO: 8515035 - DNA, 22 bp, Homo sapiens
gcacagaggatgaggcagctct

SEQ ID NO: 8515036 - DNA, 22 bp, Homo sapiens
gcacagaggatgaggcagctct

SEQ ID NO: 8515037 - DNA, 22 bp, Homo sapiens
gcacaggctgttggccttcaga

SEQ ID NO: 8515038 - DNA, 23 bp, Homo sapiens
gcacagagcagttaggggaagat

SEQ ID NO: 8515039 - DNA, 23 bp, Homo sapiens
gcacagagcagttaggggaagat

SEQ ID NO: 8515040 - DNA, 20 bp, Homo sapiens
gcacagagatgagcaaagta

SEQ ID NO: 8515041 - DNA, 20 bp, Homo sapiens
gcacagagatgagcaaagta

SEQ ID NO: 8515042 - DNA, 18 bp, Homo sapiens
gcacagagcccaggctct

SEQ ID NO: 8515043 - DNA, 18 bp, Homo sapiens
gcacagagcccaggctct

SEQ ID NO: 8515044 - DNA, 23 bp, Homo sapiens
gcacagagcagttaggggaagat

SEQ ID NO: 8515045 - DNA, 22 bp, Homo sapiens
gcacagagctggccctccaggc

SEQ ID NO: 8515046 - DNA, 22 bp, Homo sapiens
gcacagaggaagcacagactct

SEQ ID NO: 8515047 - DNA, 22 bp, Homo sapiens
gcacagagcttgtttacatttg

SEQ ID NO: 8515048 - DNA, 22 bp, Homo sapiens
gcacagaggaagcacagactct

SEQ ID NO: 8515049 - DNA, 22 bp, Homo sapiens
gcacagagcctggtaccgagaa

SEQ ID NO: 8515050 - DNA, 22 bp, Homo sapiens
gcacagagcctggtaccgagaa

SEQ ID NO: 8515051 - DNA, 22 bp, Homo sapiens
gcacagagcctggtaccgagaa

SEQ ID NO: 8515052 - DNA, 22 bp, Homo sapiens
gcacagagctggccctccaggc

SEQ ID NO: 8515053 - DNA, 21 bp, Homo sapiens
gcactcagtcactactcaaga

SEQ ID NO: 8515054 - DNA, 22 bp, Homo sapiens
gcactcaggactctcatcagta

SEQ ID NO: 8515055 - DNA, 22 bp, Homo sapiens
gcactcaggactctcatcagta

SEQ ID NO: 8515056 - DNA, 22 bp, Homo sapiens
gcacagggccctgtgcgtaggt

SEQ ID NO: 8515057 - DNA, 22 bp, Homo sapiens
gcacagggaggctggcctggcc

SEQ ID NO: 8515058 - DNA, 22 bp, Homo sapiens
gcacagggaggctggcctggcc

SEQ ID NO: 8515059 - DNA, 22 bp, Homo sapiens
gcacagggagcaggtctctggt

SEQ ID NO: 8515060 - DNA, 22 bp, Homo sapiens
gcacagggagcaggtctctggt

SEQ ID NO: 8515061 - DNA, 22 bp, Homo sapiens
gcacagggcaacaggtctgtta

SEQ ID NO: 8515062 - DNA, 22 bp, Homo sapiens
gcacagggcaacaggtctgtta

SEQ ID NO: 8515063 - DNA, 22 bp, Homo sapiens
gcacagggcaacaggtctgtta

SEQ ID NO: 8515064 - DNA, 22 bp, Homo sapiens
gcacagggcaacaggtctgtta

SEQ ID NO: 8515065 - DNA, 22 bp, Homo sapiens
gcactgggtgtgaggcagcgtc

SEQ ID NO: 8515066 - DNA, 22 bp, Homo sapiens
gcactgggtgtgaggcagcgtc

SEQ ID NO: 8515067 - DNA, 22 bp, Homo sapiens
gcactgggtgggagatctgaat

SEQ ID NO: 8515068 - DNA, 22 bp, Homo sapiens
gcactgtgacccagagcaggtg

SEQ ID NO: 8515069 - DNA, 22 bp, Homo sapiens
gcactgtagtgggggagaaatg

SEQ ID NO: 8515070 - DNA, 22 bp, Homo sapiens
atgtaacacccacttttatagc

SEQ ID NO: 8515071 - DNA, 22 bp, Homo sapiens
atgtaacaaatggtatacatgt

SEQ ID NO: 8515072 - DNA, 22 bp, Homo sapiens
atgtaacaaatggtatacatgt

SEQ ID NO: 8515073 - DNA, 22 bp, Homo sapiens
atgtaacaggtgaagctctgag

SEQ ID NO: 8515074 - DNA, 22 bp, Homo sapiens
atgtaacacccacttttatagc

SEQ ID NO: 8515075 - DNA, 22 bp, Homo sapiens
atgtaacattgaattatatagt

SEQ ID NO: 8515076 - DNA, 22 bp, Homo sapiens
atgtaacattgaattatatagt

SEQ ID NO: 8515077 - DNA, 22 bp, Homo sapiens
atgtaacatatgtgatcgcatt

SEQ ID NO: 8515078 - DNA, 22 bp, Homo sapiens
atgtaactgaaggaaatgcatg

SEQ ID NO: 8515079 - DNA, 22 bp, Homo sapiens
atgtaacattgaattatatagt

SEQ ID NO: 8515080 - DNA, 22 bp, Homo sapiens
atgtaacattgaattatatagt

SEQ ID NO: 8515081 - DNA, 22 bp, Homo sapiens
atgtaacattgaattatatagt

SEQ ID NO: 8515082 - DNA, 22 bp, Homo sapiens
atgtaacaaatggtatacatgt

SEQ ID NO: 8515083 - DNA, 22 bp, Homo sapiens
atgtaacaaatggtatacatgt

SEQ ID NO: 8515084 - DNA, 22 bp, Homo sapiens
atgtaacaaatggtatacatgt

SEQ ID NO: 8515085 - DNA, 22 bp, Homo sapiens
atgtaacaaatggtatacatgt

SEQ ID NO: 8515086 - DNA, 22 bp, Homo sapiens
atgtaatagggtaacataacat

SEQ ID NO: 8515087 - DNA, 22 bp, Homo sapiens
atgtaatttatgttatccataa

SEQ ID NO: 8515088 - DNA, 22 bp, Homo sapiens
atgtaactgttatattttgttg

SEQ ID NO: 8515089 - DNA, 22 bp, Homo sapiens
atgtaactgttatattttgttg

SEQ ID NO: 8515090 - DNA, 22 bp, Homo sapiens
atgtaacttcctcagggatggt

SEQ ID NO: 8515091 - DNA, 22 bp, Homo sapiens
atgtaacttctgtgaatctgac

SEQ ID NO: 8515092 - DNA, 22 bp, Homo sapiens
atgtaacttctgtgaatctgac

SEQ ID NO: 8515093 - DNA, 22 bp, Homo sapiens
atgtaagactttaagaacctaa

SEQ ID NO: 8515094 - DNA, 22 bp, Homo sapiens
atgtaagtattcaaaatatttc

SEQ ID NO: 8515095 - DNA, 22 bp, Homo sapiens
atgtaagtttaagcacaacaag

SEQ ID NO: 8515096 - DNA, 22 bp, Homo sapiens
atgtcacagctcccattcctcc

SEQ ID NO: 8515097 - DNA, 22 bp, Homo sapiens
atgtcacaggcaacaagattgc

SEQ ID NO: 8515098 - DNA, 22 bp, Homo sapiens
atgtcacagcaggagtattctt

SEQ ID NO: 8515099 - DNA, 22 bp, Homo sapiens
atgtcacagtctgactcagtga

SEQ ID NO: 8515100 - DNA, 22 bp, Homo sapiens
atgtcaacaggcctttaaacat

SEQ ID NO: 8515101 - DNA, 22 bp, Homo sapiens
atgtacaatctatcacaagaag

SEQ ID NO: 8515102 - DNA, 22 bp, Homo sapiens
atgtatttctatgtagtgaaga

SEQ ID NO: 8515103 - DNA, 21 bp, Homo sapiens
atgtcaaatgctttattttat

SEQ ID NO: 8515104 - DNA, 22 bp, Homo sapiens
atgtacaacctgcatgacagtc

SEQ ID NO: 8515105 - DNA, 22 bp, Homo sapiens
atgtacaacctgcatgacagtc

SEQ ID NO: 8515106 - DNA, 22 bp, Homo sapiens
atgtacaagctgttttactgca

SEQ ID NO: 8515107 - DNA, 22 bp, Homo sapiens
atgtacaatctatcacaagaag

SEQ ID NO: 8515108 - DNA, 22 bp, Homo sapiens
atgtacaatctatcacaagaag

SEQ ID NO: 8515109 - DNA, 22 bp, Homo sapiens
atgtacaacctgcatgacagtc

SEQ ID NO: 8515110 - DNA, 22 bp, Homo sapiens
atgtacaacctgcatgacagtc

SEQ ID NO: 8515111 - DNA, 22 bp, Homo sapiens
atgtacaaaatgttttgaaatg

SEQ ID NO: 8515112 - DNA, 22 bp, Homo sapiens
atgtacaaaatgttttgaaatg

SEQ ID NO: 8515113 - DNA, 22 bp, Homo sapiens
atgtacaaaatgccactgaatt

SEQ ID NO: 8515114 - DNA, 22 bp, Homo sapiens
atgtacaaaatgccactgaatt

SEQ ID NO: 8515115 - DNA, 22 bp, Homo sapiens
gaggaagcagggcttggctgag

SEQ ID NO: 8515116 - DNA, 22 bp, Homo sapiens
gagctttgctggaagcctgggg

SEQ ID NO: 8515117 - DNA, 22 bp, Homo sapiens
gagctttgctggaagcctgggg

SEQ ID NO: 8515118 - DNA, 22 bp, Homo sapiens
atggtttaagggagaatattga

SEQ ID NO: 8515119 - DNA, 22 bp, Homo sapiens
gaggaaggctaaggggcttaga

SEQ ID NO: 8515120 - DNA, 22 bp, Homo sapiens
gaggaaggatttagtttgaggg

SEQ ID NO: 8515121 - DNA, 22 bp, Homo sapiens
gaggaaggaatgcagtgtatgc

SEQ ID NO: 8515122 - DNA, 22 bp, Homo sapiens
gaggaaggagggaaagcgcgcg

SEQ ID NO: 8515123 - DNA, 22 bp, Homo sapiens
gaggaaggagggaaagcgcgcg

SEQ ID NO: 8515124 - DNA, 22 bp, Homo sapiens
gaggaaggagggaaagcgcgcg

SEQ ID NO: 8515125 - DNA, 22 bp, Homo sapiens
gagctctgcttgggttcttagg

SEQ ID NO: 8515126 - DNA, 22 bp, Homo sapiens
gagctctgcggaaaacgtgccg

SEQ ID NO: 8515127 - DNA, 22 bp, Homo sapiens
gagctctggcagggcaggtctg

SEQ ID NO: 8515128 - DNA, 22 bp, Homo sapiens
gagctctggttcatgatctatt

SEQ ID NO: 8515129 - DNA, 22 bp, Homo sapiens
gagctctgggaaacaaagtgta

SEQ ID NO: 8515130 - DNA, 22 bp, Homo sapiens
gagctctgtccacacttggaga

SEQ ID NO: 8515131 - DNA, 22 bp, Homo sapiens
gagctggggcggatactcagct

SEQ ID NO: 8515132 - DNA, 22 bp, Homo sapiens
gagcttggtgcacagtggttaa

SEQ ID NO: 8515133 - DNA, 22 bp, Homo sapiens
gagcttggtgatgcctcctggt

SEQ ID NO: 8515134 - DNA, 22 bp, Homo sapiens
gagctttaccttaggttctgtt

SEQ ID NO: 8515135 - DNA, 22 bp, Homo sapiens
gagcctggattgtcaccgactt

SEQ ID NO: 8515136 - DNA, 22 bp, Homo sapiens
gagcagtgaagacagaagtaca

SEQ ID NO: 8515137 - DNA, 22 bp, Homo sapiens
gagcagtgaagacagaagtaca

SEQ ID NO: 8515138 - DNA, 22 bp, Homo sapiens
gagcagtaggagaaccctgagc

SEQ ID NO: 8515139 - DNA, 22 bp, Homo sapiens
gagcaggtgcctgtagctctct

SEQ ID NO: 8515140 - DNA, 22 bp, Homo sapiens
gagcaggtctttcatggtgcat

SEQ ID NO: 8515141 - DNA, 22 bp, Homo sapiens
gagcaggtctttcatggtgcat

SEQ ID NO: 8515142 - DNA, 17 bp, Homo sapiens
gagcagggatgcggttc

SEQ ID NO: 8515143 - DNA, 17 bp, Homo sapiens
gagcagggatgcggttc

SEQ ID NO: 8515144 - DNA, 22 bp, Homo sapiens
gagcagggccacttctgtacct

SEQ ID NO: 8515145 - DNA, 22 bp, Homo sapiens
gagcagctctgtgcctggagac

SEQ ID NO: 8515146 - DNA, 22 bp, Homo sapiens
gagcagctctgtgcctggagac

SEQ ID NO: 8515147 - DNA, 22 bp, Homo sapiens
gagcagctgagctggaatgaga

SEQ ID NO: 8515148 - DNA, 22 bp, Homo sapiens
gagcagctgagctggaatgaga

SEQ ID NO: 8515149 - DNA, 22 bp, Homo sapiens
gagcagctgagctggaatgaga

SEQ ID NO: 8515150 - DNA, 22 bp, Homo sapiens
gagcagggagacaactctggtg

SEQ ID NO: 8515151 - DNA, 22 bp, Homo sapiens
gagcagggagacaactctggtg

SEQ ID NO: 8515152 - DNA, 22 bp, Homo sapiens
gagcagggagacaactctggtg

SEQ ID NO: 8515153 - DNA, 22 bp, Homo sapiens
gagcagggagacaactctggtg

SEQ ID NO: 8515154 - DNA, 17 bp, Homo sapiens
gagcagggatgcggttc

SEQ ID NO: 8515155 - DNA, 22 bp, Homo sapiens
gagcctggcctcctgcctcagc

SEQ ID NO: 8515156 - DNA, 22 bp, Homo sapiens
gagcctggcctcctgcctcagc

SEQ ID NO: 8515157 - DNA, 22 bp, Homo sapiens
gagcctggcctcctgcctcagc

SEQ ID NO: 8515158 - DNA, 22 bp, Homo sapiens
gagcctgggactgggggtcatg

SEQ ID NO: 8515159 - DNA, 20 bp, Homo sapiens
gagcctgggaagtctaaggt

SEQ ID NO: 8515160 - DNA, 20 bp, Homo sapiens
gagcctgggaagtctaaggt

SEQ ID NO: 8515161 - DNA, 22 bp, Homo sapiens
gagcctggggaccctcctgagt

SEQ ID NO: 8515162 - DNA, 22 bp, Homo sapiens
gagcctggggaccctcctgagt

SEQ ID NO: 8515163 - DNA, 22 bp, Homo sapiens
gagcctgggtccttccctggga

SEQ ID NO: 8515164 - DNA, 22 bp, Homo sapiens
gagcctgggtccttccctggga

SEQ ID NO: 8515165 - DNA, 18 bp, Homo sapiens
gagctctgcctcccagtc

SEQ ID NO: 8515166 - DNA, 18 bp, Homo sapiens
gagctctgcctcccagtc

SEQ ID NO: 8515167 - DNA, 22 bp, Homo sapiens
gagctctgccatggctcccacc

SEQ ID NO: 8515168 - DNA, 22 bp, Homo sapiens
gagcgattgcgggggtcagagg

SEQ ID NO: 8515169 - DNA, 19 bp, Homo sapiens
gagcgcagagggcagggga

SEQ ID NO: 8515170 - DNA, 22 bp, Homo sapiens
gagcctgtgagccccaactcca

SEQ ID NO: 8515171 - DNA, 22 bp, Homo sapiens
gagcctgtgtttcctgtagcca

SEQ ID NO: 8515172 - DNA, 22 bp, Homo sapiens
gagcctgtgtttcctgtagcca

SEQ ID NO: 8515173 - DNA, 22 bp, Homo sapiens
gagcctgggtccttccctggga

SEQ ID NO: 8515174 - DNA, 22 bp, Homo sapiens
gagccttcatcgcagccttgtt

SEQ ID NO: 8515175 - DNA, 20 bp, Homo sapiens
gagccttcccctcaccactg

SEQ ID NO: 8515176 - DNA, 21 bp, Homo sapiens
gagccttccctctgccctttc

SEQ ID NO: 8515177 - DNA, 22 bp, Homo sapiens
atgctttttaaacttaattgga

SEQ ID NO: 8515178 - DNA, 22 bp, Homo sapiens
atgcttttcctaaaatgatgcc

SEQ ID NO: 8515179 - DNA, 21 bp, Homo sapiens
atggaaaaacaggtagagcat

SEQ ID NO: 8515180 - DNA, 21 bp, Homo sapiens
atggaaaaacaggtagagcat

SEQ ID NO: 8515181 - DNA, 22 bp, Homo sapiens
gagaggctctgaggactggggt

SEQ ID NO: 8515182 - DNA, 22 bp, Homo sapiens
gagaggctctgaggactggggt

SEQ ID NO: 8515183 - DNA, 22 bp, Homo sapiens
gagaggctctgaggactggggt

SEQ ID NO: 8515184 - DNA, 22 bp, Homo sapiens
gagaggctccatgaccccggca

SEQ ID NO: 8515185 - DNA, 22 bp, Homo sapiens
gagaggctccgccactgctcag

SEQ ID NO: 8515186 - DNA, 22 bp, Homo sapiens
gagaggctggcagtgccaggtt

SEQ ID NO: 8515187 - DNA, 22 bp, Homo sapiens
gagaggctgcatatgcacactg

SEQ ID NO: 8515188 - DNA, 22 bp, Homo sapiens
gagaggctggcagtgccaggtt

SEQ ID NO: 8515189 - DNA, 22 bp, Homo sapiens
gagaggtcggggacactgcaaa

SEQ ID NO: 8515190 - DNA, 22 bp, Homo sapiens
gagaggtccattcccctgtcag

SEQ ID NO: 8515191 - DNA, 22 bp, Homo sapiens
gagaggtagcagtaagaacagg

SEQ ID NO: 8515192 - DNA, 22 bp, Homo sapiens
gagaggtagcagtaagaacagg

SEQ ID NO: 8515193 - DNA, 22 bp, Homo sapiens
gagaggctggcagtgccaggtt

SEQ ID NO: 8515194 - DNA, 22 bp, Homo sapiens
gagaggctgactggctgtcctg

SEQ ID NO: 8515195 - DNA, 22 bp, Homo sapiens
gagaggctgatcctgcagagaa

SEQ ID NO: 8515196 - DNA, 22 bp, Homo sapiens
gagaggctgaaatcacaggagc

SEQ ID NO: 8515197 - DNA, 22 bp, Homo sapiens
gagaggctctgaggactggggt

SEQ ID NO: 8515198 - DNA, 22 bp, Homo sapiens
gagaggctgaaatcacaggagc

SEQ ID NO: 8515199 - DNA, 22 bp, Homo sapiens
gagaggctgaaatcacaggagc

SEQ ID NO: 8515200 - DNA, 22 bp, Homo sapiens
gagaggctgactggctgtcctg

SEQ ID NO: 8515201 - DNA, 22 bp, Homo sapiens
gagcacagtaaagcagtgtcac

SEQ ID NO: 8515202 - DNA, 22 bp, Homo sapiens
gagcacagggaatagacagata

SEQ ID NO: 8515203 - DNA, 22 bp, Homo sapiens
gagcacagggaatagacagata

SEQ ID NO: 8515204 - DNA, 22 bp, Homo sapiens
gagcagctagataaagcccttc

SEQ ID NO: 8515205 - DNA, 22 bp, Homo sapiens
gagcagctcgagaaggaagcag

SEQ ID NO: 8515206 - DNA, 22 bp, Homo sapiens
gagaggtggaggttgcagtgag

SEQ ID NO: 8515207 - DNA, 22 bp, Homo sapiens
gagaggtggaggttgcagtgag

SEQ ID NO: 8515208 - DNA, 22 bp, Homo sapiens
gagaggtggaggttgcagtgag

SEQ ID NO: 8515209 - DNA, 22 bp, Homo sapiens
gagaggtgtgtttcagataaga

SEQ ID NO: 8515210 - DNA, 22 bp, Homo sapiens
gagaggtgtgtttcagataaga

SEQ ID NO: 8515211 - DNA, 22 bp, Homo sapiens
gagaggtgaaggctgccctggg

SEQ ID NO: 8515212 - DNA, 22 bp, Homo sapiens
gagaggtgaatgtggatgccac

SEQ ID NO: 8515213 - DNA, 22 bp, Homo sapiens
gagaggtgaatgtggatgccac

SEQ ID NO: 8515214 - DNA, 22 bp, Homo sapiens
gagaggtgaatgtggatgccac

SEQ ID NO: 8515215 - DNA, 22 bp, Homo sapiens
gagaggtgaaatagttgtccgg

SEQ ID NO: 8515216 - DNA, 22 bp, Homo sapiens
gagaggtgaaggctgccctggg

SEQ ID NO: 8515217 - DNA, 22 bp, Homo sapiens
gagtccaggctcagaaacccgt

SEQ ID NO: 8515218 - DNA, 22 bp, Homo sapiens
gagtccagcagaatgagccaag

SEQ ID NO: 8515219 - DNA, 22 bp, Homo sapiens
gaggttggtgaggggacacggt

SEQ ID NO: 8515220 - DNA, 22 bp, Homo sapiens
gagtccagctcattgtctggga

SEQ ID NO: 8515221 - DNA, 22 bp, Homo sapiens
gaggttggggctgcagtgagct

SEQ ID NO: 8515222 - DNA, 22 bp, Homo sapiens
gaggttggggctgcagtgagct

SEQ ID NO: 8515223 - DNA, 22 bp, Homo sapiens
gaggttgggatgagggatacag

SEQ ID NO: 8515224 - DNA, 22 bp, Homo sapiens
gagggggtctatgaggtagagc

SEQ ID NO: 8515225 - DNA, 22 bp, Homo sapiens
gaggtacagagtgttccaatgt

SEQ ID NO: 8515226 - DNA, 22 bp, Homo sapiens
gaggtacagagtgttccaatgt

SEQ ID NO: 8515227 - DNA, 23 bp, Homo sapiens
gaggtacagcaccagtgaatagg

SEQ ID NO: 8515228 - DNA, 22 bp, Homo sapiens
gaggtacatgaggatacacagg

SEQ ID NO: 8515229 - DNA, 23 bp, Homo sapiens
gaggtacagcaccagtgaatagg

SEQ ID NO: 8515230 - DNA, 22 bp, Homo sapiens
gaggtacatgaggatacacagg

SEQ ID NO: 8515231 - DNA, 18 bp, Homo sapiens
gaggtagataagattttc

SEQ ID NO: 8515232 - DNA, 22 bp, Homo sapiens
gaggtagcgagtggacagtgca

SEQ ID NO: 8515233 - DNA, 22 bp, Homo sapiens
gaggtagccacagatagagact

SEQ ID NO: 8515234 - DNA, 22 bp, Homo sapiens
gaggtagcatgctggaagggac

SEQ ID NO: 8515235 - DNA, 22 bp, Homo sapiens
gaggtagccacagatagagact

SEQ ID NO: 8515236 - DNA, 17 bp, Homo sapiens
gaggtaggaagtgagtc

SEQ ID NO: 8515237 - DNA, 17 bp, Homo sapiens
gaggtaggaagtgagtc

SEQ ID NO: 8515238 - DNA, 22 bp, Homo sapiens
gagggggtctatgaggtagagc

SEQ ID NO: 8515239 - DNA, 22 bp, Homo sapiens
gagggggtctatgaggtagagc

SEQ ID NO: 8515240 - DNA, 22 bp, Homo sapiens
gagggggtctatgaggtagagc

SEQ ID NO: 8515241 - DNA, 22 bp, Homo sapiens
gaggggggcgccctgcagtgca

SEQ ID NO: 8515242 - DNA, 22 bp, Homo sapiens
gagggggctctgccaacctgtc

SEQ ID NO: 8515243 - DNA, 22 bp, Homo sapiens
gagggggctccctgaagccagt

SEQ ID NO: 8515244 - DNA, 22 bp, Homo sapiens
gaggggggcgccctgcagtgca

SEQ ID NO: 8515245 - DNA, 22 bp, Homo sapiens
gagggggctctgccaacctgtc

SEQ ID NO: 8515246 - DNA, 22 bp, Homo sapiens
gagggggctccctgaagccagt

SEQ ID NO: 8515247 - DNA, 22 bp, Homo sapiens
gagggggctccctgaagccagt

SEQ ID NO: 8515248 - DNA, 22 bp, Homo sapiens
gagggggctagcgcagtgccca

SEQ ID NO: 8515249 - DNA, 22 bp, Homo sapiens
gagggggctagcgcagtgccca

SEQ ID NO: 8515250 - DNA, 22 bp, Homo sapiens
gagggggcgtgcaaggctccgc

SEQ ID NO: 8515251 - DNA, 22 bp, Homo sapiens
gagggggcgtgcaaggctccgc

SEQ ID NO: 8515252 - DNA, 22 bp, Homo sapiens
gagggggcgtgcaaggctccgc

SEQ ID NO: 8515253 - DNA, 22 bp, Homo sapiens
gagggggcgtgcaaggctccgc

SEQ ID NO: 8515254 - DNA, 19 bp, Homo sapiens
gaggggaggaattgacaag

SEQ ID NO: 8515255 - DNA, 19 bp, Homo sapiens
gaggggaggaattgacaag

SEQ ID NO: 8515256 - DNA, 19 bp, Homo sapiens
gaggggaggaattgacaag

SEQ ID NO: 8515257 - DNA, 19 bp, Homo sapiens
gaggggaggaattgacaag

SEQ ID NO: 8515258 - DNA, 19 bp, Homo sapiens
gaggggaggaattgacaag

SEQ ID NO: 8515259 - DNA, 22 bp, Homo sapiens
gagggcaccttcagtaatagct

SEQ ID NO: 8515260 - DNA, 20 bp, Homo sapiens
gagggcacattgttccgtgc

SEQ ID NO: 8515261 - DNA, 22 bp, Homo sapiens
gagggcagaaaattatgcggtg

SEQ ID NO: 8515262 - DNA, 22 bp, Homo sapiens
gagggcactgggtttcaatgtc

SEQ ID NO: 8515263 - DNA, 22 bp, Homo sapiens
gaggccacagtcagtgttcatc

SEQ ID NO: 8515264 - DNA, 22 bp, Homo sapiens
gaggccacagctatcagggaca

SEQ ID NO: 8515265 - DNA, 22 bp, Homo sapiens
gaggccacattacttggtgggt

SEQ ID NO: 8515266 - DNA, 22 bp, Homo sapiens
gaggccacagtcctgaggcatc

SEQ ID NO: 8515267 - DNA, 22 bp, Homo sapiens
gaggccacagtcctgaggcatc

SEQ ID NO: 8515268 - DNA, 22 bp, Homo sapiens
gaggccacagtgtctgggggcc

SEQ ID NO: 8515269 - DNA, 22 bp, Homo sapiens
gaggctgtgtttcagtgaggcc

SEQ ID NO: 8515270 - DNA, 22 bp, Homo sapiens
gaggctgtgtgtccctctggac

SEQ ID NO: 8515271 - DNA, 23 bp, Homo sapiens
gaggccacattcccctgcttgag

SEQ ID NO: 8515272 - DNA, 23 bp, Homo sapiens
gaggccacattcccctgcttgag

SEQ ID NO: 8515273 - DNA, 22 bp, Homo sapiens
gaggctggaatattagaaatgt

SEQ ID NO: 8515274 - DNA, 22 bp, Homo sapiens
gaggctgctttgatgacaggag

SEQ ID NO: 8515275 - DNA, 22 bp, Homo sapiens
atgtcaccagtttccaaatttg

SEQ ID NO: 8515276 - DNA, 22 bp, Homo sapiens
atgtcacattggagctgctgga

SEQ ID NO: 8515277 - DNA, 22 bp, Homo sapiens
gaggcattaaagggaatcttct

SEQ ID NO: 8515278 - DNA, 22 bp, Homo sapiens
atgtcaccttcggtggcacggt

SEQ ID NO: 8515279 - DNA, 22 bp, Homo sapiens
atgtcacagttgcaacatgaat

SEQ ID NO: 8515280 - DNA, 22 bp, Homo sapiens
atgtcacagttgcaacatgaat

SEQ ID NO: 8515281 - DNA, 22 bp, Homo sapiens
atgtcacatggcctgtactttg

SEQ ID NO: 8515282 - DNA, 22 bp, Homo sapiens
atgtcacatggtcacctctagc

SEQ ID NO: 8515283 - DNA, 17 bp, Homo sapiens
gaggccaaggcaggcgg

SEQ ID NO: 8515284 - DNA, 22 bp, Homo sapiens
gaggccaactttggagaacagg

SEQ ID NO: 8515285 - DNA, 22 bp, Homo sapiens
gaggccacagctatcagggaca

SEQ ID NO: 8515286 - DNA, 22 bp, Homo sapiens
gaggccaagttggagaccaggt

SEQ ID NO: 8515287 - DNA, 22 bp, Homo sapiens
gaggccaaggtgggcagatcac

SEQ ID NO: 8515288 - DNA, 22 bp, Homo sapiens
gaggctttcacaaggttagttc

SEQ ID NO: 8515289 - DNA, 22 bp, Homo sapiens
gagggaaacagatgggttgtgg

SEQ ID NO: 8515290 - DNA, 22 bp, Homo sapiens
gaggctgttagggcctgaggta

SEQ ID NO: 8515291 - DNA, 22 bp, Homo sapiens
gagggaagaaagaattgatgcg

SEQ ID NO: 8515292 - DNA, 22 bp, Homo sapiens
gagggatggtagttgacactga

SEQ ID NO: 8515293 - DNA, 22 bp, Homo sapiens
gagggatggtgtgagaggctca

SEQ ID NO: 8515294 - DNA, 22 bp, Homo sapiens
gagggatggtgtgagaggctca

SEQ ID NO: 8515295 - DNA, 22 bp, Homo sapiens
gagggatgtcaggggaccttgg

SEQ ID NO: 8515296 - DNA, 22 bp, Homo sapiens
gagggatggtgtgagaggctca

SEQ ID NO: 8515297 - DNA, 22 bp, Homo sapiens
gagggatggtgtgagaggctca

SEQ ID NO: 8515298 - DNA, 22 bp, Homo sapiens
gagggatgtgcctgaaggcagg

SEQ ID NO: 8515299 - DNA, 22 bp, Homo sapiens
gagggatgtgcctgaaggcagg

SEQ ID NO: 8515300 - DNA, 22 bp, Homo sapiens
atgtttcctgttggattggccc

SEQ ID NO: 8515301 - DNA, 22 bp, Homo sapiens
atgtttccgtgagcatccttga

SEQ ID NO: 8515302 - DNA, 22 bp, Homo sapiens
atgtttcccttctgatttggga

SEQ ID NO: 8515303 - DNA, 22 bp, Homo sapiens
atgtttcccagagcaaatctgg

SEQ ID NO: 8515304 - DNA, 22 bp, Homo sapiens
atgtttccattttcttgtatca

SEQ ID NO: 8515305 - DNA, 22 bp, Homo sapiens
atgtttccattttcttgtatca

SEQ ID NO: 8515306 - DNA, 22 bp, Homo sapiens
atgtttccatgttcaatttact

SEQ ID NO: 8515307 - DNA, 22 bp, Homo sapiens
atgtttccatagaagtcacagt

SEQ ID NO: 8515308 - DNA, 22 bp, Homo sapiens
atgtttccaggttcttcctatg

SEQ ID NO: 8515309 - DNA, 22 bp, Homo sapiens
atgtttccagctcagctgcagg

SEQ ID NO: 8515310 - DNA, 22 bp, Homo sapiens
atgtttccagatatgtcaccct

SEQ ID NO: 8515311 - DNA, 22 bp, Homo sapiens
atgtttcatttagatatcaggc

SEQ ID NO: 8515312 - DNA, 22 bp, Homo sapiens
gatctgagatctaaaccagagg

SEQ ID NO: 8515313 - DNA, 22 bp, Homo sapiens
gatctgaatcaatagaataact

SEQ ID NO: 8515314 - DNA, 22 bp, Homo sapiens
gatctggaatctgaaggctgag

SEQ ID NO: 8515315 - DNA, 22 bp, Homo sapiens
gatctggaatctgaaggctgag

SEQ ID NO: 8515316 - DNA, 22 bp, Homo sapiens
gatctgaagagcaatgaaatat

SEQ ID NO: 8515317 - DNA, 22 bp, Homo sapiens
gatctgaaccttgcctgttggg

SEQ ID NO: 8515318 - DNA, 22 bp, Homo sapiens
gatctgaagatatgaaatattt

SEQ ID NO: 8515319 - DNA, 22 bp, Homo sapiens
gatctatttactcttttcctag

SEQ ID NO: 8515320 - DNA, 22 bp, Homo sapiens
gatctctgaatctgaagccttc

SEQ ID NO: 8515321 - DNA, 22 bp, Homo sapiens
gatctctgggtcctgttggcct

SEQ ID NO: 8515322 - DNA, 22 bp, Homo sapiens
gatctctgtggactcttagcac

SEQ ID NO: 8515323 - DNA, 22 bp, Homo sapiens
gatctctgtggactcttagcac

SEQ ID NO: 8515324 - DNA, 18 bp, Homo sapiens
gatctctgcagtgcctac

SEQ ID NO: 8515325 - DNA, 22 bp, Homo sapiens
gatatttacaaatttgccaata

SEQ ID NO: 8515326 - DNA, 22 bp, Homo sapiens
gagttatttgtagggattatat

SEQ ID NO: 8515327 - DNA, 22 bp, Homo sapiens
gatatttaactctcacaggtcc

SEQ ID NO: 8515328 - DNA, 22 bp, Homo sapiens
gatatttaactctcacaggtcc

SEQ ID NO: 8515329 - DNA, 22 bp, Homo sapiens
gagttattgggtggaaaggtag

SEQ ID NO: 8515330 - DNA, 22 bp, Homo sapiens
gagttatttcagaaggaaagat

SEQ ID NO: 8515331 - DNA, 22 bp, Homo sapiens
gatatttacaaatttgccaata

SEQ ID NO: 8515332 - DNA, 22 bp, Homo sapiens
gatcctggcacaggttggtccc

SEQ ID NO: 8515333 - DNA, 22 bp, Homo sapiens
gatcctgggactgaatgggtgc

SEQ ID NO: 8515334 - DNA, 22 bp, Homo sapiens
gatcctgggactgaatgggtgc

SEQ ID NO: 8515335 - DNA, 22 bp, Homo sapiens
gatctagaccagaagctgttgt

SEQ ID NO: 8515336 - DNA, 22 bp, Homo sapiens
gatcgggtgggttctgccatca

SEQ ID NO: 8515337 - DNA, 18 bp, Homo sapiens
gatcgggggcgccccaag

SEQ ID NO: 8515338 - DNA, 22 bp, Homo sapiens
gatcgagttgtttgttctgggg

SEQ ID NO: 8515339 - DNA, 22 bp, Homo sapiens
gatcgattcagtgtgcctaccc

SEQ ID NO: 8515340 - DNA, 18 bp, Homo sapiens
gatcgggggcgccccaag

SEQ ID NO: 8515341 - DNA, 22 bp, Homo sapiens
gatcctgggcccttctgggtca

SEQ ID NO: 8515342 - DNA, 22 bp, Homo sapiens
gagttacatggacattctctcc

SEQ ID NO: 8515343 - DNA, 22 bp, Homo sapiens
gagttacatttggtgacacttc

SEQ ID NO: 8515344 - DNA, 22 bp, Homo sapiens
gagttagaagacagaatgtaaa

SEQ ID NO: 8515345 - DNA, 22 bp, Homo sapiens
gagttagagccatagagcacgg

SEQ ID NO: 8515346 - DNA, 22 bp, Homo sapiens
gagttacagagaggattatggt

SEQ ID NO: 8515347 - DNA, 22 bp, Homo sapiens
gagttatagatggactattatt

SEQ ID NO: 8515348 - DNA, 22 bp, Homo sapiens
gagttatagatggactattatt

SEQ ID NO: 8515349 - DNA, 22 bp, Homo sapiens
gagttatatcctgagtcatatt

SEQ ID NO: 8515350 - DNA, 22 bp, Homo sapiens
gagttatatcctgagtcatatt

SEQ ID NO: 8515351 - DNA, 22 bp, Homo sapiens
gagttagtatgttctgtaagta

SEQ ID NO: 8515352 - DNA, 22 bp, Homo sapiens
gagttataacctagtttaactg

SEQ ID NO: 8515353 - DNA, 19 bp, Homo sapiens
gagttattgccagggcatg

SEQ ID NO: 8515354 - DNA, 22 bp, Homo sapiens
gagttattctaggtcctttgta

SEQ ID NO: 8515355 - DNA, 22 bp, Homo sapiens
gagttattaatggctgagtttg

SEQ ID NO: 8515356 - DNA, 22 bp, Homo sapiens
gagttatatttgcgatattgga

SEQ ID NO: 8515357 - DNA, 22 bp, Homo sapiens
gagttatatttgcgatattgga

SEQ ID NO: 8515358 - DNA, 22 bp, Homo sapiens
atgtttattgttttaagctgct

SEQ ID NO: 8515359 - DNA, 21 bp, Homo sapiens
gagtgcaggtctgatgccatc

SEQ ID NO: 8515360 - DNA, 22 bp, Homo sapiens
atgtttaattatctgggttttg

SEQ ID NO: 8515361 - DNA, 22 bp, Homo sapiens
atgtttcaaatatatagagttg

SEQ ID NO: 8515362 - DNA, 22 bp, Homo sapiens
atgtttcaaatatatagagttg

SEQ ID NO: 8515363 - DNA, 22 bp, Homo sapiens
atgtttcaatgcactttagcct

SEQ ID NO: 8515364 - DNA, 22 bp, Homo sapiens
atgtttcaatgcactttagcct

SEQ ID NO: 8515365 - DNA, 22 bp, Homo sapiens
atgtttcaccagcaaattacct

SEQ ID NO: 8515366 - DNA, 22 bp, Homo sapiens
atgtttcaccagcaaattacct

SEQ ID NO: 8515367 - DNA, 22 bp, Homo sapiens
atgtttcaccagttttataaga

SEQ ID NO: 8515368 - DNA, 22 bp, Homo sapiens
gagttaaatattttctgaagtt

SEQ ID NO: 8515369 - DNA, 22 bp, Homo sapiens
gagttaaatagcttaggattca

SEQ ID NO: 8515370 - DNA, 22 bp, Homo sapiens
atgtttcatttagatatcaggc

SEQ ID NO: 8515371 - DNA, 22 bp, Homo sapiens
atgtttcatttagatatcaggc

SEQ ID NO: 8515372 - DNA, 22 bp, Homo sapiens
atgtttcatgactgagcaaaat

SEQ ID NO: 8515373 - DNA, 22 bp, Homo sapiens
atgtttcatccactggcctttc

SEQ ID NO: 8515374 - DNA, 22 bp, Homo sapiens
atgtttcatgactgagcaaaat

SEQ ID NO: 8515375 - DNA, 22 bp, Homo sapiens
atgtttcatttagatatcaggc

SEQ ID NO: 8515376 - DNA, 22 bp, Homo sapiens
atgtttcaggaaatcagctaga

SEQ ID NO: 8515377 - DNA, 22 bp, Homo sapiens
atgtttcagatacagatcaaat

SEQ ID NO: 8515378 - DNA, 22 bp, Homo sapiens
atgtttcaccagttttataaga

SEQ ID NO: 8515379 - DNA, 22 bp, Homo sapiens
atgtttcaggcgaactaacatg

SEQ ID NO: 8515380 - DNA, 22 bp, Homo sapiens
atgtttcaggcgaactaacatg

SEQ ID NO: 8515381 - DNA, 22 bp, Homo sapiens
atgtttcagttctaaagttaga

SEQ ID NO: 8515382 - DNA, 22 bp, Homo sapiens
atgtttcagggtgatagaaggt

SEQ ID NO: 8515383 - DNA, 21 bp, Homo sapiens
gagtgcagcaaggtagagtct

SEQ ID NO: 8515384 - DNA, 21 bp, Homo sapiens
gagtgcagcaaggtagagtct

SEQ ID NO: 8515385 - DNA, 22 bp, Homo sapiens
gagtgcagatgaacagaagatt

SEQ ID NO: 8515386 - DNA, 22 bp, Homo sapiens
gagtgcagatgaacagaagatt

SEQ ID NO: 8515387 - DNA, 23 bp, Homo sapiens
gagtgcagaatagacatgcagtg

SEQ ID NO: 8515388 - DNA, 23 bp, Homo sapiens
gagtgcagaatagacatgcagtg

SEQ ID NO: 8515389 - DNA, 22 bp, Homo sapiens
gagtccagttagtgaggctggg

SEQ ID NO: 8515390 - DNA, 22 bp, Homo sapiens
gagtccagttctttccagcagt

SEQ ID NO: 8515391 - DNA, 22 bp, Homo sapiens
gagtccagttagtgaggctggg

SEQ ID NO: 8515392 - DNA, 22 bp, Homo sapiens
gagtccagttagtgaggctggg

SEQ ID NO: 8515393 - DNA, 22 bp, Homo sapiens
gagtccagtagttaggacagag

SEQ ID NO: 8515394 - DNA, 22 bp, Homo sapiens
gagtccagtagttaggacagag

SEQ ID NO: 8515395 - DNA, 22 bp, Homo sapiens
gagtccagtgatgttcctggtc

SEQ ID NO: 8515396 - DNA, 20 bp, Homo sapiens
gagtccaggggcctgtagca

SEQ ID NO: 8515397 - DNA, 22 bp, Homo sapiens
gacataaaccttgagatattaa

SEQ ID NO: 8515398 - DNA, 22 bp, Homo sapiens
gacataaaccttgagatattaa

SEQ ID NO: 8515399 - DNA, 22 bp, Homo sapiens
gacataaaattcaataatttgt

SEQ ID NO: 8515400 - DNA, 22 bp, Homo sapiens
gacataaaattcaataatttgt

SEQ ID NO: 8515401 - DNA, 22 bp, Homo sapiens
gacataaaatggaattctgttg

SEQ ID NO: 8515402 - DNA, 22 bp, Homo sapiens
gacagttttgctgaaattgagc

SEQ ID NO: 8515403 - DNA, 22 bp, Homo sapiens
gacataaagttcttgcttgaat

SEQ ID NO: 8515404 - DNA, 20 bp, Homo sapiens
atgcttaagtgttcattatt

SEQ ID NO: 8515405 - DNA, 22 bp, Homo sapiens
atgcttaatacactgttaaagg

SEQ ID NO: 8515406 - DNA, 22 bp, Homo sapiens
atgcttgtactaaaaaaatatt

SEQ ID NO: 8515407 - DNA, 22 bp, Homo sapiens
atgcttggttcctacttctggc

SEQ ID NO: 8515408 - DNA, 22 bp, Homo sapiens
atgcttggcccctttatagcct

SEQ ID NO: 8515409 - DNA, 22 bp, Homo sapiens
atgcttggcgtttcacttcctg

SEQ ID NO: 8515410 - DNA, 22 bp, Homo sapiens
atgcttgggactccctgtagca

SEQ ID NO: 8515411 - DNA, 19 bp, Homo sapiens
atgctttatgttatttctt

SEQ ID NO: 8515412 - DNA, 22 bp, Homo sapiens
atgctttatacaaaacacttaa

SEQ ID NO: 8515413 - DNA, 22 bp, Homo sapiens
atgctttagtgtcaagtttggg

SEQ ID NO: 8515414 - DNA, 22 bp, Homo sapiens
atgctttacgacaaaaaactca

SEQ ID NO: 8515415 - DNA, 22 bp, Homo sapiens
atgctttacagttttccaaaca

SEQ ID NO: 8515416 - DNA, 22 bp, Homo sapiens
atgctttacagttttccaaaca

SEQ ID NO: 8515417 - DNA, 22 bp, Homo sapiens
atgctttacagttttccaaaca

SEQ ID NO: 8515418 - DNA, 22 bp, Homo sapiens
atgctttaaaacgtatgtgtaa

SEQ ID NO: 8515419 - DNA, 22 bp, Homo sapiens
atgctttaaactataaatccac

SEQ ID NO: 8515420 - DNA, 22 bp, Homo sapiens
gacagggaggagcagagcttct

SEQ ID NO: 8515421 - DNA, 22 bp, Homo sapiens
gacagggaggagcagagcttct

SEQ ID NO: 8515422 - DNA, 22 bp, Homo sapiens
gacagggcaagactctgtctaa

SEQ ID NO: 8515423 - DNA, 22 bp, Homo sapiens
gacagggcatggtgcagagttc

SEQ ID NO: 8515424 - DNA, 22 bp, Homo sapiens
gacagggcaagactctgtctaa

SEQ ID NO: 8515425 - DNA, 22 bp, Homo sapiens
gacagggaggagcagagcttct

SEQ ID NO: 8515426 - DNA, 22 bp, Homo sapiens
gacagggaggaaagagactgct

SEQ ID NO: 8515427 - DNA, 22 bp, Homo sapiens
gacagggaggaaagagactgct

SEQ ID NO: 8515428 - DNA, 22 bp, Homo sapiens
gacagggaggaaagagactgct

SEQ ID NO: 8515429 - DNA, 22 bp, Homo sapiens
gacagggaggaaagagactgct

SEQ ID NO: 8515430 - DNA, 22 bp, Homo sapiens
gacagggccgcagatggagact

SEQ ID NO: 8515431 - DNA, 22 bp, Homo sapiens
gacagggccgcagatggagact

SEQ ID NO: 8515432 - DNA, 22 bp, Homo sapiens
gacagggccgcagatggagact

SEQ ID NO: 8515433 - DNA, 22 bp, Homo sapiens
gacagggcatggtgcagagttc

SEQ ID NO: 8515434 - DNA, 22 bp, Homo sapiens
gacagggcatggtgcagagttc

SEQ ID NO: 8515435 - DNA, 22 bp, Homo sapiens
gacagggcgagactcagtctca

SEQ ID NO: 8515436 - DNA, 22 bp, Homo sapiens
gacagggcgagactcagtctca

SEQ ID NO: 8515437 - DNA, 22 bp, Homo sapiens
gacagggcgcccagcctgtttc

SEQ ID NO: 8515438 - DNA, 22 bp, Homo sapiens
gacagggcgagactcagtctca

SEQ ID NO: 8515439 - DNA, 22 bp, Homo sapiens
gacagtttaggttcaaatctca

SEQ ID NO: 8515440 - DNA, 22 bp, Homo sapiens
gacagtttaagcacctaatatt

SEQ ID NO: 8515441 - DNA, 22 bp, Homo sapiens
gacagtggtgttttccattgca

SEQ ID NO: 8515442 - DNA, 22 bp, Homo sapiens
gacagtggattcatctagtcaa

SEQ ID NO: 8515443 - DNA, 22 bp, Homo sapiens
gacagtggagggctgatgttaa

SEQ ID NO: 8515444 - DNA, 22 bp, Homo sapiens
gacagtggaatgaccctttgag

SEQ ID NO: 8515445 - DNA, 23 bp, Homo sapiens
gacagggctgacttggcagctgc

SEQ ID NO: 8515446 - DNA, 22 bp, Homo sapiens
gacagtgcatttcctggcatgg

SEQ ID NO: 8515447 - DNA, 22 bp, Homo sapiens
gacagtggttccaaggcagctt

SEQ ID NO: 8515448 - DNA, 22 bp, Homo sapiens
gacagtgtgaacatctaatagt

SEQ ID NO: 8515449 - DNA, 22 bp, Homo sapiens
atgctttggccaatgagaagtg

SEQ ID NO: 8515450 - DNA, 20 bp, Homo sapiens
atgctttcttgtgtgctgct

SEQ ID NO: 8515451 - DNA, 22 bp, Homo sapiens
atgctttcttctttcctgtaag

SEQ ID NO: 8515452 - DNA, 20 bp, Homo sapiens
atgctttcttgtgtgctgct

SEQ ID NO: 8515453 - DNA, 22 bp, Homo sapiens
atgctttattgttaggtcatgt

SEQ ID NO: 8515454 - DNA, 22 bp, Homo sapiens
atgcttttccaggagaaatata

SEQ ID NO: 8515455 - DNA, 22 bp, Homo sapiens
atgcttttccaggagaaatata

SEQ ID NO: 8515456 - DNA, 22 bp, Homo sapiens
gactttgattaaatcaagcaaa

SEQ ID NO: 8515457 - DNA, 22 bp, Homo sapiens
gactttgagggatacaaacatt

SEQ ID NO: 8515458 - DNA, 22 bp, Homo sapiens
gactttgacgaaagagtcatta

SEQ ID NO: 8515459 - DNA, 22 bp, Homo sapiens
gactttgaacagtgtatcagta

SEQ ID NO: 8515460 - DNA, 22 bp, Homo sapiens
gactttcttgcagaaatattcc

SEQ ID NO: 8515461 - DNA, 21 bp, Homo sapiens
gaccccagaccagcagacaca

SEQ ID NO: 8515462 - DNA, 22 bp, Homo sapiens
atgctttatgttctggcatttt

SEQ ID NO: 8515463 - DNA, 22 bp, Homo sapiens
gaccctcctactaccctggaaa

SEQ ID NO: 8515464 - DNA, 22 bp, Homo sapiens
gaccctcattgtcaccgtgagc

SEQ ID NO: 8515465 - DNA, 22 bp, Homo sapiens
gaccccaggcagatcagggggt

SEQ ID NO: 8515466 - DNA, 18 bp, Homo sapiens
gaccccgggatctgtcga

SEQ ID NO: 8515467 - DNA, 22 bp, Homo sapiens
gaccccatctggctgccccagg

SEQ ID NO: 8515468 - DNA, 22 bp, Homo sapiens
gacccggctccaggcccagcag

SEQ ID NO: 8515469 - DNA, 22 bp, Homo sapiens
gacccggctccaggcccagcag

SEQ ID NO: 8515470 - DNA, 22 bp, Homo sapiens
gaccctctagatggaagcactg

SEQ ID NO: 8515471 - DNA, 22 bp, Homo sapiens
gaccctctagatggaagcactg

SEQ ID NO: 8515472 - DNA, 22 bp, Homo sapiens
gaccctgagcaaaagcagttct

SEQ ID NO: 8515473 - DNA, 22 bp, Homo sapiens
gaccctgaggatgcaccagcag

SEQ ID NO: 8515474 - DNA, 22 bp, Homo sapiens
gaccctgactctaatgcttggc

SEQ ID NO: 8515475 - DNA, 22 bp, Homo sapiens
gaccctgaggattccctgctga

SEQ ID NO: 8515476 - DNA, 22 bp, Homo sapiens
gaccctgataggagtagaagaa

SEQ ID NO: 8515477 - DNA, 22 bp, Homo sapiens
gaccctgccatgagtgacaggg

SEQ ID NO: 8515478 - DNA, 22 bp, Homo sapiens
gaccctggagccgtctgaggca

SEQ ID NO: 8515479 - DNA, 22 bp, Homo sapiens
gactttccaggtcctgggctat

SEQ ID NO: 8515480 - DNA, 22 bp, Homo sapiens
gactggggtaaggtgaggaggt

SEQ ID NO: 8515481 - DNA, 22 bp, Homo sapiens
gactttctgatgtaaacattta

SEQ ID NO: 8515482 - DNA, 22 bp, Homo sapiens
gactttctgagtcaaagaaagg

SEQ ID NO: 8515483 - DNA, 22 bp, Homo sapiens
gactttctctcctcccaggtgt

SEQ ID NO: 8515484 - DNA, 22 bp, Homo sapiens
gaagcagaaggtttggacgtgc

SEQ ID NO: 8515485 - DNA, 22 bp, Homo sapiens
gaagcactgcatttcaagatca

SEQ ID NO: 8515486 - DNA, 22 bp, Homo sapiens
gaagcactgtgctgctaagttg

SEQ ID NO: 8515487 - DNA, 22 bp, Homo sapiens
gaagcagagcctaaggcagaca

SEQ ID NO: 8515488 - DNA, 22 bp, Homo sapiens
gaatcaggattcaagatcagct

SEQ ID NO: 8515489 - DNA, 22 bp, Homo sapiens
gaatgtaatagtcagtagaaca

SEQ ID NO: 8515490 - DNA, 22 bp, Homo sapiens
gaagcacatggctgtgagcaac

SEQ ID NO: 8515491 - DNA, 22 bp, Homo sapiens
gaagcacagggctcgatctcag

SEQ ID NO: 8515492 - DNA, 22 bp, Homo sapiens
gaagcacatggctgtgagcaac

SEQ ID NO: 8515493 - DNA, 22 bp, Homo sapiens
gaagcaatttagaatcagaagc

SEQ ID NO: 8515494 - DNA, 22 bp, Homo sapiens
gaagcaatctggctcccagcca

SEQ ID NO: 8515495 - DNA, 23 bp, Homo sapiens
atgcacaagccagcaggggacag

SEQ ID NO: 8515496 - DNA, 22 bp, Homo sapiens
atgcacaagcaagagataatgg

SEQ ID NO: 8515497 - DNA, 22 bp, Homo sapiens
atgcacaagcaagagataatgg

SEQ ID NO: 8515498 - DNA, 22 bp, Homo sapiens
atgcacaagaggctagaaaaga

SEQ ID NO: 8515499 - DNA, 22 bp, Homo sapiens
atgcacaagaggctagaaaaga

SEQ ID NO: 8515500 - DNA, 22 bp, Homo sapiens
gaagcaatctggctcccagcca

SEQ ID NO: 8515501 - DNA, 22 bp, Homo sapiens
gaagcaatgtgttttcaacatt

SEQ ID NO: 8515502 - DNA, 22 bp, Homo sapiens
gaagcaatgtgttttcaacatt

SEQ ID NO: 8515503 - DNA, 22 bp, Homo sapiens
gaagcaattaagtttgtgatct

SEQ ID NO: 8515504 - DNA, 22 bp, Homo sapiens
gaatgtgtgactctattgagca

SEQ ID NO: 8515505 - DNA, 22 bp, Homo sapiens
gaatgtgtgactctattgagca

SEQ ID NO: 8515506 - DNA, 22 bp, Homo sapiens
gaatgtgtcaccctgtcccatg

SEQ ID NO: 8515507 - DNA, 22 bp, Homo sapiens
gaatgtgtactgagtgcccctt

SEQ ID NO: 8515508 - DNA, 22 bp, Homo sapiens
gaatgtgtcaccctgtcccatg

SEQ ID NO: 8515509 - DNA, 22 bp, Homo sapiens
gaatgtgggctgtgaagaggag

SEQ ID NO: 8515510 - DNA, 22 bp, Homo sapiens
gaatgtaatagtcagtagaaca

SEQ ID NO: 8515511 - DNA, 22 bp, Homo sapiens
gaatgtccctgcagttgctgcc

SEQ ID NO: 8515512 - DNA, 22 bp, Homo sapiens
gaatgtcctcctggatcactcc

SEQ ID NO: 8515513 - DNA, 22 bp, Homo sapiens
gaatgtcttctgttcccagctg

SEQ ID NO: 8515514 - DNA, 19 bp, Homo sapiens
gaatgtctcctacttctga

SEQ ID NO: 8515515 - DNA, 21 bp, Homo sapiens
gaatgtctgccttcacaatga

SEQ ID NO: 8515516 - DNA, 22 bp, Homo sapiens
atgcatataaggcacatgtatt

SEQ ID NO: 8515517 - DNA, 22 bp, Homo sapiens
atgcatataaggcacatgtatt

SEQ ID NO: 8515518 - DNA, 22 bp, Homo sapiens
atgcatataatggccagaacaa

SEQ ID NO: 8515519 - DNA, 22 bp, Homo sapiens
atgcatatagaacatttgacat

SEQ ID NO: 8515520 - DNA, 22 bp, Homo sapiens
atgcatatatacatacacagtc

SEQ ID NO: 8515521 - DNA, 22 bp, Homo sapiens
atgcatatagaacatttgacat

SEQ ID NO: 8515522 - DNA, 22 bp, Homo sapiens
atgcatataatggccagaacaa

SEQ ID NO: 8515523 - DNA, 22 bp, Homo sapiens
atgcatatagaacatttgacat

SEQ ID NO: 8515524 - DNA, 22 bp, Homo sapiens
atgcataatgtatgtattgact

SEQ ID NO: 8515525 - DNA, 22 bp, Homo sapiens
atgcataagtgcagcagatttg

SEQ ID NO: 8515526 - DNA, 22 bp, Homo sapiens
gaatgtttgactaaaggtagct

SEQ ID NO: 8515527 - DNA, 22 bp, Homo sapiens
atgcctggactgacatgcactg

SEQ ID NO: 8515528 - DNA, 22 bp, Homo sapiens
gacaggaaatatgggggttgtt

SEQ ID NO: 8515529 - DNA, 22 bp, Homo sapiens
gacaggaacataaatgtaggag

SEQ ID NO: 8515530 - DNA, 22 bp, Homo sapiens
gacagggacgaggcttcaggca

SEQ ID NO: 8515531 - DNA, 22 bp, Homo sapiens
gacagggactccctggttagaa

SEQ ID NO: 8515532 - DNA, 22 bp, Homo sapiens
gacagggactccctggttagaa

SEQ ID NO: 8515533 - DNA, 22 bp, Homo sapiens
atgcctggactgacatgcactg

SEQ ID NO: 8515534 - DNA, 22 bp, Homo sapiens
atgcctgccatttagaagtctt

SEQ ID NO: 8515535 - DNA, 22 bp, Homo sapiens
atgcctgcttactccaggtgct

SEQ ID NO: 8515536 - DNA, 22 bp, Homo sapiens
atgcctgcttactccaggtgct

SEQ ID NO: 8515537 - DNA, 22 bp, Homo sapiens
atgcctggactgacatgcactg

SEQ ID NO: 8515538 - DNA, 22 bp, Homo sapiens
atgcctgccatttagaagtctt

SEQ ID NO: 8515539 - DNA, 20 bp, Homo sapiens
atgcctctaattttgcaaac

SEQ ID NO: 8515540 - DNA, 20 bp, Homo sapiens
atgcctctaattttgcaaac

SEQ ID NO: 8515541 - DNA, 22 bp, Homo sapiens
atgcctcctcaaatctgccaca

SEQ ID NO: 8515542 - DNA, 22 bp, Homo sapiens
atgcctcctcaaatctgccaca

SEQ ID NO: 8515543 - DNA, 22 bp, Homo sapiens
atgccctgtgactctcctggac

SEQ ID NO: 8515544 - DNA, 22 bp, Homo sapiens
atgccctgtgactctcctggac

SEQ ID NO: 8515545 - DNA, 20 bp, Homo sapiens
atgccctgtcctcttctgtt

SEQ ID NO: 8515546 - DNA, 22 bp, Homo sapiens
atgccctgctgctggggcagtg

SEQ ID NO: 8515547 - DNA, 22 bp, Homo sapiens
atgcccttcaacgtgaggattt

SEQ ID NO: 8515548 - DNA, 22 bp, Homo sapiens
atgccctgctctcgggaaggga

SEQ ID NO: 8515549 - DNA, 22 bp, Homo sapiens
atgcccaggcccatacctagat

SEQ ID NO: 8515550 - DNA, 22 bp, Homo sapiens
atgccctgagcaggccttcaag

SEQ ID NO: 8515551 - DNA, 22 bp, Homo sapiens
atgcatatcagtgattgtttgc

SEQ ID NO: 8515552 - DNA, 22 bp, Homo sapiens
atgcatatcagtgattgtttgc

SEQ ID NO: 8515553 - DNA, 22 bp, Homo sapiens
atgcatatcacagtctccatgt

SEQ ID NO: 8515554 - DNA, 20 bp, Homo sapiens
atgcatatatgtggtgtctg

SEQ ID NO: 8515555 - DNA, 20 bp, Homo sapiens
atgcatatatgtggtgtctg

SEQ ID NO: 8515556 - DNA, 22 bp, Homo sapiens
atgcatatctcctatctcctca

SEQ ID NO: 8515557 - DNA, 22 bp, Homo sapiens
atgcatatgcaatgcacaattt

SEQ ID NO: 8515558 - DNA, 22 bp, Homo sapiens
atgcatatctcctatctcctca

SEQ ID NO: 8515559 - DNA, 22 bp, Homo sapiens
atgcatatgcaatgcacaattt

SEQ ID NO: 8515560 - DNA, 22 bp, Homo sapiens
atgcatatgcatctgtgtacat

SEQ ID NO: 8515561 - DNA, 22 bp, Homo sapiens
atgcatatgcatctgtgtacat

SEQ ID NO: 8515562 - DNA, 22 bp, Homo sapiens
atgccacttcattccagcctcg

SEQ ID NO: 8515563 - DNA, 22 bp, Homo sapiens
atgccacttcattccagcctcg

SEQ ID NO: 8515564 - DNA, 22 bp, Homo sapiens
atgccacttcattccagcctcg

SEQ ID NO: 8515565 - DNA, 22 bp, Homo sapiens
atgcccaatgtcacaatttttg

SEQ ID NO: 8515566 - DNA, 22 bp, Homo sapiens
gaaaactgtgattagaatgcct

SEQ ID NO: 8515567 - DNA, 22 bp, Homo sapiens
gaaaactattggcctagaacaa

SEQ ID NO: 8515568 - DNA, 22 bp, Homo sapiens
gaaaactattggcctagaacaa

SEQ ID NO: 8515569 - DNA, 22 bp, Homo sapiens
gaaaactattggcctagaacaa

SEQ ID NO: 8515570 - DNA, 22 bp, Homo sapiens
gaaaactaacggaaaagttagg

SEQ ID NO: 8515571 - DNA, 22 bp, Homo sapiens
gaaaactaacggaaaagttagg

SEQ ID NO: 8515572 - DNA, 22 bp, Homo sapiens
gaaaactaacggaaaagttagg

SEQ ID NO: 8515573 - DNA, 22 bp, Homo sapiens
gaaaactattggcctagaacaa

SEQ ID NO: 8515574 - DNA, 22 bp, Homo sapiens
gaaaactaacggaaaagttagg

SEQ ID NO: 8515575 - DNA, 22 bp, Homo sapiens
gaaaagaactgcatgggattaa

SEQ ID NO: 8515576 - DNA, 22 bp, Homo sapiens
gaaaacttggatctctagaatg

SEQ ID NO: 8515577 - DNA, 22 bp, Homo sapiens
gaaaatgagcctcagctacatt

SEQ ID NO: 8515578 - DNA, 22 bp, Homo sapiens
gaaaatagttcatcacaatgat

SEQ ID NO: 8515579 - DNA, 22 bp, Homo sapiens
gaaaatagttcatcacaatgat

SEQ ID NO: 8515580 - DNA, 22 bp, Homo sapiens
gaaaataggctgcatctccttc

SEQ ID NO: 8515581 - DNA, 22 bp, Homo sapiens
gaaaataggctgcatctccttc

SEQ ID NO: 8515582 - DNA, 20 bp, Homo sapiens
gaaaataggccagccaggta

SEQ ID NO: 8515583 - DNA, 20 bp, Homo sapiens
gaaaataggccagccaggta

SEQ ID NO: 8515584 - DNA, 22 bp, Homo sapiens
gaaaataggcagatgcattgta

SEQ ID NO: 8515585 - DNA, 20 bp, Homo sapiens
gaaaataggccagccaggta

SEQ ID NO: 8515586 - DNA, 22 bp, Homo sapiens
gaaaatagcagatagaccaatg

SEQ ID NO: 8515587 - DNA, 22 bp, Homo sapiens
gaaaatagcagatagaccaatg

SEQ ID NO: 8515588 - DNA, 22 bp, Homo sapiens
gaaaataggcagatgcattgta

SEQ ID NO: 8515589 - DNA, 22 bp, Homo sapiens
atgaatgtttggtgatcagata

SEQ ID NO: 8515590 - DNA, 22 bp, Homo sapiens
atgaatgtgatgattctgttac

SEQ ID NO: 8515591 - DNA, 22 bp, Homo sapiens
atgaatggatggggtcaagata

SEQ ID NO: 8515592 - DNA, 22 bp, Homo sapiens
atgaatgggtcattatttgatc

SEQ ID NO: 8515593 - DNA, 22 bp, Homo sapiens
atgaattgaggaaaacagtcgt

SEQ ID NO: 8515594 - DNA, 22 bp, Homo sapiens
atgaattgaggaaaacagtcgt

SEQ ID NO: 8515595 - DNA, 22 bp, Homo sapiens
ctttttccagcttcagggtggg

SEQ ID NO: 8515596 - DNA, 22 bp, Homo sapiens
atgaattgaggaaaacagtcgt

SEQ ID NO: 8515597 - DNA, 22 bp, Homo sapiens
ctttttccagcttcagggtggg

SEQ ID NO: 8515598 - DNA, 22 bp, Homo sapiens
gaaaacatccagagatagacct

SEQ ID NO: 8515599 - DNA, 22 bp, Homo sapiens
gaaaactaacggaaaagttagg

SEQ ID NO: 8515600 - DNA, 21 bp, Homo sapiens
gaaaaccatttgcatcatgag

SEQ ID NO: 8515601 - DNA, 22 bp, Homo sapiens
atgaatgagaaagctgaaatct

SEQ ID NO: 8515602 - DNA, 22 bp, Homo sapiens
atgaatgagaaacaggtgagat

SEQ ID NO: 8515603 - DNA, 22 bp, Homo sapiens
atgaatgagaaagctgaaatct

SEQ ID NO: 8515604 - DNA, 19 bp, Homo sapiens
atgaatgagctgtgaggtt

SEQ ID NO: 8515605 - DNA, 19 bp, Homo sapiens
atgaatgagctgtgaggtt

SEQ ID NO: 8515606 - DNA, 22 bp, Homo sapiens
atgaatgattaaagagtacagt

SEQ ID NO: 8515607 - DNA, 22 bp, Homo sapiens
atgaatgatgccagttgaaatg

SEQ ID NO: 8515608 - DNA, 22 bp, Homo sapiens
atgaatgattttatgtaaatga

SEQ ID NO: 8515609 - DNA, 22 bp, Homo sapiens
atgaatgcatacatttgtcaag

SEQ ID NO: 8515610 - DNA, 22 bp, Homo sapiens
atgaatgcttattaaattgaaa

SEQ ID NO: 8515611 - DNA, 22 bp, Homo sapiens
atgaatgctgggacaaatatat

SEQ ID NO: 8515612 - DNA, 22 bp, Homo sapiens
atgaatcaaactgtacactgag

SEQ ID NO: 8515613 - DNA, 22 bp, Homo sapiens
atgaatcaaactgtacactgag

SEQ ID NO: 8515614 - DNA, 22 bp, Homo sapiens
atgaatcaaactgtacactgag

SEQ ID NO: 8515615 - DNA, 22 bp, Homo sapiens
atgaatcaaagttcatttgatc

SEQ ID NO: 8515616 - DNA, 22 bp, Homo sapiens
atgaatatgagactgagagcct

SEQ ID NO: 8515617 - DNA, 22 bp, Homo sapiens
atgaatatgtacacatctgtca

SEQ ID NO: 8515618 - DNA, 22 bp, Homo sapiens
atgaatatgagactgagagcct

SEQ ID NO: 8515619 - DNA, 23 bp, Homo sapiens
atgaatgaataaggcaggaaagc

SEQ ID NO: 8515620 - DNA, 22 bp, Homo sapiens
atgaatgaagaacatctgtgcc

SEQ ID NO: 8515621 - DNA, 22 bp, Homo sapiens
atgaatgactgtctactttggg

SEQ ID NO: 8515622 - DNA, 22 bp, Homo sapiens
atgaatccagcaaacagtgagg

SEQ ID NO: 8515623 - DNA, 22 bp, Homo sapiens
atgaatccaaagtttactatta

SEQ ID NO: 8515624 - DNA, 22 bp, Homo sapiens
atgaatccaaagtttactatta

SEQ ID NO: 8515625 - DNA, 22 bp, Homo sapiens
cttgagctaggaaggctgaggc

SEQ ID NO: 8515626 - DNA, 18 bp, Homo sapiens
cttgagctaagggacccc

SEQ ID NO: 8515627 - DNA, 22 bp, Homo sapiens
cttgagcacagcggcttcagga

SEQ ID NO: 8515628 - DNA, 23 bp, Homo sapiens
cttgagctcaggaagagctgagt

SEQ ID NO: 8515629 - DNA, 22 bp, Homo sapiens
cttgaggctgcactccagggcc

SEQ ID NO: 8515630 - DNA, 22 bp, Homo sapiens
atgaagcaggcacagcttcagg

SEQ ID NO: 8515631 - DNA, 22 bp, Homo sapiens
cttgaggttttgactcagcttt

SEQ ID NO: 8515632 - DNA, 22 bp, Homo sapiens
atgaagttctcaataatcatgt

SEQ ID NO: 8515633 - DNA, 22 bp, Homo sapiens
atgaataaacaggtgcctcttc

SEQ ID NO: 8515634 - DNA, 22 bp, Homo sapiens
atgaataaaacattttaatcag

SEQ ID NO: 8515635 - DNA, 22 bp, Homo sapiens
atgaataaaacattttaatcag

SEQ ID NO: 8515636 - DNA, 16 bp, Homo sapiens
atcttccaaagttatt

SEQ ID NO: 8515637 - DNA, 22 bp, Homo sapiens
atcttccaagctccctggtgta

SEQ ID NO: 8515638 - DNA, 22 bp, Homo sapiens
atcttcccaggctggggagagg

SEQ ID NO: 8515639 - DNA, 22 bp, Homo sapiens
atcttccaggtgccgggggtca

SEQ ID NO: 8515640 - DNA, 22 bp, Homo sapiens
atcttcagttttcagtgagcca

SEQ ID NO: 8515641 - DNA, 22 bp, Homo sapiens
atcttcatcaagttcacagtgg

SEQ ID NO: 8515642 - DNA, 22 bp, Homo sapiens
atcttcaaggaaaaaatacagt

SEQ ID NO: 8515643 - DNA, 22 bp, Homo sapiens
atcttcaacttgatcatttgaa

SEQ ID NO: 8515644 - DNA, 22 bp, Homo sapiens
atcttcaaagcacatcgtttgt

SEQ ID NO: 8515645 - DNA, 22 bp, Homo sapiens
cttgagaaaggaacaggaagct

SEQ ID NO: 8515646 - DNA, 22 bp, Homo sapiens
atcttccttcactttctcccac

SEQ ID NO: 8515647 - DNA, 22 bp, Homo sapiens
atcttcccaggctggggagagg

SEQ ID NO: 8515648 - DNA, 22 bp, Homo sapiens
cttgagaaaggaacaggaagct

SEQ ID NO: 8515649 - DNA, 22 bp, Homo sapiens
cttgagaacagggttaggtaac

SEQ ID NO: 8515650 - DNA, 22 bp, Homo sapiens
atcttcccaggctggggagagg

SEQ ID NO: 8515651 - DNA, 22 bp, Homo sapiens
atcttcccaggctggggagagg

SEQ ID NO: 8515652 - DNA, 22 bp, Homo sapiens
cttgagaatcttgatgtctacc

SEQ ID NO: 8515653 - DNA, 22 bp, Homo sapiens
cttgagaatcttgatgtctacc

SEQ ID NO: 8515654 - DNA, 22 bp, Homo sapiens
cttgagaacagggttaggtaac

SEQ ID NO: 8515655 - DNA, 22 bp, Homo sapiens
cttgagaagagatttatatttg

SEQ ID NO: 8515656 - DNA, 22 bp, Homo sapiens
cttgagaagcattaagaggtag

SEQ ID NO: 8515657 - DNA, 22 bp, Homo sapiens
cttgagaatcttctctgaagag

SEQ ID NO: 8515658 - DNA, 22 bp, Homo sapiens
gaaatctttatggaaataacaa

SEQ ID NO: 8515659 - DNA, 22 bp, Homo sapiens
gaaatctttatggaaataacaa

SEQ ID NO: 8515660 - DNA, 22 bp, Homo sapiens
gaaatcttttaaccattcattt

SEQ ID NO: 8515661 - DNA, 22 bp, Homo sapiens
gaaatcttttaaccattcattt

SEQ ID NO: 8515662 - DNA, 22 bp, Homo sapiens
gaaatcttttcatctcatttga

SEQ ID NO: 8515663 - DNA, 22 bp, Homo sapiens
gaaatcttttccaattgtttag

SEQ ID NO: 8515664 - DNA, 22 bp, Homo sapiens
gaaatcttgctcattgtgacaa

SEQ ID NO: 8515665 - DNA, 22 bp, Homo sapiens
gaaatgaaatagcaccaaggtt

SEQ ID NO: 8515666 - DNA, 22 bp, Homo sapiens
gaaatgaaacaggcttttaagg

SEQ ID NO: 8515667 - DNA, 22 bp, Homo sapiens
gaaatgaactgattatcattgc

SEQ ID NO: 8515668 - DNA, 22 bp, Homo sapiens
gaaatctacgattagtgaaaat

SEQ ID NO: 8515669 - DNA, 22 bp, Homo sapiens
gaaatatacatgaagtcggctg

SEQ ID NO: 8515670 - DNA, 23 bp, Homo sapiens
gaaatctagtcatttttagtctg

SEQ ID NO: 8515671 - DNA, 22 bp, Homo sapiens
gaaatatacatgaagtcggctg

SEQ ID NO: 8515672 - DNA, 22 bp, Homo sapiens
gaaaatgtgtcatccctactgt

SEQ ID NO: 8515673 - DNA, 22 bp, Homo sapiens
gaaaatgtgtcatccctactgt

SEQ ID NO: 8515674 - DNA, 22 bp, Homo sapiens
gaaaatgtgcctttgggtattg

SEQ ID NO: 8515675 - DNA, 22 bp, Homo sapiens
gaaaatgagcctcagctacatt

SEQ ID NO: 8515676 - DNA, 22 bp, Homo sapiens
gaaaatgagcctcagctacatt

SEQ ID NO: 8515677 - DNA, 22 bp, Homo sapiens
gaaaatgtgcctttgggtattg

SEQ ID NO: 8515678 - DNA, 22 bp, Homo sapiens
gaaaatgcctctggcattaaac

SEQ ID NO: 8515679 - DNA, 22 bp, Homo sapiens
gaaaatgcctctggcattaaac

SEQ ID NO: 8515680 - DNA, 22 bp, Homo sapiens
gaaatgatgtctgtgctgccac

SEQ ID NO: 8515681 - DNA, 22 bp, Homo sapiens
atgaggcagtctggcctgaggg

SEQ ID NO: 8515682 - DNA, 22 bp, Homo sapiens
atgaggcatctgcagtcactag

SEQ ID NO: 8515683 - DNA, 22 bp, Homo sapiens
atgaggcattccactcaaactc

SEQ ID NO: 8515684 - DNA, 22 bp, Homo sapiens
gaacaatgaaagacataaactc

SEQ ID NO: 8515685 - DNA, 22 bp, Homo sapiens
atgaggcatgtgaggagaaggg

SEQ ID NO: 8515686 - DNA, 22 bp, Homo sapiens
atgaggcatgtgaggagaaggg

SEQ ID NO: 8515687 - DNA, 22 bp, Homo sapiens
gaacatcaaggtctgtgtctag

SEQ ID NO: 8515688 - DNA, 22 bp, Homo sapiens
gaacatcagtcataatttaacg

SEQ ID NO: 8515689 - DNA, 22 bp, Homo sapiens
gaacatcatgaagaaaacatat

SEQ ID NO: 8515690 - DNA, 22 bp, Homo sapiens
gaacataactattgtgaatagt

SEQ ID NO: 8515691 - DNA, 22 bp, Homo sapiens
gaacaatgagtcattcaggtga

SEQ ID NO: 8515692 - DNA, 22 bp, Homo sapiens
gaacaatgagtcattcaggtga

SEQ ID NO: 8515693 - DNA, 22 bp, Homo sapiens
gaacatttatgatgcaatacct

SEQ ID NO: 8515694 - DNA, 22 bp, Homo sapiens
gaacatttccagaaaggaacta

SEQ ID NO: 8515695 - DNA, 22 bp, Homo sapiens
gaacattcttggaggaaataac

SEQ ID NO: 8515696 - DNA, 22 bp, Homo sapiens
gaacattcttggaggaaataac

SEQ ID NO: 8515697 - DNA, 22 bp, Homo sapiens
gaacattgctttatttcttcta

SEQ ID NO: 8515698 - DNA, 20 bp, Homo sapiens
gaacatggcaggtggagggg

SEQ ID NO: 8515699 - DNA, 22 bp, Homo sapiens
gaacattcacagactcaccatt

SEQ ID NO: 8515700 - DNA, 23 bp, Homo sapiens
gaacattcattggttgctttaga

SEQ ID NO: 8515701 - DNA, 22 bp, Homo sapiens
gaacatgaaaagtcttacacgc

SEQ ID NO: 8515702 - DNA, 17 bp, Homo sapiens
gaacttttattaaattc

SEQ ID NO: 8515703 - DNA, 18 bp, Homo sapiens
gaacttttggctttgtgt

SEQ ID NO: 8515704 - DNA, 22 bp, Homo sapiens
gaacttttgggaagccgtgtga

SEQ ID NO: 8515705 - DNA, 22 bp, Homo sapiens
gaagaaacaggggcttggggag

SEQ ID NO: 8515706 - DNA, 22 bp, Homo sapiens
gaactttattccagaagaaagc

SEQ ID NO: 8515707 - DNA, 22 bp, Homo sapiens
gaactttaccatttaggtaact

SEQ ID NO: 8515708 - DNA, 22 bp, Homo sapiens
gaactttaccatttaggtaact

SEQ ID NO: 8515709 - DNA, 22 bp, Homo sapiens
gaactttaggattttcacaggt

SEQ ID NO: 8515710 - DNA, 22 bp, Homo sapiens
gaacatttgatgatgacattgg

SEQ ID NO: 8515711 - DNA, 22 bp, Homo sapiens
gaacatttgatgatgacattgg

SEQ ID NO: 8515712 - DNA, 22 bp, Homo sapiens
gaactttaaaacaaagtacagt

SEQ ID NO: 8515713 - DNA, 22 bp, Homo sapiens
gaactttaatcccttgggctta

SEQ ID NO: 8515714 - DNA, 22 bp, Homo sapiens
atgcaagagcaatatggtatgc

SEQ ID NO: 8515715 - DNA, 22 bp, Homo sapiens
atgcaagatgtatagaagactt

SEQ ID NO: 8515716 - DNA, 22 bp, Homo sapiens
atgcaagatgtatagaagactt

SEQ ID NO: 8515717 - DNA, 23 bp, Homo sapiens
atgcaagagtttctcaaactgga

SEQ ID NO: 8515718 - DNA, 22 bp, Homo sapiens
gaagaaactgaaaggggttggt

SEQ ID NO: 8515719 - DNA, 22 bp, Homo sapiens
gaagaaacaggggcttggggag

SEQ ID NO: 8515720 - DNA, 22 bp, Homo sapiens
atgcaataaatactttccagct

SEQ ID NO: 8515721 - DNA, 22 bp, Homo sapiens
atgcaatatagggaagatagat

SEQ ID NO: 8515722 - DNA, 22 bp, Homo sapiens
atgcaatagtaattctagtctg

SEQ ID NO: 8515723 - DNA, 22 bp, Homo sapiens
atgcaatatgtgtttctgttta

SEQ ID NO: 8515724 - DNA, 22 bp, Homo sapiens
atgcaatggtatatggtcacct

SEQ ID NO: 8515725 - DNA, 22 bp, Homo sapiens
atgcaatttactgtacataaat

SEQ ID NO: 8515726 - DNA, 22 bp, Homo sapiens
atgcaatgttacagaatgtact

SEQ ID NO: 8515727 - DNA, 22 bp, Homo sapiens
atgcacaagaggctagaaaaga

SEQ ID NO: 8515728 - DNA, 22 bp, Homo sapiens
atgcacaacagtggctgccttg

SEQ ID NO: 8515729 - DNA, 22 bp, Homo sapiens
cacagcataatgaaatatactt

SEQ ID NO: 8515730 - DNA, 22 bp, Homo sapiens
cacagcataatgaaatatactt

SEQ ID NO: 8515731 - DNA, 22 bp, Homo sapiens
cacagcataatgaaatatactt

SEQ ID NO: 8515732 - DNA, 22 bp, Homo sapiens
cacagcattaactgggacagct

SEQ ID NO: 8515733 - DNA, 22 bp, Homo sapiens
cacagcagtctttcactaaata

SEQ ID NO: 8515734 - DNA, 22 bp, Homo sapiens
cacagcagtctttcactaaata

SEQ ID NO: 8515735 - DNA, 21 bp, Homo sapiens
cacagcagggttcctgggctc

SEQ ID NO: 8515736 - DNA, 22 bp, Homo sapiens
cacagcagggatgaatggagtg

SEQ ID NO: 8515737 - DNA, 22 bp, Homo sapiens
cacagcagggcatggctgttgt

SEQ ID NO: 8515738 - DNA, 22 bp, Homo sapiens
cacagcaggcagaacgtgggca

SEQ ID NO: 8515739 - DNA, 22 bp, Homo sapiens
cacagcaggcactatacagggc

SEQ ID NO: 8515740 - DNA, 22 bp, Homo sapiens
cacagcagggatgaatggagtg

SEQ ID NO: 8515741 - DNA, 22 bp, Homo sapiens
cacagcccccttgacactctgg

SEQ ID NO: 8515742 - DNA, 22 bp, Homo sapiens
cacagcattgccttccaaaagg

SEQ ID NO: 8515743 - DNA, 22 bp, Homo sapiens
cacagcattcacagaaagacat

SEQ ID NO: 8515744 - DNA, 22 bp, Homo sapiens
ggagcagccgcgtctcagggca

SEQ ID NO: 8515745 - DNA, 22 bp, Homo sapiens
ggagcagccacgtctcagggca

SEQ ID NO: 8515746 - DNA, 22 bp, Homo sapiens
ggagcagcttgcatgctcaggg

SEQ ID NO: 8515747 - DNA, 22 bp, Homo sapiens
ggagcagcttgcatgctcaggg

SEQ ID NO: 8515748 - DNA, 22 bp, Homo sapiens
ggagcagcctgtgtagacgggg

SEQ ID NO: 8515749 - DNA, 22 bp, Homo sapiens
ggagcaggagtctcttgaattt

SEQ ID NO: 8515750 - DNA, 20 bp, Homo sapiens
ggagctggcatccagcctct

SEQ ID NO: 8515751 - DNA, 22 bp, Homo sapiens
ggaggagacggagtgattagtg

SEQ ID NO: 8515752 - DNA, 22 bp, Homo sapiens
ggaggagacggagtgattagtg

SEQ ID NO: 8515753 - DNA, 22 bp, Homo sapiens
ggaggagattcccctctcactt

SEQ ID NO: 8515754 - DNA, 22 bp, Homo sapiens
ggaggagcacttctgagctcag

SEQ ID NO: 8515755 - DNA, 22 bp, Homo sapiens
ggaggagcacttgacggggtct

SEQ ID NO: 8515756 - DNA, 22 bp, Homo sapiens
ggaggagcacttgacggggtct

SEQ ID NO: 8515757 - DNA, 22 bp, Homo sapiens
ggaggagcacttgacggggtct

SEQ ID NO: 8515758 - DNA, 22 bp, Homo sapiens
ggaggagcacttctgagctcag

SEQ ID NO: 8515759 - DNA, 18 bp, Homo sapiens
cacaggagatgacctgac

SEQ ID NO: 8515760 - DNA, 18 bp, Homo sapiens
cacaggagatgacctgac

SEQ ID NO: 8515761 - DNA, 22 bp, Homo sapiens
cacaggagattgatctattggt

SEQ ID NO: 8515762 - DNA, 22 bp, Homo sapiens
cacaggagattgatctattggt

SEQ ID NO: 8515763 - DNA, 22 bp, Homo sapiens
cacaggagaggttaatgggggc

SEQ ID NO: 8515764 - DNA, 22 bp, Homo sapiens
cacaggagaggttaatgggggc

SEQ ID NO: 8515765 - DNA, 22 bp, Homo sapiens
cacaggagaggttaatgggggc

SEQ ID NO: 8515766 - DNA, 22 bp, Homo sapiens
cacaggagaggttaatgggggc

SEQ ID NO: 8515767 - DNA, 22 bp, Homo sapiens
cacaggagaaaggggaagctcg

SEQ ID NO: 8515768 - DNA, 22 bp, Homo sapiens
cacaggagaacccacagattct

SEQ ID NO: 8515769 - DNA, 22 bp, Homo sapiens
cacaggagaacccacagattct

SEQ ID NO: 8515770 - DNA, 22 bp, Homo sapiens
cacaggagaaaggggaagctcg

SEQ ID NO: 8515771 - DNA, 22 bp, Homo sapiens
cacaggagagctgggaggtgcc

SEQ ID NO: 8515772 - DNA, 22 bp, Homo sapiens
cacaggagagctgggaggtgcc

SEQ ID NO: 8515773 - DNA, 22 bp, Homo sapiens
cacaggagagctgggaggtgcc

SEQ ID NO: 8515774 - DNA, 22 bp, Homo sapiens
ggaggggccggctgcctgccac

SEQ ID NO: 8515775 - DNA, 22 bp, Homo sapiens
ggaggggccggctgcctgccac

SEQ ID NO: 8515776 - DNA, 22 bp, Homo sapiens
ggaggggcatagttcaccatca

SEQ ID NO: 8515777 - DNA, 22 bp, Homo sapiens
ggaggggccggctgcctgccac

SEQ ID NO: 8515778 - DNA, 22 bp, Homo sapiens
ggaggggccggctgcctgccac

SEQ ID NO: 8515779 - DNA, 22 bp, Homo sapiens
ggaggggcagccatggaactcc

SEQ ID NO: 8515780 - DNA, 22 bp, Homo sapiens
ggaggggcagccatggaactcc

SEQ ID NO: 8515781 - DNA, 22 bp, Homo sapiens
ggaggggatttagtagatgcta

SEQ ID NO: 8515782 - DNA, 22 bp, Homo sapiens
ggaggggcagccatggaactcc

SEQ ID NO: 8515783 - DNA, 22 bp, Homo sapiens
ggaggggcaggtcccaagttgt

SEQ ID NO: 8515784 - DNA, 22 bp, Homo sapiens
ggaggggcagccatggaactcc

SEQ ID NO: 8515785 - DNA, 22 bp, Homo sapiens
ggaggggcaggtcccaagttgt

SEQ ID NO: 8515786 - DNA, 22 bp, Homo sapiens
cacagctacctgcatgcctgct

SEQ ID NO: 8515787 - DNA, 22 bp, Homo sapiens
cacagctagatggatagataga

SEQ ID NO: 8515788 - DNA, 22 bp, Homo sapiens
cacagctagactaattgctggg

SEQ ID NO: 8515789 - DNA, 22 bp, Homo sapiens
cacagcctttagggtacacaca

SEQ ID NO: 8515790 - DNA, 19 bp, Homo sapiens
cacagcgaagacaaggtgg

SEQ ID NO: 8515791 - DNA, 22 bp, Homo sapiens
cacagcctgctgcactcaagaa

SEQ ID NO: 8515792 - DNA, 22 bp, Homo sapiens
cacagcctgctgcactcaagaa

SEQ ID NO: 8515793 - DNA, 22 bp, Homo sapiens
cacagccttactgagatccact

SEQ ID NO: 8515794 - DNA, 22 bp, Homo sapiens
cacagccttgagcgaggacaag

SEQ ID NO: 8515795 - DNA, 22 bp, Homo sapiens
cacagccttactgagatccact

SEQ ID NO: 8515796 - DNA, 22 bp, Homo sapiens
cacagcctccttcagagagcat

SEQ ID NO: 8515797 - DNA, 22 bp, Homo sapiens
cacagcctcctctggctcacgg

SEQ ID NO: 8515798 - DNA, 22 bp, Homo sapiens
ggagggcaacttttcagtaggt

SEQ ID NO: 8515799 - DNA, 22 bp, Homo sapiens
ggagggcaacttttcagtaggt

SEQ ID NO: 8515800 - DNA, 22 bp, Homo sapiens
cacagctgaagtagccatgtgg

SEQ ID NO: 8515801 - DNA, 22 bp, Homo sapiens
ggagggagtttcattcctgccc

SEQ ID NO: 8515802 - DNA, 22 bp, Homo sapiens
cacagctgaagtagccatgtgg

SEQ ID NO: 8515803 - DNA, 22 bp, Homo sapiens
cacagctatgagcagcctagct

SEQ ID NO: 8515804 - DNA, 22 bp, Homo sapiens
ggaggggatggtttgaccctgg

SEQ ID NO: 8515805 - DNA, 22 bp, Homo sapiens
ggaggggatggtttgaccctgg

SEQ ID NO: 8515806 - DNA, 22 bp, Homo sapiens
ggaggggatggtttgaccctgg

SEQ ID NO: 8515807 - DNA, 22 bp, Homo sapiens
ggaggggatttagtagatgcta

SEQ ID NO: 8515808 - DNA, 22 bp, Homo sapiens
ggaggggatttagtagatgcta

SEQ ID NO: 8515809 - DNA, 22 bp, Homo sapiens
ggaggggatttagtagatgcta

SEQ ID NO: 8515810 - DNA, 22 bp, Homo sapiens
ggaggggatttagtagatgcta

SEQ ID NO: 8515811 - DNA, 22 bp, Homo sapiens
ggaggggatggtttgaccctgg

SEQ ID NO: 8515812 - DNA, 22 bp, Homo sapiens
ggaagagagggctgggcctcaa

SEQ ID NO: 8515813 - DNA, 19 bp, Homo sapiens
ggaagagaggaaaggtgga

SEQ ID NO: 8515814 - DNA, 22 bp, Homo sapiens
ggaagagagatcccatagatgt

SEQ ID NO: 8515815 - DNA, 22 bp, Homo sapiens
ggaagacagaagcctacagctt

SEQ ID NO: 8515816 - DNA, 22 bp, Homo sapiens
ggaagacatctgcttgcaccag

SEQ ID NO: 8515817 - DNA, 22 bp, Homo sapiens
ggaacaggaaaggagggatgct

SEQ ID NO: 8515818 - DNA, 22 bp, Homo sapiens
ggaacaggaaaggagggatgct

SEQ ID NO: 8515819 - DNA, 22 bp, Homo sapiens
ggaacaggaaaggagggatgct

SEQ ID NO: 8515820 - DNA, 22 bp, Homo sapiens
ggaacaggaaaggagggatgct

SEQ ID NO: 8515821 - DNA, 22 bp, Homo sapiens
ggacaagcctgtgagtgggttt

SEQ ID NO: 8515822 - DNA, 22 bp, Homo sapiens
ggacaacatgttttaattaagg

SEQ ID NO: 8515823 - DNA, 22 bp, Homo sapiens
ggacaagcctgtgagtgggttt

SEQ ID NO: 8515824 - DNA, 22 bp, Homo sapiens
ggacaagcctcagacaaaactc

SEQ ID NO: 8515825 - DNA, 22 bp, Homo sapiens
ggacaacacttcattccagcta

SEQ ID NO: 8515826 - DNA, 22 bp, Homo sapiens
ggacaaaggtctggggaacctg

SEQ ID NO: 8515827 - DNA, 22 bp, Homo sapiens
ggaaggggtcacctcctgatga

SEQ ID NO: 8515828 - DNA, 22 bp, Homo sapiens
ggacaaagctctgctgcctccc

SEQ ID NO: 8515829 - DNA, 22 bp, Homo sapiens
ggaaggggtcacctcctgatga

SEQ ID NO: 8515830 - DNA, 22 bp, Homo sapiens
ggaaggggtcacctcctgatga

SEQ ID NO: 8515831 - DNA, 22 bp, Homo sapiens
ggacaaagggctagccacaact

SEQ ID NO: 8515832 - DNA, 22 bp, Homo sapiens
ggacacagataatcacacagat

SEQ ID NO: 8515833 - DNA, 22 bp, Homo sapiens
ggacacagataatcacacagat

SEQ ID NO: 8515834 - DNA, 22 bp, Homo sapiens
ggacagcacagctcttgacaac

SEQ ID NO: 8515835 - DNA, 22 bp, Homo sapiens
ggacagcacagctcttgacaac

SEQ ID NO: 8515836 - DNA, 22 bp, Homo sapiens
ggacagagggttgacagagtat

SEQ ID NO: 8515837 - DNA, 22 bp, Homo sapiens
ggacagagggttgacagagtat

SEQ ID NO: 8515838 - DNA, 22 bp, Homo sapiens
ggacacagacctttctgttcta

SEQ ID NO: 8515839 - DNA, 19 bp, Homo sapiens
ggacacagaaagctgcatt

SEQ ID NO: 8515840 - DNA, 19 bp, Homo sapiens
ggacacagaaagctgcatt

SEQ ID NO: 8515841 - DNA, 19 bp, Homo sapiens
ggacacagaaagctgcatt

SEQ ID NO: 8515842 - DNA, 22 bp, Homo sapiens
ggacacaaaagtgaataaaata

SEQ ID NO: 8515843 - DNA, 22 bp, Homo sapiens
ggacacaagctccggggctgca

SEQ ID NO: 8515844 - DNA, 21 bp, Homo sapiens
ggacagctgcgcgcagggctc

SEQ ID NO: 8515845 - DNA, 22 bp, Homo sapiens
ggacagctctgccaggagctca

SEQ ID NO: 8515846 - DNA, 22 bp, Homo sapiens
ggacagctgctttcaggccaca

SEQ ID NO: 8515847 - DNA, 22 bp, Homo sapiens
ggacagctgctttcaggccaca

SEQ ID NO: 8515848 - DNA, 22 bp, Homo sapiens
ggacagcgtggctggtggaggg

SEQ ID NO: 8515849 - DNA, 22 bp, Homo sapiens
ggacagctcctgcacttgagta

SEQ ID NO: 8515850 - DNA, 22 bp, Homo sapiens
ggacagcgtggctggtggaggg

SEQ ID NO: 8515851 - DNA, 22 bp, Homo sapiens
ggacagcatatcagcagggcag

SEQ ID NO: 8515852 - DNA, 22 bp, Homo sapiens
ggacagcattctactgtaggca

SEQ ID NO: 8515853 - DNA, 22 bp, Homo sapiens
ggacagcattctactgtaggca

SEQ ID NO: 8515854 - DNA, 22 bp, Homo sapiens
ggacagcatatcagcagggcag

SEQ ID NO: 8515855 - DNA, 22 bp, Homo sapiens
ggacagcatatcagcagggcag

SEQ ID NO: 8515856 - DNA, 22 bp, Homo sapiens
ggagagtggattccagctgtat

SEQ ID NO: 8515857 - DNA, 22 bp, Homo sapiens
ggagagttgtttttgcctagat

SEQ ID NO: 8515858 - DNA, 17 bp, Homo sapiens
ggagagtgggaatggcc

SEQ ID NO: 8515859 - DNA, 17 bp, Homo sapiens
ggagagtgggaatggcc

SEQ ID NO: 8515860 - DNA, 22 bp, Homo sapiens
ggagagtctgccgagccagccc

SEQ ID NO: 8515861 - DNA, 22 bp, Homo sapiens
ggagagtctgctggccacagtg

SEQ ID NO: 8515862 - DNA, 22 bp, Homo sapiens
ggagagtctgctggccacagtg

SEQ ID NO: 8515863 - DNA, 22 bp, Homo sapiens
ggagagtctgccgagccagccc

SEQ ID NO: 8515864 - DNA, 18 bp, Homo sapiens
ggagagtgacagagtcgt

SEQ ID NO: 8515865 - DNA, 22 bp, Homo sapiens
ggagagctgacatcatgatgtt

SEQ ID NO: 8515866 - DNA, 22 bp, Homo sapiens
ggagagctgacatcatgatgtt

SEQ ID NO: 8515867 - DNA, 22 bp, Homo sapiens
ggagaggttatccgtgttatgt

SEQ ID NO: 8515868 - DNA, 22 bp, Homo sapiens
ggagagctgaagcatggacagg

SEQ ID NO: 8515869 - DNA, 22 bp, Homo sapiens
cacagagaactgtgggagtgtg

SEQ ID NO: 8515870 - DNA, 22 bp, Homo sapiens
cacagagaactgtgggagtgtg

SEQ ID NO: 8515871 - DNA, 22 bp, Homo sapiens
cacagagaactgtgggagtgtg

SEQ ID NO: 8515872 - DNA, 22 bp, Homo sapiens
cacagagaactgtgggagtgtg

SEQ ID NO: 8515873 - DNA, 22 bp, Homo sapiens
ggagatctgagagctggaagtg

SEQ ID NO: 8515874 - DNA, 22 bp, Homo sapiens
cacagagaatactgctcttgct

SEQ ID NO: 8515875 - DNA, 22 bp, Homo sapiens
cacagagaatgatgagtcactg

SEQ ID NO: 8515876 - DNA, 22 bp, Homo sapiens
ggagatagacttggtgagccac

SEQ ID NO: 8515877 - DNA, 22 bp, Homo sapiens
ggagatagacttggtgagccac

SEQ ID NO: 8515878 - DNA, 19 bp, Homo sapiens
ggagatcccgctgcagatg

SEQ ID NO: 8515879 - DNA, 22 bp, Homo sapiens
ggagatccaggctgagtctttc

SEQ ID NO: 8515880 - DNA, 22 bp, Homo sapiens
ggagatccaggcaaggccgcag

SEQ ID NO: 8515881 - DNA, 23 bp, Homo sapiens
ggagatcagagactagggcagtt

SEQ ID NO: 8515882 - DNA, 22 bp, Homo sapiens
cacagagaattcccatatgtga

SEQ ID NO: 8515883 - DNA, 22 bp, Homo sapiens
cacagagaatgatgagtcactg

SEQ ID NO: 8515884 - DNA, 22 bp, Homo sapiens
cacagagaatgatgagtcactg

SEQ ID NO: 8515885 - DNA, 22 bp, Homo sapiens
cacagagacagaagcacttatg

SEQ ID NO: 8515886 - DNA, 22 bp, Homo sapiens
cacagagacagaagcacttatg

SEQ ID NO: 8515887 - DNA, 22 bp, Homo sapiens
cacagagacagaagcacttatg

SEQ ID NO: 8515888 - DNA, 22 bp, Homo sapiens
cacagagacatgatgtcattgc

SEQ ID NO: 8515889 - DNA, 22 bp, Homo sapiens
cacagagacagatctattttgc

SEQ ID NO: 8515890 - DNA, 22 bp, Homo sapiens
cacagcaaaggcttcggctgat

SEQ ID NO: 8515891 - DNA, 22 bp, Homo sapiens
cacagcaaaggcttcggctgat

SEQ ID NO: 8515892 - DNA, 22 bp, Homo sapiens
cacagcaaagacactctcaact

SEQ ID NO: 8515893 - DNA, 22 bp, Homo sapiens
cacagcaaagacactctcaact

SEQ ID NO: 8515894 - DNA, 22 bp, Homo sapiens
caagttcattgtagcattattg

SEQ ID NO: 8515895 - DNA, 22 bp, Homo sapiens
caagttcacgttgctttttgag

SEQ ID NO: 8515896 - DNA, 22 bp, Homo sapiens
caagtgatcagacactgaagtc

SEQ ID NO: 8515897 - DNA, 22 bp, Homo sapiens
caagtcaatgattataagagtc

SEQ ID NO: 8515898 - DNA, 22 bp, Homo sapiens
caagtgtccatgatagtcttag

SEQ ID NO: 8515899 - DNA, 22 bp, Homo sapiens
caagtgtcttcaaaggctaaaa

SEQ ID NO: 8515900 - DNA, 22 bp, Homo sapiens
caagtgtctatatcagtgcttg

SEQ ID NO: 8515901 - DNA, 21 bp, Homo sapiens
caagtgtggatgtggaaggta

SEQ ID NO: 8515902 - DNA, 22 bp, Homo sapiens
gctggtgccttgttgttgttac

SEQ ID NO: 8515903 - DNA, 22 bp, Homo sapiens
gctggtgagcaaaggagaagga

SEQ ID NO: 8515904 - DNA, 22 bp, Homo sapiens
gctggtgagcaaaggagaagga

SEQ ID NO: 8515905 - DNA, 22 bp, Homo sapiens
gctggtgcattagctgcagttc

SEQ ID NO: 8515906 - DNA, 22 bp, Homo sapiens
gctggtgcattagctgcagttc

SEQ ID NO: 8515907 - DNA, 22 bp, Homo sapiens
gctggtgattgcctcaggaggc

SEQ ID NO: 8515908 - DNA, 22 bp, Homo sapiens
gctggtttccttatctataaag

SEQ ID NO: 8515909 - DNA, 22 bp, Homo sapiens
gctggtttcacccaaccgatgt

SEQ ID NO: 8515910 - DNA, 22 bp, Homo sapiens
gctggttagaaaacagagctca

SEQ ID NO: 8515911 - DNA, 22 bp, Homo sapiens
gctggttaggtgagggtgcgcc

SEQ ID NO: 8515912 - DNA, 22 bp, Homo sapiens
gctggttagaaaacagagctca

SEQ ID NO: 8515913 - DNA, 22 bp, Homo sapiens
caatgcaagcaagatggtcaca

SEQ ID NO: 8515914 - DNA, 22 bp, Homo sapiens
caatgcacatggacatcaggct

SEQ ID NO: 8515915 - DNA, 22 bp, Homo sapiens
caatgcacgctcagatttgacc

SEQ ID NO: 8515916 - DNA, 22 bp, Homo sapiens
caatgcatacttcgaaatttca

SEQ ID NO: 8515917 - DNA, 22 bp, Homo sapiens
caatgcatacttcgaaatttca

SEQ ID NO: 8515918 - DNA, 20 bp, Homo sapiens
caatgcacacagctgcttct

SEQ ID NO: 8515919 - DNA, 22 bp, Homo sapiens
caatgcaatgcaatgcaatgca

SEQ ID NO: 8515920 - DNA, 22 bp, Homo sapiens
caatgcaatgcaatgcaatgca

SEQ ID NO: 8515921 - DNA, 22 bp, Homo sapiens
caatgcttgctgactccctgtc

SEQ ID NO: 8515922 - DNA, 22 bp, Homo sapiens
caatgcttctgagggaattaca

SEQ ID NO: 8515923 - DNA, 22 bp, Homo sapiens
caatgcttctcattagccaatg

SEQ ID NO: 8515924 - DNA, 22 bp, Homo sapiens
caatgcttttagcttcagcttg

SEQ ID NO: 8515925 - DNA, 22 bp, Homo sapiens
caatgcttttgttctttactca

SEQ ID NO: 8515926 - DNA, 22 bp, Homo sapiens
caatgctttatttcctcccctt

SEQ ID NO: 8515927 - DNA, 22 bp, Homo sapiens
caatgctttatttcctcccctt

SEQ ID NO: 8515928 - DNA, 22 bp, Homo sapiens
caatgcttttagcttcagcttg

SEQ ID NO: 8515929 - DNA, 22 bp, Homo sapiens
caatgctaggcagatcctgcgt

SEQ ID NO: 8515930 - DNA, 22 bp, Homo sapiens
caatgctatcatgtcagagata

SEQ ID NO: 8515931 - DNA, 22 bp, Homo sapiens
caatgcttctcattagccaatg

SEQ ID NO: 8515932 - DNA, 22 bp, Homo sapiens
caatgcttctcattagccaatg

SEQ ID NO: 8515933 - DNA, 22 bp, Homo sapiens
caatgcttcaggctccttatag

SEQ ID NO: 8515934 - DNA, 21 bp, Homo sapiens
caatggcgagatcttggctca

SEQ ID NO: 8515935 - DNA, 21 bp, Homo sapiens
caatggcgagatcttggctca

SEQ ID NO: 8515936 - DNA, 21 bp, Homo sapiens
caatggcgagatcttggctca

SEQ ID NO: 8515937 - DNA, 22 bp, Homo sapiens
caatgggagcagaaattgtttg

SEQ ID NO: 8515938 - DNA, 22 bp, Homo sapiens
caatggtggtgtcagaagagat

SEQ ID NO: 8515939 - DNA, 20 bp, Homo sapiens
gcttccagaggaggccccgt

SEQ ID NO: 8515940 - DNA, 22 bp, Homo sapiens
gcttccagcaaacactggctgc

SEQ ID NO: 8515941 - DNA, 22 bp, Homo sapiens
gcttccagatcccatgctctta

SEQ ID NO: 8515942 - DNA, 22 bp, Homo sapiens
gcttccagacgatcatgtaaga

SEQ ID NO: 8515943 - DNA, 22 bp, Homo sapiens
gcttccagagagccccgcctgg

SEQ ID NO: 8515944 - DNA, 22 bp, Homo sapiens
gcttccagagagccccgcctgg

SEQ ID NO: 8515945 - DNA, 22 bp, Homo sapiens
caatgtactacaaagattgtca

SEQ ID NO: 8515946 - DNA, 22 bp, Homo sapiens
gcttccagaccccagtccctca

SEQ ID NO: 8515947 - DNA, 22 bp, Homo sapiens
gcttccagaatgactaggatgt

SEQ ID NO: 8515948 - DNA, 22 bp, Homo sapiens
gcttccacctactaaatgccac

SEQ ID NO: 8515949 - DNA, 22 bp, Homo sapiens
gcttccaggcttcctacctttg

SEQ ID NO: 8515950 - DNA, 22 bp, Homo sapiens
gcttccagggctcagtcactgc

SEQ ID NO: 8515951 - DNA, 22 bp, Homo sapiens
gcttccagggctcagtcactgc

SEQ ID NO: 8515952 - DNA, 22 bp, Homo sapiens
ggaaacaaaccactcatggtgg

SEQ ID NO: 8515953 - DNA, 22 bp, Homo sapiens
ggaaatgacttggtgcttcgtt

SEQ ID NO: 8515954 - DNA, 22 bp, Homo sapiens
ggaaaatttccttcaaaatgtg

SEQ ID NO: 8515955 - DNA, 22 bp, Homo sapiens
ggaaaatttccttcaaaatgtg

SEQ ID NO: 8515956 - DNA, 22 bp, Homo sapiens
ggaaaatttccttcaaaatgtg

SEQ ID NO: 8515957 - DNA, 19 bp, Homo sapiens
gcttccagcactgcaggag

SEQ ID NO: 8515958 - DNA, 19 bp, Homo sapiens
gcttccagcactgcaggag

SEQ ID NO: 8515959 - DNA, 19 bp, Homo sapiens
gcttccagcactgcaggag

SEQ ID NO: 8515960 - DNA, 22 bp, Homo sapiens
gcttccagccttttctcctctg

SEQ ID NO: 8515961 - DNA, 22 bp, Homo sapiens
gcttccagcaaacactggctgc

SEQ ID NO: 8515962 - DNA, 17 bp, Homo sapiens
ggaacaaatactatgca

SEQ ID NO: 8515963 - DNA, 17 bp, Homo sapiens
ggaacaaatactatgca

SEQ ID NO: 8515964 - DNA, 17 bp, Homo sapiens
ggaacaaatactatgca

SEQ ID NO: 8515965 - DNA, 22 bp, Homo sapiens
ggaacacagaagggctgaaaaa

SEQ ID NO: 8515966 - DNA, 22 bp, Homo sapiens
ggaacacaaatgggagagctgg

SEQ ID NO: 8515967 - DNA, 22 bp, Homo sapiens
ggaacacagtgccttacaaact

SEQ ID NO: 8515968 - DNA, 22 bp, Homo sapiens
ggaacacagtgccttacaaact

SEQ ID NO: 8515969 - DNA, 22 bp, Homo sapiens
ggaacactcgtcaaatagcggg

SEQ ID NO: 8515970 - DNA, 22 bp, Homo sapiens
ggaacactgccttttattttcc

SEQ ID NO: 8515971 - DNA, 22 bp, Homo sapiens
ggaacactcagaaatgctcgtc

SEQ ID NO: 8515972 - DNA, 22 bp, Homo sapiens
ggaacacagtgccttacaaact

SEQ ID NO: 8515973 - DNA, 22 bp, Homo sapiens
ggaaatgtgggctgtttctgta

SEQ ID NO: 8515974 - DNA, 22 bp, Homo sapiens
ggaaatgtaatcacagagggtt

SEQ ID NO: 8515975 - DNA, 22 bp, Homo sapiens
gctgggagccctggtctgctcc

SEQ ID NO: 8515976 - DNA, 22 bp, Homo sapiens
gctgggagccgtacctgtcacg

SEQ ID NO: 8515977 - DNA, 22 bp, Homo sapiens
gctgggaggaatttggggaata

SEQ ID NO: 8515978 - DNA, 22 bp, Homo sapiens
gctgggaggaatttggggaata

SEQ ID NO: 8515979 - DNA, 22 bp, Homo sapiens
gctgggagccgtacctgtcacg

SEQ ID NO: 8515980 - DNA, 22 bp, Homo sapiens
gctgggcccagatcccaggatc

SEQ ID NO: 8515981 - DNA, 22 bp, Homo sapiens
gctgggccccatccctcgagca

SEQ ID NO: 8515982 - DNA, 22 bp, Homo sapiens
gctgggcccagatcccaggatc

SEQ ID NO: 8515983 - DNA, 22 bp, Homo sapiens
gctgggcccagatcccaggatc

SEQ ID NO: 8515984 - DNA, 22 bp, Homo sapiens
gctgggccagccagacatgtga

SEQ ID NO: 8515985 - DNA, 22 bp, Homo sapiens
gctgggccagagcagcagcact

SEQ ID NO: 8515986 - DNA, 22 bp, Homo sapiens
gctgggaggaatttggggaata

SEQ ID NO: 8515987 - DNA, 22 bp, Homo sapiens
gctgggccagccagacatgtga

SEQ ID NO: 8515988 - DNA, 22 bp, Homo sapiens
gctgggccttccgattctcaag

SEQ ID NO: 8515989 - DNA, 20 bp, Homo sapiens
gctgggctaccactggccct

SEQ ID NO: 8515990 - DNA, 22 bp, Homo sapiens
gctgggccttccgattctcaag

SEQ ID NO: 8515991 - DNA, 22 bp, Homo sapiens
gctgggccgacctgggctgcag

SEQ ID NO: 8515992 - DNA, 21 bp, Homo sapiens
gctgggcctgtacttgccctg

SEQ ID NO: 8515993 - DNA, 21 bp, Homo sapiens
gctgggcctgtacttgccctg

SEQ ID NO: 8515994 - DNA, 22 bp, Homo sapiens
gctgggccccatccctcgagca

SEQ ID NO: 8515995 - DNA, 22 bp, Homo sapiens
gctgggccccttgaaaggcgtc

SEQ ID NO: 8515996 - DNA, 22 bp, Homo sapiens
gctgggccctgggtgccctagc

SEQ ID NO: 8515997 - DNA, 22 bp, Homo sapiens
gctgggccccttgaaaggcgtc

SEQ ID NO: 8515998 - DNA, 22 bp, Homo sapiens
gctgggccctgggtgccctagc

SEQ ID NO: 8515999 - DNA, 22 bp, Homo sapiens
gctgggccgacctgggctgcag

SEQ ID NO: 8516000 - DNA, 19 bp, Homo sapiens
gctgggagcagaccctccc

SEQ ID NO: 8516001 - DNA, 22 bp, Homo sapiens
gctgggagcaagtactcatctt

SEQ ID NO: 8516002 - DNA, 22 bp, Homo sapiens
gctgggagcaagtactcatctt

SEQ ID NO: 8516003 - DNA, 22 bp, Homo sapiens
gctgggagcaaagccatgcata

SEQ ID NO: 8516004 - DNA, 22 bp, Homo sapiens
gctgggagcaaagccatgcata

SEQ ID NO: 8516005 - DNA, 22 bp, Homo sapiens
gctgggagcaaagccatgcata

SEQ ID NO: 8516006 - DNA, 21 bp, Homo sapiens
gctggctgtctcttacacggt

SEQ ID NO: 8516007 - DNA, 22 bp, Homo sapiens
gctgggagccctggtctgctcc

SEQ ID NO: 8516008 - DNA, 22 bp, Homo sapiens
gctgggagccctggtctgctcc

SEQ ID NO: 8516009 - DNA, 22 bp, Homo sapiens
gctgggagccctggtctgctcc

SEQ ID NO: 8516010 - DNA, 22 bp, Homo sapiens
gctgggagccccgagccagcgc

SEQ ID NO: 8516011 - DNA, 19 bp, Homo sapiens
gctgggagcagaccctccc

SEQ ID NO: 8516012 - DNA, 19 bp, Homo sapiens
gctgggagcagaccctccc

SEQ ID NO: 8516013 - DNA, 22 bp, Homo sapiens
gctgggagccccgagccagcgc

SEQ ID NO: 8516014 - DNA, 22 bp, Homo sapiens
gctgggagccccgagccagcgc

SEQ ID NO: 8516015 - DNA, 22 bp, Homo sapiens
gctggcccagcgcccagggcag

SEQ ID NO: 8516016 - DNA, 21 bp, Homo sapiens
gctggctgtcccagggaagca

SEQ ID NO: 8516017 - DNA, 21 bp, Homo sapiens
gctggctgtcccagggaagca

SEQ ID NO: 8516018 - DNA, 22 bp, Homo sapiens
gctggccattctctttgagatg

SEQ ID NO: 8516019 - DNA, 22 bp, Homo sapiens
gctggcccagcgcccagggcag

SEQ ID NO: 8516020 - DNA, 22 bp, Homo sapiens
gctggccatggggagtgaggag

SEQ ID NO: 8516021 - DNA, 22 bp, Homo sapiens
gctggccatggggagtgaggag

SEQ ID NO: 8516022 - DNA, 22 bp, Homo sapiens
gctggccatggggagtgaggag

SEQ ID NO: 8516023 - DNA, 22 bp, Homo sapiens
gctggccatagaagccaaagag

SEQ ID NO: 8516024 - DNA, 22 bp, Homo sapiens
gctggccatagaagccaaagag

SEQ ID NO: 8516025 - DNA, 22 bp, Homo sapiens
gctggccatatattttgctgtt

SEQ ID NO: 8516026 - DNA, 22 bp, Homo sapiens
gctggccatggcctgcgccatc

SEQ ID NO: 8516027 - DNA, 22 bp, Homo sapiens
gctggccatggcctgcgccatc

SEQ ID NO: 8516028 - DNA, 19 bp, Homo sapiens
gctggcagatgtggccgtg

SEQ ID NO: 8516029 - DNA, 19 bp, Homo sapiens
gctggcagatgtggccgtg

SEQ ID NO: 8516030 - DNA, 22 bp, Homo sapiens
gctggcagcattagaccctggg

SEQ ID NO: 8516031 - DNA, 22 bp, Homo sapiens
gctggcagccaagtgaagaggg

SEQ ID NO: 8516032 - DNA, 22 bp, Homo sapiens
gctggccagtgtggtgaccacc

SEQ ID NO: 8516033 - DNA, 22 bp, Homo sapiens
gctggccagtgtcccagggatc

SEQ ID NO: 8516034 - DNA, 22 bp, Homo sapiens
gctggccagtgtggtgaccacc

SEQ ID NO: 8516035 - DNA, 22 bp, Homo sapiens
gctggcagagagctggtgagga

SEQ ID NO: 8516036 - DNA, 22 bp, Homo sapiens
gctggcagagagctggtgagga

SEQ ID NO: 8516037 - DNA, 22 bp, Homo sapiens
gctggcagagagctggtgagga

SEQ ID NO: 8516038 - DNA, 20 bp, Homo sapiens
gctggcagatgtcttgagat

SEQ ID NO: 8516039 - DNA, 22 bp, Homo sapiens
gctgaggtggagattgcagtga

SEQ ID NO: 8516040 - DNA, 22 bp, Homo sapiens
gctgaggtggagattgcagtga

SEQ ID NO: 8516041 - DNA, 22 bp, Homo sapiens
gctgaggtggagattgcagtga

SEQ ID NO: 8516042 - DNA, 19 bp, Homo sapiens
gctgaggtggaggaaggag

SEQ ID NO: 8516043 - DNA, 22 bp, Homo sapiens
caaatttaggtaacagtctgta

SEQ ID NO: 8516044 - DNA, 23 bp, Homo sapiens
gctgaggtacatttacaggaaga

SEQ ID NO: 8516045 - DNA, 22 bp, Homo sapiens
gctgaggtaggaggttgcagtg

SEQ ID NO: 8516046 - DNA, 22 bp, Homo sapiens
gctgaggtaggaggttgcagtg

SEQ ID NO: 8516047 - DNA, 22 bp, Homo sapiens
gctgaggtaggaggttgcagtg

SEQ ID NO: 8516048 - DNA, 20 bp, Homo sapiens
gctgaggtcattatgcctca

SEQ ID NO: 8516049 - DNA, 22 bp, Homo sapiens
gctgaggtcaggagctgtgggg

SEQ ID NO: 8516050 - DNA, 20 bp, Homo sapiens
gctgaggtcattatgcctca

SEQ ID NO: 8516051 - DNA, 20 bp, Homo sapiens
gctgaggtcattatgcctca

SEQ ID NO: 8516052 - DNA, 22 bp, Homo sapiens
gctgaggtccagcattcgccta

SEQ ID NO: 8516053 - DNA, 20 bp, Homo sapiens
gctgaggtccctgtggtttt

SEQ ID NO: 8516054 - DNA, 22 bp, Homo sapiens
gctgaggtgaggctggaaagga

SEQ ID NO: 8516055 - DNA, 20 bp, Homo sapiens
gctgaggtccctgtggtttt

SEQ ID NO: 8516056 - DNA, 23 bp, Homo sapiens
gctgaggtcctgctgagtggtgg

SEQ ID NO: 8516057 - DNA, 22 bp, Homo sapiens
caaatttaagttagaaagcaat

SEQ ID NO: 8516058 - DNA, 22 bp, Homo sapiens
caaatttaagttagaaagcaat

SEQ ID NO: 8516059 - DNA, 22 bp, Homo sapiens
caaatttaggtaacagtctgta

SEQ ID NO: 8516060 - DNA, 22 bp, Homo sapiens
caaatttaagtgaggtctttgt

SEQ ID NO: 8516061 - DNA, 18 bp, Homo sapiens
caaattctcattgatttc

SEQ ID NO: 8516062 - DNA, 22 bp, Homo sapiens
caaattcctcagaatcagaaaa

SEQ ID NO: 8516063 - DNA, 22 bp, Homo sapiens
caaattcagaaaattggtagag

SEQ ID NO: 8516064 - DNA, 22 bp, Homo sapiens
ggagtgactcacagctgggaca

SEQ ID NO: 8516065 - DNA, 22 bp, Homo sapiens
ggagtgactcacagctgggaca

SEQ ID NO: 8516066 - DNA, 22 bp, Homo sapiens
ggagtgactcacagctgggaca

SEQ ID NO: 8516067 - DNA, 22 bp, Homo sapiens
ggagtgactcacagctgggaca

SEQ ID NO: 8516068 - DNA, 22 bp, Homo sapiens
ggagtgaatcactagatgcaga

SEQ ID NO: 8516069 - DNA, 22 bp, Homo sapiens
ggagtgaagtggcgcgatctcg

SEQ ID NO: 8516070 - DNA, 22 bp, Homo sapiens
ggagtgaagcaaataatgctgg

SEQ ID NO: 8516071 - DNA, 23 bp, Homo sapiens
ggataaatctcagcttcttccat

SEQ ID NO: 8516072 - DNA, 21 bp, Homo sapiens
ggagtttttctggaagggact

SEQ ID NO: 8516073 - DNA, 22 bp, Homo sapiens
ggataaagtctttaggtggaca

SEQ ID NO: 8516074 - DNA, 22 bp, Homo sapiens
ggagtgactctcggggccacta

SEQ ID NO: 8516075 - DNA, 22 bp, Homo sapiens
ggagtgactcacagctgggaca

SEQ ID NO: 8516076 - DNA, 22 bp, Homo sapiens
ggagtgactctcggggccacta

SEQ ID NO: 8516077 - DNA, 22 bp, Homo sapiens
ggagtgagagagtttaaggtca

SEQ ID NO: 8516078 - DNA, 22 bp, Homo sapiens
ggagtgaatcactagatgcaga

SEQ ID NO: 8516079 - DNA, 22 bp, Homo sapiens
ggagtgagcaaatagagatttg

SEQ ID NO: 8516080 - DNA, 22 bp, Homo sapiens
ggagtctgttttacatgcagga

SEQ ID NO: 8516081 - DNA, 22 bp, Homo sapiens
ggagtctgtgtcttgaagcagt

SEQ ID NO: 8516082 - DNA, 22 bp, Homo sapiens
ggagtctggagtggggcccaag

SEQ ID NO: 8516083 - DNA, 22 bp, Homo sapiens
ggagtctgggaattggagagaa

SEQ ID NO: 8516084 - DNA, 22 bp, Homo sapiens
ggaggtggaggttgcagtgagc

SEQ ID NO: 8516085 - DNA, 22 bp, Homo sapiens
ggaggtggaggttgcagtgagc

SEQ ID NO: 8516086 - DNA, 22 bp, Homo sapiens
ggataagaaaattgtaataact

SEQ ID NO: 8516087 - DNA, 23 bp, Homo sapiens
ggatacaaagattaatagtagag

SEQ ID NO: 8516088 - DNA, 22 bp, Homo sapiens
ggatacaactagaagatggcag

SEQ ID NO: 8516089 - DNA, 22 bp, Homo sapiens
ggatacaaggtgttctatcact

SEQ ID NO: 8516090 - DNA, 22 bp, Homo sapiens
ggatacaactagaagatggcag

SEQ ID NO: 8516091 - DNA, 22 bp, Homo sapiens
ggatcaggctgaagctaggact

SEQ ID NO: 8516092 - DNA, 22 bp, Homo sapiens
ggatcattaacacatccatcac

SEQ ID NO: 8516093 - DNA, 19 bp, Homo sapiens
ggatccagaggatctgcca

SEQ ID NO: 8516094 - DNA, 22 bp, Homo sapiens
ggatccagaggtgaagatggga

SEQ ID NO: 8516095 - DNA, 22 bp, Homo sapiens
ggatcattaagaatagctacta

SEQ ID NO: 8516096 - DNA, 22 bp, Homo sapiens
ggatcagaatctctgagagttt

SEQ ID NO: 8516097 - DNA, 22 bp, Homo sapiens
ggatcagaatctctgagagttt

SEQ ID NO: 8516098 - DNA, 22 bp, Homo sapiens
ggcaggaagtagcagtctgagc

SEQ ID NO: 8516099 - DNA, 22 bp, Homo sapiens
ggcaggaagtagcagtctgagc

SEQ ID NO: 8516100 - DNA, 22 bp, Homo sapiens
ggcaggaagaggagggtgaact

SEQ ID NO: 8516101 - DNA, 22 bp, Homo sapiens
ggcagcttttatccctgacaga

SEQ ID NO: 8516102 - DNA, 22 bp, Homo sapiens
ggcagctgcaaatctgctctgt

SEQ ID NO: 8516103 - DNA, 22 bp, Homo sapiens
ggcagctgcaaatctgctctgt

SEQ ID NO: 8516104 - DNA, 22 bp, Homo sapiens
ggatccagtccagggctgtgtg

SEQ ID NO: 8516105 - DNA, 22 bp, Homo sapiens
ggatccagtccagggctgtgtg

SEQ ID NO: 8516106 - DNA, 22 bp, Homo sapiens
ggcaggagaaaggtctcttctt

SEQ ID NO: 8516107 - DNA, 22 bp, Homo sapiens
cacatgcattggcaaaagtgta

SEQ ID NO: 8516108 - DNA, 22 bp, Homo sapiens
cacatgcattggcaaaagtgta

SEQ ID NO: 8516109 - DNA, 22 bp, Homo sapiens
cacatgcccagaacttctcatt

SEQ ID NO: 8516110 - DNA, 22 bp, Homo sapiens
cacatgcatctgtcatgtttgg

SEQ ID NO: 8516111 - DNA, 22 bp, Homo sapiens
cacatgcatcacgacttccttt

SEQ ID NO: 8516112 - DNA, 22 bp, Homo sapiens
cacatgcagtttacgtcactga

SEQ ID NO: 8516113 - DNA, 22 bp, Homo sapiens
cacatgcatacctatgtgtata

SEQ ID NO: 8516114 - DNA, 22 bp, Homo sapiens
cacatgcatacctatgtgtata

SEQ ID NO: 8516115 - DNA, 22 bp, Homo sapiens
cacatgcataaggataattact

SEQ ID NO: 8516116 - DNA, 22 bp, Homo sapiens
cacatgcataaggataattact

SEQ ID NO: 8516117 - DNA, 22 bp, Homo sapiens
cacatgcatacctatgtgtata

SEQ ID NO: 8516118 - DNA, 22 bp, Homo sapiens
cacatttctctacctcacacaa

SEQ ID NO: 8516119 - DNA, 22 bp, Homo sapiens
cacatttctaggaaattaaatg

SEQ ID NO: 8516120 - DNA, 22 bp, Homo sapiens
ggcagtcacaggggagactggg

SEQ ID NO: 8516121 - DNA, 22 bp, Homo sapiens
cacatttctgtgagtcaatatt

SEQ ID NO: 8516122 - DNA, 22 bp, Homo sapiens
cacatttctgtgagtcaatatt

SEQ ID NO: 8516123 - DNA, 22 bp, Homo sapiens
ggcaggtgtggtgaccagagat

SEQ ID NO: 8516124 - DNA, 22 bp, Homo sapiens
ggcagtcaagagggagtctgaa

SEQ ID NO: 8516125 - DNA, 22 bp, Homo sapiens
ggcagtcaagagggagtctgaa

SEQ ID NO: 8516126 - DNA, 21 bp, Homo sapiens
ggcagtaagatttactttaag

SEQ ID NO: 8516127 - DNA, 22 bp, Homo sapiens
ggcagtagccagggactggcag

SEQ ID NO: 8516128 - DNA, 22 bp, Homo sapiens
ggcaggtgtgagctgtaaagga

SEQ ID NO: 8516129 - DNA, 22 bp, Homo sapiens
ggcaggtgtgagatcgaggcca

SEQ ID NO: 8516130 - DNA, 22 bp, Homo sapiens
cacatgctccatacagaatggg

SEQ ID NO: 8516131 - DNA, 22 bp, Homo sapiens
cacatgctagaataaatctcca

SEQ ID NO: 8516132 - DNA, 22 bp, Homo sapiens
ggcccagaagccagaagcctcc

SEQ ID NO: 8516133 - DNA, 22 bp, Homo sapiens
ggcccagagctccctggcacct

SEQ ID NO: 8516134 - DNA, 22 bp, Homo sapiens
ggcccagcacagtgcttggggg

SEQ ID NO: 8516135 - DNA, 22 bp, Homo sapiens
ggccccagcagaccctcctctg

SEQ ID NO: 8516136 - DNA, 22 bp, Homo sapiens
ggcccagcatcttgtgaagttt

SEQ ID NO: 8516137 - DNA, 22 bp, Homo sapiens
ggcccagcatcttgtgaagttt

SEQ ID NO: 8516138 - DNA, 22 bp, Homo sapiens
ggcccagcacagtgcttggggg

SEQ ID NO: 8516139 - DNA, 22 bp, Homo sapiens
ggcccagcccgagtcagccttc

SEQ ID NO: 8516140 - DNA, 22 bp, Homo sapiens
ggcccagcccgagtcagccttc

SEQ ID NO: 8516141 - DNA, 22 bp, Homo sapiens
ggcccagcccgagtcagccttc

SEQ ID NO: 8516142 - DNA, 22 bp, Homo sapiens
ggccccagcagaccctcctctg

SEQ ID NO: 8516143 - DNA, 17 bp, Homo sapiens
ggcctgtgtggctgcag

SEQ ID NO: 8516144 - DNA, 17 bp, Homo sapiens
ggcctgtgtggctgcag

SEQ ID NO: 8516145 - DNA, 17 bp, Homo sapiens
ggcctgtgtggctgcag

SEQ ID NO: 8516146 - DNA, 22 bp, Homo sapiens
ggccccagggattaggccaacc

SEQ ID NO: 8516147 - DNA, 22 bp, Homo sapiens
ggccccaggacctccacggtcc

SEQ ID NO: 8516148 - DNA, 22 bp, Homo sapiens
ggccccaggacctccacggtcc

SEQ ID NO: 8516149 - DNA, 22 bp, Homo sapiens
ggccccaggacctccacggtcc

SEQ ID NO: 8516150 - DNA, 22 bp, Homo sapiens
ggcgcccatcggtgcagagggc

SEQ ID NO: 8516151 - DNA, 22 bp, Homo sapiens
ggcgcccccttcaaacagagca

SEQ ID NO: 8516152 - DNA, 22 bp, Homo sapiens
ggcgccagcactgcagcgcctc

SEQ ID NO: 8516153 - DNA, 22 bp, Homo sapiens
ggcgccagcccaggccgtcgtg

SEQ ID NO: 8516154 - DNA, 22 bp, Homo sapiens
ggcgcacaatgtgcaggtttgt

SEQ ID NO: 8516155 - DNA, 22 bp, Homo sapiens
ggcgagggagcagtgcggtggg

SEQ ID NO: 8516156 - DNA, 22 bp, Homo sapiens
ggccagctcagggtccttgggc

SEQ ID NO: 8516157 - DNA, 22 bp, Homo sapiens
ggccagctcagtctccatcagg

SEQ ID NO: 8516158 - DNA, 22 bp, Homo sapiens
ggccagctccttggcagtgcct

SEQ ID NO: 8516159 - DNA, 22 bp, Homo sapiens
ggccagctccttggcagtgcct

SEQ ID NO: 8516160 - DNA, 22 bp, Homo sapiens
ggccagctcagtctccatcagg

SEQ ID NO: 8516161 - DNA, 18 bp, Homo sapiens
ggccagctcctgaggcag

SEQ ID NO: 8516162 - DNA, 22 bp, Homo sapiens
cacccagcagcacttaagacta

SEQ ID NO: 8516163 - DNA, 22 bp, Homo sapiens
cacccagccttcacacaggagt

SEQ ID NO: 8516164 - DNA, 22 bp, Homo sapiens
cacccagcattggctaagagag

SEQ ID NO: 8516165 - DNA, 22 bp, Homo sapiens
cacccagccttcacacaggagt

SEQ ID NO: 8516166 - DNA, 22 bp, Homo sapiens
cacccagccttcacacaggagt

SEQ ID NO: 8516167 - DNA, 22 bp, Homo sapiens
cacccaggacaaaatatggaat

SEQ ID NO: 8516168 - DNA, 22 bp, Homo sapiens
cacccaggctagagtgcagtgg

SEQ ID NO: 8516169 - DNA, 22 bp, Homo sapiens
cacccaggctagagtgcagtgg

SEQ ID NO: 8516170 - DNA, 22 bp, Homo sapiens
cacccaggctagagtgcagtgg

SEQ ID NO: 8516171 - DNA, 22 bp, Homo sapiens
cacccaggcatgggttgagatg

SEQ ID NO: 8516172 - DNA, 22 bp, Homo sapiens
cacccaggcatgggttgagatg

SEQ ID NO: 8516173 - DNA, 22 bp, Homo sapiens
cacccaggcaggtggctgagaa

SEQ ID NO: 8516174 - DNA, 22 bp, Homo sapiens
cacccaggcaggtggctgagaa

SEQ ID NO: 8516175 - DNA, 22 bp, Homo sapiens
cacccaggcaggtggctgagaa

SEQ ID NO: 8516176 - DNA, 22 bp, Homo sapiens
cacccaggcaggtggctgagaa

SEQ ID NO: 8516177 - DNA, 22 bp, Homo sapiens
cacccaggcaggtggctgagaa

SEQ ID NO: 8516178 - DNA, 22 bp, Homo sapiens
cacccaggcaaggattctgcaa

SEQ ID NO: 8516179 - DNA, 22 bp, Homo sapiens
cacccaggacaggccagatgtg

SEQ ID NO: 8516180 - DNA, 22 bp, Homo sapiens
cacccaggacaggccagatgtg

SEQ ID NO: 8516181 - DNA, 22 bp, Homo sapiens
cacccaggacaggccagatgtg

SEQ ID NO: 8516182 - DNA, 22 bp, Homo sapiens
cacccaggaggttgggaagggc

SEQ ID NO: 8516183 - DNA, 22 bp, Homo sapiens
ggccactgtttcctgggcagtt

SEQ ID NO: 8516184 - DNA, 18 bp, Homo sapiens
ggccagccccaggccagc

SEQ ID NO: 8516185 - DNA, 18 bp, Homo sapiens
ggccagccccaggccagc

SEQ ID NO: 8516186 - DNA, 22 bp, Homo sapiens
ggccagcctggggctcccagac

SEQ ID NO: 8516187 - DNA, 22 bp, Homo sapiens
ggccagccctcctccctgggtt

SEQ ID NO: 8516188 - DNA, 22 bp, Homo sapiens
ggccagccctcctccctgggtt

SEQ ID NO: 8516189 - DNA, 22 bp, Homo sapiens
ggccagcctggggctcccagac

SEQ ID NO: 8516190 - DNA, 22 bp, Homo sapiens
ggccagcggcacagcctggccc

SEQ ID NO: 8516191 - DNA, 20 bp, Homo sapiens
caccacagaattggggacag

SEQ ID NO: 8516192 - DNA, 22 bp, Homo sapiens
caccactgaattgttcactttc

SEQ ID NO: 8516193 - DNA, 22 bp, Homo sapiens
caccactgaattgttcactttc

SEQ ID NO: 8516194 - DNA, 22 bp, Homo sapiens
caccacagcatccactagaagg

SEQ ID NO: 8516195 - DNA, 20 bp, Homo sapiens
caccacagaattggggacag

SEQ ID NO: 8516196 - DNA, 19 bp, Homo sapiens
cacattttgagtctgagat

SEQ ID NO: 8516197 - DNA, 22 bp, Homo sapiens
cacatttttactgccaacttaa

SEQ ID NO: 8516198 - DNA, 22 bp, Homo sapiens
ggctcctgtggcaagacagctt

SEQ ID NO: 8516199 - DNA, 22 bp, Homo sapiens
ggctcctgtggcaagacagctt

SEQ ID NO: 8516200 - DNA, 22 bp, Homo sapiens
ggctcctgtcctcctggagctc

SEQ ID NO: 8516201 - DNA, 22 bp, Homo sapiens
ggctcctgtcctcctggagctc

SEQ ID NO: 8516202 - DNA, 22 bp, Homo sapiens
ggctcctgtcctcctggagctc

SEQ ID NO: 8516203 - DNA, 22 bp, Homo sapiens
ggctcctgtcccctcagctgct

SEQ ID NO: 8516204 - DNA, 22 bp, Homo sapiens
ggctcctgtcccctcagctgct

SEQ ID NO: 8516205 - DNA, 22 bp, Homo sapiens
ggctcctgggggtgctcctgcc

SEQ ID NO: 8516206 - DNA, 19 bp, Homo sapiens
ggctcctgtggctgcagcc

SEQ ID NO: 8516207 - DNA, 19 bp, Homo sapiens
ggctcctgtggctgcagcc

SEQ ID NO: 8516208 - DNA, 19 bp, Homo sapiens
ggctcctgtggctgcagcc

SEQ ID NO: 8516209 - DNA, 22 bp, Homo sapiens
cactgcccaggacctgccaccc

SEQ ID NO: 8516210 - DNA, 22 bp, Homo sapiens
cactgcccaggcacccatcttg

SEQ ID NO: 8516211 - DNA, 22 bp, Homo sapiens
cactgcccaggacctgccaccc

SEQ ID NO: 8516212 - DNA, 22 bp, Homo sapiens
cactgcccaggacctgccaccc

SEQ ID NO: 8516213 - DNA, 22 bp, Homo sapiens
cactgccctcactgtggttctc

SEQ ID NO: 8516214 - DNA, 20 bp, Homo sapiens
cactgccctccagcctgagc

SEQ ID NO: 8516215 - DNA, 20 bp, Homo sapiens
cactgccctccagcctgagc

SEQ ID NO: 8516216 - DNA, 22 bp, Homo sapiens
cactgccctgggggttgccatc

SEQ ID NO: 8516217 - DNA, 22 bp, Homo sapiens
cactgcccttacatgccctgca

SEQ ID NO: 8516218 - DNA, 22 bp, Homo sapiens
ggctccagtttccccttggggc

SEQ ID NO: 8516219 - DNA, 22 bp, Homo sapiens
cactgcaacctccacctcctgg

SEQ ID NO: 8516220 - DNA, 22 bp, Homo sapiens
cactgcaacctccacctcctgg

SEQ ID NO: 8516221 - DNA, 22 bp, Homo sapiens
cactgcaacctccacctcctgg

SEQ ID NO: 8516222 - DNA, 22 bp, Homo sapiens
cactgattaagtctgctagagg

SEQ ID NO: 8516223 - DNA, 22 bp, Homo sapiens
cactgagttccctgacatttca

SEQ ID NO: 8516224 - DNA, 22 bp, Homo sapiens
cactgcaacctccacctcctgg

SEQ ID NO: 8516225 - DNA, 22 bp, Homo sapiens
cactgattaagtctgctagagg

SEQ ID NO: 8516226 - DNA, 22 bp, Homo sapiens
cactgattaagtctgctagagg

SEQ ID NO: 8516227 - DNA, 22 bp, Homo sapiens
cactgaggtatctgtctctcct

SEQ ID NO: 8516228 - DNA, 22 bp, Homo sapiens
ggcgctcagtgttgccccagag

SEQ ID NO: 8516229 - DNA, 22 bp, Homo sapiens
ggcgctcagtgttgccccagag

SEQ ID NO: 8516230 - DNA, 22 bp, Homo sapiens
ggcgctcagtgttgccccagag

SEQ ID NO: 8516231 - DNA, 22 bp, Homo sapiens
ggcgccgcactcggtgcagccg

SEQ ID NO: 8516232 - DNA, 22 bp, Homo sapiens
ggcgccgcactcggtgcagccg

SEQ ID NO: 8516233 - DNA, 22 bp, Homo sapiens
ggctgcagattgtagtctgtta

SEQ ID NO: 8516234 - DNA, 22 bp, Homo sapiens
ggctgcagattgtagtctgtta

SEQ ID NO: 8516235 - DNA, 22 bp, Homo sapiens
ggctgcagatagccagccacca

SEQ ID NO: 8516236 - DNA, 22 bp, Homo sapiens
ggctgcagatagccagccacca

SEQ ID NO: 8516237 - DNA, 22 bp, Homo sapiens
cactgcctccccaggctccaca

SEQ ID NO: 8516238 - DNA, 22 bp, Homo sapiens
cactgcctccccaggctccaca

SEQ ID NO: 8516239 - DNA, 22 bp, Homo sapiens
ggctgaggctcatgccatcttg

SEQ ID NO: 8516240 - DNA, 22 bp, Homo sapiens
ggctgcagaggcgatctgaggt

SEQ ID NO: 8516241 - DNA, 22 bp, Homo sapiens
ggctgcagaggcgatctgaggt

SEQ ID NO: 8516242 - DNA, 22 bp, Homo sapiens
ggctgcagccctcgcctagcca

SEQ ID NO: 8516243 - DNA, 22 bp, Homo sapiens
ggctgcagccctcgcctagcca

SEQ ID NO: 8516244 - DNA, 22 bp, Homo sapiens
ggctgcagcagagggactcacg

SEQ ID NO: 8516245 - DNA, 22 bp, Homo sapiens
ggctgcagcagagggactcacg

SEQ ID NO: 8516246 - DNA, 22 bp, Homo sapiens
ggctgcagcagagggactcacg

SEQ ID NO: 8516247 - DNA, 22 bp, Homo sapiens
ggctgcagcggattggggattg

SEQ ID NO: 8516248 - DNA, 22 bp, Homo sapiens
cactgtccaatagatacataat

SEQ ID NO: 8516249 - DNA, 22 bp, Homo sapiens
ggctgcagcggattggggattg

SEQ ID NO: 8516250 - DNA, 22 bp, Homo sapiens
cactgtctattaatataactta

SEQ ID NO: 8516251 - DNA, 22 bp, Homo sapiens
cactgtccatgcttgctaaccc

SEQ ID NO: 8516252 - DNA, 22 bp, Homo sapiens
cactgtccctgtttcctggaaa

SEQ ID NO: 8516253 - DNA, 22 bp, Homo sapiens
ggctgcggatctaaggctggga

SEQ ID NO: 8516254 - DNA, 22 bp, Homo sapiens
ggctgcctttagaacggatgct

SEQ ID NO: 8516255 - DNA, 19 bp, Homo sapiens
ggctgcctttccttaccag

SEQ ID NO: 8516256 - DNA, 22 bp, Homo sapiens
ggctgctcctttaccctggcag

SEQ ID NO: 8516257 - DNA, 18 bp, Homo sapiens
ggctgctcgctctccccg

SEQ ID NO: 8516258 - DNA, 22 bp, Homo sapiens
ggctgctgggtcatgatgcaga

SEQ ID NO: 8516259 - DNA, 22 bp, Homo sapiens
ggctgctcacgcagccctccct

SEQ ID NO: 8516260 - DNA, 18 bp, Homo sapiens
ggctgctcctctccctac

SEQ ID NO: 8516261 - DNA, 21 bp, Homo sapiens
ggctgctcacctaggtcccaa

SEQ ID NO: 8516262 - DNA, 22 bp, Homo sapiens
ggctgctcaaggactctgatcg

SEQ ID NO: 8516263 - DNA, 18 bp, Homo sapiens
ggctgctcctctccctac

SEQ ID NO: 8516264 - DNA, 22 bp, Homo sapiens
ggctgccttgaccctggctccg

SEQ ID NO: 8516265 - DNA, 22 bp, Homo sapiens
ggctgccttgaccctggctccg

SEQ ID NO: 8516266 - DNA, 22 bp, Homo sapiens
ggctgccttgaccctggctccg

SEQ ID NO: 8516267 - DNA, 22 bp, Homo sapiens
cactgtgctcctaactagctgt

SEQ ID NO: 8516268 - DNA, 22 bp, Homo sapiens
cactgtgctccttccttagcac

SEQ ID NO: 8516269 - DNA, 22 bp, Homo sapiens
ggctgcctcaaagctcaagctc

SEQ ID NO: 8516270 - DNA, 22 bp, Homo sapiens
ggctgcctcaaagctcaagctc

SEQ ID NO: 8516271 - DNA, 22 bp, Homo sapiens
cactgtcttttgtgaagacaat

SEQ ID NO: 8516272 - DNA, 22 bp, Homo sapiens
cactgtcttttgtgaagacaat

SEQ ID NO: 8516273 - DNA, 22 bp, Homo sapiens
cactgtcttcagtttcactgca

SEQ ID NO: 8516274 - DNA, 22 bp, Homo sapiens
cactgtcttcagtttcactgca

SEQ ID NO: 8516275 - DNA, 22 bp, Homo sapiens
cactgtctgtgtgtccttgggg

SEQ ID NO: 8516276 - DNA, 22 bp, Homo sapiens
cactgtctgggacatgtggtct

SEQ ID NO: 8516277 - DNA, 22 bp, Homo sapiens
cactgtctgagctggtgattag

SEQ ID NO: 8516278 - DNA, 22 bp, Homo sapiens
ggctgggagctggacaggccgg

SEQ ID NO: 8516279 - DNA, 17 bp, Homo sapiens
ggcttcagggagctggg

SEQ ID NO: 8516280 - DNA, 22 bp, Homo sapiens
ggctgggagctggacaggccgg

SEQ ID NO: 8516281 - DNA, 22 bp, Homo sapiens
ggcttcaggggcccagtcagca

SEQ ID NO: 8516282 - DNA, 19 bp, Homo sapiens
ggcttcagggagttagcat

SEQ ID NO: 8516283 - DNA, 22 bp, Homo sapiens
ggcttcttcctggctcctatta

SEQ ID NO: 8516284 - DNA, 22 bp, Homo sapiens
ggcttcttcctggctcctatta

SEQ ID NO: 8516285 - DNA, 22 bp, Homo sapiens
ggcttctttttagtaaatgtca

SEQ ID NO: 8516286 - DNA, 22 bp, Homo sapiens
ggcttgaagactatgacatttc

SEQ ID NO: 8516287 - DNA, 23 bp, Homo sapiens
ggcttcttgcctgtcttggtgct

SEQ ID NO: 8516288 - DNA, 22 bp, Homo sapiens
ggcttcttcctgtgaacatgtt

SEQ ID NO: 8516289 - DNA, 22 bp, Homo sapiens
ggcttggcccaggcctcactcc

SEQ ID NO: 8516290 - DNA, 22 bp, Homo sapiens
ggcttggaaattgcaggacaca

SEQ ID NO: 8516291 - DNA, 22 bp, Homo sapiens
cagaacagacttaacagggctg

SEQ ID NO: 8516292 - DNA, 22 bp, Homo sapiens
cagaacagacttaacagggctg

SEQ ID NO: 8516293 - DNA, 23 bp, Homo sapiens
ggcttgagctggaacagcttggt

SEQ ID NO: 8516294 - DNA, 22 bp, Homo sapiens
ggcttgagacccgggagccaga

SEQ ID NO: 8516295 - DNA, 22 bp, Homo sapiens
ggcttgcttcttgtccaggaat

SEQ ID NO: 8516296 - DNA, 19 bp, Homo sapiens
cagaacagctgggaagaga

SEQ ID NO: 8516297 - DNA, 19 bp, Homo sapiens
cagaacaggaccaggggcc

SEQ ID NO: 8516298 - DNA, 19 bp, Homo sapiens
cagaacagaggtcatggcc

SEQ ID NO: 8516299 - DNA, 19 bp, Homo sapiens
cagaacagaggtcatggcc

SEQ ID NO: 8516300 - DNA, 22 bp, Homo sapiens
cagaacagtcgcctgcatggat

SEQ ID NO: 8516301 - DNA, 22 bp, Homo sapiens
cagaacagtacctagcacatag

SEQ ID NO: 8516302 - DNA, 22 bp, Homo sapiens
cagaacaggtcatgcttgctgt

SEQ ID NO: 8516303 - DNA, 20 bp, Homo sapiens
cagaacatgagcatcgagcc

SEQ ID NO: 8516304 - DNA, 22 bp, Homo sapiens
cagaacatgatataaacagaag

SEQ ID NO: 8516305 - DNA, 22 bp, Homo sapiens
cagaacattcactcatatgtgg

SEQ ID NO: 8516306 - DNA, 20 bp, Homo sapiens
cagaacagtctgagaggcca

SEQ ID NO: 8516307 - DNA, 20 bp, Homo sapiens
cagaacagtctgagaggcca

SEQ ID NO: 8516308 - DNA, 20 bp, Homo sapiens
cagaacagtctgagaggcca

SEQ ID NO: 8516309 - DNA, 22 bp, Homo sapiens
cagaagaggactgggtagctca

SEQ ID NO: 8516310 - DNA, 22 bp, Homo sapiens
cagaacattccatgtgccctgc

SEQ ID NO: 8516311 - DNA, 22 bp, Homo sapiens
cagaacattcactcatatgtgg

SEQ ID NO: 8516312 - DNA, 22 bp, Homo sapiens
cagaagagatgaaatagtatta

SEQ ID NO: 8516313 - DNA, 22 bp, Homo sapiens
cagaagaggactgggtagctca

SEQ ID NO: 8516314 - DNA, 22 bp, Homo sapiens
cagaaattggaatagagaaata

SEQ ID NO: 8516315 - DNA, 22 bp, Homo sapiens
cagaaattcccatttcagattc

SEQ ID NO: 8516316 - DNA, 22 bp, Homo sapiens
cagaacagaatcgtgtggtgag

SEQ ID NO: 8516317 - DNA, 22 bp, Homo sapiens
cagaaatgtactgacatgcagt

SEQ ID NO: 8516318 - DNA, 22 bp, Homo sapiens
cagaaatgttctaatgattcag

SEQ ID NO: 8516319 - DNA, 22 bp, Homo sapiens
cagaaatgtttatgcttttgaa

SEQ ID NO: 8516320 - DNA, 22 bp, Homo sapiens
cagaaatgtttatatgtggtgt

SEQ ID NO: 8516321 - DNA, 23 bp, Homo sapiens
ggctgggagctccgggtgcacgt

SEQ ID NO: 8516322 - DNA, 23 bp, Homo sapiens
ggctgggagctccgggtgcacgt

SEQ ID NO: 8516323 - DNA, 23 bp, Homo sapiens
ggctgggagctccgggtgcacgt

SEQ ID NO: 8516324 - DNA, 23 bp, Homo sapiens
ggctgggagctccgggtgcacgt

SEQ ID NO: 8516325 - DNA, 22 bp, Homo sapiens
ggctgggacgatgaggattagt

SEQ ID NO: 8516326 - DNA, 22 bp, Homo sapiens
ggctgggagccccacagagtca

SEQ ID NO: 8516327 - DNA, 22 bp, Homo sapiens
ggctgctggtaggggtaggaag

SEQ ID NO: 8516328 - DNA, 19 bp, Homo sapiens
ggctgctggttacagaggc

SEQ ID NO: 8516329 - DNA, 19 bp, Homo sapiens
ggctgctggttacagaggc

SEQ ID NO: 8516330 - DNA, 22 bp, Homo sapiens
ggctgctggtggaatggtaggc

SEQ ID NO: 8516331 - DNA, 22 bp, Homo sapiens
ggctgctggtggaatggtaggc

SEQ ID NO: 8516332 - DNA, 22 bp, Homo sapiens
ggctgctgtactgatgtcagtt

SEQ ID NO: 8516333 - DNA, 22 bp, Homo sapiens
ggctgctgtactgatgtcagtt

SEQ ID NO: 8516334 - DNA, 19 bp, Homo sapiens
ggctgctggttacagaggc

SEQ ID NO: 8516335 - DNA, 19 bp, Homo sapiens
cagaaatagcgaagtgtaa

SEQ ID NO: 8516336 - DNA, 21 bp, Homo sapiens
ggctgctgtcaccgctgtcac

SEQ ID NO: 8516337 - DNA, 22 bp, Homo sapiens
cagaaatggagcccaggaatct

SEQ ID NO: 8516338 - DNA, 22 bp, Homo sapiens
cagaaatggagcccaggaatct

SEQ ID NO: 8516339 - DNA, 22 bp, Homo sapiens
cagaaatggagcccaggaatct

SEQ ID NO: 8516340 - DNA, 22 bp, Homo sapiens
cagaaatggaattttccatcac

SEQ ID NO: 8516341 - DNA, 22 bp, Homo sapiens
cagaaatgtactgacatgcagt

SEQ ID NO: 8516342 - DNA, 22 bp, Homo sapiens
cagaaatggtctgttcagctta

SEQ ID NO: 8516343 - DNA, 22 bp, Homo sapiens
cagaaatgtactgacatgcagt

SEQ ID NO: 8516344 - DNA, 20 bp, Homo sapiens
gtctccactgggggttaacc

SEQ ID NO: 8516345 - DNA, 20 bp, Homo sapiens
gtctccactgggggttaacc

SEQ ID NO: 8516346 - DNA, 22 bp, Homo sapiens
gtctccactaaaaactttcacg

SEQ ID NO: 8516347 - DNA, 20 bp, Homo sapiens
gtctccactgggggttaacc

SEQ ID NO: 8516348 - DNA, 22 bp, Homo sapiens
gtctccactaaaaactttcacg

SEQ ID NO: 8516349 - DNA, 22 bp, Homo sapiens
gtctccacagcccagctgccac

SEQ ID NO: 8516350 - DNA, 22 bp, Homo sapiens
gtctccagaagcctagacagcc

SEQ ID NO: 8516351 - DNA, 22 bp, Homo sapiens
gtctccagaagcctagacagcc

SEQ ID NO: 8516352 - DNA, 20 bp, Homo sapiens
gtctccactgggggttaacc

SEQ ID NO: 8516353 - DNA, 22 bp, Homo sapiens
gtctcattggttctgccagagt

SEQ ID NO: 8516354 - DNA, 18 bp, Homo sapiens
gtctcaggagtggcacgt

SEQ ID NO: 8516355 - DNA, 22 bp, Homo sapiens
gtctcagggactgcttctgggg

SEQ ID NO: 8516356 - DNA, 19 bp, Homo sapiens
gtctctggatttcaggtcc

SEQ ID NO: 8516357 - DNA, 19 bp, Homo sapiens
gtctctggatttcaggtcc

SEQ ID NO: 8516358 - DNA, 22 bp, Homo sapiens
gtctctgggttaagcagtgcat

SEQ ID NO: 8516359 - DNA, 22 bp, Homo sapiens
gtctctgtgccttctccccacc

SEQ ID NO: 8516360 - DNA, 22 bp, Homo sapiens
gtctttgctgtctttgctctca

SEQ ID NO: 8516361 - DNA, 22 bp, Homo sapiens
gtctttcttcagagcttggact

SEQ ID NO: 8516362 - DNA, 22 bp, Homo sapiens
gtctttggagaggtgccatttc

SEQ ID NO: 8516363 - DNA, 22 bp, Homo sapiens
gtctttggaggcactgttgagt

SEQ ID NO: 8516364 - DNA, 18 bp, Homo sapiens
gtctttggagtggaggta

SEQ ID NO: 8516365 - DNA, 22 bp, Homo sapiens
gtgaaggtggggagcctcagtt

SEQ ID NO: 8516366 - DNA, 22 bp, Homo sapiens
gtgaagttcaagcttgccatct

SEQ ID NO: 8516367 - DNA, 16 bp, Homo sapiens
gtctcttccctgctga

SEQ ID NO: 8516368 - DNA, 22 bp, Homo sapiens
gtctcttctttgccggtcctgc

SEQ ID NO: 8516369 - DNA, 22 bp, Homo sapiens
gtcttaaaatcagaggatatag

SEQ ID NO: 8516370 - DNA, 19 bp, Homo sapiens
gtcttacaggcaacatgag

SEQ ID NO: 8516371 - DNA, 22 bp, Homo sapiens
gtctttcttaattcaagtgctt

SEQ ID NO: 8516372 - DNA, 22 bp, Homo sapiens
gtgcaaagtgcatggggaaggg

SEQ ID NO: 8516373 - DNA, 23 bp, Homo sapiens
gtgcaaagatataccacatggct

SEQ ID NO: 8516374 - DNA, 16 bp, Homo sapiens
gtgcaaaagtgaggag

SEQ ID NO: 8516375 - DNA, 16 bp, Homo sapiens
gtgcaaaagtgaggag

SEQ ID NO: 8516376 - DNA, 22 bp, Homo sapiens
gtgcaaaatgatatcctgaagc

SEQ ID NO: 8516377 - DNA, 22 bp, Homo sapiens
gtgcaaaatgatatcctgaagc

SEQ ID NO: 8516378 - DNA, 22 bp, Homo sapiens
gtgcaaacatcatagagtgtac

SEQ ID NO: 8516379 - DNA, 22 bp, Homo sapiens
gtgcaaacatcatagagtgtac

SEQ ID NO: 8516380 - DNA, 22 bp, Homo sapiens
gtgcagcagggggaagacagtg

SEQ ID NO: 8516381 - DNA, 22 bp, Homo sapiens
gtgcagcagggggaagacagtg

SEQ ID NO: 8516382 - DNA, 22 bp, Homo sapiens
gtgcagcctgtcgccagtggat

SEQ ID NO: 8516383 - DNA, 22 bp, Homo sapiens
gtgcagccatttgcatgcttcc

SEQ ID NO: 8516384 - DNA, 22 bp, Homo sapiens
gtgcaggagccaggggtaggaa

SEQ ID NO: 8516385 - DNA, 22 bp, Homo sapiens
gtgcagctcagttgaaatgcag

SEQ ID NO: 8516386 - DNA, 22 bp, Homo sapiens
gtgcagctgggcgctgaccttc

SEQ ID NO: 8516387 - DNA, 22 bp, Homo sapiens
gtgcaaaagtcattgtggtttt

SEQ ID NO: 8516388 - DNA, 22 bp, Homo sapiens
gtgcaaaagtaattgtggtttt

SEQ ID NO: 8516389 - DNA, 22 bp, Homo sapiens
gtgcaaaagtacttgcggattt

SEQ ID NO: 8516390 - DNA, 22 bp, Homo sapiens
gtgcaaaagtaattgcggtttt

SEQ ID NO: 8516391 - DNA, 22 bp, Homo sapiens
gtgcaaaagtaattgctgtttt

SEQ ID NO: 8516392 - DNA, 22 bp, Homo sapiens
gtgcaaaagtaattgcagtttt

SEQ ID NO: 8516393 - DNA, 22 bp, Homo sapiens
gtgcaaaagtaattgcagtttt

SEQ ID NO: 8516394 - DNA, 22 bp, Homo sapiens
gtgcaaaagtaattgcagtact

SEQ ID NO: 8516395 - DNA, 22 bp, Homo sapiens
gtgcaaaagtaattgaggtttt

SEQ ID NO: 8516396 - DNA, 22 bp, Homo sapiens
gtgcaaaagtaattgaggtttt

SEQ ID NO: 8516397 - DNA, 22 bp, Homo sapiens
gtgcaaaagtaattacagtttt

SEQ ID NO: 8516398 - DNA, 22 bp, Homo sapiens
gtgaggtcaaagccttgggtat

SEQ ID NO: 8516399 - DNA, 22 bp, Homo sapiens
gtgcaaaagtaatggcagtttt

SEQ ID NO: 8516400 - DNA, 22 bp, Homo sapiens
gtgaataactttctatgttaat

SEQ ID NO: 8516401 - DNA, 22 bp, Homo sapiens
gtgaataatattgtttataaaa

SEQ ID NO: 8516402 - DNA, 22 bp, Homo sapiens
gtgaataattttttagtataag

SEQ ID NO: 8516403 - DNA, 22 bp, Homo sapiens
gtgaataatcacccttctggat

SEQ ID NO: 8516404 - DNA, 22 bp, Homo sapiens
gtgaatgcaaactgtttctgat

SEQ ID NO: 8516405 - DNA, 17 bp, Homo sapiens
gtgaatggcatagtcgg

SEQ ID NO: 8516406 - DNA, 22 bp, Homo sapiens
gtgaatgccgcagtctgttgct

SEQ ID NO: 8516407 - DNA, 22 bp, Homo sapiens
cagcagtgcttcagtgtgagat

SEQ ID NO: 8516408 - DNA, 22 bp, Homo sapiens
cagcagtgcttcagtgtgagat

SEQ ID NO: 8516409 - DNA, 20 bp, Homo sapiens
cagcagtggatgagagtttt

SEQ ID NO: 8516410 - DNA, 22 bp, Homo sapiens
cagcagtggaactacccaggga

SEQ ID NO: 8516411 - DNA, 22 bp, Homo sapiens
cagcagtggccatctgtgtggt

SEQ ID NO: 8516412 - DNA, 20 bp, Homo sapiens
cagcagtggatgagagtttt

SEQ ID NO: 8516413 - DNA, 22 bp, Homo sapiens
cagcagtgatgtgtgagggttc

SEQ ID NO: 8516414 - DNA, 22 bp, Homo sapiens
cagcagtgacaagactaagaag

SEQ ID NO: 8516415 - DNA, 22 bp, Homo sapiens
cagcagtgacaagactaagaag

SEQ ID NO: 8516416 - DNA, 22 bp, Homo sapiens
cagcagtgcttcagtgtgagat

SEQ ID NO: 8516417 - DNA, 22 bp, Homo sapiens
cagcagtgatgtgtgagggttc

SEQ ID NO: 8516418 - DNA, 22 bp, Homo sapiens
cagcagtgatgtgtgagggttc

SEQ ID NO: 8516419 - DNA, 22 bp, Homo sapiens
cagcaggtggacacactcacct

SEQ ID NO: 8516420 - DNA, 22 bp, Homo sapiens
cagcaggtgtctagcaagggtc

SEQ ID NO: 8516421 - DNA, 22 bp, Homo sapiens
cagcagtaattagtgctgcatg

SEQ ID NO: 8516422 - DNA, 22 bp, Homo sapiens
cagcagtaattagtgctgcatg

SEQ ID NO: 8516423 - DNA, 22 bp, Homo sapiens
cagcagtacttctcagaggtat

SEQ ID NO: 8516424 - DNA, 22 bp, Homo sapiens
cagcagtacttctcagaggtat

SEQ ID NO: 8516425 - DNA, 22 bp, Homo sapiens
cagcagtcaggcaaatgggagg

SEQ ID NO: 8516426 - DNA, 22 bp, Homo sapiens
cagcaggttaacagaggctggt

SEQ ID NO: 8516427 - DNA, 22 bp, Homo sapiens
cagcaggttaacagaggctggt

SEQ ID NO: 8516428 - DNA, 22 bp, Homo sapiens
cagcagagctgtgtgggaaggg

SEQ ID NO: 8516429 - DNA, 22 bp, Homo sapiens
cagcagggaagctgtgctgttt

SEQ ID NO: 8516430 - DNA, 22 bp, Homo sapiens
cagcagggaagctgtgctgttt

SEQ ID NO: 8516431 - DNA, 22 bp, Homo sapiens
cagcagggttaagtgactcacc

SEQ ID NO: 8516432 - DNA, 22 bp, Homo sapiens
cagcagggttaagtgactcacc

SEQ ID NO: 8516433 - DNA, 22 bp, Homo sapiens
cagcaggtatgtttgttcagca

SEQ ID NO: 8516434 - DNA, 22 bp, Homo sapiens
cagcaggtatgtttgttcagca

SEQ ID NO: 8516435 - DNA, 22 bp, Homo sapiens
cagcaggtcccactgagggccc

SEQ ID NO: 8516436 - DNA, 22 bp, Homo sapiens
cagcaggtcccactgagggccc

SEQ ID NO: 8516437 - DNA, 22 bp, Homo sapiens
cagcaggtcccactgagggccc

SEQ ID NO: 8516438 - DNA, 22 bp, Homo sapiens
cagcaggtcctgggcgtggcct

SEQ ID NO: 8516439 - DNA, 22 bp, Homo sapiens
cagcaggtcctgggcgtggcct

SEQ ID NO: 8516440 - DNA, 22 bp, Homo sapiens
cagcagagacggtaagcagaac

SEQ ID NO: 8516441 - DNA, 22 bp, Homo sapiens
cagcagagacggtaagcagaac

SEQ ID NO: 8516442 - DNA, 22 bp, Homo sapiens
cagcagagacggtaagcagaac

SEQ ID NO: 8516443 - DNA, 22 bp, Homo sapiens
cagcagagacggtaagcagaac

SEQ ID NO: 8516444 - DNA, 22 bp, Homo sapiens
cagcagagacggtaagcagaac

SEQ ID NO: 8516445 - DNA, 22 bp, Homo sapiens
cagcagagacggtaagcagaac

SEQ ID NO: 8516446 - DNA, 22 bp, Homo sapiens
cagcagagatgagattcctata

SEQ ID NO: 8516447 - DNA, 22 bp, Homo sapiens
cagcagagcatttggtaggagg

SEQ ID NO: 8516448 - DNA, 22 bp, Homo sapiens
cagcagagcatttggtaggagg

SEQ ID NO: 8516449 - DNA, 22 bp, Homo sapiens
cagcagagctgggctttgaatt

SEQ ID NO: 8516450 - DNA, 22 bp, Homo sapiens
cagcagagctgggaataaaatt

SEQ ID NO: 8516451 - DNA, 22 bp, Homo sapiens
cagcatcttctagatccaggct

SEQ ID NO: 8516452 - DNA, 22 bp, Homo sapiens
cagcatcttctagatccaggct

SEQ ID NO: 8516453 - DNA, 22 bp, Homo sapiens
cagcatcttctagatccaggct

SEQ ID NO: 8516454 - DNA, 22 bp, Homo sapiens
cagcatcttctccaaagctgcc

SEQ ID NO: 8516455 - DNA, 22 bp, Homo sapiens
cagcatcttctccaaagctgcc

SEQ ID NO: 8516456 - DNA, 22 bp, Homo sapiens
cagcatctttctcttctggagt

SEQ ID NO: 8516457 - DNA, 22 bp, Homo sapiens
cagcatctttctcttctggagt

SEQ ID NO: 8516458 - DNA, 22 bp, Homo sapiens
cagcatcttgaagggtaaacca

SEQ ID NO: 8516459 - DNA, 22 bp, Homo sapiens
cagcatctttataaaaagtaaa

SEQ ID NO: 8516460 - DNA, 22 bp, Homo sapiens
cagcatcttgaagggtaaacca

SEQ ID NO: 8516461 - DNA, 22 bp, Homo sapiens
cagcatcttattttctatggaa

SEQ ID NO: 8516462 - DNA, 22 bp, Homo sapiens
cagcatcttcatgtgcatctcc

SEQ ID NO: 8516463 - DNA, 22 bp, Homo sapiens
cagcatcttcatgtgcatctcc

SEQ ID NO: 8516464 - DNA, 22 bp, Homo sapiens
cagcatcttattttctatggaa

SEQ ID NO: 8516465 - DNA, 18 bp, Homo sapiens
cagcatcttcattaggcc

SEQ ID NO: 8516466 - DNA, 22 bp, Homo sapiens
cagcatcttcatgtgcatctcc

SEQ ID NO: 8516467 - DNA, 18 bp, Homo sapiens
cagcatcttcattaggcc

SEQ ID NO: 8516468 - DNA, 22 bp, Homo sapiens
cagcatctttataaaaagtaaa

SEQ ID NO: 8516469 - DNA, 22 bp, Homo sapiens
cagcatctttctcttctggagt

SEQ ID NO: 8516470 - DNA, 22 bp, Homo sapiens
cagcatgaaaagtgttgctatc

SEQ ID NO: 8516471 - DNA, 22 bp, Homo sapiens
cagcatgaaaagtgttgctatc

SEQ ID NO: 8516472 - DNA, 22 bp, Homo sapiens
cagcatgaatgtgttcgtaggg

SEQ ID NO: 8516473 - DNA, 22 bp, Homo sapiens
cagcatgaaacaattgagccca

SEQ ID NO: 8516474 - DNA, 22 bp, Homo sapiens
cagcatgacagtctgcagcaga

SEQ ID NO: 8516475 - DNA, 22 bp, Homo sapiens
cagcatgagaaaatgaatcaga

SEQ ID NO: 8516476 - DNA, 22 bp, Homo sapiens
cagcatgatcccagttgattgc

SEQ ID NO: 8516477 - DNA, 22 bp, Homo sapiens
cagcatgatgctcacacaaaac

SEQ ID NO: 8516478 - DNA, 22 bp, Homo sapiens
cagcatgatgagtgcagtttgg

SEQ ID NO: 8516479 - DNA, 22 bp, Homo sapiens
cagcatgatgctcacacaaaac

SEQ ID NO: 8516480 - DNA, 22 bp, Homo sapiens
gtcctgtgctcagacatggggg

SEQ ID NO: 8516481 - DNA, 22 bp, Homo sapiens
cagcatgcccagactgagctaa

SEQ ID NO: 8516482 - DNA, 22 bp, Homo sapiens
cagcatgattggtgtctggtga

SEQ ID NO: 8516483 - DNA, 22 bp, Homo sapiens
cagcatgcaagtccagatgtgg

SEQ ID NO: 8516484 - DNA, 22 bp, Homo sapiens
gtcctgtgggcccaccatgagc

SEQ ID NO: 8516485 - DNA, 20 bp, Homo sapiens
gtctcaagtatctcacagtc

SEQ ID NO: 8516486 - DNA, 22 bp, Homo sapiens
gtctcagagtcctacttattcc

SEQ ID NO: 8516487 - DNA, 22 bp, Homo sapiens
gtcctctgtgtaggctgcagac

SEQ ID NO: 8516488 - DNA, 22 bp, Homo sapiens
gtcctctgtttccatctgactt

SEQ ID NO: 8516489 - DNA, 22 bp, Homo sapiens
gtcctctgtttccatctgactt

SEQ ID NO: 8516490 - DNA, 22 bp, Homo sapiens
gtcctctgtttccatctgactt

SEQ ID NO: 8516491 - DNA, 22 bp, Homo sapiens
gtcctctgttagaaatgtgctt

SEQ ID NO: 8516492 - DNA, 22 bp, Homo sapiens
gtcctctgttagaaatgtgctt

SEQ ID NO: 8516493 - DNA, 22 bp, Homo sapiens
gtcctctgttagaaatgtgctt

SEQ ID NO: 8516494 - DNA, 22 bp, Homo sapiens
gtcctctgttagaaatgtgctt

SEQ ID NO: 8516495 - DNA, 22 bp, Homo sapiens
gtcctctgtgtaggctgcagac

SEQ ID NO: 8516496 - DNA, 22 bp, Homo sapiens
gtcctagagatccgggagggga

SEQ ID NO: 8516497 - DNA, 22 bp, Homo sapiens
cagcagtgtacaaggtgtcaga

SEQ ID NO: 8516498 - DNA, 22 bp, Homo sapiens
cagcagtggctgcaggcagctg

SEQ ID NO: 8516499 - DNA, 22 bp, Homo sapiens
cagcagtggctgcaggcagctg

SEQ ID NO: 8516500 - DNA, 22 bp, Homo sapiens
cagcagtggctgcaggcagctg

SEQ ID NO: 8516501 - DNA, 22 bp, Homo sapiens
cagcagtgtacaaggtgtcaga

SEQ ID NO: 8516502 - DNA, 22 bp, Homo sapiens
gtcctgaatgcctttaggcaga

SEQ ID NO: 8516503 - DNA, 22 bp, Homo sapiens
gtcctcttgctcattggggcag

SEQ ID NO: 8516504 - DNA, 22 bp, Homo sapiens
gtcctgacggctgattggcctg

SEQ ID NO: 8516505 - DNA, 22 bp, Homo sapiens
gtcctgacggctgattggcctg

SEQ ID NO: 8516506 - DNA, 22 bp, Homo sapiens
gtcctgacggctgattggcctg

SEQ ID NO: 8516507 - DNA, 22 bp, Homo sapiens
gtcctgagcattaagcaattgt

SEQ ID NO: 8516508 - DNA, 18 bp, Homo sapiens
gtcctgagctctgctgta

SEQ ID NO: 8516509 - DNA, 22 bp, Homo sapiens
gtcctgagggcccaggcattct

SEQ ID NO: 8516510 - DNA, 22 bp, Homo sapiens
gtcctgagtcaagtgtgggcag

SEQ ID NO: 8516511 - DNA, 22 bp, Homo sapiens
cagctcctattagacactgaat

SEQ ID NO: 8516512 - DNA, 22 bp, Homo sapiens
cagctcctagatcggcgaagtg

SEQ ID NO: 8516513 - DNA, 22 bp, Homo sapiens
cagctcctatgagtatgattcc

SEQ ID NO: 8516514 - DNA, 22 bp, Homo sapiens
cagctccctatggtgaggcgac

SEQ ID NO: 8516515 - DNA, 22 bp, Homo sapiens
cagctccctatggtgaggcgac

SEQ ID NO: 8516516 - DNA, 22 bp, Homo sapiens
cagctcccgccatcgggaggca

SEQ ID NO: 8516517 - DNA, 22 bp, Homo sapiens
cagctcctctggccagccctgc

SEQ ID NO: 8516518 - DNA, 22 bp, Homo sapiens
cagctcctcacgagtcttgaaa

SEQ ID NO: 8516519 - DNA, 22 bp, Homo sapiens
cagctctgaggaacactccttt

SEQ ID NO: 8516520 - DNA, 21 bp, Homo sapiens
cagctctgagatttctactag

SEQ ID NO: 8516521 - DNA, 22 bp, Homo sapiens
cagctctgaggaacactccttt

SEQ ID NO: 8516522 - DNA, 22 bp, Homo sapiens
cagctctgagactgaggctatg

SEQ ID NO: 8516523 - DNA, 22 bp, Homo sapiens
cagctcctgcagctgctgccgt

SEQ ID NO: 8516524 - DNA, 22 bp, Homo sapiens
cagctcctctgttagccctggg

SEQ ID NO: 8516525 - DNA, 22 bp, Homo sapiens
cagctcctgaggactgctggga

SEQ ID NO: 8516526 - DNA, 23 bp, Homo sapiens
cagctccagtgcactcaggtagc

SEQ ID NO: 8516527 - DNA, 23 bp, Homo sapiens
cagctccagtgcactcaggtagc

SEQ ID NO: 8516528 - DNA, 22 bp, Homo sapiens
cagctccatcttgcttatacca

SEQ ID NO: 8516529 - DNA, 22 bp, Homo sapiens
cagctccagccgactgtaagaa

SEQ ID NO: 8516530 - DNA, 22 bp, Homo sapiens
cagctccagccgactgtaagaa

SEQ ID NO: 8516531 - DNA, 22 bp, Homo sapiens
cagctccagcccaggcagctcc

SEQ ID NO: 8516532 - DNA, 22 bp, Homo sapiens
cagctccagcccaggcagctcc

SEQ ID NO: 8516533 - DNA, 22 bp, Homo sapiens
cagctccagcctgacaccaaga

SEQ ID NO: 8516534 - DNA, 22 bp, Homo sapiens
cagctccagcctgacaccaaga

SEQ ID NO: 8516535 - DNA, 22 bp, Homo sapiens
cagctccagctctgggcgcctc

SEQ ID NO: 8516536 - DNA, 22 bp, Homo sapiens
cagctcccagagtgaccagcag

SEQ ID NO: 8516537 - DNA, 22 bp, Homo sapiens
cagctcccagaactgaccatgt

SEQ ID NO: 8516538 - DNA, 22 bp, Homo sapiens
cagctcccagtggcagctcctt

SEQ ID NO: 8516539 - DNA, 22 bp, Homo sapiens
cagctcccagtggcagctcctt

SEQ ID NO: 8516540 - DNA, 22 bp, Homo sapiens
cagctccccatggttcctgaag

SEQ ID NO: 8516541 - DNA, 22 bp, Homo sapiens
cagctcccctctgtggggcagt

SEQ ID NO: 8516542 - DNA, 22 bp, Homo sapiens
cagctccccatggttcctgaag

SEQ ID NO: 8516543 - DNA, 22 bp, Homo sapiens
cagctccagcccaggcagctcc

SEQ ID NO: 8516544 - DNA, 22 bp, Homo sapiens
cagctccagcccaggcagctcc

SEQ ID NO: 8516545 - DNA, 22 bp, Homo sapiens
cagctccagcccaggcagctcc

SEQ ID NO: 8516546 - DNA, 22 bp, Homo sapiens
cagctccagccaccggggggtg

SEQ ID NO: 8516547 - DNA, 22 bp, Homo sapiens
cagctccagccaccggggggtg

SEQ ID NO: 8516548 - DNA, 21 bp, Homo sapiens
cagctccactaaagcagctgt

SEQ ID NO: 8516549 - DNA, 22 bp, Homo sapiens
cagctccacttgagtggggcct

SEQ ID NO: 8516550 - DNA, 21 bp, Homo sapiens
cagctccactaaagcagctgt

SEQ ID NO: 8516551 - DNA, 21 bp, Homo sapiens
cagctccactaaagcagctgt

SEQ ID NO: 8516552 - DNA, 22 bp, Homo sapiens
cagctcagcttcctgggtgtgt

SEQ ID NO: 8516553 - DNA, 22 bp, Homo sapiens
gtgctgaggtgggtgggcagcc

SEQ ID NO: 8516554 - DNA, 22 bp, Homo sapiens
cagctcagcttcctgggtgtgt

SEQ ID NO: 8516555 - DNA, 20 bp, Homo sapiens
gtgctgagggctgggcaatg

SEQ ID NO: 8516556 - DNA, 22 bp, Homo sapiens
gtgctgaggaaggaagacttat

SEQ ID NO: 8516557 - DNA, 22 bp, Homo sapiens
gtgctgaggtgggtgggcagcc

SEQ ID NO: 8516558 - DNA, 22 bp, Homo sapiens
gtgctgaggtgggtgggcagcc

SEQ ID NO: 8516559 - DNA, 22 bp, Homo sapiens
gtgcctggggttgagctatgaa

SEQ ID NO: 8516560 - DNA, 22 bp, Homo sapiens
gtgcctggtatgtaggtagcgg

SEQ ID NO: 8516561 - DNA, 22 bp, Homo sapiens
gtgcctggtatgtaggtagcgg

SEQ ID NO: 8516562 - DNA, 22 bp, Homo sapiens
gtgcctggtatgtaggtagcgg

SEQ ID NO: 8516563 - DNA, 22 bp, Homo sapiens
gtgcctggtatgtaggtagcgg

SEQ ID NO: 8516564 - DNA, 22 bp, Homo sapiens
gtgcctggtttggggaatgttc

SEQ ID NO: 8516565 - DNA, 22 bp, Homo sapiens
gtgcctggtttggggagtgttc

SEQ ID NO: 8516566 - DNA, 22 bp, Homo sapiens
gtgcctggtttggggagtgttc

SEQ ID NO: 8516567 - DNA, 22 bp, Homo sapiens
gtgcctgtaagttgtatgggct

SEQ ID NO: 8516568 - DNA, 22 bp, Homo sapiens
gtgcctgtaagttgtatgggct

SEQ ID NO: 8516569 - DNA, 22 bp, Homo sapiens
gtgcctgtgccaggggtgtgct

SEQ ID NO: 8516570 - DNA, 22 bp, Homo sapiens
gtgcctgtgccaggggtgtgct

SEQ ID NO: 8516571 - DNA, 22 bp, Homo sapiens
gtgcctgtgccaggggtgtgct

SEQ ID NO: 8516572 - DNA, 22 bp, Homo sapiens
gtgcctgtgcggactcagggaa

SEQ ID NO: 8516573 - DNA, 17 bp, Homo sapiens
gtgcctgttgtcctgga

SEQ ID NO: 8516574 - DNA, 17 bp, Homo sapiens
gtgcctgttgtcctgga

SEQ ID NO: 8516575 - DNA, 22 bp, Homo sapiens
gtgctgagagtttattatgata

SEQ ID NO: 8516576 - DNA, 22 bp, Homo sapiens
gtgctgagcacaaggcccagag

SEQ ID NO: 8516577 - DNA, 22 bp, Homo sapiens
gtgctgagcacaccttggagca

SEQ ID NO: 8516578 - DNA, 22 bp, Homo sapiens
gtgctgagcacaccttggagca

SEQ ID NO: 8516579 - DNA, 22 bp, Homo sapiens
gtgctgagcacagctgcccagg

SEQ ID NO: 8516580 - DNA, 22 bp, Homo sapiens
gtgctgagattacaggtgtgag

SEQ ID NO: 8516581 - DNA, 22 bp, Homo sapiens
gtgctgagctgcagatgcgctc

SEQ ID NO: 8516582 - DNA, 22 bp, Homo sapiens
gtgctgagcatcatgaggcact

SEQ ID NO: 8516583 - DNA, 22 bp, Homo sapiens
gtgctgagcatcatgaggcact

SEQ ID NO: 8516584 - DNA, 22 bp, Homo sapiens
gtgctgaggccaatgtcagggt

SEQ ID NO: 8516585 - DNA, 22 bp, Homo sapiens
gtgctgaggatacagctgtgaa

SEQ ID NO: 8516586 - DNA, 22 bp, Homo sapiens
gtgctgaggagagggggtggtc

SEQ ID NO: 8516587 - DNA, 22 bp, Homo sapiens
cagcccttgcgacaccctggct

SEQ ID NO: 8516588 - DNA, 20 bp, Homo sapiens
cagccctttatcctcctatg

SEQ ID NO: 8516589 - DNA, 20 bp, Homo sapiens
cagccctttatcctcctatg

SEQ ID NO: 8516590 - DNA, 23 bp, Homo sapiens
cagcccttcctgcatgtttttgt

SEQ ID NO: 8516591 - DNA, 22 bp, Homo sapiens
cagcccttccaggcagaattct

SEQ ID NO: 8516592 - DNA, 22 bp, Homo sapiens
cagcccttcttccaaccagctt

SEQ ID NO: 8516593 - DNA, 22 bp, Homo sapiens
cagccctgttgcgcttccggcg

SEQ ID NO: 8516594 - DNA, 20 bp, Homo sapiens
cagcctccactcactcagct

SEQ ID NO: 8516595 - DNA, 22 bp, Homo sapiens
gtgccctgacacacctggtgtg

SEQ ID NO: 8516596 - DNA, 22 bp, Homo sapiens
gtgcctggggttgagctatgaa

SEQ ID NO: 8516597 - DNA, 22 bp, Homo sapiens
gtgcctgggggtaatgtaggat

SEQ ID NO: 8516598 - DNA, 22 bp, Homo sapiens
gtgcctgggacttgctccggat

SEQ ID NO: 8516599 - DNA, 22 bp, Homo sapiens
gtgcctgggacttgctccggat

SEQ ID NO: 8516600 - DNA, 22 bp, Homo sapiens
gtgcctgggacttgctccggat

SEQ ID NO: 8516601 - DNA, 22 bp, Homo sapiens
gtgcctgggcatgagcttgttg

SEQ ID NO: 8516602 - DNA, 22 bp, Homo sapiens
gtgcctgggcatgagcttgttg

SEQ ID NO: 8516603 - DNA, 22 bp, Homo sapiens
gtgcatgtcggggtgcatgtca

SEQ ID NO: 8516604 - DNA, 22 bp, Homo sapiens
gtgcatgtcggggtgcatgtca

SEQ ID NO: 8516605 - DNA, 22 bp, Homo sapiens
gtgcatgtgcatccatgtgtac

SEQ ID NO: 8516606 - DNA, 22 bp, Homo sapiens
gtgcatgtgcatccatgtgtac

SEQ ID NO: 8516607 - DNA, 22 bp, Homo sapiens
gtgcatgttaatggtgtacaaa

SEQ ID NO: 8516608 - DNA, 22 bp, Homo sapiens
gtgcatgttaatggtgtacaaa

SEQ ID NO: 8516609 - DNA, 22 bp, Homo sapiens
gtgcatgtgtctttatagtagc

SEQ ID NO: 8516610 - DNA, 23 bp, Homo sapiens
gtgcatgtgtctttacagtagca

SEQ ID NO: 8516611 - DNA, 22 bp, Homo sapiens
gtgcatgtgtctttatagtaga

SEQ ID NO: 8516612 - DNA, 22 bp, Homo sapiens
gtgcatgtgcgttgactgtcca

SEQ ID NO: 8516613 - DNA, 22 bp, Homo sapiens
gtgcattaacaacccagaactc

SEQ ID NO: 8516614 - DNA, 22 bp, Homo sapiens
gtgcattacatgtaataaaata

SEQ ID NO: 8516615 - DNA, 22 bp, Homo sapiens
gtgcattagtttcctattgctg

SEQ ID NO: 8516616 - DNA, 22 bp, Homo sapiens
gtgcattaggctggaatgttga

SEQ ID NO: 8516617 - DNA, 22 bp, Homo sapiens
gtgcattattcttacctttctt

SEQ ID NO: 8516618 - DNA, 22 bp, Homo sapiens
cagccctgtgctaagcaccctc

SEQ ID NO: 8516619 - DNA, 22 bp, Homo sapiens
cagccctgtgcggagggccctg

SEQ ID NO: 8516620 - DNA, 22 bp, Homo sapiens
cagccctgtgcggagggccctg

SEQ ID NO: 8516621 - DNA, 22 bp, Homo sapiens
gtgcatattttgcacacagatg

SEQ ID NO: 8516622 - DNA, 22 bp, Homo sapiens
gtgcatatgtgtgtatacaaac

SEQ ID NO: 8516623 - DNA, 22 bp, Homo sapiens
gtgcaggaggtaacatagcaaa

SEQ ID NO: 8516624 - DNA, 22 bp, Homo sapiens
gtgcaggaggatgacaactgca

SEQ ID NO: 8516625 - DNA, 22 bp, Homo sapiens
gtgcaggagcttctggcctgac

SEQ ID NO: 8516626 - DNA, 22 bp, Homo sapiens
gtgcaggagctcccgcagtggt

SEQ ID NO: 8516627 - DNA, 22 bp, Homo sapiens
gtgcatgcagtaagtgttttaa

SEQ ID NO: 8516628 - DNA, 18 bp, Homo sapiens
gtgcatgcatgctctgcc

SEQ ID NO: 8516629 - DNA, 22 bp, Homo sapiens
gtgcatgcacacatgtgtgagg

SEQ ID NO: 8516630 - DNA, 22 bp, Homo sapiens
gtgcatgcacacatgtgtgagg

SEQ ID NO: 8516631 - DNA, 18 bp, Homo sapiens
gtgcatgcatgctctgcc

SEQ ID NO: 8516632 - DNA, 22 bp, Homo sapiens
gggctcaggcctggcctctcac

SEQ ID NO: 8516633 - DNA, 22 bp, Homo sapiens
gggctcaggcctggcctctcac

SEQ ID NO: 8516634 - DNA, 22 bp, Homo sapiens
gggctcaggcctggcctctcac

SEQ ID NO: 8516635 - DNA, 22 bp, Homo sapiens
gggctcaggagtttgaggctgc

SEQ ID NO: 8516636 - DNA, 22 bp, Homo sapiens
gggctcaggagtttgaggctgc

SEQ ID NO: 8516637 - DNA, 22 bp, Homo sapiens
gggctcagggacacatgtgtgt

SEQ ID NO: 8516638 - DNA, 22 bp, Homo sapiens
gggctcaggtcagggcatcagc

SEQ ID NO: 8516639 - DNA, 22 bp, Homo sapiens
gggctcagtcggcaagcccctt

SEQ ID NO: 8516640 - DNA, 22 bp, Homo sapiens
gggctcagtctgcggcgcgcgg

SEQ ID NO: 8516641 - DNA, 22 bp, Homo sapiens
gggctcagtctgcggcgcgcgg

SEQ ID NO: 8516642 - DNA, 21 bp, Homo sapiens
gggctcagtggaaaagagtgt

SEQ ID NO: 8516643 - DNA, 18 bp, Homo sapiens
gggctctgatccttcacc

SEQ ID NO: 8516644 - DNA, 22 bp, Homo sapiens
gggctctgcgctcagctccagc

SEQ ID NO: 8516645 - DNA, 22 bp, Homo sapiens
cagagctgtcatttgccagtga

SEQ ID NO: 8516646 - DNA, 22 bp, Homo sapiens
cagagctgtcatttgccagtga

SEQ ID NO: 8516647 - DNA, 22 bp, Homo sapiens
cagagctgtcatttgccagtga

SEQ ID NO: 8516648 - DNA, 22 bp, Homo sapiens
cagagctgtcatttgccagtga

SEQ ID NO: 8516649 - DNA, 22 bp, Homo sapiens
cagagctttctgtcacattagt

SEQ ID NO: 8516650 - DNA, 22 bp, Homo sapiens
cagagctttctgtcacattagt

SEQ ID NO: 8516651 - DNA, 22 bp, Homo sapiens
cagagctttggctagatggttg

SEQ ID NO: 8516652 - DNA, 22 bp, Homo sapiens
cagaggaaagtatttctggaag

SEQ ID NO: 8516653 - DNA, 22 bp, Homo sapiens
cagaggaaatgggaaggagata

SEQ ID NO: 8516654 - DNA, 22 bp, Homo sapiens
cagaggaaagtatttctggaag

SEQ ID NO: 8516655 - DNA, 22 bp, Homo sapiens
cagaggaaagtatttctggaag

SEQ ID NO: 8516656 - DNA, 22 bp, Homo sapiens
cagaggaacgtttggattgatt

SEQ ID NO: 8516657 - DNA, 22 bp, Homo sapiens
cagaggaagagatacaagccct

SEQ ID NO: 8516658 - DNA, 22 bp, Homo sapiens
cagaggaagagatacaagccct

SEQ ID NO: 8516659 - DNA, 22 bp, Homo sapiens
cagaggaagagatacaagccct

SEQ ID NO: 8516660 - DNA, 22 bp, Homo sapiens
cagaggaaatgggaaggagata

SEQ ID NO: 8516661 - DNA, 22 bp, Homo sapiens
cagaggaaatgggaaggagata

SEQ ID NO: 8516662 - DNA, 22 bp, Homo sapiens
cagaggaagggtgctgcgaaag

SEQ ID NO: 8516663 - DNA, 22 bp, Homo sapiens
cagaggaaggctctgggaatgt

SEQ ID NO: 8516664 - DNA, 22 bp, Homo sapiens
cagaggaagttccttgatgaga

SEQ ID NO: 8516665 - DNA, 22 bp, Homo sapiens
cagaggacaatagaatggaaag

SEQ ID NO: 8516666 - DNA, 22 bp, Homo sapiens
cagaggaagttccttgatgaga

SEQ ID NO: 8516667 - DNA, 22 bp, Homo sapiens
cagaggaagttccttgatgaga

SEQ ID NO: 8516668 - DNA, 22 bp, Homo sapiens
cagaggaagctgggtgtggagt

SEQ ID NO: 8516669 - DNA, 22 bp, Homo sapiens
cagaggaagctgggtgtggagt

SEQ ID NO: 8516670 - DNA, 22 bp, Homo sapiens
cagaggaaggctctgggaatgt

SEQ ID NO: 8516671 - DNA, 22 bp, Homo sapiens
cagaggaagctgggtgtggagt

SEQ ID NO: 8516672 - DNA, 22 bp, Homo sapiens
cagaggaaggctctgggaatgt

SEQ ID NO: 8516673 - DNA, 22 bp, Homo sapiens
cagaggaagcagacacatcttg

SEQ ID NO: 8516674 - DNA, 22 bp, Homo sapiens
cagaggaagcagacacatcttg

SEQ ID NO: 8516675 - DNA, 22 bp, Homo sapiens
ggggcggggctctgagaagcat

SEQ ID NO: 8516676 - DNA, 22 bp, Homo sapiens
ggggcggggctctgagaagcat

SEQ ID NO: 8516677 - DNA, 22 bp, Homo sapiens
ggggcgctcggagggatcccct

SEQ ID NO: 8516678 - DNA, 22 bp, Homo sapiens
gggggaggtgaatgcaataagg

SEQ ID NO: 8516679 - DNA, 22 bp, Homo sapiens
gggggaggtgaatgcaataagg

SEQ ID NO: 8516680 - DNA, 22 bp, Homo sapiens
gggggaggtgaatgcaataagg

SEQ ID NO: 8516681 - DNA, 22 bp, Homo sapiens
gggggcagaatgtactcttgtc

SEQ ID NO: 8516682 - DNA, 22 bp, Homo sapiens
gggggcagaatgtactcttgtc

SEQ ID NO: 8516683 - DNA, 22 bp, Homo sapiens
gggggcaggtctggaactttga

SEQ ID NO: 8516684 - DNA, 22 bp, Homo sapiens
gggggatgctcaggaggctgct

SEQ ID NO: 8516685 - DNA, 22 bp, Homo sapiens
gggggatgctcaggaggctgct

SEQ ID NO: 8516686 - DNA, 22 bp, Homo sapiens
gggggcagtaacctcaaagtgt

SEQ ID NO: 8516687 - DNA, 22 bp, Homo sapiens
gggggcaggtctggaactttga

SEQ ID NO: 8516688 - DNA, 22 bp, Homo sapiens
gggggcaggtctggaactttga

SEQ ID NO: 8516689 - DNA, 22 bp, Homo sapiens
gggggcagtaaggatatggaaa

SEQ ID NO: 8516690 - DNA, 22 bp, Homo sapiens
gggggcagtaacctcaaagtgt

SEQ ID NO: 8516691 - DNA, 22 bp, Homo sapiens
gggggcagtaaggatatggaaa

SEQ ID NO: 8516692 - DNA, 22 bp, Homo sapiens
cagaggcaggaagatgggcagt

SEQ ID NO: 8516693 - DNA, 22 bp, Homo sapiens
cagaggcagccgggggagaacg

SEQ ID NO: 8516694 - DNA, 22 bp, Homo sapiens
cagaggcagaggtcatctctgg

SEQ ID NO: 8516695 - DNA, 22 bp, Homo sapiens
cagaggcagaggtcatctctgg

SEQ ID NO: 8516696 - DNA, 22 bp, Homo sapiens
cagaggcagaggtcatctctgg

SEQ ID NO: 8516697 - DNA, 22 bp, Homo sapiens
cagaggcagaggtcatctctgg

SEQ ID NO: 8516698 - DNA, 22 bp, Homo sapiens
cagaggcagaggtcatctctgg

SEQ ID NO: 8516699 - DNA, 22 bp, Homo sapiens
cagaggcagaccctccagggcg

SEQ ID NO: 8516700 - DNA, 22 bp, Homo sapiens
cagaggcagaccctccagggcg

SEQ ID NO: 8516701 - DNA, 22 bp, Homo sapiens
cagaggcagaatggagatttgg

SEQ ID NO: 8516702 - DNA, 21 bp, Homo sapiens
cagagcagcgttctgctgtgg

SEQ ID NO: 8516703 - DNA, 21 bp, Homo sapiens
cagagcagcgttctgctgtgg

SEQ ID NO: 8516704 - DNA, 22 bp, Homo sapiens
cagagcagcctccagggggagc

SEQ ID NO: 8516705 - DNA, 22 bp, Homo sapiens
cagagcagcctccagggggagc

SEQ ID NO: 8516706 - DNA, 22 bp, Homo sapiens
cagagcagcctccagggggagc

SEQ ID NO: 8516707 - DNA, 22 bp, Homo sapiens
gggcgccgtgggaaacagccgg

SEQ ID NO: 8516708 - DNA, 22 bp, Homo sapiens
gggcgcgggaaggagcccgaga

SEQ ID NO: 8516709 - DNA, 17 bp, Homo sapiens
gggcgcgggtagagccc

SEQ ID NO: 8516710 - DNA, 22 bp, Homo sapiens
cagagcaggaatagggtgttga

SEQ ID NO: 8516711 - DNA, 22 bp, Homo sapiens
cagagcaggaatagggtgttga

SEQ ID NO: 8516712 - DNA, 22 bp, Homo sapiens
cagagcagagtgattgttctgg

SEQ ID NO: 8516713 - DNA, 18 bp, Homo sapiens
cagagcagaggtggagcg

SEQ ID NO: 8516714 - DNA, 22 bp, Homo sapiens
cagagcagatttctaagtattg

SEQ ID NO: 8516715 - DNA, 22 bp, Homo sapiens
cagagcagatttctaagtattg

SEQ ID NO: 8516716 - DNA, 22 bp, Homo sapiens
cagagcagcagagcttccatgg

SEQ ID NO: 8516717 - DNA, 22 bp, Homo sapiens
cagagcagcagagcttccatgg

SEQ ID NO: 8516718 - DNA, 22 bp, Homo sapiens
cagagcagcagagcttccatgg

SEQ ID NO: 8516719 - DNA, 18 bp, Homo sapiens
gggccctggcgtccgccc

SEQ ID NO: 8516720 - DNA, 18 bp, Homo sapiens
gggccctggcgtccgccc

SEQ ID NO: 8516721 - DNA, 22 bp, Homo sapiens
gggccctggctttcctgttctt

SEQ ID NO: 8516722 - DNA, 20 bp, Homo sapiens
gggccctgggattcagagca

SEQ ID NO: 8516723 - DNA, 22 bp, Homo sapiens
cagagagcttagtgtgctgcat

SEQ ID NO: 8516724 - DNA, 22 bp, Homo sapiens
cagagagcttagtgtgctgcat

SEQ ID NO: 8516725 - DNA, 22 bp, Homo sapiens
cagagagcttagtgtgctgcat

SEQ ID NO: 8516726 - DNA, 21 bp, Homo sapiens
cagagagctagaacttcatga

SEQ ID NO: 8516727 - DNA, 22 bp, Homo sapiens
cagagagcatgggaggcccgag

SEQ ID NO: 8516728 - DNA, 22 bp, Homo sapiens
cagagagcttagtgtgctgcat

SEQ ID NO: 8516729 - DNA, 22 bp, Homo sapiens
cagagagagtctgtccctgaag

SEQ ID NO: 8516730 - DNA, 22 bp, Homo sapiens
cagagagagtggggtgtggatt

SEQ ID NO: 8516731 - DNA, 22 bp, Homo sapiens
cagagagagtggggtgtggatt

SEQ ID NO: 8516732 - DNA, 22 bp, Homo sapiens
cagagagagtggggtgtggatt

SEQ ID NO: 8516733 - DNA, 22 bp, Homo sapiens
cagagagcacataggatacttt

SEQ ID NO: 8516734 - DNA, 22 bp, Homo sapiens
gggccctgcgtccggaagtctg

SEQ ID NO: 8516735 - DNA, 22 bp, Homo sapiens
gggccctgcgtccggaagtctg

SEQ ID NO: 8516736 - DNA, 22 bp, Homo sapiens
gggccctgcgtccggaagtctg

SEQ ID NO: 8516737 - DNA, 22 bp, Homo sapiens
gggccctggccgaatccctctg

SEQ ID NO: 8516738 - DNA, 22 bp, Homo sapiens
gggccctggatttaagcatgga

SEQ ID NO: 8516739 - DNA, 22 bp, Homo sapiens
gggccctggatttaagcatgga

SEQ ID NO: 8516740 - DNA, 22 bp, Homo sapiens
gggccctggacgtggcggcaga

SEQ ID NO: 8516741 - DNA, 22 bp, Homo sapiens
gggccctggacgtggcggcaga

SEQ ID NO: 8516742 - DNA, 22 bp, Homo sapiens
gggccctggacgtggcggcaga

SEQ ID NO: 8516743 - DNA, 22 bp, Homo sapiens
cagagagaggccactgctatta

SEQ ID NO: 8516744 - DNA, 22 bp, Homo sapiens
cagagagaggccactgctatta

SEQ ID NO: 8516745 - DNA, 22 bp, Homo sapiens
cagagagagcaggaaacctccg

SEQ ID NO: 8516746 - DNA, 22 bp, Homo sapiens
cagagagagcaggaaacctccg

SEQ ID NO: 8516747 - DNA, 19 bp, Homo sapiens
cagagagaccaaggcgcca

SEQ ID NO: 8516748 - DNA, 22 bp, Homo sapiens
cagagagaggggctgcctggcc

SEQ ID NO: 8516749 - DNA, 22 bp, Homo sapiens
cagagagaggggctgcctggcc

SEQ ID NO: 8516750 - DNA, 22 bp, Homo sapiens
cagagagagtcaaatctttgct

SEQ ID NO: 8516751 - DNA, 22 bp, Homo sapiens
cagagagaatcttggcagctga

SEQ ID NO: 8516752 - DNA, 22 bp, Homo sapiens
cagagagaatcttggcagctga

SEQ ID NO: 8516753 - DNA, 22 bp, Homo sapiens
cagagagaatcttggcagctga

SEQ ID NO: 8516754 - DNA, 22 bp, Homo sapiens
cagagagaatcttggcagctga

SEQ ID NO: 8516755 - DNA, 22 bp, Homo sapiens
cagagagaatatgtagtatgga

SEQ ID NO: 8516756 - DNA, 22 bp, Homo sapiens
cagagagaatcttggcagctga

SEQ ID NO: 8516757 - DNA, 22 bp, Homo sapiens
cagagacagtttcacagggtct

SEQ ID NO: 8516758 - DNA, 20 bp, Homo sapiens
cagagacctgtcttcacaga

SEQ ID NO: 8516759 - DNA, 22 bp, Homo sapiens
cagagacagtttcacagggtct

SEQ ID NO: 8516760 - DNA, 18 bp, Homo sapiens
cagaagcaggcagtgcag

SEQ ID NO: 8516761 - DNA, 22 bp, Homo sapiens
cagaagcagattctaaagcaag

SEQ ID NO: 8516762 - DNA, 22 bp, Homo sapiens
cagaagcagaacactagattta

SEQ ID NO: 8516763 - DNA, 22 bp, Homo sapiens
cagaagcactaggaggaaacgt

SEQ ID NO: 8516764 - DNA, 22 bp, Homo sapiens
cagaagcactaggaggaaacgt

SEQ ID NO: 8516765 - DNA, 22 bp, Homo sapiens
cagaagcactaggaggaaacgt

SEQ ID NO: 8516766 - DNA, 22 bp, Homo sapiens
cagaagcactaggaggaaacgt

SEQ ID NO: 8516767 - DNA, 23 bp, Homo sapiens
cagaagcacctgttgactgctgc

SEQ ID NO: 8516768 - DNA, 22 bp, Homo sapiens
cagaagcacatgtttacatgta

SEQ ID NO: 8516769 - DNA, 22 bp, Homo sapiens
cagaagcacatgtttacatgta

SEQ ID NO: 8516770 - DNA, 22 bp, Homo sapiens
cagaagcaagtagtgattcttt

SEQ ID NO: 8516771 - DNA, 22 bp, Homo sapiens
cagaagcaaatgccttgctgag

SEQ ID NO: 8516772 - DNA, 22 bp, Homo sapiens
cagaagcaaatgccttgctgag

SEQ ID NO: 8516773 - DNA, 22 bp, Homo sapiens
cagaagatgcagtgtctgagaa

SEQ ID NO: 8516774 - DNA, 22 bp, Homo sapiens
ggtggcagggagtgtccctggg

SEQ ID NO: 8516775 - DNA, 18 bp, Homo sapiens
ggtggcaggtcagatgcc

SEQ ID NO: 8516776 - DNA, 18 bp, Homo sapiens
ggtggcaggtcagatgcc

SEQ ID NO: 8516777 - DNA, 18 bp, Homo sapiens
ggtggcaggtcagatgcc

SEQ ID NO: 8516778 - DNA, 22 bp, Homo sapiens
ggtggcagtagcactgggcctg

SEQ ID NO: 8516779 - DNA, 22 bp, Homo sapiens
ggtggcagtcttaagagatctt

SEQ ID NO: 8516780 - DNA, 22 bp, Homo sapiens
ggtggcagtcttaagagatctt

SEQ ID NO: 8516781 - DNA, 22 bp, Homo sapiens
cagatgcttggaggacacttgg

SEQ ID NO: 8516782 - DNA, 22 bp, Homo sapiens
cagatgcttggaggacacttgg

SEQ ID NO: 8516783 - DNA, 22 bp, Homo sapiens
cagatgcttgttggctggtctc

SEQ ID NO: 8516784 - DNA, 22 bp, Homo sapiens
cagatgcttttgattctggggt

SEQ ID NO: 8516785 - DNA, 22 bp, Homo sapiens
cagatggattttgtaggctgat

SEQ ID NO: 8516786 - DNA, 22 bp, Homo sapiens
ggtggcaggctggcattggcaa

SEQ ID NO: 8516787 - DNA, 22 bp, Homo sapiens
ggtgctggttcagggtggctgt

SEQ ID NO: 8516788 - DNA, 22 bp, Homo sapiens
ggtgctggttcagggtggctgt

SEQ ID NO: 8516789 - DNA, 22 bp, Homo sapiens
ggtgctggttcagggtggctgt

SEQ ID NO: 8516790 - DNA, 22 bp, Homo sapiens
ggtggctgggattagtagccca

SEQ ID NO: 8516791 - DNA, 22 bp, Homo sapiens
ggtggctggaggagctgatgga

SEQ ID NO: 8516792 - DNA, 22 bp, Homo sapiens
ggtggctggaggagctgatgga

SEQ ID NO: 8516793 - DNA, 22 bp, Homo sapiens
ggtggctgtgagcattatgtga

SEQ ID NO: 8516794 - DNA, 22 bp, Homo sapiens
ggtggctggttttataagaggt

SEQ ID NO: 8516795 - DNA, 18 bp, Homo sapiens
ggtggctggggacggaca

SEQ ID NO: 8516796 - DNA, 22 bp, Homo sapiens
ggtggctgcttcctcaagagga

SEQ ID NO: 8516797 - DNA, 22 bp, Homo sapiens
ggtggctgcttcctcaagagga

SEQ ID NO: 8516798 - DNA, 22 bp, Homo sapiens
ggtgggaaggccactgaaggtt

SEQ ID NO: 8516799 - DNA, 22 bp, Homo sapiens
ggtgggaaggccactgaaggtt

SEQ ID NO: 8516800 - DNA, 22 bp, Homo sapiens
ggtgggacaggtaggagtggct

SEQ ID NO: 8516801 - DNA, 22 bp, Homo sapiens
ggtgggacaggtaggagtggct

SEQ ID NO: 8516802 - DNA, 22 bp, Homo sapiens
ggtgggaaggggccagtgtgcg

SEQ ID NO: 8516803 - DNA, 22 bp, Homo sapiens
ggtgggaaggggccagtgtgcg

SEQ ID NO: 8516804 - DNA, 22 bp, Homo sapiens
cagcagaacaggcagggaagct

SEQ ID NO: 8516805 - DNA, 22 bp, Homo sapiens
cagcactgctgctgtacacaca

SEQ ID NO: 8516806 - DNA, 22 bp, Homo sapiens
cagcagaacaggcagggaagct

SEQ ID NO: 8516807 - DNA, 20 bp, Homo sapiens
cagcagaaatggggtgggaa

SEQ ID NO: 8516808 - DNA, 22 bp, Homo sapiens
cagcagagaaattaaacttctg

SEQ ID NO: 8516809 - DNA, 22 bp, Homo sapiens
cagcagacttactagaatgtaa

SEQ ID NO: 8516810 - DNA, 22 bp, Homo sapiens
cagcagactggagtaggcagtg

SEQ ID NO: 8516811 - DNA, 22 bp, Homo sapiens
cagcagaagtgcatttgtgatt

SEQ ID NO: 8516812 - DNA, 22 bp, Homo sapiens
cagcagagaaattacatatttg

SEQ ID NO: 8516813 - DNA, 18 bp, Homo sapiens
cagcagagacattcaaaa

SEQ ID NO: 8516814 - DNA, 22 bp, Homo sapiens
cagcagagaaattacatatttg

SEQ ID NO: 8516815 - DNA, 18 bp, Homo sapiens
cagcagagacattcaaaa

SEQ ID NO: 8516816 - DNA, 22 bp, Homo sapiens
ggtgtctggacagtgagccagg

SEQ ID NO: 8516817 - DNA, 22 bp, Homo sapiens
ggtgtctgcttccctccagctg

SEQ ID NO: 8516818 - DNA, 15 bp, Homo sapiens
ggtgtctgcagtgtg

SEQ ID NO: 8516819 - DNA, 22 bp, Homo sapiens
ggtgtctgcttccctccagctg

SEQ ID NO: 8516820 - DNA, 22 bp, Homo sapiens
ggtgtctgtgatggcatataac

SEQ ID NO: 8516821 - DNA, 22 bp, Homo sapiens
ggtgtctggacagtgagccagg

SEQ ID NO: 8516822 - DNA, 22 bp, Homo sapiens
ggtgtctgttgcctcctggtta

SEQ ID NO: 8516823 - DNA, 20 bp, Homo sapiens
cagcagagacccatggggag

SEQ ID NO: 8516824 - DNA, 20 bp, Homo sapiens
cagcagagacccatggggag

SEQ ID NO: 8516825 - DNA, 22 bp, Homo sapiens
ggtgtctatgattcagtttatg

SEQ ID NO: 8516826 - DNA, 22 bp, Homo sapiens
ggtgtctcagctgctggcaggg

SEQ ID NO: 8516827 - DNA, 22 bp, Homo sapiens
ggtgtctgatggtggcttctca

SEQ ID NO: 8516828 - DNA, 22 bp, Homo sapiens
ggtgtctgattccaaggccaca

SEQ ID NO: 8516829 - DNA, 22 bp, Homo sapiens
ggtgtctgattccaaggccaca

SEQ ID NO: 8516830 - DNA, 22 bp, Homo sapiens
ggtgtgaaatgttcagtgttac

SEQ ID NO: 8516831 - DNA, 22 bp, Homo sapiens
ggtgtgaattttgaccttttaa

SEQ ID NO: 8516832 - DNA, 22 bp, Homo sapiens
gtaaacatcagccactctattt

SEQ ID NO: 8516833 - DNA, 22 bp, Homo sapiens
gtaaacatcagccactctattt

SEQ ID NO: 8516834 - DNA, 22 bp, Homo sapiens
gtaacattattcatgagataca

SEQ ID NO: 8516835 - DNA, 22 bp, Homo sapiens
gtaacattattcatgagataca

SEQ ID NO: 8516836 - DNA, 22 bp, Homo sapiens
gtaaacatcgacccaacagggg

SEQ ID NO: 8516837 - DNA, 22 bp, Homo sapiens
gtaacatttacagttcctagag

SEQ ID NO: 8516838 - DNA, 16 bp, Homo sapiens
gtaacattctgtagcc

SEQ ID NO: 8516839 - DNA, 22 bp, Homo sapiens
gtaacattctagaaacttaaca

SEQ ID NO: 8516840 - DNA, 22 bp, Homo sapiens
gtaacattttgagcagtaggct

SEQ ID NO: 8516841 - DNA, 22 bp, Homo sapiens
gtaacctggaagtttagggaag

SEQ ID NO: 8516842 - DNA, 22 bp, Homo sapiens
gtaacatttacagttcctagag

SEQ ID NO: 8516843 - DNA, 22 bp, Homo sapiens
gtaacctgggatgtagcacaga

SEQ ID NO: 8516844 - DNA, 22 bp, Homo sapiens
gtaacctgggatgtagcacaga

SEQ ID NO: 8516845 - DNA, 22 bp, Homo sapiens
gtaacctgtcggaaagccttgt

SEQ ID NO: 8516846 - DNA, 22 bp, Homo sapiens
gtaacctgtcggaaagccttgt

SEQ ID NO: 8516847 - DNA, 22 bp, Homo sapiens
gtaactgaggcagcttttaaga

SEQ ID NO: 8516848 - DNA, 22 bp, Homo sapiens
gtaactgaggcagcttttaaga

SEQ ID NO: 8516849 - DNA, 22 bp, Homo sapiens
gtaaggctaatgtctttgtggt

SEQ ID NO: 8516850 - DNA, 22 bp, Homo sapiens
gtaagcattcattgtctgtata

SEQ ID NO: 8516851 - DNA, 22 bp, Homo sapiens
gtaagcattcattgtctgtata

SEQ ID NO: 8516852 - DNA, 22 bp, Homo sapiens
gtaagcatctgtctcttctgca

SEQ ID NO: 8516853 - DNA, 20 bp, Homo sapiens
cagcagagacccatggggag

SEQ ID NO: 8516854 - DNA, 22 bp, Homo sapiens
cagcagagacggtaagcagaac

SEQ ID NO: 8516855 - DNA, 22 bp, Homo sapiens
cagcagagacggtaagcagaac

SEQ ID NO: 8516856 - DNA, 22 bp, Homo sapiens
gtaagcaaacagcaaatgattt

SEQ ID NO: 8516857 - DNA, 22 bp, Homo sapiens
gtaagaggatcaaggcggtgca

SEQ ID NO: 8516858 - DNA, 22 bp, Homo sapiens
gtaagaggagtgggaagcctca

SEQ ID NO: 8516859 - DNA, 22 bp, Homo sapiens
gtaactttggatttagggtacc

SEQ ID NO: 8516860 - DNA, 22 bp, Homo sapiens
gtaagaagatgaatccaggctg

SEQ ID NO: 8516861 - DNA, 22 bp, Homo sapiens
gtaagaggagtgggaagcctca

SEQ ID NO: 8516862 - DNA, 22 bp, Homo sapiens
cagagtgaaaactgagctcaaa

SEQ ID NO: 8516863 - DNA, 22 bp, Homo sapiens
cagagtggtgcaagggcagtgt

SEQ ID NO: 8516864 - DNA, 22 bp, Homo sapiens
cagagtggtgcaagggcagtgt

SEQ ID NO: 8516865 - DNA, 22 bp, Homo sapiens
cagagtgggctgtcagccacca

SEQ ID NO: 8516866 - DNA, 19 bp, Homo sapiens
cagagttacatggctgtgg

SEQ ID NO: 8516867 - DNA, 22 bp, Homo sapiens
cagagttcaaagcctgctggga

SEQ ID NO: 8516868 - DNA, 22 bp, Homo sapiens
cagagtttcggtaagcatagaa

SEQ ID NO: 8516869 - DNA, 19 bp, Homo sapiens
cagagtttgcaggcagagg

SEQ ID NO: 8516870 - DNA, 22 bp, Homo sapiens
cagagtttgcaagggcagaagc

SEQ ID NO: 8516871 - DNA, 21 bp, Homo sapiens
ggggtcaagtgaatggtgttg

SEQ ID NO: 8516872 - DNA, 21 bp, Homo sapiens
ggggtcaagtgaatggtgttg

SEQ ID NO: 8516873 - DNA, 22 bp, Homo sapiens
ggggtcggggcatagccactta

SEQ ID NO: 8516874 - DNA, 22 bp, Homo sapiens
ggggtgagctgggcctgtgcct

SEQ ID NO: 8516875 - DNA, 22 bp, Homo sapiens
cagagtgaaaactgagctcaaa

SEQ ID NO: 8516876 - DNA, 22 bp, Homo sapiens
ggggtctgggcttagctggaat

SEQ ID NO: 8516877 - DNA, 21 bp, Homo sapiens
cagaggctgagagggcaatct

SEQ ID NO: 8516878 - DNA, 22 bp, Homo sapiens
cagaggcctttctacagtgata

SEQ ID NO: 8516879 - DNA, 22 bp, Homo sapiens
cagaggcctttctacagtgata

SEQ ID NO: 8516880 - DNA, 22 bp, Homo sapiens
cagaggcctttctacagtgata

SEQ ID NO: 8516881 - DNA, 22 bp, Homo sapiens
cagaggctgaccctgctgttgt

SEQ ID NO: 8516882 - DNA, 22 bp, Homo sapiens
cagaggcctttctacagtgata

SEQ ID NO: 8516883 - DNA, 22 bp, Homo sapiens
cagaggcaggataagaactgcg

SEQ ID NO: 8516884 - DNA, 21 bp, Homo sapiens
cagaggctgagagggcaatct

SEQ ID NO: 8516885 - DNA, 22 bp, Homo sapiens
cagaggctgagcagtcagtttg

SEQ ID NO: 8516886 - DNA, 22 bp, Homo sapiens
cagaggctgatggctgtagcca

SEQ ID NO: 8516887 - DNA, 22 bp, Homo sapiens
cagaggctgagcagtcagtttg

SEQ ID NO: 8516888 - DNA, 21 bp, Homo sapiens
cagaggctgagagggcaatct

SEQ ID NO: 8516889 - DNA, 22 bp, Homo sapiens
cagaggctgaccctgctgttgt

SEQ ID NO: 8516890 - DNA, 22 bp, Homo sapiens
cagaggctgatgtgggatgggc

SEQ ID NO: 8516891 - DNA, 22 bp, Homo sapiens
cagaggctgatgtgggatgggc

SEQ ID NO: 8516892 - DNA, 22 bp, Homo sapiens
cagaggctgagcagtcagtttg

SEQ ID NO: 8516893 - DNA, 22 bp, Homo sapiens
cagaggctgctctgggtggcat

SEQ ID NO: 8516894 - DNA, 22 bp, Homo sapiens
cagaggctgctctgggtggcat

SEQ ID NO: 8516895 - DNA, 22 bp, Homo sapiens
cagaggctgctctgggtggcat

SEQ ID NO: 8516896 - DNA, 22 bp, Homo sapiens
ggggtagggtgattgtgaagta

SEQ ID NO: 8516897 - DNA, 22 bp, Homo sapiens
ggggtcaagctcagaatcctag

SEQ ID NO: 8516898 - DNA, 22 bp, Homo sapiens
ggggtagggtgattgtgaagta

SEQ ID NO: 8516899 - DNA, 22 bp, Homo sapiens
cagaggctgccagccatgtgca

SEQ ID NO: 8516900 - DNA, 22 bp, Homo sapiens
cagaggctgatgtgggatgggc

SEQ ID NO: 8516901 - DNA, 22 bp, Homo sapiens
cagaggctgatgtgggatgggc

SEQ ID NO: 8516902 - DNA, 22 bp, Homo sapiens
cagaggctgccagccatgtgca

SEQ ID NO: 8516903 - DNA, 22 bp, Homo sapiens
cagaggctgccagccatgtgca

SEQ ID NO: 8516904 - DNA, 22 bp, Homo sapiens
cagaggctgctctgggtggcat

SEQ ID NO: 8516905 - DNA, 22 bp, Homo sapiens
cagatgcttcgtgggtgagcac

SEQ ID NO: 8516906 - DNA, 20 bp, Homo sapiens
cagatgctggatcttggtcc

SEQ ID NO: 8516907 - DNA, 22 bp, Homo sapiens
cagatgctggtatgggggaggt

SEQ ID NO: 8516908 - DNA, 22 bp, Homo sapiens
cagatgctatagtgctgccata

SEQ ID NO: 8516909 - DNA, 22 bp, Homo sapiens
cagatgctatgtattatgtatg

SEQ ID NO: 8516910 - DNA, 22 bp, Homo sapiens
cagatgctgctcacctgattat

SEQ ID NO: 8516911 - DNA, 22 bp, Homo sapiens
cagatgctgctatttcaccctg

SEQ ID NO: 8516912 - DNA, 22 bp, Homo sapiens
cagatgctgcctgggaatgtct

SEQ ID NO: 8516913 - DNA, 22 bp, Homo sapiens
ggtgcagatctttctcttcagg

SEQ ID NO: 8516914 - DNA, 22 bp, Homo sapiens
ggtgcagagtccacagaaagct

SEQ ID NO: 8516915 - DNA, 22 bp, Homo sapiens
ggtgcagagtccacagaaagct

SEQ ID NO: 8516916 - DNA, 22 bp, Homo sapiens
ggtgcagagtccacagaaagct

SEQ ID NO: 8516917 - DNA, 18 bp, Homo sapiens
cagatgctaggcctccag

SEQ ID NO: 8516918 - DNA, 22 bp, Homo sapiens
cagatgctatagtgctgccata

SEQ ID NO: 8516919 - DNA, 22 bp, Homo sapiens
ggtgcagctgcagcctgggagc

SEQ ID NO: 8516920 - DNA, 22 bp, Homo sapiens
ggtgcagagcagtgtcagagca

SEQ ID NO: 8516921 - DNA, 22 bp, Homo sapiens
ggtgcagagcagtgtcagagca

SEQ ID NO: 8516922 - DNA, 22 bp, Homo sapiens
ggtgcagaggagccagctgggg

SEQ ID NO: 8516923 - DNA, 22 bp, Homo sapiens
ggtgcagaggagccagctgggg

SEQ ID NO: 8516924 - DNA, 22 bp, Homo sapiens
ggtgcagaagaaagcagtcatt

SEQ ID NO: 8516925 - DNA, 22 bp, Homo sapiens
ggtgcagaagaaagcagtcatt

SEQ ID NO: 8516926 - DNA, 22 bp, Homo sapiens
ggtgcagaaggaagggagctgg

SEQ ID NO: 8516927 - DNA, 22 bp, Homo sapiens
ggtgcagaaggaagggagctgg

SEQ ID NO: 8516928 - DNA, 22 bp, Homo sapiens
ggtgagaggcagaggacagctt

SEQ ID NO: 8516929 - DNA, 22 bp, Homo sapiens
ggtgagaggcagtgctgtggaa

SEQ ID NO: 8516930 - DNA, 22 bp, Homo sapiens
ggtgcaaagggcctagagagtg

SEQ ID NO: 8516931 - DNA, 22 bp, Homo sapiens
cagatacattaaaatgatgatt

SEQ ID NO: 8516932 - DNA, 22 bp, Homo sapiens
cagatacattaaaatgatgatt

SEQ ID NO: 8516933 - DNA, 22 bp, Homo sapiens
cagatacattaaaatgatgatt

SEQ ID NO: 8516934 - DNA, 22 bp, Homo sapiens
cagatacattaaaatgatgatt

SEQ ID NO: 8516935 - DNA, 22 bp, Homo sapiens
cagatagcgtttgagagcataa

SEQ ID NO: 8516936 - DNA, 22 bp, Homo sapiens
cagataggaaaagctaggcata

SEQ ID NO: 8516937 - DNA, 22 bp, Homo sapiens
cagatatattttatttggtcaa

SEQ ID NO: 8516938 - DNA, 22 bp, Homo sapiens
ggtgagaggcagaggacagctt

SEQ ID NO: 8516939 - DNA, 22 bp, Homo sapiens
cagatatagtggcttgcctggg

SEQ ID NO: 8516940 - DNA, 22 bp, Homo sapiens
cagatatagtggcttgcctggg

SEQ ID NO: 8516941 - DNA, 22 bp, Homo sapiens
cagatataaatggatgtggtag

SEQ ID NO: 8516942 - DNA, 22 bp, Homo sapiens
cagataaaggcttactagtagt

SEQ ID NO: 8516943 - DNA, 22 bp, Homo sapiens
cagataaaggcttactagtagt

SEQ ID NO: 8516944 - DNA, 22 bp, Homo sapiens
cagagttttgtgaacaacttgg

SEQ ID NO: 8516945 - DNA, 22 bp, Homo sapiens
cagataaaattaatattaccaa

SEQ ID NO: 8516946 - DNA, 22 bp, Homo sapiens
cagataaaattaatattaccaa

SEQ ID NO: 8516947 - DNA, 22 bp, Homo sapiens
cagataactgaaatatcatacc

SEQ ID NO: 8516948 - DNA, 22 bp, Homo sapiens
cagataactgaaatatcatacc

SEQ ID NO: 8516949 - DNA, 22 bp, Homo sapiens
cagataacacaaagaaatgggc

SEQ ID NO: 8516950 - DNA, 22 bp, Homo sapiens
cagatacagctagctccgtggc

SEQ ID NO: 8516951 - DNA, 22 bp, Homo sapiens
cagataaatagacttggtcaga

SEQ ID NO: 8516952 - DNA, 22 bp, Homo sapiens
cagataaatagatagataaact

SEQ ID NO: 8516953 - DNA, 22 bp, Homo sapiens
cagataaatagatagataaact

SEQ ID NO: 8516954 - DNA, 22 bp, Homo sapiens
cagataaatagatagataaact

SEQ ID NO: 8516955 - DNA, 22 bp, Homo sapiens
cagataaatagatagataaact

SEQ ID NO: 8516956 - DNA, 19 bp, Homo sapiens
catggtgaaaccccgtctc

SEQ ID NO: 8516957 - DNA, 22 bp, Homo sapiens
catggtgaggggtgaagggcag

SEQ ID NO: 8516958 - DNA, 19 bp, Homo sapiens
catggtgaaaccccgtctc

SEQ ID NO: 8516959 - DNA, 22 bp, Homo sapiens
catgggctcttctggactgcac

SEQ ID NO: 8516960 - DNA, 22 bp, Homo sapiens
catggaacaaggaagatgtttg

SEQ ID NO: 8516961 - DNA, 22 bp, Homo sapiens
catgtaaaccattgtgagcatc

SEQ ID NO: 8516962 - DNA, 22 bp, Homo sapiens
catgtaaaacactcagaacagt

SEQ ID NO: 8516963 - DNA, 22 bp, Homo sapiens
catgtaaaaagaagaatctgga

SEQ ID NO: 8516964 - DNA, 22 bp, Homo sapiens
catgtaaaaaattaggtcatct

SEQ ID NO: 8516965 - DNA, 22 bp, Homo sapiens
catgtaaaaaattaggtcatct

SEQ ID NO: 8516966 - DNA, 22 bp, Homo sapiens
catgtaaagaatttcacacaag

SEQ ID NO: 8516967 - DNA, 22 bp, Homo sapiens
catgtaaagaatttcacacaag

SEQ ID NO: 8516968 - DNA, 22 bp, Homo sapiens
catgtaaagcacttcataacag

SEQ ID NO: 8516969 - DNA, 22 bp, Homo sapiens
catgtaatgctgggagctgggc

SEQ ID NO: 8516970 - DNA, 22 bp, Homo sapiens
catgtacaaaaggcaaatgcct

SEQ ID NO: 8516971 - DNA, 22 bp, Homo sapiens
catgtacaaaaggcaaatgcct

SEQ ID NO: 8516972 - DNA, 22 bp, Homo sapiens
catgtaatcctggggagatgaa

SEQ ID NO: 8516973 - DNA, 22 bp, Homo sapiens
tccagcagaaaagaggtaggga

SEQ ID NO: 8516974 - DNA, 22 bp, Homo sapiens
tccagcagaaaagaggtaggga

SEQ ID NO: 8516975 - DNA, 22 bp, Homo sapiens
tccagcaaagtgataggatttc

SEQ ID NO: 8516976 - DNA, 22 bp, Homo sapiens
tccagatggatttaagacctaa

SEQ ID NO: 8516977 - DNA, 22 bp, Homo sapiens
tccagatggatttaagacctaa

SEQ ID NO: 8516978 - DNA, 19 bp, Homo sapiens
tccagatgatatggattac

SEQ ID NO: 8516979 - DNA, 22 bp, Homo sapiens
tccagatgctgcacattcctga

SEQ ID NO: 8516980 - DNA, 22 bp, Homo sapiens
tccagatggatttaagacctaa

SEQ ID NO: 8516981 - DNA, 21 bp, Homo sapiens
tccagcacagatgacctcccc

SEQ ID NO: 8516982 - DNA, 22 bp, Homo sapiens
tccagcacccaatgtggctaag

SEQ ID NO: 8516983 - DNA, 22 bp, Homo sapiens
catgcttaattggagcattcat

SEQ ID NO: 8516984 - DNA, 22 bp, Homo sapiens
catgcttatatggaaaggaaga

SEQ ID NO: 8516985 - DNA, 22 bp, Homo sapiens
catgcttacttgtctcagcaga

SEQ ID NO: 8516986 - DNA, 22 bp, Homo sapiens
catgcttcatgcaaaattctga

SEQ ID NO: 8516987 - DNA, 22 bp, Homo sapiens
catgcttcctccaaactaccct

SEQ ID NO: 8516988 - DNA, 22 bp, Homo sapiens
catgcttcctccaaactaccct

SEQ ID NO: 8516989 - DNA, 22 bp, Homo sapiens
catgctttaccaaagcagtgat

SEQ ID NO: 8516990 - DNA, 23 bp, Homo sapiens
catggaaaactgaaagctgacct

SEQ ID NO: 8516991 - DNA, 22 bp, Homo sapiens
catgctttttgacaacaagctg

SEQ ID NO: 8516992 - DNA, 22 bp, Homo sapiens
catgcttttcaatctatcttaa

SEQ ID NO: 8516993 - DNA, 22 bp, Homo sapiens
catgctttgggtcagaaatgcc

SEQ ID NO: 8516994 - DNA, 22 bp, Homo sapiens
catgcttttcaatctatcttaa

SEQ ID NO: 8516995 - DNA, 22 bp, Homo sapiens
catgctttctgtccaaatgtta

SEQ ID NO: 8516996 - DNA, 22 bp, Homo sapiens
catgctttgggtcagaaatgcc

SEQ ID NO: 8516997 - DNA, 22 bp, Homo sapiens
tccaagcatgtggtcaggagcc

SEQ ID NO: 8516998 - DNA, 22 bp, Homo sapiens
tccaagcactgttaattaaact

SEQ ID NO: 8516999 - DNA, 22 bp, Homo sapiens
tccagaggtatgtagagagtat

SEQ ID NO: 8517000 - DNA, 18 bp, Homo sapiens
tccagagagggagaagtg

SEQ ID NO: 8517001 - DNA, 22 bp, Homo sapiens
tccagaggtatgtagagagtat

SEQ ID NO: 8517002 - DNA, 18 bp, Homo sapiens
tccagagagggagaagtg

SEQ ID NO: 8517003 - DNA, 18 bp, Homo sapiens
tccagagagggagaagtg

SEQ ID NO: 8517004 - DNA, 17 bp, Homo sapiens
tccagagaggcttccct

SEQ ID NO: 8517005 - DNA, 22 bp, Homo sapiens
tccagaggtgaacacccaggca

SEQ ID NO: 8517006 - DNA, 22 bp, Homo sapiens
tccagaggtgaacacccaggca

SEQ ID NO: 8517007 - DNA, 18 bp, Homo sapiens
tccagaggtgttggagcc

SEQ ID NO: 8517008 - DNA, 18 bp, Homo sapiens
tccagaggtgttggagcc

SEQ ID NO: 8517009 - DNA, 22 bp, Homo sapiens
tccagagtacggaagagtcatc

SEQ ID NO: 8517010 - DNA, 18 bp, Homo sapiens
tccagaggtgttggagcc

SEQ ID NO: 8517011 - DNA, 22 bp, Homo sapiens
tccagagtgctgacgcagaccc

SEQ ID NO: 8517012 - DNA, 22 bp, Homo sapiens
tccagatagagtcctgttagta

SEQ ID NO: 8517013 - DNA, 20 bp, Homo sapiens
tccagatattaagacaggca

SEQ ID NO: 8517014 - DNA, 22 bp, Homo sapiens
tccagatagagtcctgttagta

SEQ ID NO: 8517015 - DNA, 22 bp, Homo sapiens
tccagagtttgagtctccttcc

SEQ ID NO: 8517016 - DNA, 22 bp, Homo sapiens
tccagagttgtaagtgttgaca

SEQ ID NO: 8517017 - DNA, 22 bp, Homo sapiens
tccaagagaatactggagagta

SEQ ID NO: 8517018 - DNA, 22 bp, Homo sapiens
tccaagagtatagtttattggc

SEQ ID NO: 8517019 - DNA, 22 bp, Homo sapiens
tccaagatctacagcagtttag

SEQ ID NO: 8517020 - DNA, 22 bp, Homo sapiens
tccaagatcaaggtgttggcag

SEQ ID NO: 8517021 - DNA, 22 bp, Homo sapiens
tccaagagttcaaggctacagt

SEQ ID NO: 8517022 - DNA, 22 bp, Homo sapiens
tccaagatctacagcagtttag

SEQ ID NO: 8517023 - DNA, 22 bp, Homo sapiens
tccaagatctacagcagtttag

SEQ ID NO: 8517024 - DNA, 22 bp, Homo sapiens
tccaagatctacagcagtttag

SEQ ID NO: 8517025 - DNA, 22 bp, Homo sapiens
tccaagaagtcatctaaactgt

SEQ ID NO: 8517026 - DNA, 22 bp, Homo sapiens
tccaagaagcttacaatctaat

SEQ ID NO: 8517027 - DNA, 22 bp, Homo sapiens
catgctgtgcatcttgatgacc

SEQ ID NO: 8517028 - DNA, 22 bp, Homo sapiens
catgctgtgtggttagaactgt

SEQ ID NO: 8517029 - DNA, 22 bp, Homo sapiens
catgctgtgtgttttagctcca

SEQ ID NO: 8517030 - DNA, 22 bp, Homo sapiens
catgctgattcttcctgagctt

SEQ ID NO: 8517031 - DNA, 22 bp, Homo sapiens
catgctctgcagcagacctgtg

SEQ ID NO: 8517032 - DNA, 22 bp, Homo sapiens
catgctgagcacattctgtatt

SEQ ID NO: 8517033 - DNA, 22 bp, Homo sapiens
catgctgagcacattctgtatt

SEQ ID NO: 8517034 - DNA, 22 bp, Homo sapiens
catgctctagattctctctaat

SEQ ID NO: 8517035 - DNA, 22 bp, Homo sapiens
catgctctctggcaacttgtgt

SEQ ID NO: 8517036 - DNA, 22 bp, Homo sapiens
catgctctctggcaacttgtgt

SEQ ID NO: 8517037 - DNA, 22 bp, Homo sapiens
catgctctagattctctctaat

SEQ ID NO: 8517038 - DNA, 22 bp, Homo sapiens
catgctctccattggacacaga

SEQ ID NO: 8517039 - DNA, 22 bp, Homo sapiens
catgctattttccaataatgta

SEQ ID NO: 8517040 - DNA, 22 bp, Homo sapiens
catgctcacaaaagatggcaaa

SEQ ID NO: 8517041 - DNA, 22 bp, Homo sapiens
catgctatataggaagagcact

SEQ ID NO: 8517042 - DNA, 22 bp, Homo sapiens
catgctaattaattccacctgc

SEQ ID NO: 8517043 - DNA, 22 bp, Homo sapiens
catgctaattcccaggccccaa

SEQ ID NO: 8517044 - DNA, 22 bp, Homo sapiens
tcatcagggatattggcctgaa

SEQ ID NO: 8517045 - DNA, 22 bp, Homo sapiens
catgcattttctattcactcag

SEQ ID NO: 8517046 - DNA, 22 bp, Homo sapiens
catgctaagtcataaaagagta

SEQ ID NO: 8517047 - DNA, 23 bp, Homo sapiens
catgtacacacagctgtacagtg

SEQ ID NO: 8517048 - DNA, 23 bp, Homo sapiens
catgtacacacagctgtacagtg

SEQ ID NO: 8517049 - DNA, 23 bp, Homo sapiens
catgtacacacagctgtacagtg

SEQ ID NO: 8517050 - DNA, 22 bp, Homo sapiens
catgtacaaggatgctcagagt

SEQ ID NO: 8517051 - DNA, 22 bp, Homo sapiens
catgtacaaggatgctcagagt

SEQ ID NO: 8517052 - DNA, 23 bp, Homo sapiens
catgtacagagtttgataaagtg

SEQ ID NO: 8517053 - DNA, 23 bp, Homo sapiens
catgtacagagtttgataaagtg

SEQ ID NO: 8517054 - DNA, 22 bp, Homo sapiens
catgtacactcatgtaactata

SEQ ID NO: 8517055 - DNA, 22 bp, Homo sapiens
catgtacactcatgtaactata

SEQ ID NO: 8517056 - DNA, 22 bp, Homo sapiens
catgtacactcatgtaactata

SEQ ID NO: 8517057 - DNA, 22 bp, Homo sapiens
tccaggctgtgcgcaccgtgtg

SEQ ID NO: 8517058 - DNA, 22 bp, Homo sapiens
tccaggctgtgcgcaccgtgtg

SEQ ID NO: 8517059 - DNA, 22 bp, Homo sapiens
tccaggcttcacgtctgccctc

SEQ ID NO: 8517060 - DNA, 22 bp, Homo sapiens
tccaggcttcacgtctgccctc

SEQ ID NO: 8517061 - DNA, 22 bp, Homo sapiens
tccaggcttgagaccaggctct

SEQ ID NO: 8517062 - DNA, 22 bp, Homo sapiens
tccaggcttcacgtctgccctc

SEQ ID NO: 8517063 - DNA, 20 bp, Homo sapiens
tccaggctcctccacttagt

SEQ ID NO: 8517064 - DNA, 22 bp, Homo sapiens
tccaggctcctgactttttggg

SEQ ID NO: 8517065 - DNA, 22 bp, Homo sapiens
tccaggctgtgcatgagtttag

SEQ ID NO: 8517066 - DNA, 22 bp, Homo sapiens
tccaggctgggctgaagggtgc

SEQ ID NO: 8517067 - DNA, 22 bp, Homo sapiens
catgtacagtttttctgtcctg

SEQ ID NO: 8517068 - DNA, 22 bp, Homo sapiens
catgtgggaagaggccagctgg

SEQ ID NO: 8517069 - DNA, 22 bp, Homo sapiens
catgtgtaaggctcacaggcag

SEQ ID NO: 8517070 - DNA, 22 bp, Homo sapiens
catgtggtattgtgagatccac

SEQ ID NO: 8517071 - DNA, 23 bp, Homo sapiens
catgtgtaatttctggttgggtg

SEQ ID NO: 8517072 - DNA, 22 bp, Homo sapiens
catgttttgtgtacagaatatt

SEQ ID NO: 8517073 - DNA, 22 bp, Homo sapiens
cattaataaacatttcagaaga

SEQ ID NO: 8517074 - DNA, 22 bp, Homo sapiens
cattaagtatttcagttactgt

SEQ ID NO: 8517075 - DNA, 22 bp, Homo sapiens
catgttttctaggctttcacaa

SEQ ID NO: 8517076 - DNA, 22 bp, Homo sapiens
catgtgtattattcttgtggaa

SEQ ID NO: 8517077 - DNA, 22 bp, Homo sapiens
catgtgtcaaatgatgtagctg

SEQ ID NO: 8517078 - DNA, 17 bp, Homo sapiens
catgtgtatgtgggagt

SEQ ID NO: 8517079 - DNA, 17 bp, Homo sapiens
catgtgtatgtgggagt

SEQ ID NO: 8517080 - DNA, 22 bp, Homo sapiens
tccaggctttttcatgctgtct

SEQ ID NO: 8517081 - DNA, 22 bp, Homo sapiens
catgtgctgtagcagagaggaa

SEQ ID NO: 8517082 - DNA, 22 bp, Homo sapiens
catgtgctgtagcagagaggaa

SEQ ID NO: 8517083 - DNA, 22 bp, Homo sapiens
catgtggctttggcatgtgccc

SEQ ID NO: 8517084 - DNA, 22 bp, Homo sapiens
catgtggatatgaattgtagaa

SEQ ID NO: 8517085 - DNA, 22 bp, Homo sapiens
catgtggcacaaagaaggaaat

SEQ ID NO: 8517086 - DNA, 22 bp, Homo sapiens
tccaggctttggggcaggagcg

SEQ ID NO: 8517087 - DNA, 22 bp, Homo sapiens
tccaggcttgagaccaggctct

SEQ ID NO: 8517088 - DNA, 22 bp, Homo sapiens
tccaggcttgagaccaggctct

SEQ ID NO: 8517089 - DNA, 22 bp, Homo sapiens
tccagggcatgctcagactcag

SEQ ID NO: 8517090 - DNA, 22 bp, Homo sapiens
tccagggcatgctcagactcag

SEQ ID NO: 8517091 - DNA, 22 bp, Homo sapiens
tccagggcatggggagagagtg

SEQ ID NO: 8517092 - DNA, 22 bp, Homo sapiens
tccagggcatccacgcgtgggg

SEQ ID NO: 8517093 - DNA, 22 bp, Homo sapiens
tccagggcatgctcagactcag

SEQ ID NO: 8517094 - DNA, 22 bp, Homo sapiens
tccaggggagtgctacgcacag

SEQ ID NO: 8517095 - DNA, 22 bp, Homo sapiens
tccaggggagactagacccaca

SEQ ID NO: 8517096 - DNA, 22 bp, Homo sapiens
tccaggggagactagacccaca

SEQ ID NO: 8517097 - DNA, 21 bp, Homo sapiens
tccaggggccagcacccaagc

SEQ ID NO: 8517098 - DNA, 19 bp, Homo sapiens
tccaggggctccacctcct

SEQ ID NO: 8517099 - DNA, 21 bp, Homo sapiens
tccaggggccagcacccaagc

SEQ ID NO: 8517100 - DNA, 22 bp, Homo sapiens
tccaggggacactgtttctcca

SEQ ID NO: 8517101 - DNA, 22 bp, Homo sapiens
tccaggggacactgtttctcca

SEQ ID NO: 8517102 - DNA, 22 bp, Homo sapiens
tccagggcatggggagagagtg

SEQ ID NO: 8517103 - DNA, 22 bp, Homo sapiens
tccagggcatggggagagagtg

SEQ ID NO: 8517104 - DNA, 22 bp, Homo sapiens
tccagggcatggggagagagtg

SEQ ID NO: 8517105 - DNA, 22 bp, Homo sapiens
tccagggttgtgggcttcagca

SEQ ID NO: 8517106 - DNA, 22 bp, Homo sapiens
tccagggtgtgtttactggggt

SEQ ID NO: 8517107 - DNA, 22 bp, Homo sapiens
tccagggtgtgtttactggggt

SEQ ID NO: 8517108 - DNA, 22 bp, Homo sapiens
tccagggtcagaagtcacatac

SEQ ID NO: 8517109 - DNA, 22 bp, Homo sapiens
tccaggggtgatttttgacttg

SEQ ID NO: 8517110 - DNA, 22 bp, Homo sapiens
tccaggggtgatttttgacttg

SEQ ID NO: 8517111 - DNA, 19 bp, Homo sapiens
tccaggggctccacctcct

SEQ ID NO: 8517112 - DNA, 22 bp, Homo sapiens
tccaggggctgtcttggaatct

SEQ ID NO: 8517113 - DNA, 22 bp, Homo sapiens
tccaggggtaccggccaggcag

SEQ ID NO: 8517114 - DNA, 22 bp, Homo sapiens
tccaggggtaccggccaggcag

SEQ ID NO: 8517115 - DNA, 22 bp, Homo sapiens
tccaggtcccagactgggcagc

SEQ ID NO: 8517116 - DNA, 22 bp, Homo sapiens
tccaggtcatcttggagagctg

SEQ ID NO: 8517117 - DNA, 20 bp, Homo sapiens
tccaggtaacatctctctgg

SEQ ID NO: 8517118 - DNA, 22 bp, Homo sapiens
tccaggtagggaataaatgtca

SEQ ID NO: 8517119 - DNA, 22 bp, Homo sapiens
tccaggtaggccaagacagcta

SEQ ID NO: 8517120 - DNA, 22 bp, Homo sapiens
tccaggtactcattggctgtta

SEQ ID NO: 8517121 - DNA, 22 bp, Homo sapiens
tccaggtaatttggatgctagt

SEQ ID NO: 8517122 - DNA, 22 bp, Homo sapiens
tccaggtagatttattccagcc

SEQ ID NO: 8517123 - DNA, 22 bp, Homo sapiens
tccaggtatgacatggctgttt

SEQ ID NO: 8517124 - DNA, 22 bp, Homo sapiens
tccaggtatctggcttccacat

SEQ ID NO: 8517125 - DNA, 22 bp, Homo sapiens
tccaggtatctttatgaaactt

SEQ ID NO: 8517126 - DNA, 22 bp, Homo sapiens
tccaggtatgacaggccactcc

SEQ ID NO: 8517127 - DNA, 22 bp, Homo sapiens
tccagggcaggtgctgggctct

SEQ ID NO: 8517128 - DNA, 22 bp, Homo sapiens
tccagggcagtgactacagcgg

SEQ ID NO: 8517129 - DNA, 22 bp, Homo sapiens
tccagggcagtgactacagcgg

SEQ ID NO: 8517130 - DNA, 22 bp, Homo sapiens
cattacaaccccaaattacaaa

SEQ ID NO: 8517131 - DNA, 22 bp, Homo sapiens
cattacaaccccaaattacaaa

SEQ ID NO: 8517132 - DNA, 22 bp, Homo sapiens
cattacaaccccaaattacaaa

SEQ ID NO: 8517133 - DNA, 22 bp, Homo sapiens
cattacaaccccaaattacaaa

SEQ ID NO: 8517134 - DNA, 22 bp, Homo sapiens
cattaatattgttcttctttag

SEQ ID NO: 8517135 - DNA, 22 bp, Homo sapiens
cattacaacaatctgccatggc

SEQ ID NO: 8517136 - DNA, 22 bp, Homo sapiens
cattacaaagttataaacagtt

SEQ ID NO: 8517137 - DNA, 22 bp, Homo sapiens
cattacaaagttataaacagtt

SEQ ID NO: 8517138 - DNA, 22 bp, Homo sapiens
cattacaaagttataaacagtt

SEQ ID NO: 8517139 - DNA, 22 bp, Homo sapiens
cagtgtcctcagccagcagcta

SEQ ID NO: 8517140 - DNA, 22 bp, Homo sapiens
cagtgtcctcagccagcagcta

SEQ ID NO: 8517141 - DNA, 22 bp, Homo sapiens
cagtgtctacagtggctggagg

SEQ ID NO: 8517142 - DNA, 22 bp, Homo sapiens
cagtgtcaccaggcgagtctcc

SEQ ID NO: 8517143 - DNA, 22 bp, Homo sapiens
cagtgtcaggatcagtatattt

SEQ ID NO: 8517144 - DNA, 22 bp, Homo sapiens
cagtgtcaggatcagtatattt

SEQ ID NO: 8517145 - DNA, 22 bp, Homo sapiens
cagtgtctcaaaacaagttgct

SEQ ID NO: 8517146 - DNA, 22 bp, Homo sapiens
tcactgttgacctggaagtggg

SEQ ID NO: 8517147 - DNA, 22 bp, Homo sapiens
tcactgtttcatccctagcact

SEQ ID NO: 8517148 - DNA, 22 bp, Homo sapiens
tcactgtttcatccctagcact

SEQ ID NO: 8517149 - DNA, 22 bp, Homo sapiens
cagtggtttccaaacttgttcc

SEQ ID NO: 8517150 - DNA, 22 bp, Homo sapiens
cagtggtttctgaacagtgtgc

SEQ ID NO: 8517151 - DNA, 22 bp, Homo sapiens
cagtggttttatatctaagctt

SEQ ID NO: 8517152 - DNA, 22 bp, Homo sapiens
cagtggttttgagattcagggt

SEQ ID NO: 8517153 - DNA, 22 bp, Homo sapiens
cagtgtataaactttaacatag

SEQ ID NO: 8517154 - DNA, 22 bp, Homo sapiens
cagtgtatcattagtgtgatga

SEQ ID NO: 8517155 - DNA, 22 bp, Homo sapiens
cagtgtacttggaatgtaacag

SEQ ID NO: 8517156 - DNA, 21 bp, Homo sapiens
tcacttataatgtatttgctg

SEQ ID NO: 8517157 - DNA, 22 bp, Homo sapiens
tcacttataaaatgcaagatct

SEQ ID NO: 8517158 - DNA, 22 bp, Homo sapiens
tcacttaaaaattctagttatg

SEQ ID NO: 8517159 - DNA, 22 bp, Homo sapiens
tcacttaaaaattctagttatg

SEQ ID NO: 8517160 - DNA, 22 bp, Homo sapiens
tcactgttttgcctgcacttcc

SEQ ID NO: 8517161 - DNA, 22 bp, Homo sapiens
tcactgtttcctgtactggaca

SEQ ID NO: 8517162 - DNA, 22 bp, Homo sapiens
tcacttattgctcatctcatgc

SEQ ID NO: 8517163 - DNA, 22 bp, Homo sapiens
tcaggaagttttgaatcaactg

SEQ ID NO: 8517164 - DNA, 22 bp, Homo sapiens
tcacttcacacccactatcatg

SEQ ID NO: 8517165 - DNA, 22 bp, Homo sapiens
tcaggcagaattatcaaaagat

SEQ ID NO: 8517166 - DNA, 22 bp, Homo sapiens
tcaggcagaaaaatcactaatt

SEQ ID NO: 8517167 - DNA, 22 bp, Homo sapiens
tcaggcagaaaaatcactaatt

SEQ ID NO: 8517168 - DNA, 21 bp, Homo sapiens
tcaggaggctcagactcctgc

SEQ ID NO: 8517169 - DNA, 22 bp, Homo sapiens
tcaggagggagtgtggatagag

SEQ ID NO: 8517170 - DNA, 22 bp, Homo sapiens
tcaggcagaaaaatcactaatt

SEQ ID NO: 8517171 - DNA, 22 bp, Homo sapiens
tcaggaggcggtgctgcctttg

SEQ ID NO: 8517172 - DNA, 22 bp, Homo sapiens
tcaggaggcgtctcgctggggc

SEQ ID NO: 8517173 - DNA, 22 bp, Homo sapiens
tcaggaggcctgagtagctcta

SEQ ID NO: 8517174 - DNA, 22 bp, Homo sapiens
tcaggaggcggaggttgcagtg

SEQ ID NO: 8517175 - DNA, 22 bp, Homo sapiens
tcaggaggcctgagtagctcta

SEQ ID NO: 8517176 - DNA, 22 bp, Homo sapiens
tcaggaggccgtgtgctcagtg

SEQ ID NO: 8517177 - DNA, 22 bp, Homo sapiens
tcaggaggccgtgtgctcagtg

SEQ ID NO: 8517178 - DNA, 22 bp, Homo sapiens
tcaggaggccgtgtgctcagtg

SEQ ID NO: 8517179 - DNA, 22 bp, Homo sapiens
tcaggaatgaggataaacattg

SEQ ID NO: 8517180 - DNA, 22 bp, Homo sapiens
tcaggaatgaggataaacattg

SEQ ID NO: 8517181 - DNA, 22 bp, Homo sapiens
tcaggaggccaccaggacctgt

SEQ ID NO: 8517182 - DNA, 22 bp, Homo sapiens
tcaggctgcatctgtaagggtg

SEQ ID NO: 8517183 - DNA, 22 bp, Homo sapiens
tcaggctgcagtggcaaaagac

SEQ ID NO: 8517184 - DNA, 22 bp, Homo sapiens
tcaggctgcatctgtaagggtg

SEQ ID NO: 8517185 - DNA, 22 bp, Homo sapiens
tcaggctgcccgttcagggctc

SEQ ID NO: 8517186 - DNA, 22 bp, Homo sapiens
tcaggctgcccgttcagggctc

SEQ ID NO: 8517187 - DNA, 18 bp, Homo sapiens
tcaggctgccctgtgtct

SEQ ID NO: 8517188 - DNA, 22 bp, Homo sapiens
tcaggctgcctatcagactgtg

SEQ ID NO: 8517189 - DNA, 22 bp, Homo sapiens
tcaggctgcctatcagactgtg

SEQ ID NO: 8517190 - DNA, 18 bp, Homo sapiens
tcaggctgccctgtgtct

SEQ ID NO: 8517191 - DNA, 21 bp, Homo sapiens
catcacattactcaaagtcct

SEQ ID NO: 8517192 - DNA, 21 bp, Homo sapiens
catcacattactcaaagtcct

SEQ ID NO: 8517193 - DNA, 22 bp, Homo sapiens
tcaggctgatttcttttgaggg

SEQ ID NO: 8517194 - DNA, 22 bp, Homo sapiens
catcacaaaatgattattccct

SEQ ID NO: 8517195 - DNA, 22 bp, Homo sapiens
catcacaaaatgattattccct

SEQ ID NO: 8517196 - DNA, 21 bp, Homo sapiens
tcaggctgatgtcgatgttag

SEQ ID NO: 8517197 - DNA, 22 bp, Homo sapiens
tcaggctgcagctgtcagcagc

SEQ ID NO: 8517198 - DNA, 22 bp, Homo sapiens
tcaggctgcagctgtcagcagc

SEQ ID NO: 8517199 - DNA, 20 bp, Homo sapiens
catcaacaccttgtcagcct

SEQ ID NO: 8517200 - DNA, 22 bp, Homo sapiens
catcaatgtgcagagatgaacg

SEQ ID NO: 8517201 - DNA, 22 bp, Homo sapiens
catcaatagggtttgaaagcaa

SEQ ID NO: 8517202 - DNA, 22 bp, Homo sapiens
tcaggcagagctgtggagctct

SEQ ID NO: 8517203 - DNA, 22 bp, Homo sapiens
tcaggcagagctgtggagctct

SEQ ID NO: 8517204 - DNA, 22 bp, Homo sapiens
tcaggcagagctgtggagctct

SEQ ID NO: 8517205 - DNA, 22 bp, Homo sapiens
tcaggcagaccaccgtgggcag

SEQ ID NO: 8517206 - DNA, 22 bp, Homo sapiens
tcaggcagaccaccgtgggcag

SEQ ID NO: 8517207 - DNA, 22 bp, Homo sapiens
tcaggcagaccaccgtgggcag

SEQ ID NO: 8517208 - DNA, 22 bp, Homo sapiens
tcaggcagaattatcaaaagat

SEQ ID NO: 8517209 - DNA, 22 bp, Homo sapiens
tcaggcagagggagaagccaag

SEQ ID NO: 8517210 - DNA, 22 bp, Homo sapiens
tcaggcagagggagaagccaag

SEQ ID NO: 8517211 - DNA, 22 bp, Homo sapiens
tcaggcagaggatggggagcgt

SEQ ID NO: 8517212 - DNA, 22 bp, Homo sapiens
tcaggcagaggatggggagcgt

SEQ ID NO: 8517213 - DNA, 22 bp, Homo sapiens
tcaggcagaggatggggagcgt

SEQ ID NO: 8517214 - DNA, 21 bp, Homo sapiens
catattaaatcggtgccttta

SEQ ID NO: 8517215 - DNA, 22 bp, Homo sapiens
catcaaaattagacattgttga

SEQ ID NO: 8517216 - DNA, 22 bp, Homo sapiens
catcaaaattagacattgttga

SEQ ID NO: 8517217 - DNA, 22 bp, Homo sapiens
catcaaagttgatatccaatta

SEQ ID NO: 8517218 - DNA, 22 bp, Homo sapiens
catcaaaattagacattgttga

SEQ ID NO: 8517219 - DNA, 22 bp, Homo sapiens
catcaaagttggtatatttgca

SEQ ID NO: 8517220 - DNA, 22 bp, Homo sapiens
catcaaataaagaaattccttg

SEQ ID NO: 8517221 - DNA, 22 bp, Homo sapiens
catcaaatggcaagtgaaagct

SEQ ID NO: 8517222 - DNA, 22 bp, Homo sapiens
tcagtgtgtaattctttgtttc

SEQ ID NO: 8517223 - DNA, 22 bp, Homo sapiens
tcagtgtgtacactgagcattt

SEQ ID NO: 8517224 - DNA, 22 bp, Homo sapiens
tcagtgtgtacactgagcattt

SEQ ID NO: 8517225 - DNA, 22 bp, Homo sapiens
tcagtgtgtaattctttgtttc

SEQ ID NO: 8517226 - DNA, 22 bp, Homo sapiens
tcagtgtgggtaagcatgctgt

SEQ ID NO: 8517227 - DNA, 22 bp, Homo sapiens
tcagtgtggaaaatcctttggc

SEQ ID NO: 8517228 - DNA, 22 bp, Homo sapiens
tcagtgtgcactctgtgaccca

SEQ ID NO: 8517229 - DNA, 22 bp, Homo sapiens
tcagtgtgaattcattttagat

SEQ ID NO: 8517230 - DNA, 22 bp, Homo sapiens
tcagtgtgactgatggctttat

SEQ ID NO: 8517231 - DNA, 22 bp, Homo sapiens
tcagtgtcttgggcttgaatgc

SEQ ID NO: 8517232 - DNA, 22 bp, Homo sapiens
tcagtgtgattaggctatctga

SEQ ID NO: 8517233 - DNA, 22 bp, Homo sapiens
tcagtgtgaggtcttccacccg

SEQ ID NO: 8517234 - DNA, 19 bp, Homo sapiens
tcagtgtgacttggtcagt

SEQ ID NO: 8517235 - DNA, 22 bp, Homo sapiens
tcagtgtgaggggctgggtcct

SEQ ID NO: 8517236 - DNA, 22 bp, Homo sapiens
tcagtgtcttctctttcctacc

SEQ ID NO: 8517237 - DNA, 22 bp, Homo sapiens
tcagtgtcttgacctgggtgtg

SEQ ID NO: 8517238 - DNA, 22 bp, Homo sapiens
tcagtgtcttctctttcctacc

SEQ ID NO: 8517239 - DNA, 22 bp, Homo sapiens
tcagtgctgctttatgacagtt

SEQ ID NO: 8517240 - DNA, 22 bp, Homo sapiens
catcatcaactggcaggtaagt

SEQ ID NO: 8517241 - DNA, 22 bp, Homo sapiens
catcataaaattgagataactg

SEQ ID NO: 8517242 - DNA, 22 bp, Homo sapiens
catcataataacccagacacag

SEQ ID NO: 8517243 - DNA, 22 bp, Homo sapiens
catcataataacccagacacag

SEQ ID NO: 8517244 - DNA, 22 bp, Homo sapiens
catcatcaaaacaaatggagtc

SEQ ID NO: 8517245 - DNA, 22 bp, Homo sapiens
catcatcaaaagtgacagagaa

SEQ ID NO: 8517246 - DNA, 22 bp, Homo sapiens
catcatatatttctacaagtgc

SEQ ID NO: 8517247 - DNA, 22 bp, Homo sapiens
catcagagtggtggcctggtgt

SEQ ID NO: 8517248 - DNA, 22 bp, Homo sapiens
catcagcaggcaacactcttgg

SEQ ID NO: 8517249 - DNA, 22 bp, Homo sapiens
catcagcctggaaggcagcctg

SEQ ID NO: 8517250 - DNA, 22 bp, Homo sapiens
catcagcctggaaggcagcctg

SEQ ID NO: 8517251 - DNA, 23 bp, Homo sapiens
catcagcctcagtctgtggaccc

SEQ ID NO: 8517252 - DNA, 22 bp, Homo sapiens
catcagctaaacttagtgaaat

SEQ ID NO: 8517253 - DNA, 22 bp, Homo sapiens
catcagctcttcattcttgatt

SEQ ID NO: 8517254 - DNA, 22 bp, Homo sapiens
catcagctgagggtgagcagaa

SEQ ID NO: 8517255 - DNA, 22 bp, Homo sapiens
catcagtaaggcaacatagctt

SEQ ID NO: 8517256 - DNA, 22 bp, Homo sapiens
catcaggaggagatgaagaaaa

SEQ ID NO: 8517257 - DNA, 22 bp, Homo sapiens
catcagcttttctatgtggtga

SEQ ID NO: 8517258 - DNA, 22 bp, Homo sapiens
catcagcttttctatgtggtga

SEQ ID NO: 8517259 - DNA, 22 bp, Homo sapiens
catcagctttggcgctgagcat

SEQ ID NO: 8517260 - DNA, 22 bp, Homo sapiens
catcagtgtggcagttcactgt

SEQ ID NO: 8517261 - DNA, 22 bp, Homo sapiens
catcagtgttcactattccttc

SEQ ID NO: 8517262 - DNA, 22 bp, Homo sapiens
catcagtctgaaagccagggag

SEQ ID NO: 8517263 - DNA, 22 bp, Homo sapiens
catcagtcagtctcttcagtat

SEQ ID NO: 8517264 - DNA, 22 bp, Homo sapiens
catccctgtctgccactctgaa

SEQ ID NO: 8517265 - DNA, 22 bp, Homo sapiens
tcagtgtgtagtaaattgtagg

SEQ ID NO: 8517266 - DNA, 22 bp, Homo sapiens
tcagtgtgtctctgcatttggg

SEQ ID NO: 8517267 - DNA, 19 bp, Homo sapiens
tcagtgtgtgggaggtggt

SEQ ID NO: 8517268 - DNA, 22 bp, Homo sapiens
tcagtgtgtctctgcatttggg

SEQ ID NO: 8517269 - DNA, 17 bp, Homo sapiens
catccgtgagctcggca

SEQ ID NO: 8517270 - DNA, 17 bp, Homo sapiens
catccgtgagctcggca

SEQ ID NO: 8517271 - DNA, 22 bp, Homo sapiens
catccgttaataaaaagacagt

SEQ ID NO: 8517272 - DNA, 22 bp, Homo sapiens
catccgttgtgctgttgctctc

SEQ ID NO: 8517273 - DNA, 21 bp, Homo sapiens
catccgtttatatctctgtgg

SEQ ID NO: 8517274 - DNA, 22 bp, Homo sapiens
catcctgacaagaaagccagaa

SEQ ID NO: 8517275 - DNA, 22 bp, Homo sapiens
catcctgaagaagccgcactgt

SEQ ID NO: 8517276 - DNA, 22 bp, Homo sapiens
catcctgacaagaaagccagaa

SEQ ID NO: 8517277 - DNA, 22 bp, Homo sapiens
catcctgagaggtctctctacc

SEQ ID NO: 8517278 - DNA, 22 bp, Homo sapiens
catcctgactgtaactaagaga

SEQ ID NO: 8517279 - DNA, 22 bp, Homo sapiens
catcctgactgtaactaagaga

SEQ ID NO: 8517280 - DNA, 22 bp, Homo sapiens
catcctgagaaaataaaggaga

SEQ ID NO: 8517281 - DNA, 22 bp, Homo sapiens
catcctgacccatgggagggga

SEQ ID NO: 8517282 - DNA, 22 bp, Homo sapiens
catcctgactgggtaaagctta

SEQ ID NO: 8517283 - DNA, 22 bp, Homo sapiens
catccttctcaaagagtgcatg

SEQ ID NO: 8517284 - DNA, 22 bp, Homo sapiens
catctaaatttgactccaagga

SEQ ID NO: 8517285 - DNA, 22 bp, Homo sapiens
catccttcaaaggctacaatta

SEQ ID NO: 8517286 - DNA, 18 bp, Homo sapiens
catccttatagctgagaa

SEQ ID NO: 8517287 - DNA, 23 bp, Homo sapiens
catctagcatccagtgagtagtg

SEQ ID NO: 8517288 - DNA, 22 bp, Homo sapiens
catctacctccaccctatatat

SEQ ID NO: 8517289 - DNA, 22 bp, Homo sapiens
catctaatacctcatttaatct

SEQ ID NO: 8517290 - DNA, 22 bp, Homo sapiens
tcagtttcctcatctacaaaag

SEQ ID NO: 8517291 - DNA, 22 bp, Homo sapiens
tcataacagctaagtccctttc

SEQ ID NO: 8517292 - DNA, 22 bp, Homo sapiens
tcataacaggctgagaggattt

SEQ ID NO: 8517293 - DNA, 22 bp, Homo sapiens
tcataacaacctggaaggccag

SEQ ID NO: 8517294 - DNA, 19 bp, Homo sapiens
tcataaggagagaggaaat

SEQ ID NO: 8517295 - DNA, 22 bp, Homo sapiens
tcatcacatatgtcatgatttg

SEQ ID NO: 8517296 - DNA, 22 bp, Homo sapiens
tcatcacatatgtcatgatttg

SEQ ID NO: 8517297 - DNA, 22 bp, Homo sapiens
tcatcaaagtcaaagaatgact

SEQ ID NO: 8517298 - DNA, 22 bp, Homo sapiens
tcatcacaattttatgaccctc

SEQ ID NO: 8517299 - DNA, 22 bp, Homo sapiens
tcatacataacttgtacagtga

SEQ ID NO: 8517300 - DNA, 22 bp, Homo sapiens
tcatcaaagtcaaagaatgact

SEQ ID NO: 8517301 - DNA, 22 bp, Homo sapiens
tcatcagctcatctgctcctag

SEQ ID NO: 8517302 - DNA, 22 bp, Homo sapiens
tcatcagaggcatctggcaagg

SEQ ID NO: 8517303 - DNA, 20 bp, Homo sapiens
tcatcagataggttagtaca

SEQ ID NO: 8517304 - DNA, 22 bp, Homo sapiens
tcatcactgtatcattgataga

SEQ ID NO: 8517305 - DNA, 22 bp, Homo sapiens
tcatcacatgtgtagtcatccc

SEQ ID NO: 8517306 - DNA, 22 bp, Homo sapiens
tcatcacatgtgtagtcatccc

SEQ ID NO: 8517307 - DNA, 22 bp, Homo sapiens
tcatcacatgtgtagtcatccc

SEQ ID NO: 8517308 - DNA, 22 bp, Homo sapiens
tcatcacatgtgtagtcatccc

SEQ ID NO: 8517309 - DNA, 22 bp, Homo sapiens
tcataattgtatacatttatgg

SEQ ID NO: 8517310 - DNA, 22 bp, Homo sapiens
tcataattgtatacatttatgg

SEQ ID NO: 8517311 - DNA, 22 bp, Homo sapiens
tcataatgtagttcatggctgg

SEQ ID NO: 8517312 - DNA, 22 bp, Homo sapiens
tcataagtggtttatatgcttg

SEQ ID NO: 8517313 - DNA, 22 bp, Homo sapiens
tcataatacaaagagttctgca

SEQ ID NO: 8517314 - DNA, 22 bp, Homo sapiens
tcataatgaccccagagtccgc

SEQ ID NO: 8517315 - DNA, 22 bp, Homo sapiens
tcataatgtagttcatggctgg

SEQ ID NO: 8517316 - DNA, 22 bp, Homo sapiens
tcatacaggctcaagctatacg

SEQ ID NO: 8517317 - DNA, 20 bp, Homo sapiens
tcatacacatgagcatgcag

SEQ ID NO: 8517318 - DNA, 20 bp, Homo sapiens
tcatacacatgagcatgcag

SEQ ID NO: 8517319 - DNA, 20 bp, Homo sapiens
tcatacacatgagcatgcag

SEQ ID NO: 8517320 - DNA, 22 bp, Homo sapiens
tcatacaagatcactttggcca

SEQ ID NO: 8517321 - DNA, 22 bp, Homo sapiens
tcatacaactaagagtttcaga

SEQ ID NO: 8517322 - DNA, 22 bp, Homo sapiens
tcatacaattcaatctctgatt

SEQ ID NO: 8517323 - DNA, 22 bp, Homo sapiens
catttctacagcttcttcagaa

SEQ ID NO: 8517324 - DNA, 22 bp, Homo sapiens
catttctaagaaggctgcacat

SEQ ID NO: 8517325 - DNA, 21 bp, Homo sapiens
catttctaagcctggctatag

SEQ ID NO: 8517326 - DNA, 22 bp, Homo sapiens
catttctagggatcataaagta

SEQ ID NO: 8517327 - DNA, 22 bp, Homo sapiens
catttctagggatcataaagta

SEQ ID NO: 8517328 - DNA, 22 bp, Homo sapiens
catttctagacaagtcctggag

SEQ ID NO: 8517329 - DNA, 22 bp, Homo sapiens
catttctaccaaatgtgactgg

SEQ ID NO: 8517330 - DNA, 22 bp, Homo sapiens
catttctaagaaggctgcacat

SEQ ID NO: 8517331 - DNA, 22 bp, Homo sapiens
catttctaagaagatctgggta

SEQ ID NO: 8517332 - DNA, 22 bp, Homo sapiens
catttccccctcatgttgcagc

SEQ ID NO: 8517333 - DNA, 22 bp, Homo sapiens
catttcctgtctggaggtcaaa

SEQ ID NO: 8517334 - DNA, 22 bp, Homo sapiens
catttccttcctgctgctcctc

SEQ ID NO: 8517335 - DNA, 22 bp, Homo sapiens
catttcctgtctggaggtcaaa

SEQ ID NO: 8517336 - DNA, 22 bp, Homo sapiens
catttccagctcctgcatcatg

SEQ ID NO: 8517337 - DNA, 22 bp, Homo sapiens
catttccacttctgaaaactgg

SEQ ID NO: 8517338 - DNA, 21 bp, Homo sapiens
catttcatgattatagaaatg

SEQ ID NO: 8517339 - DNA, 21 bp, Homo sapiens
catttcatgattatagaaatg

SEQ ID NO: 8517340 - DNA, 21 bp, Homo sapiens
catttcatgattatagaaatg

SEQ ID NO: 8517341 - DNA, 22 bp, Homo sapiens
catttccactctgggagtcaga

SEQ ID NO: 8517342 - DNA, 22 bp, Homo sapiens
catttcagtgttattctaattt

SEQ ID NO: 8517343 - DNA, 22 bp, Homo sapiens
catttcatagttgtcacaataa

SEQ ID NO: 8517344 - DNA, 22 bp, Homo sapiens
catttcatagttgtcacaataa

SEQ ID NO: 8517345 - DNA, 21 bp, Homo sapiens
tccataagagaccatctccta

SEQ ID NO: 8517346 - DNA, 22 bp, Homo sapiens
tccataaaccagaaaatcaaga

SEQ ID NO: 8517347 - DNA, 20 bp, Homo sapiens
tccagttttggagacattct

SEQ ID NO: 8517348 - DNA, 18 bp, Homo sapiens
tccaggtcccaggggaag

SEQ ID NO: 8517349 - DNA, 22 bp, Homo sapiens
tccaggtattactaagtgttaa

SEQ ID NO: 8517350 - DNA, 19 bp, Homo sapiens
tccagtttggcaggaagac

SEQ ID NO: 8517351 - DNA, 22 bp, Homo sapiens
tccatacatacagatatgcatt

SEQ ID NO: 8517352 - DNA, 22 bp, Homo sapiens
tccatactcagaaagtattgca

SEQ ID NO: 8517353 - DNA, 22 bp, Homo sapiens
tccatacccagctttctcacac

SEQ ID NO: 8517354 - DNA, 23 bp, Homo sapiens
tccatactctaaacatgttattt

SEQ ID NO: 8517355 - DNA, 22 bp, Homo sapiens
tccataggatctgcttcatact

SEQ ID NO: 8517356 - DNA, 22 bp, Homo sapiens
tccatagtagaaaatgggacag

SEQ ID NO: 8517357 - DNA, 22 bp, Homo sapiens
tccatagtgaatgggtaatgca

SEQ ID NO: 8517358 - DNA, 22 bp, Homo sapiens
catttcaccttagagaattatt

SEQ ID NO: 8517359 - DNA, 22 bp, Homo sapiens
catttcacagtaaagtgatttc

SEQ ID NO: 8517360 - DNA, 22 bp, Homo sapiens
catttattggcatgtagtaggt

SEQ ID NO: 8517361 - DNA, 22 bp, Homo sapiens
catttctatggcaatgggaaaa

SEQ ID NO: 8517362 - DNA, 22 bp, Homo sapiens
catttctatggcaatgggaaaa

SEQ ID NO: 8517363 - DNA, 21 bp, Homo sapiens
catttctattgatgagaaaag

SEQ ID NO: 8517364 - DNA, 21 bp, Homo sapiens
catttctattgatgagaaaag

SEQ ID NO: 8517365 - DNA, 21 bp, Homo sapiens
catttctattgatgagaaaag

SEQ ID NO: 8517366 - DNA, 21 bp, Homo sapiens
catttctattgatgagaaaag

SEQ ID NO: 8517367 - DNA, 21 bp, Homo sapiens
catttctattgatgagaaaag

SEQ ID NO: 8517368 - DNA, 21 bp, Homo sapiens
catttctattgatgagaaaag

SEQ ID NO: 8517369 - DNA, 22 bp, Homo sapiens
catttgtgtgggaacccatcag

SEQ ID NO: 8517370 - DNA, 22 bp, Homo sapiens
catttgtgtccgtcccagttct

SEQ ID NO: 8517371 - DNA, 22 bp, Homo sapiens
catttgtgcttttataaaatag

SEQ ID NO: 8517372 - DNA, 22 bp, Homo sapiens
catttgtgcttttataaaatag

SEQ ID NO: 8517373 - DNA, 22 bp, Homo sapiens
catttgtgcttttataaaatag

SEQ ID NO: 8517374 - DNA, 22 bp, Homo sapiens
cattttaaatgatttaagccaa

SEQ ID NO: 8517375 - DNA, 22 bp, Homo sapiens
cattttaaatgatttaagccaa

SEQ ID NO: 8517376 - DNA, 22 bp, Homo sapiens
cattttaaatgatttaagccaa

SEQ ID NO: 8517377 - DNA, 22 bp, Homo sapiens
cattttaagatgacctggtttc

SEQ ID NO: 8517378 - DNA, 22 bp, Homo sapiens
cattttaagatgacctggtttc

SEQ ID NO: 8517379 - DNA, 22 bp, Homo sapiens
cattttaagatgacctggtttc

SEQ ID NO: 8517380 - DNA, 19 bp, Homo sapiens
cattttaagcatccccagt

SEQ ID NO: 8517381 - DNA, 19 bp, Homo sapiens
cattttaagcatccccagt

SEQ ID NO: 8517382 - DNA, 22 bp, Homo sapiens
cattttactgactcttgaatta

SEQ ID NO: 8517383 - DNA, 22 bp, Homo sapiens
cattttatcctctgggaagcta

SEQ ID NO: 8517384 - DNA, 22 bp, Homo sapiens
cattttatcctctgggaagcta

SEQ ID NO: 8517385 - DNA, 19 bp, Homo sapiens
cattttaagcatccccagt

SEQ ID NO: 8517386 - DNA, 22 bp, Homo sapiens
cattttacctagaagctgaaag

SEQ ID NO: 8517387 - DNA, 22 bp, Homo sapiens
cattttactgactcttgaatta

SEQ ID NO: 8517388 - DNA, 22 bp, Homo sapiens
cattttcatgagtttctgttca

SEQ ID NO: 8517389 - DNA, 22 bp, Homo sapiens
cattttcagcacccatctgaaa

SEQ ID NO: 8517390 - DNA, 22 bp, Homo sapiens
cattttcagcacccatctgaaa

SEQ ID NO: 8517391 - DNA, 22 bp, Homo sapiens
cattttcagcacccatctgaaa

SEQ ID NO: 8517392 - DNA, 22 bp, Homo sapiens
cattttcagcacccatctgaaa

SEQ ID NO: 8517393 - DNA, 22 bp, Homo sapiens
cattttcagcacccatctgaaa

SEQ ID NO: 8517394 - DNA, 22 bp, Homo sapiens
cattttcagcacccatctgaaa

SEQ ID NO: 8517395 - DNA, 22 bp, Homo sapiens
cattttatgtttatggagtgct

SEQ ID NO: 8517396 - DNA, 22 bp, Homo sapiens
cattttatgtttatggagtgct

SEQ ID NO: 8517397 - DNA, 22 bp, Homo sapiens
cattttctcaatgaaccctctt

SEQ ID NO: 8517398 - DNA, 22 bp, Homo sapiens
cattttctcaatgaaccctctt

SEQ ID NO: 8517399 - DNA, 19 bp, Homo sapiens
cattttctcattgtgcccc

SEQ ID NO: 8517400 - DNA, 22 bp, Homo sapiens
cattttgtgcacacgtggagtt

SEQ ID NO: 8517401 - DNA, 19 bp, Homo sapiens
cattttcccatcatccttt

SEQ ID NO: 8517402 - DNA, 22 bp, Homo sapiens
cattttcatgagtttctgttca

SEQ ID NO: 8517403 - DNA, 22 bp, Homo sapiens
cattttcatgagtttctgttca

SEQ ID NO: 8517404 - DNA, 22 bp, Homo sapiens
cattttcatgagtttctgttca

SEQ ID NO: 8517405 - DNA, 22 bp, Homo sapiens
ccaaaaattagatacacatata

SEQ ID NO: 8517406 - DNA, 22 bp, Homo sapiens
tcctgagaaggcacagcttgca

SEQ ID NO: 8517407 - DNA, 22 bp, Homo sapiens
tcctgacttggctgttggccct

SEQ ID NO: 8517408 - DNA, 22 bp, Homo sapiens
tcctgaggctcactttgaatgt

SEQ ID NO: 8517409 - DNA, 22 bp, Homo sapiens
tcctgaggctcactttgaatgt

SEQ ID NO: 8517410 - DNA, 22 bp, Homo sapiens
tcctgagggcgattcagcaggt

SEQ ID NO: 8517411 - DNA, 22 bp, Homo sapiens
tcctgagggcgattcagcaggt

SEQ ID NO: 8517412 - DNA, 22 bp, Homo sapiens
tcctgagggcgattcagcaggt

SEQ ID NO: 8517413 - DNA, 22 bp, Homo sapiens
tcctgagggctcggggctcatg

SEQ ID NO: 8517414 - DNA, 22 bp, Homo sapiens
tcctgagggctcggggctcatg

SEQ ID NO: 8517415 - DNA, 22 bp, Homo sapiens
tcctgagggactggttcctcgc

SEQ ID NO: 8517416 - DNA, 22 bp, Homo sapiens
tcctgagggcgattcagcaggt

SEQ ID NO: 8517417 - DNA, 22 bp, Homo sapiens
tcctgagggcattttggtgact

SEQ ID NO: 8517418 - DNA, 22 bp, Homo sapiens
ccacagctgaccgcaggtgagc

SEQ ID NO: 8517419 - DNA, 22 bp, Homo sapiens
ccacaggcggagtggcgggcag

SEQ ID NO: 8517420 - DNA, 22 bp, Homo sapiens
tcctggaggacagaggcatctc

SEQ ID NO: 8517421 - DNA, 22 bp, Homo sapiens
ccacagctgacaatggatagac

SEQ ID NO: 8517422 - DNA, 22 bp, Homo sapiens
tcctggagcttccttcatggta

SEQ ID NO: 8517423 - DNA, 22 bp, Homo sapiens
tcctggagcttccttcatggta

SEQ ID NO: 8517424 - DNA, 22 bp, Homo sapiens
tcctggagcttccttcatggta

SEQ ID NO: 8517425 - DNA, 22 bp, Homo sapiens
tcctggagcttccttcatggta

SEQ ID NO: 8517426 - DNA, 22 bp, Homo sapiens
tcctggaggaataagttttcca

SEQ ID NO: 8517427 - DNA, 22 bp, Homo sapiens
tcctggaggaataagttttcca

SEQ ID NO: 8517428 - DNA, 22 bp, Homo sapiens
tcctggaggaataagttttcca

SEQ ID NO: 8517429 - DNA, 22 bp, Homo sapiens
tcctggagctggtgtctttccc

SEQ ID NO: 8517430 - DNA, 22 bp, Homo sapiens
tcctggagctggtgtctttccc

SEQ ID NO: 8517431 - DNA, 22 bp, Homo sapiens
tcctggagcttcagtttccttt

SEQ ID NO: 8517432 - DNA, 22 bp, Homo sapiens
tcctggagcttcagtttccttt

SEQ ID NO: 8517433 - DNA, 22 bp, Homo sapiens
tcctggagcttcagtttccttt

SEQ ID NO: 8517434 - DNA, 22 bp, Homo sapiens
tcctggagctgactccgtttga

SEQ ID NO: 8517435 - DNA, 20 bp, Homo sapiens
tcctggagctgcttgaattc

SEQ ID NO: 8517436 - DNA, 20 bp, Homo sapiens
tcctggagctgcttgaattc

SEQ ID NO: 8517437 - DNA, 20 bp, Homo sapiens
tcctggagctgcttgaattc

SEQ ID NO: 8517438 - DNA, 22 bp, Homo sapiens
tcctggagcctcattcaaacac

SEQ ID NO: 8517439 - DNA, 22 bp, Homo sapiens
tcctggagcctcattcaaacac

SEQ ID NO: 8517440 - DNA, 22 bp, Homo sapiens
tcctggagctgactccgtttga

SEQ ID NO: 8517441 - DNA, 22 bp, Homo sapiens
tcctggagctgactccgtttga

SEQ ID NO: 8517442 - DNA, 22 bp, Homo sapiens
ccacaggctgctgcaggtcccg

SEQ ID NO: 8517443 - DNA, 22 bp, Homo sapiens
ccacaggctgctgcaggtcccg

SEQ ID NO: 8517444 - DNA, 22 bp, Homo sapiens
ccacagggaacatgacagcctt

SEQ ID NO: 8517445 - DNA, 22 bp, Homo sapiens
ccacagggaacatgacagcctt

SEQ ID NO: 8517446 - DNA, 22 bp, Homo sapiens
ccacagggactgttaaaaccct

SEQ ID NO: 8517447 - DNA, 22 bp, Homo sapiens
ccacagggcctttcctgctggc

SEQ ID NO: 8517448 - DNA, 22 bp, Homo sapiens
ccacagggcctttcctgctggc

SEQ ID NO: 8517449 - DNA, 22 bp, Homo sapiens
ccacagggcacagacaggaagc

SEQ ID NO: 8517450 - DNA, 22 bp, Homo sapiens
ccacagggcacagacaggaagc

SEQ ID NO: 8517451 - DNA, 22 bp, Homo sapiens
ccacagggcctttcctgctggc

SEQ ID NO: 8517452 - DNA, 16 bp, Homo sapiens
ccacagggcaaggggc

SEQ ID NO: 8517453 - DNA, 22 bp, Homo sapiens
ccacagggcacaagggaggttg

SEQ ID NO: 8517454 - DNA, 22 bp, Homo sapiens
ccacagggataggaatggggct

SEQ ID NO: 8517455 - DNA, 22 bp, Homo sapiens
ccacagggataggaatggggct

SEQ ID NO: 8517456 - DNA, 22 bp, Homo sapiens
ccacagggcacaagggaggttg

SEQ ID NO: 8517457 - DNA, 22 bp, Homo sapiens
ccacagggcacagacaggaagc

SEQ ID NO: 8517458 - DNA, 22 bp, Homo sapiens
ccacagggcacagacaggaagc

SEQ ID NO: 8517459 - DNA, 22 bp, Homo sapiens
ccaccaggacagccctgagggg

SEQ ID NO: 8517460 - DNA, 22 bp, Homo sapiens
tcctggctccactgagcaggcc

SEQ ID NO: 8517461 - DNA, 22 bp, Homo sapiens
ccaccaggacagccctgagggg

SEQ ID NO: 8517462 - DNA, 22 bp, Homo sapiens
tcctggccttgctcctgatgcc

SEQ ID NO: 8517463 - DNA, 22 bp, Homo sapiens
tcctggccttgcgtcttgggag

SEQ ID NO: 8517464 - DNA, 22 bp, Homo sapiens
tcctggccttgctcctgatgcc

SEQ ID NO: 8517465 - DNA, 22 bp, Homo sapiens
tcctggctaacacggtgacacc

SEQ ID NO: 8517466 - DNA, 22 bp, Homo sapiens
tcctggccttatccccaaactg

SEQ ID NO: 8517467 - DNA, 22 bp, Homo sapiens
tcctggccttagcgaggcggtc

SEQ ID NO: 8517468 - DNA, 20 bp, Homo sapiens
tcctggccttctcgggcagt

SEQ ID NO: 8517469 - DNA, 22 bp, Homo sapiens
tcctggccttagcgaggcggtc

SEQ ID NO: 8517470 - DNA, 22 bp, Homo sapiens
ccacagggctctaggcgcttcc

SEQ ID NO: 8517471 - DNA, 22 bp, Homo sapiens
ccacaggggcccacgagccgct

SEQ ID NO: 8517472 - DNA, 21 bp, Homo sapiens
ccacaggggctcccctgtcag

SEQ ID NO: 8517473 - DNA, 22 bp, Homo sapiens
ccacaggggtctctgtagctga

SEQ ID NO: 8517474 - DNA, 22 bp, Homo sapiens
ccacaggggtctctgtagctga

SEQ ID NO: 8517475 - DNA, 22 bp, Homo sapiens
ccacaggggtctctgtagctga

SEQ ID NO: 8517476 - DNA, 22 bp, Homo sapiens
ccacaggggtctctgtagctga

SEQ ID NO: 8517477 - DNA, 21 bp, Homo sapiens
ccacaggggctcccctgtcag

SEQ ID NO: 8517478 - DNA, 22 bp, Homo sapiens
tcctgcgagtgcgcttttggtc

SEQ ID NO: 8517479 - DNA, 22 bp, Homo sapiens
tcctggagccacggagctttca

SEQ ID NO: 8517480 - DNA, 22 bp, Homo sapiens
tcctggagccacggagctttca

SEQ ID NO: 8517481 - DNA, 22 bp, Homo sapiens
tcctggagccaggacccttccc

SEQ ID NO: 8517482 - DNA, 22 bp, Homo sapiens
tcctggagccaggacccttccc

SEQ ID NO: 8517483 - DNA, 22 bp, Homo sapiens
tcctggagccacggagctttca

SEQ ID NO: 8517484 - DNA, 22 bp, Homo sapiens
tcctggagccaggacccttccc

SEQ ID NO: 8517485 - DNA, 22 bp, Homo sapiens
tcctggagccatgattcccctc

SEQ ID NO: 8517486 - DNA, 22 bp, Homo sapiens
tcctggagccatgattcccctc

SEQ ID NO: 8517487 - DNA, 22 bp, Homo sapiens
tcctgccttcatactgctgtat

SEQ ID NO: 8517488 - DNA, 22 bp, Homo sapiens
tcctgccttcatactgctgtat

SEQ ID NO: 8517489 - DNA, 22 bp, Homo sapiens
tcctgccttcatactgctgtat

SEQ ID NO: 8517490 - DNA, 22 bp, Homo sapiens
tcctgccttcatactgctgtat

SEQ ID NO: 8517491 - DNA, 22 bp, Homo sapiens
tcctgccttcatactgctgtat

SEQ ID NO: 8517492 - DNA, 22 bp, Homo sapiens
tcctgccttgcctgggacatca

SEQ ID NO: 8517493 - DNA, 22 bp, Homo sapiens
tcctgccttgcctgggacatca

SEQ ID NO: 8517494 - DNA, 22 bp, Homo sapiens
tcctgccttgcctgggacatca

SEQ ID NO: 8517495 - DNA, 22 bp, Homo sapiens
tcctgccttgcctgggacatca

SEQ ID NO: 8517496 - DNA, 21 bp, Homo sapiens
tcctgccttagtccagagcag

SEQ ID NO: 8517497 - DNA, 22 bp, Homo sapiens
tcctgccttagagcaaggaaaa

SEQ ID NO: 8517498 - DNA, 21 bp, Homo sapiens
tcctgccttagtccagagcag

SEQ ID NO: 8517499 - DNA, 22 bp, Homo sapiens
tcctgccttagagcaaggaaaa

SEQ ID NO: 8517500 - DNA, 22 bp, Homo sapiens
tcctgccttagagcaaggaaaa

SEQ ID NO: 8517501 - DNA, 21 bp, Homo sapiens
tcctgccttagtccagagcag

SEQ ID NO: 8517502 - DNA, 21 bp, Homo sapiens
tcctgccttagtccagagcag

SEQ ID NO: 8517503 - DNA, 21 bp, Homo sapiens
tcctgccttagtccagagcag

SEQ ID NO: 8517504 - DNA, 22 bp, Homo sapiens
tcctgcccagagctctccactc

SEQ ID NO: 8517505 - DNA, 22 bp, Homo sapiens
ccaagaggtatcttgccataaa

SEQ ID NO: 8517506 - DNA, 22 bp, Homo sapiens
ccaagaggtaatacgagatatc

SEQ ID NO: 8517507 - DNA, 23 bp, Homo sapiens
ccaagactgttaggagtggggag

SEQ ID NO: 8517508 - DNA, 22 bp, Homo sapiens
ccaagaggcagaatgcagagaa

SEQ ID NO: 8517509 - DNA, 22 bp, Homo sapiens
ccaagaggaccttgccagggca

SEQ ID NO: 8517510 - DNA, 23 bp, Homo sapiens
ccaagactgttaggagtggggag

SEQ ID NO: 8517511 - DNA, 23 bp, Homo sapiens
ccaagactgttaggagtggggag

SEQ ID NO: 8517512 - DNA, 23 bp, Homo sapiens
ccaagactgttaggagtggggag

SEQ ID NO: 8517513 - DNA, 22 bp, Homo sapiens
ccaacaggttgagagtctgaat

SEQ ID NO: 8517514 - DNA, 22 bp, Homo sapiens
ccaacaccatctgagctccagc

SEQ ID NO: 8517515 - DNA, 22 bp, Homo sapiens
ccaacaccatctgagctccagc

SEQ ID NO: 8517516 - DNA, 22 bp, Homo sapiens
ccaacaccatctgagctccagc

SEQ ID NO: 8517517 - DNA, 22 bp, Homo sapiens
tcctgagggctgcagtcatagg

SEQ ID NO: 8517518 - DNA, 22 bp, Homo sapiens
tcctgagggctgcagtcatagg

SEQ ID NO: 8517519 - DNA, 23 bp, Homo sapiens
tcctgagggtttcccagccttgg

SEQ ID NO: 8517520 - DNA, 23 bp, Homo sapiens
tcctgagggtttcccagccttgg

SEQ ID NO: 8517521 - DNA, 22 bp, Homo sapiens
tcctgaggtgctcagccaggaa

SEQ ID NO: 8517522 - DNA, 22 bp, Homo sapiens
tcctgaggtatatgctttgcag

SEQ ID NO: 8517523 - DNA, 22 bp, Homo sapiens
tcctgaggtctgaaaaaggagc

SEQ ID NO: 8517524 - DNA, 22 bp, Homo sapiens
tcctgaggtatatgctttgcag

SEQ ID NO: 8517525 - DNA, 22 bp, Homo sapiens
tcctgaggtggattgagcagag

SEQ ID NO: 8517526 - DNA, 22 bp, Homo sapiens
tcctgaggtggattgagcagag

SEQ ID NO: 8517527 - DNA, 22 bp, Homo sapiens
tcctgaggtggattgagcagag

SEQ ID NO: 8517528 - DNA, 22 bp, Homo sapiens
tcctgaggtggattgagcagag

SEQ ID NO: 8517529 - DNA, 22 bp, Homo sapiens
tcctgaggtggattgagcagag

SEQ ID NO: 8517530 - DNA, 22 bp, Homo sapiens
ccaacacagatgtgttagtgtt

SEQ ID NO: 8517531 - DNA, 22 bp, Homo sapiens
ccagagggaactgggcctcatt

SEQ ID NO: 8517532 - DNA, 22 bp, Homo sapiens
ccagagggaactgggcctcatt

SEQ ID NO: 8517533 - DNA, 22 bp, Homo sapiens
ccagagggaactgggcctcatt

SEQ ID NO: 8517534 - DNA, 22 bp, Homo sapiens
ccagagggaagaggaagcgctg

SEQ ID NO: 8517535 - DNA, 22 bp, Homo sapiens
ccagagggaagaggaagcgctg

SEQ ID NO: 8517536 - DNA, 22 bp, Homo sapiens
ccagagggagccaccagggtgt

SEQ ID NO: 8517537 - DNA, 22 bp, Homo sapiens
ccagagggagccaccagggtgt

SEQ ID NO: 8517538 - DNA, 22 bp, Homo sapiens
ccagaggctggggaaggataca

SEQ ID NO: 8517539 - DNA, 22 bp, Homo sapiens
ccagaggctggggaaggataca

SEQ ID NO: 8517540 - DNA, 22 bp, Homo sapiens
ccagaggctggcagccagctga

SEQ ID NO: 8517541 - DNA, 22 bp, Homo sapiens
ccagaggctggcagccagctga

SEQ ID NO: 8517542 - DNA, 22 bp, Homo sapiens
ccagaggctgggttcacctcag

SEQ ID NO: 8517543 - DNA, 22 bp, Homo sapiens
ccagaggctgggttcacctcag

SEQ ID NO: 8517544 - DNA, 22 bp, Homo sapiens
ccagaggctgggttcacctcag

SEQ ID NO: 8517545 - DNA, 22 bp, Homo sapiens
ccagaggctggggaaggataca

SEQ ID NO: 8517546 - DNA, 22 bp, Homo sapiens
ccagaggctggcagccagctga

SEQ ID NO: 8517547 - DNA, 22 bp, Homo sapiens
ccagaggatcagtactggctgg

SEQ ID NO: 8517548 - DNA, 22 bp, Homo sapiens
ccagaggctggcaagggctcct

SEQ ID NO: 8517549 - DNA, 22 bp, Homo sapiens
ccagaggctggcaagggctcct

SEQ ID NO: 8517550 - DNA, 22 bp, Homo sapiens
ccagaggctggcagccagctga

SEQ ID NO: 8517551 - DNA, 22 bp, Homo sapiens
ccagaggctggcagccagctga

SEQ ID NO: 8517552 - DNA, 22 bp, Homo sapiens
ccagaggctggcaagggctcct

SEQ ID NO: 8517553 - DNA, 22 bp, Homo sapiens
ccagagcctcttatgaagatcg

SEQ ID NO: 8517554 - DNA, 22 bp, Homo sapiens
ccagagcctcttatgaagatcg

SEQ ID NO: 8517555 - DNA, 21 bp, Homo sapiens
ccagagcctgagaggattatg

SEQ ID NO: 8517556 - DNA, 22 bp, Homo sapiens
ccagaggatcagtactggctgg

SEQ ID NO: 8517557 - DNA, 22 bp, Homo sapiens
ccagagcctcgcccggagcctc

SEQ ID NO: 8517558 - DNA, 22 bp, Homo sapiens
ccagagcctaagatctgatcct

SEQ ID NO: 8517559 - DNA, 22 bp, Homo sapiens
ccagagcctaagatctgatcct

SEQ ID NO: 8517560 - DNA, 22 bp, Homo sapiens
ccagagccggctccctcagctt

SEQ ID NO: 8517561 - DNA, 22 bp, Homo sapiens
ccagagccggctccctcagctt

SEQ ID NO: 8517562 - DNA, 22 bp, Homo sapiens
ccagagccggattgtgaagtgc

SEQ ID NO: 8517563 - DNA, 22 bp, Homo sapiens
ccagagcccgggacctggactt

SEQ ID NO: 8517564 - DNA, 19 bp, Homo sapiens
ccagagcccgccagatggg

SEQ ID NO: 8517565 - DNA, 19 bp, Homo sapiens
ccagagcccgccagatggg

SEQ ID NO: 8517566 - DNA, 19 bp, Homo sapiens
ccagagcccgccagatggg

SEQ ID NO: 8517567 - DNA, 22 bp, Homo sapiens
ccagagcccagggtcatgcagg

SEQ ID NO: 8517568 - DNA, 22 bp, Homo sapiens
ccagagcccctgagcttccctg

SEQ ID NO: 8517569 - DNA, 22 bp, Homo sapiens
ccagagcagggcagcagggctc

SEQ ID NO: 8517570 - DNA, 22 bp, Homo sapiens
ccagagcagggcagcagggctc

SEQ ID NO: 8517571 - DNA, 22 bp, Homo sapiens
ccagagagggcgccacctggag

SEQ ID NO: 8517572 - DNA, 20 bp, Homo sapiens
ccagagcagccactgaagtt

SEQ ID NO: 8517573 - DNA, 22 bp, Homo sapiens
ccagagccagagaggtgcctgc

SEQ ID NO: 8517574 - DNA, 22 bp, Homo sapiens
ccagagccagagaggtgcctgc

SEQ ID NO: 8517575 - DNA, 22 bp, Homo sapiens
ccagagcccagcacacggtgct

SEQ ID NO: 8517576 - DNA, 22 bp, Homo sapiens
ccagagcccagggtcatgcagg

SEQ ID NO: 8517577 - DNA, 22 bp, Homo sapiens
ccagagcccagggtcatgcagg

SEQ ID NO: 8517578 - DNA, 22 bp, Homo sapiens
ccagaggggctgagcaggtcac

SEQ ID NO: 8517579 - DNA, 22 bp, Homo sapiens
ccagaggggctgagcaggtcac

SEQ ID NO: 8517580 - DNA, 22 bp, Homo sapiens
ccagaggggctgagcaggtcac

SEQ ID NO: 8517581 - DNA, 22 bp, Homo sapiens
ccagaggggtgggcctggttta

SEQ ID NO: 8517582 - DNA, 22 bp, Homo sapiens
ccagaggggtgggcctggttta

SEQ ID NO: 8517583 - DNA, 20 bp, Homo sapiens
ccagagggtagggccgcccc

SEQ ID NO: 8517584 - DNA, 20 bp, Homo sapiens
ccagagggtagggccgcccc

SEQ ID NO: 8517585 - DNA, 20 bp, Homo sapiens
ccagagggtagggccgcccc

SEQ ID NO: 8517586 - DNA, 22 bp, Homo sapiens
ccagagggcttggtttgggcca

SEQ ID NO: 8517587 - DNA, 22 bp, Homo sapiens
ccagaggggcacaaaagtagaa

SEQ ID NO: 8517588 - DNA, 22 bp, Homo sapiens
ccagaggggcacaaaagtagaa

SEQ ID NO: 8517589 - DNA, 22 bp, Homo sapiens
ccagagggcctttggagttatc

SEQ ID NO: 8517590 - DNA, 22 bp, Homo sapiens
ccagagggcctttggagttatc

SEQ ID NO: 8517591 - DNA, 22 bp, Homo sapiens
ccagagggcttggtttgggcca

SEQ ID NO: 8517592 - DNA, 22 bp, Homo sapiens
ccagagggcaaaatgaagctta

SEQ ID NO: 8517593 - DNA, 22 bp, Homo sapiens
ccagagggcaaaatgaagctta

SEQ ID NO: 8517594 - DNA, 22 bp, Homo sapiens
ccagagggcaaaatgaagctta

SEQ ID NO: 8517595 - DNA, 22 bp, Homo sapiens
ccagagggccctggtctcagct

SEQ ID NO: 8517596 - DNA, 22 bp, Homo sapiens
ccagagggccctggtctcagct

SEQ ID NO: 8517597 - DNA, 22 bp, Homo sapiens
ccagaggtgaacaggaggctgt

SEQ ID NO: 8517598 - DNA, 22 bp, Homo sapiens
tctctgggataaactgggccag

SEQ ID NO: 8517599 - DNA, 22 bp, Homo sapiens
ccagaggtctcctgcacgggat

SEQ ID NO: 8517600 - DNA, 22 bp, Homo sapiens
ccagaggtctcctgcacgggat

SEQ ID NO: 8517601 - DNA, 22 bp, Homo sapiens
ccagaggtcctgtgatgctgca

SEQ ID NO: 8517602 - DNA, 22 bp, Homo sapiens
ccagaggtcctgctcactggtg

SEQ ID NO: 8517603 - DNA, 22 bp, Homo sapiens
ccagaggtcctgctcactggtg

SEQ ID NO: 8517604 - DNA, 22 bp, Homo sapiens
ccagaggtcccctgccaggagg

SEQ ID NO: 8517605 - DNA, 18 bp, Homo sapiens
ccagagggtgcgtcagct

SEQ ID NO: 8517606 - DNA, 18 bp, Homo sapiens
ccagagggtgcgtcagct

SEQ ID NO: 8517607 - DNA, 18 bp, Homo sapiens
ccagagggtgcgtcagct

SEQ ID NO: 8517608 - DNA, 18 bp, Homo sapiens
ccagagggtgcgtcagct

SEQ ID NO: 8517609 - DNA, 18 bp, Homo sapiens
ccagagggtgcgtcagct

SEQ ID NO: 8517610 - DNA, 22 bp, Homo sapiens
ccagatgtccctctcaggtttg

SEQ ID NO: 8517611 - DNA, 22 bp, Homo sapiens
tctctgtattctgatattcact

SEQ ID NO: 8517612 - DNA, 22 bp, Homo sapiens
tctctgtagttgggcagctgct

SEQ ID NO: 8517613 - DNA, 22 bp, Homo sapiens
tctctgtatcagcacctgctgg

SEQ ID NO: 8517614 - DNA, 22 bp, Homo sapiens
tctctgtagttgggcagctgct

SEQ ID NO: 8517615 - DNA, 22 bp, Homo sapiens
tctctgtagagacagcactgtg

SEQ ID NO: 8517616 - DNA, 22 bp, Homo sapiens
tctctgtaaaatgtggatgata

SEQ ID NO: 8517617 - DNA, 22 bp, Homo sapiens
tctctgggataaactgggccag

SEQ ID NO: 8517618 - DNA, 21 bp, Homo sapiens
tctctggttggagttgtgcca

SEQ ID NO: 8517619 - DNA, 22 bp, Homo sapiens
tctctgtagagacagcactgtg

SEQ ID NO: 8517620 - DNA, 22 bp, Homo sapiens
tctctgtagacctgaccagcac

SEQ ID NO: 8517621 - DNA, 22 bp, Homo sapiens
tctctgtacagtacatgccgtg

SEQ ID NO: 8517622 - DNA, 23 bp, Homo sapiens
tctctgtacagatgaggacacac

SEQ ID NO: 8517623 - DNA, 22 bp, Homo sapiens
ccagcaagtgcagatggccaag

SEQ ID NO: 8517624 - DNA, 22 bp, Homo sapiens
ccagcaagccaggtctgtggct

SEQ ID NO: 8517625 - DNA, 22 bp, Homo sapiens
ccagatgtccctctcaggtttg

SEQ ID NO: 8517626 - DNA, 22 bp, Homo sapiens
ccagatgtccctctcaggtttg

SEQ ID NO: 8517627 - DNA, 22 bp, Homo sapiens
ccagatgttcccctggaggcct

SEQ ID NO: 8517628 - DNA, 22 bp, Homo sapiens
ccagatgtgagcagagccttga

SEQ ID NO: 8517629 - DNA, 22 bp, Homo sapiens
ccagatgtctgagccacactcc

SEQ ID NO: 8517630 - DNA, 22 bp, Homo sapiens
ccagatgttcccctggaggcct

SEQ ID NO: 8517631 - DNA, 22 bp, Homo sapiens
ccaccctgagccgcaagagcag

SEQ ID NO: 8517632 - DNA, 22 bp, Homo sapiens
ccaccctgccttgggccagtga

SEQ ID NO: 8517633 - DNA, 22 bp, Homo sapiens
ccaccctgccttgggccagtga

SEQ ID NO: 8517634 - DNA, 22 bp, Homo sapiens
ccaccctggacaggcctctgag

SEQ ID NO: 8517635 - DNA, 22 bp, Homo sapiens
tcctgtggtcattcttctgccc

SEQ ID NO: 8517636 - DNA, 22 bp, Homo sapiens
tcctgtggtcattcttctgccc

SEQ ID NO: 8517637 - DNA, 22 bp, Homo sapiens
ccaccctgaggaatggtccggc

SEQ ID NO: 8517638 - DNA, 22 bp, Homo sapiens
ccaccctgccttgggccagtga

SEQ ID NO: 8517639 - DNA, 22 bp, Homo sapiens
tcctgtgtgggcaggatgagaa

SEQ ID NO: 8517640 - DNA, 22 bp, Homo sapiens
tcctgtgtgggcaggatgagaa

SEQ ID NO: 8517641 - DNA, 22 bp, Homo sapiens
tcctgtgtgggcaggatgagaa

SEQ ID NO: 8517642 - DNA, 18 bp, Homo sapiens
ccacccagggggagagga

SEQ ID NO: 8517643 - DNA, 18 bp, Homo sapiens
ccacccagggggagagga

SEQ ID NO: 8517644 - DNA, 18 bp, Homo sapiens
ccacccagggggagagga

SEQ ID NO: 8517645 - DNA, 22 bp, Homo sapiens
ccaccccaaatgaagacctctc

SEQ ID NO: 8517646 - DNA, 22 bp, Homo sapiens
ccacccctgggtgcagggagcg

SEQ ID NO: 8517647 - DNA, 22 bp, Homo sapiens
ccacccctgggtgcagggagcg

SEQ ID NO: 8517648 - DNA, 22 bp, Homo sapiens
ccacccctgtagagggacagac

SEQ ID NO: 8517649 - DNA, 19 bp, Homo sapiens
ccacccctttgctgggccc

SEQ ID NO: 8517650 - DNA, 19 bp, Homo sapiens
ccacccctttgctgggccc

SEQ ID NO: 8517651 - DNA, 22 bp, Homo sapiens
tcctgtgttgatagagatggtt

SEQ ID NO: 8517652 - DNA, 22 bp, Homo sapiens
tcctgtgttctaggtatggtct

SEQ ID NO: 8517653 - DNA, 22 bp, Homo sapiens
tcctgtgttacccttgcagtga

SEQ ID NO: 8517654 - DNA, 22 bp, Homo sapiens
tcctgtgttctaggtatggtct

SEQ ID NO: 8517655 - DNA, 17 bp, Homo sapiens
tcctgtttatcattgat

SEQ ID NO: 8517656 - DNA, 19 bp, Homo sapiens
tcctgttatggagcttagg

SEQ ID NO: 8517657 - DNA, 22 bp, Homo sapiens
tcctgttagtgttagacttccc

SEQ ID NO: 8517658 - DNA, 22 bp, Homo sapiens
tctagaaacatgacattgatct

SEQ ID NO: 8517659 - DNA, 22 bp, Homo sapiens
tctagaaacatgacattgatct

SEQ ID NO: 8517660 - DNA, 22 bp, Homo sapiens
tcctgtttctcctgcaaaatcc

SEQ ID NO: 8517661 - DNA, 22 bp, Homo sapiens
tctaatgaaagatgtaggaact

SEQ ID NO: 8517662 - DNA, 22 bp, Homo sapiens
tctagaaagccaaattaggaat

SEQ ID NO: 8517663 - DNA, 18 bp, Homo sapiens
tctagaaacccagactct

SEQ ID NO: 8517664 - DNA, 22 bp, Homo sapiens
tctagaaattttgccttgtatt

SEQ ID NO: 8517665 - DNA, 22 bp, Homo sapiens
tctagaaattttgccttgtatt

SEQ ID NO: 8517666 - DNA, 22 bp, Homo sapiens
tctcagtggtgttttgagtcca

SEQ ID NO: 8517667 - DNA, 22 bp, Homo sapiens
tctcagtgtgttgagaggtctg

SEQ ID NO: 8517668 - DNA, 22 bp, Homo sapiens
tctcagtgggttaaaagagaag

SEQ ID NO: 8517669 - DNA, 22 bp, Homo sapiens
tctcagtgtgttttctctcaga

SEQ ID NO: 8517670 - DNA, 22 bp, Homo sapiens
tctcagtgtttaaaaagatttc

SEQ ID NO: 8517671 - DNA, 23 bp, Homo sapiens
tctcagttccagaggctacaagt

SEQ ID NO: 8517672 - DNA, 22 bp, Homo sapiens
ccagagaggccttggcaagaca

SEQ ID NO: 8517673 - DNA, 22 bp, Homo sapiens
ccagagaggccttggcaagaca

SEQ ID NO: 8517674 - DNA, 22 bp, Homo sapiens
tctcaggcattcccacatagaa

SEQ ID NO: 8517675 - DNA, 20 bp, Homo sapiens
tctcaggccccagttttctt

SEQ ID NO: 8517676 - DNA, 22 bp, Homo sapiens
tctcaggcccactgtgttgaaa

SEQ ID NO: 8517677 - DNA, 20 bp, Homo sapiens
tctcaggccccagttttctt

SEQ ID NO: 8517678 - DNA, 22 bp, Homo sapiens
tctcagtggatctcagaatttt

SEQ ID NO: 8517679 - DNA, 22 bp, Homo sapiens
tctcagtggatctcagaatttt

SEQ ID NO: 8517680 - DNA, 22 bp, Homo sapiens
tctcaggcactgggtgccaact

SEQ ID NO: 8517681 - DNA, 17 bp, Homo sapiens
tctcaggcacgtgtggc

SEQ ID NO: 8517682 - DNA, 22 bp, Homo sapiens
tctcaggcatctgtgtggcaca

SEQ ID NO: 8517683 - DNA, 22 bp, Homo sapiens
tctcaggcatggtttgttcatc

SEQ ID NO: 8517684 - DNA, 22 bp, Homo sapiens
tctcaggactcctctggccata

SEQ ID NO: 8517685 - DNA, 22 bp, Homo sapiens
tctcaggactttgggaagctca

SEQ ID NO: 8517686 - DNA, 23 bp, Homo sapiens
tctcaggcaaaccaggacaagtt

SEQ ID NO: 8517687 - DNA, 22 bp, Homo sapiens
tctcaggatctaatacatggta

SEQ ID NO: 8517688 - DNA, 22 bp, Homo sapiens
tctatacacacaaagaatgctt

SEQ ID NO: 8517689 - DNA, 23 bp, Homo sapiens
tctatacatactgcagcctctgg

SEQ ID NO: 8517690 - DNA, 22 bp, Homo sapiens
tctatacacacaaagaatgctt

SEQ ID NO: 8517691 - DNA, 22 bp, Homo sapiens
tctatacacacaaagaatgctt

SEQ ID NO: 8517692 - DNA, 22 bp, Homo sapiens
tctatacatgtgcacacacatc

SEQ ID NO: 8517693 - DNA, 23 bp, Homo sapiens
tctatacatactgcagcctctgg

SEQ ID NO: 8517694 - DNA, 23 bp, Homo sapiens
tctatacatactgcagcctctgg

SEQ ID NO: 8517695 - DNA, 22 bp, Homo sapiens
tctatacatgtgcacacacatc

SEQ ID NO: 8517696 - DNA, 22 bp, Homo sapiens
tctcaggaaataggatttgagt

SEQ ID NO: 8517697 - DNA, 22 bp, Homo sapiens
tctcaggaatagagtggcagca

SEQ ID NO: 8517698 - DNA, 22 bp, Homo sapiens
tctcagctgcctgccctgctcc

SEQ ID NO: 8517699 - DNA, 22 bp, Homo sapiens
tctcagctgcctgccctgctcc

SEQ ID NO: 8517700 - DNA, 22 bp, Homo sapiens
tctcagcttgagtggatgagct

SEQ ID NO: 8517701 - DNA, 22 bp, Homo sapiens
tctatacaagtttcactttgac

SEQ ID NO: 8517702 - DNA, 22 bp, Homo sapiens
tctatacaagtttcactttgac

SEQ ID NO: 8517703 - DNA, 22 bp, Homo sapiens
tctataatcctatttcaactgc

SEQ ID NO: 8517704 - DNA, 22 bp, Homo sapiens
tctataaattatgcagtctcag

SEQ ID NO: 8517705 - DNA, 22 bp, Homo sapiens
tctataaattatgcagtctcag

SEQ ID NO: 8517706 - DNA, 21 bp, Homo sapiens
tctataactatagtgacagat

SEQ ID NO: 8517707 - DNA, 22 bp, Homo sapiens
tctataaattatgcagtctcag

SEQ ID NO: 8517708 - DNA, 22 bp, Homo sapiens
tctataaatgcagatatgtgtg

SEQ ID NO: 8517709 - DNA, 22 bp, Homo sapiens
tctataaatgcagatatgtgtg

SEQ ID NO: 8517710 - DNA, 22 bp, Homo sapiens
cagtgctgttgtaagctcattg

SEQ ID NO: 8517711 - DNA, 22 bp, Homo sapiens
cagtgctgttgtaagctcattg

SEQ ID NO: 8517712 - DNA, 22 bp, Homo sapiens
cagtgctgttgtaagctcattg

SEQ ID NO: 8517713 - DNA, 22 bp, Homo sapiens
tcacactgtgaagagacaagca

SEQ ID NO: 8517714 - DNA, 22 bp, Homo sapiens
tcacacttagagcgaattgttt

SEQ ID NO: 8517715 - DNA, 19 bp, Homo sapiens
cagtggagattggaggagg

SEQ ID NO: 8517716 - DNA, 22 bp, Homo sapiens
cagtggagaggcatgcttggca

SEQ ID NO: 8517717 - DNA, 22 bp, Homo sapiens
tcacacctgtaatcccaggcct

SEQ ID NO: 8517718 - DNA, 22 bp, Homo sapiens
tcacaccagtttcctttcaatt

SEQ ID NO: 8517719 - DNA, 22 bp, Homo sapiens
tcacactggcagtgctgaaggc

SEQ ID NO: 8517720 - DNA, 23 bp, Homo sapiens
tcacactggatacacatgcaaga

SEQ ID NO: 8517721 - DNA, 22 bp, Homo sapiens
tcacactaggatgttgtttcta

SEQ ID NO: 8517722 - DNA, 23 bp, Homo sapiens
tcacactatgaagtgtgttatcc

SEQ ID NO: 8517723 - DNA, 22 bp, Homo sapiens
cagtggaggctcaagtgtgctt

SEQ ID NO: 8517724 - DNA, 22 bp, Homo sapiens
cagtggagtgggactggtctga

SEQ ID NO: 8517725 - DNA, 22 bp, Homo sapiens
cagtggaggccttgggaccttt

SEQ ID NO: 8517726 - DNA, 22 bp, Homo sapiens
cagtggaggccttgggaccttt

SEQ ID NO: 8517727 - DNA, 22 bp, Homo sapiens
tcacatgtatatgcagcacagc

SEQ ID NO: 8517728 - DNA, 22 bp, Homo sapiens
tcacatgcttgaggaaagaaaa

SEQ ID NO: 8517729 - DNA, 16 bp, Homo sapiens
tcacacatttgttggt

SEQ ID NO: 8517730 - DNA, 22 bp, Homo sapiens
tcacacatttctcaagtgtagg

SEQ ID NO: 8517731 - DNA, 22 bp, Homo sapiens
tcacacattctaggtatgttga

SEQ ID NO: 8517732 - DNA, 22 bp, Homo sapiens
tcacacatttctcaagtgtagg

SEQ ID NO: 8517733 - DNA, 22 bp, Homo sapiens
cagtgcagtttcccagatgctg

SEQ ID NO: 8517734 - DNA, 22 bp, Homo sapiens
cagtgcatagatcctgaggcct

SEQ ID NO: 8517735 - DNA, 22 bp, Homo sapiens
cagtgcataatctaaatggggg

SEQ ID NO: 8517736 - DNA, 20 bp, Homo sapiens
tcacacatggtaagctatga

SEQ ID NO: 8517737 - DNA, 22 bp, Homo sapiens
cagtgcagtcaaggaagaacca

SEQ ID NO: 8517738 - DNA, 22 bp, Homo sapiens
cagtgcagttggtggcaggggt

SEQ ID NO: 8517739 - DNA, 22 bp, Homo sapiens
cagtgcagttggtggcaggggt

SEQ ID NO: 8517740 - DNA, 22 bp, Homo sapiens
cagtgcagttggtggcaggggt

SEQ ID NO: 8517741 - DNA, 22 bp, Homo sapiens
cagtgcaggtggcagaggacag

SEQ ID NO: 8517742 - DNA, 22 bp, Homo sapiens
cagtgcaggtttagggctgggg

SEQ ID NO: 8517743 - DNA, 22 bp, Homo sapiens
cagtgcaggtggcagaggacag

SEQ ID NO: 8517744 - DNA, 22 bp, Homo sapiens
cagtgcaggtggcagaggacag

SEQ ID NO: 8517745 - DNA, 22 bp, Homo sapiens
tcactgcagagacctctagtca

SEQ ID NO: 8517746 - DNA, 22 bp, Homo sapiens
tcactgcacttcagcttgggca

SEQ ID NO: 8517747 - DNA, 22 bp, Homo sapiens
tcactgcagacaacctcagtca

SEQ ID NO: 8517748 - DNA, 22 bp, Homo sapiens
tcactgcagcctctgcctcccg

SEQ ID NO: 8517749 - DNA, 22 bp, Homo sapiens
tcactgcaggtttttcaggagg

SEQ ID NO: 8517750 - DNA, 22 bp, Homo sapiens
tcactgcactccagcctgggca

SEQ ID NO: 8517751 - DNA, 22 bp, Homo sapiens
tcactgcactccagcctgggtg

SEQ ID NO: 8517752 - DNA, 21 bp, Homo sapiens
tcactgcaatgctaggagaaa

SEQ ID NO: 8517753 - DNA, 22 bp, Homo sapiens
cagtggcacccacgggctgggc

SEQ ID NO: 8517754 - DNA, 22 bp, Homo sapiens
cagtggcaatgggacagagcac

SEQ ID NO: 8517755 - DNA, 22 bp, Homo sapiens
cagtggcagagaacagagacct

SEQ ID NO: 8517756 - DNA, 22 bp, Homo sapiens
cagtggcagagaacagagacct

SEQ ID NO: 8517757 - DNA, 22 bp, Homo sapiens
cagtggttggtagatacttgag

SEQ ID NO: 8517758 - DNA, 22 bp, Homo sapiens
cagtggttggtagatacttgag

SEQ ID NO: 8517759 - DNA, 22 bp, Homo sapiens
cagtggttgcttgcatggctcc

SEQ ID NO: 8517760 - DNA, 22 bp, Homo sapiens
cagtggttgtcagcaacaatat

SEQ ID NO: 8517761 - DNA, 21 bp, Homo sapiens
cagtggtttataaacaacaga

SEQ ID NO: 8517762 - DNA, 22 bp, Homo sapiens
cagtggtttaggtcaaggggag

SEQ ID NO: 8517763 - DNA, 22 bp, Homo sapiens
cagtgggtcctgcgtctgccag

SEQ ID NO: 8517764 - DNA, 22 bp, Homo sapiens
cagtgggtgatgagtcctgggg

SEQ ID NO: 8517765 - DNA, 21 bp, Homo sapiens
cagtggttgctgaattagtgg

SEQ ID NO: 8517766 - DNA, 22 bp, Homo sapiens
tcactcctcattgctgcccatt

SEQ ID NO: 8517767 - DNA, 19 bp, Homo sapiens
tcactctccctgtctgtcc

SEQ ID NO: 8517768 - DNA, 22 bp, Homo sapiens
tcactctctaagcatgacagac

SEQ ID NO: 8517769 - DNA, 22 bp, Homo sapiens
tcactgcaacctccacctcctg

SEQ ID NO: 8517770 - DNA, 22 bp, Homo sapiens
tcactgcaacctccacctcctg

SEQ ID NO: 8517771 - DNA, 22 bp, Homo sapiens
tcactgcaacctctgcctcccg

SEQ ID NO: 8517772 - DNA, 22 bp, Homo sapiens
tcactgcaacctccgcctgctg

SEQ ID NO: 8517773 - DNA, 22 bp, Homo sapiens
tcactgcaagctctgccttccg

SEQ ID NO: 8517774 - DNA, 22 bp, Homo sapiens
tcactgcaagctcctcctcctg

SEQ ID NO: 8517775 - DNA, 22 bp, Homo sapiens
tcactgcaaggaggcttctcaa

SEQ ID NO: 8517776 - DNA, 22 bp, Homo sapiens
tcactgcaatctcagcctcctg

SEQ ID NO: 8517777 - DNA, 22 bp, Homo sapiens
tcactgcaatctctgccttcca

SEQ ID NO: 8517778 - DNA, 22 bp, Homo sapiens
tcactgcaacctctgccttccg

SEQ ID NO: 8517779 - DNA, 22 bp, Homo sapiens
tcactgcaacctctgcctgcca

SEQ ID NO: 8517780 - DNA, 22 bp, Homo sapiens
tcactgcaacctctgcctcttg

SEQ ID NO: 8517781 - DNA, 22 bp, Homo sapiens
tcactgcaagctccacctcccg

SEQ ID NO: 8517782 - DNA, 22 bp, Homo sapiens
tcactgcaagctcagcctcccg

SEQ ID NO: 8517783 - DNA, 22 bp, Homo sapiens
tcacatgtgtggcagtgcaagt

SEQ ID NO: 8517784 - DNA, 22 bp, Homo sapiens
tcacatgtgtggcagtgcaagt

SEQ ID NO: 8517785 - DNA, 22 bp, Homo sapiens
tcacatgttaggtcgggcaagg

SEQ ID NO: 8517786 - DNA, 22 bp, Homo sapiens
tcacatgtgttttctcaccaac

SEQ ID NO: 8517787 - DNA, 22 bp, Homo sapiens
tcacattaggaagtaatgttgt

SEQ ID NO: 8517788 - DNA, 18 bp, Homo sapiens
tcacattataatgtaaca

SEQ ID NO: 8517789 - DNA, 22 bp, Homo sapiens
tcacattctcagcatctataca

SEQ ID NO: 8517790 - DNA, 22 bp, Homo sapiens
tcacattctcagcatctataca

SEQ ID NO: 8517791 - DNA, 22 bp, Homo sapiens
tcacattctcagcatctataca

SEQ ID NO: 8517792 - DNA, 22 bp, Homo sapiens
cagtcccagtttgagactctgg

SEQ ID NO: 8517793 - DNA, 22 bp, Homo sapiens
cagtcccagtttgagactctgg

SEQ ID NO: 8517794 - DNA, 22 bp, Homo sapiens
cagtcccagggttggttcagct

SEQ ID NO: 8517795 - DNA, 22 bp, Homo sapiens
cagtcccagggttggttcagct

SEQ ID NO: 8517796 - DNA, 22 bp, Homo sapiens
cagtcccagggttggttcagct

SEQ ID NO: 8517797 - DNA, 22 bp, Homo sapiens
cagtcccagctgctcagaaggc

SEQ ID NO: 8517798 - DNA, 22 bp, Homo sapiens
cagtcccagctgctcagaaggc

SEQ ID NO: 8517799 - DNA, 22 bp, Homo sapiens
cagtcccagctgctcagaaggc

SEQ ID NO: 8517800 - DNA, 15 bp, Homo sapiens
cagtcccagggaccc

SEQ ID NO: 8517801 - DNA, 15 bp, Homo sapiens
cagtcccagggaccc

SEQ ID NO: 8517802 - DNA, 22 bp, Homo sapiens
cagtcccatctcccaggtggct

SEQ ID NO: 8517803 - DNA, 22 bp, Homo sapiens
cagtcccatctcccaggtggct

SEQ ID NO: 8517804 - DNA, 22 bp, Homo sapiens
cagtcccatgagcccagaacat

SEQ ID NO: 8517805 - DNA, 22 bp, Homo sapiens
cagtcccatctcccaggtggct

SEQ ID NO: 8517806 - DNA, 22 bp, Homo sapiens
cagtcccatgagcccagaacat

SEQ ID NO: 8517807 - DNA, 22 bp, Homo sapiens
cagtcccatgagcccagaacat

SEQ ID NO: 8517808 - DNA, 22 bp, Homo sapiens
cagtccctagtggagctcacag

SEQ ID NO: 8517809 - DNA, 22 bp, Homo sapiens
cagtctgggactgagctccacc

SEQ ID NO: 8517810 - DNA, 22 bp, Homo sapiens
cagtctgggactgagctccacc

SEQ ID NO: 8517811 - DNA, 22 bp, Homo sapiens
cagtctgggactgagctccacc

SEQ ID NO: 8517812 - DNA, 22 bp, Homo sapiens
cagtctgggactgagctccacc

SEQ ID NO: 8517813 - DNA, 22 bp, Homo sapiens
cagtctgggactgagctccacc

SEQ ID NO: 8517814 - DNA, 22 bp, Homo sapiens
cagtcttagaggtgactgtgga

SEQ ID NO: 8517815 - DNA, 22 bp, Homo sapiens
cagtctctcagctttcagctgt

SEQ ID NO: 8517816 - DNA, 22 bp, Homo sapiens
cagtctggaggtcagctggctt

SEQ ID NO: 8517817 - DNA, 22 bp, Homo sapiens
cagtctctctccttgcaggcgt

SEQ ID NO: 8517818 - DNA, 23 bp, Homo sapiens
cagtctgcagcccacttgggcag

SEQ ID NO: 8517819 - DNA, 22 bp, Homo sapiens
tcaaatgctgcctttgtgtgcc

SEQ ID NO: 8517820 - DNA, 22 bp, Homo sapiens
tcaaatgctgcctttgtgtgcc

SEQ ID NO: 8517821 - DNA, 22 bp, Homo sapiens
tcaaatgcttctactcctaaga

SEQ ID NO: 8517822 - DNA, 22 bp, Homo sapiens
tcaaatgctgtattgtagtaat

SEQ ID NO: 8517823 - DNA, 22 bp, Homo sapiens
tcaaatgctgtattgtagtaat

SEQ ID NO: 8517824 - DNA, 22 bp, Homo sapiens
tcaaatgctctttgcagagagg

SEQ ID NO: 8517825 - DNA, 22 bp, Homo sapiens
tcaaatgctcagactcctgtgg

SEQ ID NO: 8517826 - DNA, 22 bp, Homo sapiens
tcaaatgcggtcatggctttta

SEQ ID NO: 8517827 - DNA, 22 bp, Homo sapiens
tcaaatgcggtcatggctttta

SEQ ID NO: 8517828 - DNA, 22 bp, Homo sapiens
cagtgaacttgagtacttcatt

SEQ ID NO: 8517829 - DNA, 19 bp, Homo sapiens
tcaaatgccaatgtcacag

SEQ ID NO: 8517830 - DNA, 22 bp, Homo sapiens
cagtcttctaacctagcagcct

SEQ ID NO: 8517831 - DNA, 22 bp, Homo sapiens
cagtcttctaacctagcagcct

SEQ ID NO: 8517832 - DNA, 22 bp, Homo sapiens
cagtcttctaacctagcagcct

SEQ ID NO: 8517833 - DNA, 22 bp, Homo sapiens
cagtgaaatagtggacatcaaa

SEQ ID NO: 8517834 - DNA, 22 bp, Homo sapiens
cagtctttgttcccattactga

SEQ ID NO: 8517835 - DNA, 22 bp, Homo sapiens
tcaaatgttccctgtactggcc

SEQ ID NO: 8517836 - DNA, 22 bp, Homo sapiens
tcaaattagtggaataataatg

SEQ ID NO: 8517837 - DNA, 22 bp, Homo sapiens
tcaaattagtggaataataatg

SEQ ID NO: 8517838 - DNA, 22 bp, Homo sapiens
tcaaattagtggaataataatg

SEQ ID NO: 8517839 - DNA, 22 bp, Homo sapiens
cagtcccagacccagaaggtgg

SEQ ID NO: 8517840 - DNA, 22 bp, Homo sapiens
tcaaaggcattgccaataagta

SEQ ID NO: 8517841 - DNA, 22 bp, Homo sapiens
tcaaaggcattgccaataagta

SEQ ID NO: 8517842 - DNA, 22 bp, Homo sapiens
tcaaaggagacacaaggagaaa

SEQ ID NO: 8517843 - DNA, 23 bp, Homo sapiens
tcaaaggaggcatcgttctgcag

SEQ ID NO: 8517844 - DNA, 22 bp, Homo sapiens
tcaaaggaatttgattttgatg

SEQ ID NO: 8517845 - DNA, 22 bp, Homo sapiens
tcaaaggagacacaaggagaaa

SEQ ID NO: 8517846 - DNA, 22 bp, Homo sapiens
tcaaaggaaacacaagcttctg

SEQ ID NO: 8517847 - DNA, 22 bp, Homo sapiens
tcaaagcttagataatttcttt

SEQ ID NO: 8517848 - DNA, 22 bp, Homo sapiens
tcaaagcatcagtcaatttagg

SEQ ID NO: 8517849 - DNA, 22 bp, Homo sapiens
tcaaaacctaggctctctgctt

SEQ ID NO: 8517850 - DNA, 22 bp, Homo sapiens
tattcctaatttgcagggcatg

SEQ ID NO: 8517851 - DNA, 21 bp, Homo sapiens
tcaaagcacatatttgcacat

SEQ ID NO: 8517852 - DNA, 21 bp, Homo sapiens
tcaaagcacatatttgcacat

SEQ ID NO: 8517853 - DNA, 22 bp, Homo sapiens
tcaaagcaatttcaccagtgcc

SEQ ID NO: 8517854 - DNA, 19 bp, Homo sapiens
tcaaagcaagcatgttctg

SEQ ID NO: 8517855 - DNA, 22 bp, Homo sapiens
tattccaatgtcagttatatca

SEQ ID NO: 8517856 - DNA, 22 bp, Homo sapiens
tattccagatgaaatcattcag

SEQ ID NO: 8517857 - DNA, 22 bp, Homo sapiens
tattccaacttcactattgtct

SEQ ID NO: 8517858 - DNA, 22 bp, Homo sapiens
tattccaatgtcagttatatca

SEQ ID NO: 8517859 - DNA, 22 bp, Homo sapiens
tattcccaccctaagtagtagg

SEQ ID NO: 8517860 - DNA, 22 bp, Homo sapiens
tattcccattccacttatcaag

SEQ ID NO: 8517861 - DNA, 22 bp, Homo sapiens
tattcccagcctctttctatct

SEQ ID NO: 8517862 - DNA, 22 bp, Homo sapiens
tattccatgccagagtttattg

SEQ ID NO: 8517863 - DNA, 22 bp, Homo sapiens
cagtagcaggcactcagcacgt

SEQ ID NO: 8517864 - DNA, 22 bp, Homo sapiens
cagtagcaggatttgggattat

SEQ ID NO: 8517865 - DNA, 22 bp, Homo sapiens
cagtagcaggcaggtgcttttg

SEQ ID NO: 8517866 - DNA, 20 bp, Homo sapiens
cagtagcaataattagaagc

SEQ ID NO: 8517867 - DNA, 22 bp, Homo sapiens
cagtagcactagatatgtgtgg

SEQ ID NO: 8517868 - DNA, 22 bp, Homo sapiens
cagtagcactctgtcagtgaag

SEQ ID NO: 8517869 - DNA, 22 bp, Homo sapiens
cagtagcactctgtcagtgaag

SEQ ID NO: 8517870 - DNA, 22 bp, Homo sapiens
cagtagcatgcttatcttttga

SEQ ID NO: 8517871 - DNA, 22 bp, Homo sapiens
cagtagcagggattattttagg

SEQ ID NO: 8517872 - DNA, 22 bp, Homo sapiens
tattccaacttcactattgtct

SEQ ID NO: 8517873 - DNA, 22 bp, Homo sapiens
tattccaactgtcatagtcata

SEQ ID NO: 8517874 - DNA, 22 bp, Homo sapiens
cagtagatttggtaaactagga

SEQ ID NO: 8517875 - DNA, 22 bp, Homo sapiens
cagtagaattattataaaacat

SEQ ID NO: 8517876 - DNA, 22 bp, Homo sapiens
cagtacttggggggttctaagt

SEQ ID NO: 8517877 - DNA, 22 bp, Homo sapiens
cagtacttggtcaaggaagcag

SEQ ID NO: 8517878 - DNA, 22 bp, Homo sapiens
cagtactttgcatcattccact

SEQ ID NO: 8517879 - DNA, 20 bp, Homo sapiens
tatgaagatatgtgaacagc

SEQ ID NO: 8517880 - DNA, 22 bp, Homo sapiens
tatgaagatatatctgatctct

SEQ ID NO: 8517881 - DNA, 22 bp, Homo sapiens
tatgaagatatatctgatctct

SEQ ID NO: 8517882 - DNA, 22 bp, Homo sapiens
tatgaagaagttctgtgaaatg

SEQ ID NO: 8517883 - DNA, 22 bp, Homo sapiens
tatgaagaagttctgtgaaatg

SEQ ID NO: 8517884 - DNA, 22 bp, Homo sapiens
tatgaagacaatgatagcatga

SEQ ID NO: 8517885 - DNA, 22 bp, Homo sapiens
tatgaagacaatgatagcatga

SEQ ID NO: 8517886 - DNA, 22 bp, Homo sapiens
tatgaagatatatctgatctct

SEQ ID NO: 8517887 - DNA, 22 bp, Homo sapiens
tatgcaaagtcctaagaaagaa

SEQ ID NO: 8517888 - DNA, 22 bp, Homo sapiens
tatgcaaacagttcaggtgaca

SEQ ID NO: 8517889 - DNA, 22 bp, Homo sapiens
tatgatttgtagacatttgatt

SEQ ID NO: 8517890 - DNA, 22 bp, Homo sapiens
tatgcaaatcattagatttcct

SEQ ID NO: 8517891 - DNA, 22 bp, Homo sapiens
tatgcaaatgactggtatgttt

SEQ ID NO: 8517892 - DNA, 22 bp, Homo sapiens
tatgcaaagtcctaagaaagaa

SEQ ID NO: 8517893 - DNA, 22 bp, Homo sapiens
tatgcaaatcattagatttcct

SEQ ID NO: 8517894 - DNA, 22 bp, Homo sapiens
tatgcaacagcattattacaat

SEQ ID NO: 8517895 - DNA, 22 bp, Homo sapiens
tatgcaacatctggtagaaatc

SEQ ID NO: 8517896 - DNA, 22 bp, Homo sapiens
tatgcaattctcttaatattct

SEQ ID NO: 8517897 - DNA, 22 bp, Homo sapiens
tatgcaacatctggtagaaatc

SEQ ID NO: 8517898 - DNA, 22 bp, Homo sapiens
tatgcacacaggcttaattcat

SEQ ID NO: 8517899 - DNA, 22 bp, Homo sapiens
tatgcacaatatgatctatttg

SEQ ID NO: 8517900 - DNA, 22 bp, Homo sapiens
tatctgtatccccatctagcta

SEQ ID NO: 8517901 - DNA, 23 bp, Homo sapiens
tatctgtatttgttcactgctgt

SEQ ID NO: 8517902 - DNA, 22 bp, Homo sapiens
tatgaacacactttggaagtga

SEQ ID NO: 8517903 - DNA, 22 bp, Homo sapiens
tatgaacatgttcattgactta

SEQ ID NO: 8517904 - DNA, 22 bp, Homo sapiens
tatgaactttaagctctgtgtc

SEQ ID NO: 8517905 - DNA, 22 bp, Homo sapiens
tatgaacttttgatgtgacatg

SEQ ID NO: 8517906 - DNA, 22 bp, Homo sapiens
tatgaagaaacctatcctctag

SEQ ID NO: 8517907 - DNA, 22 bp, Homo sapiens
tatgaagaaacctatcctctag

SEQ ID NO: 8517908 - DNA, 22 bp, Homo sapiens
tatgaagaagacaaatgacact

SEQ ID NO: 8517909 - DNA, 22 bp, Homo sapiens
tatgaactgtgagtgtgatggg

SEQ ID NO: 8517910 - DNA, 22 bp, Homo sapiens
tatgaactgtactgtactaagc

SEQ ID NO: 8517911 - DNA, 22 bp, Homo sapiens
tatgaactgtgagtgtgatggg

SEQ ID NO: 8517912 - DNA, 22 bp, Homo sapiens
tatgaactgtaaccctcaccgc

SEQ ID NO: 8517913 - DNA, 22 bp, Homo sapiens
tatgaactgctcttgtgttttg

SEQ ID NO: 8517914 - DNA, 23 bp, Homo sapiens
tatgaactgcattgctggtgtgt

SEQ ID NO: 8517915 - DNA, 22 bp, Homo sapiens
tatattccagttcatctcttga

SEQ ID NO: 8517916 - DNA, 22 bp, Homo sapiens
tatattcattttaaagccatct

SEQ ID NO: 8517917 - DNA, 18 bp, Homo sapiens
tatattctgtgccctggt

SEQ ID NO: 8517918 - DNA, 22 bp, Homo sapiens
tatattcttaccagtgtatgta

SEQ ID NO: 8517919 - DNA, 18 bp, Homo sapiens
tatattctgtgccctggt

SEQ ID NO: 8517920 - DNA, 22 bp, Homo sapiens
tatattctgattccatctgtgt

SEQ ID NO: 8517921 - DNA, 22 bp, Homo sapiens
tatattgtaggtgctatttgaa

SEQ ID NO: 8517922 - DNA, 22 bp, Homo sapiens
tatattgggacttcaggacttt

SEQ ID NO: 8517923 - DNA, 22 bp, Homo sapiens
tatattgactttaaagaagcaa

SEQ ID NO: 8517924 - DNA, 22 bp, Homo sapiens
tatattgagatttgagcattgt

SEQ ID NO: 8517925 - DNA, 22 bp, Homo sapiens
tatattgaccagtacaattggt

SEQ ID NO: 8517926 - DNA, 22 bp, Homo sapiens
tatattctttcaccttcttcct

SEQ ID NO: 8517927 - DNA, 22 bp, Homo sapiens
tatattcttaccagtgtatgta

SEQ ID NO: 8517928 - DNA, 22 bp, Homo sapiens
tatgtacatgatttcatttgct

SEQ ID NO: 8517929 - DNA, 22 bp, Homo sapiens
tatgtacatgatttcatttgct

SEQ ID NO: 8517930 - DNA, 22 bp, Homo sapiens
tatgtacatgatttcatttgct

SEQ ID NO: 8517931 - DNA, 22 bp, Homo sapiens
tatgtacatgatttcatttgct

SEQ ID NO: 8517932 - DNA, 22 bp, Homo sapiens
tatgtacatcttgagcaatgaa

SEQ ID NO: 8517933 - DNA, 22 bp, Homo sapiens
tatgtacatcgttgaattcaaa

SEQ ID NO: 8517934 - DNA, 22 bp, Homo sapiens
tatgtacatcttgagcaatgaa

SEQ ID NO: 8517935 - DNA, 22 bp, Homo sapiens
tatgtacatggagagcaattga

SEQ ID NO: 8517936 - DNA, 22 bp, Homo sapiens
tatgtacatggagagcaattga

SEQ ID NO: 8517937 - DNA, 22 bp, Homo sapiens
tatgtacatgttaaagggcaaa

SEQ ID NO: 8517938 - DNA, 22 bp, Homo sapiens
cagtaaaagatggaaatagaat

SEQ ID NO: 8517939 - DNA, 22 bp, Homo sapiens
cagtaaaagatggaaatagaat

SEQ ID NO: 8517940 - DNA, 22 bp, Homo sapiens
cagtaaaagatggaaatagaat

SEQ ID NO: 8517941 - DNA, 22 bp, Homo sapiens
cagtacatttcatatgattcta

SEQ ID NO: 8517942 - DNA, 22 bp, Homo sapiens
cagtacatttcatatgattcta

SEQ ID NO: 8517943 - DNA, 22 bp, Homo sapiens
cagtacataatgcgcaaaaccg

SEQ ID NO: 8517944 - DNA, 22 bp, Homo sapiens
cagtaccagtcaccacattgat

SEQ ID NO: 8517945 - DNA, 22 bp, Homo sapiens
cagtacaatgttgaaaaggagt

SEQ ID NO: 8517946 - DNA, 22 bp, Homo sapiens
cagtacacaagctttcatgtat

SEQ ID NO: 8517947 - DNA, 22 bp, Homo sapiens
cagtacaattttacaaaggacg

SEQ ID NO: 8517948 - DNA, 22 bp, Homo sapiens
cagtaaaagatggaaatagaat

SEQ ID NO: 8517949 - DNA, 22 bp, Homo sapiens
cagtaattccaagtgcttatac

SEQ ID NO: 8517950 - DNA, 22 bp, Homo sapiens
caggtggggcgccctcaggcag

SEQ ID NO: 8517951 - DNA, 22 bp, Homo sapiens
caggtggggcgccctcaggcag

SEQ ID NO: 8517952 - DNA, 22 bp, Homo sapiens
tatgtacatcgttgaattcaaa

SEQ ID NO: 8517953 - DNA, 22 bp, Homo sapiens
tatgtacatcgttgaattcaaa

SEQ ID NO: 8517954 - DNA, 22 bp, Homo sapiens
tatgtacatcgttgaattcaaa

SEQ ID NO: 8517955 - DNA, 22 bp, Homo sapiens
tatgtacatcgttgaattcaaa

SEQ ID NO: 8517956 - DNA, 22 bp, Homo sapiens
caggtggggcagctgtgggagc

SEQ ID NO: 8517957 - DNA, 22 bp, Homo sapiens
caggtggggcagctgtgggagc

SEQ ID NO: 8517958 - DNA, 22 bp, Homo sapiens
caggtggggcagctgtgggagc

SEQ ID NO: 8517959 - DNA, 22 bp, Homo sapiens
caggtggggcagctgtgggagc

SEQ ID NO: 8517960 - DNA, 22 bp, Homo sapiens
caggtggggcagctgtgggagc

SEQ ID NO: 8517961 - DNA, 22 bp, Homo sapiens
caggtggggagagtgtggagca

SEQ ID NO: 8517962 - DNA, 22 bp, Homo sapiens
caggtggggagagtgtggagca

SEQ ID NO: 8517963 - DNA, 22 bp, Homo sapiens
caggtgggctgcctctccagct

SEQ ID NO: 8517964 - DNA, 22 bp, Homo sapiens
caggtgggcttgggagaacact

SEQ ID NO: 8517965 - DNA, 22 bp, Homo sapiens
caggtgggcttgggagaacact

SEQ ID NO: 8517966 - DNA, 22 bp, Homo sapiens
caggtggggagagtgtggagca

SEQ ID NO: 8517967 - DNA, 22 bp, Homo sapiens
caggtggggagagtgtggagca

SEQ ID NO: 8517968 - DNA, 22 bp, Homo sapiens
caggtgggcttgggagaacact

SEQ ID NO: 8517969 - DNA, 22 bp, Homo sapiens
tatgcacacatcgcagcaggaa

SEQ ID NO: 8517970 - DNA, 22 bp, Homo sapiens
caggtggcttattagggtcagt

SEQ ID NO: 8517971 - DNA, 22 bp, Homo sapiens
caggtggcttattagggtcagt

SEQ ID NO: 8517972 - DNA, 22 bp, Homo sapiens
caggtgggcgtggcgagaaggc

SEQ ID NO: 8517973 - DNA, 22 bp, Homo sapiens
caggtgggcgtggcgagaaggc

SEQ ID NO: 8517974 - DNA, 22 bp, Homo sapiens
caggtgggccggggtttgttct

SEQ ID NO: 8517975 - DNA, 22 bp, Homo sapiens
tatataattttctgccatatcc

SEQ ID NO: 8517976 - DNA, 22 bp, Homo sapiens
tatataatttgtaaaagcacct

SEQ ID NO: 8517977 - DNA, 22 bp, Homo sapiens
tatatacaaggtaggtttaggt

SEQ ID NO: 8517978 - DNA, 22 bp, Homo sapiens
tatatacaaggtaggtttaggt

SEQ ID NO: 8517979 - DNA, 22 bp, Homo sapiens
tatatacaaggtaggtttaggt

SEQ ID NO: 8517980 - DNA, 22 bp, Homo sapiens
tatatacaaggtaggtttaggt

SEQ ID NO: 8517981 - DNA, 22 bp, Homo sapiens
tatataactactattttgctca

SEQ ID NO: 8517982 - DNA, 22 bp, Homo sapiens
tatataagatgggtaggcttgt

SEQ ID NO: 8517983 - DNA, 21 bp, Homo sapiens
tatacatgtgtgcatacgtgt

SEQ ID NO: 8517984 - DNA, 22 bp, Homo sapiens
tagttttagcagcaatgggatg

SEQ ID NO: 8517985 - DNA, 22 bp, Homo sapiens
tatacagtttgagttcttgcat

SEQ ID NO: 8517986 - DNA, 22 bp, Homo sapiens
tatacagtttgagttcttgcat

SEQ ID NO: 8517987 - DNA, 22 bp, Homo sapiens
tatatagaaaagcagatgttgg

SEQ ID NO: 8517988 - DNA, 22 bp, Homo sapiens
tatatactttcttcctgggtag

SEQ ID NO: 8517989 - DNA, 22 bp, Homo sapiens
tatatagaaaagcagatgttgg

SEQ ID NO: 8517990 - DNA, 22 bp, Homo sapiens
tatattcaatgattagtatcag

SEQ ID NO: 8517991 - DNA, 22 bp, Homo sapiens
tatatatatgcacacacaccta

SEQ ID NO: 8517992 - DNA, 22 bp, Homo sapiens
tatatatatgcacacacaccta

SEQ ID NO: 8517993 - DNA, 22 bp, Homo sapiens
tatatatatgcacacacaccta

SEQ ID NO: 8517994 - DNA, 22 bp, Homo sapiens
tagttttacttgcgatgataat

SEQ ID NO: 8517995 - DNA, 22 bp, Homo sapiens
tagttttacttgcgatgataat

SEQ ID NO: 8517996 - DNA, 22 bp, Homo sapiens
tagtttgtaatgaggagaagta

SEQ ID NO: 8517997 - DNA, 22 bp, Homo sapiens
tagtttgtaatgaggagaagta

SEQ ID NO: 8517998 - DNA, 22 bp, Homo sapiens
tagtttgagaattgaaatagaa

SEQ ID NO: 8517999 - DNA, 22 bp, Homo sapiens
tagttttacatcagccattgtt

SEQ ID NO: 8518000 - DNA, 22 bp, Homo sapiens
tagtttgtagaaatctagaaat

SEQ ID NO: 8518001 - DNA, 22 bp, Homo sapiens
tagtttctgaggattgaaagat

SEQ ID NO: 8518002 - DNA, 22 bp, Homo sapiens
tagtttctgggttggcttctac

SEQ ID NO: 8518003 - DNA, 22 bp, Homo sapiens
tagtttctggttcttgctctgg

SEQ ID NO: 8518004 - DNA, 22 bp, Homo sapiens
tagtttcttcacctgtaaaatg

SEQ ID NO: 8518005 - DNA, 22 bp, Homo sapiens
tagtgtgtccctggggagtgtt

SEQ ID NO: 8518006 - DNA, 22 bp, Homo sapiens
tagtgtgtccctggggagtgtt

SEQ ID NO: 8518007 - DNA, 22 bp, Homo sapiens
tagtgtgtccctggggagtgtt

SEQ ID NO: 8518008 - DNA, 22 bp, Homo sapiens
tagtgtgtatggtaatgatgaa

SEQ ID NO: 8518009 - DNA, 22 bp, Homo sapiens
tagtgtggtatcttctatggaa

SEQ ID NO: 8518010 - DNA, 22 bp, Homo sapiens
tagtgttctaagaacatccatg

SEQ ID NO: 8518011 - DNA, 22 bp, Homo sapiens
tagtttctagtcaatcttcttt

SEQ ID NO: 8518012 - DNA, 22 bp, Homo sapiens
tagtgtggccccaagaggatct

SEQ ID NO: 8518013 - DNA, 22 bp, Homo sapiens
tagtgtggtatcttctatggaa

SEQ ID NO: 8518014 - DNA, 22 bp, Homo sapiens
tagtgtggtaaataaatgtttt

SEQ ID NO: 8518015 - DNA, 22 bp, Homo sapiens
tagtgtcttccaggacatggta

SEQ ID NO: 8518016 - DNA, 22 bp, Homo sapiens
tagtgtcttcaggagatatgag

SEQ ID NO: 8518017 - DNA, 22 bp, Homo sapiens
tagtgtctgaatgcacctgttt

SEQ ID NO: 8518018 - DNA, 22 bp, Homo sapiens
tagtgtctgatccgtagttaca

SEQ ID NO: 8518019 - DNA, 22 bp, Homo sapiens
tagtgtctgacatttaagagca

SEQ ID NO: 8518020 - DNA, 22 bp, Homo sapiens
tagtgtctgtccatcagtaact

SEQ ID NO: 8518021 - DNA, 21 bp, Homo sapiens
tagtgtcttaagagccttgca

SEQ ID NO: 8518022 - DNA, 22 bp, Homo sapiens
tagtgtctgttgcttttgttca

SEQ ID NO: 8518023 - DNA, 20 bp, Homo sapiens
cagggccacgctccaaggca

SEQ ID NO: 8518024 - DNA, 22 bp, Homo sapiens
taggtagtttcctgttgttggg

SEQ ID NO: 8518025 - DNA, 22 bp, Homo sapiens
cagggccaccctctgctgggtg

SEQ ID NO: 8518026 - DNA, 22 bp, Homo sapiens
cagggccaccctctgctgggtg

SEQ ID NO: 8518027 - DNA, 22 bp, Homo sapiens
cagggccaccgtgtttgctgct

SEQ ID NO: 8518028 - DNA, 22 bp, Homo sapiens
cagggccaccctctgctgggtg

SEQ ID NO: 8518029 - DNA, 22 bp, Homo sapiens
cagggccaagttggtgcctttt

SEQ ID NO: 8518030 - DNA, 21 bp, Homo sapiens
cagggccaatcctgacctcta

SEQ ID NO: 8518031 - DNA, 17 bp, Homo sapiens
tagtaaatgagtagagc

SEQ ID NO: 8518032 - DNA, 22 bp, Homo sapiens
taggtagttacacagcaatgta

SEQ ID NO: 8518033 - DNA, 22 bp, Homo sapiens
tagtaaatctcagaaaaagatc

SEQ ID NO: 8518034 - DNA, 22 bp, Homo sapiens
tagtaaatctcagaaaaagatc

SEQ ID NO: 8518035 - DNA, 22 bp, Homo sapiens
tagtaacagatttatacagtct

SEQ ID NO: 8518036 - DNA, 22 bp, Homo sapiens
tagtaacagatttatacagtct

SEQ ID NO: 8518037 - DNA, 22 bp, Homo sapiens
tagtaacagatttatacagtct

SEQ ID NO: 8518038 - DNA, 22 bp, Homo sapiens
tagtacactaccatcaggtttt

SEQ ID NO: 8518039 - DNA, 19 bp, Homo sapiens
tagtacacactctaattcc

SEQ ID NO: 8518040 - DNA, 22 bp, Homo sapiens
tagtaatcagaggtaaacttta

SEQ ID NO: 8518041 - DNA, 22 bp, Homo sapiens
tagtacagtactgggctctagt

SEQ ID NO: 8518042 - DNA, 22 bp, Homo sapiens
tagtacagagacactggaggaa

SEQ ID NO: 8518043 - DNA, 22 bp, Homo sapiens
tagtacagtactgggctctagt

SEQ ID NO: 8518044 - DNA, 22 bp, Homo sapiens
cagggctgagaatttagagaca

SEQ ID NO: 8518045 - DNA, 22 bp, Homo sapiens
cagggctgagaatttagagaca

SEQ ID NO: 8518046 - DNA, 22 bp, Homo sapiens
cagggctgagtcatatagcctt

SEQ ID NO: 8518047 - DNA, 22 bp, Homo sapiens
cagggctggatcctccagactc

SEQ ID NO: 8518048 - DNA, 22 bp, Homo sapiens
cagggctggatcctccagactc

SEQ ID NO: 8518049 - DNA, 22 bp, Homo sapiens
cagggctggatcctccagactc

SEQ ID NO: 8518050 - DNA, 22 bp, Homo sapiens
cagggctgctggccgtgccctc

SEQ ID NO: 8518051 - DNA, 22 bp, Homo sapiens
cagggctgctggccgtgccctc

SEQ ID NO: 8518052 - DNA, 22 bp, Homo sapiens
tagtgatttagaattcaaatgt

SEQ ID NO: 8518053 - DNA, 22 bp, Homo sapiens
tagtgtctcggggcccaggatt

SEQ ID NO: 8518054 - DNA, 22 bp, Homo sapiens
tagtgtctgaatgcacctgttt

SEQ ID NO: 8518055 - DNA, 22 bp, Homo sapiens
tagtgtctcttcctgtttgaaa

SEQ ID NO: 8518056 - DNA, 22 bp, Homo sapiens
tagtgtctattgaccggaaaga

SEQ ID NO: 8518057 - DNA, 22 bp, Homo sapiens
tagtgtctagtgagtttgatgc

SEQ ID NO: 8518058 - DNA, 22 bp, Homo sapiens
caggctccttcccagggatggt

SEQ ID NO: 8518059 - DNA, 22 bp, Homo sapiens
caggctccttcccagggatggt

SEQ ID NO: 8518060 - DNA, 22 bp, Homo sapiens
caggctcggaagtgctggcttt

SEQ ID NO: 8518061 - DNA, 22 bp, Homo sapiens
caggctcggtccagtggcaccc

SEQ ID NO: 8518062 - DNA, 20 bp, Homo sapiens
caggctccgcaggactaggg

SEQ ID NO: 8518063 - DNA, 23 bp, Homo sapiens
caggctcccggaccaggatccgc

SEQ ID NO: 8518064 - DNA, 22 bp, Homo sapiens
caggctcccgctccactgggca

SEQ ID NO: 8518065 - DNA, 22 bp, Homo sapiens
caggctccctgccagggccggc

SEQ ID NO: 8518066 - DNA, 22 bp, Homo sapiens
caggctccctgggcagtggcag

SEQ ID NO: 8518067 - DNA, 22 bp, Homo sapiens
tacagtttgtatggtcaggaat

SEQ ID NO: 8518068 - DNA, 22 bp, Homo sapiens
tacagtttgtatggtcaggaat

SEQ ID NO: 8518069 - DNA, 22 bp, Homo sapiens
tacagtttctgtccttgtggag

SEQ ID NO: 8518070 - DNA, 22 bp, Homo sapiens
tacagtttgtatggtcaggaat

SEQ ID NO: 8518071 - DNA, 22 bp, Homo sapiens
caggctccactgtaggcagctc

SEQ ID NO: 8518072 - DNA, 22 bp, Homo sapiens
caggctcccaccctcctgcagc

SEQ ID NO: 8518073 - DNA, 22 bp, Homo sapiens
tacagtttagaaccatagatgg

SEQ ID NO: 8518074 - DNA, 22 bp, Homo sapiens
tacagtttcccagcagatgcaa

SEQ ID NO: 8518075 - DNA, 22 bp, Homo sapiens
tacagtttcccagcagatgcaa

SEQ ID NO: 8518076 - DNA, 22 bp, Homo sapiens
tacagtttctgtccttgtggag

SEQ ID NO: 8518077 - DNA, 22 bp, Homo sapiens
tacagttcacagtatcataaat

SEQ ID NO: 8518078 - DNA, 22 bp, Homo sapiens
tacagttccaggatcatagggt

SEQ ID NO: 8518079 - DNA, 20 bp, Homo sapiens
tacagttctgtagaagtaga

SEQ ID NO: 8518080 - DNA, 22 bp, Homo sapiens
tacagtttacatgagaggaagc

SEQ ID NO: 8518081 - DNA, 22 bp, Homo sapiens
tacagtttacatgagaggaagc

SEQ ID NO: 8518082 - DNA, 22 bp, Homo sapiens
tacagtttaacactttggagaa

SEQ ID NO: 8518083 - DNA, 22 bp, Homo sapiens
tacagtttaacactttggagaa

SEQ ID NO: 8518084 - DNA, 22 bp, Homo sapiens
tacagttctttgaaggatctag

SEQ ID NO: 8518085 - DNA, 22 bp, Homo sapiens
tacagctgcaagggtttctggg

SEQ ID NO: 8518086 - DNA, 22 bp, Homo sapiens
caggcctggagtgcaatggcac

SEQ ID NO: 8518087 - DNA, 22 bp, Homo sapiens
caggcctggagtgcaatggcac

SEQ ID NO: 8518088 - DNA, 22 bp, Homo sapiens
caggcctgtctgcacatgaggc

SEQ ID NO: 8518089 - DNA, 22 bp, Homo sapiens
caggcctgtgacaccgtgtctg

SEQ ID NO: 8518090 - DNA, 22 bp, Homo sapiens
caggcctgtctgcacatgaggc

SEQ ID NO: 8518091 - DNA, 22 bp, Homo sapiens
caggcctgtctgcacatgaggc

SEQ ID NO: 8518092 - DNA, 22 bp, Homo sapiens
tacagctaggcaaaaatgacat

SEQ ID NO: 8518093 - DNA, 22 bp, Homo sapiens
tacagctatgtcttggtgttct

SEQ ID NO: 8518094 - DNA, 22 bp, Homo sapiens
tacagcctgatttggagccact

SEQ ID NO: 8518095 - DNA, 22 bp, Homo sapiens
tacagcctggcactaccctggg

SEQ ID NO: 8518096 - DNA, 22 bp, Homo sapiens
tacagcctgttacctatatttg

SEQ ID NO: 8518097 - DNA, 22 bp, Homo sapiens
tacagccttcatctttgccttg

SEQ ID NO: 8518098 - DNA, 22 bp, Homo sapiens
tacagcctcttccctggagtgg

SEQ ID NO: 8518099 - DNA, 22 bp, Homo sapiens
tacagcctcgaactcctgcatt

SEQ ID NO: 8518100 - DNA, 22 bp, Homo sapiens
tacagccatggttaatttacct

SEQ ID NO: 8518101 - DNA, 20 bp, Homo sapiens
tacagcctattcaccacata

SEQ ID NO: 8518102 - DNA, 22 bp, Homo sapiens
tacagcctcacatttacttaca

SEQ ID NO: 8518103 - DNA, 22 bp, Homo sapiens
tacagcctccacaggccaagtg

SEQ ID NO: 8518104 - DNA, 22 bp, Homo sapiens
tacagcctcatcacgggagctg

SEQ ID NO: 8518105 - DNA, 22 bp, Homo sapiens
tacagcatgtccttagcaaggc

SEQ ID NO: 8518106 - DNA, 22 bp, Homo sapiens
tacagcatgtccttagcaaggc

SEQ ID NO: 8518107 - DNA, 22 bp, Homo sapiens
tacagcattgtgtcttcactca

SEQ ID NO: 8518108 - DNA, 22 bp, Homo sapiens
tacagcattgcattttcctttg

SEQ ID NO: 8518109 - DNA, 22 bp, Homo sapiens
tacagcattaacaggctgttta

SEQ ID NO: 8518110 - DNA, 22 bp, Homo sapiens
tacagccatcatgtatgtatat

SEQ ID NO: 8518111 - DNA, 22 bp, Homo sapiens
tacagcattttgtagagtacta

SEQ ID NO: 8518112 - DNA, 22 bp, Homo sapiens
tacagagagataagtgtaaaag

SEQ ID NO: 8518113 - DNA, 22 bp, Homo sapiens
tacagagagaggggttaccagg

SEQ ID NO: 8518114 - DNA, 22 bp, Homo sapiens
tacagagactttatggcacaaa

SEQ ID NO: 8518115 - DNA, 22 bp, Homo sapiens
tacagagacccacaagagactg

SEQ ID NO: 8518116 - DNA, 22 bp, Homo sapiens
tacagagacccacaagagactg

SEQ ID NO: 8518117 - DNA, 22 bp, Homo sapiens
tacagagaataataggacaggt

SEQ ID NO: 8518118 - DNA, 22 bp, Homo sapiens
tacagagaggtgacccttgggc

SEQ ID NO: 8518119 - DNA, 22 bp, Homo sapiens
tacagagagctccggacattca

SEQ ID NO: 8518120 - DNA, 22 bp, Homo sapiens
tacagcatgatcacaatggaaa

SEQ ID NO: 8518121 - DNA, 22 bp, Homo sapiens
tacagcatgatcacaatggaaa

SEQ ID NO: 8518122 - DNA, 22 bp, Homo sapiens
tacagcatatacagaatgaaca

SEQ ID NO: 8518123 - DNA, 22 bp, Homo sapiens
tacacagactcttcaattcaga

SEQ ID NO: 8518124 - DNA, 22 bp, Homo sapiens
tacacagaagccagaaggcctg

SEQ ID NO: 8518125 - DNA, 22 bp, Homo sapiens
tacacagaagccagaaggcctg

SEQ ID NO: 8518126 - DNA, 22 bp, Homo sapiens
tacacagaacctggtgtacagt

SEQ ID NO: 8518127 - DNA, 22 bp, Homo sapiens
tacaatatgtgaactttggtgt

SEQ ID NO: 8518128 - DNA, 22 bp, Homo sapiens
gtggagccaggggctgtaggta

SEQ ID NO: 8518129 - DNA, 22 bp, Homo sapiens
tacacagaggctgatgtcttag

SEQ ID NO: 8518130 - DNA, 22 bp, Homo sapiens
tacacagatatgtgatcaatca

SEQ ID NO: 8518131 - DNA, 22 bp, Homo sapiens
tacacagatatgtgatcaatca

SEQ ID NO: 8518132 - DNA, 22 bp, Homo sapiens
tacacagactcttcaattcaga

SEQ ID NO: 8518133 - DNA, 22 bp, Homo sapiens
tacacagactcttcaattcaga

SEQ ID NO: 8518134 - DNA, 22 bp, Homo sapiens
tacacagaggctgatgtcttag

SEQ ID NO: 8518135 - DNA, 22 bp, Homo sapiens
caggccaaagatcccattgaca

SEQ ID NO: 8518136 - DNA, 22 bp, Homo sapiens
caggccaaaattcaggcattct

SEQ ID NO: 8518137 - DNA, 22 bp, Homo sapiens
caggccaactgcatggtgacca

SEQ ID NO: 8518138 - DNA, 22 bp, Homo sapiens
caggccaaagatcccattgaca

SEQ ID NO: 8518139 - DNA, 22 bp, Homo sapiens
caggccaagtcccaagtgcggg

SEQ ID NO: 8518140 - DNA, 22 bp, Homo sapiens
caggccaataaatgtgatggcc

SEQ ID NO: 8518141 - DNA, 22 bp, Homo sapiens
caggccaagcctccccagctcc

SEQ ID NO: 8518142 - DNA, 22 bp, Homo sapiens
caggccaactgcatggtgacca

SEQ ID NO: 8518143 - DNA, 22 bp, Homo sapiens
tacacagggagagattggaaac

SEQ ID NO: 8518144 - DNA, 22 bp, Homo sapiens
tacacagatttcagtatcatca

SEQ ID NO: 8518145 - DNA, 22 bp, Homo sapiens
tacacagatttcagtatcatca

SEQ ID NO: 8518146 - DNA, 22 bp, Homo sapiens
tacacagatttaaaagcaggga

SEQ ID NO: 8518147 - DNA, 20 bp, Homo sapiens
gtggagaggctggcgggact

SEQ ID NO: 8518148 - DNA, 21 bp, Homo sapiens
gtggagagtgattttgatgca

SEQ ID NO: 8518149 - DNA, 21 bp, Homo sapiens
gtggagagtgattttgatgca

SEQ ID NO: 8518150 - DNA, 20 bp, Homo sapiens
gtggagaggctggcgggact

SEQ ID NO: 8518151 - DNA, 20 bp, Homo sapiens
gtggagaggctggcgggact

SEQ ID NO: 8518152 - DNA, 20 bp, Homo sapiens
gtggagaggctggcgggact

SEQ ID NO: 8518153 - DNA, 22 bp, Homo sapiens
gtggagaggagcagctacctca

SEQ ID NO: 8518154 - DNA, 22 bp, Homo sapiens
gtggagcaggactagctgagaa

SEQ ID NO: 8518155 - DNA, 22 bp, Homo sapiens
gtggagcaatcagagggtcagt

SEQ ID NO: 8518156 - DNA, 22 bp, Homo sapiens
gtggagcatgtgaggactgagt

SEQ ID NO: 8518157 - DNA, 22 bp, Homo sapiens
gtggagcataacacactagcct

SEQ ID NO: 8518158 - DNA, 22 bp, Homo sapiens
gtggagcaggactagctgagaa

SEQ ID NO: 8518159 - DNA, 22 bp, Homo sapiens
gtggagcaggactagctgagaa

SEQ ID NO: 8518160 - DNA, 23 bp, Homo sapiens
gtggagccacatcacaggctcct

SEQ ID NO: 8518161 - DNA, 22 bp, Homo sapiens
gtggagccaggatctccgcaca

SEQ ID NO: 8518162 - DNA, 22 bp, Homo sapiens
gtggagccaggatctccgcaca

SEQ ID NO: 8518163 - DNA, 23 bp, Homo sapiens
gtggagccacatcacaggctcct

SEQ ID NO: 8518164 - DNA, 23 bp, Homo sapiens
gtggagccacatcacaggctcct

SEQ ID NO: 8518165 - DNA, 22 bp, Homo sapiens
gtggagcatgtgaggactgagt

SEQ ID NO: 8518166 - DNA, 22 bp, Homo sapiens
gtggagcatgtgaggactgagt

SEQ ID NO: 8518167 - DNA, 22 bp, Homo sapiens
cagctctgccacttcctagcta

SEQ ID NO: 8518168 - DNA, 22 bp, Homo sapiens
cagctctgccacttcctagcta

SEQ ID NO: 8518169 - DNA, 22 bp, Homo sapiens
cagctctgccacttcctagcta

SEQ ID NO: 8518170 - DNA, 22 bp, Homo sapiens
cagctctgccacttcctagcta

SEQ ID NO: 8518171 - DNA, 17 bp, Homo sapiens
cagctctgcatcttcct

SEQ ID NO: 8518172 - DNA, 17 bp, Homo sapiens
cagctctgcatcttcct

SEQ ID NO: 8518173 - DNA, 22 bp, Homo sapiens
cagctctgccatcatctgcctt

SEQ ID NO: 8518174 - DNA, 22 bp, Homo sapiens
cagctctgcctctggggctgag

SEQ ID NO: 8518175 - DNA, 22 bp, Homo sapiens
cagctctgctgggaggatgcag

SEQ ID NO: 8518176 - DNA, 22 bp, Homo sapiens
gtggagaggagcagctacctca

SEQ ID NO: 8518177 - DNA, 22 bp, Homo sapiens
gtggagaggagcagctacctca

SEQ ID NO: 8518178 - DNA, 22 bp, Homo sapiens
caggccctcctgtgatctgcct

SEQ ID NO: 8518179 - DNA, 22 bp, Homo sapiens
caggccctcgcccgcagcgacc

SEQ ID NO: 8518180 - DNA, 22 bp, Homo sapiens
caggccctcgtggtgagctggg

SEQ ID NO: 8518181 - DNA, 22 bp, Homo sapiens
caggccacagctaaagaggatt

SEQ ID NO: 8518182 - DNA, 22 bp, Homo sapiens
caggccacacggcggctccctg

SEQ ID NO: 8518183 - DNA, 22 bp, Homo sapiens
caggccacagctaaagaggatt

SEQ ID NO: 8518184 - DNA, 22 bp, Homo sapiens
caggccaatatcacatgctatg

SEQ ID NO: 8518185 - DNA, 22 bp, Homo sapiens
caggccaatatcacatgctatg

SEQ ID NO: 8518186 - DNA, 22 bp, Homo sapiens
caggccacaagttgggttcaag

SEQ ID NO: 8518187 - DNA, 22 bp, Homo sapiens
caggccacaagttgggttcaag

SEQ ID NO: 8518188 - DNA, 22 bp, Homo sapiens
caggcccaggggtctggcccac

SEQ ID NO: 8518189 - DNA, 22 bp, Homo sapiens
caggccacgccccggcgtgtga

SEQ ID NO: 8518190 - DNA, 22 bp, Homo sapiens
caggccaccagatacatgcccc

SEQ ID NO: 8518191 - DNA, 22 bp, Homo sapiens
tacactgtacgctctgcttcaa

SEQ ID NO: 8518192 - DNA, 22 bp, Homo sapiens
tacactgtaggtggcaggcagc

SEQ ID NO: 8518193 - DNA, 22 bp, Homo sapiens
tacactgtgacaatcatgacag

SEQ ID NO: 8518194 - DNA, 22 bp, Homo sapiens
tacactgtgacaatcatgacag

SEQ ID NO: 8518195 - DNA, 22 bp, Homo sapiens
tacactgtgacaatcatgacag

SEQ ID NO: 8518196 - DNA, 22 bp, Homo sapiens
tacactgtcagatttcgattgc

SEQ ID NO: 8518197 - DNA, 22 bp, Homo sapiens
tacactgtcttagaaaggggca

SEQ ID NO: 8518198 - DNA, 22 bp, Homo sapiens
tacactgtggtaaactcaaagt

SEQ ID NO: 8518199 - DNA, 22 bp, Homo sapiens
tacactgtgtaaaatgcacttt

SEQ ID NO: 8518200 - DNA, 22 bp, Homo sapiens
tacactgtgtaaaatgcacttt

SEQ ID NO: 8518201 - DNA, 22 bp, Homo sapiens
tacactgtggtaaactcaaagt

SEQ ID NO: 8518202 - DNA, 22 bp, Homo sapiens
tacactgtgaggtttccaaggg

SEQ ID NO: 8518203 - DNA, 22 bp, Homo sapiens
tacagacatttactccactcct

SEQ ID NO: 8518204 - DNA, 22 bp, Homo sapiens
tacagagaactcatagaaagaa

SEQ ID NO: 8518205 - DNA, 22 bp, Homo sapiens
tacagagaactcatagaaagaa

SEQ ID NO: 8518206 - DNA, 22 bp, Homo sapiens
tacacttgttcaaacagcaaaa

SEQ ID NO: 8518207 - DNA, 19 bp, Homo sapiens
tacacttgtaatgagcaga

SEQ ID NO: 8518208 - DNA, 22 bp, Homo sapiens
tacacttgttcaaacagcaaaa

SEQ ID NO: 8518209 - DNA, 22 bp, Homo sapiens
tacacttataactctgtgtgtg

SEQ ID NO: 8518210 - DNA, 22 bp, Homo sapiens
tacacttataactctgtgtgtg

SEQ ID NO: 8518211 - DNA, 22 bp, Homo sapiens
tacactgtttttggaaagaaga

SEQ ID NO: 8518212 - DNA, 22 bp, Homo sapiens
tacactgtttttggaaagaaga

SEQ ID NO: 8518213 - DNA, 22 bp, Homo sapiens
tacactgtttgaactgtggtcg

SEQ ID NO: 8518214 - DNA, 22 bp, Homo sapiens
tacactttatggatcctacttt

SEQ ID NO: 8518215 - DNA, 22 bp, Homo sapiens
tacagacattcaattttgaccc

SEQ ID NO: 8518216 - DNA, 22 bp, Homo sapiens
cagggcagtttgtgcctatgag

SEQ ID NO: 8518217 - DNA, 22 bp, Homo sapiens
cagggcagtttgtgcctatgag

SEQ ID NO: 8518218 - DNA, 22 bp, Homo sapiens
cagggcagtgaagaacacacgt

SEQ ID NO: 8518219 - DNA, 22 bp, Homo sapiens
cagggcagtgaagaacacacgt

SEQ ID NO: 8518220 - DNA, 22 bp, Homo sapiens
cagggcagtaccgccctctggc

SEQ ID NO: 8518221 - DNA, 22 bp, Homo sapiens
cagggcagtaccgccctctggc

SEQ ID NO: 8518222 - DNA, 22 bp, Homo sapiens
cagggcagtaccgccctctggc

SEQ ID NO: 8518223 - DNA, 22 bp, Homo sapiens
cagggcaggacagatacattac

SEQ ID NO: 8518224 - DNA, 22 bp, Homo sapiens
cagggcaggacagatacattac

SEQ ID NO: 8518225 - DNA, 22 bp, Homo sapiens
cagggcagtaccgccctctggc

SEQ ID NO: 8518226 - DNA, 22 bp, Homo sapiens
cagggcatccgtgctccatgct

SEQ ID NO: 8518227 - DNA, 22 bp, Homo sapiens
cagggcatgaggtgtgcttctc

SEQ ID NO: 8518228 - DNA, 22 bp, Homo sapiens
cagggccaagcccctttggctg

SEQ ID NO: 8518229 - DNA, 22 bp, Homo sapiens
cagggccaagctgcagcatctg

SEQ ID NO: 8518230 - DNA, 22 bp, Homo sapiens
cagggcagttttacttctctct

SEQ ID NO: 8518231 - DNA, 22 bp, Homo sapiens
cagggcagttttacttctctct

SEQ ID NO: 8518232 - DNA, 22 bp, Homo sapiens
cagggcagttttacttctctct

SEQ ID NO: 8518233 - DNA, 22 bp, Homo sapiens
cagggcagtttgtgcctatgag

SEQ ID NO: 8518234 - DNA, 22 bp, Homo sapiens
tagcatctttttctgtcttcta

SEQ ID NO: 8518235 - DNA, 22 bp, Homo sapiens
tagcatctttttctgtcttcta

SEQ ID NO: 8518236 - DNA, 22 bp, Homo sapiens
tagcattaaaggtaagacatta

SEQ ID NO: 8518237 - DNA, 22 bp, Homo sapiens
tagcatctaacatcttaggact

SEQ ID NO: 8518238 - DNA, 22 bp, Homo sapiens
tagcatctcaacctcctgaaag

SEQ ID NO: 8518239 - DNA, 22 bp, Homo sapiens
tagcatctccttagggtaagga

SEQ ID NO: 8518240 - DNA, 22 bp, Homo sapiens
tagcatctgcatttgtaactag

SEQ ID NO: 8518241 - DNA, 22 bp, Homo sapiens
tagcatctgaactgttgaaaag

SEQ ID NO: 8518242 - DNA, 21 bp, Homo sapiens
tagcatctctactgtcataga

SEQ ID NO: 8518243 - DNA, 22 bp, Homo sapiens
tagcatcttgatttcagaccag

SEQ ID NO: 8518244 - DNA, 22 bp, Homo sapiens
tagcatctgtttctctttgtga

SEQ ID NO: 8518245 - DNA, 22 bp, Homo sapiens
tagcatctgttctttcattaaa

SEQ ID NO: 8518246 - DNA, 22 bp, Homo sapiens
tagcatctgtactgacataatc

SEQ ID NO: 8518247 - DNA, 22 bp, Homo sapiens
tagcatctgtactgacataatc

SEQ ID NO: 8518248 - DNA, 22 bp, Homo sapiens
tagcatctggagaaacaagtcc

SEQ ID NO: 8518249 - DNA, 22 bp, Homo sapiens
tagcatctggagaaacaagtcc

SEQ ID NO: 8518250 - DNA, 22 bp, Homo sapiens
tagcatctgcgttgggttggac

SEQ ID NO: 8518251 - DNA, 22 bp, Homo sapiens
tagcagcacctacacgtcagag

SEQ ID NO: 8518252 - DNA, 22 bp, Homo sapiens
tagcagcacctttctaatctga

SEQ ID NO: 8518253 - DNA, 20 bp, Homo sapiens
tagcagcagaaagaacttag

SEQ ID NO: 8518254 - DNA, 22 bp, Homo sapiens
tagcagcaggggaaacagctgt

SEQ ID NO: 8518255 - DNA, 22 bp, Homo sapiens
tagcagcaggggaaacagctgt

SEQ ID NO: 8518256 - DNA, 22 bp, Homo sapiens
tagcataacaggtaagagtgag

SEQ ID NO: 8518257 - DNA, 22 bp, Homo sapiens
tagcatcagccacaccttgtac

SEQ ID NO: 8518258 - DNA, 22 bp, Homo sapiens
tagcataatttgtagaaaatca

SEQ ID NO: 8518259 - DNA, 22 bp, Homo sapiens
tagcagtgtctaggtaggccat

SEQ ID NO: 8518260 - DNA, 22 bp, Homo sapiens
cagggagtttttgttcctctag

SEQ ID NO: 8518261 - DNA, 22 bp, Homo sapiens
cagggatgaccagagggatgtg

SEQ ID NO: 8518262 - DNA, 22 bp, Homo sapiens
cagggatgaccagagggatgtg

SEQ ID NO: 8518263 - DNA, 22 bp, Homo sapiens
cagggaggctgtcttatgcctg

SEQ ID NO: 8518264 - DNA, 22 bp, Homo sapiens
cagggagtcaacaaacagatca

SEQ ID NO: 8518265 - DNA, 22 bp, Homo sapiens
cagggagggacaattgtcacct

SEQ ID NO: 8518266 - DNA, 23 bp, Homo sapiens
cagggaggagatactgtgtatct

SEQ ID NO: 8518267 - DNA, 22 bp, Homo sapiens
cagggaggatgggctgttttgc

SEQ ID NO: 8518268 - DNA, 22 bp, Homo sapiens
cagggagcctgaatgttccagg

SEQ ID NO: 8518269 - DNA, 22 bp, Homo sapiens
tagacatttgtcaagaatgact

SEQ ID NO: 8518270 - DNA, 22 bp, Homo sapiens
cagggagctttgtcttctcatt

SEQ ID NO: 8518271 - DNA, 22 bp, Homo sapiens
cagggatgctgcttaggcagtt

SEQ ID NO: 8518272 - DNA, 22 bp, Homo sapiens
cagggatgctgcttaggcagtt

SEQ ID NO: 8518273 - DNA, 22 bp, Homo sapiens
cagggatgctgcttaggcagtt

SEQ ID NO: 8518274 - DNA, 22 bp, Homo sapiens
cagggatggcctggcgggccac

SEQ ID NO: 8518275 - DNA, 22 bp, Homo sapiens
cagggatgagagatggcacaga

SEQ ID NO: 8518276 - DNA, 22 bp, Homo sapiens
cagggatgagagatggcacaga

SEQ ID NO: 8518277 - DNA, 22 bp, Homo sapiens
cagggatgagcagatggagcaa

SEQ ID NO: 8518278 - DNA, 22 bp, Homo sapiens
cagggatgagcagatggagcaa

SEQ ID NO: 8518279 - DNA, 22 bp, Homo sapiens
tagcagcaattcaggtgtgatg

SEQ ID NO: 8518280 - DNA, 22 bp, Homo sapiens
tagcagcaattacacagtccgt

SEQ ID NO: 8518281 - DNA, 22 bp, Homo sapiens
tagcagcacaaatggactatga

SEQ ID NO: 8518282 - DNA, 22 bp, Homo sapiens
tagcaatgtgttgacttggtca

SEQ ID NO: 8518283 - DNA, 22 bp, Homo sapiens
tagcaatgtgttgacttggtca

SEQ ID NO: 8518284 - DNA, 22 bp, Homo sapiens
tagcagcaaagcaggatctgct

SEQ ID NO: 8518285 - DNA, 22 bp, Homo sapiens
tagcagcaaaatgaccttctaa

SEQ ID NO: 8518286 - DNA, 22 bp, Homo sapiens
tagacagtgagctatgagtggt

SEQ ID NO: 8518287 - DNA, 22 bp, Homo sapiens
tagacagggtggcttagaaaca

SEQ ID NO: 8518288 - DNA, 22 bp, Homo sapiens
tagacatacagtgcagtacata

SEQ ID NO: 8518289 - DNA, 22 bp, Homo sapiens
tagacattaggtaggttcatgg

SEQ ID NO: 8518290 - DNA, 22 bp, Homo sapiens
tagacattatgtattaagttct

SEQ ID NO: 8518291 - DNA, 22 bp, Homo sapiens
tagacatttctggttattgaca

SEQ ID NO: 8518292 - DNA, 22 bp, Homo sapiens
tagacattatgtattaagttct

SEQ ID NO: 8518293 - DNA, 22 bp, Homo sapiens
tagacatttctggttattgaca

SEQ ID NO: 8518294 - DNA, 22 bp, Homo sapiens
tagacatttgaatgtgaaatga

SEQ ID NO: 8518295 - DNA, 22 bp, Homo sapiens
tagacatttggagttttatgac

SEQ ID NO: 8518296 - DNA, 22 bp, Homo sapiens
cagggagaggcctctgttgccc

SEQ ID NO: 8518297 - DNA, 22 bp, Homo sapiens
cagggagaggctggtggagtaa

SEQ ID NO: 8518298 - DNA, 22 bp, Homo sapiens
cagggagaggcctctgttgccc

SEQ ID NO: 8518299 - DNA, 22 bp, Homo sapiens
cagggagatcttggctcctggt

SEQ ID NO: 8518300 - DNA, 22 bp, Homo sapiens
cagggagaggctggtggagtaa

SEQ ID NO: 8518301 - DNA, 22 bp, Homo sapiens
cagggagaggcctctgttgccc

SEQ ID NO: 8518302 - DNA, 22 bp, Homo sapiens
cagggagaggcatcatagggaa

SEQ ID NO: 8518303 - DNA, 22 bp, Homo sapiens
cagggagaggcatcatagggaa

SEQ ID NO: 8518304 - DNA, 22 bp, Homo sapiens
cagggagaggcatcatagggaa

SEQ ID NO: 8518305 - DNA, 22 bp, Homo sapiens
cagggagaagtctggtcagtcc

SEQ ID NO: 8518306 - DNA, 22 bp, Homo sapiens
cagggagaagtctggtcagtcc

SEQ ID NO: 8518307 - DNA, 22 bp, Homo sapiens
cagggagaaatctccaggaggt

SEQ ID NO: 8518308 - DNA, 22 bp, Homo sapiens
cagggagaaatctccaggaggt

SEQ ID NO: 8518309 - DNA, 22 bp, Homo sapiens
cagggacagccttggggtggcg

SEQ ID NO: 8518310 - DNA, 22 bp, Homo sapiens
tagaacagagggttgcccagat

SEQ ID NO: 8518311 - DNA, 22 bp, Homo sapiens
tagaacagagttccagtgatca

SEQ ID NO: 8518312 - DNA, 22 bp, Homo sapiens
tagaaatgttggtattaacatt

SEQ ID NO: 8518313 - DNA, 22 bp, Homo sapiens
tagaaatgttggtattaacatt

SEQ ID NO: 8518314 - DNA, 22 bp, Homo sapiens
tagaaatgttggtattaacatt

SEQ ID NO: 8518315 - DNA, 22 bp, Homo sapiens
tagaaatgttggtattaacatt

SEQ ID NO: 8518316 - DNA, 22 bp, Homo sapiens
tagaaatgttagatgtattgag

SEQ ID NO: 8518317 - DNA, 22 bp, Homo sapiens
tagaaagcagtatctccatttt

SEQ ID NO: 8518318 - DNA, 22 bp, Homo sapiens
tagaaatgtcgtctccacattt

SEQ ID NO: 8518319 - DNA, 22 bp, Homo sapiens
caggctgagggttaggccttag

SEQ ID NO: 8518320 - DNA, 22 bp, Homo sapiens
caggctgaggcagtagggtttg

SEQ ID NO: 8518321 - DNA, 22 bp, Homo sapiens
caggctgatcagggctgggatg

SEQ ID NO: 8518322 - DNA, 22 bp, Homo sapiens
caggctgatcagggctgggatg

SEQ ID NO: 8518323 - DNA, 22 bp, Homo sapiens
caggctgatcagggctgggatg

SEQ ID NO: 8518324 - DNA, 22 bp, Homo sapiens
caggctgatagggtccaaagtt

SEQ ID NO: 8518325 - DNA, 22 bp, Homo sapiens
caggctgattaggcctcgtcca

SEQ ID NO: 8518326 - DNA, 22 bp, Homo sapiens
caggctgcaagaaaggcattca

SEQ ID NO: 8518327 - DNA, 22 bp, Homo sapiens
caggctgcagaggcctttcatg

SEQ ID NO: 8518328 - DNA, 22 bp, Homo sapiens
caggctgattaggcctcgtcca

SEQ ID NO: 8518329 - DNA, 22 bp, Homo sapiens
caggctgcagaggcctttcatg

SEQ ID NO: 8518330 - DNA, 22 bp, Homo sapiens
caggctgcagcagcagtggccc

SEQ ID NO: 8518331 - DNA, 22 bp, Homo sapiens
caggctgcagcagcagtggccc

SEQ ID NO: 8518332 - DNA, 22 bp, Homo sapiens
taccctctcccggtccagcttt

SEQ ID NO: 8518333 - DNA, 22 bp, Homo sapiens
taccctctcccggtccagcttt

SEQ ID NO: 8518334 - DNA, 22 bp, Homo sapiens
taccctggagcaagtttcctca

SEQ ID NO: 8518335 - DNA, 22 bp, Homo sapiens
taccctgctagctagcatctct

SEQ ID NO: 8518336 - DNA, 22 bp, Homo sapiens
tacctagacatgaacacagatg

SEQ ID NO: 8518337 - DNA, 20 bp, Homo sapiens
taccctggctatgcttctga

SEQ ID NO: 8518338 - DNA, 19 bp, Homo sapiens
taccctcagggcctcattt

SEQ ID NO: 8518339 - DNA, 22 bp, Homo sapiens
taccctctcccggtccagcttt

SEQ ID NO: 8518340 - DNA, 22 bp, Homo sapiens
tacccagttccacacactgatg

SEQ ID NO: 8518341 - DNA, 22 bp, Homo sapiens
tacccaggagaaacagcagggc

SEQ ID NO: 8518342 - DNA, 22 bp, Homo sapiens
caggctgcagcagcagtggccc

SEQ ID NO: 8518343 - DNA, 22 bp, Homo sapiens
tagaaagactgtccagatttca

SEQ ID NO: 8518344 - DNA, 22 bp, Homo sapiens
tagaaagactgtccagatttca

SEQ ID NO: 8518345 - DNA, 22 bp, Homo sapiens
tagaaagcagaaaccatcagag

SEQ ID NO: 8518346 - DNA, 22 bp, Homo sapiens
tagaaagcagaaaccatcagag

SEQ ID NO: 8518347 - DNA, 22 bp, Homo sapiens
tagaaagcaaaatcctaccaag

SEQ ID NO: 8518348 - DNA, 22 bp, Homo sapiens
tagaaagatctgtaggcaagag

SEQ ID NO: 8518349 - DNA, 22 bp, Homo sapiens
tacctagaccagttacaatgca

SEQ ID NO: 8518350 - DNA, 22 bp, Homo sapiens
tacctcaagttccaggaaagcg

SEQ ID NO: 8518351 - DNA, 22 bp, Homo sapiens
tacctcaagttccaggaaagcg

SEQ ID NO: 8518352 - DNA, 22 bp, Homo sapiens
tacctcaagttccaggaaagcg

SEQ ID NO: 8518353 - DNA, 22 bp, Homo sapiens
tacctcaagttccaggaaagcg

SEQ ID NO: 8518354 - DNA, 22 bp, Homo sapiens
tacctcagattgctgccttggg

SEQ ID NO: 8518355 - DNA, 22 bp, Homo sapiens
tacctcaagttccaggaaagcg

SEQ ID NO: 8518356 - DNA, 22 bp, Homo sapiens
tacctctcggggtctgtttgtg

SEQ ID NO: 8518357 - DNA, 22 bp, Homo sapiens
tacctctctaaacccagggaca

SEQ ID NO: 8518358 - DNA, 22 bp, Homo sapiens
tacctctctaaacccagggaca

SEQ ID NO: 8518359 - DNA, 22 bp, Homo sapiens
tagaaagaacttcatgtaaaac

SEQ ID NO: 8518360 - DNA, 22 bp, Homo sapiens
tagaaagaacttcatgtaaaac

SEQ ID NO: 8518361 - DNA, 22 bp, Homo sapiens
tagaaagacaatgggaagtgct

SEQ ID NO: 8518362 - DNA, 22 bp, Homo sapiens
tagaaagaacttcatgtaaaac

SEQ ID NO: 8518363 - DNA, 22 bp, Homo sapiens
tagaaacaagggagaggattct

SEQ ID NO: 8518364 - DNA, 22 bp, Homo sapiens
tagaaacaagggagaggattct

SEQ ID NO: 8518365 - DNA, 22 bp, Homo sapiens
tggagctgaggggaatgctgag

SEQ ID NO: 8518366 - DNA, 22 bp, Homo sapiens
tggaggaaaattactggggtct

SEQ ID NO: 8518367 - DNA, 22 bp, Homo sapiens
tggagatgtaaagcaaggctta

SEQ ID NO: 8518368 - DNA, 22 bp, Homo sapiens
tggagatgtaaagcaaggctta

SEQ ID NO: 8518369 - DNA, 22 bp, Homo sapiens
tggagatgggttaatggagaga

SEQ ID NO: 8518370 - DNA, 22 bp, Homo sapiens
tggagatggcctcaggccctca

SEQ ID NO: 8518371 - DNA, 23 bp, Homo sapiens
tggagatgccccactccctgtct

SEQ ID NO: 8518372 - DNA, 23 bp, Homo sapiens
tggagatgccccactccctgtct

SEQ ID NO: 8518373 - DNA, 22 bp, Homo sapiens
tggagatgcacgagcaggtgga

SEQ ID NO: 8518374 - DNA, 18 bp, Homo sapiens
tggaggaatcacaatggc

SEQ ID NO: 8518375 - DNA, 22 bp, Homo sapiens
tggaggacaggactggacagcc

SEQ ID NO: 8518376 - DNA, 22 bp, Homo sapiens
tggaggaatcagggcttaggct

SEQ ID NO: 8518377 - DNA, 23 bp, Homo sapiens
tggaggaaacacatcagaagacc

SEQ ID NO: 8518378 - DNA, 23 bp, Homo sapiens
tggaggaaacacatcagaagacc

SEQ ID NO: 8518379 - DNA, 22 bp, Homo sapiens
tggaggaagtggacagttgtgt

SEQ ID NO: 8518380 - DNA, 22 bp, Homo sapiens
tggaggaagttgctggaagtca

SEQ ID NO: 8518381 - DNA, 22 bp, Homo sapiens
tggaggaagtggctggccagaa

SEQ ID NO: 8518382 - DNA, 22 bp, Homo sapiens
tggaggaagtggctggccagaa

SEQ ID NO: 8518383 - DNA, 22 bp, Homo sapiens
tggaggcattttaggttgtcac

SEQ ID NO: 8518384 - DNA, 22 bp, Homo sapiens
tggaggcatgacagtgtctgga

SEQ ID NO: 8518385 - DNA, 22 bp, Homo sapiens
tggaggcattgtgactgctgaa

SEQ ID NO: 8518386 - DNA, 22 bp, Homo sapiens
ccctggagggatttctcaatca

SEQ ID NO: 8518387 - DNA, 22 bp, Homo sapiens
ccctggagggatttctcaatca

SEQ ID NO: 8518388 - DNA, 22 bp, Homo sapiens
ccctggagggatttctcaatca

SEQ ID NO: 8518389 - DNA, 22 bp, Homo sapiens
ccctggaggaccccaatgtggc

SEQ ID NO: 8518390 - DNA, 22 bp, Homo sapiens
ccctggaggaccccaatgtggc

SEQ ID NO: 8518391 - DNA, 22 bp, Homo sapiens
ccctggagggacagctgctcta

SEQ ID NO: 8518392 - DNA, 22 bp, Homo sapiens
ccctggaggaccccaatgtggc

SEQ ID NO: 8518393 - DNA, 22 bp, Homo sapiens
tggaggccaaggcaggcggatc

SEQ ID NO: 8518394 - DNA, 22 bp, Homo sapiens
ccctggaggaccccaatgtggc

SEQ ID NO: 8518395 - DNA, 22 bp, Homo sapiens
tggaggcataggcctgggccct

SEQ ID NO: 8518396 - DNA, 22 bp, Homo sapiens
tggaggcatcagagtgcttggc

SEQ ID NO: 8518397 - DNA, 22 bp, Homo sapiens
tggaggcatcagagtgcttggc

SEQ ID NO: 8518398 - DNA, 22 bp, Homo sapiens
tggaggcagtttaagtctgaga

SEQ ID NO: 8518399 - DNA, 22 bp, Homo sapiens
tggaggagaactccctggctac

SEQ ID NO: 8518400 - DNA, 22 bp, Homo sapiens
tggaggacgtgtccaccatgaa

SEQ ID NO: 8518401 - DNA, 22 bp, Homo sapiens
tggaggacgtgtccaccatgaa

SEQ ID NO: 8518402 - DNA, 22 bp, Homo sapiens
tggaggacgtgtccaccatgaa

SEQ ID NO: 8518403 - DNA, 22 bp, Homo sapiens
tggaaactaacaacagagcaga

SEQ ID NO: 8518404 - DNA, 22 bp, Homo sapiens
tggaaagaaaaacaggccatga

SEQ ID NO: 8518405 - DNA, 22 bp, Homo sapiens
ccctccctgtgtgcctcatttg

SEQ ID NO: 8518406 - DNA, 22 bp, Homo sapiens
ccctcccttccaagttgaggac

SEQ ID NO: 8518407 - DNA, 22 bp, Homo sapiens
ccctccctgaagaagttactct

SEQ ID NO: 8518408 - DNA, 23 bp, Homo sapiens
tggaaacattctgaatgtccatc

SEQ ID NO: 8518409 - DNA, 23 bp, Homo sapiens
tggagaattcttccttccactgt

SEQ ID NO: 8518410 - DNA, 22 bp, Homo sapiens
tggagacagagatagccaattg

SEQ ID NO: 8518411 - DNA, 22 bp, Homo sapiens
tggagacacaggaccagactgc

SEQ ID NO: 8518412 - DNA, 23 bp, Homo sapiens
tggaaacttaagggggagatgtc

SEQ ID NO: 8518413 - DNA, 22 bp, Homo sapiens
tggacatgtccggccagacaat

SEQ ID NO: 8518414 - DNA, 22 bp, Homo sapiens
tggacatgtaaaggctcaaggt

SEQ ID NO: 8518415 - DNA, 22 bp, Homo sapiens
tggacatgtcttctccaagaaa

SEQ ID NO: 8518416 - DNA, 22 bp, Homo sapiens
tggagaatctggaaactgttga

SEQ ID NO: 8518417 - DNA, 22 bp, Homo sapiens
tggagaatgatattccatcatt

SEQ ID NO: 8518418 - DNA, 22 bp, Homo sapiens
tggagaattctatgttgagggg

SEQ ID NO: 8518419 - DNA, 22 bp, Homo sapiens
tggagaattctatgttgagggg

SEQ ID NO: 8518420 - DNA, 22 bp, Homo sapiens
tggagagttctgtagatatcta

SEQ ID NO: 8518421 - DNA, 22 bp, Homo sapiens
tggagagtttagcctactggaa

SEQ ID NO: 8518422 - DNA, 22 bp, Homo sapiens
tggagatgaacatggtgatgtt

SEQ ID NO: 8518423 - DNA, 22 bp, Homo sapiens
tggagatgaacatggtgatgtt

SEQ ID NO: 8518424 - DNA, 22 bp, Homo sapiens
tggagatgaatatgtgtacctg

SEQ ID NO: 8518425 - DNA, 22 bp, Homo sapiens
tggagatgaatatgtgtacctg

SEQ ID NO: 8518426 - DNA, 22 bp, Homo sapiens
tggagatgaggacatggacgtc

SEQ ID NO: 8518427 - DNA, 22 bp, Homo sapiens
tggagactctgcatctgtgaca

SEQ ID NO: 8518428 - DNA, 21 bp, Homo sapiens
tggagactctggttctttgtg

SEQ ID NO: 8518429 - DNA, 22 bp, Homo sapiens
tggagactctgcatctgtgaca

SEQ ID NO: 8518430 - DNA, 22 bp, Homo sapiens
tggagactcagaaggggaagca

SEQ ID NO: 8518431 - DNA, 22 bp, Homo sapiens
tggagactcagaaggggaagca

SEQ ID NO: 8518432 - DNA, 19 bp, Homo sapiens
tggagactgagagtgagca

SEQ ID NO: 8518433 - DNA, 22 bp, Homo sapiens
tggagactgactgcctgtattt

SEQ ID NO: 8518434 - DNA, 22 bp, Homo sapiens
tggagactgtgctaagggagtt

SEQ ID NO: 8518435 - DNA, 22 bp, Homo sapiens
tggagactgataaaggctattg

SEQ ID NO: 8518436 - DNA, 19 bp, Homo sapiens
tggagactgagagtgagca

SEQ ID NO: 8518437 - DNA, 22 bp, Homo sapiens
cccttggaggaagctctaggct

SEQ ID NO: 8518438 - DNA, 22 bp, Homo sapiens
cccttggaggaagctctaggct

SEQ ID NO: 8518439 - DNA, 22 bp, Homo sapiens
ccctttaaagttttaccagcag

SEQ ID NO: 8518440 - DNA, 22 bp, Homo sapiens
cccttgggtgccagccacaagt

SEQ ID NO: 8518441 - DNA, 22 bp, Homo sapiens
ccctttaagtagaatatattat

SEQ ID NO: 8518442 - DNA, 22 bp, Homo sapiens
ccctttagcccctgcagagact

SEQ ID NO: 8518443 - DNA, 22 bp, Homo sapiens
ccctttaattccaacacaggaa

SEQ ID NO: 8518444 - DNA, 22 bp, Homo sapiens
ccctttaagtcctggaacaaag

SEQ ID NO: 8518445 - DNA, 19 bp, Homo sapiens
tggcagggagagtttgaag

SEQ ID NO: 8518446 - DNA, 22 bp, Homo sapiens
tggcagggaatacagatgttta

SEQ ID NO: 8518447 - DNA, 22 bp, Homo sapiens
cccttgcatcccatgtgtggcc

SEQ ID NO: 8518448 - DNA, 22 bp, Homo sapiens
cccttgcacatttgtctttaat

SEQ ID NO: 8518449 - DNA, 22 bp, Homo sapiens
ccctgggacccgctgcagaggc

SEQ ID NO: 8518450 - DNA, 22 bp, Homo sapiens
ccctgggacccgctgcagaggc

SEQ ID NO: 8518451 - DNA, 22 bp, Homo sapiens
ccctgggagaagttgagggctg

SEQ ID NO: 8518452 - DNA, 22 bp, Homo sapiens
ccctgggagaagttgagggctg

SEQ ID NO: 8518453 - DNA, 22 bp, Homo sapiens
ccctgggagaagttgagggctg

SEQ ID NO: 8518454 - DNA, 22 bp, Homo sapiens
ccctgggagctgcctggctgac

SEQ ID NO: 8518455 - DNA, 22 bp, Homo sapiens
ccctgggagctgcctggctgac

SEQ ID NO: 8518456 - DNA, 22 bp, Homo sapiens
ccctgggaagtattccagctat

SEQ ID NO: 8518457 - DNA, 22 bp, Homo sapiens
tggcaggctgagttggcctggt

SEQ ID NO: 8518458 - DNA, 22 bp, Homo sapiens
tggcaggctgagttggcctggt

SEQ ID NO: 8518459 - DNA, 22 bp, Homo sapiens
tggcaggctctgagtagcacct

SEQ ID NO: 8518460 - DNA, 19 bp, Homo sapiens
tggcaggcccaggatggac

SEQ ID NO: 8518461 - DNA, 19 bp, Homo sapiens
tggcaggcccaggatggac

SEQ ID NO: 8518462 - DNA, 22 bp, Homo sapiens
tggcaggcggaggttgcagtga

SEQ ID NO: 8518463 - DNA, 22 bp, Homo sapiens
tggcaggcggaggttgcagtga

SEQ ID NO: 8518464 - DNA, 22 bp, Homo sapiens
ccctgggaggcttccaggcaga

SEQ ID NO: 8518465 - DNA, 22 bp, Homo sapiens
ccctgggagtccactgatgtca

SEQ ID NO: 8518466 - DNA, 22 bp, Homo sapiens
ccctgggaggcttccaggcaga

SEQ ID NO: 8518467 - DNA, 22 bp, Homo sapiens
tggcaggaaaaacattggagat

SEQ ID NO: 8518468 - DNA, 19 bp, Homo sapiens
tggcaggcccaggatggac

SEQ ID NO: 8518469 - DNA, 19 bp, Homo sapiens
tggcaggcccaggatggac

SEQ ID NO: 8518470 - DNA, 22 bp, Homo sapiens
tggcaggaaaaacattggagat

SEQ ID NO: 8518471 - DNA, 22 bp, Homo sapiens
tggcaggcattgatgcgagttc

SEQ ID NO: 8518472 - DNA, 22 bp, Homo sapiens
tggcaggcattgatgcgagttc

SEQ ID NO: 8518473 - DNA, 23 bp, Homo sapiens
ccctggagtaaattcttggaagg

SEQ ID NO: 8518474 - DNA, 23 bp, Homo sapiens
ccctggagtaaattcttggaagg

SEQ ID NO: 8518475 - DNA, 23 bp, Homo sapiens
ccctggagtaaattcttggaagg

SEQ ID NO: 8518476 - DNA, 23 bp, Homo sapiens
ccctggagtaaattcttggaagg

SEQ ID NO: 8518477 - DNA, 22 bp, Homo sapiens
ccctggagtagcactgggtcgc

SEQ ID NO: 8518478 - DNA, 22 bp, Homo sapiens
ccctggagtagcactgggtcgc

SEQ ID NO: 8518479 - DNA, 22 bp, Homo sapiens
ccctggagtcaggttggcctgg

SEQ ID NO: 8518480 - DNA, 22 bp, Homo sapiens
ccctggagtcaggttggcctgg

SEQ ID NO: 8518481 - DNA, 22 bp, Homo sapiens
ccctggagtcaggttggcctgg

SEQ ID NO: 8518482 - DNA, 22 bp, Homo sapiens
ccctggagtcaggttggcctgg

SEQ ID NO: 8518483 - DNA, 22 bp, Homo sapiens
ccctggagtagcactgggtcgc

SEQ ID NO: 8518484 - DNA, 22 bp, Homo sapiens
ccctggagtcaggttggcctgg

SEQ ID NO: 8518485 - DNA, 22 bp, Homo sapiens
ccctggagtagcactgggtcgc

SEQ ID NO: 8518486 - DNA, 22 bp, Homo sapiens
ccctggagtagcactgggtcgc

SEQ ID NO: 8518487 - DNA, 22 bp, Homo sapiens
ccctggagtcctggcagttgat

SEQ ID NO: 8518488 - DNA, 22 bp, Homo sapiens
ccctggagtcctggcagttgat

SEQ ID NO: 8518489 - DNA, 22 bp, Homo sapiens
ccctggagtccggagctcacct

SEQ ID NO: 8518490 - DNA, 22 bp, Homo sapiens
ccctggagtccggagctcacct

SEQ ID NO: 8518491 - DNA, 22 bp, Homo sapiens
ccctggagtccggagctcacct

SEQ ID NO: 8518492 - DNA, 22 bp, Homo sapiens
ccctggagtccggagctcacct

SEQ ID NO: 8518493 - DNA, 22 bp, Homo sapiens
ccctggagtgccggaatcaaga

SEQ ID NO: 8518494 - DNA, 22 bp, Homo sapiens
ccctggagtgccggaatcaaga

SEQ ID NO: 8518495 - DNA, 22 bp, Homo sapiens
ccctggagtgccggaatcaaga

SEQ ID NO: 8518496 - DNA, 22 bp, Homo sapiens
ccctggagtgtgacgaggcatt

SEQ ID NO: 8518497 - DNA, 22 bp, Homo sapiens
ccctggagtcctggcagttgat

SEQ ID NO: 8518498 - DNA, 22 bp, Homo sapiens
ccctggagtgccggaatcaaga

SEQ ID NO: 8518499 - DNA, 22 bp, Homo sapiens
ccctggaggttgaggctgcagt

SEQ ID NO: 8518500 - DNA, 22 bp, Homo sapiens
ccctggaggttgaggctgcagt

SEQ ID NO: 8518501 - DNA, 22 bp, Homo sapiens
ccctggaggttgaggctgcagt

SEQ ID NO: 8518502 - DNA, 22 bp, Homo sapiens
ccctggaggttgaggctgcagt

SEQ ID NO: 8518503 - DNA, 22 bp, Homo sapiens
ccctggaggttgaggctgcagt

SEQ ID NO: 8518504 - DNA, 22 bp, Homo sapiens
ccctggaggttgaggctgcagt

SEQ ID NO: 8518505 - DNA, 22 bp, Homo sapiens
ccctggaggttgaggctgcagt

SEQ ID NO: 8518506 - DNA, 22 bp, Homo sapiens
ccctggaggtggaggttgcagg

SEQ ID NO: 8518507 - DNA, 22 bp, Homo sapiens
ccctggaggtggaggttgcagg

SEQ ID NO: 8518508 - DNA, 22 bp, Homo sapiens
ccctggaggtggaggttgcagg

SEQ ID NO: 8518509 - DNA, 22 bp, Homo sapiens
ccctggaggtggaggttgcagg

SEQ ID NO: 8518510 - DNA, 22 bp, Homo sapiens
ccctggaggtggaggttgcagg

SEQ ID NO: 8518511 - DNA, 22 bp, Homo sapiens
ccctggagggcagacagatgcc

SEQ ID NO: 8518512 - DNA, 22 bp, Homo sapiens
ccctggagggcagacagatgcc

SEQ ID NO: 8518513 - DNA, 22 bp, Homo sapiens
ccctggagggcagacagatgcc

SEQ ID NO: 8518514 - DNA, 22 bp, Homo sapiens
ccctggaggtcagaggcctggg

SEQ ID NO: 8518515 - DNA, 22 bp, Homo sapiens
ccctggagggcagacagatgcc

SEQ ID NO: 8518516 - DNA, 22 bp, Homo sapiens
ccctggagggcagacagatgcc

SEQ ID NO: 8518517 - DNA, 22 bp, Homo sapiens
ccctggaggtcagaggcctggg

SEQ ID NO: 8518518 - DNA, 22 bp, Homo sapiens
ccctggaggtcagaggcctggg

SEQ ID NO: 8518519 - DNA, 22 bp, Homo sapiens
ccctggaggtcagaggcctggg

SEQ ID NO: 8518520 - DNA, 22 bp, Homo sapiens
ccctggaggtcagaggcctggg

SEQ ID NO: 8518521 - DNA, 22 bp, Homo sapiens
ccctggaggtcagaggcctggg

SEQ ID NO: 8518522 - DNA, 22 bp, Homo sapiens
ccctggaggtcagaggcctggg

SEQ ID NO: 8518523 - DNA, 22 bp, Homo sapiens
tggcagagaacacacatgattc

SEQ ID NO: 8518524 - DNA, 22 bp, Homo sapiens
tggcagagaacacacatgattc

SEQ ID NO: 8518525 - DNA, 22 bp, Homo sapiens
tggcagagaacacacatgattc

SEQ ID NO: 8518526 - DNA, 22 bp, Homo sapiens
ccctggctgccagtcaccagac

SEQ ID NO: 8518527 - DNA, 22 bp, Homo sapiens
tggcagacactgtcgaagccta

SEQ ID NO: 8518528 - DNA, 22 bp, Homo sapiens
tggcagacctgaaggttcggcg

SEQ ID NO: 8518529 - DNA, 22 bp, Homo sapiens
tggcagaattttaaagacagat

SEQ ID NO: 8518530 - DNA, 22 bp, Homo sapiens
tggcagaatgaagactggggcc

SEQ ID NO: 8518531 - DNA, 22 bp, Homo sapiens
tggcacagtgctggatggtgct

SEQ ID NO: 8518532 - DNA, 22 bp, Homo sapiens
ccctggagtgtgacgaggcatt

SEQ ID NO: 8518533 - DNA, 22 bp, Homo sapiens
ccctggagtgtgacgaggcatt

SEQ ID NO: 8518534 - DNA, 22 bp, Homo sapiens
ccctggagtgtgacgaggcatt

SEQ ID NO: 8518535 - DNA, 22 bp, Homo sapiens
ccctggagtgtgacgaggcatt

SEQ ID NO: 8518536 - DNA, 22 bp, Homo sapiens
ccctggagtgtgacgaggcatt

SEQ ID NO: 8518537 - DNA, 22 bp, Homo sapiens
ccctggatttacatcattctga

SEQ ID NO: 8518538 - DNA, 22 bp, Homo sapiens
tggcacagtcctgggtgcctgc

SEQ ID NO: 8518539 - DNA, 22 bp, Homo sapiens
tggcagaatgaagactggggcc

SEQ ID NO: 8518540 - DNA, 22 bp, Homo sapiens
tggcagaagttcactagtagct

SEQ ID NO: 8518541 - DNA, 22 bp, Homo sapiens
tggcagaagtacacaagcatgc

SEQ ID NO: 8518542 - DNA, 22 bp, Homo sapiens
tggcagaagtacacaagcatgc

SEQ ID NO: 8518543 - DNA, 22 bp, Homo sapiens
tgctgggggtgtctcaccaggc

SEQ ID NO: 8518544 - DNA, 22 bp, Homo sapiens
tgctgggggttcagatgagtaa

SEQ ID NO: 8518545 - DNA, 22 bp, Homo sapiens
tgctgggggtgtctcaccaggc

SEQ ID NO: 8518546 - DNA, 22 bp, Homo sapiens
tgctgggggctttctggatacc

SEQ ID NO: 8518547 - DNA, 22 bp, Homo sapiens
tgctgggggctttctggatacc

SEQ ID NO: 8518548 - DNA, 22 bp, Homo sapiens
tgctggggctctgaccactcca

SEQ ID NO: 8518549 - DNA, 22 bp, Homo sapiens
tgctgggggctttctggatacc

SEQ ID NO: 8518550 - DNA, 22 bp, Homo sapiens
ccccagctcagtgcagggacat

SEQ ID NO: 8518551 - DNA, 22 bp, Homo sapiens
ccccagctcagtgcagggacat

SEQ ID NO: 8518552 - DNA, 18 bp, Homo sapiens
tgctggggtagaatccac

SEQ ID NO: 8518553 - DNA, 22 bp, Homo sapiens
tgctgggggttcagatgagtaa

SEQ ID NO: 8518554 - DNA, 22 bp, Homo sapiens
tgctgggggttcagatgagtaa

SEQ ID NO: 8518555 - DNA, 22 bp, Homo sapiens
ccccagctgcatacttgccaag

SEQ ID NO: 8518556 - DNA, 22 bp, Homo sapiens
ccccagctgcatacttgccaag

SEQ ID NO: 8518557 - DNA, 22 bp, Homo sapiens
ccccagctgagatttgaggaga

SEQ ID NO: 8518558 - DNA, 22 bp, Homo sapiens
ccccagctgagatttgaggaga

SEQ ID NO: 8518559 - DNA, 22 bp, Homo sapiens
ccccagctgcatacttgccaag

SEQ ID NO: 8518560 - DNA, 22 bp, Homo sapiens
ccccagctgcatacttgccaag

SEQ ID NO: 8518561 - DNA, 22 bp, Homo sapiens
ccccagctgcatacttgccaag

SEQ ID NO: 8518562 - DNA, 22 bp, Homo sapiens
ccccagctgcatacttgccaag

SEQ ID NO: 8518563 - DNA, 22 bp, Homo sapiens
ccccaggaagcctcagatttgc

SEQ ID NO: 8518564 - DNA, 22 bp, Homo sapiens
ccccagctgcatacttgccaag

SEQ ID NO: 8518565 - DNA, 22 bp, Homo sapiens
ccccaggacacatggaccaagt

SEQ ID NO: 8518566 - DNA, 22 bp, Homo sapiens
ccccaggaagcctcagatttgc

SEQ ID NO: 8518567 - DNA, 22 bp, Homo sapiens
cccagtgggtcactgcatctca

SEQ ID NO: 8518568 - DNA, 22 bp, Homo sapiens
cccagtggggaaatagctagct

SEQ ID NO: 8518569 - DNA, 22 bp, Homo sapiens
cccagtggggagctgaggttca

SEQ ID NO: 8518570 - DNA, 22 bp, Homo sapiens
cccagtggtgctggcatctgtg

SEQ ID NO: 8518571 - DNA, 22 bp, Homo sapiens
cccagtggtgctggcatctgtg

SEQ ID NO: 8518572 - DNA, 22 bp, Homo sapiens
cccagtggtgctggcatctgtg

SEQ ID NO: 8518573 - DNA, 22 bp, Homo sapiens
cccagtggggaaatagctagct

SEQ ID NO: 8518574 - DNA, 17 bp, Homo sapiens
tgctgctaattaaaata

SEQ ID NO: 8518575 - DNA, 22 bp, Homo sapiens
tgctgctagctgtattgcaaga

SEQ ID NO: 8518576 - DNA, 17 bp, Homo sapiens
tgctgctaattaaaata

SEQ ID NO: 8518577 - DNA, 22 bp, Homo sapiens
tgctgcctttgtggggtcactg

SEQ ID NO: 8518578 - DNA, 22 bp, Homo sapiens
tgctgcctttgggacctggcct

SEQ ID NO: 8518579 - DNA, 22 bp, Homo sapiens
cccagtggcttttgcccaggtt

SEQ ID NO: 8518580 - DNA, 22 bp, Homo sapiens
tgctgctcaatgagatgccatc

SEQ ID NO: 8518581 - DNA, 22 bp, Homo sapiens
cccagtgtgcccctcctgcagc

SEQ ID NO: 8518582 - DNA, 22 bp, Homo sapiens
cccagtgtggttctttggagaa

SEQ ID NO: 8518583 - DNA, 22 bp, Homo sapiens
cccagtgtggttgtgaattctg

SEQ ID NO: 8518584 - DNA, 22 bp, Homo sapiens
cccagtgtctgggcctgcaggg

SEQ ID NO: 8518585 - DNA, 22 bp, Homo sapiens
cccagtgtgatgaggttgctaa

SEQ ID NO: 8518586 - DNA, 22 bp, Homo sapiens
cccagtgtctgggcctgcaggg

SEQ ID NO: 8518587 - DNA, 22 bp, Homo sapiens
cccagtgtctgggcctgcaggg

SEQ ID NO: 8518588 - DNA, 22 bp, Homo sapiens
cccagtgtctcttgtgcctttc

SEQ ID NO: 8518589 - DNA, 22 bp, Homo sapiens
cccagtgtctccaacatcagat

SEQ ID NO: 8518590 - DNA, 22 bp, Homo sapiens
cccagtgtcaccaacaggacac

SEQ ID NO: 8518591 - DNA, 20 bp, Homo sapiens
cccagtgtccagccttgcca

SEQ ID NO: 8518592 - DNA, 22 bp, Homo sapiens
cccagtgtcattctaagggagg

SEQ ID NO: 8518593 - DNA, 22 bp, Homo sapiens
cccagttgttgccggctctgga

SEQ ID NO: 8518594 - DNA, 22 bp, Homo sapiens
cccagttgttgccggctctgga

SEQ ID NO: 8518595 - DNA, 22 bp, Homo sapiens
cccagttgttgccggctctgga

SEQ ID NO: 8518596 - DNA, 22 bp, Homo sapiens
cccagtgttccttgaggggctg

SEQ ID NO: 8518597 - DNA, 22 bp, Homo sapiens
cccagtgttacgtgacagcctg

SEQ ID NO: 8518598 - DNA, 22 bp, Homo sapiens
cccagtgttccttgaggggctg

SEQ ID NO: 8518599 - DNA, 22 bp, Homo sapiens
cccagttgttgccggctctgga

SEQ ID NO: 8518600 - DNA, 22 bp, Homo sapiens
tgctgggcactgtctaggtact

SEQ ID NO: 8518601 - DNA, 22 bp, Homo sapiens
tgcttcctgctaaggctgcctg

SEQ ID NO: 8518602 - DNA, 20 bp, Homo sapiens
tgcttcctggccactgcggg

SEQ ID NO: 8518603 - DNA, 22 bp, Homo sapiens
tgcttccttcccgttcttctcc

SEQ ID NO: 8518604 - DNA, 22 bp, Homo sapiens
tgcttccttcccgttcttctcc

SEQ ID NO: 8518605 - DNA, 22 bp, Homo sapiens
tgcttccttgatcattcccaaa

SEQ ID NO: 8518606 - DNA, 22 bp, Homo sapiens
tgcttccttgatcattcccaaa

SEQ ID NO: 8518607 - DNA, 22 bp, Homo sapiens
tgcttccttgatcattcccaaa

SEQ ID NO: 8518608 - DNA, 22 bp, Homo sapiens
tgcttccttgagctctccaatc

SEQ ID NO: 8518609 - DNA, 22 bp, Homo sapiens
tgcttccttgagctctccaatc

SEQ ID NO: 8518610 - DNA, 22 bp, Homo sapiens
tgcttccttgagctctccaatc

SEQ ID NO: 8518611 - DNA, 22 bp, Homo sapiens
tgcttccttcccgttcttctcc

SEQ ID NO: 8518612 - DNA, 22 bp, Homo sapiens
tgcttcctatccacacaatgcc

SEQ ID NO: 8518613 - DNA, 22 bp, Homo sapiens
tgcttcctatccacacaatgcc

SEQ ID NO: 8518614 - DNA, 21 bp, Homo sapiens
tgcttccctgggccacactga

SEQ ID NO: 8518615 - DNA, 22 bp, Homo sapiens
tgcttcctatccacacaatgcc

SEQ ID NO: 8518616 - DNA, 22 bp, Homo sapiens
tgcttccgctaaaaattaatcc

SEQ ID NO: 8518617 - DNA, 19 bp, Homo sapiens
tgcttcctcaccatctccc

SEQ ID NO: 8518618 - DNA, 19 bp, Homo sapiens
tgcttcctcaccatctccc

SEQ ID NO: 8518619 - DNA, 22 bp, Homo sapiens
tgcttcctgaggccgtcttctc

SEQ ID NO: 8518620 - DNA, 22 bp, Homo sapiens
tgcttcctgaggccgtcttctc

SEQ ID NO: 8518621 - DNA, 22 bp, Homo sapiens
tgcttcctgaggccgtcttctc

SEQ ID NO: 8518622 - DNA, 22 bp, Homo sapiens
tgcttcctgctaaggctgcctg

SEQ ID NO: 8518623 - DNA, 22 bp, Homo sapiens
ccccaggagatttgggagcaca

SEQ ID NO: 8518624 - DNA, 22 bp, Homo sapiens
ccccaggagatttgggagcaca

SEQ ID NO: 8518625 - DNA, 22 bp, Homo sapiens
ccccaggagatttgggagcaca

SEQ ID NO: 8518626 - DNA, 22 bp, Homo sapiens
ccccaggagatttgggagcaca

SEQ ID NO: 8518627 - DNA, 22 bp, Homo sapiens
ccccaggagaaatcttaaacta

SEQ ID NO: 8518628 - DNA, 22 bp, Homo sapiens
ccccaggagaaatcttaaacta

SEQ ID NO: 8518629 - DNA, 22 bp, Homo sapiens
ccccaggacacatggaccaagt

SEQ ID NO: 8518630 - DNA, 22 bp, Homo sapiens
ccccaggacgtggccctcatag

SEQ ID NO: 8518631 - DNA, 16 bp, Homo sapiens
ccccaggacttggcac

SEQ ID NO: 8518632 - DNA, 16 bp, Homo sapiens
ccccaggacttggcac

SEQ ID NO: 8518633 - DNA, 22 bp, Homo sapiens
ccccaggacgtggccctcatag

SEQ ID NO: 8518634 - DNA, 22 bp, Homo sapiens
ccccaggacgtggccctcatag

SEQ ID NO: 8518635 - DNA, 22 bp, Homo sapiens
ccccaggagcttgttttagaga

SEQ ID NO: 8518636 - DNA, 22 bp, Homo sapiens
ccccaggagcttgttttagaga

SEQ ID NO: 8518637 - DNA, 22 bp, Homo sapiens
tgcttaaaaacagtatggtagt

SEQ ID NO: 8518638 - DNA, 22 bp, Homo sapiens
ccctccagtgtcccagtgggga

SEQ ID NO: 8518639 - DNA, 22 bp, Homo sapiens
ccctccagtgtcccagtgggga

SEQ ID NO: 8518640 - DNA, 22 bp, Homo sapiens
ccctccagtgtcccagtgggga

SEQ ID NO: 8518641 - DNA, 22 bp, Homo sapiens
ccctccccacaaagcttcacac

SEQ ID NO: 8518642 - DNA, 20 bp, Homo sapiens
tgcttgtcatgcactcaggc

SEQ ID NO: 8518643 - DNA, 20 bp, Homo sapiens
tgcttgtcatgcactcaggc

SEQ ID NO: 8518644 - DNA, 22 bp, Homo sapiens
tgcttgtcaggataagctctgg

SEQ ID NO: 8518645 - DNA, 21 bp, Homo sapiens
tgcttgtcatgaatgggccag

SEQ ID NO: 8518646 - DNA, 22 bp, Homo sapiens
ccctccccacaaagcttcacac

SEQ ID NO: 8518647 - DNA, 22 bp, Homo sapiens
ccctccccagggtcatattgaa

SEQ ID NO: 8518648 - DNA, 22 bp, Homo sapiens
ccctccctatgtagatgatgtt

SEQ ID NO: 8518649 - DNA, 22 bp, Homo sapiens
ccctccctatgtagatgatgtt

SEQ ID NO: 8518650 - DNA, 22 bp, Homo sapiens
ccctccctctgctgggtgtaga

SEQ ID NO: 8518651 - DNA, 22 bp, Homo sapiens
ccctccctctgctgggtgtaga

SEQ ID NO: 8518652 - DNA, 22 bp, Homo sapiens
tgcttgtcacatacaggagcat

SEQ ID NO: 8518653 - DNA, 22 bp, Homo sapiens
tgcttgtcaccctgcctgagtg

SEQ ID NO: 8518654 - DNA, 22 bp, Homo sapiens
tgcttggctttctgagcttctg

SEQ ID NO: 8518655 - DNA, 22 bp, Homo sapiens
tgcttgggcggccagcatggcg

SEQ ID NO: 8518656 - DNA, 22 bp, Homo sapiens
tgcttggctttctgagcttctg

SEQ ID NO: 8518657 - DNA, 22 bp, Homo sapiens
tgcttggcttcatttaagtttt

SEQ ID NO: 8518658 - DNA, 17 bp, Homo sapiens
tgcttggcttctttagg

SEQ ID NO: 8518659 - DNA, 22 bp, Homo sapiens
tgcttggctagcttggcagctc

SEQ ID NO: 8518660 - DNA, 22 bp, Homo sapiens
tgcttggagaatcagtcccagc

SEQ ID NO: 8518661 - DNA, 18 bp, Homo sapiens
tgcttggagcatttacca

SEQ ID NO: 8518662 - DNA, 22 bp, Homo sapiens
tgcttggcctacttgtcctttg

SEQ ID NO: 8518663 - DNA, 22 bp, Homo sapiens
tgcttggcctacttgtcctttg

SEQ ID NO: 8518664 - DNA, 22 bp, Homo sapiens
tgcttgctgggccaatggcaat

SEQ ID NO: 8518665 - DNA, 22 bp, Homo sapiens
tgcttgctggaggcagacagaa

SEQ ID NO: 8518666 - DNA, 23 bp, Homo sapiens
tgcttggacaagactctattaag

SEQ ID NO: 8518667 - DNA, 19 bp, Homo sapiens
tgctgcaggatgctgctgg

SEQ ID NO: 8518668 - DNA, 22 bp, Homo sapiens
tgctgcaggcaatagaaaacct

SEQ ID NO: 8518669 - DNA, 22 bp, Homo sapiens
tgctctggacgctgagtggttt

SEQ ID NO: 8518670 - DNA, 19 bp, Homo sapiens
tgctctggagccagctctc

SEQ ID NO: 8518671 - DNA, 22 bp, Homo sapiens
tgctctggaccatgactatgtg

SEQ ID NO: 8518672 - DNA, 22 bp, Homo sapiens
tgctctggaatagtcctaggca

SEQ ID NO: 8518673 - DNA, 20 bp, Homo sapiens
tgctctggaaatggtctgag

SEQ ID NO: 8518674 - DNA, 22 bp, Homo sapiens
tgctgcctctgctgatatggcc

SEQ ID NO: 8518675 - DNA, 22 bp, Homo sapiens
tgctgcctgctacgagggaaga

SEQ ID NO: 8518676 - DNA, 22 bp, Homo sapiens
tgctgcctggagccttttgttt

SEQ ID NO: 8518677 - DNA, 22 bp, Homo sapiens
tgctgcctgtgccaggagggtc

SEQ ID NO: 8518678 - DNA, 22 bp, Homo sapiens
tgctgcctggtttcttcttgct

SEQ ID NO: 8518679 - DNA, 22 bp, Homo sapiens
tgctgcctgttgtggggccacg

SEQ ID NO: 8518680 - DNA, 22 bp, Homo sapiens
tgctgcctgttgtggggccacg

SEQ ID NO: 8518681 - DNA, 22 bp, Homo sapiens
tgctgccttagcagccaggcaa

SEQ ID NO: 8518682 - DNA, 22 bp, Homo sapiens
tgctgccttagaaatggctata

SEQ ID NO: 8518683 - DNA, 22 bp, Homo sapiens
tgctgccttctaggcgtgccct

SEQ ID NO: 8518684 - DNA, 22 bp, Homo sapiens
tgctgccttctaggcgtgccct

SEQ ID NO: 8518685 - DNA, 22 bp, Homo sapiens
tgctgcctttctgaatggtgga

SEQ ID NO: 8518686 - DNA, 22 bp, Homo sapiens
tgctgcctttcaatgttgtcat

SEQ ID NO: 8518687 - DNA, 22 bp, Homo sapiens
tgctctgcaagcaggagcaaga

SEQ ID NO: 8518688 - DNA, 19 bp, Homo sapiens
tgctctctggtgcttcatg

SEQ ID NO: 8518689 - DNA, 22 bp, Homo sapiens
cccagtggctgtccccatgggc

SEQ ID NO: 8518690 - DNA, 22 bp, Homo sapiens
cccagtggcccagcatgtggtg

SEQ ID NO: 8518691 - DNA, 22 bp, Homo sapiens
cccagtggcccagcatgtggtg

SEQ ID NO: 8518692 - DNA, 22 bp, Homo sapiens
cccagtgctatgcctattacat

SEQ ID NO: 8518693 - DNA, 22 bp, Homo sapiens
cccagtggaaggagtagaagac

SEQ ID NO: 8518694 - DNA, 22 bp, Homo sapiens
tgctcaggtcgttctgcccctt

SEQ ID NO: 8518695 - DNA, 22 bp, Homo sapiens
cccagtgccaggcacaggcagc

SEQ ID NO: 8518696 - DNA, 22 bp, Homo sapiens
cccagtcctaaagcagacgcca

SEQ ID NO: 8518697 - DNA, 22 bp, Homo sapiens
cccagtcctaaagcagacgcca

SEQ ID NO: 8518698 - DNA, 22 bp, Homo sapiens
cccagtcctaaagcagacgcca

SEQ ID NO: 8518699 - DNA, 22 bp, Homo sapiens
tgccttctcccttggaccctga

SEQ ID NO: 8518700 - DNA, 22 bp, Homo sapiens
tgccttctcttccctgggagct

SEQ ID NO: 8518701 - DNA, 22 bp, Homo sapiens
tgctaatgtcctgaccgttctg

SEQ ID NO: 8518702 - DNA, 22 bp, Homo sapiens
tgctaagctgaggaagatgaga

SEQ ID NO: 8518703 - DNA, 22 bp, Homo sapiens
tgctacagagccaggaagagtg

SEQ ID NO: 8518704 - DNA, 22 bp, Homo sapiens
tgctacagagccaggaagagtg

SEQ ID NO: 8518705 - DNA, 22 bp, Homo sapiens
tgctacactcaatcagtgctat

SEQ ID NO: 8518706 - DNA, 22 bp, Homo sapiens
tgcaggtgcgttttcaagcctc

SEQ ID NO: 8518707 - DNA, 22 bp, Homo sapiens
tgcaggtgcctcttgagcttgt

SEQ ID NO: 8518708 - DNA, 22 bp, Homo sapiens
tgcaggtgcctcttgagcttgt

SEQ ID NO: 8518709 - DNA, 22 bp, Homo sapiens
tgcaggtgcctcttgagcttgt

SEQ ID NO: 8518710 - DNA, 22 bp, Homo sapiens
tgcagggctaagtcagagcctg

SEQ ID NO: 8518711 - DNA, 22 bp, Homo sapiens
tgcagggctaagtcagagcctg

SEQ ID NO: 8518712 - DNA, 22 bp, Homo sapiens
tgcagggctaagtcagagcctg

SEQ ID NO: 8518713 - DNA, 22 bp, Homo sapiens
tgcagggctaagtcagagcctg

SEQ ID NO: 8518714 - DNA, 22 bp, Homo sapiens
tgctcagggacaatggagaggg

SEQ ID NO: 8518715 - DNA, 22 bp, Homo sapiens
tgctcagggacaatggagaggg

SEQ ID NO: 8518716 - DNA, 20 bp, Homo sapiens
tgctcaggatggagaggtgt

SEQ ID NO: 8518717 - DNA, 22 bp, Homo sapiens
tgctagtgcagggttttcagtt

SEQ ID NO: 8518718 - DNA, 22 bp, Homo sapiens
tgctaggtgctcctccctaatt

SEQ ID NO: 8518719 - DNA, 21 bp, Homo sapiens
tgctaggccatattggttgct

SEQ ID NO: 8518720 - DNA, 22 bp, Homo sapiens
tgctagaaatctgaaactagca

SEQ ID NO: 8518721 - DNA, 22 bp, Homo sapiens
tggcttgtcatgtatctgaggc

SEQ ID NO: 8518722 - DNA, 20 bp, Homo sapiens
tggcttgtttctatgggcag

SEQ ID NO: 8518723 - DNA, 22 bp, Homo sapiens
tggctttaagaagactgacagc

SEQ ID NO: 8518724 - DNA, 22 bp, Homo sapiens
tggcttggtgagcagagtgtag

SEQ ID NO: 8518725 - DNA, 22 bp, Homo sapiens
tggcttggtcctggcccttccc

SEQ ID NO: 8518726 - DNA, 22 bp, Homo sapiens
tggcttctttgtgacagctctt

SEQ ID NO: 8518727 - DNA, 22 bp, Homo sapiens
tggcttggctaagatctaagct

SEQ ID NO: 8518728 - DNA, 22 bp, Homo sapiens
tggcttggctaagatctaagct

SEQ ID NO: 8518729 - DNA, 22 bp, Homo sapiens
tggcttctttccactgtcctgt

SEQ ID NO: 8518730 - DNA, 22 bp, Homo sapiens
tggcttctttccactgtcctgt

SEQ ID NO: 8518731 - DNA, 22 bp, Homo sapiens
tggcttctttccactgtcctgt

SEQ ID NO: 8518732 - DNA, 22 bp, Homo sapiens
tggcttctttctttccatgtgt

SEQ ID NO: 8518733 - DNA, 22 bp, Homo sapiens
tggcttctttctttccatgtgt

SEQ ID NO: 8518734 - DNA, 22 bp, Homo sapiens
tggcttctttgtgacagctctt

SEQ ID NO: 8518735 - DNA, 22 bp, Homo sapiens
tggcttctttgtgacagctctt

SEQ ID NO: 8518736 - DNA, 22 bp, Homo sapiens
tggcttctttgtagaaattgaa

SEQ ID NO: 8518737 - DNA, 20 bp, Homo sapiens
cctcctggtcaggtgtgcag

SEQ ID NO: 8518738 - DNA, 20 bp, Homo sapiens
cctcctggtcaggtgtgcag

SEQ ID NO: 8518739 - DNA, 22 bp, Homo sapiens
cctcctggtaattagcgaaagg

SEQ ID NO: 8518740 - DNA, 22 bp, Homo sapiens
cctcctggtaattagcgaaagg

SEQ ID NO: 8518741 - DNA, 22 bp, Homo sapiens
cctcctgggttcaagcgattct

SEQ ID NO: 8518742 - DNA, 22 bp, Homo sapiens
cctcctggtccagcatctcttt

SEQ ID NO: 8518743 - DNA, 22 bp, Homo sapiens
cctcctggtccagcatctcttt

SEQ ID NO: 8518744 - DNA, 22 bp, Homo sapiens
tggcttcccatagcttgctagt

SEQ ID NO: 8518745 - DNA, 22 bp, Homo sapiens
tggcttcccatagcttgctagt

SEQ ID NO: 8518746 - DNA, 22 bp, Homo sapiens
tggcttcccctaccttccaatt

SEQ ID NO: 8518747 - DNA, 22 bp, Homo sapiens
tggcttccccggagtgacatgt

SEQ ID NO: 8518748 - DNA, 22 bp, Homo sapiens
tggcttctttccactgtcctgt

SEQ ID NO: 8518749 - DNA, 22 bp, Homo sapiens
tggcttctttccactgtcctgt

SEQ ID NO: 8518750 - DNA, 22 bp, Homo sapiens
cctctcccagggagagcctgag

SEQ ID NO: 8518751 - DNA, 22 bp, Homo sapiens
cctctcccgggtgccgctgggc

SEQ ID NO: 8518752 - DNA, 22 bp, Homo sapiens
cctctcccacgtggcagaggct

SEQ ID NO: 8518753 - DNA, 22 bp, Homo sapiens
cctctcccacgtggcagaggct

SEQ ID NO: 8518754 - DNA, 22 bp, Homo sapiens
cctctccagttttaacgtgacc

SEQ ID NO: 8518755 - DNA, 22 bp, Homo sapiens
cctctccagttttaacgtgacc

SEQ ID NO: 8518756 - DNA, 22 bp, Homo sapiens
cctctccagttttaacgtgacc

SEQ ID NO: 8518757 - DNA, 22 bp, Homo sapiens
cctctccagcggcctcagggcc

SEQ ID NO: 8518758 - DNA, 22 bp, Homo sapiens
cctctccagcggcctcagggcc

SEQ ID NO: 8518759 - DNA, 22 bp, Homo sapiens
cctctccagcggcctcagggcc

SEQ ID NO: 8518760 - DNA, 22 bp, Homo sapiens
tggctttacttaaactgaatca

SEQ ID NO: 8518761 - DNA, 22 bp, Homo sapiens
tgggagagaattctggtgactg

SEQ ID NO: 8518762 - DNA, 22 bp, Homo sapiens
tgggagagaattctggtgactg

SEQ ID NO: 8518763 - DNA, 22 bp, Homo sapiens
tgggagagaattctggtgactg

SEQ ID NO: 8518764 - DNA, 22 bp, Homo sapiens
tgggagagcactgcagccccgg

SEQ ID NO: 8518765 - DNA, 22 bp, Homo sapiens
tgggagagataggcttctggac

SEQ ID NO: 8518766 - DNA, 22 bp, Homo sapiens
tgggagagataggcttctggac

SEQ ID NO: 8518767 - DNA, 22 bp, Homo sapiens
tgggacagggaatctgatcccc

SEQ ID NO: 8518768 - DNA, 22 bp, Homo sapiens
tgggagagaataatcaataggt

SEQ ID NO: 8518769 - DNA, 22 bp, Homo sapiens
tgggacaggaggcctctggaga

SEQ ID NO: 8518770 - DNA, 22 bp, Homo sapiens
tgggacaggaggcctctggaga

SEQ ID NO: 8518771 - DNA, 22 bp, Homo sapiens
tgggacaggatgaccagaaggt

SEQ ID NO: 8518772 - DNA, 22 bp, Homo sapiens
tgggacaggatgaccagaaggt

SEQ ID NO: 8518773 - DNA, 22 bp, Homo sapiens
tgggacagagtgagctttggcc

SEQ ID NO: 8518774 - DNA, 22 bp, Homo sapiens
tgggacagagtgagctttggcc

SEQ ID NO: 8518775 - DNA, 22 bp, Homo sapiens
tgggacaggaggcctctggaga

SEQ ID NO: 8518776 - DNA, 22 bp, Homo sapiens
tgggacagattataagtctgca

SEQ ID NO: 8518777 - DNA, 22 bp, Homo sapiens
tgggcactgtagctggtgctgg

SEQ ID NO: 8518778 - DNA, 22 bp, Homo sapiens
tgggcactgtagctggtgctgg

SEQ ID NO: 8518779 - DNA, 21 bp, Homo sapiens
tgggcactgagggtgctgctc

SEQ ID NO: 8518780 - DNA, 22 bp, Homo sapiens
tgggagtttgttagaaatgcag

SEQ ID NO: 8518781 - DNA, 22 bp, Homo sapiens
tgggcactggaagcctgctgtg

SEQ ID NO: 8518782 - DNA, 22 bp, Homo sapiens
tgggagagcagagaaccctctt

SEQ ID NO: 8518783 - DNA, 22 bp, Homo sapiens
tgggagagcactgcagccccgg

SEQ ID NO: 8518784 - DNA, 21 bp, Homo sapiens
tgggagagcgttgctgtcctc

SEQ ID NO: 8518785 - DNA, 22 bp, Homo sapiens
tgggcagactaaggtcaaagct

SEQ ID NO: 8518786 - DNA, 22 bp, Homo sapiens
tgggcaggagagaagctaaaga

SEQ ID NO: 8518787 - DNA, 22 bp, Homo sapiens
tgggcagacgggagcttgcctt

SEQ ID NO: 8518788 - DNA, 22 bp, Homo sapiens
tgggcagacgctgttggaaggc

SEQ ID NO: 8518789 - DNA, 22 bp, Homo sapiens
tgggcagacattgagtttgttc

SEQ ID NO: 8518790 - DNA, 22 bp, Homo sapiens
tgggcagaattgtggtagttaa

SEQ ID NO: 8518791 - DNA, 22 bp, Homo sapiens
tgggcagaaatcagtatcagat

SEQ ID NO: 8518792 - DNA, 22 bp, Homo sapiens
tgggcagaatgtgggatccaga

SEQ ID NO: 8518793 - DNA, 22 bp, Homo sapiens
tgggcagaatgtgggatccaga

SEQ ID NO: 8518794 - DNA, 22 bp, Homo sapiens
tgggcagaaggaagagccacct

SEQ ID NO: 8518795 - DNA, 22 bp, Homo sapiens
tggcagtgggaatggacaaaca

SEQ ID NO: 8518796 - DNA, 22 bp, Homo sapiens
tggcagtgggaagctggaagtc

SEQ ID NO: 8518797 - DNA, 22 bp, Homo sapiens
tggcagtgggaagctggaagtc

SEQ ID NO: 8518798 - DNA, 22 bp, Homo sapiens
tggcagtgggaagctggaagtc

SEQ ID NO: 8518799 - DNA, 22 bp, Homo sapiens
tggcagtggtgtctgcacaggc

SEQ ID NO: 8518800 - DNA, 22 bp, Homo sapiens
tggcagtggtaccggctctcag

SEQ ID NO: 8518801 - DNA, 22 bp, Homo sapiens
tggcagtggtgtctgcacaggc

SEQ ID NO: 8518802 - DNA, 22 bp, Homo sapiens
tggcagtgtataggtggctcct

SEQ ID NO: 8518803 - DNA, 22 bp, Homo sapiens
tggcagtgggaagctggaagtc

SEQ ID NO: 8518804 - DNA, 22 bp, Homo sapiens
tggcagtgggaagctggaagtc

SEQ ID NO: 8518805 - DNA, 22 bp, Homo sapiens
tggcagtgggaagctggaagtc

SEQ ID NO: 8518806 - DNA, 22 bp, Homo sapiens
tggcagtggctttgctggtgga

SEQ ID NO: 8518807 - DNA, 22 bp, Homo sapiens
tggcagtggctttgctggtgga

SEQ ID NO: 8518808 - DNA, 22 bp, Homo sapiens
tggcagtggctttgctggtgga

SEQ ID NO: 8518809 - DNA, 22 bp, Homo sapiens
tggcagtgtcctactggttggt

SEQ ID NO: 8518810 - DNA, 22 bp, Homo sapiens
tggcagtgtataggtggctcct

SEQ ID NO: 8518811 - DNA, 22 bp, Homo sapiens
tggcagtgtataggtggctcct

SEQ ID NO: 8518812 - DNA, 22 bp, Homo sapiens
tggcagtgtcttgctggggcag

SEQ ID NO: 8518813 - DNA, 22 bp, Homo sapiens
tggcagtgtcttgctggggcag

SEQ ID NO: 8518814 - DNA, 22 bp, Homo sapiens
tggcagtgtcttatcaggagtg

SEQ ID NO: 8518815 - DNA, 22 bp, Homo sapiens
tggcagtgtgggaggaaggtac

SEQ ID NO: 8518816 - DNA, 22 bp, Homo sapiens
tggcagtgtgggaggaaggtac

SEQ ID NO: 8518817 - DNA, 19 bp, Homo sapiens
tggcagtgtggcttccaga

SEQ ID NO: 8518818 - DNA, 22 bp, Homo sapiens
tggcatttggcttacttatgtt

SEQ ID NO: 8518819 - DNA, 22 bp, Homo sapiens
cctccagggcccctctcactgg

SEQ ID NO: 8518820 - DNA, 22 bp, Homo sapiens
cctccagggcccctctcactgg

SEQ ID NO: 8518821 - DNA, 21 bp, Homo sapiens
cctccaggtgattccgtgctc

SEQ ID NO: 8518822 - DNA, 21 bp, Homo sapiens
cctccaggtgattccgtgctc

SEQ ID NO: 8518823 - DNA, 21 bp, Homo sapiens
cctccaggtgattccgtgctc

SEQ ID NO: 8518824 - DNA, 22 bp, Homo sapiens
cctccagggcagacggggagca

SEQ ID NO: 8518825 - DNA, 22 bp, Homo sapiens
cctccagggcagacggggagca

SEQ ID NO: 8518826 - DNA, 22 bp, Homo sapiens
cctccagggcccctctcactgg

SEQ ID NO: 8518827 - DNA, 22 bp, Homo sapiens
cctccagggcagacggggagca

SEQ ID NO: 8518828 - DNA, 20 bp, Homo sapiens
tggccaagtatccaactgga

SEQ ID NO: 8518829 - DNA, 22 bp, Homo sapiens
cctccagctgcctcagtctctt

SEQ ID NO: 8518830 - DNA, 22 bp, Homo sapiens
cctccaggctggttatcagctg

SEQ ID NO: 8518831 - DNA, 22 bp, Homo sapiens
cctccaggctggttatcagctg

SEQ ID NO: 8518832 - DNA, 21 bp, Homo sapiens
tggccaaactggagcatttga

SEQ ID NO: 8518833 - DNA, 22 bp, Homo sapiens
tggccaagccactgctgggtct

SEQ ID NO: 8518834 - DNA, 22 bp, Homo sapiens
tggccaagatgcgacctctcag

SEQ ID NO: 8518835 - DNA, 22 bp, Homo sapiens
tggccaagccactgctgggtct

SEQ ID NO: 8518836 - DNA, 22 bp, Homo sapiens
tggccaagccactgctgggtct

SEQ ID NO: 8518837 - DNA, 22 bp, Homo sapiens
cctccatctccagcttctgcct

SEQ ID NO: 8518838 - DNA, 22 bp, Homo sapiens
cctccatctccagcttctgcct

SEQ ID NO: 8518839 - DNA, 22 bp, Homo sapiens
cctccaggtgttacatatgact

SEQ ID NO: 8518840 - DNA, 22 bp, Homo sapiens
cctccagtcacctggatgagaa

SEQ ID NO: 8518841 - DNA, 21 bp, Homo sapiens
cctccaggtgattccgtgctc

SEQ ID NO: 8518842 - DNA, 22 bp, Homo sapiens
cctccaggtgttacatatgact

SEQ ID NO: 8518843 - DNA, 22 bp, Homo sapiens
cctccagtactccagtccagcg

SEQ ID NO: 8518844 - DNA, 22 bp, Homo sapiens
cctccaggtgttacatatgact

SEQ ID NO: 8518845 - DNA, 22 bp, Homo sapiens
cctccatgtaaaggtcccctca

SEQ ID NO: 8518846 - DNA, 22 bp, Homo sapiens
cctccatgtaaaggtcccctca

SEQ ID NO: 8518847 - DNA, 17 bp, Homo sapiens
cctcccacaccgccctg

SEQ ID NO: 8518848 - DNA, 17 bp, Homo sapiens
cctcccacaccgccctg

SEQ ID NO: 8518849 - DNA, 17 bp, Homo sapiens
cctcccacaccgccctg

SEQ ID NO: 8518850 - DNA, 17 bp, Homo sapiens
cctcccacaccgccctg

SEQ ID NO: 8518851 - DNA, 22 bp, Homo sapiens
cctcccacatcctagctctgct

SEQ ID NO: 8518852 - DNA, 22 bp, Homo sapiens
cctcccacatcctagctctgct

SEQ ID NO: 8518853 - DNA, 22 bp, Homo sapiens
cctcccacatcctagctctgct

SEQ ID NO: 8518854 - DNA, 22 bp, Homo sapiens
cctcccacatcctagctctgct

SEQ ID NO: 8518855 - DNA, 23 bp, Homo sapiens
cctcccacctatttcactttctt

SEQ ID NO: 8518856 - DNA, 23 bp, Homo sapiens
cctcccacctatttcactttctt

SEQ ID NO: 8518857 - DNA, 19 bp, Homo sapiens
cctcccacggattccttcc

SEQ ID NO: 8518858 - DNA, 22 bp, Homo sapiens
cctcccacttcttgctgaggtc

SEQ ID NO: 8518859 - DNA, 22 bp, Homo sapiens
cctcccacttcttgctgaggtc

SEQ ID NO: 8518860 - DNA, 22 bp, Homo sapiens
cctcccacttcttgctgaggtc

SEQ ID NO: 8518861 - DNA, 22 bp, Homo sapiens
cctcccacttcttgctgaggtc

SEQ ID NO: 8518862 - DNA, 22 bp, Homo sapiens
cctcccacattgaggacatgct

SEQ ID NO: 8518863 - DNA, 22 bp, Homo sapiens
cctcccacattgaggacatgct

SEQ ID NO: 8518864 - DNA, 22 bp, Homo sapiens
cctcccaccatttagagagagc

SEQ ID NO: 8518865 - DNA, 22 bp, Homo sapiens
cctcccacattgaggacatgct

SEQ ID NO: 8518866 - DNA, 22 bp, Homo sapiens
cctcccacattgaggacatgct

SEQ ID NO: 8518867 - DNA, 22 bp, Homo sapiens
cctcccaccgtatctcagtggc

SEQ ID NO: 8518868 - DNA, 22 bp, Homo sapiens
cctcccaccgtatctcagtggc

SEQ ID NO: 8518869 - DNA, 22 bp, Homo sapiens
cctcccaccatttagagagagc

SEQ ID NO: 8518870 - DNA, 22 bp, Homo sapiens
cctcccaccgtatctcagtggc

SEQ ID NO: 8518871 - DNA, 23 bp, Homo sapiens
cctcctgggcacaggcctgatgg

SEQ ID NO: 8518872 - DNA, 23 bp, Homo sapiens
cctcctgggcacaggcctgatgg

SEQ ID NO: 8518873 - DNA, 22 bp, Homo sapiens
cctcctgggagagcacggaggg

SEQ ID NO: 8518874 - DNA, 22 bp, Homo sapiens
cctcctgggagagcacggaggg

SEQ ID NO: 8518875 - DNA, 22 bp, Homo sapiens
cctcctgggccttgctctgtga

SEQ ID NO: 8518876 - DNA, 22 bp, Homo sapiens
cctcctgggccttgctctgtga

SEQ ID NO: 8518877 - DNA, 22 bp, Homo sapiens
cctcctgggccttgctctgtga

SEQ ID NO: 8518878 - DNA, 22 bp, Homo sapiens
cctcctgggccttgctctgtga

SEQ ID NO: 8518879 - DNA, 22 bp, Homo sapiens
cctcctgggctcctgtctgcac

SEQ ID NO: 8518880 - DNA, 22 bp, Homo sapiens
cctcctgggctcctgtctgcac

SEQ ID NO: 8518881 - DNA, 22 bp, Homo sapiens
cctcctggcctgtgcagagccc

SEQ ID NO: 8518882 - DNA, 22 bp, Homo sapiens
cctcctggcctgtgcagagccc

SEQ ID NO: 8518883 - DNA, 22 bp, Homo sapiens
cctcctggccctgggcctggaa

SEQ ID NO: 8518884 - DNA, 22 bp, Homo sapiens
cctcctctgtgcagctgtgggt

SEQ ID NO: 8518885 - DNA, 22 bp, Homo sapiens
cctcctgggactcattagcacc

SEQ ID NO: 8518886 - DNA, 22 bp, Homo sapiens
cctcctgggactcattagcacc

SEQ ID NO: 8518887 - DNA, 22 bp, Homo sapiens
cctcctgggacaggctggcaca

SEQ ID NO: 8518888 - DNA, 22 bp, Homo sapiens
cctcctgggacaggctggcaca

SEQ ID NO: 8518889 - DNA, 22 bp, Homo sapiens
cctcctggcttttcccattgaa

SEQ ID NO: 8518890 - DNA, 22 bp, Homo sapiens
tgggcctggacaaggccactag

SEQ ID NO: 8518891 - DNA, 22 bp, Homo sapiens
tgggccgtggagcactctgaga

SEQ ID NO: 8518892 - DNA, 22 bp, Homo sapiens
tgggcctggagccctggagagt

SEQ ID NO: 8518893 - DNA, 22 bp, Homo sapiens
tgggcctggagtttgtccagag

SEQ ID NO: 8518894 - DNA, 22 bp, Homo sapiens
tgggcctggagtttgtccagag

SEQ ID NO: 8518895 - DNA, 22 bp, Homo sapiens
tgggcctggagtttgtccagag

SEQ ID NO: 8518896 - DNA, 22 bp, Homo sapiens
tgggcctggagccctggagagt

SEQ ID NO: 8518897 - DNA, 22 bp, Homo sapiens
tgggcaggagagaagctaaaga

SEQ ID NO: 8518898 - DNA, 22 bp, Homo sapiens
tgggcaggagagaagctaaaga

SEQ ID NO: 8518899 - DNA, 22 bp, Homo sapiens
tgggcaggataatatctcatgt

SEQ ID NO: 8518900 - DNA, 22 bp, Homo sapiens
tgggcaggataatatctcatgt

SEQ ID NO: 8518901 - DNA, 22 bp, Homo sapiens
tgggcaggataatatctcatgt

SEQ ID NO: 8518902 - DNA, 22 bp, Homo sapiens
tgggcaggataatatctcatgt

SEQ ID NO: 8518903 - DNA, 22 bp, Homo sapiens
tgggcaggcaagtgaatacctt

SEQ ID NO: 8518904 - DNA, 22 bp, Homo sapiens
tgggcaggcaagtgaatacctt

SEQ ID NO: 8518905 - DNA, 22 bp, Homo sapiens
tgggcaggcaagtgaatacctt

SEQ ID NO: 8518906 - DNA, 22 bp, Homo sapiens
tgggcaggatgcgttgattctt

SEQ ID NO: 8518907 - DNA, 22 bp, Homo sapiens
tgggcaggatgcgttgattctt

SEQ ID NO: 8518908 - DNA, 22 bp, Homo sapiens
tgggcctgggagggcagacgct

SEQ ID NO: 8518909 - DNA, 23 bp, Homo sapiens
tgggcctggcctcccagtccagc

SEQ ID NO: 8518910 - DNA, 22 bp, Homo sapiens
tgggctcatggcccagcactgg

SEQ ID NO: 8518911 - DNA, 23 bp, Homo sapiens
tgggcctggcctcccagtccagc

SEQ ID NO: 8518912 - DNA, 23 bp, Homo sapiens
tgggcctggcctcccagtccagc

SEQ ID NO: 8518913 - DNA, 22 bp, Homo sapiens
tgggcctggccctgtggaggag

SEQ ID NO: 8518914 - DNA, 22 bp, Homo sapiens
tgggctcatgtttatacatatc

SEQ ID NO: 8518915 - DNA, 22 bp, Homo sapiens
tgggctcatgtttctttgagga

SEQ ID NO: 8518916 - DNA, 22 bp, Homo sapiens
tgggctccagcacctgtgctct

SEQ ID NO: 8518917 - DNA, 22 bp, Homo sapiens
tgggctccagcacctgtgctct

SEQ ID NO: 8518918 - DNA, 22 bp, Homo sapiens
tgggctccagcacctgtgctct

SEQ ID NO: 8518919 - DNA, 22 bp, Homo sapiens
tgggctccagcacctgtgctct

SEQ ID NO: 8518920 - DNA, 22 bp, Homo sapiens
tgggctccggcggcctcaggct

SEQ ID NO: 8518921 - DNA, 22 bp, Homo sapiens
tgggctccggcggcctcaggct

SEQ ID NO: 8518922 - DNA, 22 bp, Homo sapiens
tgggctccggcggcctcaggct

SEQ ID NO: 8518923 - DNA, 22 bp, Homo sapiens
tgggctccggcggcctcaggct

SEQ ID NO: 8518924 - DNA, 22 bp, Homo sapiens
tgggctcctcgtcactcgctgt

SEQ ID NO: 8518925 - DNA, 22 bp, Homo sapiens
tgggctcctcgtcactcgctgt

SEQ ID NO: 8518926 - DNA, 22 bp, Homo sapiens
tgggctccgttgcctggggcag

SEQ ID NO: 8518927 - DNA, 22 bp, Homo sapiens
tgggctccgttgcctggggcag

SEQ ID NO: 8518928 - DNA, 22 bp, Homo sapiens
cctgcagacacttgtccagcaa

SEQ ID NO: 8518929 - DNA, 22 bp, Homo sapiens
tggggagattgttaaatttaga

SEQ ID NO: 8518930 - DNA, 23 bp, Homo sapiens
tggggagagttaccctggaagcg

SEQ ID NO: 8518931 - DNA, 22 bp, Homo sapiens
tggggagcacggtagggaaatg

SEQ ID NO: 8518932 - DNA, 23 bp, Homo sapiens
tggggagagttaccctggaagcg

SEQ ID NO: 8518933 - DNA, 23 bp, Homo sapiens
tggggagagttaccctggaagcg

SEQ ID NO: 8518934 - DNA, 23 bp, Homo sapiens
tggggagagttaccctggaagcg

SEQ ID NO: 8518935 - DNA, 22 bp, Homo sapiens
tggggagagttacaaggaatct

SEQ ID NO: 8518936 - DNA, 22 bp, Homo sapiens
tggggagaggaatttgaatgat

SEQ ID NO: 8518937 - DNA, 22 bp, Homo sapiens
tggggagagattgaggagtttt

SEQ ID NO: 8518938 - DNA, 22 bp, Homo sapiens
tggggagaggaatttgaatgat

SEQ ID NO: 8518939 - DNA, 22 bp, Homo sapiens
tggggagaggtatcattgagat

SEQ ID NO: 8518940 - DNA, 22 bp, Homo sapiens
tggggagagttacaaggaatct

SEQ ID NO: 8518941 - DNA, 22 bp, Homo sapiens
tggggagaggtatcattgagat

SEQ ID NO: 8518942 - DNA, 22 bp, Homo sapiens
tggggagagattgaggagtttt

SEQ ID NO: 8518943 - DNA, 22 bp, Homo sapiens
tggggagagaccggaatgtttc

SEQ ID NO: 8518944 - DNA, 22 bp, Homo sapiens
tggggagagattgaggagtttt

SEQ ID NO: 8518945 - DNA, 22 bp, Homo sapiens
cctgcaggctgcaggccagttc

SEQ ID NO: 8518946 - DNA, 22 bp, Homo sapiens
cctgcagctttgcctcctgaac

SEQ ID NO: 8518947 - DNA, 22 bp, Homo sapiens
cctgcagctgtaggagaaggcg

SEQ ID NO: 8518948 - DNA, 22 bp, Homo sapiens
cctgcagaccacactcagtcct

SEQ ID NO: 8518949 - DNA, 23 bp, Homo sapiens
cctgcagctgctggggctccacc

SEQ ID NO: 8518950 - DNA, 22 bp, Homo sapiens
cctgcagggaatcgaggcagaa

SEQ ID NO: 8518951 - DNA, 22 bp, Homo sapiens
cctgcagggaatcgaggcagaa

SEQ ID NO: 8518952 - DNA, 22 bp, Homo sapiens
cctgcaggctgcaggccagttc

SEQ ID NO: 8518953 - DNA, 22 bp, Homo sapiens
cctgcaggctgcaggccagttc

SEQ ID NO: 8518954 - DNA, 22 bp, Homo sapiens
cctgagtggagggattctgcag

SEQ ID NO: 8518955 - DNA, 22 bp, Homo sapiens
cctgagtgcttccagagtcatg

SEQ ID NO: 8518956 - DNA, 22 bp, Homo sapiens
cctgagtgccatgagagcaccc

SEQ ID NO: 8518957 - DNA, 22 bp, Homo sapiens
cctgagtggtgctaagcagata

SEQ ID NO: 8518958 - DNA, 22 bp, Homo sapiens
cctgagtgtaataatgaaggca

SEQ ID NO: 8518959 - DNA, 22 bp, Homo sapiens
cctgagtggccaggcagctgtg

SEQ ID NO: 8518960 - DNA, 22 bp, Homo sapiens
tgggctcctcgtcactcgctgt

SEQ ID NO: 8518961 - DNA, 22 bp, Homo sapiens
cctgaggtcatggtccagtgtt

SEQ ID NO: 8518962 - DNA, 22 bp, Homo sapiens
cctgagtgaattccctcactgt

SEQ ID NO: 8518963 - DNA, 22 bp, Homo sapiens
cctgagtgccatgagagcaccc

SEQ ID NO: 8518964 - DNA, 21 bp, Homo sapiens
cctgagtgagacctggcccgt

SEQ ID NO: 8518965 - DNA, 21 bp, Homo sapiens
cctgagtgagacctggcccgt

SEQ ID NO: 8518966 - DNA, 22 bp, Homo sapiens
cctgagtgaattccctcactgt

SEQ ID NO: 8518967 - DNA, 22 bp, Homo sapiens
cctgagttagttgctgtgtctc

SEQ ID NO: 8518968 - DNA, 19 bp, Homo sapiens
cctgagtgtttcagagaca

SEQ ID NO: 8518969 - DNA, 19 bp, Homo sapiens
cctgagttgggtgaagaga

SEQ ID NO: 8518970 - DNA, 22 bp, Homo sapiens
cctgagttcttatttccagtca

SEQ ID NO: 8518971 - DNA, 22 bp, Homo sapiens
cctgagttgtcagttgctgtag

SEQ ID NO: 8518972 - DNA, 22 bp, Homo sapiens
cctgatggagccctgctgcatg

SEQ ID NO: 8518973 - DNA, 22 bp, Homo sapiens
tggggagagaccggaatgtttc

SEQ ID NO: 8518974 - DNA, 22 bp, Homo sapiens
tggggagactggccgagatcct

SEQ ID NO: 8518975 - DNA, 22 bp, Homo sapiens
tggggagaagcaatagactcta

SEQ ID NO: 8518976 - DNA, 22 bp, Homo sapiens
tggggagaagcaatagactcta

SEQ ID NO: 8518977 - DNA, 22 bp, Homo sapiens
tggggagaaatgtctttgttcc

SEQ ID NO: 8518978 - DNA, 22 bp, Homo sapiens
tggggagaagcaatagactcta

SEQ ID NO: 8518979 - DNA, 22 bp, Homo sapiens
tggggagaaatgtctttgttcc

SEQ ID NO: 8518980 - DNA, 22 bp, Homo sapiens
cctgatcaagttttctggctcc

SEQ ID NO: 8518981 - DNA, 22 bp, Homo sapiens
tgggtccacaaacatcagatat

SEQ ID NO: 8518982 - DNA, 22 bp, Homo sapiens
tgggtccacaaacatcagatat

SEQ ID NO: 8518983 - DNA, 22 bp, Homo sapiens
tgggtggaataaatcagttctg

SEQ ID NO: 8518984 - DNA, 22 bp, Homo sapiens
tgggtggaataaatcagttctg

SEQ ID NO: 8518985 - DNA, 22 bp, Homo sapiens
tgggtggcacttctggggtcca

SEQ ID NO: 8518986 - DNA, 22 bp, Homo sapiens
tgggtggagctccacaacctgt

SEQ ID NO: 8518987 - DNA, 18 bp, Homo sapiens
tgggtggctagggagttt

SEQ ID NO: 8518988 - DNA, 22 bp, Homo sapiens
tgggtggcggcctggttctgag

SEQ ID NO: 8518989 - DNA, 22 bp, Homo sapiens
tgggtggcacttctggggtcca

SEQ ID NO: 8518990 - DNA, 22 bp, Homo sapiens
tgggtggcacttctggggtcca

SEQ ID NO: 8518991 - DNA, 22 bp, Homo sapiens
tgggtggcagcttcagcatgtt

SEQ ID NO: 8518992 - DNA, 22 bp, Homo sapiens
tgggtgggagcaccctgtctgg

SEQ ID NO: 8518993 - DNA, 18 bp, Homo sapiens
tgggtggctagggagttt

SEQ ID NO: 8518994 - DNA, 18 bp, Homo sapiens
tgggtggctagggagttt

SEQ ID NO: 8518995 - DNA, 22 bp, Homo sapiens
tgggtgggagcaccctgtctgg

SEQ ID NO: 8518996 - DNA, 22 bp, Homo sapiens
tgggtgggagcaccctgtctgg

SEQ ID NO: 8518997 - DNA, 22 bp, Homo sapiens
tgggtgggagcaccctgtctgg

SEQ ID NO: 8518998 - DNA, 23 bp, Homo sapiens
tggtaatagggagcagaaggtag

SEQ ID NO: 8518999 - DNA, 22 bp, Homo sapiens
tgggtgggagcaccctgtctgg

SEQ ID NO: 8519000 - DNA, 22 bp, Homo sapiens
tgggtgggagcaccctgtctgg

SEQ ID NO: 8519001 - DNA, 22 bp, Homo sapiens
tgggtgggagcaccctgtctgg

SEQ ID NO: 8519002 - DNA, 22 bp, Homo sapiens
tggtacaatcacagctcactgt

SEQ ID NO: 8519003 - DNA, 22 bp, Homo sapiens
tggtaatttacgcatttctgta

SEQ ID NO: 8519004 - DNA, 22 bp, Homo sapiens
tggtaatggttctcttgctata

SEQ ID NO: 8519005 - DNA, 21 bp, Homo sapiens
tggtaatgttcagtatccact

SEQ ID NO: 8519006 - DNA, 22 bp, Homo sapiens
tggtaattaatttgataggttc

SEQ ID NO: 8519007 - DNA, 22 bp, Homo sapiens
cctgccagaaaagagggagttc

SEQ ID NO: 8519008 - DNA, 22 bp, Homo sapiens
cctgccacttcttgctatggag

SEQ ID NO: 8519009 - DNA, 22 bp, Homo sapiens
cctgcatccgaaagtgatcata

SEQ ID NO: 8519010 - DNA, 22 bp, Homo sapiens
cctgcagtctacccaatgtgtg

SEQ ID NO: 8519011 - DNA, 22 bp, Homo sapiens
cctgcaggtttcccccggacgg

SEQ ID NO: 8519012 - DNA, 22 bp, Homo sapiens
cctgcaggttgcagaggcggaa

SEQ ID NO: 8519013 - DNA, 22 bp, Homo sapiens
cctgcaggttgcagaggcggaa

SEQ ID NO: 8519014 - DNA, 22 bp, Homo sapiens
cctgcaggtccccggatgcgca

SEQ ID NO: 8519015 - DNA, 22 bp, Homo sapiens
cctgcagggtgctgccacagat

SEQ ID NO: 8519016 - DNA, 22 bp, Homo sapiens
cctgcagggtgctgccacagat

SEQ ID NO: 8519017 - DNA, 22 bp, Homo sapiens
cctgcaggtccccggatgcgca

SEQ ID NO: 8519018 - DNA, 22 bp, Homo sapiens
cctgcaggtccccggatgcgca

SEQ ID NO: 8519019 - DNA, 22 bp, Homo sapiens
cctgcaggtaaggctaactgcc

SEQ ID NO: 8519020 - DNA, 22 bp, Homo sapiens
cctgcaggtaaggctaactgcc

SEQ ID NO: 8519021 - DNA, 19 bp, Homo sapiens
cctgcagggatgagaggtt

SEQ ID NO: 8519022 - DNA, 19 bp, Homo sapiens
cctgcagggatgagaggtt

SEQ ID NO: 8519023 - DNA, 19 bp, Homo sapiens
cctgcagggatgagaggtt

SEQ ID NO: 8519024 - DNA, 22 bp, Homo sapiens
cctgcaggggagagacttctag

SEQ ID NO: 8519025 - DNA, 22 bp, Homo sapiens
cctgcaggggagagacttctag

SEQ ID NO: 8519026 - DNA, 22 bp, Homo sapiens
cctgcaggggagagacttctag

SEQ ID NO: 8519027 - DNA, 22 bp, Homo sapiens
cctgccctgtgtttggggacta

SEQ ID NO: 8519028 - DNA, 22 bp, Homo sapiens
cctgccctgtgtttggggacta

SEQ ID NO: 8519029 - DNA, 22 bp, Homo sapiens
cctgcctatgtaagtggtttct

SEQ ID NO: 8519030 - DNA, 22 bp, Homo sapiens
cctgcctatgtaagtggtttct

SEQ ID NO: 8519031 - DNA, 22 bp, Homo sapiens
cctgcctatgagacgttttgcc

SEQ ID NO: 8519032 - DNA, 22 bp, Homo sapiens
cctgcctactgagttttatatt

SEQ ID NO: 8519033 - DNA, 22 bp, Homo sapiens
cctgcctactgagttttatatt

SEQ ID NO: 8519034 - DNA, 22 bp, Homo sapiens
cctgcctcatcaacttgtcgtg

SEQ ID NO: 8519035 - DNA, 22 bp, Homo sapiens
cctgcctcatcaacttgtcgtg

SEQ ID NO: 8519036 - DNA, 22 bp, Homo sapiens
cctgcctcaggactctgcatat

SEQ ID NO: 8519037 - DNA, 22 bp, Homo sapiens
tggtacttggaggcagaaaaat

SEQ ID NO: 8519038 - DNA, 22 bp, Homo sapiens
tggtacacatgtccaaggtcag

SEQ ID NO: 8519039 - DNA, 21 bp, Homo sapiens
tggtacaccttgcctgtcaga

SEQ ID NO: 8519040 - DNA, 22 bp, Homo sapiens
cctgccctgtcactggctaggg

SEQ ID NO: 8519041 - DNA, 22 bp, Homo sapiens
cctgccctgtcactggctaggg

SEQ ID NO: 8519042 - DNA, 22 bp, Homo sapiens
cctgcccagcttcacctcaggc

SEQ ID NO: 8519043 - DNA, 22 bp, Homo sapiens
cctgcccagcttcacctcaggc

SEQ ID NO: 8519044 - DNA, 22 bp, Homo sapiens
cctgcccagcttcacctcaggc

SEQ ID NO: 8519045 - DNA, 22 bp, Homo sapiens
tggtagcaacatctcagtggct

SEQ ID NO: 8519046 - DNA, 22 bp, Homo sapiens
tggtaggagatatggtctccga

SEQ ID NO: 8519047 - DNA, 22 bp, Homo sapiens
cctgcccagagcccctttcact

SEQ ID NO: 8519048 - DNA, 22 bp, Homo sapiens
cctgcctcccagaggtcctcta

SEQ ID NO: 8519049 - DNA, 22 bp, Homo sapiens
cctgcctcccagaggtcctcta

SEQ ID NO: 8519050 - DNA, 22 bp, Homo sapiens
cctgcctcatcaacttgtcgtg

SEQ ID NO: 8519051 - DNA, 23 bp, Homo sapiens
cctgcctccccatcagttataca

SEQ ID NO: 8519052 - DNA, 22 bp, Homo sapiens
cctgcctgacagagaaggttca

SEQ ID NO: 8519053 - DNA, 22 bp, Homo sapiens
cctgcctgacagagaaggttca

SEQ ID NO: 8519054 - DNA, 19 bp, Homo sapiens
cctgcctgaccccggctac

SEQ ID NO: 8519055 - DNA, 22 bp, Homo sapiens
cctgcctgaaggtcagccaccc

SEQ ID NO: 8519056 - DNA, 22 bp, Homo sapiens
cctgcctgaaggtcagccaccc

SEQ ID NO: 8519057 - DNA, 22 bp, Homo sapiens
cctgcctgaaggtcagccaccc

SEQ ID NO: 8519058 - DNA, 19 bp, Homo sapiens
cctgcctgagctgtccctc

SEQ ID NO: 8519059 - DNA, 17 bp, Homo sapiens
cctgcctgagccatagc

SEQ ID NO: 8519060 - DNA, 22 bp, Homo sapiens
cctgcctgattccaggatggct

SEQ ID NO: 8519061 - DNA, 22 bp, Homo sapiens
cctgcctgattccaggatggct

SEQ ID NO: 8519062 - DNA, 22 bp, Homo sapiens
cctgcctgcaaaatgggacaag

SEQ ID NO: 8519063 - DNA, 22 bp, Homo sapiens
cctgcctgcaaaatgggacaag

SEQ ID NO: 8519064 - DNA, 22 bp, Homo sapiens
cctgcctgcaccttctctgggg

SEQ ID NO: 8519065 - DNA, 22 bp, Homo sapiens
cctgcctgcaccttctctgggg

SEQ ID NO: 8519066 - DNA, 22 bp, Homo sapiens
cctgcctgcagaaagtatctcc

SEQ ID NO: 8519067 - DNA, 22 bp, Homo sapiens
cctgcctgcagaaagtatctcc

SEQ ID NO: 8519068 - DNA, 22 bp, Homo sapiens
cctgcctgcagaaagtatctcc

SEQ ID NO: 8519069 - DNA, 22 bp, Homo sapiens
tggttacagagatttttaagat

SEQ ID NO: 8519070 - DNA, 22 bp, Homo sapiens
ccagtctgaggcctggtgaggg

SEQ ID NO: 8519071 - DNA, 22 bp, Homo sapiens
ccagtctgaggcctggtgaggg

SEQ ID NO: 8519072 - DNA, 22 bp, Homo sapiens
tgagcccaggagttggagaccg

SEQ ID NO: 8519073 - DNA, 22 bp, Homo sapiens
tgagcccaggagtatgaggctg

SEQ ID NO: 8519074 - DNA, 22 bp, Homo sapiens
ccagtctgcagcccctggggac

SEQ ID NO: 8519075 - DNA, 22 bp, Homo sapiens
ccagtgcaggtgagcaccaggt

SEQ ID NO: 8519076 - DNA, 23 bp, Homo sapiens
tgagcccaggaggtcaaggctgc

SEQ ID NO: 8519077 - DNA, 22 bp, Homo sapiens
tgagcccagagatctgagctat

SEQ ID NO: 8519078 - DNA, 22 bp, Homo sapiens
tgagcccagagcccttgtaggg

SEQ ID NO: 8519079 - DNA, 22 bp, Homo sapiens
tgagcccagagatctgagctat

SEQ ID NO: 8519080 - DNA, 19 bp, Homo sapiens
ccagtcccatacaggagat

SEQ ID NO: 8519081 - DNA, 22 bp, Homo sapiens
ccagtcccatctctgtcgctta

SEQ ID NO: 8519082 - DNA, 22 bp, Homo sapiens
tgagccagtggaagatggcagt

SEQ ID NO: 8519083 - DNA, 19 bp, Homo sapiens
ccagtcccatacaggagat

SEQ ID NO: 8519084 - DNA, 22 bp, Homo sapiens
ccagtcccaggcagaaatccag

SEQ ID NO: 8519085 - DNA, 22 bp, Homo sapiens
ccagtcccagctctgccatgct

SEQ ID NO: 8519086 - DNA, 22 bp, Homo sapiens
ccagtcccagctctgccatgct

SEQ ID NO: 8519087 - DNA, 22 bp, Homo sapiens
tgagccatgggactccaaggga

SEQ ID NO: 8519088 - DNA, 22 bp, Homo sapiens
tgagccatgggactccaaggga

SEQ ID NO: 8519089 - DNA, 22 bp, Homo sapiens
tgagccatgggactccaaggga

SEQ ID NO: 8519090 - DNA, 22 bp, Homo sapiens
tgagccatgggactccaaggga

SEQ ID NO: 8519091 - DNA, 22 bp, Homo sapiens
tgagccagtgtggtaaagctga

SEQ ID NO: 8519092 - DNA, 22 bp, Homo sapiens
tgagccagtggaagatggcagt

SEQ ID NO: 8519093 - DNA, 22 bp, Homo sapiens
tgagccagtggaagatggcagt

SEQ ID NO: 8519094 - DNA, 22 bp, Homo sapiens
ccagtgcttccaggaatacggt

SEQ ID NO: 8519095 - DNA, 22 bp, Homo sapiens
ccagtgcgcaggcgccacctgt

SEQ ID NO: 8519096 - DNA, 22 bp, Homo sapiens
ccagtgctaaggtagcctctgc

SEQ ID NO: 8519097 - DNA, 22 bp, Homo sapiens
ccagtgctaaggtagcctctgc

SEQ ID NO: 8519098 - DNA, 21 bp, Homo sapiens
ccagtgctacagctgcctgac

SEQ ID NO: 8519099 - DNA, 21 bp, Homo sapiens
ccagtgctacagctgcctgac

SEQ ID NO: 8519100 - DNA, 22 bp, Homo sapiens
ccagtgcttctttgctagctgg

SEQ ID NO: 8519101 - DNA, 22 bp, Homo sapiens
tgaggcagtgctgggaagcctg

SEQ ID NO: 8519102 - DNA, 22 bp, Homo sapiens
ccagtgcctatctcctctggga

SEQ ID NO: 8519103 - DNA, 19 bp, Homo sapiens
ccagtgccggcgctgggga

SEQ ID NO: 8519104 - DNA, 19 bp, Homo sapiens
ccagtgccggcgctgggga

SEQ ID NO: 8519105 - DNA, 22 bp, Homo sapiens
ccagtgcctgtgggcatggtgc

SEQ ID NO: 8519106 - DNA, 22 bp, Homo sapiens
ccagtgcgagcctgtgctggcc

SEQ ID NO: 8519107 - DNA, 17 bp, Homo sapiens
ccagtgcctgtggcaac

SEQ ID NO: 8519108 - DNA, 18 bp, Homo sapiens
ccagtgccaagagtggca

SEQ ID NO: 8519109 - DNA, 22 bp, Homo sapiens
ccagtgcccagctgcccaggca

SEQ ID NO: 8519110 - DNA, 22 bp, Homo sapiens
ccagtgcccagctgcccaggca

SEQ ID NO: 8519111 - DNA, 22 bp, Homo sapiens
ccagtgcccagctgcccaggca

SEQ ID NO: 8519112 - DNA, 22 bp, Homo sapiens
ccagtgcattgccgtgtctagg

SEQ ID NO: 8519113 - DNA, 22 bp, Homo sapiens
ccagtgcagtccccctgaactg

SEQ ID NO: 8519114 - DNA, 22 bp, Homo sapiens
ccagtgcagtccccctgaactg

SEQ ID NO: 8519115 - DNA, 22 bp, Homo sapiens
ccaggtggacggcgagtacagg

SEQ ID NO: 8519116 - DNA, 22 bp, Homo sapiens
ccaggtggaggtgtgaggtcct

SEQ ID NO: 8519117 - DNA, 17 bp, Homo sapiens
ccaggtgggaggtgggg

SEQ ID NO: 8519118 - DNA, 22 bp, Homo sapiens
ccaggtggcttctgcccgatgt

SEQ ID NO: 8519119 - DNA, 22 bp, Homo sapiens
ccaggtggcttctgcccgatgt

SEQ ID NO: 8519120 - DNA, 22 bp, Homo sapiens
ccaggtgggaggaaagcagaga

SEQ ID NO: 8519121 - DNA, 22 bp, Homo sapiens
ccaggtgggaggaaagcagaga

SEQ ID NO: 8519122 - DNA, 22 bp, Homo sapiens
ccagtccagtgccatgcatggc

SEQ ID NO: 8519123 - DNA, 22 bp, Homo sapiens
ccagtccatatttatactgccg

SEQ ID NO: 8519124 - DNA, 22 bp, Homo sapiens
ccagtccagtgccatgcatggc

SEQ ID NO: 8519125 - DNA, 20 bp, Homo sapiens
ccagtccacctgagacatgt

SEQ ID NO: 8519126 - DNA, 22 bp, Homo sapiens
ccagtcagttctgattatgtgg

SEQ ID NO: 8519127 - DNA, 22 bp, Homo sapiens
ccagtccacgtcaagaagaggt

SEQ ID NO: 8519128 - DNA, 22 bp, Homo sapiens
ccagtcagccaagctgcagcgg

SEQ ID NO: 8519129 - DNA, 22 bp, Homo sapiens
ccagtcagccaagctgcagcgg

SEQ ID NO: 8519130 - DNA, 22 bp, Homo sapiens
ccagtcactggaaaatgggaat

SEQ ID NO: 8519131 - DNA, 22 bp, Homo sapiens
ccagtcagagaaaatgtccact

SEQ ID NO: 8519132 - DNA, 18 bp, Homo sapiens
tgagcaggggctgacctt

SEQ ID NO: 8519133 - DNA, 18 bp, Homo sapiens
tgagcaggggctgacctt

SEQ ID NO: 8519134 - DNA, 22 bp, Homo sapiens
tgagcaggtcaggaagtacatt

SEQ ID NO: 8519135 - DNA, 22 bp, Homo sapiens
tgagcaggtgagtctagggcag

SEQ ID NO: 8519136 - DNA, 22 bp, Homo sapiens
tgagcaggtgagtctagggcag

SEQ ID NO: 8519137 - DNA, 21 bp, Homo sapiens
tgagcaggtgcagggaagtgg

SEQ ID NO: 8519138 - DNA, 21 bp, Homo sapiens
tgagcaggtgcagggaagtgg

SEQ ID NO: 8519139 - DNA, 21 bp, Homo sapiens
tgagcaggtgctgcttttatg

SEQ ID NO: 8519140 - DNA, 17 bp, Homo sapiens
tgagcagtagaagatgc

SEQ ID NO: 8519141 - DNA, 22 bp, Homo sapiens
tgagcagtaggtctgaatagtg

SEQ ID NO: 8519142 - DNA, 22 bp, Homo sapiens
ccagggctgctcattggctggt

SEQ ID NO: 8519143 - DNA, 22 bp, Homo sapiens
ccagggctgcctggccgtgtgt

SEQ ID NO: 8519144 - DNA, 22 bp, Homo sapiens
ccagggctgcctggccgtgtgt

SEQ ID NO: 8519145 - DNA, 22 bp, Homo sapiens
ccagggctgctgggggagttga

SEQ ID NO: 8519146 - DNA, 22 bp, Homo sapiens
ccagggctgctgggggagttga

SEQ ID NO: 8519147 - DNA, 22 bp, Homo sapiens
ccagggctgctgggggagttga

SEQ ID NO: 8519148 - DNA, 22 bp, Homo sapiens
ccagggctgctgggggagttga

SEQ ID NO: 8519149 - DNA, 22 bp, Homo sapiens
tgagcagagacgggggcctcca

SEQ ID NO: 8519150 - DNA, 22 bp, Homo sapiens
tgagcagagacgggggcctcca

SEQ ID NO: 8519151 - DNA, 22 bp, Homo sapiens
ccagggctgctgtgggactcca

SEQ ID NO: 8519152 - DNA, 22 bp, Homo sapiens
ccagggctgctgtgggactcca

SEQ ID NO: 8519153 - DNA, 22 bp, Homo sapiens
tgagtccaccttagtatatggg

SEQ ID NO: 8519154 - DNA, 22 bp, Homo sapiens
tgagtccagatgggccagcagg

SEQ ID NO: 8519155 - DNA, 22 bp, Homo sapiens
tgagtccaagagccagtgggaa

SEQ ID NO: 8519156 - DNA, 22 bp, Homo sapiens
tgagtccaataggggcctggaa

SEQ ID NO: 8519157 - DNA, 22 bp, Homo sapiens
tgagtccaagagccagtgggaa

SEQ ID NO: 8519158 - DNA, 22 bp, Homo sapiens
tgagtcagtgacatgaacttgt

SEQ ID NO: 8519159 - DNA, 22 bp, Homo sapiens
tgagtcagtgacatgaacttgt

SEQ ID NO: 8519160 - DNA, 22 bp, Homo sapiens
tgagtcagtctgccctggcttc

SEQ ID NO: 8519161 - DNA, 22 bp, Homo sapiens
ccatcctgaatggtctcagcca

SEQ ID NO: 8519162 - DNA, 22 bp, Homo sapiens
ccatcctgcattgctattcaga

SEQ ID NO: 8519163 - DNA, 22 bp, Homo sapiens
ccatcctgcaggacctccatat

SEQ ID NO: 8519164 - DNA, 22 bp, Homo sapiens
tgaggtcccaggggtagtgtgc

SEQ ID NO: 8519165 - DNA, 22 bp, Homo sapiens
tgaggtcatggctgatatttcc

SEQ ID NO: 8519166 - DNA, 22 bp, Homo sapiens
tgagtcagccagagctgccatg

SEQ ID NO: 8519167 - DNA, 22 bp, Homo sapiens
tgaggtcctgcatgttgaggtc

SEQ ID NO: 8519168 - DNA, 22 bp, Homo sapiens
tgaggtcctgcatgttgaggtc

SEQ ID NO: 8519169 - DNA, 22 bp, Homo sapiens
tgagtcagtctgccctggcttc

SEQ ID NO: 8519170 - DNA, 20 bp, Homo sapiens
tgagtcagctgcatgggtgg

SEQ ID NO: 8519171 - DNA, 22 bp, Homo sapiens
ccatccaggctgtgggtgagct

SEQ ID NO: 8519172 - DNA, 22 bp, Homo sapiens
ccatccatgaacgaggaagtgg

SEQ ID NO: 8519173 - DNA, 21 bp, Homo sapiens
ccatccatctccctttgctgg

SEQ ID NO: 8519174 - DNA, 22 bp, Homo sapiens
ccatccatatggtgacaaggtg

SEQ ID NO: 8519175 - DNA, 22 bp, Homo sapiens
ccatccatggtgttggttgtat

SEQ ID NO: 8519176 - DNA, 22 bp, Homo sapiens
ccatccatgtggcagggctggc

SEQ ID NO: 8519177 - DNA, 19 bp, Homo sapiens
ccatccatggggccagagg

SEQ ID NO: 8519178 - DNA, 22 bp, Homo sapiens
ccatccatgcgccagacagatt

SEQ ID NO: 8519179 - DNA, 22 bp, Homo sapiens
ccatccattttcttgcttgcct

SEQ ID NO: 8519180 - DNA, 22 bp, Homo sapiens
ccatcctgaatggtctcagcca

SEQ ID NO: 8519181 - DNA, 22 bp, Homo sapiens
ccatcctatctgacctacttgt

SEQ ID NO: 8519182 - DNA, 22 bp, Homo sapiens
ccatccctgggccatgtcccct

SEQ ID NO: 8519183 - DNA, 22 bp, Homo sapiens
ccatccctcctccaccagctag

SEQ ID NO: 8519184 - DNA, 22 bp, Homo sapiens
tgagtcctgtctttgtcactta

SEQ ID NO: 8519185 - DNA, 22 bp, Homo sapiens
tgagtcctggctttgggatgta

SEQ ID NO: 8519186 - DNA, 22 bp, Homo sapiens
tgagtcctgctctgggcagggt

SEQ ID NO: 8519187 - DNA, 22 bp, Homo sapiens
tgagtcctgctgagcagagagg

SEQ ID NO: 8519188 - DNA, 21 bp, Homo sapiens
tgagtctctcagcttcaggta

SEQ ID NO: 8519189 - DNA, 21 bp, Homo sapiens
tgagtctctcagcttcaggta

SEQ ID NO: 8519190 - DNA, 22 bp, Homo sapiens
tgagtctcggtttcccctccaa

SEQ ID NO: 8519191 - DNA, 21 bp, Homo sapiens
tgagtttcagaggggaaggaa

SEQ ID NO: 8519192 - DNA, 22 bp, Homo sapiens
tgagttcttcacattacctacg

SEQ ID NO: 8519193 - DNA, 22 bp, Homo sapiens
tgataaacattttaggaactaa

SEQ ID NO: 8519194 - DNA, 22 bp, Homo sapiens
tgataaactggagaggtggagg

SEQ ID NO: 8519195 - DNA, 22 bp, Homo sapiens
tgataaatccatgtaaatggta

SEQ ID NO: 8519196 - DNA, 22 bp, Homo sapiens
tgataaacttagaaagaatgtt

SEQ ID NO: 8519197 - DNA, 22 bp, Homo sapiens
tgataaactggagaggtggagg

SEQ ID NO: 8519198 - DNA, 22 bp, Homo sapiens
tgataaacattttaggaactaa

SEQ ID NO: 8519199 - DNA, 22 bp, Homo sapiens
tgagttttgtcttgctagaagt

SEQ ID NO: 8519200 - DNA, 22 bp, Homo sapiens
tgagttttgtcttgctagaagt

SEQ ID NO: 8519201 - DNA, 22 bp, Homo sapiens
tgataaacagctgatgaagacc

SEQ ID NO: 8519202 - DNA, 22 bp, Homo sapiens
tgataaacagctgatgaagacc

SEQ ID NO: 8519203 - DNA, 22 bp, Homo sapiens
tgagttttttcaacatatgaag

SEQ ID NO: 8519204 - DNA, 22 bp, Homo sapiens
ccatcacagtccccatcgtgat

SEQ ID NO: 8519205 - DNA, 22 bp, Homo sapiens
ccatcacagtccccatcgtgat

SEQ ID NO: 8519206 - DNA, 22 bp, Homo sapiens
ccatatttgcttcttgctgata

SEQ ID NO: 8519207 - DNA, 22 bp, Homo sapiens
ccatcagcatgggagcatgggc

SEQ ID NO: 8519208 - DNA, 22 bp, Homo sapiens
ccatcagcatgggagcatgggc

SEQ ID NO: 8519209 - DNA, 21 bp, Homo sapiens
ccatccactgagtggttccct

SEQ ID NO: 8519210 - DNA, 22 bp, Homo sapiens
ccatccagaaacttccatcccc

SEQ ID NO: 8519211 - DNA, 22 bp, Homo sapiens
ccatcatttgatacagctgtct

SEQ ID NO: 8519212 - DNA, 22 bp, Homo sapiens
ccatagcaagaggagcagaaat

SEQ ID NO: 8519213 - DNA, 22 bp, Homo sapiens
ccatagtgaattgtctcagacg

SEQ ID NO: 8519214 - DNA, 17 bp, Homo sapiens
ccatactgacatattga

SEQ ID NO: 8519215 - DNA, 22 bp, Homo sapiens
ccatacacacaccaaatttgta

SEQ ID NO: 8519216 - DNA, 22 bp, Homo sapiens
ccatacacacaccaaatttgta

SEQ ID NO: 8519217 - DNA, 21 bp, Homo sapiens
ccatacctacctcacctggtt

SEQ ID NO: 8519218 - DNA, 22 bp, Homo sapiens
tgaggctgagatatcagggagg

SEQ ID NO: 8519219 - DNA, 18 bp, Homo sapiens
tgaggctgagggtagagg

SEQ ID NO: 8519220 - DNA, 18 bp, Homo sapiens
tgaggctgagggtagagg

SEQ ID NO: 8519221 - DNA, 18 bp, Homo sapiens
tgaggctgagggtagagg

SEQ ID NO: 8519222 - DNA, 22 bp, Homo sapiens
ccagtgttttccagtttgccca

SEQ ID NO: 8519223 - DNA, 22 bp, Homo sapiens
tgaggcccatctgagattttga

SEQ ID NO: 8519224 - DNA, 22 bp, Homo sapiens
tgaggcccagccgccctgagag

SEQ ID NO: 8519225 - DNA, 22 bp, Homo sapiens
tgaggcccagccgccctgagag

SEQ ID NO: 8519226 - DNA, 22 bp, Homo sapiens
tgaggcccagccgccctgagag

SEQ ID NO: 8519227 - DNA, 20 bp, Homo sapiens
tgaggcccagcagagtcggg

SEQ ID NO: 8519228 - DNA, 22 bp, Homo sapiens
tgaggctgaaactggcgataga

SEQ ID NO: 8519229 - DNA, 18 bp, Homo sapiens
tgaggctgaatatggggc

SEQ ID NO: 8519230 - DNA, 22 bp, Homo sapiens
tgaggctgaaactggcgataga

SEQ ID NO: 8519231 - DNA, 18 bp, Homo sapiens
tgaggctgaatatggggc

SEQ ID NO: 8519232 - DNA, 22 bp, Homo sapiens
tgaggctgacaaaagatgaggt

SEQ ID NO: 8519233 - DNA, 22 bp, Homo sapiens
tgaggctgacaaaagatgaggt

SEQ ID NO: 8519234 - DNA, 22 bp, Homo sapiens
tgaggctgacaaaagatgaggt

SEQ ID NO: 8519235 - DNA, 22 bp, Homo sapiens
tgaggctgagatatcagggagg

SEQ ID NO: 8519236 - DNA, 22 bp, Homo sapiens
tgaggctgagatatcagggagg

SEQ ID NO: 8519237 - DNA, 22 bp, Homo sapiens
tgaggccatggaactagcttgg

SEQ ID NO: 8519238 - DNA, 17 bp, Homo sapiens
tgaggccatggcaccat

SEQ ID NO: 8519239 - DNA, 22 bp, Homo sapiens
tgaggccatggaactagcttgg

SEQ ID NO: 8519240 - DNA, 22 bp, Homo sapiens
tgaggccatgcccgtgccggcc

SEQ ID NO: 8519241 - DNA, 22 bp, Homo sapiens
tgaggccatggtcttcccagtc

SEQ ID NO: 8519242 - DNA, 20 bp, Homo sapiens
tgaggcccagcagagtcggg

SEQ ID NO: 8519243 - DNA, 17 bp, Homo sapiens
tgaggccatggcaccat

SEQ ID NO: 8519244 - DNA, 22 bp, Homo sapiens
tgaggccagggattccatcatt

SEQ ID NO: 8519245 - DNA, 22 bp, Homo sapiens
tgaggccaggcaaaggcgatct

SEQ ID NO: 8519246 - DNA, 22 bp, Homo sapiens
tgaggccagtgacatatattaa

SEQ ID NO: 8519247 - DNA, 22 bp, Homo sapiens
tgaggccagtctcatcacaggc

SEQ ID NO: 8519248 - DNA, 22 bp, Homo sapiens
tgaggccagtctcatcacaggc

SEQ ID NO: 8519249 - DNA, 21 bp, Homo sapiens
tgcaggcaggcagagatgctg

SEQ ID NO: 8519250 - DNA, 22 bp, Homo sapiens
tgcaggcaggggatgagcagcc

SEQ ID NO: 8519251 - DNA, 22 bp, Homo sapiens
tgcaggcaggggatgagcagcc

SEQ ID NO: 8519252 - DNA, 22 bp, Homo sapiens
tgcaggccggccctaggcctca

SEQ ID NO: 8519253 - DNA, 22 bp, Homo sapiens
tgcaggcctcacacctggcacc

SEQ ID NO: 8519254 - DNA, 22 bp, Homo sapiens
tgcaggcccagtgtagaggctc

SEQ ID NO: 8519255 - DNA, 22 bp, Homo sapiens
cccagcagccagaatgaggagc

SEQ ID NO: 8519256 - DNA, 22 bp, Homo sapiens
cccagcagcttgcacagtgctg

SEQ ID NO: 8519257 - DNA, 22 bp, Homo sapiens
cccagcagccttgtcccttctc

SEQ ID NO: 8519258 - DNA, 22 bp, Homo sapiens
cccagcaggaggaggttgcagt

SEQ ID NO: 8519259 - DNA, 22 bp, Homo sapiens
cccagcagcttgcacagtgctg

SEQ ID NO: 8519260 - DNA, 22 bp, Homo sapiens
cccagcaggtcggtgctgcctg

SEQ ID NO: 8519261 - DNA, 22 bp, Homo sapiens
cccagcagggtctctgtgtcta

SEQ ID NO: 8519262 - DNA, 22 bp, Homo sapiens
tgcagggccttgttgatgtgct

SEQ ID NO: 8519263 - DNA, 22 bp, Homo sapiens
tgcagggccttgggatgtgtcc

SEQ ID NO: 8519264 - DNA, 22 bp, Homo sapiens
tgcagggccttgttgatgtgct

SEQ ID NO: 8519265 - DNA, 22 bp, Homo sapiens
tgcagggccttctagaccatgg

SEQ ID NO: 8519266 - DNA, 22 bp, Homo sapiens
tgcagggccttctagaccatgg

SEQ ID NO: 8519267 - DNA, 22 bp, Homo sapiens
tgcagggccttgggatgtgtcc

SEQ ID NO: 8519268 - DNA, 20 bp, Homo sapiens
tgcagggcctaaaaagggaa

SEQ ID NO: 8519269 - DNA, 22 bp, Homo sapiens
tgcagggccttctagaccatgg

SEQ ID NO: 8519270 - DNA, 22 bp, Homo sapiens
tgcagggccgctggaggtcatg

SEQ ID NO: 8519271 - DNA, 22 bp, Homo sapiens
cccagaggggtcgtctgagggg

SEQ ID NO: 8519272 - DNA, 22 bp, Homo sapiens
cccagaggggtcgtctgagggg

SEQ ID NO: 8519273 - DNA, 22 bp, Homo sapiens
cccagagggctgaggatatgaa

SEQ ID NO: 8519274 - DNA, 22 bp, Homo sapiens
cccagagggaagggaatgaggt

SEQ ID NO: 8519275 - DNA, 22 bp, Homo sapiens
cccagagggaagggaatgaggt

SEQ ID NO: 8519276 - DNA, 22 bp, Homo sapiens
cccagagggctgaggatatgaa

SEQ ID NO: 8519277 - DNA, 22 bp, Homo sapiens
cccagagggctgaggatatgaa

SEQ ID NO: 8519278 - DNA, 22 bp, Homo sapiens
cccagaggctgagttgggagca

SEQ ID NO: 8519279 - DNA, 22 bp, Homo sapiens
cccagagggaagggaatgaggt

SEQ ID NO: 8519280 - DNA, 22 bp, Homo sapiens
cccagagggaagggaatgaggt

SEQ ID NO: 8519281 - DNA, 22 bp, Homo sapiens
cccagaggctgagttgggagca

SEQ ID NO: 8519282 - DNA, 22 bp, Homo sapiens
cccagaggaggatctcggcccg

SEQ ID NO: 8519283 - DNA, 22 bp, Homo sapiens
cccagaggaggcaaagctctgt

SEQ ID NO: 8519284 - DNA, 22 bp, Homo sapiens
cccagaggaggatctcggcccg

SEQ ID NO: 8519285 - DNA, 23 bp, Homo sapiens
cccagaggagcagggcgtgagat

SEQ ID NO: 8519286 - DNA, 22 bp, Homo sapiens
cccagaggaggatctcggcccg

SEQ ID NO: 8519287 - DNA, 22 bp, Homo sapiens
tgcagctgattaaagggcagac

SEQ ID NO: 8519288 - DNA, 22 bp, Homo sapiens
tgcagctgattaaagggcagac

SEQ ID NO: 8519289 - DNA, 22 bp, Homo sapiens
cccagaggggtcgtctgagggg

SEQ ID NO: 8519290 - DNA, 20 bp, Homo sapiens
tgcagctgcaggagggtggg

SEQ ID NO: 8519291 - DNA, 22 bp, Homo sapiens
tgcaggaatcagaggggaagcg

SEQ ID NO: 8519292 - DNA, 20 bp, Homo sapiens
tgcaggaatttgcattcctt

SEQ ID NO: 8519293 - DNA, 20 bp, Homo sapiens
tgcaggaatttgcattcctt

SEQ ID NO: 8519294 - DNA, 22 bp, Homo sapiens
tgcaggaatgaggttctcagtt

SEQ ID NO: 8519295 - DNA, 22 bp, Homo sapiens
tgcaggaatgaggttctcagtt

SEQ ID NO: 8519296 - DNA, 22 bp, Homo sapiens
tgcaggaattttttgcagaaag

SEQ ID NO: 8519297 - DNA, 22 bp, Homo sapiens
tgcaggaattttttgcagaaag

SEQ ID NO: 8519298 - DNA, 23 bp, Homo sapiens
tgcaggactactcgagcactgct

SEQ ID NO: 8519299 - DNA, 22 bp, Homo sapiens
tgcaggactcaagggtagcagg

SEQ ID NO: 8519300 - DNA, 23 bp, Homo sapiens
tgcagctgcctctggcgggccgg

SEQ ID NO: 8519301 - DNA, 22 bp, Homo sapiens
tgcaggaagtttcctgaacttt

SEQ ID NO: 8519302 - DNA, 22 bp, Homo sapiens
tgcagctgctcattctctcagt

SEQ ID NO: 8519303 - DNA, 22 bp, Homo sapiens
tgcaggaatattgatgaactta

SEQ ID NO: 8519304 - DNA, 22 bp, Homo sapiens
tgcaggaatagctacagagctg

SEQ ID NO: 8519305 - DNA, 22 bp, Homo sapiens
tgcaggaagtttcctgaacttt

SEQ ID NO: 8519306 - DNA, 22 bp, Homo sapiens
tgcaggaatagctacagagctg

SEQ ID NO: 8519307 - DNA, 22 bp, Homo sapiens
tgcaggaatagctacagagctg

SEQ ID NO: 8519308 - DNA, 22 bp, Homo sapiens
cccaagggagtgcctggtcaac

SEQ ID NO: 8519309 - DNA, 22 bp, Homo sapiens
cccaagggagtgcctggtcaac

SEQ ID NO: 8519310 - DNA, 22 bp, Homo sapiens
cccaagggatgcttgagtagtt

SEQ ID NO: 8519311 - DNA, 22 bp, Homo sapiens
cccaagggatgcttgagtagtt

SEQ ID NO: 8519312 - DNA, 22 bp, Homo sapiens
cccaaggggtgttgatggagga

SEQ ID NO: 8519313 - DNA, 22 bp, Homo sapiens
tgcacagatgctaggaggtgaa

SEQ ID NO: 8519314 - DNA, 22 bp, Homo sapiens
cccaagggtgcccagcagagga

SEQ ID NO: 8519315 - DNA, 22 bp, Homo sapiens
cccaaggggtgttgatggagga

SEQ ID NO: 8519316 - DNA, 22 bp, Homo sapiens
cccaaggggtgttgatggagga

SEQ ID NO: 8519317 - DNA, 22 bp, Homo sapiens
cccaaggggtgttgatggagga

SEQ ID NO: 8519318 - DNA, 22 bp, Homo sapiens
tgcacagatgggcttgttcata

SEQ ID NO: 8519319 - DNA, 22 bp, Homo sapiens
tgcacagatgggcttgttcata

SEQ ID NO: 8519320 - DNA, 22 bp, Homo sapiens
tgcacagatgctaggaggtgaa

SEQ ID NO: 8519321 - DNA, 22 bp, Homo sapiens
tgcactatttcgccatggttgt

SEQ ID NO: 8519322 - DNA, 22 bp, Homo sapiens
tgcactccaggctgggtgacag

SEQ ID NO: 8519323 - DNA, 22 bp, Homo sapiens
tgcactccaggctgggtgacag

SEQ ID NO: 8519324 - DNA, 23 bp, Homo sapiens
cccaagcctgtgccctctgactc

SEQ ID NO: 8519325 - DNA, 22 bp, Homo sapiens
cccaaggaagacgcttgtgata

SEQ ID NO: 8519326 - DNA, 22 bp, Homo sapiens
cccaaggaagacgcttgtgata

SEQ ID NO: 8519327 - DNA, 22 bp, Homo sapiens
cccaaggacacgggcagggaca

SEQ ID NO: 8519328 - DNA, 21 bp, Homo sapiens
cccaagggaggcaggataagg

SEQ ID NO: 8519329 - DNA, 21 bp, Homo sapiens
cccaagggaggcaggataagg

SEQ ID NO: 8519330 - DNA, 22 bp, Homo sapiens
cccaaggctgcagtgagcatga

SEQ ID NO: 8519331 - DNA, 19 bp, Homo sapiens
cccaaggccctgggcaggc

SEQ ID NO: 8519332 - DNA, 22 bp, Homo sapiens
tgcaagtgccatgtgcacagtg

SEQ ID NO: 8519333 - DNA, 22 bp, Homo sapiens
tgcaataacccagtatctgtga

SEQ ID NO: 8519334 - DNA, 22 bp, Homo sapiens
tgcaataacccagtatctgtga

SEQ ID NO: 8519335 - DNA, 22 bp, Homo sapiens
tgcaataacccagtatctgtga

SEQ ID NO: 8519336 - DNA, 22 bp, Homo sapiens
tgcaataaagtgctataaatcc

SEQ ID NO: 8519337 - DNA, 22 bp, Homo sapiens
tgcaataaagtgctataaatcc

SEQ ID NO: 8519338 - DNA, 22 bp, Homo sapiens
tgcaataaagtgctataaatcc

SEQ ID NO: 8519339 - DNA, 22 bp, Homo sapiens
tgcaataaagtgctataaatcc

SEQ ID NO: 8519340 - DNA, 22 bp, Homo sapiens
tgcaaatattccatgctgttca

SEQ ID NO: 8519341 - DNA, 22 bp, Homo sapiens
tgataatgttcgagaatgaaga

SEQ ID NO: 8519342 - DNA, 22 bp, Homo sapiens
tgatacaatcatgagagaggac

SEQ ID NO: 8519343 - DNA, 22 bp, Homo sapiens
tgataaatccatgtaaatggta

SEQ ID NO: 8519344 - DNA, 22 bp, Homo sapiens
tgataactctcagtttctcatg

SEQ ID NO: 8519345 - DNA, 22 bp, Homo sapiens
tgcaatatgttgcattgtatgg

SEQ ID NO: 8519346 - DNA, 22 bp, Homo sapiens
tgcaatatgttgcattgtatgg

SEQ ID NO: 8519347 - DNA, 22 bp, Homo sapiens
tgcaataatgtatgtcactccc

SEQ ID NO: 8519348 - DNA, 23 bp, Homo sapiens
tgcaatatgtcagtgcaaagtgg

SEQ ID NO: 8519349 - DNA, 22 bp, Homo sapiens
tgcaatatgttgcattgtatgg

SEQ ID NO: 8519350 - DNA, 22 bp, Homo sapiens
tgcaataacccatgagatagaa

SEQ ID NO: 8519351 - DNA, 22 bp, Homo sapiens
tgcaataactactttaatgttg

SEQ ID NO: 8519352 - DNA, 22 bp, Homo sapiens
tgcaataaggagtaatagtaaa

SEQ ID NO: 8519353 - DNA, 22 bp, Homo sapiens
tgcaataactactttaatgttg

SEQ ID NO: 8519354 - DNA, 22 bp, Homo sapiens
tgcaataaggagtaatagtaaa

SEQ ID NO: 8519355 - DNA, 22 bp, Homo sapiens
tgcaataagttgtgttatcact

SEQ ID NO: 8519356 - DNA, 22 bp, Homo sapiens
tgcaataagttgtgttatcact

SEQ ID NO: 8519357 - DNA, 22 bp, Homo sapiens
tgcaataagtattgcttacatg

SEQ ID NO: 8519358 - DNA, 22 bp, Homo sapiens
tgcaataaggagtaatagtaaa

SEQ ID NO: 8519359 - DNA, 22 bp, Homo sapiens
tgcaataaggagtaatagtaaa

SEQ ID NO: 8519360 - DNA, 16 bp, Homo sapiens
tgcagagagcatggtg

SEQ ID NO: 8519361 - DNA, 22 bp, Homo sapiens
cccagagcctcattctgttggg

SEQ ID NO: 8519362 - DNA, 22 bp, Homo sapiens
cccagagcctcattctgttggg

SEQ ID NO: 8519363 - DNA, 22 bp, Homo sapiens
cccagagcctcattctgttggg

SEQ ID NO: 8519364 - DNA, 22 bp, Homo sapiens
cccagagatgggaggtgatcgg

SEQ ID NO: 8519365 - DNA, 22 bp, Homo sapiens
cccagagctgagggggcacgtt

SEQ ID NO: 8519366 - DNA, 22 bp, Homo sapiens
cccagagctgagggggcacgtt

SEQ ID NO: 8519367 - DNA, 22 bp, Homo sapiens
cccagagctgagtctgatatat

SEQ ID NO: 8519368 - DNA, 22 bp, Homo sapiens
cccagagctgagtctgatatat

SEQ ID NO: 8519369 - DNA, 22 bp, Homo sapiens
cccagagctgagtctgatatat

SEQ ID NO: 8519370 - DNA, 22 bp, Homo sapiens
cccagagctccggtcctgccca

SEQ ID NO: 8519371 - DNA, 22 bp, Homo sapiens
cccagagctccggtcctgccca

SEQ ID NO: 8519372 - DNA, 22 bp, Homo sapiens
cccagagctgagggggcacgtt

SEQ ID NO: 8519373 - DNA, 22 bp, Homo sapiens
cccagagcctcattctgttggg

SEQ ID NO: 8519374 - DNA, 22 bp, Homo sapiens
cccagagctcagtgtgcaaggt

SEQ ID NO: 8519375 - DNA, 22 bp, Homo sapiens
cccagagctcagtgtgcaaggt

SEQ ID NO: 8519376 - DNA, 22 bp, Homo sapiens
cccagagctccggtcctgccca

SEQ ID NO: 8519377 - DNA, 22 bp, Homo sapiens
cccagagctccggtcctgccca

SEQ ID NO: 8519378 - DNA, 22 bp, Homo sapiens
cccagagctgggtgggcagcgg

SEQ ID NO: 8519379 - DNA, 22 bp, Homo sapiens
cccagagctgggtgggcagcgg

SEQ ID NO: 8519380 - DNA, 22 bp, Homo sapiens
cccagagctgggtgggcagcgg

SEQ ID NO: 8519381 - DNA, 22 bp, Homo sapiens
cccagagctgattgttggagcc

SEQ ID NO: 8519382 - DNA, 22 bp, Homo sapiens
cccagagctgattgttggagcc

SEQ ID NO: 8519383 - DNA, 18 bp, Homo sapiens
cccagaggaatgcctgga

SEQ ID NO: 8519384 - DNA, 23 bp, Homo sapiens
cccagaggagcagggcgtgagat

SEQ ID NO: 8519385 - DNA, 23 bp, Homo sapiens
cccagaggagcagggcgtgagat

SEQ ID NO: 8519386 - DNA, 23 bp, Homo sapiens
cccagaggagcagggcgtgagat

SEQ ID NO: 8519387 - DNA, 19 bp, Homo sapiens
cccagaggaatgcctggaa

SEQ ID NO: 8519388 - DNA, 19 bp, Homo sapiens
cccagaggaatgcctggaa

SEQ ID NO: 8519389 - DNA, 22 bp, Homo sapiens
tgcagagagatcctcagggttt

SEQ ID NO: 8519390 - DNA, 22 bp, Homo sapiens
tgcagagagatatggcaagagg

SEQ ID NO: 8519391 - DNA, 22 bp, Homo sapiens
tgcagagagacccctgggccag

SEQ ID NO: 8519392 - DNA, 22 bp, Homo sapiens
tgcagagacttgtgtgcatttg

SEQ ID NO: 8519393 - DNA, 22 bp, Homo sapiens
tgcagagaaaccagtggaggac

SEQ ID NO: 8519394 - DNA, 22 bp, Homo sapiens
tgcagagaaagtgtagacaggc

SEQ ID NO: 8519395 - DNA, 22 bp, Homo sapiens
tgcagagaccactgtgccttcc

SEQ ID NO: 8519396 - DNA, 22 bp, Homo sapiens
tgcagagacttgtgtgcatttg

SEQ ID NO: 8519397 - DNA, 22 bp, Homo sapiens
tgcagagaagaggacagttcta

SEQ ID NO: 8519398 - DNA, 22 bp, Homo sapiens
tgcagagaagaggacagttcta

SEQ ID NO: 8519399 - DNA, 22 bp, Homo sapiens
tgcagagaagaggacagttcta

SEQ ID NO: 8519400 - DNA, 22 bp, Homo sapiens
tgcacttgtgttttcagaatct

SEQ ID NO: 8519401 - DNA, 22 bp, Homo sapiens
tgcactttgcaggcatggaaac

SEQ ID NO: 8519402 - DNA, 22 bp, Homo sapiens
tgcactggggtcccagcgcacg

SEQ ID NO: 8519403 - DNA, 22 bp, Homo sapiens
tgcactgatcctgaccagtgaa

SEQ ID NO: 8519404 - DNA, 22 bp, Homo sapiens
tgcactgatgttttgccaagga

SEQ ID NO: 8519405 - DNA, 22 bp, Homo sapiens
tgcactgaatagtagactgtac

SEQ ID NO: 8519406 - DNA, 22 bp, Homo sapiens
tgcactccaggctgggtgacag

SEQ ID NO: 8519407 - DNA, 22 bp, Homo sapiens
tgcactccaggctgggtgacag

SEQ ID NO: 8519408 - DNA, 22 bp, Homo sapiens
tcttacagaaaatagataacat

SEQ ID NO: 8519409 - DNA, 20 bp, Homo sapiens
tcttacaatcgttacatcca

SEQ ID NO: 8519410 - DNA, 20 bp, Homo sapiens
tcttacaatcgttacatcca

SEQ ID NO: 8519411 - DNA, 22 bp, Homo sapiens
tcttacaagtcacccgctttct

SEQ ID NO: 8519412 - DNA, 22 bp, Homo sapiens
tcttacaagaaggaaaagggag

SEQ ID NO: 8519413 - DNA, 22 bp, Homo sapiens
tcttacagccactctgtgaagc

SEQ ID NO: 8519414 - DNA, 22 bp, Homo sapiens
tcttacatatacgtcatttagt

SEQ ID NO: 8519415 - DNA, 22 bp, Homo sapiens
tcttacatatagcatgagtaca

SEQ ID NO: 8519416 - DNA, 22 bp, Homo sapiens
ccaggcagcaaattttctgaat

SEQ ID NO: 8519417 - DNA, 22 bp, Homo sapiens
tcttaatgctagccaatagaga

SEQ ID NO: 8519418 - DNA, 22 bp, Homo sapiens
tcttaattctgtgtcttcacta

SEQ ID NO: 8519419 - DNA, 22 bp, Homo sapiens
tcttacaagaaataagccaatg

SEQ ID NO: 8519420 - DNA, 22 bp, Homo sapiens
tcttaattgagaacagtgtagg

SEQ ID NO: 8519421 - DNA, 22 bp, Homo sapiens
tcttaattgagaacagtgtagg

SEQ ID NO: 8519422 - DNA, 22 bp, Homo sapiens
ccaggcagagtgctccagaaag

SEQ ID NO: 8519423 - DNA, 22 bp, Homo sapiens
ccaggcagagtgctccagaaag

SEQ ID NO: 8519424 - DNA, 22 bp, Homo sapiens
ccaggcagagtgctccagaaag

SEQ ID NO: 8519425 - DNA, 22 bp, Homo sapiens
ccaggcagagtgctccagaaag

SEQ ID NO: 8519426 - DNA, 22 bp, Homo sapiens
ccaggcagagtgctccagaaag

SEQ ID NO: 8519427 - DNA, 22 bp, Homo sapiens
ccaggcagagggatccccatcc

SEQ ID NO: 8519428 - DNA, 22 bp, Homo sapiens
ccaggcagagggatccccatcc

SEQ ID NO: 8519429 - DNA, 22 bp, Homo sapiens
ccaggcagagggatccccatcc

SEQ ID NO: 8519430 - DNA, 22 bp, Homo sapiens
ccaggcagagggaatagcaagt

SEQ ID NO: 8519431 - DNA, 21 bp, Homo sapiens
ccaggcagagctgtgagttct

SEQ ID NO: 8519432 - DNA, 22 bp, Homo sapiens
ccaggcagaatgaaacccctgt

SEQ ID NO: 8519433 - DNA, 22 bp, Homo sapiens
ccaggcagaatgaaacccctgt

SEQ ID NO: 8519434 - DNA, 22 bp, Homo sapiens
ccaggcacttgtttgccaggca

SEQ ID NO: 8519435 - DNA, 22 bp, Homo sapiens
ccaggaggcttcgtccgtggag

SEQ ID NO: 8519436 - DNA, 22 bp, Homo sapiens
ccaggcaattctgaaagcattt

SEQ ID NO: 8519437 - DNA, 22 bp, Homo sapiens
ccaggaggcggaggttgcagtg

SEQ ID NO: 8519438 - DNA, 22 bp, Homo sapiens
ccaggaggcggaggttgcagtg

SEQ ID NO: 8519439 - DNA, 22 bp, Homo sapiens
ccaggaggcggaggttgcagtg

SEQ ID NO: 8519440 - DNA, 22 bp, Homo sapiens
ccaggaggcggaggttgcagtg

SEQ ID NO: 8519441 - DNA, 22 bp, Homo sapiens
ccaggaggcggaggttgcagcg

SEQ ID NO: 8519442 - DNA, 22 bp, Homo sapiens
ccaggaggcggaggttgcagcg

SEQ ID NO: 8519443 - DNA, 22 bp, Homo sapiens
ccaggaggcggaggttgcagtg

SEQ ID NO: 8519444 - DNA, 22 bp, Homo sapiens
ccaggaggcggaggttgcagtg

SEQ ID NO: 8519445 - DNA, 22 bp, Homo sapiens
ccaggaggctctgactggaccc

SEQ ID NO: 8519446 - DNA, 22 bp, Homo sapiens
ccaggaggctctgactggaccc

SEQ ID NO: 8519447 - DNA, 22 bp, Homo sapiens
ccaggaggctctgactggaccc

SEQ ID NO: 8519448 - DNA, 22 bp, Homo sapiens
ccaggcaggcgatggtgcagtg

SEQ ID NO: 8519449 - DNA, 22 bp, Homo sapiens
ccaggcccccgagcagaagaca

SEQ ID NO: 8519450 - DNA, 22 bp, Homo sapiens
ccaggcctcctgtgagtggacc

SEQ ID NO: 8519451 - DNA, 19 bp, Homo sapiens
ccaggcctcctgggaggtc

SEQ ID NO: 8519452 - DNA, 22 bp, Homo sapiens
ccaggcagctctgatttatgtc

SEQ ID NO: 8519453 - DNA, 22 bp, Homo sapiens
ccaggcagcctgctccattctg

SEQ ID NO: 8519454 - DNA, 22 bp, Homo sapiens
ccaggcagcctgctccattctg

SEQ ID NO: 8519455 - DNA, 22 bp, Homo sapiens
ccaggcagccaagtgtgtgtgt

SEQ ID NO: 8519456 - DNA, 22 bp, Homo sapiens
ccaggcagccaagtgtgtgtgt

SEQ ID NO: 8519457 - DNA, 22 bp, Homo sapiens
ccaggcaggcagcgttctcagg

SEQ ID NO: 8519458 - DNA, 22 bp, Homo sapiens
ccaggcaggcagcgttctcagg

SEQ ID NO: 8519459 - DNA, 22 bp, Homo sapiens
ccaggcaggcagcgttctcagg

SEQ ID NO: 8519460 - DNA, 22 bp, Homo sapiens
ccaggcaggcagcgttctcagg

SEQ ID NO: 8519461 - DNA, 22 bp, Homo sapiens
ccaggcaggcgatggtgcagtg

SEQ ID NO: 8519462 - DNA, 22 bp, Homo sapiens
ccaggcaggcgatggtgcagtg

SEQ ID NO: 8519463 - DNA, 22 bp, Homo sapiens
ccaggcaggcgatggtgcagtg

SEQ ID NO: 8519464 - DNA, 22 bp, Homo sapiens
ccaggcaggcgatggtgcagtg

SEQ ID NO: 8519465 - DNA, 17 bp, Homo sapiens
tcttctcttccagtctt

SEQ ID NO: 8519466 - DNA, 17 bp, Homo sapiens
tcttctcttccagtctt

SEQ ID NO: 8519467 - DNA, 17 bp, Homo sapiens
tcttctcttccagtctt

SEQ ID NO: 8519468 - DNA, 17 bp, Homo sapiens
tcttctcttccagtctt

SEQ ID NO: 8519469 - DNA, 22 bp, Homo sapiens
tcttctctgtggcctggtggtg

SEQ ID NO: 8519470 - DNA, 22 bp, Homo sapiens
tcttctctgtggcctggtggtg

SEQ ID NO: 8519471 - DNA, 17 bp, Homo sapiens
tcttctcttccagtctt

SEQ ID NO: 8519472 - DNA, 17 bp, Homo sapiens
tcttctcttccagtctt

SEQ ID NO: 8519473 - DNA, 22 bp, Homo sapiens
tcttctggatcgatcacattgt

SEQ ID NO: 8519474 - DNA, 22 bp, Homo sapiens
ccaggcagcaaattttctgaat

SEQ ID NO: 8519475 - DNA, 22 bp, Homo sapiens
tcttctgatgccagtaaccatg

SEQ ID NO: 8519476 - DNA, 22 bp, Homo sapiens
tcttctgaaggtaggaagcatt

SEQ ID NO: 8519477 - DNA, 19 bp, Homo sapiens
tcttctgacttcaagaaac

SEQ ID NO: 8519478 - DNA, 22 bp, Homo sapiens
tcttctgagacttctctttggt

SEQ ID NO: 8519479 - DNA, 22 bp, Homo sapiens
tcttagaagttcatgttccagc

SEQ ID NO: 8519480 - DNA, 22 bp, Homo sapiens
tcttagaaattccccagtggct

SEQ ID NO: 8519481 - DNA, 22 bp, Homo sapiens
tcttagaagttcatgttccagc

SEQ ID NO: 8519482 - DNA, 22 bp, Homo sapiens
tcttcctatggggctgcaggaa

SEQ ID NO: 8519483 - DNA, 22 bp, Homo sapiens
tcttagaaattccccagtggct

SEQ ID NO: 8519484 - DNA, 22 bp, Homo sapiens
tcttagaaatgaagttctttct

SEQ ID NO: 8519485 - DNA, 22 bp, Homo sapiens
tcttagaaatgaagttctttct

SEQ ID NO: 8519486 - DNA, 22 bp, Homo sapiens
tcttagaaaaatggtatgtttt

SEQ ID NO: 8519487 - DNA, 22 bp, Homo sapiens
tcttctctcctgcttggcagaa

SEQ ID NO: 8519488 - DNA, 22 bp, Homo sapiens
tcttctctcctgcttggcagaa

SEQ ID NO: 8519489 - DNA, 22 bp, Homo sapiens
tcttctctcctgcttggcagaa

SEQ ID NO: 8519490 - DNA, 22 bp, Homo sapiens
tcttctctgtggcctggtggtg

SEQ ID NO: 8519491 - DNA, 22 bp, Homo sapiens
tcttcctcaatgtaacaacccc

SEQ ID NO: 8519492 - DNA, 22 bp, Homo sapiens
tcttctctcatgtaggagggaa

SEQ ID NO: 8519493 - DNA, 22 bp, Homo sapiens
tcttctctcatgtaggagggaa

SEQ ID NO: 8519494 - DNA, 22 bp, Homo sapiens
tcttctctcctgcttggcagaa

SEQ ID NO: 8519495 - DNA, 22 bp, Homo sapiens
tctgggccgctgcgttccatga

SEQ ID NO: 8519496 - DNA, 22 bp, Homo sapiens
tctgggccggagccgacggcag

SEQ ID NO: 8519497 - DNA, 22 bp, Homo sapiens
tctgggccctgagatgttcttc

SEQ ID NO: 8519498 - DNA, 22 bp, Homo sapiens
tctgggccgctgcgttccatga

SEQ ID NO: 8519499 - DNA, 22 bp, Homo sapiens
tctgggccctgagatgttcttc

SEQ ID NO: 8519500 - DNA, 22 bp, Homo sapiens
tctgggcctcacctgctgctca

SEQ ID NO: 8519501 - DNA, 22 bp, Homo sapiens
tctgggcctatagaagtctacc

SEQ ID NO: 8519502 - DNA, 22 bp, Homo sapiens
tctgggcctatagaagtctacc

SEQ ID NO: 8519503 - DNA, 22 bp, Homo sapiens
tctgggccggagccgacggcag

SEQ ID NO: 8519504 - DNA, 20 bp, Homo sapiens
tctgggagggacaagtctcc

SEQ ID NO: 8519505 - DNA, 22 bp, Homo sapiens
ccagcaccttgatcttggagtt

SEQ ID NO: 8519506 - DNA, 22 bp, Homo sapiens
ccagcaccttgatcttggagtt

SEQ ID NO: 8519507 - DNA, 22 bp, Homo sapiens
ccagcaccttgatcttggagtt

SEQ ID NO: 8519508 - DNA, 22 bp, Homo sapiens
tctgggccttggagtggggaga

SEQ ID NO: 8519509 - DNA, 22 bp, Homo sapiens
tctgggccttggagtggggaga

SEQ ID NO: 8519510 - DNA, 22 bp, Homo sapiens
tctgggctctgtcagcacctct

SEQ ID NO: 8519511 - DNA, 22 bp, Homo sapiens
tctgggcctgtctcagagctgg

SEQ ID NO: 8519512 - DNA, 22 bp, Homo sapiens
tctgggcctgtctcagagctgg

SEQ ID NO: 8519513 - DNA, 22 bp, Homo sapiens
tctgggcctgtctcagagctgg

SEQ ID NO: 8519514 - DNA, 22 bp, Homo sapiens
tctgggcctgatggctaaagcc

SEQ ID NO: 8519515 - DNA, 22 bp, Homo sapiens
tctgggcctcagtttcttcatc

SEQ ID NO: 8519516 - DNA, 22 bp, Homo sapiens
tctgggcctgatggctaaagcc

SEQ ID NO: 8519517 - DNA, 22 bp, Homo sapiens
tctgggcctcacctgctgctca

SEQ ID NO: 8519518 - DNA, 22 bp, Homo sapiens
tctgggcctcacctgctgctca

SEQ ID NO: 8519519 - DNA, 22 bp, Homo sapiens
tctgggcctcagtttcttcatc

SEQ ID NO: 8519520 - DNA, 22 bp, Homo sapiens
ccaggagcaacttgaaggcaag

SEQ ID NO: 8519521 - DNA, 22 bp, Homo sapiens
ccaggagcaacttgaaggcaag

SEQ ID NO: 8519522 - DNA, 22 bp, Homo sapiens
ccaggagcaacttgaaggcaag

SEQ ID NO: 8519523 - DNA, 22 bp, Homo sapiens
ccaggagcaacttgaaggcaag

SEQ ID NO: 8519524 - DNA, 22 bp, Homo sapiens
tctggggagtcaaagagacctg

SEQ ID NO: 8519525 - DNA, 22 bp, Homo sapiens
tctggggagtgcctaagtggaa

SEQ ID NO: 8519526 - DNA, 17 bp, Homo sapiens
ccaggagagatgcttgt

SEQ ID NO: 8519527 - DNA, 22 bp, Homo sapiens
tctggggagcagccctggtgag

SEQ ID NO: 8519528 - DNA, 22 bp, Homo sapiens
tctggggagggagccacaggtc

SEQ ID NO: 8519529 - DNA, 22 bp, Homo sapiens
tctggggagggagccacaggtc

SEQ ID NO: 8519530 - DNA, 22 bp, Homo sapiens
tctggggaccatggcatctaaa

SEQ ID NO: 8519531 - DNA, 22 bp, Homo sapiens
tctggggaccatggcatctaaa

SEQ ID NO: 8519532 - DNA, 22 bp, Homo sapiens
tctggggaccatggcatctaaa

SEQ ID NO: 8519533 - DNA, 21 bp, Homo sapiens
tctggggaagacatctaggat

SEQ ID NO: 8519534 - DNA, 22 bp, Homo sapiens
tctgggctctgtcagcacctct

SEQ ID NO: 8519535 - DNA, 19 bp, Homo sapiens
ccaggagcagtggtgagct

SEQ ID NO: 8519536 - DNA, 19 bp, Homo sapiens
ccaggagcagtggtgagct

SEQ ID NO: 8519537 - DNA, 22 bp, Homo sapiens
ccaggagcagggctggctgcac

SEQ ID NO: 8519538 - DNA, 22 bp, Homo sapiens
ccaggagcagggctggctgcac

SEQ ID NO: 8519539 - DNA, 22 bp, Homo sapiens
ccaggagcagggctggctgcac

SEQ ID NO: 8519540 - DNA, 22 bp, Homo sapiens
ccaggagccctgccacaatggt

SEQ ID NO: 8519541 - DNA, 22 bp, Homo sapiens
ccaggagccactcaggcccaca

SEQ ID NO: 8519542 - DNA, 22 bp, Homo sapiens
ccaggagccactcaggcccaca

SEQ ID NO: 8519543 - DNA, 22 bp, Homo sapiens
ccaggagcattaagagaacata

SEQ ID NO: 8519544 - DNA, 22 bp, Homo sapiens
ccaggagcattaagagaacata

SEQ ID NO: 8519545 - DNA, 19 bp, Homo sapiens
ccaggagcagtggtgagct

SEQ ID NO: 8519546 - DNA, 22 bp, Homo sapiens
ccaggagcattaagagaacata

SEQ ID NO: 8519547 - DNA, 22 bp, Homo sapiens
ccaggagcattaagagaacata

SEQ ID NO: 8519548 - DNA, 22 bp, Homo sapiens
ccaggagcagccggcccacctg

SEQ ID NO: 8519549 - DNA, 22 bp, Homo sapiens
ccaggagcaggagctgcagctg

SEQ ID NO: 8519550 - DNA, 22 bp, Homo sapiens
ccaggagcaggagctggacaga

SEQ ID NO: 8519551 - DNA, 22 bp, Homo sapiens
ccaggagcaggagctggacaga

SEQ ID NO: 8519552 - DNA, 22 bp, Homo sapiens
ccaggagcaggagctggacaga

SEQ ID NO: 8519553 - DNA, 22 bp, Homo sapiens
ccaggagcagagtaggtgttca

SEQ ID NO: 8519554 - DNA, 22 bp, Homo sapiens
ccaggagcagatatggacataa

SEQ ID NO: 8519555 - DNA, 22 bp, Homo sapiens
ccaggagcaccaggcctgtgcc

SEQ ID NO: 8519556 - DNA, 22 bp, Homo sapiens
ccaggagcaacttgaaggcaag

SEQ ID NO: 8519557 - DNA, 22 bp, Homo sapiens
ccaggagcaccaggcctgtgcc

SEQ ID NO: 8519558 - DNA, 22 bp, Homo sapiens
ccaggagcctgggccaggctgg

SEQ ID NO: 8519559 - DNA, 22 bp, Homo sapiens
ccaggagccctgccacaatggt

SEQ ID NO: 8519560 - DNA, 22 bp, Homo sapiens
tctgtggctatcatactgaagg

SEQ ID NO: 8519561 - DNA, 22 bp, Homo sapiens
ccaggagcctgggccaggctgg

SEQ ID NO: 8519562 - DNA, 20 bp, Homo sapiens
tctgttattgcatgtacata

SEQ ID NO: 8519563 - DNA, 20 bp, Homo sapiens
tctgttattgcatgtacata

SEQ ID NO: 8519564 - DNA, 20 bp, Homo sapiens
tctgttattgcatgtacata

SEQ ID NO: 8519565 - DNA, 20 bp, Homo sapiens
tctgttattgcatgtacata

SEQ ID NO: 8519566 - DNA, 22 bp, Homo sapiens
tctgttattctgtctattgcca

SEQ ID NO: 8519567 - DNA, 22 bp, Homo sapiens
tctgttcatgtctttttaagtg

SEQ ID NO: 8519568 - DNA, 17 bp, Homo sapiens
tctgttcatgcatacct

SEQ ID NO: 8519569 - DNA, 22 bp, Homo sapiens
tctgttccatgttttgttccat

SEQ ID NO: 8519570 - DNA, 22 bp, Homo sapiens
tctgttccatgttttgttccat

SEQ ID NO: 8519571 - DNA, 22 bp, Homo sapiens
tctgttccagtagaaaggtgca

SEQ ID NO: 8519572 - DNA, 22 bp, Homo sapiens
tctgttctaagcattctatgtg

SEQ ID NO: 8519573 - DNA, 22 bp, Homo sapiens
tctgttcctggtctctggagct

SEQ ID NO: 8519574 - DNA, 22 bp, Homo sapiens
tctgttctattggtctatgtgt

SEQ ID NO: 8519575 - DNA, 22 bp, Homo sapiens
tctgttctattggtctatgtgt

SEQ ID NO: 8519576 - DNA, 22 bp, Homo sapiens
tctgttcttaaagcattcttgc

SEQ ID NO: 8519577 - DNA, 22 bp, Homo sapiens
tctgttcttgcttttctccaac

SEQ ID NO: 8519578 - DNA, 22 bp, Homo sapiens
ccaggaggcggaggttgcagcg

SEQ ID NO: 8519579 - DNA, 22 bp, Homo sapiens
tcttttgagggccagaggaaga

SEQ ID NO: 8519580 - DNA, 22 bp, Homo sapiens
tcttttggaaatgatgtgcagg

SEQ ID NO: 8519581 - DNA, 22 bp, Homo sapiens
tcttttgagggccagaggaaga

SEQ ID NO: 8519582 - DNA, 22 bp, Homo sapiens
tcttttggaaatgatgtgcagg

SEQ ID NO: 8519583 - DNA, 22 bp, Homo sapiens
tcttttcttgcattattgcact

SEQ ID NO: 8519584 - DNA, 22 bp, Homo sapiens
tcttttcttgcattattgcact

SEQ ID NO: 8519585 - DNA, 22 bp, Homo sapiens
tcttttcttcttaatggttaat

SEQ ID NO: 8519586 - DNA, 22 bp, Homo sapiens
tcttttcttcttaatggttaat

SEQ ID NO: 8519587 - DNA, 22 bp, Homo sapiens
tcttttcttgcattattgcact

SEQ ID NO: 8519588 - DNA, 22 bp, Homo sapiens
tcttttggaaatgatgtgcagg

SEQ ID NO: 8519589 - DNA, 22 bp, Homo sapiens
tcttttgggttcttatgattta

SEQ ID NO: 8519590 - DNA, 18 bp, Homo sapiens
tcttttgtcccctgctgc

SEQ ID NO: 8519591 - DNA, 22 bp, Homo sapiens
tcttgccacttcatcccctttc

SEQ ID NO: 8519592 - DNA, 22 bp, Homo sapiens
tcttgcatgatattctgtattt

SEQ ID NO: 8519593 - DNA, 22 bp, Homo sapiens
tcttttctgtaactcagtgtct

SEQ ID NO: 8519594 - DNA, 22 bp, Homo sapiens
tcttttctgtaactcagtgtct

SEQ ID NO: 8519595 - DNA, 22 bp, Homo sapiens
tcttttctggactctgcatgga

SEQ ID NO: 8519596 - DNA, 22 bp, Homo sapiens
tcttttctggactctgcatgga

SEQ ID NO: 8519597 - DNA, 22 bp, Homo sapiens
tctttgtaaatgcctagcataa

SEQ ID NO: 8519598 - DNA, 22 bp, Homo sapiens
tctttgtaaatgcctagcataa

SEQ ID NO: 8519599 - DNA, 22 bp, Homo sapiens
tcttttctgccacagcctgagc

SEQ ID NO: 8519600 - DNA, 22 bp, Homo sapiens
tcttttctgccacagcctgagc

SEQ ID NO: 8519601 - DNA, 22 bp, Homo sapiens
tcttttctggactctgcatgga

SEQ ID NO: 8519602 - DNA, 22 bp, Homo sapiens
tcttttctgccagctgagccct

SEQ ID NO: 8519603 - DNA, 19 bp, Homo sapiens
tcttgcagccccagcaggc

SEQ ID NO: 8519604 - DNA, 19 bp, Homo sapiens
tcttgcagccccagcaggc

SEQ ID NO: 8519605 - DNA, 22 bp, Homo sapiens
tcttgcaggcatgaaaggactc

SEQ ID NO: 8519606 - DNA, 22 bp, Homo sapiens
tcttgattttgtgaataagttg

SEQ ID NO: 8519607 - DNA, 22 bp, Homo sapiens
tcttgattttgttaaaattaga

SEQ ID NO: 8519608 - DNA, 22 bp, Homo sapiens
tcttgcacttcatgaatatgtt

SEQ ID NO: 8519609 - DNA, 22 bp, Homo sapiens
tcttgcacttcatgaatatgtt

SEQ ID NO: 8519610 - DNA, 22 bp, Homo sapiens
tcttgcacttcatgaatatgtt

SEQ ID NO: 8519611 - DNA, 22 bp, Homo sapiens
tcttgcagacagcttccagcct

SEQ ID NO: 8519612 - DNA, 22 bp, Homo sapiens
ccaggcctgattgggaatcttg

SEQ ID NO: 8519613 - DNA, 22 bp, Homo sapiens
ccaggcctgattgggaatcttg

SEQ ID NO: 8519614 - DNA, 22 bp, Homo sapiens
tcttgatttgtaaaagaaggat

SEQ ID NO: 8519615 - DNA, 22 bp, Homo sapiens
ccaggcctctggctgcttagtc

SEQ ID NO: 8519616 - DNA, 23 bp, Homo sapiens
ccaggcctctcagagggtgtgcc

SEQ ID NO: 8519617 - DNA, 22 bp, Homo sapiens
tgaaacaagggaccgtcctttc

SEQ ID NO: 8519618 - DNA, 22 bp, Homo sapiens
tgaaacaagggaccgtcctttc

SEQ ID NO: 8519619 - DNA, 18 bp, Homo sapiens
tgaaacaagaatggtgca

SEQ ID NO: 8519620 - DNA, 21 bp, Homo sapiens
tgaaacaatcagacagagtct

SEQ ID NO: 8519621 - DNA, 21 bp, Homo sapiens
tgaaacaatcagacagagtct

SEQ ID NO: 8519622 - DNA, 22 bp, Homo sapiens
tgaaacaagggccatgggaaac

SEQ ID NO: 8519623 - DNA, 22 bp, Homo sapiens
tgaaacaagtttaagggatcta

SEQ ID NO: 8519624 - DNA, 22 bp, Homo sapiens
tgaaacaaatttggaaaatcta

SEQ ID NO: 8519625 - DNA, 22 bp, Homo sapiens
tgaaacaaatttggaaaatcta

SEQ ID NO: 8519626 - DNA, 22 bp, Homo sapiens
tcttttgtggatgaagaaatgg

SEQ ID NO: 8519627 - DNA, 22 bp, Homo sapiens
tcttttgtgccaagtaatgaat

SEQ ID NO: 8519628 - DNA, 22 bp, Homo sapiens
tcttttgtgattctttagttac

SEQ ID NO: 8519629 - DNA, 22 bp, Homo sapiens
tgaaacaattagaatgtaatga

SEQ ID NO: 8519630 - DNA, 22 bp, Homo sapiens
tgaaacaattagaatgtaatga

SEQ ID NO: 8519631 - DNA, 22 bp, Homo sapiens
tgaaacaattagaatgtaatga

SEQ ID NO: 8519632 - DNA, 22 bp, Homo sapiens
tgaaacaatgtgaagttgctga

SEQ ID NO: 8519633 - DNA, 22 bp, Homo sapiens
tgaaacacaagcctggttagtg

SEQ ID NO: 8519634 - DNA, 22 bp, Homo sapiens
tgaaacacaagcctggttagtg

SEQ ID NO: 8519635 - DNA, 22 bp, Homo sapiens
tgaaacagagtggatacagtga

SEQ ID NO: 8519636 - DNA, 21 bp, Homo sapiens
ccaggctggccatggtattga

SEQ ID NO: 8519637 - DNA, 17 bp, Homo sapiens
tgaaacaccaagactgt

SEQ ID NO: 8519638 - DNA, 22 bp, Homo sapiens
ccaggctgttttcaaacttggg

SEQ ID NO: 8519639 - DNA, 22 bp, Homo sapiens
ccaggctgttttcaaacttggg

SEQ ID NO: 8519640 - DNA, 22 bp, Homo sapiens
ccaggctgtggtttagatagag

SEQ ID NO: 8519641 - DNA, 22 bp, Homo sapiens
ccaggctgtggtttagatagag

SEQ ID NO: 8519642 - DNA, 22 bp, Homo sapiens
ccaggctgtggtttagatagag

SEQ ID NO: 8519643 - DNA, 22 bp, Homo sapiens
ccaggctgtgcttttcataaat

SEQ ID NO: 8519644 - DNA, 22 bp, Homo sapiens
ccaggctgtgcttttcataaat

SEQ ID NO: 8519645 - DNA, 22 bp, Homo sapiens
ccaggctgtgcttttcataaat

SEQ ID NO: 8519646 - DNA, 22 bp, Homo sapiens
ccaggctgtaagagtgatgttg

SEQ ID NO: 8519647 - DNA, 22 bp, Homo sapiens
ccaggctgtaagagtgatgttg

SEQ ID NO: 8519648 - DNA, 22 bp, Homo sapiens
ccaggctgtaagagtgatgttg

SEQ ID NO: 8519649 - DNA, 22 bp, Homo sapiens
ccaggctgtaagagtgatgttg

SEQ ID NO: 8519650 - DNA, 22 bp, Homo sapiens
ccaggcttccctgagaggctgc

SEQ ID NO: 8519651 - DNA, 22 bp, Homo sapiens
tgaaatgaaacagaacatatca

SEQ ID NO: 8519652 - DNA, 22 bp, Homo sapiens
ccaggcttcctaatgtgtgcag

SEQ ID NO: 8519653 - DNA, 22 bp, Homo sapiens
tgaaatgaatgtgattcgatag

SEQ ID NO: 8519654 - DNA, 22 bp, Homo sapiens
tgaaatgaagggcttgttctgg

SEQ ID NO: 8519655 - DNA, 22 bp, Homo sapiens
tgaaatgacagtcttaagctct

SEQ ID NO: 8519656 - DNA, 22 bp, Homo sapiens
tgaaatgacaaaggtttttctt

SEQ ID NO: 8519657 - DNA, 22 bp, Homo sapiens
tgaaatgagagcacagaataaa

SEQ ID NO: 8519658 - DNA, 21 bp, Homo sapiens
tgaaatgagaatgctgagcac

SEQ ID NO: 8519659 - DNA, 21 bp, Homo sapiens
tgaaatgagaatgctgagcac

SEQ ID NO: 8519660 - DNA, 22 bp, Homo sapiens
tgaaatgacagtcttaagctct

SEQ ID NO: 8519661 - DNA, 22 bp, Homo sapiens
ccagggctccattgctcatcct

SEQ ID NO: 8519662 - DNA, 22 bp, Homo sapiens
ccagggctccattgctcatcct

SEQ ID NO: 8519663 - DNA, 22 bp, Homo sapiens
ccagggctccattgctcatcct

SEQ ID NO: 8519664 - DNA, 22 bp, Homo sapiens
ccagggcctacagcttaagtcc

SEQ ID NO: 8519665 - DNA, 22 bp, Homo sapiens
tgaagttatatatgttgaaaat

SEQ ID NO: 8519666 - DNA, 22 bp, Homo sapiens
tgaagtgggggaacgagagttc

SEQ ID NO: 8519667 - DNA, 17 bp, Homo sapiens
tgaagttaggctgcaga

SEQ ID NO: 8519668 - DNA, 22 bp, Homo sapiens
tgaagttagaactatgaggata

SEQ ID NO: 8519669 - DNA, 22 bp, Homo sapiens
ccagggctctatgagggtggag

SEQ ID NO: 8519670 - DNA, 22 bp, Homo sapiens
ccagggctccccagaagtaccc

SEQ ID NO: 8519671 - DNA, 22 bp, Homo sapiens
ccagggctccattgctcatcct

SEQ ID NO: 8519672 - DNA, 22 bp, Homo sapiens
ccagggctctgcttctgccatg

SEQ ID NO: 8519673 - DNA, 22 bp, Homo sapiens
ccagggctctgcttctgccatg

SEQ ID NO: 8519674 - DNA, 22 bp, Homo sapiens
ccagggctctgcttctgccatg

SEQ ID NO: 8519675 - DNA, 22 bp, Homo sapiens
ccagggctctgcttctgccatg

SEQ ID NO: 8519676 - DNA, 22 bp, Homo sapiens
ccagggctgagactgtattggg

SEQ ID NO: 8519677 - DNA, 22 bp, Homo sapiens
ccagggctgagctgtgaccatg

SEQ ID NO: 8519678 - DNA, 22 bp, Homo sapiens
ccagggctgagctgtgaccatg

SEQ ID NO: 8519679 - DNA, 22 bp, Homo sapiens
ccagggctgagctgtgaccatg

SEQ ID NO: 8519680 - DNA, 22 bp, Homo sapiens
ccagggctgagctgtgaccatg

SEQ ID NO: 8519681 - DNA, 22 bp, Homo sapiens
ccagggctgagctgtgaccatg

SEQ ID NO: 8519682 - DNA, 22 bp, Homo sapiens
ccagggctgccgcatccctggt

SEQ ID NO: 8519683 - DNA, 22 bp, Homo sapiens
ccagggctgccgcatccctggt

SEQ ID NO: 8519684 - DNA, 22 bp, Homo sapiens
tgaagtggaccctggacagacc

SEQ ID NO: 8519685 - DNA, 22 bp, Homo sapiens
tgaagtaggcagcatgctgaga

SEQ ID NO: 8519686 - DNA, 22 bp, Homo sapiens
tgaagtatccatcttgttctag

SEQ ID NO: 8519687 - DNA, 22 bp, Homo sapiens
ccagggcagtgggagaaggtgc

SEQ ID NO: 8519688 - DNA, 22 bp, Homo sapiens
ccagggcagtgggagaaggtgc

SEQ ID NO: 8519689 - DNA, 22 bp, Homo sapiens
ccagggcagtgggagaaggtgc

SEQ ID NO: 8519690 - DNA, 22 bp, Homo sapiens
ccagggcatcacatccagtgtt

SEQ ID NO: 8519691 - DNA, 22 bp, Homo sapiens
ccagggcatcacatccagtgtt

SEQ ID NO: 8519692 - DNA, 22 bp, Homo sapiens
ccagggcatcacatccagtgtt

SEQ ID NO: 8519693 - DNA, 22 bp, Homo sapiens
tgaaggtgtatgctgtgggtca

SEQ ID NO: 8519694 - DNA, 19 bp, Homo sapiens
tgaaggtgtatgtgctggg

SEQ ID NO: 8519695 - DNA, 22 bp, Homo sapiens
tgaaggtgtctttgtgaacatc

SEQ ID NO: 8519696 - DNA, 22 bp, Homo sapiens
ccagggcatcctcacatcgcag

SEQ ID NO: 8519697 - DNA, 22 bp, Homo sapiens
ccagggcatcctcacatcgcag

SEQ ID NO: 8519698 - DNA, 22 bp, Homo sapiens
ccagggcaacgctgtctcagag

SEQ ID NO: 8519699 - DNA, 22 bp, Homo sapiens
ccagggcaacgctgtctcagag

SEQ ID NO: 8519700 - DNA, 22 bp, Homo sapiens
ccagggcaacgctgtctcagag

SEQ ID NO: 8519701 - DNA, 22 bp, Homo sapiens
ccagggcaaatgagatcatagc

SEQ ID NO: 8519702 - DNA, 21 bp, Homo sapiens
ccagggatgttgaactgaaag

SEQ ID NO: 8519703 - DNA, 22 bp, Homo sapiens
ccagggatgtggcagcaccata

SEQ ID NO: 8519704 - DNA, 22 bp, Homo sapiens
ccagggatgtggcagcaccata

SEQ ID NO: 8519705 - DNA, 22 bp, Homo sapiens
ccagggcaaatgagatcatagc

SEQ ID NO: 8519706 - DNA, 22 bp, Homo sapiens
ccagggcaacgctgtctcagag

SEQ ID NO: 8519707 - DNA, 22 bp, Homo sapiens
ccagggcaacgctgtctcagag

SEQ ID NO: 8519708 - DNA, 22 bp, Homo sapiens
ccagggcaataggaacactttt

SEQ ID NO: 8519709 - DNA, 22 bp, Homo sapiens
ccagggcaataggaacactttt

SEQ ID NO: 8519710 - DNA, 22 bp, Homo sapiens
ccagggcaattatttggagggt

SEQ ID NO: 8519711 - DNA, 22 bp, Homo sapiens
ccagggcaattatttggagggt

SEQ ID NO: 8519712 - DNA, 22 bp, Homo sapiens
ccagggcaggggctggagttca

SEQ ID NO: 8519713 - DNA, 22 bp, Homo sapiens
ccagggcaggggctggagttca

SEQ ID NO: 8519714 - DNA, 22 bp, Homo sapiens
ccagggcagggaccacgtgtct

SEQ ID NO: 8519715 - DNA, 22 bp, Homo sapiens
ccagggcagggaccacgtgtct

SEQ ID NO: 8519716 - DNA, 22 bp, Homo sapiens
ccagggcagggaccacgtgtct

SEQ ID NO: 8519717 - DNA, 22 bp, Homo sapiens
ccagggcagggaccacgtgtct

SEQ ID NO: 8519718 - DNA, 22 bp, Homo sapiens
ccagggcaggagaaagactcac

SEQ ID NO: 8519719 - DNA, 22 bp, Homo sapiens
ccagggcaggagaaagactcac

SEQ ID NO: 8519720 - DNA, 22 bp, Homo sapiens
ccagggcacgttgggacagtac

SEQ ID NO: 8519721 - DNA, 22 bp, Homo sapiens
ccagggcacgttgggacagtac

SEQ ID NO: 8519722 - DNA, 22 bp, Homo sapiens
ccagggcaggagaaagactcac

SEQ ID NO: 8519723 - DNA, 22 bp, Homo sapiens
ccagggcacgttgggacagtac

SEQ ID NO: 8519724 - DNA, 22 bp, Homo sapiens
ccagggcacgttgggacagtac

SEQ ID NO: 8519725 - DNA, 22 bp, Homo sapiens
ccagggcaattatttggagggt

SEQ ID NO: 8519726 - DNA, 22 bp, Homo sapiens
ccagggatgctttcccaggact

SEQ ID NO: 8519727 - DNA, 23 bp, Homo sapiens
ccagggagtgctactatcaagcc

SEQ ID NO: 8519728 - DNA, 22 bp, Homo sapiens
ccagggagggtcctgtggcttc

SEQ ID NO: 8519729 - DNA, 23 bp, Homo sapiens
ccagggaggttgattggttaccc

SEQ ID NO: 8519730 - DNA, 22 bp, Homo sapiens
ccagggagggtcctgtggcttc

SEQ ID NO: 8519731 - DNA, 17 bp, Homo sapiens
ccagggaggggccgcgc

SEQ ID NO: 8519732 - DNA, 22 bp, Homo sapiens
ccagggaagattagaagccact

SEQ ID NO: 8519733 - DNA, 22 bp, Homo sapiens
tgaaatgatgtacaagaaggca

SEQ ID NO: 8519734 - DNA, 22 bp, Homo sapiens
tgaaatgatcagtttggttact

SEQ ID NO: 8519735 - DNA, 22 bp, Homo sapiens
tgaaatgatatctgataacaaa

SEQ ID NO: 8519736 - DNA, 22 bp, Homo sapiens
tgaaatgagataatttaagtgc

SEQ ID NO: 8519737 - DNA, 22 bp, Homo sapiens
tgaaatgagatagataatcagg

SEQ ID NO: 8519738 - DNA, 22 bp, Homo sapiens
tgaaatgatatctgataacaaa

SEQ ID NO: 8519739 - DNA, 22 bp, Homo sapiens
tgaaatgagcatttattcttta

SEQ ID NO: 8519740 - DNA, 22 bp, Homo sapiens
tgaaatgagatagataatcagg

SEQ ID NO: 8519741 - DNA, 22 bp, Homo sapiens
tgaaatgagcatttattcttta

SEQ ID NO: 8519742 - DNA, 22 bp, Homo sapiens
ctgtctgtcaccaaaacagact

SEQ ID NO: 8519743 - DNA, 22 bp, Homo sapiens
ctgtctgtcccgtcaccgcccc

SEQ ID NO: 8519744 - DNA, 22 bp, Homo sapiens
ctgtctgtcctgagttcaacca

SEQ ID NO: 8519745 - DNA, 22 bp, Homo sapiens
ctgtctgtcaccaaaacagact

SEQ ID NO: 8519746 - DNA, 22 bp, Homo sapiens
ctgtctgtgcctcttctcccag

SEQ ID NO: 8519747 - DNA, 19 bp, Homo sapiens
ctgtctgtgcagagatgtg

SEQ ID NO: 8519748 - DNA, 22 bp, Homo sapiens
ctgtctgtgacctctgcatgtc

SEQ ID NO: 8519749 - DNA, 19 bp, Homo sapiens
ctgtctgtgcagagatgtg

SEQ ID NO: 8519750 - DNA, 22 bp, Homo sapiens
ctgtctgtgacctctgcatgtc

SEQ ID NO: 8519751 - DNA, 22 bp, Homo sapiens
ctgtctgtacaaatgtggggcc

SEQ ID NO: 8519752 - DNA, 19 bp, Homo sapiens
ctgtctggttcatgtgttc

SEQ ID NO: 8519753 - DNA, 22 bp, Homo sapiens
ctgtctgtcaagttcatctcca

SEQ ID NO: 8519754 - DNA, 22 bp, Homo sapiens
ctgtctgtatccctgttggtaa

SEQ ID NO: 8519755 - DNA, 22 bp, Homo sapiens
ctgtctgtatccctgttggtaa

SEQ ID NO: 8519756 - DNA, 22 bp, Homo sapiens
ctgtctgtactgagagttctgt

SEQ ID NO: 8519757 - DNA, 22 bp, Homo sapiens
ctgtctgtactgagagttctgt

SEQ ID NO: 8519758 - DNA, 22 bp, Homo sapiens
ctgtctgtacaaatgtggggcc

SEQ ID NO: 8519759 - DNA, 22 bp, Homo sapiens
ctgtctgtagacatttttggtt

SEQ ID NO: 8519760 - DNA, 17 bp, Homo sapiens
ctgtctgcgcatgaggt

SEQ ID NO: 8519761 - DNA, 19 bp, Homo sapiens
ctgtctgcggggcctgttc

SEQ ID NO: 8519762 - DNA, 22 bp, Homo sapiens
ctgtctgctagaacatctatac

SEQ ID NO: 8519763 - DNA, 22 bp, Homo sapiens
ctgtctgctagaacatctatac

SEQ ID NO: 8519764 - DNA, 22 bp, Homo sapiens
ctgtctggaatgcagtacatag

SEQ ID NO: 8519765 - DNA, 22 bp, Homo sapiens
ctgtctgctatgcttgttgtca

SEQ ID NO: 8519766 - DNA, 22 bp, Homo sapiens
ctgtctggccggcccagcttcc

SEQ ID NO: 8519767 - DNA, 22 bp, Homo sapiens
ctgtctgggtctacatcctctg

SEQ ID NO: 8519768 - DNA, 22 bp, Homo sapiens
ctgtctgggtctacatcctctg

SEQ ID NO: 8519769 - DNA, 22 bp, Homo sapiens
ctgtctgggtctacatcctctg

SEQ ID NO: 8519770 - DNA, 22 bp, Homo sapiens
ctgtctggatgtgagtcaccta

SEQ ID NO: 8519771 - DNA, 22 bp, Homo sapiens
ctgtctggatataccttggcca

SEQ ID NO: 8519772 - DNA, 22 bp, Homo sapiens
ctgtctggatgtgagtcaccta

SEQ ID NO: 8519773 - DNA, 22 bp, Homo sapiens
ctgtctggatataccttggcca

SEQ ID NO: 8519774 - DNA, 21 bp, Homo sapiens
ctgtctggccgcgggctccgc

SEQ ID NO: 8519775 - DNA, 22 bp, Homo sapiens
ctgtctggccggcccagcttcc

SEQ ID NO: 8519776 - DNA, 22 bp, Homo sapiens
ctgtgctgcagacgcagtagct

SEQ ID NO: 8519777 - DNA, 22 bp, Homo sapiens
ctgtgctgcagacgcagtagct

SEQ ID NO: 8519778 - DNA, 22 bp, Homo sapiens
ctgtgctgcagacgcagtagct

SEQ ID NO: 8519779 - DNA, 22 bp, Homo sapiens
ctgtgctggagatgggccagag

SEQ ID NO: 8519780 - DNA, 22 bp, Homo sapiens
ctgtgctggattctgaggctac

SEQ ID NO: 8519781 - DNA, 22 bp, Homo sapiens
ctgtgctggagatgggccagag

SEQ ID NO: 8519782 - DNA, 22 bp, Homo sapiens
ctgtgctggcagacctggagtt

SEQ ID NO: 8519783 - DNA, 22 bp, Homo sapiens
ctgtgcttacctgcccaggtga

SEQ ID NO: 8519784 - DNA, 22 bp, Homo sapiens
ctgtgcttcagagtcagtgctg

SEQ ID NO: 8519785 - DNA, 22 bp, Homo sapiens
ctgtgcttagccatcacattca

SEQ ID NO: 8519786 - DNA, 22 bp, Homo sapiens
ctgtgcttcagagtcagtgctg

SEQ ID NO: 8519787 - DNA, 22 bp, Homo sapiens
ctgtgctggtgaaacccacaga

SEQ ID NO: 8519788 - DNA, 22 bp, Homo sapiens
ctgtgctgtcttgggagcctta

SEQ ID NO: 8519789 - DNA, 22 bp, Homo sapiens
ctgtgctgggtgtgcttatgat

SEQ ID NO: 8519790 - DNA, 22 bp, Homo sapiens
ctgtctgtggagcttctgatgt

SEQ ID NO: 8519791 - DNA, 22 bp, Homo sapiens
ctgtgccctggccaggcctctc

SEQ ID NO: 8519792 - DNA, 22 bp, Homo sapiens
ctgtgccctgtggctggcacct

SEQ ID NO: 8519793 - DNA, 22 bp, Homo sapiens
ctgtgccctggccaggcctctc

SEQ ID NO: 8519794 - DNA, 17 bp, Homo sapiens
ctgtgctcgagtgatgg

SEQ ID NO: 8519795 - DNA, 22 bp, Homo sapiens
ctgtgctgaggatgcagtttct

SEQ ID NO: 8519796 - DNA, 22 bp, Homo sapiens
ctgtgctgagtgatgtgactta

SEQ ID NO: 8519797 - DNA, 22 bp, Homo sapiens
ctgtgctgagtgatgtgactta

SEQ ID NO: 8519798 - DNA, 22 bp, Homo sapiens
ctgtgctgaggatgcagtttct

SEQ ID NO: 8519799 - DNA, 22 bp, Homo sapiens
ctgtgctgattcagcacaggcc

SEQ ID NO: 8519800 - DNA, 22 bp, Homo sapiens
ctgtgctgattcagcacaggcc

SEQ ID NO: 8519801 - DNA, 22 bp, Homo sapiens
ctgtcagcttctcctggccaga

SEQ ID NO: 8519802 - DNA, 18 bp, Homo sapiens
ctgtcagcagcttcacga

SEQ ID NO: 8519803 - DNA, 19 bp, Homo sapiens
ctgtcaggggctggatgtt

SEQ ID NO: 8519804 - DNA, 22 bp, Homo sapiens
ctgtcaggggcgggtggagcgg

SEQ ID NO: 8519805 - DNA, 22 bp, Homo sapiens
ctgtcacctgccagcataccca

SEQ ID NO: 8519806 - DNA, 18 bp, Homo sapiens
ctgtcaccgccaccacac

SEQ ID NO: 8519807 - DNA, 22 bp, Homo sapiens
ctgtcacctgttcactgcagca

SEQ ID NO: 8519808 - DNA, 22 bp, Homo sapiens
ctgtcacttaaattcaggctga

SEQ ID NO: 8519809 - DNA, 22 bp, Homo sapiens
ctgtcactgatgggctcaccag

SEQ ID NO: 8519810 - DNA, 22 bp, Homo sapiens
ctgtcactgatgctcctgccac

SEQ ID NO: 8519811 - DNA, 22 bp, Homo sapiens
ctgtcacttaaattcaggctga

SEQ ID NO: 8519812 - DNA, 22 bp, Homo sapiens
ctgtcagagatggggagtcaga

SEQ ID NO: 8519813 - DNA, 22 bp, Homo sapiens
ctgtcagaggctctctgttgcc

SEQ ID NO: 8519814 - DNA, 22 bp, Homo sapiens
ctgtcagagatggggagtcaga

SEQ ID NO: 8519815 - DNA, 22 bp, Homo sapiens
ctgtcagcactctactacagat

SEQ ID NO: 8519816 - DNA, 22 bp, Homo sapiens
ctgtcctgtggacctgaggacg

SEQ ID NO: 8519817 - DNA, 22 bp, Homo sapiens
ctgtcctgtggacctgaggacg

SEQ ID NO: 8519818 - DNA, 22 bp, Homo sapiens
ctgtcctgtgtcagcctgaaat

SEQ ID NO: 8519819 - DNA, 22 bp, Homo sapiens
ctgtcctgtggacctgaggacg

SEQ ID NO: 8519820 - DNA, 22 bp, Homo sapiens
ctgtcctgtggacctgaggacg

SEQ ID NO: 8519821 - DNA, 22 bp, Homo sapiens
ctgtcaggttggtctcagagct

SEQ ID NO: 8519822 - DNA, 22 bp, Homo sapiens
ctgtcaggtttcccatctgcaa

SEQ ID NO: 8519823 - DNA, 22 bp, Homo sapiens
ctgtctctgttgcctgtaggtg

SEQ ID NO: 8519824 - DNA, 22 bp, Homo sapiens
ctgtctctgttgcctgtaggtg

SEQ ID NO: 8519825 - DNA, 22 bp, Homo sapiens
ctgtattttttaagtgatctgg

SEQ ID NO: 8519826 - DNA, 22 bp, Homo sapiens
ctgtcaaatggaaacttatcct

SEQ ID NO: 8519827 - DNA, 22 bp, Homo sapiens
ctgtattttttaagaatatctc

SEQ ID NO: 8519828 - DNA, 22 bp, Homo sapiens
ctgtattttcatgcctacgtac

SEQ ID NO: 8519829 - DNA, 22 bp, Homo sapiens
ctgtattttcatgcctacgtac

SEQ ID NO: 8519830 - DNA, 22 bp, Homo sapiens
ctgtattttttaagaatatctc

SEQ ID NO: 8519831 - DNA, 22 bp, Homo sapiens
ctgtcacactgatatcaggctt

SEQ ID NO: 8519832 - DNA, 20 bp, Homo sapiens
ctgtagggtgcagcaggctc

SEQ ID NO: 8519833 - DNA, 22 bp, Homo sapiens
ctgtagttgatgatttctgata

SEQ ID NO: 8519834 - DNA, 22 bp, Homo sapiens
ctgtagttgggcattataatag

SEQ ID NO: 8519835 - DNA, 22 bp, Homo sapiens
ctgtagctgggcctcggcagtg

SEQ ID NO: 8519836 - DNA, 20 bp, Homo sapiens
ctgtagggtgcagcaggctc

SEQ ID NO: 8519837 - DNA, 22 bp, Homo sapiens
ctgtagctgacaggatcactta

SEQ ID NO: 8519838 - DNA, 22 bp, Homo sapiens
ctgtagctccagcctgtctaca

SEQ ID NO: 8519839 - DNA, 22 bp, Homo sapiens
ctgtaggagtgggaatttattg

SEQ ID NO: 8519840 - DNA, 22 bp, Homo sapiens
ctgtataacatcttttgtttcc

SEQ ID NO: 8519841 - DNA, 22 bp, Homo sapiens
ctgtataattcatgctcttatt

SEQ ID NO: 8519842 - DNA, 22 bp, Homo sapiens
ctgtatttgaaagaaaagattt

SEQ ID NO: 8519843 - DNA, 22 bp, Homo sapiens
ctgtatatcatggttttgcagt

SEQ ID NO: 8519844 - DNA, 22 bp, Homo sapiens
ctgtatataatgtatgcatggg

SEQ ID NO: 8519845 - DNA, 22 bp, Homo sapiens
ctgtatttgtcctctatttatt

SEQ ID NO: 8519846 - DNA, 22 bp, Homo sapiens
ctgtatttgtcctctatttatt

SEQ ID NO: 8519847 - DNA, 23 bp, Homo sapiens
ctgtatttgacttgagcggaaat

SEQ ID NO: 8519848 - DNA, 22 bp, Homo sapiens
ctgtaaaactgcttaagtatgc

SEQ ID NO: 8519849 - DNA, 22 bp, Homo sapiens
ctgtaaaactgcttaagtatgc

SEQ ID NO: 8519850 - DNA, 22 bp, Homo sapiens
ctgtaaaactgcttaagtatgc

SEQ ID NO: 8519851 - DNA, 22 bp, Homo sapiens
ctgtaaaacactgtagtatctg

SEQ ID NO: 8519852 - DNA, 22 bp, Homo sapiens
ctgtaaaacactgtagtatctg

SEQ ID NO: 8519853 - DNA, 22 bp, Homo sapiens
ctgtaaaacactgtagtatctg

SEQ ID NO: 8519854 - DNA, 22 bp, Homo sapiens
ctggtgccctgtgtggcaggag

SEQ ID NO: 8519855 - DNA, 22 bp, Homo sapiens
ctggtgccattctgtggcctag

SEQ ID NO: 8519856 - DNA, 22 bp, Homo sapiens
ctggtgccattctgtggcctag

SEQ ID NO: 8519857 - DNA, 22 bp, Homo sapiens
ctggtgccctgtgtggcaggag

SEQ ID NO: 8519858 - DNA, 22 bp, Homo sapiens
ctgtacaaagtagctgctggga

SEQ ID NO: 8519859 - DNA, 22 bp, Homo sapiens
ctgtacaaatggcagttgagtt

SEQ ID NO: 8519860 - DNA, 22 bp, Homo sapiens
ctggtgcacgtggctgcagtcg

SEQ ID NO: 8519861 - DNA, 22 bp, Homo sapiens
ctggtgcaggaaggagctggca

SEQ ID NO: 8519862 - DNA, 22 bp, Homo sapiens
ctggtgcaggaaggagctggca

SEQ ID NO: 8519863 - DNA, 22 bp, Homo sapiens
ctggtgcaggaaggagctggca

SEQ ID NO: 8519864 - DNA, 22 bp, Homo sapiens
ctggtgccattctgtggcctag

SEQ ID NO: 8519865 - DNA, 22 bp, Homo sapiens
ctggtgatcttgggcaagtcac

SEQ ID NO: 8519866 - DNA, 22 bp, Homo sapiens
ctggtgattacaatgatgacaa

SEQ ID NO: 8519867 - DNA, 22 bp, Homo sapiens
ctggtgagacggttgacaggag

SEQ ID NO: 8519868 - DNA, 22 bp, Homo sapiens
ctggtgagactcagggatgctt

SEQ ID NO: 8519869 - DNA, 22 bp, Homo sapiens
ctgtacagagttctgagtgtac

SEQ ID NO: 8519870 - DNA, 22 bp, Homo sapiens
ctgtacagaagctagagcaaat

SEQ ID NO: 8519871 - DNA, 22 bp, Homo sapiens
ctgtacaagtccttcatcaggg

SEQ ID NO: 8519872 - DNA, 22 bp, Homo sapiens
ctgtacaagtccttcatcaggg

SEQ ID NO: 8519873 - DNA, 22 bp, Homo sapiens
ctgtacaatgttacctatttat

SEQ ID NO: 8519874 - DNA, 22 bp, Homo sapiens
ctgtacaatgttacctatttat

SEQ ID NO: 8519875 - DNA, 22 bp, Homo sapiens
ctgtacaatgttacctatttat

SEQ ID NO: 8519876 - DNA, 22 bp, Homo sapiens
ctgtacaggtcaatgataagat

SEQ ID NO: 8519877 - DNA, 22 bp, Homo sapiens
ctgtacaggagacgtctgtgca

SEQ ID NO: 8519878 - DNA, 22 bp, Homo sapiens
ctgtacataaaggaataggtgt

SEQ ID NO: 8519879 - DNA, 19 bp, Homo sapiens
ctgtacaggttgcttctgg

SEQ ID NO: 8519880 - DNA, 22 bp, Homo sapiens
ctgtacaggtgaggagggggct

SEQ ID NO: 8519881 - DNA, 19 bp, Homo sapiens
ctgtacaggttgcttctgg

SEQ ID NO: 8519882 - DNA, 22 bp, Homo sapiens
ctgtagcaagttattcaataaa

SEQ ID NO: 8519883 - DNA, 22 bp, Homo sapiens
ctgtagagaaagcatggaagct

SEQ ID NO: 8519884 - DNA, 22 bp, Homo sapiens
ctgtacttttgcaggtcacagc

SEQ ID NO: 8519885 - DNA, 22 bp, Homo sapiens
ctgtagcagtgttccagcattg

SEQ ID NO: 8519886 - DNA, 22 bp, Homo sapiens
ctgtagcagacagaccctaggt

SEQ ID NO: 8519887 - DNA, 22 bp, Homo sapiens
ctgtagcagctgacctggctaa

SEQ ID NO: 8519888 - DNA, 22 bp, Homo sapiens
ctgtagcagtgtgctctttttc

SEQ ID NO: 8519889 - DNA, 22 bp, Homo sapiens
ctgtagcagtgtgctctttttc

SEQ ID NO: 8519890 - DNA, 22 bp, Homo sapiens
ctgtagccagaagcagaaggcc

SEQ ID NO: 8519891 - DNA, 22 bp, Homo sapiens
ctgtagccagtttggcctcacc

SEQ ID NO: 8519892 - DNA, 23 bp, Homo sapiens
ctgtagctaaaagctgggatttg

SEQ ID NO: 8519893 - DNA, 23 bp, Homo sapiens
ctgtagctaaaagctgggatttg

SEQ ID NO: 8519894 - DNA, 22 bp, Homo sapiens
ctgtacatcccgagagccagta

SEQ ID NO: 8519895 - DNA, 22 bp, Homo sapiens
ctgtacatcttaaatggaaaaa

SEQ ID NO: 8519896 - DNA, 22 bp, Homo sapiens
ctgtacatcttaaatggaaaaa

SEQ ID NO: 8519897 - DNA, 22 bp, Homo sapiens
ctgtacatcttaaatggaaaaa

SEQ ID NO: 8519898 - DNA, 22 bp, Homo sapiens
ctgtacatatacatttttttcc

SEQ ID NO: 8519899 - DNA, 22 bp, Homo sapiens
ctgtacataaaggaataggtgt

SEQ ID NO: 8519900 - DNA, 22 bp, Homo sapiens
ctgggcttctccccctggcaga

SEQ ID NO: 8519901 - DNA, 22 bp, Homo sapiens
ctgggcttctccccctggcaga

SEQ ID NO: 8519902 - DNA, 22 bp, Homo sapiens
ctgggcttgagttcctgctcgt

SEQ ID NO: 8519903 - DNA, 22 bp, Homo sapiens
ctggggaacaatttgccacact

SEQ ID NO: 8519904 - DNA, 22 bp, Homo sapiens
ctggggaacgcagcgagcagcg

SEQ ID NO: 8519905 - DNA, 22 bp, Homo sapiens
ctggggaacgcagcgagcagcg

SEQ ID NO: 8519906 - DNA, 21 bp, Homo sapiens
ctgggctttctctcaaagaca

SEQ ID NO: 8519907 - DNA, 22 bp, Homo sapiens
ctgggctttgaagccaggctgc

SEQ ID NO: 8519908 - DNA, 22 bp, Homo sapiens
ctggggacttgcagacacaatt

SEQ ID NO: 8519909 - DNA, 22 bp, Homo sapiens
ctggggacttgcagacacaatt

SEQ ID NO: 8519910 - DNA, 22 bp, Homo sapiens
ctggggactcattcagagcata

SEQ ID NO: 8519911 - DNA, 22 bp, Homo sapiens
ctggggagaagcgactcggctg

SEQ ID NO: 8519912 - DNA, 22 bp, Homo sapiens
ctggggagaagcgactcggctg

SEQ ID NO: 8519913 - DNA, 22 bp, Homo sapiens
ctggggagacgatcgatgttct

SEQ ID NO: 8519914 - DNA, 22 bp, Homo sapiens
ctggggagacgatcgatgttct

SEQ ID NO: 8519915 - DNA, 22 bp, Homo sapiens
ctggggagaagcgactcggctg

SEQ ID NO: 8519916 - DNA, 22 bp, Homo sapiens
ctggggagaagcgactcggctg

SEQ ID NO: 8519917 - DNA, 22 bp, Homo sapiens
ctggggaaggcggtgactgcgc

SEQ ID NO: 8519918 - DNA, 22 bp, Homo sapiens
ctggtctgagggctcttgaggc

SEQ ID NO: 8519919 - DNA, 22 bp, Homo sapiens
ctggtctgagggctcttgaggc

SEQ ID NO: 8519920 - DNA, 22 bp, Homo sapiens
ctggtctgaaaaggaggcatgc

SEQ ID NO: 8519921 - DNA, 19 bp, Homo sapiens
ctggtctgctgcttccagg

SEQ ID NO: 8519922 - DNA, 21 bp, Homo sapiens
ctggtctggccaataaggtcc

SEQ ID NO: 8519923 - DNA, 22 bp, Homo sapiens
ctggtctgggatgagggatgta

SEQ ID NO: 8519924 - DNA, 22 bp, Homo sapiens
ctggtctgtccgcaggtcacct

SEQ ID NO: 8519925 - DNA, 22 bp, Homo sapiens
ctggtgaatattggaggcattg

SEQ ID NO: 8519926 - DNA, 16 bp, Homo sapiens
ctggtcttgctgccga

SEQ ID NO: 8519927 - DNA, 22 bp, Homo sapiens
ctggtcagctgaagccccacac

SEQ ID NO: 8519928 - DNA, 23 bp, Homo sapiens
ctggtcagaggctgctggaaggg

SEQ ID NO: 8519929 - DNA, 22 bp, Homo sapiens
ctggtccttgacgcgtgggagg

SEQ ID NO: 8519930 - DNA, 22 bp, Homo sapiens
ctggtccttgctacccagcaag

SEQ ID NO: 8519931 - DNA, 18 bp, Homo sapiens
ctggtctcccttcgcttt

SEQ ID NO: 8519932 - DNA, 18 bp, Homo sapiens
ctggtctcccttcgcttt

SEQ ID NO: 8519933 - DNA, 20 bp, Homo sapiens
ctggggagcctcgcggtggc

SEQ ID NO: 8519934 - DNA, 22 bp, Homo sapiens
ctggtcactggtctcatccagc

SEQ ID NO: 8519935 - DNA, 22 bp, Homo sapiens
ctggggagacgatcgatgttct

SEQ ID NO: 8519936 - DNA, 20 bp, Homo sapiens
ctggggagcctcgcggtggc

SEQ ID NO: 8519937 - DNA, 20 bp, Homo sapiens
ctggggagcctcgcggtggc

SEQ ID NO: 8519938 - DNA, 22 bp, Homo sapiens
ctgggccttggattgacactgt

SEQ ID NO: 8519939 - DNA, 22 bp, Homo sapiens
ctgggccttggattgacactgt

SEQ ID NO: 8519940 - DNA, 22 bp, Homo sapiens
ctgggccttggattgacactgt

SEQ ID NO: 8519941 - DNA, 22 bp, Homo sapiens
ctgggcctttacctacggagtt

SEQ ID NO: 8519942 - DNA, 22 bp, Homo sapiens
ctgggctaattaagcacagctg

SEQ ID NO: 8519943 - DNA, 22 bp, Homo sapiens
ctgggctacgtgttgacagcat

SEQ ID NO: 8519944 - DNA, 22 bp, Homo sapiens
ctgggctcaaatcctatctcca

SEQ ID NO: 8519945 - DNA, 22 bp, Homo sapiens
ctgggctggagtgcaatggcgc

SEQ ID NO: 8519946 - DNA, 22 bp, Homo sapiens
ctgggctcaaatcctatctcca

SEQ ID NO: 8519947 - DNA, 22 bp, Homo sapiens
ctgggctagaaggaccaggatg

SEQ ID NO: 8519948 - DNA, 22 bp, Homo sapiens
ctgggctggagtgcaatggcgc

SEQ ID NO: 8519949 - DNA, 21 bp, Homo sapiens
ctgggctggcaggcattacct

SEQ ID NO: 8519950 - DNA, 22 bp, Homo sapiens
ctgggcttaggacctggtgcgg

SEQ ID NO: 8519951 - DNA, 22 bp, Homo sapiens
ctgggctgtttgttctggtctc

SEQ ID NO: 8519952 - DNA, 22 bp, Homo sapiens
ctgggcttagcagctcctggtc

SEQ ID NO: 8519953 - DNA, 22 bp, Homo sapiens
ctgggctggcgcatccgacacg

SEQ ID NO: 8519954 - DNA, 22 bp, Homo sapiens
ctgggctgttctgcccctgggt

SEQ ID NO: 8519955 - DNA, 22 bp, Homo sapiens
ctgggctgtttgttctggtctc

SEQ ID NO: 8519956 - DNA, 22 bp, Homo sapiens
ctgggcctgtcagggctttttg

SEQ ID NO: 8519957 - DNA, 22 bp, Homo sapiens
ctgggcctggtgtggcacctgc

SEQ ID NO: 8519958 - DNA, 22 bp, Homo sapiens
ctgggcctgtgggcacacggac

SEQ ID NO: 8519959 - DNA, 22 bp, Homo sapiens
ctgggccttcattgctctccca

SEQ ID NO: 8519960 - DNA, 22 bp, Homo sapiens
ctgggccttatgagtacctgga

SEQ ID NO: 8519961 - DNA, 22 bp, Homo sapiens
ctgggccttgccaggggtgtct

SEQ ID NO: 8519962 - DNA, 22 bp, Homo sapiens
ctgggccttgcatcccagagcc

SEQ ID NO: 8519963 - DNA, 22 bp, Homo sapiens
ctgggcagaattttaggatggc

SEQ ID NO: 8519964 - DNA, 22 bp, Homo sapiens
ctgggcagaattttaggatggc

SEQ ID NO: 8519965 - DNA, 22 bp, Homo sapiens
ctgggcactttggggagcctac

SEQ ID NO: 8519966 - DNA, 22 bp, Homo sapiens
ctgggcactttggggagcctac

SEQ ID NO: 8519967 - DNA, 22 bp, Homo sapiens
ctgggcagagctaacacctgag

SEQ ID NO: 8519968 - DNA, 22 bp, Homo sapiens
ctgggcagagctaacacctgag

SEQ ID NO: 8519969 - DNA, 22 bp, Homo sapiens
ctgggcagagctaacacctgag

SEQ ID NO: 8519970 - DNA, 22 bp, Homo sapiens
ctgggcagagtccggaagatgg

SEQ ID NO: 8519971 - DNA, 22 bp, Homo sapiens
ctgggcagctaccaccactgct

SEQ ID NO: 8519972 - DNA, 22 bp, Homo sapiens
ctgggcagctaccaccactgct

SEQ ID NO: 8519973 - DNA, 22 bp, Homo sapiens
ctgggcagctccataccaccca

SEQ ID NO: 8519974 - DNA, 22 bp, Homo sapiens
ctgggcagctccataccaccca

SEQ ID NO: 8519975 - DNA, 22 bp, Homo sapiens
ctgggcagctccataccaccca

SEQ ID NO: 8519976 - DNA, 22 bp, Homo sapiens
ctgggcagctccataccaccca

SEQ ID NO: 8519977 - DNA, 22 bp, Homo sapiens
ctgggcagcctcacacaatgtt

SEQ ID NO: 8519978 - DNA, 22 bp, Homo sapiens
ctgggcagcctcacacaatgtt

SEQ ID NO: 8519979 - DNA, 22 bp, Homo sapiens
ctgggcagctaccaccactgct

SEQ ID NO: 8519980 - DNA, 22 bp, Homo sapiens
ctgggcagctgtgcaaacaata

SEQ ID NO: 8519981 - DNA, 22 bp, Homo sapiens
ctgggcagctgtatcagggagt

SEQ ID NO: 8519982 - DNA, 22 bp, Homo sapiens
ctgggcagctgtatcagggagt

SEQ ID NO: 8519983 - DNA, 22 bp, Homo sapiens
ctgggcagctgtatcagggagt

SEQ ID NO: 8519984 - DNA, 22 bp, Homo sapiens
ctgggcagctgtatcagggagt

SEQ ID NO: 8519985 - DNA, 22 bp, Homo sapiens
ctgggagattgctagagatgca

SEQ ID NO: 8519986 - DNA, 22 bp, Homo sapiens
ctgggagattgctagagatgca

SEQ ID NO: 8519987 - DNA, 22 bp, Homo sapiens
ctgggagcgcagcaggcacaac

SEQ ID NO: 8519988 - DNA, 22 bp, Homo sapiens
ctgggagccctgactagcctgg

SEQ ID NO: 8519989 - DNA, 22 bp, Homo sapiens
ctgggagcccgcgtcctggtgg

SEQ ID NO: 8519990 - DNA, 22 bp, Homo sapiens
ctgggagcccgcgtcctggtgg

SEQ ID NO: 8519991 - DNA, 22 bp, Homo sapiens
ctgggagccctgactagcctgg

SEQ ID NO: 8519992 - DNA, 22 bp, Homo sapiens
ctgggagcggctgtcactggtt

SEQ ID NO: 8519993 - DNA, 22 bp, Homo sapiens
ctgggagcggctgtcactggtt

SEQ ID NO: 8519994 - DNA, 22 bp, Homo sapiens
ctgggagcgcagcaggcacaac

SEQ ID NO: 8519995 - DNA, 17 bp, Homo sapiens
ctgggatgtggactctt

SEQ ID NO: 8519996 - DNA, 17 bp, Homo sapiens
ctgggatgtggactctt

SEQ ID NO: 8519997 - DNA, 22 bp, Homo sapiens
ctgggcacttgctcacagctct

SEQ ID NO: 8519998 - DNA, 22 bp, Homo sapiens
ctgggcacttgctcacagctct

SEQ ID NO: 8519999 - DNA, 22 bp, Homo sapiens
ctgggcacttgctcacagctct

SEQ ID NO: 8520000 - DNA, 22 bp, Homo sapiens
ctgggcactgcagcaggcatca

SEQ ID NO: 8520001 - DNA, 22 bp, Homo sapiens
ctgcttccatgcaatggcagtc

SEQ ID NO: 8520002 - DNA, 22 bp, Homo sapiens
ctgcttccataaataatgtgct

SEQ ID NO: 8520003 - DNA, 22 bp, Homo sapiens
ctgcttccataaataatgtgct

SEQ ID NO: 8520004 - DNA, 22 bp, Homo sapiens
ctgcttccatgcaatggcagtc

SEQ ID NO: 8520005 - DNA, 22 bp, Homo sapiens
ctgcttcatagccctggtctct

SEQ ID NO: 8520006 - DNA, 19 bp, Homo sapiens
ctgcttcaggcgccttgcc

SEQ ID NO: 8520007 - DNA, 22 bp, Homo sapiens
ctgcttcatatttcatagtgat

SEQ ID NO: 8520008 - DNA, 22 bp, Homo sapiens
ctgcttcatatttcatagtgat

SEQ ID NO: 8520009 - DNA, 22 bp, Homo sapiens
ctgcttcatatttcatagtgat

SEQ ID NO: 8520010 - DNA, 22 bp, Homo sapiens
ctgcttcaccctgcctgagaac

SEQ ID NO: 8520011 - DNA, 22 bp, Homo sapiens
ctgcttcaccctgcctgagaac

SEQ ID NO: 8520012 - DNA, 22 bp, Homo sapiens
ctgcttcacgttgtgccttgtt

SEQ ID NO: 8520013 - DNA, 22 bp, Homo sapiens
ctgcttcacgttgtgccttgtt

SEQ ID NO: 8520014 - DNA, 19 bp, Homo sapiens
ctgcttcaggcgccttgcc

SEQ ID NO: 8520015 - DNA, 22 bp, Homo sapiens
ctgcttcagcaaagctatttgc

SEQ ID NO: 8520016 - DNA, 22 bp, Homo sapiens
ctgcttcacttcggttgcatag

SEQ ID NO: 8520017 - DNA, 22 bp, Homo sapiens
ctgcttcacttcggttgcatag

SEQ ID NO: 8520018 - DNA, 22 bp, Homo sapiens
ctgggacacccaaggaaagagc

SEQ ID NO: 8520019 - DNA, 22 bp, Homo sapiens
ctgggaagaagtgggctacatt

SEQ ID NO: 8520020 - DNA, 22 bp, Homo sapiens
ctgggaagaagggacaacagcg

SEQ ID NO: 8520021 - DNA, 22 bp, Homo sapiens
ctgggacagagcagcagtgggg

SEQ ID NO: 8520022 - DNA, 22 bp, Homo sapiens
ctgctgtgtggattcaatggct

SEQ ID NO: 8520023 - DNA, 22 bp, Homo sapiens
ctgctgtgtggtgaaactcagt

SEQ ID NO: 8520024 - DNA, 22 bp, Homo sapiens
ctgctgtgattgggagaaaccg

SEQ ID NO: 8520025 - DNA, 22 bp, Homo sapiens
ctgctgtgcacccaggaaggct

SEQ ID NO: 8520026 - DNA, 22 bp, Homo sapiens
ctgctgtgcaacattgcaccta

SEQ ID NO: 8520027 - DNA, 22 bp, Homo sapiens
ctgctgtgttgccagtgtcacc

SEQ ID NO: 8520028 - DNA, 22 bp, Homo sapiens
ctgctgtgttcctcctgcatct

SEQ ID NO: 8520029 - DNA, 22 bp, Homo sapiens
ctgctgtgttcctcctgcatct

SEQ ID NO: 8520030 - DNA, 20 bp, Homo sapiens
ctgctgtgtgtgcctcagcc

SEQ ID NO: 8520031 - DNA, 20 bp, Homo sapiens
ctgctgtgtgtgcctcagcc

SEQ ID NO: 8520032 - DNA, 20 bp, Homo sapiens
ctgctgtgtgtgcctcagcc

SEQ ID NO: 8520033 - DNA, 22 bp, Homo sapiens
ctgctgtgttagcaggtttagt

SEQ ID NO: 8520034 - DNA, 20 bp, Homo sapiens
ctgctgtgttattgtagaac

SEQ ID NO: 8520035 - DNA, 22 bp, Homo sapiens
ctgctgtttctcaaaattaagt

SEQ ID NO: 8520036 - DNA, 23 bp, Homo sapiens
ctgctgttttctgtacctgaagc

SEQ ID NO: 8520037 - DNA, 20 bp, Homo sapiens
ctgcttaagtaagtgacaca

SEQ ID NO: 8520038 - DNA, 22 bp, Homo sapiens
ctgcttaaaatgcagattctgt

SEQ ID NO: 8520039 - DNA, 20 bp, Homo sapiens
ctgcttaagtaagtgacaca

SEQ ID NO: 8520040 - DNA, 18 bp, Homo sapiens
ctgcttacaaaaataccc

SEQ ID NO: 8520041 - DNA, 22 bp, Homo sapiens
ctgcttcacccaactttgggat

SEQ ID NO: 8520042 - DNA, 22 bp, Homo sapiens
ctgcttcacccaactttgggat

SEQ ID NO: 8520043 - DNA, 22 bp, Homo sapiens
ctgcttcaaggaaatgaatcgg

SEQ ID NO: 8520044 - DNA, 23 bp, Homo sapiens
ctgctgtgttggtctcgatggga

SEQ ID NO: 8520045 - DNA, 23 bp, Homo sapiens
ctgctgtgttggtctcgatggga

SEQ ID NO: 8520046 - DNA, 22 bp, Homo sapiens
ctgctgtgttggcattggatag

SEQ ID NO: 8520047 - DNA, 22 bp, Homo sapiens
ctgctgtgttgccagtgtcacc

SEQ ID NO: 8520048 - DNA, 22 bp, Homo sapiens
ctgctgttctgaagcaacaagc

SEQ ID NO: 8520049 - DNA, 22 bp, Homo sapiens
ctgctgtgtttctgctagaaaa

SEQ ID NO: 8520050 - DNA, 22 bp, Homo sapiens
ctgctgtgtttcacacctctgg

SEQ ID NO: 8520051 - DNA, 22 bp, Homo sapiens
ctgggacagctgagacaggaga

SEQ ID NO: 8520052 - DNA, 22 bp, Homo sapiens
ctgggacagctgagacaggaga

SEQ ID NO: 8520053 - DNA, 22 bp, Homo sapiens
ctgggacagctgagacaggaga

SEQ ID NO: 8520054 - DNA, 22 bp, Homo sapiens
ctgggacagctgagacaggaga

SEQ ID NO: 8520055 - DNA, 22 bp, Homo sapiens
ctgggacatattgctagtgttg

SEQ ID NO: 8520056 - DNA, 22 bp, Homo sapiens
ctgggacatattgctagtgttg

SEQ ID NO: 8520057 - DNA, 22 bp, Homo sapiens
ctgggacatgatagaaacagat

SEQ ID NO: 8520058 - DNA, 22 bp, Homo sapiens
ctgggaccatctgtgtctactt

SEQ ID NO: 8520059 - DNA, 22 bp, Homo sapiens
ctgggaccagtgaagcaactca

SEQ ID NO: 8520060 - DNA, 22 bp, Homo sapiens
ctgggacccccactgcgtagct

SEQ ID NO: 8520061 - DNA, 18 bp, Homo sapiens
ctgggactcaatgctact

SEQ ID NO: 8520062 - DNA, 18 bp, Homo sapiens
ctgggactcaatgctact

SEQ ID NO: 8520063 - DNA, 22 bp, Homo sapiens
ctgggactcagaccagttctgt

SEQ ID NO: 8520064 - DNA, 22 bp, Homo sapiens
ctgggactcagaccagttctgt

SEQ ID NO: 8520065 - DNA, 18 bp, Homo sapiens
ctgggactcaatgctact

SEQ ID NO: 8520066 - DNA, 19 bp, Homo sapiens
ctgggactcctgatacctt

SEQ ID NO: 8520067 - DNA, 22 bp, Homo sapiens
ctgggactgccattcacagcca

SEQ ID NO: 8520068 - DNA, 22 bp, Homo sapiens
ctgggactggacctctgcctgg

SEQ ID NO: 8520069 - DNA, 22 bp, Homo sapiens
ctgggactgccattcacagcca

SEQ ID NO: 8520070 - DNA, 22 bp, Homo sapiens
ctgggactggacctctgcctgg

SEQ ID NO: 8520071 - DNA, 22 bp, Homo sapiens
ctgggactgccattcacagcca

SEQ ID NO: 8520072 - DNA, 22 bp, Homo sapiens
ctgggactgccattcacagcca

SEQ ID NO: 8520073 - DNA, 19 bp, Homo sapiens
ctgggactcctgatacctt

SEQ ID NO: 8520074 - DNA, 19 bp, Homo sapiens
ctgggactcctgatacctt

SEQ ID NO: 8520075 - DNA, 22 bp, Homo sapiens
ctgggagatatgaggatctgga

SEQ ID NO: 8520076 - DNA, 22 bp, Homo sapiens
ctgggagatatgaggatctgga

SEQ ID NO: 8520077 - DNA, 22 bp, Homo sapiens
ctgggagatatgaggatctgga

SEQ ID NO: 8520078 - DNA, 22 bp, Homo sapiens
ctgggagaggctgctccgctct

SEQ ID NO: 8520079 - DNA, 22 bp, Homo sapiens
ctgggacttgggctatgctctg

SEQ ID NO: 8520080 - DNA, 22 bp, Homo sapiens
ctgggacttgtagtctcggcgc

SEQ ID NO: 8520081 - DNA, 22 bp, Homo sapiens
ctgggacttgggctatgctctg

SEQ ID NO: 8520082 - DNA, 22 bp, Homo sapiens
ctgggacttgcagagcaggagg

SEQ ID NO: 8520083 - DNA, 22 bp, Homo sapiens
ctgggacttgcagagcaggagg

SEQ ID NO: 8520084 - DNA, 22 bp, Homo sapiens
ctgggactgggtcctcaggaca

SEQ ID NO: 8520085 - DNA, 22 bp, Homo sapiens
ctgggactgggtcctcaggaca

SEQ ID NO: 8520086 - DNA, 22 bp, Homo sapiens
ctgggacttgatgaaatgactg

SEQ ID NO: 8520087 - DNA, 22 bp, Homo sapiens
ctgggacttgatgaaatgactg

SEQ ID NO: 8520088 - DNA, 22 bp, Homo sapiens
ctgggacttgcagagcaggagg

SEQ ID NO: 8520089 - DNA, 22 bp, Homo sapiens
ctgggacttgcagagcaggagg

SEQ ID NO: 8520090 - DNA, 22 bp, Homo sapiens
ctgggacttgcagagcaggagg

SEQ ID NO: 8520091 - DNA, 22 bp, Homo sapiens
ctgggagatctgttgggactgg

SEQ ID NO: 8520092 - DNA, 22 bp, Homo sapiens
ctgggagatgactcagagcagg

SEQ ID NO: 8520093 - DNA, 22 bp, Homo sapiens
ctgggagatgactcagagcagg

SEQ ID NO: 8520094 - DNA, 22 bp, Homo sapiens
ctgggagatgactcagagcagg

SEQ ID NO: 8520095 - DNA, 22 bp, Homo sapiens
ctgggagatctgttgggactgg

SEQ ID NO: 8520096 - DNA, 22 bp, Homo sapiens
ctgggagatgactcagagcagg

SEQ ID NO: 8520097 - DNA, 22 bp, Homo sapiens
ctgggagattgctagagatgca

SEQ ID NO: 8520098 - DNA, 22 bp, Homo sapiens
ctgggagattgaggccatggtg

SEQ ID NO: 8520099 - DNA, 22 bp, Homo sapiens
ctgggagattgaggccatggtg

SEQ ID NO: 8520100 - DNA, 22 bp, Homo sapiens
ctgggagattgaggccatggtg

SEQ ID NO: 8520101 - DNA, 21 bp, Homo sapiens
ctgtttcttgtgaagtgacac

SEQ ID NO: 8520102 - DNA, 21 bp, Homo sapiens
ctgtttcttgtgaagtgacac

SEQ ID NO: 8520103 - DNA, 21 bp, Homo sapiens
ctgtttcttgtgaagtgacac

SEQ ID NO: 8520104 - DNA, 22 bp, Homo sapiens
ctgtttatacgacaggtggagg

SEQ ID NO: 8520105 - DNA, 22 bp, Homo sapiens
ctgtttataaatagaggggagt

SEQ ID NO: 8520106 - DNA, 22 bp, Homo sapiens
ctgtggaaggacttagcgatac

SEQ ID NO: 8520107 - DNA, 21 bp, Homo sapiens
ctgtggaagggaactagaggg

SEQ ID NO: 8520108 - DNA, 22 bp, Homo sapiens
ctgtttataaaccaccagttta

SEQ ID NO: 8520109 - DNA, 22 bp, Homo sapiens
ctgtttaatgcaatgaaatgag

SEQ ID NO: 8520110 - DNA, 22 bp, Homo sapiens
ctgtttaatgcaatgaaatgag

SEQ ID NO: 8520111 - DNA, 22 bp, Homo sapiens
ctgtttaatgaggtgtaacaac

SEQ ID NO: 8520112 - DNA, 22 bp, Homo sapiens
ctgtttaatgaggtgtaacaac

SEQ ID NO: 8520113 - DNA, 22 bp, Homo sapiens
ctgtttaatgaggtgtaacaac

SEQ ID NO: 8520114 - DNA, 22 bp, Homo sapiens
ctgtgctttcaggccgctgtgt

SEQ ID NO: 8520115 - DNA, 22 bp, Homo sapiens
ctgtgctttcgagatgtgatct

SEQ ID NO: 8520116 - DNA, 21 bp, Homo sapiens
ctgtgctttttaagtgtgatg

SEQ ID NO: 8520117 - DNA, 22 bp, Homo sapiens
ctgtgcttcgcaactccaaggt

SEQ ID NO: 8520118 - DNA, 22 bp, Homo sapiens
ctgtgcttgcgggtgtggagcc

SEQ ID NO: 8520119 - DNA, 22 bp, Homo sapiens
ctgtgcttgcgggtgtggagcc

SEQ ID NO: 8520120 - DNA, 19 bp, Homo sapiens
ctgtgctttaaactcctat

SEQ ID NO: 8520121 - DNA, 22 bp, Homo sapiens
ctgtgcttgtgttcattgttaa

SEQ ID NO: 8520122 - DNA, 22 bp, Homo sapiens
ctgttttctagggctgaggtga

SEQ ID NO: 8520123 - DNA, 22 bp, Homo sapiens
ctgttttcaaagagagagaatg

SEQ ID NO: 8520124 - DNA, 22 bp, Homo sapiens
ctgttttatgaagggaatgaga

SEQ ID NO: 8520125 - DNA, 22 bp, Homo sapiens
ctgttttcaaagagagagaatg

SEQ ID NO: 8520126 - DNA, 22 bp, Homo sapiens
ctgtttgtgattagcagtgggt

SEQ ID NO: 8520127 - DNA, 22 bp, Homo sapiens
cttaaagaaattgaggagagga

SEQ ID NO: 8520128 - DNA, 22 bp, Homo sapiens
cttaaacaggaaagagccaggt

SEQ ID NO: 8520129 - DNA, 22 bp, Homo sapiens
cttaaactgaaagctacaagat

SEQ ID NO: 8520130 - DNA, 22 bp, Homo sapiens
cttaaactgggcattcagagaa

SEQ ID NO: 8520131 - DNA, 22 bp, Homo sapiens
cttaaactgaaagctacaagat

SEQ ID NO: 8520132 - DNA, 20 bp, Homo sapiens
cttaaacacagagatagatt

SEQ ID NO: 8520133 - DNA, 20 bp, Homo sapiens
cttaaacacagagatagatt

SEQ ID NO: 8520134 - DNA, 20 bp, Homo sapiens
cttaaacacagagatagatt

SEQ ID NO: 8520135 - DNA, 22 bp, Homo sapiens
cttaaaatctggcagttagcta

SEQ ID NO: 8520136 - DNA, 22 bp, Homo sapiens
ctgttttcctgggttccatgag

SEQ ID NO: 8520137 - DNA, 22 bp, Homo sapiens
ctgtttttgtgctgtgtctccc

SEQ ID NO: 8520138 - DNA, 22 bp, Homo sapiens
ctgtttttcagaaggtaaggga

SEQ ID NO: 8520139 - DNA, 22 bp, Homo sapiens
cttacacactagatggtaggtg

SEQ ID NO: 8520140 - DNA, 22 bp, Homo sapiens
cttacacagtctggcacttctt

SEQ ID NO: 8520141 - DNA, 22 bp, Homo sapiens
cttacaaatacacttaggagag

SEQ ID NO: 8520142 - DNA, 22 bp, Homo sapiens
cttacagagaagaaaatgtagt

SEQ ID NO: 8520143 - DNA, 22 bp, Homo sapiens
cttacacttcatctcatccagg

SEQ ID NO: 8520144 - DNA, 22 bp, Homo sapiens
cttacactttccgaaagcttgt

SEQ ID NO: 8520145 - DNA, 22 bp, Homo sapiens
cttacagtacttctaatatgat

SEQ ID NO: 8520146 - DNA, 22 bp, Homo sapiens
cttacagtacttctaatatgat

SEQ ID NO: 8520147 - DNA, 22 bp, Homo sapiens
cttacagtgaccctgcagattt

SEQ ID NO: 8520148 - DNA, 22 bp, Homo sapiens
cttacagtgaccctgcagattt

SEQ ID NO: 8520149 - DNA, 22 bp, Homo sapiens
cttacagtgaccctgcagattt

SEQ ID NO: 8520150 - DNA, 22 bp, Homo sapiens
cttacagtgatcaacacaaaga

SEQ ID NO: 8520151 - DNA, 22 bp, Homo sapiens
cttacagtgttgagggaattaa

SEQ ID NO: 8520152 - DNA, 22 bp, Homo sapiens
cttacatactgagaaaatatcc

SEQ ID NO: 8520153 - DNA, 22 bp, Homo sapiens
cttacattaagtaagagattga

SEQ ID NO: 8520154 - DNA, 22 bp, Homo sapiens
cttacattgtcttagttttcaa

SEQ ID NO: 8520155 - DNA, 22 bp, Homo sapiens
cttacattgtcttagttttcaa

SEQ ID NO: 8520156 - DNA, 22 bp, Homo sapiens
cttacatttaatcatgtgtcat

SEQ ID NO: 8520157 - DNA, 22 bp, Homo sapiens
cttacattgtgtgcatgagggg

SEQ ID NO: 8520158 - DNA, 22 bp, Homo sapiens
cttagaaataatggtttcagtt

SEQ ID NO: 8520159 - DNA, 22 bp, Homo sapiens
cttagaaataatggtttcagtt

SEQ ID NO: 8520160 - DNA, 22 bp, Homo sapiens
cttagaaatcgaactcaggtta

SEQ ID NO: 8520161 - DNA, 22 bp, Homo sapiens
cttagaaatcgaactcaggtta

SEQ ID NO: 8520162 - DNA, 22 bp, Homo sapiens
cttagaaatcgaactcaggtta

SEQ ID NO: 8520163 - DNA, 22 bp, Homo sapiens
cttagaaatgcagattctcagg

SEQ ID NO: 8520164 - DNA, 22 bp, Homo sapiens
cttagaaatgcagattctcagg

SEQ ID NO: 8520165 - DNA, 22 bp, Homo sapiens
cttacaaatacacttaggagag

SEQ ID NO: 8520166 - DNA, 22 bp, Homo sapiens
cttacaaaggagaggagatagg

SEQ ID NO: 8520167 - DNA, 22 bp, Homo sapiens
cttaatttttgtagtagatgga

SEQ ID NO: 8520168 - DNA, 22 bp, Homo sapiens
cttacaaaggagaggagatagg

SEQ ID NO: 8520169 - DNA, 22 bp, Homo sapiens
cttaatttaaaatagttcaggc

SEQ ID NO: 8520170 - DNA, 22 bp, Homo sapiens
cttaatttaaaatagttcaggc

SEQ ID NO: 8520171 - DNA, 22 bp, Homo sapiens
cttaatttaagcctagaatgca

SEQ ID NO: 8520172 - DNA, 22 bp, Homo sapiens
cttaaagtagaatacaagacct

SEQ ID NO: 8520173 - DNA, 22 bp, Homo sapiens
cttaaagtagaatacaagacct

SEQ ID NO: 8520174 - DNA, 22 bp, Homo sapiens
cttaaaggaggttttgtttcca

SEQ ID NO: 8520175 - DNA, 22 bp, Homo sapiens
cttaaagtattggtttaaccaa

SEQ ID NO: 8520176 - DNA, 22 bp, Homo sapiens
cttaaagtctatcctttctaga

SEQ ID NO: 8520177 - DNA, 22 bp, Homo sapiens
cttaattggcttatttcctcaa

SEQ ID NO: 8520178 - DNA, 22 bp, Homo sapiens
cttaattactgtccaatatgca

SEQ ID NO: 8520179 - DNA, 22 bp, Homo sapiens
cttaattacccaatgtggtagg

SEQ ID NO: 8520180 - DNA, 22 bp, Homo sapiens
cttaatgtggacctggtttcta

SEQ ID NO: 8520181 - DNA, 22 bp, Homo sapiens
cttcatttcaggctgaagaata

SEQ ID NO: 8520182 - DNA, 22 bp, Homo sapiens
cttcatttcaggctgaagaata

SEQ ID NO: 8520183 - DNA, 22 bp, Homo sapiens
cttcatttcaggctgaagaata

SEQ ID NO: 8520184 - DNA, 22 bp, Homo sapiens
cttcatttcaggctgaagaata

SEQ ID NO: 8520185 - DNA, 22 bp, Homo sapiens
cttcatttcaggctgaagaata

SEQ ID NO: 8520186 - DNA, 22 bp, Homo sapiens
cttcatttggagaactgtgctt

SEQ ID NO: 8520187 - DNA, 22 bp, Homo sapiens
cttccaaagcactttatggacc

SEQ ID NO: 8520188 - DNA, 22 bp, Homo sapiens
cttccaaaatttatatgttgaa

SEQ ID NO: 8520189 - DNA, 22 bp, Homo sapiens
cttccaaacccagggtatgggc

SEQ ID NO: 8520190 - DNA, 22 bp, Homo sapiens
cttccaaaatttatatgttgaa

SEQ ID NO: 8520191 - DNA, 18 bp, Homo sapiens
cttcatttgtagagttcc

SEQ ID NO: 8520192 - DNA, 18 bp, Homo sapiens
cttcatttgtagagttcc

SEQ ID NO: 8520193 - DNA, 22 bp, Homo sapiens
cttcagttagagtttacaaagt

SEQ ID NO: 8520194 - DNA, 22 bp, Homo sapiens
cttcagttagtttcatgtgagc

SEQ ID NO: 8520195 - DNA, 22 bp, Homo sapiens
cttcatttcaggctgaagaata

SEQ ID NO: 8520196 - DNA, 22 bp, Homo sapiens
cttcatttcaggctgaagaata

SEQ ID NO: 8520197 - DNA, 19 bp, Homo sapiens
cttcattcttcagcttttg

SEQ ID NO: 8520198 - DNA, 22 bp, Homo sapiens
cttcattacttgctcgtagcac

SEQ ID NO: 8520199 - DNA, 22 bp, Homo sapiens
cttcattggcttccatagatgc

SEQ ID NO: 8520200 - DNA, 22 bp, Homo sapiens
cttatagtatgatgttgagaat

SEQ ID NO: 8520201 - DNA, 22 bp, Homo sapiens
cttatatttgtcaactttacaa

SEQ ID NO: 8520202 - DNA, 22 bp, Homo sapiens
cttcagtgttgccagggcctag

SEQ ID NO: 8520203 - DNA, 19 bp, Homo sapiens
cttatacagattttctcat

SEQ ID NO: 8520204 - DNA, 22 bp, Homo sapiens
cttatacagatcaagggaaaag

SEQ ID NO: 8520205 - DNA, 19 bp, Homo sapiens
cttatacagattttctcat

SEQ ID NO: 8520206 - DNA, 19 bp, Homo sapiens
cttatacagattttctcat

SEQ ID NO: 8520207 - DNA, 22 bp, Homo sapiens
cttatacataaaatgggtgtag

SEQ ID NO: 8520208 - DNA, 22 bp, Homo sapiens
cttataaagtccatctgaacaa

SEQ ID NO: 8520209 - DNA, 22 bp, Homo sapiens
cttataaagtccatctgaacaa

SEQ ID NO: 8520210 - DNA, 22 bp, Homo sapiens
cttataaagtccatctgaacaa

SEQ ID NO: 8520211 - DNA, 22 bp, Homo sapiens
cttagtttgcatgattatggag

SEQ ID NO: 8520212 - DNA, 22 bp, Homo sapiens
cttagtttttgccctggagttt

SEQ ID NO: 8520213 - DNA, 22 bp, Homo sapiens
cttatacacgaacacaaggtgt

SEQ ID NO: 8520214 - DNA, 22 bp, Homo sapiens
cttatacaccctcttcccaggc

SEQ ID NO: 8520215 - DNA, 22 bp, Homo sapiens
cttatacacgaacacaaggtgt

SEQ ID NO: 8520216 - DNA, 22 bp, Homo sapiens
cttatacaccctcttcccaggc

SEQ ID NO: 8520217 - DNA, 22 bp, Homo sapiens
cttaggatgagtttttgcgttt

SEQ ID NO: 8520218 - DNA, 22 bp, Homo sapiens
cttaggcaagcagagcccatcc

SEQ ID NO: 8520219 - DNA, 22 bp, Homo sapiens
cttagtttctctgtatgtttac

SEQ ID NO: 8520220 - DNA, 22 bp, Homo sapiens
cttaggaatatccacagcaggt

SEQ ID NO: 8520221 - DNA, 22 bp, Homo sapiens
cttaggaagcttttgaggacaa

SEQ ID NO: 8520222 - DNA, 22 bp, Homo sapiens
cttaggaaagttggctgatttc

SEQ ID NO: 8520223 - DNA, 22 bp, Homo sapiens
cttaggaaagtttctgcttatg

SEQ ID NO: 8520224 - DNA, 22 bp, Homo sapiens
cttaggaaatatatactaaact

SEQ ID NO: 8520225 - DNA, 22 bp, Homo sapiens
cttaggaacacttactggtact

SEQ ID NO: 8520226 - DNA, 22 bp, Homo sapiens
cttaggaaatatatactaaact

SEQ ID NO: 8520227 - DNA, 22 bp, Homo sapiens
cttagcttctctgcatctgtgt

SEQ ID NO: 8520228 - DNA, 22 bp, Homo sapiens
cttagcttctctgcatctgtgt

SEQ ID NO: 8520229 - DNA, 22 bp, Homo sapiens
cttagctttaaaagtgagatct

SEQ ID NO: 8520230 - DNA, 22 bp, Homo sapiens
cttagctttgtcctaggtctct

SEQ ID NO: 8520231 - DNA, 20 bp, Homo sapiens
cttagcttctaaggttctgg

SEQ ID NO: 8520232 - DNA, 22 bp, Homo sapiens
cttagcatgtggtgtccttgta

SEQ ID NO: 8520233 - DNA, 22 bp, Homo sapiens
cttccagaggaactctgcagtg

SEQ ID NO: 8520234 - DNA, 22 bp, Homo sapiens
cttccagctgattacaggctat

SEQ ID NO: 8520235 - DNA, 22 bp, Homo sapiens
cttccagctgattacaggctat

SEQ ID NO: 8520236 - DNA, 22 bp, Homo sapiens
cttccagctgattacaggctat

SEQ ID NO: 8520237 - DNA, 22 bp, Homo sapiens
cttccagaggaactctgcagtg

SEQ ID NO: 8520238 - DNA, 22 bp, Homo sapiens
cttccagagctgggctgacctt

SEQ ID NO: 8520239 - DNA, 22 bp, Homo sapiens
cttccagagatagggcctcaag

SEQ ID NO: 8520240 - DNA, 22 bp, Homo sapiens
cttccagagatccatgaatacc

SEQ ID NO: 8520241 - DNA, 22 bp, Homo sapiens
cttccaatagcaacaaagatta

SEQ ID NO: 8520242 - DNA, 20 bp, Homo sapiens
cttccacacaagaagcacag

SEQ ID NO: 8520243 - DNA, 22 bp, Homo sapiens
cttccaagttgctctgctgacc

SEQ ID NO: 8520244 - DNA, 22 bp, Homo sapiens
cttccaagatgaacagcaagcg

SEQ ID NO: 8520245 - DNA, 22 bp, Homo sapiens
cttccagcttgtggcgctttcc

SEQ ID NO: 8520246 - DNA, 22 bp, Homo sapiens
cttccagctgattggcatccag

SEQ ID NO: 8520247 - DNA, 22 bp, Homo sapiens
cttccaggacaccagggtagta

SEQ ID NO: 8520248 - DNA, 22 bp, Homo sapiens
cttcctgttgtcacagtctgcg

SEQ ID NO: 8520249 - DNA, 22 bp, Homo sapiens
cttcctggtttgaagctcgccg

SEQ ID NO: 8520250 - DNA, 22 bp, Homo sapiens
cttcctggtttgaagctcgccg

SEQ ID NO: 8520251 - DNA, 22 bp, Homo sapiens
cttccttcaatataatttttac

SEQ ID NO: 8520252 - DNA, 22 bp, Homo sapiens
cttctaacatcctacaatgcaa

SEQ ID NO: 8520253 - DNA, 22 bp, Homo sapiens
cttcctttccccaatcatatcg

SEQ ID NO: 8520254 - DNA, 23 bp, Homo sapiens
cttctcagaagtctgtgccagga

SEQ ID NO: 8520255 - DNA, 22 bp, Homo sapiens
cttctcaactgcacttgccagg

SEQ ID NO: 8520256 - DNA, 23 bp, Homo sapiens
cttctcagaagtctgtgccagga

SEQ ID NO: 8520257 - DNA, 22 bp, Homo sapiens
cttctcagaggccagaagctat

SEQ ID NO: 8520258 - DNA, 22 bp, Homo sapiens
cttctattttcatgcctgggtc

SEQ ID NO: 8520259 - DNA, 22 bp, Homo sapiens
cttctattcactggtcacagtt

SEQ ID NO: 8520260 - DNA, 22 bp, Homo sapiens
cttctcagcattttgtcagtct

SEQ ID NO: 8520261 - DNA, 22 bp, Homo sapiens
cttctcagcattttgtcagtct

SEQ ID NO: 8520262 - DNA, 22 bp, Homo sapiens
cttctcagaggccagaagctat

SEQ ID NO: 8520263 - DNA, 22 bp, Homo sapiens
cttctcagcatggttactgtga

SEQ ID NO: 8520264 - DNA, 22 bp, Homo sapiens
cttctcagcatggttactgtga

SEQ ID NO: 8520265 - DNA, 22 bp, Homo sapiens
cttctcagatctcagctttgag

SEQ ID NO: 8520266 - DNA, 22 bp, Homo sapiens
cttctagagctggagcaaatgt

SEQ ID NO: 8520267 - DNA, 22 bp, Homo sapiens
cttctaggcttctcagggggca

SEQ ID NO: 8520268 - DNA, 22 bp, Homo sapiens
cttctatgaggagagacatgca

SEQ ID NO: 8520269 - DNA, 22 bp, Homo sapiens
cttctaattcttatgtaagctt

SEQ ID NO: 8520270 - DNA, 22 bp, Homo sapiens
cttctaattcttatgtaagctt

SEQ ID NO: 8520271 - DNA, 22 bp, Homo sapiens
cttctacacatccctcttgctt

SEQ ID NO: 8520272 - DNA, 22 bp, Homo sapiens
cttctacacatccctcttgctt

SEQ ID NO: 8520273 - DNA, 22 bp, Homo sapiens
cttctacacatccctcttgctt

SEQ ID NO: 8520274 - DNA, 22 bp, Homo sapiens
cttctacacatccctcttgctt

SEQ ID NO: 8520275 - DNA, 22 bp, Homo sapiens
cttttctcttacattccactgg

SEQ ID NO: 8520276 - DNA, 22 bp, Homo sapiens
cttttctctgtaccgtatatct

SEQ ID NO: 8520277 - DNA, 22 bp, Homo sapiens
cttttcctcaggaggagacgcg

SEQ ID NO: 8520278 - DNA, 22 bp, Homo sapiens
cttttctctgcgggtctttcat

SEQ ID NO: 8520279 - DNA, 21 bp, Homo sapiens
cttttctctccgcaggacatt

SEQ ID NO: 8520280 - DNA, 22 bp, Homo sapiens
cttttctctgcaccatgtgtga

SEQ ID NO: 8520281 - DNA, 22 bp, Homo sapiens
cttttcttactcccgcaaggca

SEQ ID NO: 8520282 - DNA, 22 bp, Homo sapiens
cttttcttactcccgcaaggca

SEQ ID NO: 8520283 - DNA, 22 bp, Homo sapiens
cttttcttatgtggacgtacct

SEQ ID NO: 8520284 - DNA, 22 bp, Homo sapiens
cttttcttatgtggacgtacct

SEQ ID NO: 8520285 - DNA, 22 bp, Homo sapiens
cttttcttctcacggctgtcag

SEQ ID NO: 8520286 - DNA, 22 bp, Homo sapiens
cttttcttgtattggatgcccc

SEQ ID NO: 8520287 - DNA, 22 bp, Homo sapiens
cttttcttgtattggatgcccc

SEQ ID NO: 8520288 - DNA, 22 bp, Homo sapiens
cttttgatggagttcaagaagc

SEQ ID NO: 8520289 - DNA, 22 bp, Homo sapiens
cttttgattgagcagtttcaaa

SEQ ID NO: 8520290 - DNA, 22 bp, Homo sapiens
cttttgattgagcagtttcaaa

SEQ ID NO: 8520291 - DNA, 21 bp, Homo sapiens
cttttacattcagtcatgatg

SEQ ID NO: 8520292 - DNA, 22 bp, Homo sapiens
cttttacagtggacctgccatt

SEQ ID NO: 8520293 - DNA, 22 bp, Homo sapiens
cttttacagtggacctgccatt

SEQ ID NO: 8520294 - DNA, 17 bp, Homo sapiens
ctttgcagcagacatgt

SEQ ID NO: 8520295 - DNA, 19 bp, Homo sapiens
ctttgcaggggatgggtga

SEQ ID NO: 8520296 - DNA, 22 bp, Homo sapiens
ctttgcagtgattgttcttgga

SEQ ID NO: 8520297 - DNA, 21 bp, Homo sapiens
cttttacattcagtcatgatg

SEQ ID NO: 8520298 - DNA, 22 bp, Homo sapiens
cttttcctattgattctgttac

SEQ ID NO: 8520299 - DNA, 22 bp, Homo sapiens
ctttgcaatagaggcacacatg

SEQ ID NO: 8520300 - DNA, 22 bp, Homo sapiens
ctttgcaatagaggcacacatg

SEQ ID NO: 8520301 - DNA, 22 bp, Homo sapiens
ctttgcagcaatttctgttaaa

SEQ ID NO: 8520302 - DNA, 22 bp, Homo sapiens
ctttgcagatttgtttagtgct

SEQ ID NO: 8520303 - DNA, 22 bp, Homo sapiens
ctttgcagaaataaacttgatg

SEQ ID NO: 8520304 - DNA, 22 bp, Homo sapiens
ctttgattccaggcacatgttt

SEQ ID NO: 8520305 - DNA, 22 bp, Homo sapiens
ctttgattatcggtgtgaatgt

SEQ ID NO: 8520306 - DNA, 22 bp, Homo sapiens
ctttgcaaactgtcacactttc

SEQ ID NO: 8520307 - DNA, 22 bp, Homo sapiens
gaaacagcacgtttggagagat

SEQ ID NO: 8520308 - DNA, 22 bp, Homo sapiens
gaaacagcacgtttggagagat

SEQ ID NO: 8520309 - DNA, 22 bp, Homo sapiens
gaaacactggtaaagactgccg

SEQ ID NO: 8520310 - DNA, 22 bp, Homo sapiens
gaaacactatgccaagacaggg

SEQ ID NO: 8520311 - DNA, 22 bp, Homo sapiens
gaaacactatgccaagacaggg

SEQ ID NO: 8520312 - DNA, 22 bp, Homo sapiens
gaaacactggtaaagactgccg

SEQ ID NO: 8520313 - DNA, 22 bp, Homo sapiens
gaaacactatgccaagacaggg

SEQ ID NO: 8520314 - DNA, 22 bp, Homo sapiens
gaaacacatatgaacagttgat

SEQ ID NO: 8520315 - DNA, 22 bp, Homo sapiens
gaaacacatgcagctccataga

SEQ ID NO: 8520316 - DNA, 22 bp, Homo sapiens
gaaacacatgcagctccataga

SEQ ID NO: 8520317 - DNA, 22 bp, Homo sapiens
gaaacacatatgaacagttgat

SEQ ID NO: 8520318 - DNA, 22 bp, Homo sapiens
gaaagagtatgggagctttact

SEQ ID NO: 8520319 - DNA, 22 bp, Homo sapiens
gaaagagaggggctgagatgca

SEQ ID NO: 8520320 - DNA, 22 bp, Homo sapiens
gaaacagcacgtttggagagat

SEQ ID NO: 8520321 - DNA, 18 bp, Homo sapiens
gaaagccatgcagcagtg

SEQ ID NO: 8520322 - DNA, 22 bp, Homo sapiens
gaaagccagagagaaagggctc

SEQ ID NO: 8520323 - DNA, 22 bp, Homo sapiens
gaaaattattgaaaatggctct

SEQ ID NO: 8520324 - DNA, 22 bp, Homo sapiens
gaaaattattgaaaatggctct

SEQ ID NO: 8520325 - DNA, 22 bp, Homo sapiens
gaaaatttaattctcttctgtg

SEQ ID NO: 8520326 - DNA, 22 bp, Homo sapiens
gaaaatttagaactgaacttct

SEQ ID NO: 8520327 - DNA, 22 bp, Homo sapiens
gaaacaatcatcatgtgatttg

SEQ ID NO: 8520328 - DNA, 22 bp, Homo sapiens
gaaacaatcatcatgtgatttg

SEQ ID NO: 8520329 - DNA, 22 bp, Homo sapiens
gaaaatttctgccacatgtgtg

SEQ ID NO: 8520330 - DNA, 22 bp, Homo sapiens
gaaacaactactattgatttct

SEQ ID NO: 8520331 - DNA, 22 bp, Homo sapiens
gaaacaactactattgatttct

SEQ ID NO: 8520332 - DNA, 22 bp, Homo sapiens
gaaaatacttcagtgttctggc

SEQ ID NO: 8520333 - DNA, 22 bp, Homo sapiens
cttttgcagccattattgctgc

SEQ ID NO: 8520334 - DNA, 22 bp, Homo sapiens
cttttgcaccttttaagtaatg

SEQ ID NO: 8520335 - DNA, 22 bp, Homo sapiens
cttttgcacccagagttatttg

SEQ ID NO: 8520336 - DNA, 22 bp, Homo sapiens
gaaaatacttcagtgttctggc

SEQ ID NO: 8520337 - DNA, 22 bp, Homo sapiens
gaaaatagcagatagaccaatg

SEQ ID NO: 8520338 - DNA, 22 bp, Homo sapiens
gaaaatgtttgtccggagctga

SEQ ID NO: 8520339 - DNA, 22 bp, Homo sapiens
gaaaattattgaaaatggctct

SEQ ID NO: 8520340 - DNA, 22 bp, Homo sapiens
gaaaatgtttgtccggagctga

SEQ ID NO: 8520341 - DNA, 22 bp, Homo sapiens
gaaaatgtttcctgttatttgc

SEQ ID NO: 8520342 - DNA, 22 bp, Homo sapiens
gaaaatgtttcctgttatttgc

SEQ ID NO: 8520343 - DNA, 22 bp, Homo sapiens
gaaaatgtttcctgttatttgc

SEQ ID NO: 8520344 - DNA, 22 bp, Homo sapiens
gaaaatgttagcttcatagtca

SEQ ID NO: 8520345 - DNA, 22 bp, Homo sapiens
gaaaatagcagatagaccaatg

SEQ ID NO: 8520346 - DNA, 22 bp, Homo sapiens
ctttgaagagattactgtgctc

SEQ ID NO: 8520347 - DNA, 22 bp, Homo sapiens
ctttgaattaacgacacaagtg

SEQ ID NO: 8520348 - DNA, 22 bp, Homo sapiens
ctttgaaaacttaaataacagc

SEQ ID NO: 8520349 - DNA, 22 bp, Homo sapiens
ctttgaaagctcccaggactta

SEQ ID NO: 8520350 - DNA, 22 bp, Homo sapiens
ctttgaattgccgtttcatctg

SEQ ID NO: 8520351 - DNA, 22 bp, Homo sapiens
ctttgatataagtatacatagt

SEQ ID NO: 8520352 - DNA, 22 bp, Homo sapiens
ctttgattcagactttgtcggc

SEQ ID NO: 8520353 - DNA, 22 bp, Homo sapiens
ctttctttgtccaccaacaatg

SEQ ID NO: 8520354 - DNA, 22 bp, Homo sapiens
ctttctttgtccaccaacaatg

SEQ ID NO: 8520355 - DNA, 22 bp, Homo sapiens
ctttctttgtccaccaacaatg

SEQ ID NO: 8520356 - DNA, 22 bp, Homo sapiens
ctttctttgcagtgagccagag

SEQ ID NO: 8520357 - DNA, 22 bp, Homo sapiens
ctttctcttcgaaaacctgccc

SEQ ID NO: 8520358 - DNA, 22 bp, Homo sapiens
ctttgaaaaatggtttcctaga

SEQ ID NO: 8520359 - DNA, 22 bp, Homo sapiens
ctttgaaaaatggtttcctaga

SEQ ID NO: 8520360 - DNA, 22 bp, Homo sapiens
ctttgaaaacacacgaatagac

SEQ ID NO: 8520361 - DNA, 22 bp, Homo sapiens
ctttgaaaacttaaataacagc

SEQ ID NO: 8520362 - DNA, 22 bp, Homo sapiens
ctttgaaaacttaaataacagc

SEQ ID NO: 8520363 - DNA, 22 bp, Homo sapiens
ctttgaaaacttaaataacagc

SEQ ID NO: 8520364 - DNA, 22 bp, Homo sapiens
ctttgaaaacttaaataacagc

SEQ ID NO: 8520365 - DNA, 22 bp, Homo sapiens
ctttaattgtagctcccataat

SEQ ID NO: 8520366 - DNA, 22 bp, Homo sapiens
ctttacaaagcaattttgtctc

SEQ ID NO: 8520367 - DNA, 22 bp, Homo sapiens
ctttacaaagcaattttgtctc

SEQ ID NO: 8520368 - DNA, 22 bp, Homo sapiens
ctttacaaactataaagtgcgg

SEQ ID NO: 8520369 - DNA, 22 bp, Homo sapiens
ctttctcttcagcacccagccc

SEQ ID NO: 8520370 - DNA, 22 bp, Homo sapiens
ctttacaaagcaattttgtctc

SEQ ID NO: 8520371 - DNA, 22 bp, Homo sapiens
ctttaattaggaagtataatga

SEQ ID NO: 8520372 - DNA, 22 bp, Homo sapiens
ctttaattaggaagtataatga

SEQ ID NO: 8520373 - DNA, 23 bp, Homo sapiens
ctttaatgaaattctctgtgaag

SEQ ID NO: 8520374 - DNA, 22 bp, Homo sapiens
ctttaattcagatttgaaggga

SEQ ID NO: 8520375 - DNA, 22 bp, Homo sapiens
ctttaattctcaggtgcacata

SEQ ID NO: 8520376 - DNA, 22 bp, Homo sapiens
ctttaaggtgatgagagatgct

SEQ ID NO: 8520377 - DNA, 22 bp, Homo sapiens
ctttaacagttccattcaattt

SEQ ID NO: 8520378 - DNA, 22 bp, Homo sapiens
ctttaagactaaattagagttt

SEQ ID NO: 8520379 - DNA, 22 bp, Homo sapiens
ctttaacaaatgactcttgtct

SEQ ID NO: 8520380 - DNA, 22 bp, Homo sapiens
ctttaaataatacaaggtccag

SEQ ID NO: 8520381 - DNA, 22 bp, Homo sapiens
ctttaaataatacaaggtccag

SEQ ID NO: 8520382 - DNA, 22 bp, Homo sapiens
cttgttttctaaaacatcattt

SEQ ID NO: 8520383 - DNA, 22 bp, Homo sapiens
cttgttttctaaaacatcattt

SEQ ID NO: 8520384 - DNA, 22 bp, Homo sapiens
cttgttttctaaaacatcattt

SEQ ID NO: 8520385 - DNA, 22 bp, Homo sapiens
cttgttttcttctgcagtctat

SEQ ID NO: 8520386 - DNA, 22 bp, Homo sapiens
cttgttttggaacagagtgaat

SEQ ID NO: 8520387 - DNA, 22 bp, Homo sapiens
cttgttttggaacagagtgaat

SEQ ID NO: 8520388 - DNA, 22 bp, Homo sapiens
cttgttttggaacagagtgaat

SEQ ID NO: 8520389 - DNA, 22 bp, Homo sapiens
cttgttttggctagtatgatgt

SEQ ID NO: 8520390 - DNA, 22 bp, Homo sapiens
ctttaaataatacaaggtccag

SEQ ID NO: 8520391 - DNA, 22 bp, Homo sapiens
ctttaaataatacaaggtccag

SEQ ID NO: 8520392 - DNA, 22 bp, Homo sapiens
ctttaaataatacaaggtccag

SEQ ID NO: 8520393 - DNA, 22 bp, Homo sapiens
cttctgggttgcaggtcttggc

SEQ ID NO: 8520394 - DNA, 22 bp, Homo sapiens
cttgtgcatttcattcctcagg

SEQ ID NO: 8520395 - DNA, 22 bp, Homo sapiens
cttgtgcaattgacattgaatc

SEQ ID NO: 8520396 - DNA, 22 bp, Homo sapiens
cttctgggtgtggagtgaggac

SEQ ID NO: 8520397 - DNA, 22 bp, Homo sapiens
cttctgggtgtggagtgaggac

SEQ ID NO: 8520398 - DNA, 22 bp, Homo sapiens
cttctgggcatggcagagcctg

SEQ ID NO: 8520399 - DNA, 22 bp, Homo sapiens
cttctgggcagaagttttgaga

SEQ ID NO: 8520400 - DNA, 22 bp, Homo sapiens
cttctgggcattcagctgcaca

SEQ ID NO: 8520401 - DNA, 22 bp, Homo sapiens
cttctgggcattcagctgcaca

SEQ ID NO: 8520402 - DNA, 22 bp, Homo sapiens
cttctggggatggagcccagaa

SEQ ID NO: 8520403 - DNA, 22 bp, Homo sapiens
cttctggggatggagcccagaa

SEQ ID NO: 8520404 - DNA, 22 bp, Homo sapiens
cttctgggcattcagctgcaca

SEQ ID NO: 8520405 - DNA, 22 bp, Homo sapiens
cttctgggccatggccttcctc

SEQ ID NO: 8520406 - DNA, 23 bp, Homo sapiens
cttctggctctatatcagaattc

SEQ ID NO: 8520407 - DNA, 20 bp, Homo sapiens
cttctggctggtcaaggact

SEQ ID NO: 8520408 - DNA, 22 bp, Homo sapiens
cttctgggatttttgaagactc

SEQ ID NO: 8520409 - DNA, 22 bp, Homo sapiens
cttctggcaaaacaggcagaaa

SEQ ID NO: 8520410 - DNA, 23 bp, Homo sapiens
cttctggctctatatcagaattc

SEQ ID NO: 8520411 - DNA, 22 bp, Homo sapiens
cttctggaggacactggcccca

SEQ ID NO: 8520412 - DNA, 22 bp, Homo sapiens
cttctggatttattcattcctt

SEQ ID NO: 8520413 - DNA, 22 bp, Homo sapiens
cttctggaggctccagggaggt

SEQ ID NO: 8520414 - DNA, 22 bp, Homo sapiens
cttctggaggctccagggaggt

SEQ ID NO: 8520415 - DNA, 22 bp, Homo sapiens
cttctgacccctggtctacagc

SEQ ID NO: 8520416 - DNA, 22 bp, Homo sapiens
cttctcttggtagttcttgttg

SEQ ID NO: 8520417 - DNA, 22 bp, Homo sapiens
cttctcttggtagttcttgttg

SEQ ID NO: 8520418 - DNA, 22 bp, Homo sapiens
gacatttaaattgcaggcagcc

SEQ ID NO: 8520419 - DNA, 22 bp, Homo sapiens
gacattgggtgtacaattggca

SEQ ID NO: 8520420 - DNA, 22 bp, Homo sapiens
gacattggctgttcattgggat

SEQ ID NO: 8520421 - DNA, 22 bp, Homo sapiens
gacattgacagtcctccttata

SEQ ID NO: 8520422 - DNA, 22 bp, Homo sapiens
gacattgagtatttcttttctc

SEQ ID NO: 8520423 - DNA, 22 bp, Homo sapiens
gacattgaacaagtttcctgac

SEQ ID NO: 8520424 - DNA, 22 bp, Homo sapiens
gacattgaagtatttttgtcga

SEQ ID NO: 8520425 - DNA, 22 bp, Homo sapiens
gacatttagaagtctaatggcc

SEQ ID NO: 8520426 - DNA, 22 bp, Homo sapiens
gacatttagaagtctaatggcc

SEQ ID NO: 8520427 - DNA, 22 bp, Homo sapiens
gacatttactgaatactgatta

SEQ ID NO: 8520428 - DNA, 22 bp, Homo sapiens
gacatttaatagtattgtggga

SEQ ID NO: 8520429 - DNA, 22 bp, Homo sapiens
gacatttaaggcagtcacttaa

SEQ ID NO: 8520430 - DNA, 22 bp, Homo sapiens
gacatttaaggcagtcacttaa

SEQ ID NO: 8520431 - DNA, 22 bp, Homo sapiens
gacagcagatgaagcctgcaga

SEQ ID NO: 8520432 - DNA, 22 bp, Homo sapiens
gacagcagatgaagcctgcaga

SEQ ID NO: 8520433 - DNA, 22 bp, Homo sapiens
gacagcagatgaagcctgcaga

SEQ ID NO: 8520434 - DNA, 22 bp, Homo sapiens
gacagcagcataatacatgaac

SEQ ID NO: 8520435 - DNA, 22 bp, Homo sapiens
gacagcagcatgtttacaggcc

SEQ ID NO: 8520436 - DNA, 22 bp, Homo sapiens
gacattcaactttgatgattat

SEQ ID NO: 8520437 - DNA, 22 bp, Homo sapiens
gacagcagcatgtttacaggcc

SEQ ID NO: 8520438 - DNA, 22 bp, Homo sapiens
gacattcacaggtaaacattcc

SEQ ID NO: 8520439 - DNA, 22 bp, Homo sapiens
gacagaggcaagaccagaagcc

SEQ ID NO: 8520440 - DNA, 22 bp, Homo sapiens
gacagaggcaagaccagaagcc

SEQ ID NO: 8520441 - DNA, 22 bp, Homo sapiens
gacagaggcaagaccagaagcc

SEQ ID NO: 8520442 - DNA, 22 bp, Homo sapiens
gacagaggagaagatgctgtgg

SEQ ID NO: 8520443 - DNA, 21 bp, Homo sapiens
gacagcaactgtagtcctctt

SEQ ID NO: 8520444 - DNA, 22 bp, Homo sapiens
gacagcaatgacggggcagctg

SEQ ID NO: 8520445 - DNA, 22 bp, Homo sapiens
gacagcaagagacagagcatcc

SEQ ID NO: 8520446 - DNA, 22 bp, Homo sapiens
gacagcagacagaactacctgc

SEQ ID NO: 8520447 - DNA, 22 bp, Homo sapiens
gacagcagaatccattcccagt

SEQ ID NO: 8520448 - DNA, 22 bp, Homo sapiens
gacagcagacaaaccatgtttt

SEQ ID NO: 8520449 - DNA, 22 bp, Homo sapiens
gacagagattgaatcaggaaat

SEQ ID NO: 8520450 - DNA, 22 bp, Homo sapiens
gacagagattgaatcaggaaat

SEQ ID NO: 8520451 - DNA, 22 bp, Homo sapiens
gacagagaggctgagcagtaca

SEQ ID NO: 8520452 - DNA, 22 bp, Homo sapiens
gacagagattgaatcaggaaat

SEQ ID NO: 8520453 - DNA, 22 bp, Homo sapiens
gacagagattgaatcaggaaat

SEQ ID NO: 8520454 - DNA, 22 bp, Homo sapiens
gacagacatttcctgatccaat

SEQ ID NO: 8520455 - DNA, 22 bp, Homo sapiens
gacagacatttcctgatccaat

SEQ ID NO: 8520456 - DNA, 22 bp, Homo sapiens
gacagacatgggacttcatact

SEQ ID NO: 8520457 - DNA, 22 bp, Homo sapiens
gacagactaaatggctgtagga

SEQ ID NO: 8520458 - DNA, 22 bp, Homo sapiens
gacagagaggctgagcagtaca

SEQ ID NO: 8520459 - DNA, 22 bp, Homo sapiens
gacagagaggctgagcagtaca

SEQ ID NO: 8520460 - DNA, 22 bp, Homo sapiens
gaccactggcgctgcgagaccc

SEQ ID NO: 8520461 - DNA, 22 bp, Homo sapiens
gaccactgatgacatgaggaga

SEQ ID NO: 8520462 - DNA, 22 bp, Homo sapiens
gaccacagtccagtcatcatgg

SEQ ID NO: 8520463 - DNA, 22 bp, Homo sapiens
gaccagaatctggactctgatt

SEQ ID NO: 8520464 - DNA, 22 bp, Homo sapiens
gaccagagaaaggcactggaag

SEQ ID NO: 8520465 - DNA, 22 bp, Homo sapiens
gaccagagaaaggcactggaag

SEQ ID NO: 8520466 - DNA, 22 bp, Homo sapiens
gaccagagaaaggcactggaag

SEQ ID NO: 8520467 - DNA, 22 bp, Homo sapiens
gacatttagaagttagattcaa

SEQ ID NO: 8520468 - DNA, 22 bp, Homo sapiens
gacatttagaagttagattcaa

SEQ ID NO: 8520469 - DNA, 22 bp, Homo sapiens
gacatttaggtagcttccagtt

SEQ ID NO: 8520470 - DNA, 21 bp, Homo sapiens
gaccacagggaaggtcttgca

SEQ ID NO: 8520471 - DNA, 22 bp, Homo sapiens
gaccacagctacaagggcaagg

SEQ ID NO: 8520472 - DNA, 22 bp, Homo sapiens
gacatttagctgttttgcattt

SEQ ID NO: 8520473 - DNA, 22 bp, Homo sapiens
gactccaggtgcaggaggagcc

SEQ ID NO: 8520474 - DNA, 22 bp, Homo sapiens
gactccagcatatacttttagt

SEQ ID NO: 8520475 - DNA, 22 bp, Homo sapiens
gactccatccaatctgtgttct

SEQ ID NO: 8520476 - DNA, 22 bp, Homo sapiens
gactccaggtgtccaggcctcc

SEQ ID NO: 8520477 - DNA, 22 bp, Homo sapiens
gactccaggtgtccaggcctcc

SEQ ID NO: 8520478 - DNA, 22 bp, Homo sapiens
gactcccctgggccccatccag

SEQ ID NO: 8520479 - DNA, 17 bp, Homo sapiens
gaccaggagaaaccagg

SEQ ID NO: 8520480 - DNA, 22 bp, Homo sapiens
gaccagctggtcctgtcctggg

SEQ ID NO: 8520481 - DNA, 22 bp, Homo sapiens
gaccagctgataaggcatataa

SEQ ID NO: 8520482 - DNA, 22 bp, Homo sapiens
gaccagctctctgaagaaagag

SEQ ID NO: 8520483 - DNA, 22 bp, Homo sapiens
gaccagctacttgtacagttca

SEQ ID NO: 8520484 - DNA, 22 bp, Homo sapiens
gaccaggaaagagtgtgactaa

SEQ ID NO: 8520485 - DNA, 22 bp, Homo sapiens
gaccagctggtgaaaaccaatt

SEQ ID NO: 8520486 - DNA, 22 bp, Homo sapiens
gaccagctggtcctgtcctggg

SEQ ID NO: 8520487 - DNA, 22 bp, Homo sapiens
gactcctgggcctctgagaggc

SEQ ID NO: 8520488 - DNA, 22 bp, Homo sapiens
gactctcaagcacaagtccacc

SEQ ID NO: 8520489 - DNA, 21 bp, Homo sapiens
gactctggggtcagctcaacc

SEQ ID NO: 8520490 - DNA, 22 bp, Homo sapiens
gactgaggtattaagatggctt

SEQ ID NO: 8520491 - DNA, 17 bp, Homo sapiens
gactgaggtaaggtgag

SEQ ID NO: 8520492 - DNA, 22 bp, Homo sapiens
gactgagggatagaggtgcttc

SEQ ID NO: 8520493 - DNA, 22 bp, Homo sapiens
gactgagggacagggcagtgga

SEQ ID NO: 8520494 - DNA, 22 bp, Homo sapiens
gactgaggctcccctaggctca

SEQ ID NO: 8520495 - DNA, 22 bp, Homo sapiens
gactgagaaacagtacattacc

SEQ ID NO: 8520496 - DNA, 22 bp, Homo sapiens
gactgaacctcaaatttggctc

SEQ ID NO: 8520497 - DNA, 22 bp, Homo sapiens
gactgaacagtaagaggcttta

SEQ ID NO: 8520498 - DNA, 22 bp, Homo sapiens
gactgaaattataccaagtggt

SEQ ID NO: 8520499 - DNA, 22 bp, Homo sapiens
gactctttcaaacagaaagcca

SEQ ID NO: 8520500 - DNA, 22 bp, Homo sapiens
gactctgtgggaggaggctcag

SEQ ID NO: 8520501 - DNA, 22 bp, Homo sapiens
gactgagaatcatagaaggcaa

SEQ ID NO: 8520502 - DNA, 22 bp, Homo sapiens
gactgaggaggtaaggtttgaa

SEQ ID NO: 8520503 - DNA, 22 bp, Homo sapiens
gagactggtgtttgctgggctg

SEQ ID NO: 8520504 - DNA, 22 bp, Homo sapiens
gagactggtgtttgctgggctg

SEQ ID NO: 8520505 - DNA, 22 bp, Homo sapiens
gagagaaagcccctgcatccct

SEQ ID NO: 8520506 - DNA, 22 bp, Homo sapiens
gagagaaaagggggaattgatt

SEQ ID NO: 8520507 - DNA, 22 bp, Homo sapiens
gagacctggaggatgtggatgg

SEQ ID NO: 8520508 - DNA, 22 bp, Homo sapiens
gagacctgcagctgtagtctgc

SEQ ID NO: 8520509 - DNA, 22 bp, Homo sapiens
gagacctcttggtatcgctagg

SEQ ID NO: 8520510 - DNA, 22 bp, Homo sapiens
gagactgatggggctcccagaa

SEQ ID NO: 8520511 - DNA, 22 bp, Homo sapiens
gagactgctggtaaagatggga

SEQ ID NO: 8520512 - DNA, 21 bp, Homo sapiens
gagagggcattataggaagtg

SEQ ID NO: 8520513 - DNA, 21 bp, Homo sapiens
gagagggcattataggaagtg

SEQ ID NO: 8520514 - DNA, 22 bp, Homo sapiens
gagagggcaaggtagatgctac

SEQ ID NO: 8520515 - DNA, 22 bp, Homo sapiens
gagagggccgggggccagctcc

SEQ ID NO: 8520516 - DNA, 22 bp, Homo sapiens
gagagggccgggggccagctcc

SEQ ID NO: 8520517 - DNA, 22 bp, Homo sapiens
gagagggccagggtgagaacta

SEQ ID NO: 8520518 - DNA, 22 bp, Homo sapiens
gagagggccgggggccagctcc

SEQ ID NO: 8520519 - DNA, 22 bp, Homo sapiens
gagagggctctgtgtgggtact

SEQ ID NO: 8520520 - DNA, 18 bp, Homo sapiens
gagagggatccctcagga

SEQ ID NO: 8520521 - DNA, 18 bp, Homo sapiens
gagagggatccctcagga

SEQ ID NO: 8520522 - DNA, 22 bp, Homo sapiens
gagagggcaaacttgtagctaa

SEQ ID NO: 8520523 - DNA, 22 bp, Homo sapiens
gagagaaccctaaatgagatat

SEQ ID NO: 8520524 - DNA, 22 bp, Homo sapiens
gagagaacacaaagggccagct

SEQ ID NO: 8520525 - DNA, 18 bp, Homo sapiens
gagagggatccctcagga

SEQ ID NO: 8520526 - DNA, 22 bp, Homo sapiens
gagagaaaggcttgcaggctgt

SEQ ID NO: 8520527 - DNA, 22 bp, Homo sapiens
gagagaaaggcttgcaggctgt

SEQ ID NO: 8520528 - DNA, 22 bp, Homo sapiens
gagaaacctgtaaggaaggaag

SEQ ID NO: 8520529 - DNA, 22 bp, Homo sapiens
gagaaacaggaattgagtcgct

SEQ ID NO: 8520530 - DNA, 22 bp, Homo sapiens
gagaaacaggaattgagtcgct

SEQ ID NO: 8520531 - DNA, 22 bp, Homo sapiens
gagaaacaggaattgagtcgct

SEQ ID NO: 8520532 - DNA, 22 bp, Homo sapiens
gagaaacaggaattgagtcgct

SEQ ID NO: 8520533 - DNA, 22 bp, Homo sapiens
gagaaacactgttagtttatta

SEQ ID NO: 8520534 - DNA, 22 bp, Homo sapiens
gagaaacactgttagtttatta

SEQ ID NO: 8520535 - DNA, 22 bp, Homo sapiens
gagaaacactgttagtttatta

SEQ ID NO: 8520536 - DNA, 22 bp, Homo sapiens
gactgcagtgaaggcacatggg

SEQ ID NO: 8520537 - DNA, 22 bp, Homo sapiens
gactgaggtgacctaggactac

SEQ ID NO: 8520538 - DNA, 22 bp, Homo sapiens
gactgaggtgcccagaggtgac

SEQ ID NO: 8520539 - DNA, 22 bp, Homo sapiens
gagaaagatgaagagtggcgtt

SEQ ID NO: 8520540 - DNA, 22 bp, Homo sapiens
gagaaagatggaatcttacagg

SEQ ID NO: 8520541 - DNA, 22 bp, Homo sapiens
gagaaagacgtaggctgggagg

SEQ ID NO: 8520542 - DNA, 22 bp, Homo sapiens
gagaaagacgtaggctgggagg

SEQ ID NO: 8520543 - DNA, 22 bp, Homo sapiens
gagaaactaacatctgaaggtg

SEQ ID NO: 8520544 - DNA, 22 bp, Homo sapiens
gagaaacttggagttattctgg

SEQ ID NO: 8520545 - DNA, 22 bp, Homo sapiens
gagaaagaaagggaagtttgtt

SEQ ID NO: 8520546 - DNA, 22 bp, Homo sapiens
gagaaagattgtccttcagggg

SEQ ID NO: 8520547 - DNA, 22 bp, Homo sapiens
gagaaagatgtaggctgggagg

SEQ ID NO: 8520548 - DNA, 22 bp, Homo sapiens
gagaaagatggaatcttacagg

SEQ ID NO: 8520549 - DNA, 22 bp, Homo sapiens
gagaaagatgtaggctgggagg

SEQ ID NO: 8520550 - DNA, 19 bp, Homo sapiens
gagaaagcaggcacagcac

SEQ ID NO: 8520551 - DNA, 19 bp, Homo sapiens
gagaaagcaggcacagcac

SEQ ID NO: 8520552 - DNA, 22 bp, Homo sapiens
gagaaagcttcagaaatggcct

SEQ ID NO: 8520553 - DNA, 22 bp, Homo sapiens
gagaaagcttcagaaatggcct

SEQ ID NO: 8520554 - DNA, 22 bp, Homo sapiens
gagacagatgctgctggagcat

SEQ ID NO: 8520555 - DNA, 20 bp, Homo sapiens
gagacagcaaaagcctctcc

SEQ ID NO: 8520556 - DNA, 22 bp, Homo sapiens
gagacattcttaggaacaatgt

SEQ ID NO: 8520557 - DNA, 19 bp, Homo sapiens
gagacatgtagatagaaga

SEQ ID NO: 8520558 - DNA, 22 bp, Homo sapiens
gagaccaggaagtacagcagcc

SEQ ID NO: 8520559 - DNA, 22 bp, Homo sapiens
gagaccaggaagtacagcagcc

SEQ ID NO: 8520560 - DNA, 22 bp, Homo sapiens
gagaccaggaagtacagcagcc

SEQ ID NO: 8520561 - DNA, 22 bp, Homo sapiens
gagaaaggcattcctatgcaaa

SEQ ID NO: 8520562 - DNA, 22 bp, Homo sapiens
gagaaagcttctttcccacagg

SEQ ID NO: 8520563 - DNA, 22 bp, Homo sapiens
gagaaagcttctttcccacagg

SEQ ID NO: 8520564 - DNA, 22 bp, Homo sapiens
gagacagatctcggctccatgc

SEQ ID NO: 8520565 - DNA, 22 bp, Homo sapiens
gagacagatgctgctggagcat

SEQ ID NO: 8520566 - DNA, 22 bp, Homo sapiens
gagacagatgctgctggagcat

SEQ ID NO: 8520567 - DNA, 22 bp, Homo sapiens
gagacagatgctgctggagcat

SEQ ID NO: 8520568 - DNA, 22 bp, Homo sapiens
gaagcagccacggggagacaga

SEQ ID NO: 8520569 - DNA, 22 bp, Homo sapiens
gaagcagcagctggggacagtt

SEQ ID NO: 8520570 - DNA, 22 bp, Homo sapiens
gaagcagctaggatcttcattt

SEQ ID NO: 8520571 - DNA, 22 bp, Homo sapiens
gaagcagcagctggggacagtt

SEQ ID NO: 8520572 - DNA, 22 bp, Homo sapiens
gaagcagtcagcagcacctttg

SEQ ID NO: 8520573 - DNA, 22 bp, Homo sapiens
gaagcagctttctggtgaggag

SEQ ID NO: 8520574 - DNA, 20 bp, Homo sapiens
gaagcagcttcatgtagaca

SEQ ID NO: 8520575 - DNA, 22 bp, Homo sapiens
gaagcagctggtgagatggagc

SEQ ID NO: 8520576 - DNA, 22 bp, Homo sapiens
gaagcagtatcctgacagcacc

SEQ ID NO: 8520577 - DNA, 22 bp, Homo sapiens
gaagcagttcgaaagcagttgg

SEQ ID NO: 8520578 - DNA, 22 bp, Homo sapiens
gaagcatgctaaggattctcag

SEQ ID NO: 8520579 - DNA, 22 bp, Homo sapiens
gaagcatcagcaatggctggaa

SEQ ID NO: 8520580 - DNA, 22 bp, Homo sapiens
gaagccaagtgcaaatgcctta

SEQ ID NO: 8520581 - DNA, 22 bp, Homo sapiens
gaagccaacattccaagtagaa

SEQ ID NO: 8520582 - DNA, 18 bp, Homo sapiens
gaaaggagagacagtagg

SEQ ID NO: 8520583 - DNA, 18 bp, Homo sapiens
gaaaggagagacagtagg

SEQ ID NO: 8520584 - DNA, 22 bp, Homo sapiens
gaaaggaaattgagggacgcat

SEQ ID NO: 8520585 - DNA, 22 bp, Homo sapiens
gaaagctgaaccaggaaccatg

SEQ ID NO: 8520586 - DNA, 22 bp, Homo sapiens
gaaagctgggaaataaatatta

SEQ ID NO: 8520587 - DNA, 22 bp, Homo sapiens
gaaagctgtgaaatagtgctct

SEQ ID NO: 8520588 - DNA, 22 bp, Homo sapiens
gaaagcttccattttgtacatt

SEQ ID NO: 8520589 - DNA, 22 bp, Homo sapiens
gaaaggaaatattctaagcact

SEQ ID NO: 8520590 - DNA, 22 bp, Homo sapiens
gaaaggaaatattctaagcact

SEQ ID NO: 8520591 - DNA, 22 bp, Homo sapiens
gaaaggagggaaacagagcggt

SEQ ID NO: 8520592 - DNA, 22 bp, Homo sapiens
gaaaggagggaaacagagcggt

SEQ ID NO: 8520593 - DNA, 22 bp, Homo sapiens
gaaaggagggctcacaaaagtg

SEQ ID NO: 8520594 - DNA, 22 bp, Homo sapiens
gaaaggagagggttaaggagct

SEQ ID NO: 8520595 - DNA, 22 bp, Homo sapiens
gaaggcagggaatgtggtgcta

SEQ ID NO: 8520596 - DNA, 22 bp, Homo sapiens
gaaggcagggaatgtggtgcta

SEQ ID NO: 8520597 - DNA, 22 bp, Homo sapiens
gaaggcactgaactccttctgg

SEQ ID NO: 8520598 - DNA, 22 bp, Homo sapiens
gaaggcaggcttctgattaggt

SEQ ID NO: 8520599 - DNA, 22 bp, Homo sapiens
gaaggcagggaatgtggtgcta

SEQ ID NO: 8520600 - DNA, 20 bp, Homo sapiens
gaaggcaatggtttggcaca

SEQ ID NO: 8520601 - DNA, 22 bp, Homo sapiens
gaaggcacagatggcagtccac

SEQ ID NO: 8520602 - DNA, 22 bp, Homo sapiens
gaaggcaccctccatcactcac

SEQ ID NO: 8520603 - DNA, 22 bp, Homo sapiens
gaaggcacccggcgtgcggcgg

SEQ ID NO: 8520604 - DNA, 22 bp, Homo sapiens
gaaggagctaaagggagccctg

SEQ ID NO: 8520605 - DNA, 22 bp, Homo sapiens
gaaggagctaaagggagccctg

SEQ ID NO: 8520606 - DNA, 22 bp, Homo sapiens
gaagggaaggaaagaaccagca

SEQ ID NO: 8520607 - DNA, 22 bp, Homo sapiens
gaagggagaaggttgggtgacg

SEQ ID NO: 8520608 - DNA, 18 bp, Homo sapiens
gaagggagctggaatgca

SEQ ID NO: 8520609 - DNA, 22 bp, Homo sapiens
gaagggagaaggttgggtgacg

SEQ ID NO: 8520610 - DNA, 22 bp, Homo sapiens
gaaggccattgcgtcctgggat

SEQ ID NO: 8520611 - DNA, 22 bp, Homo sapiens
gaagggaaggaaagaaccagca

SEQ ID NO: 8520612 - DNA, 22 bp, Homo sapiens
gaaggccacggaatggagctgg

SEQ ID NO: 8520613 - DNA, 22 bp, Homo sapiens
gaaggccacggaatggagctgg

SEQ ID NO: 8520614 - DNA, 22 bp, Homo sapiens
gaaggcattttatgccttatag

SEQ ID NO: 8520615 - DNA, 22 bp, Homo sapiens
gaaggcatttcagagatctctg

SEQ ID NO: 8520616 - DNA, 22 bp, Homo sapiens
gaaggccaagaggctccaagat

SEQ ID NO: 8520617 - DNA, 22 bp, Homo sapiens
gaaggcattctattctacatat

SEQ ID NO: 8520618 - DNA, 22 bp, Homo sapiens
gaaggcatctctggacttattt

SEQ ID NO: 8520619 - DNA, 22 bp, Homo sapiens
gaaggcataaaaccaattttgt

SEQ ID NO: 8520620 - DNA, 22 bp, Homo sapiens
gaaggcagtaaatggctgtttt

SEQ ID NO: 8520621 - DNA, 22 bp, Homo sapiens
gaatgaaaaccttggctcaaat

SEQ ID NO: 8520622 - DNA, 22 bp, Homo sapiens
gaatcttttttcttgccaggca

SEQ ID NO: 8520623 - DNA, 21 bp, Homo sapiens
gaatctttgatttacatggga

SEQ ID NO: 8520624 - DNA, 22 bp, Homo sapiens
gaatcttttgtctcgtgaataa

SEQ ID NO: 8520625 - DNA, 22 bp, Homo sapiens
gaatgaaagatttgcattctat

SEQ ID NO: 8520626 - DNA, 22 bp, Homo sapiens
gaatgaaagatttgcattctat

SEQ ID NO: 8520627 - DNA, 22 bp, Homo sapiens
gaatgaattcagcacatggaat

SEQ ID NO: 8520628 - DNA, 22 bp, Homo sapiens
gaatgaatctgtaagtgacaag

SEQ ID NO: 8520629 - DNA, 22 bp, Homo sapiens
gaatgaatctgtaagtgacaag

SEQ ID NO: 8520630 - DNA, 22 bp, Homo sapiens
gaatgaacaaatgtggtggaga

SEQ ID NO: 8520631 - DNA, 22 bp, Homo sapiens
gaatgaacaaggatgttcatcc

SEQ ID NO: 8520632 - DNA, 22 bp, Homo sapiens
gaatgagtagagtataaacaaa

SEQ ID NO: 8520633 - DNA, 22 bp, Homo sapiens
gaatgataaatggaagcagcat

SEQ ID NO: 8520634 - DNA, 22 bp, Homo sapiens
gaatgatagagctgccttcgga

SEQ ID NO: 8520635 - DNA, 22 bp, Homo sapiens
gaatgatatattagcagatttt

SEQ ID NO: 8520636 - DNA, 22 bp, Homo sapiens
gaatgacattgaaaagacattg

SEQ ID NO: 8520637 - DNA, 22 bp, Homo sapiens
gaatgaattttggatggtgaag

SEQ ID NO: 8520638 - DNA, 22 bp, Homo sapiens
gaatgacattgagccataacat

SEQ ID NO: 8520639 - DNA, 22 bp, Homo sapiens
gaatgatattatttcgtgctgg

SEQ ID NO: 8520640 - DNA, 22 bp, Homo sapiens
gacactgtcccacagaattcga

SEQ ID NO: 8520641 - DNA, 22 bp, Homo sapiens
gacactgtgctagctgggctta

SEQ ID NO: 8520642 - DNA, 22 bp, Homo sapiens
gacactgtgctagctgggctta

SEQ ID NO: 8520643 - DNA, 22 bp, Homo sapiens
gacacttcacctttcccagcct

SEQ ID NO: 8520644 - DNA, 22 bp, Homo sapiens
gacactgttatggtgaggtaag

SEQ ID NO: 8520645 - DNA, 22 bp, Homo sapiens
gacactgttatggtgaggtaag

SEQ ID NO: 8520646 - DNA, 22 bp, Homo sapiens
gacactttaggatttaaaagtc

SEQ ID NO: 8520647 - DNA, 22 bp, Homo sapiens
gacacttgtgctgtttctgagc

SEQ ID NO: 8520648 - DNA, 22 bp, Homo sapiens
gacacttgtgctgtttctgagc

SEQ ID NO: 8520649 - DNA, 22 bp, Homo sapiens
gacactttaggccaccatgcaa

SEQ ID NO: 8520650 - DNA, 22 bp, Homo sapiens
gacactttaggatttaaaagtc

SEQ ID NO: 8520651 - DNA, 22 bp, Homo sapiens
gacagacaggtgtggtaggcac

SEQ ID NO: 8520652 - DNA, 22 bp, Homo sapiens
gacagacaggggttctcctgga

SEQ ID NO: 8520653 - DNA, 22 bp, Homo sapiens
gacagacaggaggcattcaggg

SEQ ID NO: 8520654 - DNA, 22 bp, Homo sapiens
gacagacaggaggccacctgct

SEQ ID NO: 8520655 - DNA, 22 bp, Homo sapiens
gacagacaggaggccacctgct

SEQ ID NO: 8520656 - DNA, 22 bp, Homo sapiens
gacagacaggaggccacctgct

SEQ ID NO: 8520657 - DNA, 22 bp, Homo sapiens
gacagacaggaggccacctgct

SEQ ID NO: 8520658 - DNA, 22 bp, Homo sapiens
gacagacaggaggcattcaggg

SEQ ID NO: 8520659 - DNA, 22 bp, Homo sapiens
gacagacaggagctcacaggca

SEQ ID NO: 8520660 - DNA, 22 bp, Homo sapiens
gacagacactgtgtcctcactt

SEQ ID NO: 8520661 - DNA, 22 bp, Homo sapiens
gacagacactgtgtcctcactt

SEQ ID NO: 8520662 - DNA, 22 bp, Homo sapiens
gacagacagagaatgggcttga

SEQ ID NO: 8520663 - DNA, 22 bp, Homo sapiens
gacagaatcatctcctgggact

SEQ ID NO: 8520664 - DNA, 22 bp, Homo sapiens
gacagaagaggaacttggacag

SEQ ID NO: 8520665 - DNA, 22 bp, Homo sapiens
gacactttgggactcagcccta

SEQ ID NO: 8520666 - DNA, 22 bp, Homo sapiens
gacagaagaggaacttggacag

SEQ ID NO: 8520667 - DNA, 22 bp, Homo sapiens
gacagacacaattgatccatga

SEQ ID NO: 8520668 - DNA, 22 bp, Homo sapiens
gacagaattttccatcatgtgg

SEQ ID NO: 8520669 - DNA, 22 bp, Homo sapiens
gacagacacagggccatgattg

SEQ ID NO: 8520670 - DNA, 22 bp, Homo sapiens
gacagacacagggccatgattg

SEQ ID NO: 8520671 - DNA, 22 bp, Homo sapiens
gaagggggttgcagtctagggt

SEQ ID NO: 8520672 - DNA, 22 bp, Homo sapiens
gaagggggttgcagtctagggt

SEQ ID NO: 8520673 - DNA, 22 bp, Homo sapiens
gaagggggagctcttcctaatt

SEQ ID NO: 8520674 - DNA, 22 bp, Homo sapiens
gaagggtgcatggagggaagtc

SEQ ID NO: 8520675 - DNA, 22 bp, Homo sapiens
gaagggtgcatggagggaagtc

SEQ ID NO: 8520676 - DNA, 22 bp, Homo sapiens
gaagggtgcatggagggaagtc

SEQ ID NO: 8520677 - DNA, 22 bp, Homo sapiens
gaaggtggcgagcggattgctg

SEQ ID NO: 8520678 - DNA, 22 bp, Homo sapiens
gaagggtgtgtgtgagggacac

SEQ ID NO: 8520679 - DNA, 22 bp, Homo sapiens
gaagggtgtgtgtgagggacac

SEQ ID NO: 8520680 - DNA, 22 bp, Homo sapiens
gaaggggactggcagctgcaga

SEQ ID NO: 8520681 - DNA, 22 bp, Homo sapiens
gaaggggactggcagctgcaga

SEQ ID NO: 8520682 - DNA, 22 bp, Homo sapiens
gaaggggactggcagctgcaga

SEQ ID NO: 8520683 - DNA, 19 bp, Homo sapiens
gaaggggaaggtgggtacc

SEQ ID NO: 8520684 - DNA, 19 bp, Homo sapiens
gaaggggaaggtgggtacc

SEQ ID NO: 8520685 - DNA, 22 bp, Homo sapiens
gaaggggaaagttgagcaaata

SEQ ID NO: 8520686 - DNA, 22 bp, Homo sapiens
gaaggggaaagttgagcaaata

SEQ ID NO: 8520687 - DNA, 18 bp, Homo sapiens
gaagggctttgaagtaga

SEQ ID NO: 8520688 - DNA, 22 bp, Homo sapiens
gaagggcttggctgggaggcca

SEQ ID NO: 8520689 - DNA, 22 bp, Homo sapiens
gaagggctcatcaggtggccgc

SEQ ID NO: 8520690 - DNA, 22 bp, Homo sapiens
gaagggctgcaggtctgggccc

SEQ ID NO: 8520691 - DNA, 22 bp, Homo sapiens
gaaggtttgaaataggtataga

SEQ ID NO: 8520692 - DNA, 17 bp, Homo sapiens
gaaggtttctcttaggt

SEQ ID NO: 8520693 - DNA, 22 bp, Homo sapiens
gaaggtttactgaagatttaaa

SEQ ID NO: 8520694 - DNA, 22 bp, Homo sapiens
gaatatttgtaattactgttga

SEQ ID NO: 8520695 - DNA, 22 bp, Homo sapiens
gaatatttgtaattactgttga

SEQ ID NO: 8520696 - DNA, 22 bp, Homo sapiens
gaatatttgtaattactgttga

SEQ ID NO: 8520697 - DNA, 22 bp, Homo sapiens
gaaggtttgatccttatttata

SEQ ID NO: 8520698 - DNA, 22 bp, Homo sapiens
gaatcattcattgctcaattaa

SEQ ID NO: 8520699 - DNA, 22 bp, Homo sapiens
gaatatttgtaattactgttga

SEQ ID NO: 8520700 - DNA, 22 bp, Homo sapiens
gaatccagggttgtttgagcta

SEQ ID NO: 8520701 - DNA, 22 bp, Homo sapiens
gaatctatgcctcatatagacc

SEQ ID NO: 8520702 - DNA, 22 bp, Homo sapiens
gaatctatgcctcatatagacc

SEQ ID NO: 8520703 - DNA, 22 bp, Homo sapiens
gaatcccaatctgttattgaca

SEQ ID NO: 8520704 - DNA, 22 bp, Homo sapiens
gaatccttggttttaagcaata

SEQ ID NO: 8520705 - DNA, 22 bp, Homo sapiens
gaatccgtgtgatgtggactag

SEQ ID NO: 8520706 - DNA, 17 bp, Homo sapiens
gaatccttctctgttct

SEQ ID NO: 8520707 - DNA, 22 bp, Homo sapiens
gaatcttatttttaaatcttcc

SEQ ID NO: 8520708 - DNA, 20 bp, Homo sapiens
gaatctttccccatgcaatg

SEQ ID NO: 8520709 - DNA, 22 bp, Homo sapiens
gaatcttacctctctattgttg

SEQ ID NO: 8520710 - DNA, 20 bp, Homo sapiens
gaatcttactacattctctc

SEQ ID NO: 8520711 - DNA, 22 bp, Homo sapiens
gaatcttaaatcggaatcttaa

SEQ ID NO: 8520712 - DNA, 22 bp, Homo sapiens
gaggctcagagggagcatggtc

SEQ ID NO: 8520713 - DNA, 22 bp, Homo sapiens
gaggctcagagaggtccacata

SEQ ID NO: 8520714 - DNA, 22 bp, Homo sapiens
gaggctcagagaggtccacata

SEQ ID NO: 8520715 - DNA, 22 bp, Homo sapiens
gaggctcagagaagtcatggta

SEQ ID NO: 8520716 - DNA, 22 bp, Homo sapiens
gaggctcagggaaacagcgcag

SEQ ID NO: 8520717 - DNA, 22 bp, Homo sapiens
gaggctcagagggagcatggtc

SEQ ID NO: 8520718 - DNA, 22 bp, Homo sapiens
gaggctcagagggagcatggtc

SEQ ID NO: 8520719 - DNA, 22 bp, Homo sapiens
gaggctcagagggagcatggtc

SEQ ID NO: 8520720 - DNA, 22 bp, Homo sapiens
gaggctcagagggagcatggtc

SEQ ID NO: 8520721 - DNA, 22 bp, Homo sapiens
gaggctcagttatgtcatcagg

SEQ ID NO: 8520722 - DNA, 22 bp, Homo sapiens
gaggctgaagtgtacatgggtg

SEQ ID NO: 8520723 - DNA, 22 bp, Homo sapiens
gaggctgaacaggttctcatga

SEQ ID NO: 8520724 - DNA, 22 bp, Homo sapiens
gaggctgagactctgaattttt

SEQ ID NO: 8520725 - DNA, 22 bp, Homo sapiens
gaggctgacggcaccatcttct

SEQ ID NO: 8520726 - DNA, 22 bp, Homo sapiens
gaggctgaatggccagaagcca

SEQ ID NO: 8520727 - DNA, 22 bp, Homo sapiens
gaggctgagagtttgttctact

SEQ ID NO: 8520728 - DNA, 22 bp, Homo sapiens
gaggctgagagtttgttctact

SEQ ID NO: 8520729 - DNA, 22 bp, Homo sapiens
gaggctgagagtttgttctact

SEQ ID NO: 8520730 - DNA, 22 bp, Homo sapiens
gaggctgaggcaggaggatcac

SEQ ID NO: 8520731 - DNA, 22 bp, Homo sapiens
gaggctgaggcaggaggatcac

SEQ ID NO: 8520732 - DNA, 22 bp, Homo sapiens
gaggctgaatggccagaagcca

SEQ ID NO: 8520733 - DNA, 22 bp, Homo sapiens
gaggctgaatggccagaagcca

SEQ ID NO: 8520734 - DNA, 22 bp, Homo sapiens
gaggctgaatggccagaagcca

SEQ ID NO: 8520735 - DNA, 20 bp, Homo sapiens
gaggctgaagtgtttttgct

SEQ ID NO: 8520736 - DNA, 22 bp, Homo sapiens
gaggctgaagtgtacatgggtg

SEQ ID NO: 8520737 - DNA, 22 bp, Homo sapiens
gaggcaggccctgaatgagtca

SEQ ID NO: 8520738 - DNA, 22 bp, Homo sapiens
gaggcagggtgttgattacaga

SEQ ID NO: 8520739 - DNA, 22 bp, Homo sapiens
gaggcagggtgttgattacaga

SEQ ID NO: 8520740 - DNA, 22 bp, Homo sapiens
gaggctcacctagggagcactg

SEQ ID NO: 8520741 - DNA, 22 bp, Homo sapiens
gaggctcacctagggagcactg

SEQ ID NO: 8520742 - DNA, 22 bp, Homo sapiens
gaggctcacgacgggacgaact

SEQ ID NO: 8520743 - DNA, 22 bp, Homo sapiens
gaggctcactaggcatcctggg

SEQ ID NO: 8520744 - DNA, 22 bp, Homo sapiens
gaggctcactgggcaaagactc

SEQ ID NO: 8520745 - DNA, 22 bp, Homo sapiens
gaggctcacctagggagcactg

SEQ ID NO: 8520746 - DNA, 22 bp, Homo sapiens
gaggcagtttgccatgccagga

SEQ ID NO: 8520747 - DNA, 22 bp, Homo sapiens
gaggcaggcagattgcttgagg

SEQ ID NO: 8520748 - DNA, 22 bp, Homo sapiens
gaggcaggcagattgcttgagg

SEQ ID NO: 8520749 - DNA, 22 bp, Homo sapiens
gaggcaggccctgaatgagtca

SEQ ID NO: 8520750 - DNA, 22 bp, Homo sapiens
gaggcaggcagattgcttgagg

SEQ ID NO: 8520751 - DNA, 22 bp, Homo sapiens
gaggcaggcagattgcttgagg

SEQ ID NO: 8520752 - DNA, 22 bp, Homo sapiens
gaggcaggaggattgcttgagc

SEQ ID NO: 8520753 - DNA, 22 bp, Homo sapiens
gaggcaggaggattgcttgagc

SEQ ID NO: 8520754 - DNA, 22 bp, Homo sapiens
gaggcaggaggattgcttgagc

SEQ ID NO: 8520755 - DNA, 22 bp, Homo sapiens
gaggcaggcactgttatcagca

SEQ ID NO: 8520756 - DNA, 22 bp, Homo sapiens
gaggcaggcactgttatcagca

SEQ ID NO: 8520757 - DNA, 22 bp, Homo sapiens
gaggcaggcactgttatcagca

SEQ ID NO: 8520758 - DNA, 22 bp, Homo sapiens
gaggcaggcactgttatcagca

SEQ ID NO: 8520759 - DNA, 22 bp, Homo sapiens
gaggcaggcactgttatcagca

SEQ ID NO: 8520760 - DNA, 22 bp, Homo sapiens
gaggcaggaggattgcttgagc

SEQ ID NO: 8520761 - DNA, 22 bp, Homo sapiens
gaggcagcttggggctgtgggt

SEQ ID NO: 8520762 - DNA, 22 bp, Homo sapiens
gaggcagcttagggtactgact

SEQ ID NO: 8520763 - DNA, 22 bp, Homo sapiens
gaggagccaggaggtctccctg

SEQ ID NO: 8520764 - DNA, 22 bp, Homo sapiens
gaggagaggccatcgttgttat

SEQ ID NO: 8520765 - DNA, 22 bp, Homo sapiens
gaggagagcctgcactttgacc

SEQ ID NO: 8520766 - DNA, 22 bp, Homo sapiens
gaggagaggctggacgcggtga

SEQ ID NO: 8520767 - DNA, 22 bp, Homo sapiens
gaggagaggggctcccaagagc

SEQ ID NO: 8520768 - DNA, 22 bp, Homo sapiens
gaggagcacatgaggctgaggg

SEQ ID NO: 8520769 - DNA, 22 bp, Homo sapiens
gaggagccaaggtatgtgtgtt

SEQ ID NO: 8520770 - DNA, 22 bp, Homo sapiens
gaggagcatgggaaggctctgg

SEQ ID NO: 8520771 - DNA, 22 bp, Homo sapiens
gaggagcatgggaaggctctgg

SEQ ID NO: 8520772 - DNA, 22 bp, Homo sapiens
gaggagaggggctcccaagagc

SEQ ID NO: 8520773 - DNA, 22 bp, Homo sapiens
gaggagcaagaaatagtgccca

SEQ ID NO: 8520774 - DNA, 22 bp, Homo sapiens
gaggagcaagaaatagtgccca

SEQ ID NO: 8520775 - DNA, 22 bp, Homo sapiens
gaggagcacatgaggctgaggg

SEQ ID NO: 8520776 - DNA, 22 bp, Homo sapiens
gaggctgaggttgcagtgagcc

SEQ ID NO: 8520777 - DNA, 22 bp, Homo sapiens
gaggctgaggttgcagtgagcc

SEQ ID NO: 8520778 - DNA, 22 bp, Homo sapiens
gaggctgaggttgcagtgagct

SEQ ID NO: 8520779 - DNA, 22 bp, Homo sapiens
gaggctgaggttgcagtgagct

SEQ ID NO: 8520780 - DNA, 22 bp, Homo sapiens
gaggctgaggttgcagtgagcc

SEQ ID NO: 8520781 - DNA, 22 bp, Homo sapiens
gaggctgaggcggatggatcac

SEQ ID NO: 8520782 - DNA, 22 bp, Homo sapiens
gaggctgagggttagagagtca

SEQ ID NO: 8520783 - DNA, 22 bp, Homo sapiens
gaggctgagggttagagagtca

SEQ ID NO: 8520784 - DNA, 22 bp, Homo sapiens
gaggctgaggcggatggatcac

SEQ ID NO: 8520785 - DNA, 22 bp, Homo sapiens
gaggctgaggcggatggatcac

SEQ ID NO: 8520786 - DNA, 22 bp, Homo sapiens
gaggctgaggcaggaggatcac

SEQ ID NO: 8520787 - DNA, 22 bp, Homo sapiens
gaggctgaggcaggaggatcac

SEQ ID NO: 8520788 - DNA, 22 bp, Homo sapiens
gaggctgaggttgcagtgagct

SEQ ID NO: 8520789 - DNA, 22 bp, Homo sapiens
gaggctgagtagctttgtgctc

SEQ ID NO: 8520790 - DNA, 22 bp, Homo sapiens
gaggctgatgctgcctcacaga

SEQ ID NO: 8520791 - DNA, 22 bp, Homo sapiens
gaggctgattcggggaacagca

SEQ ID NO: 8520792 - DNA, 22 bp, Homo sapiens
gaggctgattcggggaacagca

SEQ ID NO: 8520793 - DNA, 22 bp, Homo sapiens
gaggctgattcggggaacagca

SEQ ID NO: 8520794 - DNA, 22 bp, Homo sapiens
gaggctgcactggctaaaggct

SEQ ID NO: 8520795 - DNA, 22 bp, Homo sapiens
gaggctgcaggcaatgctgccc

SEQ ID NO: 8520796 - DNA, 22 bp, Homo sapiens
gaggctgcaggcaatgctgccc

SEQ ID NO: 8520797 - DNA, 22 bp, Homo sapiens
gagggagagtgatggaccattg

SEQ ID NO: 8520798 - DNA, 22 bp, Homo sapiens
gagggagaattgcagccagcgt

SEQ ID NO: 8520799 - DNA, 22 bp, Homo sapiens
gagggagaattgcagccagcgt

SEQ ID NO: 8520800 - DNA, 22 bp, Homo sapiens
gagggagagtgatggaccattg

SEQ ID NO: 8520801 - DNA, 22 bp, Homo sapiens
gagggagctggagcagacgccg

SEQ ID NO: 8520802 - DNA, 22 bp, Homo sapiens
gagggaggcatcatgaatccag

SEQ ID NO: 8520803 - DNA, 22 bp, Homo sapiens
gagggaggcatcatgaatccag

SEQ ID NO: 8520804 - DNA, 22 bp, Homo sapiens
gagggaggcatcatgaatccag

SEQ ID NO: 8520805 - DNA, 22 bp, Homo sapiens
gagggaggcatcatgaatccag

SEQ ID NO: 8520806 - DNA, 22 bp, Homo sapiens
gagggagggaaagtttaacact

SEQ ID NO: 8520807 - DNA, 22 bp, Homo sapiens
gagggagggactagcattctct

SEQ ID NO: 8520808 - DNA, 22 bp, Homo sapiens
gagggagggactagcattctct

SEQ ID NO: 8520809 - DNA, 22 bp, Homo sapiens
gagggagggactagcattctct

SEQ ID NO: 8520810 - DNA, 22 bp, Homo sapiens
gagggagggccaggtcccaacc

SEQ ID NO: 8520811 - DNA, 22 bp, Homo sapiens
gagggagggccaggtcccaacc

SEQ ID NO: 8520812 - DNA, 22 bp, Homo sapiens
gagggaggggagctccaccctc

SEQ ID NO: 8520813 - DNA, 22 bp, Homo sapiens
gagggagggccaggtcccaacc

SEQ ID NO: 8520814 - DNA, 22 bp, Homo sapiens
gagggaggggagctccaccctc

SEQ ID NO: 8520815 - DNA, 22 bp, Homo sapiens
gagggctgatgttgccacctca

SEQ ID NO: 8520816 - DNA, 22 bp, Homo sapiens
gagggctgcaatgagacagaga

SEQ ID NO: 8520817 - DNA, 22 bp, Homo sapiens
gagggctgcaatgagacagaga

SEQ ID NO: 8520818 - DNA, 22 bp, Homo sapiens
gagggctgcaatgagacagaga

SEQ ID NO: 8520819 - DNA, 22 bp, Homo sapiens
gagggctgctgccagatatgcc

SEQ ID NO: 8520820 - DNA, 22 bp, Homo sapiens
gagggctgctgccagatatgcc

SEQ ID NO: 8520821 - DNA, 22 bp, Homo sapiens
gagggctgccacgttgggcgag

SEQ ID NO: 8520822 - DNA, 22 bp, Homo sapiens
gaggggctctttaatagtaaca

SEQ ID NO: 8520823 - DNA, 22 bp, Homo sapiens
gaggggctctttaatagtaaca

SEQ ID NO: 8520824 - DNA, 22 bp, Homo sapiens
gaggggctctttaatagtaaca

SEQ ID NO: 8520825 - DNA, 22 bp, Homo sapiens
gaggggctgccctggtgtcagg

SEQ ID NO: 8520826 - DNA, 22 bp, Homo sapiens
gaggggctgccctggtgtcagg

SEQ ID NO: 8520827 - DNA, 22 bp, Homo sapiens
gaggggctgccctggtgtcagg

SEQ ID NO: 8520828 - DNA, 22 bp, Homo sapiens
gaggggctggcacgatggctgc

SEQ ID NO: 8520829 - DNA, 22 bp, Homo sapiens
gaggggctggcacgatggctgc

SEQ ID NO: 8520830 - DNA, 22 bp, Homo sapiens
gaggggctggcacgatggctgc

SEQ ID NO: 8520831 - DNA, 22 bp, Homo sapiens
gaggggctggcacgatggctgc

SEQ ID NO: 8520832 - DNA, 22 bp, Homo sapiens
gaggggctgggcagtccctgga

SEQ ID NO: 8520833 - DNA, 22 bp, Homo sapiens
gaggggctggctgtggtcccat

SEQ ID NO: 8520834 - DNA, 22 bp, Homo sapiens
gaggggctggctgtggtcccat

SEQ ID NO: 8520835 - DNA, 22 bp, Homo sapiens
gaggggctggctgtggtcccat

SEQ ID NO: 8520836 - DNA, 22 bp, Homo sapiens
gagggctgctggaaaaatgcag

SEQ ID NO: 8520837 - DNA, 22 bp, Homo sapiens
gagggctgctggaaaaatgcag

SEQ ID NO: 8520838 - DNA, 22 bp, Homo sapiens
gagggctgctggaaaaatgcag

SEQ ID NO: 8520839 - DNA, 22 bp, Homo sapiens
gagggctggggcttaggcttag

SEQ ID NO: 8520840 - DNA, 22 bp, Homo sapiens
gagggctgtggggcatgaccag

SEQ ID NO: 8520841 - DNA, 22 bp, Homo sapiens
gagggctgtggggcatgaccag

SEQ ID NO: 8520842 - DNA, 22 bp, Homo sapiens
gagggctgtgaaggagcgggtt

SEQ ID NO: 8520843 - DNA, 22 bp, Homo sapiens
gagccctgcggagccccgaggc

SEQ ID NO: 8520844 - DNA, 22 bp, Homo sapiens
gagccctgcgtgtctgggggca

SEQ ID NO: 8520845 - DNA, 22 bp, Homo sapiens
gagccctgcgtgtctgggggca

SEQ ID NO: 8520846 - DNA, 22 bp, Homo sapiens
gagccctgctgggccttgtctc

SEQ ID NO: 8520847 - DNA, 22 bp, Homo sapiens
gagccctgctgggccttgtctc

SEQ ID NO: 8520848 - DNA, 22 bp, Homo sapiens
gagccctgcttccaagggggca

SEQ ID NO: 8520849 - DNA, 22 bp, Homo sapiens
gagccctgcttccaagggggca

SEQ ID NO: 8520850 - DNA, 22 bp, Homo sapiens
gagccctggcagtctgggatgg

SEQ ID NO: 8520851 - DNA, 22 bp, Homo sapiens
gagccctgatttgcagcatttg

SEQ ID NO: 8520852 - DNA, 22 bp, Homo sapiens
gagccctgatttgcagcatttg

SEQ ID NO: 8520853 - DNA, 22 bp, Homo sapiens
gagccctgcccacttgtctgag

SEQ ID NO: 8520854 - DNA, 22 bp, Homo sapiens
gagccctgagagttgtgaggcc

SEQ ID NO: 8520855 - DNA, 18 bp, Homo sapiens
gagccctgagtctgcaca

SEQ ID NO: 8520856 - DNA, 18 bp, Homo sapiens
gagccctgagtctgcaca

SEQ ID NO: 8520857 - DNA, 18 bp, Homo sapiens
gagccctgagtctgcaca

SEQ ID NO: 8520858 - DNA, 22 bp, Homo sapiens
gagccctgtaggaatctctcaa

SEQ ID NO: 8520859 - DNA, 22 bp, Homo sapiens
gagccctgtgaggaaagagggt

SEQ ID NO: 8520860 - DNA, 22 bp, Homo sapiens
gagccctgtgattctgttgtgt

SEQ ID NO: 8520861 - DNA, 22 bp, Homo sapiens
gagctgagatcatgtacactag

SEQ ID NO: 8520862 - DNA, 22 bp, Homo sapiens
gagccctgtagcaagtcatgtc

SEQ ID NO: 8520863 - DNA, 22 bp, Homo sapiens
gagccctgtagcaagtcatgtc

SEQ ID NO: 8520864 - DNA, 22 bp, Homo sapiens
gagccctgtagcaagtcatgtc

SEQ ID NO: 8520865 - DNA, 22 bp, Homo sapiens
gagccctgtagcaagtcatgtc

SEQ ID NO: 8520866 - DNA, 22 bp, Homo sapiens
gagccctgtagcaagtcatgtc

SEQ ID NO: 8520867 - DNA, 22 bp, Homo sapiens
gagccctggcagtctgggatgg

SEQ ID NO: 8520868 - DNA, 22 bp, Homo sapiens
gagccctggcagtctgggatgg

SEQ ID NO: 8520869 - DNA, 22 bp, Homo sapiens
gagccctggcagtctgggatgg

SEQ ID NO: 8520870 - DNA, 18 bp, Homo sapiens
gagccctgggagatctct

SEQ ID NO: 8520871 - DNA, 22 bp, Homo sapiens
gagctgaggctcaggctggcgt

SEQ ID NO: 8520872 - DNA, 22 bp, Homo sapiens
gagctgaggctcaggctggcgt

SEQ ID NO: 8520873 - DNA, 22 bp, Homo sapiens
gagctgaggctgaggcctcact

SEQ ID NO: 8520874 - DNA, 22 bp, Homo sapiens
gagctgaggctcaggctggcgt

SEQ ID NO: 8520875 - DNA, 22 bp, Homo sapiens
gagctgaggccagagtcttctg

SEQ ID NO: 8520876 - DNA, 22 bp, Homo sapiens
gagctgaggatacatcagtgaa

SEQ ID NO: 8520877 - DNA, 22 bp, Homo sapiens
gagctgagcttaactccttgaa

SEQ ID NO: 8520878 - DNA, 22 bp, Homo sapiens
gagctgaggatacatcagtgaa

SEQ ID NO: 8520879 - DNA, 22 bp, Homo sapiens
gagctgagatttgaagcaagtt

SEQ ID NO: 8520880 - DNA, 22 bp, Homo sapiens
gagctgagatttgaagcaagtt

SEQ ID NO: 8520881 - DNA, 22 bp, Homo sapiens
gagctgagcctgggtggaccgc

SEQ ID NO: 8520882 - DNA, 22 bp, Homo sapiens
gagctgagcagggagcctcact

SEQ ID NO: 8520883 - DNA, 22 bp, Homo sapiens
gagctgcctacattgccaagag

SEQ ID NO: 8520884 - DNA, 22 bp, Homo sapiens
gagctgcctacattgccaagag

SEQ ID NO: 8520885 - DNA, 22 bp, Homo sapiens
gagctgcctgaacaagcagcag

SEQ ID NO: 8520886 - DNA, 22 bp, Homo sapiens
gagctgcctacattgccaagag

SEQ ID NO: 8520887 - DNA, 23 bp, Homo sapiens
gagctgagtgtagggagactagg

SEQ ID NO: 8520888 - DNA, 22 bp, Homo sapiens
gagctgagtctgcagtcgccat

SEQ ID NO: 8520889 - DNA, 22 bp, Homo sapiens
gagctgagtatcccactgaagt

SEQ ID NO: 8520890 - DNA, 22 bp, Homo sapiens
gagctgagtagaggctgctccc

SEQ ID NO: 8520891 - DNA, 22 bp, Homo sapiens
gagctgagtatcccactgaagt

SEQ ID NO: 8520892 - DNA, 22 bp, Homo sapiens
gagctgagtatcccactgaagt

SEQ ID NO: 8520893 - DNA, 22 bp, Homo sapiens
gagctgagggtctaggagggtt

SEQ ID NO: 8520894 - DNA, 22 bp, Homo sapiens
gagctgagggtctaggagggtt

SEQ ID NO: 8520895 - DNA, 22 bp, Homo sapiens
gagctgaggtgatgtggtcgtt

SEQ ID NO: 8520896 - DNA, 22 bp, Homo sapiens
gagctgctggatatgtggcctg

SEQ ID NO: 8520897 - DNA, 19 bp, Homo sapiens
gagctgccttttgaagacc

SEQ ID NO: 8520898 - DNA, 22 bp, Homo sapiens
gagctgcctgttgcatagcaac

SEQ ID NO: 8520899 - DNA, 22 bp, Homo sapiens
gagctgcctgtgtgccatgatg

SEQ ID NO: 8520900 - DNA, 22 bp, Homo sapiens
gagctgcctgtgtgccatgatg

SEQ ID NO: 8520901 - DNA, 22 bp, Homo sapiens
gagctgctggctcctcaggtta

SEQ ID NO: 8520902 - DNA, 22 bp, Homo sapiens
gagctgcttccagagttgagtg

SEQ ID NO: 8520903 - DNA, 22 bp, Homo sapiens
gaggaaaatgcaacaggaatgc

SEQ ID NO: 8520904 - DNA, 22 bp, Homo sapiens
gaggaaatcttaggccccaacc

SEQ ID NO: 8520905 - DNA, 22 bp, Homo sapiens
gaggaaagctggtttaaagtat

SEQ ID NO: 8520906 - DNA, 23 bp, Homo sapiens
gaggaaagaatatagatgcaatc

SEQ ID NO: 8520907 - DNA, 18 bp, Homo sapiens
gaggaaacaaggcagagg

SEQ ID NO: 8520908 - DNA, 22 bp, Homo sapiens
gaggaaacattgtagaagcagt

SEQ ID NO: 8520909 - DNA, 18 bp, Homo sapiens
gaggaaacaggctctgtg

SEQ ID NO: 8520910 - DNA, 22 bp, Homo sapiens
gaggaaagaaccccagtcaata

SEQ ID NO: 8520911 - DNA, 22 bp, Homo sapiens
gaggaaagaaccccagtcaata

SEQ ID NO: 8520912 - DNA, 22 bp, Homo sapiens
gaggaagaagggattagaactc

SEQ ID NO: 8520913 - DNA, 22 bp, Homo sapiens
gaggaagaagcaaaccagctaa

SEQ ID NO: 8520914 - DNA, 22 bp, Homo sapiens
gaggaagaaagcataggtgggg

SEQ ID NO: 8520915 - DNA, 22 bp, Homo sapiens
gaggagagagggactgtctgca

SEQ ID NO: 8520916 - DNA, 22 bp, Homo sapiens
gaggagagatggtagattgggt

SEQ ID NO: 8520917 - DNA, 22 bp, Homo sapiens
gaggaagaatcagggtggtgag

SEQ ID NO: 8520918 - DNA, 22 bp, Homo sapiens
gaggaaccactctgagaagcca

SEQ ID NO: 8520919 - DNA, 22 bp, Homo sapiens
gaggaacccagctggggttgcc

SEQ ID NO: 8520920 - DNA, 22 bp, Homo sapiens
gaggaagaaagcataggtgggg

SEQ ID NO: 8520921 - DNA, 22 bp, Homo sapiens
gaggaacttatgatattctact

SEQ ID NO: 8520922 - DNA, 22 bp, Homo sapiens
gaggaacagcagccacatgtcc

SEQ ID NO: 8520923 - DNA, 22 bp, Homo sapiens
gaggaacagcagccacatgtcc

SEQ ID NO: 8520924 - DNA, 22 bp, Homo sapiens
gaggaaccaatctgtgatattc

SEQ ID NO: 8520925 - DNA, 22 bp, Homo sapiens
gaggaaccaaatcagcttgcac

SEQ ID NO: 8520926 - DNA, 18 bp, Homo sapiens
gaggaacattcacctcct

SEQ ID NO: 8520927 - DNA, 22 bp, Homo sapiens
gaggaacagagacgggatcgct

SEQ ID NO: 8520928 - DNA, 22 bp, Homo sapiens
gaggaacagagggcaaggccag

SEQ ID NO: 8520929 - DNA, 22 bp, Homo sapiens
gagccatacaacctataaagtg

SEQ ID NO: 8520930 - DNA, 22 bp, Homo sapiens
gagccattgtccaagcctgttt

SEQ ID NO: 8520931 - DNA, 22 bp, Homo sapiens
gagccagtgatcagacagggag

SEQ ID NO: 8520932 - DNA, 22 bp, Homo sapiens
gagcatggttccataggttggt

SEQ ID NO: 8520933 - DNA, 22 bp, Homo sapiens
gagccaggtttgaatctcagtc

SEQ ID NO: 8520934 - DNA, 22 bp, Homo sapiens
gagccaggtttgaatctcagtc

SEQ ID NO: 8520935 - DNA, 22 bp, Homo sapiens
gagcccagctctacctcagact

SEQ ID NO: 8520936 - DNA, 22 bp, Homo sapiens
gagcccagctgcggccctcagc

SEQ ID NO: 8520937 - DNA, 22 bp, Homo sapiens
gagcccagctctacctcagact

SEQ ID NO: 8520938 - DNA, 22 bp, Homo sapiens
gagcccagcccagagccatatg

SEQ ID NO: 8520939 - DNA, 22 bp, Homo sapiens
gagcccaggaagtggaggctga

SEQ ID NO: 8520940 - DNA, 22 bp, Homo sapiens
gagcccaggaagtggaggctga

SEQ ID NO: 8520941 - DNA, 22 bp, Homo sapiens
gagcccaggagtttgatgctgc

SEQ ID NO: 8520942 - DNA, 22 bp, Homo sapiens
gagcccaggaagtggaggctga

SEQ ID NO: 8520943 - DNA, 22 bp, Homo sapiens
gagcccaggaagtggaggctga

SEQ ID NO: 8520944 - DNA, 22 bp, Homo sapiens
gagcccagcttgcacatggagc

SEQ ID NO: 8520945 - DNA, 22 bp, Homo sapiens
gagcccagcttgcacatggagc

SEQ ID NO: 8520946 - DNA, 22 bp, Homo sapiens
gagcccagcttgcacatggagc

SEQ ID NO: 8520947 - DNA, 22 bp, Homo sapiens
gagcccagctgtccttggcaaa

SEQ ID NO: 8520948 - DNA, 22 bp, Homo sapiens
gagcccagctgtccttggcaaa

SEQ ID NO: 8520949 - DNA, 22 bp, Homo sapiens
gagcccagggcaggcaaggcag

SEQ ID NO: 8520950 - DNA, 22 bp, Homo sapiens
gagcccaggctggggttcagag

SEQ ID NO: 8520951 - DNA, 22 bp, Homo sapiens
gagcccagggcaggcaaggcag

SEQ ID NO: 8520952 - DNA, 22 bp, Homo sapiens
gagcccagggtgaaatagcagc

SEQ ID NO: 8520953 - DNA, 22 bp, Homo sapiens
gagcccagggtgaaatagcagc

SEQ ID NO: 8520954 - DNA, 22 bp, Homo sapiens
gagcccaggatggtgtatggct

SEQ ID NO: 8520955 - DNA, 22 bp, Homo sapiens
gagcccaggcagaggttgcagt

SEQ ID NO: 8520956 - DNA, 22 bp, Homo sapiens
gagcccaggcagaggttgcagt

SEQ ID NO: 8520957 - DNA, 22 bp, Homo sapiens
gagcccaggcagaggttgcagt

SEQ ID NO: 8520958 - DNA, 22 bp, Homo sapiens
gagcccaggctggggttcagag

SEQ ID NO: 8520959 - DNA, 22 bp, Homo sapiens
gagccctgacactgagggagtt

SEQ ID NO: 8520960 - DNA, 22 bp, Homo sapiens
gagccctgagagttgtgaggcc

SEQ ID NO: 8520961 - DNA, 22 bp, Homo sapiens
gagccctgacactgagggagtt

SEQ ID NO: 8520962 - DNA, 22 bp, Homo sapiens
gagccctgacactgagggagtt

SEQ ID NO: 8520963 - DNA, 22 bp, Homo sapiens
gagccctgaacaacagcaggaa

SEQ ID NO: 8520964 - DNA, 22 bp, Homo sapiens
gagccctgaacaacagcaggaa

SEQ ID NO: 8520965 - DNA, 22 bp, Homo sapiens
gagccctgaacaacagcaggaa

SEQ ID NO: 8520966 - DNA, 22 bp, Homo sapiens
gagcccaggttctgcttccagc

SEQ ID NO: 8520967 - DNA, 22 bp, Homo sapiens
gagcccagtaggcaaagctgca

SEQ ID NO: 8520968 - DNA, 22 bp, Homo sapiens
gagcagtgactggagcatgaga

SEQ ID NO: 8520969 - DNA, 22 bp, Homo sapiens
gagcagtgagtgaatgttgcct

SEQ ID NO: 8520970 - DNA, 22 bp, Homo sapiens
gagcagtgggaaggaacagggt

SEQ ID NO: 8520971 - DNA, 22 bp, Homo sapiens
gagcagtgggaaggaacagggt

SEQ ID NO: 8520972 - DNA, 22 bp, Homo sapiens
gagcaggcttgcagagaagggg

SEQ ID NO: 8520973 - DNA, 22 bp, Homo sapiens
gagaggtaatttgaagtgcaaa

SEQ ID NO: 8520974 - DNA, 22 bp, Homo sapiens
gagaggggtttgccatcctatg

SEQ ID NO: 8520975 - DNA, 22 bp, Homo sapiens
gagaggggtttgccatcctatg

SEQ ID NO: 8520976 - DNA, 22 bp, Homo sapiens
gagaggggtttgccatcctatg

SEQ ID NO: 8520977 - DNA, 22 bp, Homo sapiens
gagagggtgcctggaagccagg

SEQ ID NO: 8520978 - DNA, 22 bp, Homo sapiens
gagagggtgcctggaagccagg

SEQ ID NO: 8520979 - DNA, 22 bp, Homo sapiens
gagagggtgcctggaagccagg

SEQ ID NO: 8520980 - DNA, 22 bp, Homo sapiens
gagagggtgcctggaagccagg

SEQ ID NO: 8520981 - DNA, 22 bp, Homo sapiens
gagaggggacctgtgtgtctag

SEQ ID NO: 8520982 - DNA, 22 bp, Homo sapiens
gagaggggacctgtgtgtctag

SEQ ID NO: 8520983 - DNA, 22 bp, Homo sapiens
gagaggggacctgtgtgtctag

SEQ ID NO: 8520984 - DNA, 22 bp, Homo sapiens
gagaggggcccaagccacatag

SEQ ID NO: 8520985 - DNA, 22 bp, Homo sapiens
gagagggctgcctggtgtgagg

SEQ ID NO: 8520986 - DNA, 22 bp, Homo sapiens
gagagggctgcctggtgtgagg

SEQ ID NO: 8520987 - DNA, 22 bp, Homo sapiens
gagagggctgcctggtgtgagg

SEQ ID NO: 8520988 - DNA, 22 bp, Homo sapiens
gagaggggcccaagccacatag

SEQ ID NO: 8520989 - DNA, 22 bp, Homo sapiens
gagaggggcgcgcagctcgcga

SEQ ID NO: 8520990 - DNA, 22 bp, Homo sapiens
gagaggggcgcgcagctcgcga

SEQ ID NO: 8520991 - DNA, 22 bp, Homo sapiens
gagcatctgatgagattggatt

SEQ ID NO: 8520992 - DNA, 20 bp, Homo sapiens
gagcatctgtctgctgtgca

SEQ ID NO: 8520993 - DNA, 22 bp, Homo sapiens
gagcatctggctagaggagtga

SEQ ID NO: 8520994 - DNA, 22 bp, Homo sapiens
gagcatgagggaaggcagcaga

SEQ ID NO: 8520995 - DNA, 22 bp, Homo sapiens
gagcatctgtggtccatcagaa

SEQ ID NO: 8520996 - DNA, 22 bp, Homo sapiens
gagcatcttgttcccaacttct

SEQ ID NO: 8520997 - DNA, 21 bp, Homo sapiens
gagcatggcttacatcagcag

SEQ ID NO: 8520998 - DNA, 22 bp, Homo sapiens
gagcagttttatttcatgagac

SEQ ID NO: 8520999 - DNA, 22 bp, Homo sapiens
gagcatctcctacctactcctt

SEQ ID NO: 8521000 - DNA, 22 bp, Homo sapiens
gagcatctatgtgctgggtact

SEQ ID NO: 8521001 - DNA, 21 bp, Homo sapiens
gagcatctccttcctcctgct

SEQ ID NO: 8521002 - DNA, 22 bp, Homo sapiens
gagcatctctatagtgactgtg

SEQ ID NO: 8521003 - DNA, 22 bp, Homo sapiens
gagcatcgctgagatcccagac

SEQ ID NO: 8521004 - DNA, 22 bp, Homo sapiens
gagcagtgggaaggaacagggt

SEQ ID NO: 8521005 - DNA, 22 bp, Homo sapiens
gagcagtgggaaggaacagggt

SEQ ID NO: 8521006 - DNA, 22 bp, Homo sapiens
gagcagtggtcacagggaggga

SEQ ID NO: 8521007 - DNA, 22 bp, Homo sapiens
gagcagtggttgaacagaggca

SEQ ID NO: 8521008 - DNA, 21 bp, Homo sapiens
ttctacaggatgaatgaaaac

SEQ ID NO: 8521009 - DNA, 22 bp, Homo sapiens
ttctacagactataactgtgat

SEQ ID NO: 8521010 - DNA, 22 bp, Homo sapiens
ttctacagaataaatgtttaca

SEQ ID NO: 8521011 - DNA, 22 bp, Homo sapiens
ttctacagaataaatgtttaca

SEQ ID NO: 8521012 - DNA, 22 bp, Homo sapiens
ttctacagactataactgtgat

SEQ ID NO: 8521013 - DNA, 22 bp, Homo sapiens
ttctacaggtactgaagtacat

SEQ ID NO: 8521014 - DNA, 22 bp, Homo sapiens
ttctacatatatttttctcact

SEQ ID NO: 8521015 - DNA, 22 bp, Homo sapiens
ttctacagtgactgcagccata

SEQ ID NO: 8521016 - DNA, 22 bp, Homo sapiens
ctaactttagcttagattatca

SEQ ID NO: 8521017 - DNA, 22 bp, Homo sapiens
ctaactgtcatgcacatgtgtt

SEQ ID NO: 8521018 - DNA, 22 bp, Homo sapiens
ctaactttatttgctaagtaga

SEQ ID NO: 8521019 - DNA, 21 bp, Homo sapiens
ctaactttgagtcctggcccc

SEQ ID NO: 8521020 - DNA, 22 bp, Homo sapiens
ttctacactcacccagctgtaa

SEQ ID NO: 8521021 - DNA, 22 bp, Homo sapiens
ttctacacttttcattagctag

SEQ ID NO: 8521022 - DNA, 22 bp, Homo sapiens
ttctacactgagttttttccct

SEQ ID NO: 8521023 - DNA, 22 bp, Homo sapiens
ctaaatgcctttcctacctaac

SEQ ID NO: 8521024 - DNA, 22 bp, Homo sapiens
ctaaatgccctacaatgactgg

SEQ ID NO: 8521025 - DNA, 22 bp, Homo sapiens
ctaactacaagcggggcatcct

SEQ ID NO: 8521026 - DNA, 22 bp, Homo sapiens
ctaacctgcatggcagctagaa

SEQ ID NO: 8521027 - DNA, 22 bp, Homo sapiens
ctaacctgttgaaggaattgct

SEQ ID NO: 8521028 - DNA, 20 bp, Homo sapiens
ctaaccttaaccatcaccag

SEQ ID NO: 8521029 - DNA, 22 bp, Homo sapiens
ctaacatttattgagcacttag

SEQ ID NO: 8521030 - DNA, 22 bp, Homo sapiens
ctaacatttattgagcacttag

SEQ ID NO: 8521031 - DNA, 22 bp, Homo sapiens
ctaacatttggaaggcttatga

SEQ ID NO: 8521032 - DNA, 22 bp, Homo sapiens
ctaaattatttgcacattagag

SEQ ID NO: 8521033 - DNA, 22 bp, Homo sapiens
ctaaattatcatgagaattatg

SEQ ID NO: 8521034 - DNA, 22 bp, Homo sapiens
ctacattaaattggcttactta

SEQ ID NO: 8521035 - DNA, 22 bp, Homo sapiens
ctacatgaactcttaagtcaca

SEQ ID NO: 8521036 - DNA, 22 bp, Homo sapiens
ctacattaaattggcttactta

SEQ ID NO: 8521037 - DNA, 22 bp, Homo sapiens
ctacatgaatgggtgtattact

SEQ ID NO: 8521038 - DNA, 22 bp, Homo sapiens
ctacatactgtgtgtaaagaat

SEQ ID NO: 8521039 - DNA, 22 bp, Homo sapiens
ctacataatctggatttgtctg

SEQ ID NO: 8521040 - DNA, 22 bp, Homo sapiens
ctacataaatatttatgtgtct

SEQ ID NO: 8521041 - DNA, 22 bp, Homo sapiens
ttctaccattgggaaaacagcc

SEQ ID NO: 8521042 - DNA, 22 bp, Homo sapiens
ttctaccagctactcactgata

SEQ ID NO: 8521043 - DNA, 22 bp, Homo sapiens
ttctaccagaccccagacttgt

SEQ ID NO: 8521044 - DNA, 22 bp, Homo sapiens
ttctacatttaaaaggaaaatc

SEQ ID NO: 8521045 - DNA, 22 bp, Homo sapiens
ctacagtgaagactagctatag

SEQ ID NO: 8521046 - DNA, 22 bp, Homo sapiens
ttctacatcacttaacatgcta

SEQ ID NO: 8521047 - DNA, 22 bp, Homo sapiens
ttctacatatatttttctcact

SEQ ID NO: 8521048 - DNA, 22 bp, Homo sapiens
ttctacatgagaaaatgtattt

SEQ ID NO: 8521049 - DNA, 22 bp, Homo sapiens
ttctacatgagaaaatgtattt

SEQ ID NO: 8521050 - DNA, 22 bp, Homo sapiens
ttctacatgagaaaatgtattt

SEQ ID NO: 8521051 - DNA, 22 bp, Homo sapiens
ttctacatggttgctcagaggg

SEQ ID NO: 8521052 - DNA, 22 bp, Homo sapiens
ttctacattgtgaagttcttta

SEQ ID NO: 8521053 - DNA, 22 bp, Homo sapiens
ttctacattcatgtattacctc

SEQ ID NO: 8521054 - DNA, 22 bp, Homo sapiens
ttctacattcatgtattacctc

SEQ ID NO: 8521055 - DNA, 22 bp, Homo sapiens
ttctcaggtgaggctgaggctg

SEQ ID NO: 8521056 - DNA, 22 bp, Homo sapiens
ttctcaggtgaggctgaggctg

SEQ ID NO: 8521057 - DNA, 22 bp, Homo sapiens
ttctcagtagttagcatttgtg

SEQ ID NO: 8521058 - DNA, 22 bp, Homo sapiens
ttctcagtttcactgataacag

SEQ ID NO: 8521059 - DNA, 22 bp, Homo sapiens
ttctcatagagacatgattata

SEQ ID NO: 8521060 - DNA, 22 bp, Homo sapiens
ttctcaaaactcagggtatctg

SEQ ID NO: 8521061 - DNA, 22 bp, Homo sapiens
ttctcaggtcaccagggtgcca

SEQ ID NO: 8521062 - DNA, 22 bp, Homo sapiens
ctacatttacacagttaggctt

SEQ ID NO: 8521063 - DNA, 22 bp, Homo sapiens
ttctcctggagtgcttgttggg

SEQ ID NO: 8521064 - DNA, 22 bp, Homo sapiens
ttctcctggagtgcttgttggg

SEQ ID NO: 8521065 - DNA, 22 bp, Homo sapiens
ttctcctgcgcaggcccaggga

SEQ ID NO: 8521066 - DNA, 22 bp, Homo sapiens
ttctcctgcccttggacttcca

SEQ ID NO: 8521067 - DNA, 22 bp, Homo sapiens
ttctcattctgactcagtgtag

SEQ ID NO: 8521068 - DNA, 22 bp, Homo sapiens
ttctcattctgactcagtgtag

SEQ ID NO: 8521069 - DNA, 22 bp, Homo sapiens
ttctcctgcccttggacttcca

SEQ ID NO: 8521070 - DNA, 22 bp, Homo sapiens
ttctcatgaaactcgcttcctc

SEQ ID NO: 8521071 - DNA, 22 bp, Homo sapiens
ttctcatgtaaatgccatcatc

SEQ ID NO: 8521072 - DNA, 22 bp, Homo sapiens
ttctcatgatgcaattcatccc

SEQ ID NO: 8521073 - DNA, 22 bp, Homo sapiens
ttctcatgaaactcgcttcctc

SEQ ID NO: 8521074 - DNA, 22 bp, Homo sapiens
ttctcatgaaactcgcttcctc

SEQ ID NO: 8521075 - DNA, 22 bp, Homo sapiens
ctagttgaagaggctgtcatca

SEQ ID NO: 8521076 - DNA, 22 bp, Homo sapiens
ctagttctagatccctgaggaa

SEQ ID NO: 8521077 - DNA, 22 bp, Homo sapiens
ctagtttaaagcagctgaaagg

SEQ ID NO: 8521078 - DNA, 22 bp, Homo sapiens
ctagttgtttaatattgattga

SEQ ID NO: 8521079 - DNA, 22 bp, Homo sapiens
ctagttagttctgggtcatcct

SEQ ID NO: 8521080 - DNA, 22 bp, Homo sapiens
ctagtgtgtctatgtctgttcc

SEQ ID NO: 8521081 - DNA, 22 bp, Homo sapiens
ctagtgtttattaatcatgagg

SEQ ID NO: 8521082 - DNA, 22 bp, Homo sapiens
ctagtgaacgtggtactatgga

SEQ ID NO: 8521083 - DNA, 22 bp, Homo sapiens
ttctccttattcatagttgtct

SEQ ID NO: 8521084 - DNA, 22 bp, Homo sapiens
ttctccttgaaaagctgcatct

SEQ ID NO: 8521085 - DNA, 22 bp, Homo sapiens
ttctccttgaaaagctgcatct

SEQ ID NO: 8521086 - DNA, 22 bp, Homo sapiens
ttctccttcctggttttcaggc

SEQ ID NO: 8521087 - DNA, 19 bp, Homo sapiens
ctagggcttggcagcaggc

SEQ ID NO: 8521088 - DNA, 22 bp, Homo sapiens
ttctccttggtttatgggacat

SEQ ID NO: 8521089 - DNA, 22 bp, Homo sapiens
ttccactctgtcccctgtggga

SEQ ID NO: 8521090 - DNA, 22 bp, Homo sapiens
ttccactcttctctggacttat

SEQ ID NO: 8521091 - DNA, 22 bp, Homo sapiens
ttccactgaaggatctagggaa

SEQ ID NO: 8521092 - DNA, 22 bp, Homo sapiens
ttccactggctttcagtgatct

SEQ ID NO: 8521093 - DNA, 22 bp, Homo sapiens
ttccactctatgatagaagggt

SEQ ID NO: 8521094 - DNA, 22 bp, Homo sapiens
ttccactctccagtcaatttca

SEQ ID NO: 8521095 - DNA, 22 bp, Homo sapiens
ttccagaaaacgctttatttag

SEQ ID NO: 8521096 - DNA, 22 bp, Homo sapiens
ttccagaaagttctggaactgg

SEQ ID NO: 8521097 - DNA, 22 bp, Homo sapiens
ttccagaaatctttcagctcaa

SEQ ID NO: 8521098 - DNA, 22 bp, Homo sapiens
ttccagaaatctttcagctcaa

SEQ ID NO: 8521099 - DNA, 22 bp, Homo sapiens
ttccagaaatctttcagctcaa

SEQ ID NO: 8521100 - DNA, 22 bp, Homo sapiens
cgtcccagttccagccgcgctg

SEQ ID NO: 8521101 - DNA, 22 bp, Homo sapiens
cgtccatattcctgagggctca

SEQ ID NO: 8521102 - DNA, 22 bp, Homo sapiens
cgtccatattcatgagctgagt

SEQ ID NO: 8521103 - DNA, 20 bp, Homo sapiens
cgtccccttgagcaggtccc

SEQ ID NO: 8521104 - DNA, 22 bp, Homo sapiens
cgtcccctcgttcccactttgg

SEQ ID NO: 8521105 - DNA, 22 bp, Homo sapiens
cgtcctgggtctgggaaggcat

SEQ ID NO: 8521106 - DNA, 22 bp, Homo sapiens
cgtccctacctggcagctgcgc

SEQ ID NO: 8521107 - DNA, 22 bp, Homo sapiens
cgtcccgggttcacgccattct

SEQ ID NO: 8521108 - DNA, 22 bp, Homo sapiens
cgtcccgggttcacgccattct

SEQ ID NO: 8521109 - DNA, 22 bp, Homo sapiens
cgtcccgggttcacgccattct

SEQ ID NO: 8521110 - DNA, 22 bp, Homo sapiens
ttcctctattctaacaaaagta

SEQ ID NO: 8521111 - DNA, 22 bp, Homo sapiens
ttcctctcctcccaccaggtga

SEQ ID NO: 8521112 - DNA, 17 bp, Homo sapiens
ttcctctcacatttttt

SEQ ID NO: 8521113 - DNA, 21 bp, Homo sapiens
ttcctctgcaactgatgctca

SEQ ID NO: 8521114 - DNA, 22 bp, Homo sapiens
ctaaatgatggatttaaacttt

SEQ ID NO: 8521115 - DNA, 22 bp, Homo sapiens
ttcctctctcttgccagaatgt

SEQ ID NO: 8521116 - DNA, 22 bp, Homo sapiens
ttcctctcctcccaccaggtga

SEQ ID NO: 8521117 - DNA, 17 bp, Homo sapiens
ttcctcctcaccatgtt

SEQ ID NO: 8521118 - DNA, 22 bp, Homo sapiens
ttcctcctacgcttatcacttt

SEQ ID NO: 8521119 - DNA, 17 bp, Homo sapiens
ttcctcctcaccatgtt

SEQ ID NO: 8521120 - DNA, 22 bp, Homo sapiens
cgtgaaatgagttgaattattg

SEQ ID NO: 8521121 - DNA, 22 bp, Homo sapiens
ttcctaacaaacttcagtgaat

SEQ ID NO: 8521122 - DNA, 22 bp, Homo sapiens
ttcctaacaaacttcagtgaat

SEQ ID NO: 8521123 - DNA, 22 bp, Homo sapiens
ttcctccagcctggagcacttc

SEQ ID NO: 8521124 - DNA, 22 bp, Homo sapiens
ttcagggccctgagagggcagt

SEQ ID NO: 8521125 - DNA, 22 bp, Homo sapiens
ttcagtttcaaatcctgtgaag

SEQ ID NO: 8521126 - DNA, 22 bp, Homo sapiens
ttcagggcttagggaaatagtg

SEQ ID NO: 8521127 - DNA, 22 bp, Homo sapiens
ttcagggcgttgtggctgactg

SEQ ID NO: 8521128 - DNA, 20 bp, Homo sapiens
cgcagcagtggaagtggaat

SEQ ID NO: 8521129 - DNA, 22 bp, Homo sapiens
cgcagcagccccgtggtaggtg

SEQ ID NO: 8521130 - DNA, 22 bp, Homo sapiens
cgcagcagccccgtggtaggtg

SEQ ID NO: 8521131 - DNA, 22 bp, Homo sapiens
ttcagtttctaaatgctcctct

SEQ ID NO: 8521132 - DNA, 18 bp, Homo sapiens
ttcagtttctagttcctt

SEQ ID NO: 8521133 - DNA, 22 bp, Homo sapiens
ttcagtttcttccctgtgaaat

SEQ ID NO: 8521134 - DNA, 22 bp, Homo sapiens
ttcagtttcttccctgtgaaat

SEQ ID NO: 8521135 - DNA, 22 bp, Homo sapiens
ttcagtttcttccctgtgaaat

SEQ ID NO: 8521136 - DNA, 22 bp, Homo sapiens
ttcagtttgaattctgtagaac

SEQ ID NO: 8521137 - DNA, 22 bp, Homo sapiens
ttcagtttgaattctgtagaac

SEQ ID NO: 8521138 - DNA, 21 bp, Homo sapiens
ttcagtttcttcctcatctat

SEQ ID NO: 8521139 - DNA, 22 bp, Homo sapiens
ttcagtttcgttatctatgaga

SEQ ID NO: 8521140 - DNA, 22 bp, Homo sapiens
ttcagtttcgttatctatgaga

SEQ ID NO: 8521141 - DNA, 22 bp, Homo sapiens
ttcagtttctaaagatgttcct

SEQ ID NO: 8521142 - DNA, 22 bp, Homo sapiens
ttcagtttcgttatctatgaga

SEQ ID NO: 8521143 - DNA, 22 bp, Homo sapiens
cggctgtgtcttcacaggagcc

SEQ ID NO: 8521144 - DNA, 22 bp, Homo sapiens
cggctggtgtcgggcacagcaa

SEQ ID NO: 8521145 - DNA, 22 bp, Homo sapiens
cggctggtgtcgggcacagcaa

SEQ ID NO: 8521146 - DNA, 22 bp, Homo sapiens
cggctggtgtcgggcacagcaa

SEQ ID NO: 8521147 - DNA, 22 bp, Homo sapiens
cggctgggttcggctgcaggcc

SEQ ID NO: 8521148 - DNA, 22 bp, Homo sapiens
cggctgggttcggctgcaggcc

SEQ ID NO: 8521149 - DNA, 22 bp, Homo sapiens
cggctggtgtcgggcacagcaa

SEQ ID NO: 8521150 - DNA, 22 bp, Homo sapiens
cggctggtgtcgggcacagcaa

SEQ ID NO: 8521151 - DNA, 22 bp, Homo sapiens
ttccaccattcatgctaatatt

SEQ ID NO: 8521152 - DNA, 22 bp, Homo sapiens
ttccactcatgcaaaggtccca

SEQ ID NO: 8521153 - DNA, 22 bp, Homo sapiens
ttccactctactctggccagtc

SEQ ID NO: 8521154 - DNA, 22 bp, Homo sapiens
ttccactcctcctggtggggtg

SEQ ID NO: 8521155 - DNA, 22 bp, Homo sapiens
ttccactctacacactgctggc

SEQ ID NO: 8521156 - DNA, 22 bp, Homo sapiens
ttccacattccttacattcata

SEQ ID NO: 8521157 - DNA, 22 bp, Homo sapiens
ttccaaattaaaatgtacaatg

SEQ ID NO: 8521158 - DNA, 22 bp, Homo sapiens
cgggagcacgggaggcggagct

SEQ ID NO: 8521159 - DNA, 22 bp, Homo sapiens
ctcaggagtagttcagcagctg

SEQ ID NO: 8521160 - DNA, 22 bp, Homo sapiens
ctcaggccaataagctccagcc

SEQ ID NO: 8521161 - DNA, 22 bp, Homo sapiens
ctcaggccaataagctccagcc

SEQ ID NO: 8521162 - DNA, 22 bp, Homo sapiens
ctcaggccaggtttctcccaca

SEQ ID NO: 8521163 - DNA, 22 bp, Homo sapiens
ctcaggccattcctaccaaggg

SEQ ID NO: 8521164 - DNA, 22 bp, Homo sapiens
ctcaggcccacagcagacccac

SEQ ID NO: 8521165 - DNA, 22 bp, Homo sapiens
ctcaggcccacagcagacccac

SEQ ID NO: 8521166 - DNA, 22 bp, Homo sapiens
ctcaggccattcttccagctgc

SEQ ID NO: 8521167 - DNA, 22 bp, Homo sapiens
ctcaggagtagttcagcagctg

SEQ ID NO: 8521168 - DNA, 22 bp, Homo sapiens
ctcagccccaattctccccatt

SEQ ID NO: 8521169 - DNA, 22 bp, Homo sapiens
ctcagcccagctcaggtctttc

SEQ ID NO: 8521170 - DNA, 22 bp, Homo sapiens
ctcagcccagctcaggtctttc

SEQ ID NO: 8521171 - DNA, 22 bp, Homo sapiens
ctcagcccagcccaggaccagg

SEQ ID NO: 8521172 - DNA, 22 bp, Homo sapiens
ctcagccatgtcatgcctacct

SEQ ID NO: 8521173 - DNA, 22 bp, Homo sapiens
ctcagcccagcccaggaccagg

SEQ ID NO: 8521174 - DNA, 22 bp, Homo sapiens
ctcagccatgtcatgcctacct

SEQ ID NO: 8521175 - DNA, 22 bp, Homo sapiens
ctcagcatcatggtatctgggg

SEQ ID NO: 8521176 - DNA, 22 bp, Homo sapiens
ctcagcatggagggagaacaag

SEQ ID NO: 8521177 - DNA, 22 bp, Homo sapiens
ctcagccagacatgacccagtc

SEQ ID NO: 8521178 - DNA, 22 bp, Homo sapiens
ctcagcattcaatgtccagtcc

SEQ ID NO: 8521179 - DNA, 22 bp, Homo sapiens
ctcagccatgcaacatgctggg

SEQ ID NO: 8521180 - DNA, 22 bp, Homo sapiens
ctcagccagtgatctttccttt

SEQ ID NO: 8521181 - DNA, 22 bp, Homo sapiens
ctcagccagtgatctttccttt

SEQ ID NO: 8521182 - DNA, 22 bp, Homo sapiens
ttgcaaaaactgcaattacttt

SEQ ID NO: 8521183 - DNA, 22 bp, Homo sapiens
ttgcaaaaaccacaattacttt

SEQ ID NO: 8521184 - DNA, 22 bp, Homo sapiens
ttgatttttttctactatgcgc

SEQ ID NO: 8521185 - DNA, 22 bp, Homo sapiens
ttgatttttttctactatgcgc

SEQ ID NO: 8521186 - DNA, 22 bp, Homo sapiens
ctcagaaacggagctgccattt

SEQ ID NO: 8521187 - DNA, 22 bp, Homo sapiens
ctcagaaagcaatctggtgagg

SEQ ID NO: 8521188 - DNA, 22 bp, Homo sapiens
ctcagaaacggagctgccattt

SEQ ID NO: 8521189 - DNA, 22 bp, Homo sapiens
ttgatttttccagcttctagag

SEQ ID NO: 8521190 - DNA, 22 bp, Homo sapiens
ttgatcaaatcagctactgagg

SEQ ID NO: 8521191 - DNA, 22 bp, Homo sapiens
ctcagcagtgacaagagagtat

SEQ ID NO: 8521192 - DNA, 23 bp, Homo sapiens
ttgcaaaatgagtcttgagtgaa

SEQ ID NO: 8521193 - DNA, 23 bp, Homo sapiens
ttgcaaaatgcaattgagttaga

SEQ ID NO: 8521194 - DNA, 23 bp, Homo sapiens
ttgcaaaatgagtcttgagtgaa

SEQ ID NO: 8521195 - DNA, 22 bp, Homo sapiens
ttgcaaaaccatcctaagtaaa

SEQ ID NO: 8521196 - DNA, 22 bp, Homo sapiens
ttgcaaaaccatcctaagtaaa

SEQ ID NO: 8521197 - DNA, 22 bp, Homo sapiens
ttgcaaaagccgaggcactcca

SEQ ID NO: 8521198 - DNA, 22 bp, Homo sapiens
ttgcaaaagcaattgcagtttt

SEQ ID NO: 8521199 - DNA, 22 bp, Homo sapiens
ttgctgctttcatttatacagt

SEQ ID NO: 8521200 - DNA, 22 bp, Homo sapiens
ttgctggcttgaagatagagga

SEQ ID NO: 8521201 - DNA, 22 bp, Homo sapiens
ctcaggctaagaaggccaagtg

SEQ ID NO: 8521202 - DNA, 22 bp, Homo sapiens
ctcaggctaagaaggccaagtg

SEQ ID NO: 8521203 - DNA, 22 bp, Homo sapiens
ctcaggctaagaaggccaagtg

SEQ ID NO: 8521204 - DNA, 23 bp, Homo sapiens
ttgctgcctgagccttcctctgg

SEQ ID NO: 8521205 - DNA, 23 bp, Homo sapiens
ttgctgcctgagccttcctctgg

SEQ ID NO: 8521206 - DNA, 22 bp, Homo sapiens
ttgctgccttccgaatcctctc

SEQ ID NO: 8521207 - DNA, 22 bp, Homo sapiens
ttgctgccttccgaatcctctc

SEQ ID NO: 8521208 - DNA, 22 bp, Homo sapiens
ttgctgcctgaggagcaacact

SEQ ID NO: 8521209 - DNA, 22 bp, Homo sapiens
ttgctgcctgaggagcaacact

SEQ ID NO: 8521210 - DNA, 22 bp, Homo sapiens
ttgctgccttgtctcagggtct

SEQ ID NO: 8521211 - DNA, 22 bp, Homo sapiens
ttgctgccagcgccctgcaggg

SEQ ID NO: 8521212 - DNA, 22 bp, Homo sapiens
ttgctgccagcgccctgcaggg

SEQ ID NO: 8521213 - DNA, 21 bp, Homo sapiens
ttgctgccctccctttcctca

SEQ ID NO: 8521214 - DNA, 21 bp, Homo sapiens
ttgctgccctccctttcctca

SEQ ID NO: 8521215 - DNA, 22 bp, Homo sapiens
ttgctgagctttggcaaggaag

SEQ ID NO: 8521216 - DNA, 20 bp, Homo sapiens
ttgcacagagaaggaggcag

SEQ ID NO: 8521217 - DNA, 22 bp, Homo sapiens
ttgcacagatgagggtgatgct

SEQ ID NO: 8521218 - DNA, 22 bp, Homo sapiens
ttgcacagatgcacatggttgc

SEQ ID NO: 8521219 - DNA, 23 bp, Homo sapiens
ttgcacagtgtatacacatattt

SEQ ID NO: 8521220 - DNA, 22 bp, Homo sapiens
ttgcacagtttgaagatgactc

SEQ ID NO: 8521221 - DNA, 22 bp, Homo sapiens
ttgcactccagcccgagcaaca

SEQ ID NO: 8521222 - DNA, 22 bp, Homo sapiens
ttgcactccagcccgagcaaca

SEQ ID NO: 8521223 - DNA, 23 bp, Homo sapiens
ttgcactgatcaatttgataagc

SEQ ID NO: 8521224 - DNA, 22 bp, Homo sapiens
ttgcctattgttcttacatgtt

SEQ ID NO: 8521225 - DNA, 22 bp, Homo sapiens
ttgcctagagttgcacatctgg

SEQ ID NO: 8521226 - DNA, 22 bp, Homo sapiens
ttgcccttgtggagtttacatg

SEQ ID NO: 8521227 - DNA, 22 bp, Homo sapiens
ttgccgtccttactccagcgga

SEQ ID NO: 8521228 - DNA, 22 bp, Homo sapiens
ttctgtctccctgatgtagagc

SEQ ID NO: 8521229 - DNA, 22 bp, Homo sapiens
ttctgtctccctgatgtagagc

SEQ ID NO: 8521230 - DNA, 22 bp, Homo sapiens
ttctgtctccctgatgtagagc

SEQ ID NO: 8521231 - DNA, 22 bp, Homo sapiens
ttctgtctctgtgtttacatta

SEQ ID NO: 8521232 - DNA, 22 bp, Homo sapiens
ttcttaaaattcaagctaggtt

SEQ ID NO: 8521233 - DNA, 20 bp, Homo sapiens
ttcttaaagacctcactttg

SEQ ID NO: 8521234 - DNA, 22 bp, Homo sapiens
ttctgaaattcgactatccaat

SEQ ID NO: 8521235 - DNA, 22 bp, Homo sapiens
ttctgaaatttcaactttacta

SEQ ID NO: 8521236 - DNA, 22 bp, Homo sapiens
ttctgaaatttctgtagatctt

SEQ ID NO: 8521237 - DNA, 22 bp, Homo sapiens
ttctgaaaggcaggttgtttgc

SEQ ID NO: 8521238 - DNA, 22 bp, Homo sapiens
ttctgaaaggcatgtcaggtag

SEQ ID NO: 8521239 - DNA, 22 bp, Homo sapiens
ttctgaaagccaattcattgaa

SEQ ID NO: 8521240 - DNA, 22 bp, Homo sapiens
ttctgaaaggcaggttgtttgc

SEQ ID NO: 8521241 - DNA, 22 bp, Homo sapiens
ttctgaaagtctttttaagtta

SEQ ID NO: 8521242 - DNA, 22 bp, Homo sapiens
ttctgaaataggagatagctgt

SEQ ID NO: 8521243 - DNA, 22 bp, Homo sapiens
ttctgaaataggagatagctgt

SEQ ID NO: 8521244 - DNA, 22 bp, Homo sapiens
ttctgaaattcgactatccaat

SEQ ID NO: 8521245 - DNA, 22 bp, Homo sapiens
ttctgaaatgagatataaggta

SEQ ID NO: 8521246 - DNA, 22 bp, Homo sapiens
ttctgaaaacacactttgcagc

SEQ ID NO: 8521247 - DNA, 22 bp, Homo sapiens
ttctgaaaacacactttgcagc

SEQ ID NO: 8521248 - DNA, 22 bp, Homo sapiens
ttctctttttgcatctcaacct

SEQ ID NO: 8521249 - DNA, 22 bp, Homo sapiens
ctataaatctacccagcattgg

SEQ ID NO: 8521250 - DNA, 22 bp, Homo sapiens
ttctcttttgtgatgtgagatg

SEQ ID NO: 8521251 - DNA, 22 bp, Homo sapiens
ttctgaaaattgggtcatactt

SEQ ID NO: 8521252 - DNA, 23 bp, Homo sapiens
ttctgaaaatagatagtggctcc

SEQ ID NO: 8521253 - DNA, 22 bp, Homo sapiens
ttctgaaaattgggtcatactt

SEQ ID NO: 8521254 - DNA, 22 bp, Homo sapiens
ttctgaaaattgggtcatactt

SEQ ID NO: 8521255 - DNA, 22 bp, Homo sapiens
ttctgaaaccactgaccaacta

SEQ ID NO: 8521256 - DNA, 22 bp, Homo sapiens
ttctgaaaccttcagtatgaag

SEQ ID NO: 8521257 - DNA, 20 bp, Homo sapiens
ttctgaaagcagcagaggga

SEQ ID NO: 8521258 - DNA, 20 bp, Homo sapiens
ttctgaaagcagcagaggga

SEQ ID NO: 8521259 - DNA, 20 bp, Homo sapiens
ttctgaaagcagcagaggga

SEQ ID NO: 8521260 - DNA, 22 bp, Homo sapiens
ttctgaaaccactgaccaacta

SEQ ID NO: 8521261 - DNA, 22 bp, Homo sapiens
ttcttaaagaggcaaaacacag

SEQ ID NO: 8521262 - DNA, 22 bp, Homo sapiens
ttcttaaagaggcaaaacacag

SEQ ID NO: 8521263 - DNA, 22 bp, Homo sapiens
ttcttaaagaggcaaaacacag

SEQ ID NO: 8521264 - DNA, 22 bp, Homo sapiens
ttcttaactcaaatatatatcc

SEQ ID NO: 8521265 - DNA, 22 bp, Homo sapiens
ttcttaactcaaatatatatcc

SEQ ID NO: 8521266 - DNA, 20 bp, Homo sapiens
ttcttaaagacctcactttg

SEQ ID NO: 8521267 - DNA, 22 bp, Homo sapiens
ttcttaaagaggcaaaacacag

SEQ ID NO: 8521268 - DNA, 20 bp, Homo sapiens
ttcttaaagacctcactttg

SEQ ID NO: 8521269 - DNA, 22 bp, Homo sapiens
ttcttaactggaaaatgtcaga

SEQ ID NO: 8521270 - DNA, 19 bp, Homo sapiens
ttcttacaacaccctggga

SEQ ID NO: 8521271 - DNA, 19 bp, Homo sapiens
ttcttacaacaccctggga

SEQ ID NO: 8521272 - DNA, 23 bp, Homo sapiens
ttcttacaaggctggcccacttg

SEQ ID NO: 8521273 - DNA, 23 bp, Homo sapiens
ttcttacaaggctggcccacttg

SEQ ID NO: 8521274 - DNA, 22 bp, Homo sapiens
ttcttacaaacaagatcattga

SEQ ID NO: 8521275 - DNA, 22 bp, Homo sapiens
ttcttaatcccacaaatcttca

SEQ ID NO: 8521276 - DNA, 22 bp, Homo sapiens
ttcttaatcccacaaatcttca

SEQ ID NO: 8521277 - DNA, 22 bp, Homo sapiens
ttcttaatctgtgtgggttcga

SEQ ID NO: 8521278 - DNA, 22 bp, Homo sapiens
ttcttaatctgtgtgggttcga

SEQ ID NO: 8521279 - DNA, 22 bp, Homo sapiens
ttcttaatacctattttctacc

SEQ ID NO: 8521280 - DNA, 22 bp, Homo sapiens
ttcttaagtttagcaacttgtg

SEQ ID NO: 8521281 - DNA, 22 bp, Homo sapiens
ttcttacaagtatgacgtagca

SEQ ID NO: 8521282 - DNA, 22 bp, Homo sapiens
ttcttcagggaagcttgttaat

SEQ ID NO: 8521283 - DNA, 22 bp, Homo sapiens
ttcttcatgggttcttttagga

SEQ ID NO: 8521284 - DNA, 22 bp, Homo sapiens
ttcttcatgctgttgctgcttg

SEQ ID NO: 8521285 - DNA, 22 bp, Homo sapiens
ttcttcccttcattccaccacc

SEQ ID NO: 8521286 - DNA, 22 bp, Homo sapiens
ttcttcattcccttacttccga

SEQ ID NO: 8521287 - DNA, 22 bp, Homo sapiens
ttcttcattcccttacttccga

SEQ ID NO: 8521288 - DNA, 21 bp, Homo sapiens
ttcttcatgatgattaatggc

SEQ ID NO: 8521289 - DNA, 21 bp, Homo sapiens
ttcttcatgatgattaatggc

SEQ ID NO: 8521290 - DNA, 21 bp, Homo sapiens
ttcttcatgatgattaatggc

SEQ ID NO: 8521291 - DNA, 22 bp, Homo sapiens
ttcttcagtgtagcaactgtat

SEQ ID NO: 8521292 - DNA, 21 bp, Homo sapiens
ttgaaggatcacttctgtacc

SEQ ID NO: 8521293 - DNA, 22 bp, Homo sapiens
ttgaaatatcaagttattagtg

SEQ ID NO: 8521294 - DNA, 22 bp, Homo sapiens
ttgaagttgcacattataattt

SEQ ID NO: 8521295 - DNA, 23 bp, Homo sapiens
ttgaagtctcagttttctcatag

SEQ ID NO: 8521296 - DNA, 22 bp, Homo sapiens
ttgaagtccttgcctcttgcac

SEQ ID NO: 8521297 - DNA, 22 bp, Homo sapiens
ttgaataatgtgtatgttgtta

SEQ ID NO: 8521298 - DNA, 22 bp, Homo sapiens
ttgaataaatgagcagtgaatt

SEQ ID NO: 8521299 - DNA, 22 bp, Homo sapiens
ttgaataatatgttcaggagga

SEQ ID NO: 8521300 - DNA, 22 bp, Homo sapiens
ttgaagtttaatggtagattcc

SEQ ID NO: 8521301 - DNA, 22 bp, Homo sapiens
ttgaagttggtgtggaaagtag

SEQ ID NO: 8521302 - DNA, 22 bp, Homo sapiens
ttgaatgaaattgctgtgttat

SEQ ID NO: 8521303 - DNA, 22 bp, Homo sapiens
ttgaatgaagggatgaccgaag

SEQ ID NO: 8521304 - DNA, 22 bp, Homo sapiens
ttgaatgaagtccctttttact

SEQ ID NO: 8521305 - DNA, 22 bp, Homo sapiens
ttgaatcttagctctgccactt

SEQ ID NO: 8521306 - DNA, 22 bp, Homo sapiens
ttgaatcttagctctgccactt

SEQ ID NO: 8521307 - DNA, 22 bp, Homo sapiens
ttgaatctcttgaatctctgtt

SEQ ID NO: 8521308 - DNA, 22 bp, Homo sapiens
ttgaatctcttgaatctctgtt

SEQ ID NO: 8521309 - DNA, 22 bp, Homo sapiens
ttgaatctcatcccaatgttgt

SEQ ID NO: 8521310 - DNA, 22 bp, Homo sapiens
ttgaatctataatttcagtatt

SEQ ID NO: 8521311 - DNA, 22 bp, Homo sapiens
ttgaatcattacaatagataag

SEQ ID NO: 8521312 - DNA, 19 bp, Homo sapiens
ttgaatatgcaaactgaag

SEQ ID NO: 8521313 - DNA, 22 bp, Homo sapiens
ctcactgtccaacaggctttac

SEQ ID NO: 8521314 - DNA, 22 bp, Homo sapiens
ctcactgtctgtactagctgat

SEQ ID NO: 8521315 - DNA, 22 bp, Homo sapiens
ctcactgtctgtactagctgat

SEQ ID NO: 8521316 - DNA, 22 bp, Homo sapiens
ctcactgtgacctcagcagaca

SEQ ID NO: 8521317 - DNA, 22 bp, Homo sapiens
ctcactgtttaatagctggatc

SEQ ID NO: 8521318 - DNA, 22 bp, Homo sapiens
ctcactgtctgtactagctgat

SEQ ID NO: 8521319 - DNA, 22 bp, Homo sapiens
ctcactgtgccttttcccaaac

SEQ ID NO: 8521320 - DNA, 22 bp, Homo sapiens
ctcagaaacggagctgccattt

SEQ ID NO: 8521321 - DNA, 20 bp, Homo sapiens
ctcagaaaagctaaggagaa

SEQ ID NO: 8521322 - DNA, 22 bp, Homo sapiens
ctcagaaaacctctttcttgat

SEQ ID NO: 8521323 - DNA, 22 bp, Homo sapiens
ctcagaaaacctctttcttgat

SEQ ID NO: 8521324 - DNA, 22 bp, Homo sapiens
ctcactgccctgaagttgggtt

SEQ ID NO: 8521325 - DNA, 22 bp, Homo sapiens
ctcactggcaagactacaggtg

SEQ ID NO: 8521326 - DNA, 22 bp, Homo sapiens
ctcactgcaagttccacctacc

SEQ ID NO: 8521327 - DNA, 22 bp, Homo sapiens
ctcactgcaagctctgcctccc

SEQ ID NO: 8521328 - DNA, 22 bp, Homo sapiens
ctcactgcaagctccgcctccc

SEQ ID NO: 8521329 - DNA, 22 bp, Homo sapiens
ctcactgcaagctctgcctcca

SEQ ID NO: 8521330 - DNA, 22 bp, Homo sapiens
cctgtacaagctcttggtgaca

SEQ ID NO: 8521331 - DNA, 22 bp, Homo sapiens
cctgtacaagctcttggtgaca

SEQ ID NO: 8521332 - DNA, 22 bp, Homo sapiens
cctgtacaagagccatctggat

SEQ ID NO: 8521333 - DNA, 22 bp, Homo sapiens
cctgtacaagagccatctggat

SEQ ID NO: 8521334 - DNA, 22 bp, Homo sapiens
cctgtacacggtctatgcctcc

SEQ ID NO: 8521335 - DNA, 22 bp, Homo sapiens
cctgtacacaattccgaggata

SEQ ID NO: 8521336 - DNA, 22 bp, Homo sapiens
cctgtacagtgaatgaatgtga

SEQ ID NO: 8521337 - DNA, 22 bp, Homo sapiens
cctgtacatctgctctcattgc

SEQ ID NO: 8521338 - DNA, 22 bp, Homo sapiens
cctgtacagtgaatgaatgtga

SEQ ID NO: 8521339 - DNA, 22 bp, Homo sapiens
cctgtacatggccatctttacc

SEQ ID NO: 8521340 - DNA, 19 bp, Homo sapiens
cctgtacattattctcccc

SEQ ID NO: 8521341 - DNA, 22 bp, Homo sapiens
cctgtacattagctgtgaattg

SEQ ID NO: 8521342 - DNA, 22 bp, Homo sapiens
cctgtacattagctgtgaattg

SEQ ID NO: 8521343 - DNA, 22 bp, Homo sapiens
cctgtactagggtctcattgcc

SEQ ID NO: 8521344 - DNA, 22 bp, Homo sapiens
cctgtaggaacgccttcatttg

SEQ ID NO: 8521345 - DNA, 22 bp, Homo sapiens
cctgtattaggtagacaactat

SEQ ID NO: 8521346 - DNA, 22 bp, Homo sapiens
ttaatagatatgcctctagagt

SEQ ID NO: 8521347 - DNA, 22 bp, Homo sapiens
ttaatatgttgaaatttattag

SEQ ID NO: 8521348 - DNA, 22 bp, Homo sapiens
cctgtcacatatttgctgttca

SEQ ID NO: 8521349 - DNA, 22 bp, Homo sapiens
cctgtcacctaggtactgagca

SEQ ID NO: 8521350 - DNA, 22 bp, Homo sapiens
cctgtcacgatgactgcactct

SEQ ID NO: 8521351 - DNA, 22 bp, Homo sapiens
tgttttctcttgaaaagcagtc

SEQ ID NO: 8521352 - DNA, 22 bp, Homo sapiens
ttaaaagagcagcccagcatat

SEQ ID NO: 8521353 - DNA, 22 bp, Homo sapiens
ttaaaatagccagtgcccctct

SEQ ID NO: 8521354 - DNA, 22 bp, Homo sapiens
ttaaaatagccagtgcccctct

SEQ ID NO: 8521355 - DNA, 22 bp, Homo sapiens
ttaaaagggatgttatctgtaa

SEQ ID NO: 8521356 - DNA, 22 bp, Homo sapiens
ttaaaagggatgttatctgtaa

SEQ ID NO: 8521357 - DNA, 22 bp, Homo sapiens
ttaaaagtctgatgatttacat

SEQ ID NO: 8521358 - DNA, 22 bp, Homo sapiens
ttaaaatcacagtcacccagta

SEQ ID NO: 8521359 - DNA, 22 bp, Homo sapiens
ttaaaatctaaagcagttgtct

SEQ ID NO: 8521360 - DNA, 22 bp, Homo sapiens
ttaaaatgaatattgattagca

SEQ ID NO: 8521361 - DNA, 22 bp, Homo sapiens
ttaaaatctaaagcagttgtct

SEQ ID NO: 8521362 - DNA, 22 bp, Homo sapiens
ttaaaatgaatattgattagca

SEQ ID NO: 8521363 - DNA, 22 bp, Homo sapiens
ttaaaatgaatattgattagca

SEQ ID NO: 8521364 - DNA, 22 bp, Homo sapiens
cctgtaagtagtttgcctgagc

SEQ ID NO: 8521365 - DNA, 22 bp, Homo sapiens
ttaaaatgcagattatgactca

SEQ ID NO: 8521366 - DNA, 22 bp, Homo sapiens
cctgtggctgccacttgggtga

SEQ ID NO: 8521367 - DNA, 22 bp, Homo sapiens
cctgtggctctctttggaggtc

SEQ ID NO: 8521368 - DNA, 22 bp, Homo sapiens
cctgtggcgggggccagtgcct

SEQ ID NO: 8521369 - DNA, 22 bp, Homo sapiens
ttacaagtatttaagatgctgt

SEQ ID NO: 8521370 - DNA, 22 bp, Homo sapiens
ttacaagtatttaagatgctgt

SEQ ID NO: 8521371 - DNA, 21 bp, Homo sapiens
ttacaaagctacagatgttgc

SEQ ID NO: 8521372 - DNA, 21 bp, Homo sapiens
ttacaaagctacagatgttgc

SEQ ID NO: 8521373 - DNA, 22 bp, Homo sapiens
ttacaagtactgaatatgattt

SEQ ID NO: 8521374 - DNA, 22 bp, Homo sapiens
ttacaaagcgttgagacaagta

SEQ ID NO: 8521375 - DNA, 22 bp, Homo sapiens
ttacaaagcgttgagacaagta

SEQ ID NO: 8521376 - DNA, 22 bp, Homo sapiens
ttacaatgacaggtgtatcatt

SEQ ID NO: 8521377 - DNA, 22 bp, Homo sapiens
ttacaatcatctaggataaaga

SEQ ID NO: 8521378 - DNA, 22 bp, Homo sapiens
ttacaatcatctaggataaaga

SEQ ID NO: 8521379 - DNA, 22 bp, Homo sapiens
ttacaatctgattgtctcatct

SEQ ID NO: 8521380 - DNA, 22 bp, Homo sapiens
ttacaatagttccttcttttgt

SEQ ID NO: 8521381 - DNA, 22 bp, Homo sapiens
ttacaataccacatcacctcat

SEQ ID NO: 8521382 - DNA, 22 bp, Homo sapiens
ttacaatagttccttcttttgt

SEQ ID NO: 8521383 - DNA, 22 bp, Homo sapiens
ttacaatagttccttcttttgt

SEQ ID NO: 8521384 - DNA, 22 bp, Homo sapiens
ttacaatagttccttcttttgt

SEQ ID NO: 8521385 - DNA, 22 bp, Homo sapiens
ttacaagtttctggcttcatcc

SEQ ID NO: 8521386 - DNA, 22 bp, Homo sapiens
ttacaataccacatcacctcat

SEQ ID NO: 8521387 - DNA, 23 bp, Homo sapiens
ttacaagttctgaaatttccttc

SEQ ID NO: 8521388 - DNA, 22 bp, Homo sapiens
ttacaagttcagattttctcat

SEQ ID NO: 8521389 - DNA, 22 bp, Homo sapiens
ttacaagtgtcaggtactggca

SEQ ID NO: 8521390 - DNA, 21 bp, Homo sapiens
cctgtggattttaaaattgga

SEQ ID NO: 8521391 - DNA, 20 bp, Homo sapiens
cctgtggagctgcctcctcc

SEQ ID NO: 8521392 - DNA, 22 bp, Homo sapiens
cctgtggcacatgcagggattc

SEQ ID NO: 8521393 - DNA, 22 bp, Homo sapiens
cctgtggcacatgcagggattc

SEQ ID NO: 8521394 - DNA, 23 bp, Homo sapiens
cctgtggcaagtagatgagatga

SEQ ID NO: 8521395 - DNA, 22 bp, Homo sapiens
cctgtggaccaggaggcagccc

SEQ ID NO: 8521396 - DNA, 21 bp, Homo sapiens
ttaatgctatgcagaaaatct

SEQ ID NO: 8521397 - DNA, 22 bp, Homo sapiens
ttaatgcagaaatcaaactgac

SEQ ID NO: 8521398 - DNA, 22 bp, Homo sapiens
ttaatgcagctctaccacacag

SEQ ID NO: 8521399 - DNA, 22 bp, Homo sapiens
cctgtgctttaggcctcaaact

SEQ ID NO: 8521400 - DNA, 22 bp, Homo sapiens
ttaatcacagctctgccatgag

SEQ ID NO: 8521401 - DNA, 22 bp, Homo sapiens
ttaatcacagatattaaacatg

SEQ ID NO: 8521402 - DNA, 22 bp, Homo sapiens
ttaatccaatatcctggctatt

SEQ ID NO: 8521403 - DNA, 22 bp, Homo sapiens
ttaatccaataacaaggttcaa

SEQ ID NO: 8521404 - DNA, 21 bp, Homo sapiens
ttaatcagtctccctgtctcc

SEQ ID NO: 8521405 - DNA, 22 bp, Homo sapiens
ttaatctcttagcaaattaatg

SEQ ID NO: 8521406 - DNA, 22 bp, Homo sapiens
ttaatccatggcagttattaaa

SEQ ID NO: 8521407 - DNA, 22 bp, Homo sapiens
ttaatccggggtgaatttaatt

SEQ ID NO: 8521408 - DNA, 22 bp, Homo sapiens
ttaatcttcagggactcttgct

SEQ ID NO: 8521409 - DNA, 22 bp, Homo sapiens
ttaatcttcagggactcttgct

SEQ ID NO: 8521410 - DNA, 22 bp, Homo sapiens
ttaatgaatatgacaggagagg

SEQ ID NO: 8521411 - DNA, 22 bp, Homo sapiens
tggttataaaagtcctctcatt

SEQ ID NO: 8521412 - DNA, 22 bp, Homo sapiens
tggttataaattgctatgcaga

SEQ ID NO: 8521413 - DNA, 22 bp, Homo sapiens
tggttagtcagtacctgagtgt

SEQ ID NO: 8521414 - DNA, 22 bp, Homo sapiens
tggttagtgtatatttggactg

SEQ ID NO: 8521415 - DNA, 21 bp, Homo sapiens
tggttagttattggcagtgcc

SEQ ID NO: 8521416 - DNA, 22 bp, Homo sapiens
tggttccaagatggctgccaca

SEQ ID NO: 8521417 - DNA, 22 bp, Homo sapiens
tggttccaatcgcactggctca

SEQ ID NO: 8521418 - DNA, 22 bp, Homo sapiens
tggttccaatcgcactggctca

SEQ ID NO: 8521419 - DNA, 22 bp, Homo sapiens
tggttccactaacctgagagcc

SEQ ID NO: 8521420 - DNA, 22 bp, Homo sapiens
tggttcctacgcacattgaatt

SEQ ID NO: 8521421 - DNA, 22 bp, Homo sapiens
cctgctcagccccagctcaccc

SEQ ID NO: 8521422 - DNA, 22 bp, Homo sapiens
cctgctcagccccagctcaccc

SEQ ID NO: 8521423 - DNA, 22 bp, Homo sapiens
cctgctcagccccagctcaccc

SEQ ID NO: 8521424 - DNA, 22 bp, Homo sapiens
cctgctcagagcgtcttgtgtg

SEQ ID NO: 8521425 - DNA, 22 bp, Homo sapiens
cctgctcagagcgtcttgtgtg

SEQ ID NO: 8521426 - DNA, 22 bp, Homo sapiens
cctgctcacctgatgtggcaac

SEQ ID NO: 8521427 - DNA, 22 bp, Homo sapiens
cctgctcagagcgtcttgtgtg

SEQ ID NO: 8521428 - DNA, 22 bp, Homo sapiens
cctgctcagagcgtcttgtgtg

SEQ ID NO: 8521429 - DNA, 22 bp, Homo sapiens
cctgctcatgggtccctggcag

SEQ ID NO: 8521430 - DNA, 23 bp, Homo sapiens
cctgctcaggcgtgtgccctgct

SEQ ID NO: 8521431 - DNA, 23 bp, Homo sapiens
cctgctcaggcgtgtgccctgct

SEQ ID NO: 8521432 - DNA, 23 bp, Homo sapiens
cctgctcaggcgtgtgccctgct

SEQ ID NO: 8521433 - DNA, 22 bp, Homo sapiens
cctgctcagctgtcctcacgct

SEQ ID NO: 8521434 - DNA, 22 bp, Homo sapiens
cctgccttcccagcttggcttt

SEQ ID NO: 8521435 - DNA, 22 bp, Homo sapiens
cctgctcacctgatgtggcaac

SEQ ID NO: 8521436 - DNA, 22 bp, Homo sapiens
cctgctcaacgaatatggcgat

SEQ ID NO: 8521437 - DNA, 22 bp, Homo sapiens
cctgcgtccacggctgggagac

SEQ ID NO: 8521438 - DNA, 22 bp, Homo sapiens
tgttgatttgtgggctgcaaaa

SEQ ID NO: 8521439 - DNA, 22 bp, Homo sapiens
tgttgattagtgtttagactta

SEQ ID NO: 8521440 - DNA, 22 bp, Homo sapiens
tgttgattagtgtttagactta

SEQ ID NO: 8521441 - DNA, 20 bp, Homo sapiens
tgttgattggtgtcatctca

SEQ ID NO: 8521442 - DNA, 22 bp, Homo sapiens
tgttcccatggatatctgcata

SEQ ID NO: 8521443 - DNA, 22 bp, Homo sapiens
tgttcccaagataagattatga

SEQ ID NO: 8521444 - DNA, 22 bp, Homo sapiens
cctgctcctgctattcttctgg

SEQ ID NO: 8521445 - DNA, 22 bp, Homo sapiens
tgttgcctggggaagctctgat

SEQ ID NO: 8521446 - DNA, 22 bp, Homo sapiens
tgttgcgatgaagagcttcacg

SEQ ID NO: 8521447 - DNA, 22 bp, Homo sapiens
tgttgcccaggttctctcctgc

SEQ ID NO: 8521448 - DNA, 22 bp, Homo sapiens
tgttgcccaggttctctcctgc

SEQ ID NO: 8521449 - DNA, 19 bp, Homo sapiens
tgttgccaggtatcatgtt

SEQ ID NO: 8521450 - DNA, 22 bp, Homo sapiens
tgttgcccaggttctctcctgc

SEQ ID NO: 8521451 - DNA, 22 bp, Homo sapiens
tgttggaaaggccaggctgtgg

SEQ ID NO: 8521452 - DNA, 22 bp, Homo sapiens
tgttggaaaggccaggctgtgg

SEQ ID NO: 8521453 - DNA, 22 bp, Homo sapiens
tgttttcatggttatgtgtcta

SEQ ID NO: 8521454 - DNA, 17 bp, Homo sapiens
tgttttcattcattgct

SEQ ID NO: 8521455 - DNA, 22 bp, Homo sapiens
tgttttcatggttatgtgtcta

SEQ ID NO: 8521456 - DNA, 22 bp, Homo sapiens
tgttttcatggagatggtggcg

SEQ ID NO: 8521457 - DNA, 22 bp, Homo sapiens
tgttttcagtcatatagcaggt

SEQ ID NO: 8521458 - DNA, 21 bp, Homo sapiens
tgttttctaaagggcggatca

SEQ ID NO: 8521459 - DNA, 22 bp, Homo sapiens
tgttttcctcctggtttctgcc

SEQ ID NO: 8521460 - DNA, 21 bp, Homo sapiens
tgttttccaccttgaggcaag

SEQ ID NO: 8521461 - DNA, 17 bp, Homo sapiens
tgttttcattcattgct

SEQ ID NO: 8521462 - DNA, 19 bp, Homo sapiens
tgtttcttcctccatctga

SEQ ID NO: 8521463 - DNA, 19 bp, Homo sapiens
tgtttcttcctccatctga

SEQ ID NO: 8521464 - DNA, 22 bp, Homo sapiens
tgttttcagtcatatagcaggt

SEQ ID NO: 8521465 - DNA, 22 bp, Homo sapiens
tgtttcttctcacacaaactca

SEQ ID NO: 8521466 - DNA, 22 bp, Homo sapiens
tgtttcttctcacacaaactca

SEQ ID NO: 8521467 - DNA, 22 bp, Homo sapiens
tgtttcttctcacacaaactca

SEQ ID NO: 8521468 - DNA, 22 bp, Homo sapiens
tgtttcttctcacacaaactca

SEQ ID NO: 8521469 - DNA, 22 bp, Homo sapiens
tgtttcttctcacacaaactca

SEQ ID NO: 8521470 - DNA, 22 bp, Homo sapiens
tgtttcttatccaagtggtctg

SEQ ID NO: 8521471 - DNA, 22 bp, Homo sapiens
tgtttcttacgtttttagaggc

SEQ ID NO: 8521472 - DNA, 20 bp, Homo sapiens
tgtttctgacggtaggagag

SEQ ID NO: 8521473 - DNA, 22 bp, Homo sapiens
cctggggagagaaagcccagcc

SEQ ID NO: 8521474 - DNA, 22 bp, Homo sapiens
cctggggagaagagcttccccc

SEQ ID NO: 8521475 - DNA, 22 bp, Homo sapiens
cctggggattctgacacggagt

SEQ ID NO: 8521476 - DNA, 23 bp, Homo sapiens
cctggggagctgtatccagagtg

SEQ ID NO: 8521477 - DNA, 23 bp, Homo sapiens
cctggggcacttgagtcctcatc

SEQ ID NO: 8521478 - DNA, 23 bp, Homo sapiens
cctggggcacttgagtcctcatc

SEQ ID NO: 8521479 - DNA, 22 bp, Homo sapiens
cctggggctcaagatggcgccg

SEQ ID NO: 8521480 - DNA, 22 bp, Homo sapiens
tgtttatacctgcaacctgtca

SEQ ID NO: 8521481 - DNA, 22 bp, Homo sapiens
tgtttatacctgcaacctgtca

SEQ ID NO: 8521482 - DNA, 22 bp, Homo sapiens
tgtttctagagaaaatatttac

SEQ ID NO: 8521483 - DNA, 22 bp, Homo sapiens
tgtttataccttggtataacca

SEQ ID NO: 8521484 - DNA, 22 bp, Homo sapiens
tgtttctaggtcaataattttt

SEQ ID NO: 8521485 - DNA, 22 bp, Homo sapiens
tgtttctaggtcaataattttt

SEQ ID NO: 8521486 - DNA, 22 bp, Homo sapiens
tgtttctatctggatcaataga

SEQ ID NO: 8521487 - DNA, 22 bp, Homo sapiens
cctttgggtgaattcctctctt

SEQ ID NO: 8521488 - DNA, 22 bp, Homo sapiens
cgagcagaagcctggtggtctg

SEQ ID NO: 8521489 - DNA, 22 bp, Homo sapiens
cgagcagaatggagggtgccga

SEQ ID NO: 8521490 - DNA, 22 bp, Homo sapiens
cgagcagagcagagacgtctgg

SEQ ID NO: 8521491 - DNA, 22 bp, Homo sapiens
cgatgggggcagtgttacattg

SEQ ID NO: 8521492 - DNA, 18 bp, Homo sapiens
cgatgtgtatgtgatttg

SEQ ID NO: 8521493 - DNA, 18 bp, Homo sapiens
cgatgtgtatgtgatttg

SEQ ID NO: 8521494 - DNA, 22 bp, Homo sapiens
cgagtgtctgctatgggctgag

SEQ ID NO: 8521495 - DNA, 22 bp, Homo sapiens
cgagtgtccctaccatttccta

SEQ ID NO: 8521496 - DNA, 22 bp, Homo sapiens
cgcaccactgaattccagcctg

SEQ ID NO: 8521497 - DNA, 22 bp, Homo sapiens
cgcaccactgaattccagcctg

SEQ ID NO: 8521498 - DNA, 22 bp, Homo sapiens
ttatgtactctgcaatgtttga

SEQ ID NO: 8521499 - DNA, 22 bp, Homo sapiens
ttatgtacaatgttaatgtaaa

SEQ ID NO: 8521500 - DNA, 22 bp, Homo sapiens
ttatgtacccactcatattccc

SEQ ID NO: 8521501 - DNA, 22 bp, Homo sapiens
ttatgtacctgaattagtaaag

SEQ ID NO: 8521502 - DNA, 22 bp, Homo sapiens
ttatgtacctgaattagtaaag

SEQ ID NO: 8521503 - DNA, 22 bp, Homo sapiens
ttatgggagcaattggggaggt

SEQ ID NO: 8521504 - DNA, 22 bp, Homo sapiens
ttatgtaatttgtttgctcttc

SEQ ID NO: 8521505 - DNA, 22 bp, Homo sapiens
ttatgtacaatgttaatgtaaa

SEQ ID NO: 8521506 - DNA, 22 bp, Homo sapiens
ttatgtaagtggagtcatatag

SEQ ID NO: 8521507 - DNA, 20 bp, Homo sapiens
cctttctggagtgctgttca

SEQ ID NO: 8521508 - DNA, 22 bp, Homo sapiens
cctttctgacagtgatgggggg

SEQ ID NO: 8521509 - DNA, 22 bp, Homo sapiens
cctttctgatggcctcccagcc

SEQ ID NO: 8521510 - DNA, 22 bp, Homo sapiens
cctttctggtatttaaccaaag

SEQ ID NO: 8521511 - DNA, 17 bp, Homo sapiens
cctttcttcccagaggg

SEQ ID NO: 8521512 - DNA, 22 bp, Homo sapiens
cctttctgtgttgccctatttg

SEQ ID NO: 8521513 - DNA, 22 bp, Homo sapiens
ttatgtcaaaatggttgagatt

SEQ ID NO: 8521514 - DNA, 22 bp, Homo sapiens
ttatgtatggatggctgaaagt

SEQ ID NO: 8521515 - DNA, 22 bp, Homo sapiens
ttatgtatggatggctgaaagt

SEQ ID NO: 8521516 - DNA, 22 bp, Homo sapiens
ttatgtatgaatatagtagaag

SEQ ID NO: 8521517 - DNA, 22 bp, Homo sapiens
ttatgtatgaatatagtagaag

SEQ ID NO: 8521518 - DNA, 22 bp, Homo sapiens
ttatgtatgaatatagtagaag

SEQ ID NO: 8521519 - DNA, 22 bp, Homo sapiens
cctttcttttatccaccagcca

SEQ ID NO: 8521520 - DNA, 19 bp, Homo sapiens
cctttgaatcaggacactt

SEQ ID NO: 8521521 - DNA, 22 bp, Homo sapiens
cctttgcattctagatgtttag

SEQ ID NO: 8521522 - DNA, 22 bp, Homo sapiens
cctttgatttcccccgtctcag

SEQ ID NO: 8521523 - DNA, 22 bp, Homo sapiens
cgcagagggcaggcagtgctgg

SEQ ID NO: 8521524 - DNA, 22 bp, Homo sapiens
cgcagagggagccgcgggctgc

SEQ ID NO: 8521525 - DNA, 22 bp, Homo sapiens
cgcagagggagccgcgggctgc

SEQ ID NO: 8521526 - DNA, 19 bp, Homo sapiens
cgcagagggcttctgagag

SEQ ID NO: 8521527 - DNA, 22 bp, Homo sapiens
cgcagagggcaggcagtgctgg

SEQ ID NO: 8521528 - DNA, 22 bp, Homo sapiens
cgcagagggcaggcagtgctgg

SEQ ID NO: 8521529 - DNA, 22 bp, Homo sapiens
ttcaaaacagctagatattgga

SEQ ID NO: 8521530 - DNA, 22 bp, Homo sapiens
cgcagaagaggttgtctagtcc

SEQ ID NO: 8521531 - DNA, 21 bp, Homo sapiens
cgcagagcgaacttgcggcgc

SEQ ID NO: 8521532 - DNA, 21 bp, Homo sapiens
cgcagagcgaacttgcggcgc

SEQ ID NO: 8521533 - DNA, 22 bp, Homo sapiens
ttcaaaaaggtatgttcaagtc

SEQ ID NO: 8521534 - DNA, 22 bp, Homo sapiens
ttcaaaaaggtatgttcaagtc

SEQ ID NO: 8521535 - DNA, 17 bp, Homo sapiens
ttattttttgggctgag

SEQ ID NO: 8521536 - DNA, 22 bp, Homo sapiens
ttatttttaaaagttcacacag

SEQ ID NO: 8521537 - DNA, 22 bp, Homo sapiens
ttatttttaaaagttcacacag

SEQ ID NO: 8521538 - DNA, 22 bp, Homo sapiens
ttatttttaaaagttcacacag

SEQ ID NO: 8521539 - DNA, 22 bp, Homo sapiens
ttatttttaaaagttcacacag

SEQ ID NO: 8521540 - DNA, 22 bp, Homo sapiens
ttatttttaaaagttcacacag

SEQ ID NO: 8521541 - DNA, 22 bp, Homo sapiens
cgcaccactgaattccagcctg

SEQ ID NO: 8521542 - DNA, 22 bp, Homo sapiens
cgcaccactgaattccagcctg

SEQ ID NO: 8521543 - DNA, 22 bp, Homo sapiens
cgcaccactgaattccagcctg

SEQ ID NO: 8521544 - DNA, 22 bp, Homo sapiens
cgcaccactgaattccagcctg

SEQ ID NO: 8521545 - DNA, 22 bp, Homo sapiens
ttattattgtgacctgagaatg

SEQ ID NO: 8521546 - DNA, 22 bp, Homo sapiens
ttattattgtggttgcattatc

SEQ ID NO: 8521547 - DNA, 22 bp, Homo sapiens
ttattattgtggttgcattatc

SEQ ID NO: 8521548 - DNA, 22 bp, Homo sapiens
ttattattgtggttgcattatc

SEQ ID NO: 8521549 - DNA, 22 bp, Homo sapiens
ttattattgtggttgcattatc

SEQ ID NO: 8521550 - DNA, 22 bp, Homo sapiens
ttattattttgtgtacagcaaa

SEQ ID NO: 8521551 - DNA, 22 bp, Homo sapiens
ttattattttgtgtacagcaaa

SEQ ID NO: 8521552 - DNA, 22 bp, Homo sapiens
ttattattttgtgtacagcaaa

SEQ ID NO: 8521553 - DNA, 22 bp, Homo sapiens
ttattcactctgaagccatcct

SEQ ID NO: 8521554 - DNA, 22 bp, Homo sapiens
ttattcacttcttggtccctca

SEQ ID NO: 8521555 - DNA, 18 bp, Homo sapiens
ttattcagacgcatatga

SEQ ID NO: 8521556 - DNA, 22 bp, Homo sapiens
ttatttcatgtaaaatttatgt

SEQ ID NO: 8521557 - DNA, 18 bp, Homo sapiens
ttattcagacgcatatga

SEQ ID NO: 8521558 - DNA, 22 bp, Homo sapiens
ttattcactcattaaagcagga

SEQ ID NO: 8521559 - DNA, 22 bp, Homo sapiens
ttattcactcatttaacattat

SEQ ID NO: 8521560 - DNA, 22 bp, Homo sapiens
ttattcacctctattagactca

SEQ ID NO: 8521561 - DNA, 22 bp, Homo sapiens
ttattcacctctattagactca

SEQ ID NO: 8521562 - DNA, 22 bp, Homo sapiens
ttatttttaaaagttcacacag

SEQ ID NO: 8521563 - DNA, 23 bp, Homo sapiens
ttattttgtcagaagggactttt

SEQ ID NO: 8521564 - DNA, 21 bp, Homo sapiens
ccttgggatgcaagtgagact

SEQ ID NO: 8521565 - DNA, 22 bp, Homo sapiens
ccttgggagaaattgcagagtc

SEQ ID NO: 8521566 - DNA, 22 bp, Homo sapiens
ccttgggatttctcatgccaat

SEQ ID NO: 8521567 - DNA, 22 bp, Homo sapiens
ccttgggaccctgctggaggtt

SEQ ID NO: 8521568 - DNA, 22 bp, Homo sapiens
ccttggcttgtgggctgcagcc

SEQ ID NO: 8521569 - DNA, 19 bp, Homo sapiens
ccttgcctgtccctgcagc

SEQ ID NO: 8521570 - DNA, 22 bp, Homo sapiens
ccttggctggaattactctggg

SEQ ID NO: 8521571 - DNA, 21 bp, Homo sapiens
ccttggctggcatctagcacc

SEQ ID NO: 8521572 - DNA, 22 bp, Homo sapiens
ccttggcttaccttctgtgtgg

SEQ ID NO: 8521573 - DNA, 22 bp, Homo sapiens
ttacctgtgtgtttgatacata

SEQ ID NO: 8521574 - DNA, 22 bp, Homo sapiens
ttacctggtgtttatggtccat

SEQ ID NO: 8521575 - DNA, 22 bp, Homo sapiens
ttacctgcaactcccatggtga

SEQ ID NO: 8521576 - DNA, 22 bp, Homo sapiens
ttacgaatgttagattgcatct

SEQ ID NO: 8521577 - DNA, 22 bp, Homo sapiens
ttacgagtttgcaattttaaat

SEQ ID NO: 8521578 - DNA, 22 bp, Homo sapiens
ccttgcctcattgtgcttctcc

SEQ ID NO: 8521579 - DNA, 22 bp, Homo sapiens
ccttggtttccaggatgaggct

SEQ ID NO: 8521580 - DNA, 22 bp, Homo sapiens
ccttggtgctctgctgggatgg

SEQ ID NO: 8521581 - DNA, 22 bp, Homo sapiens
ccttggttctgcctggcctgga

SEQ ID NO: 8521582 - DNA, 22 bp, Homo sapiens
ccttggtccaaccctgcacagc

SEQ ID NO: 8521583 - DNA, 22 bp, Homo sapiens
ccttgggttccaagtcactgaa

SEQ ID NO: 8521584 - DNA, 22 bp, Homo sapiens
cctttaaagactgcataacttc

SEQ ID NO: 8521585 - DNA, 22 bp, Homo sapiens
cctttaaatggatgttcaactg

SEQ ID NO: 8521586 - DNA, 22 bp, Homo sapiens
ccttgtgtttacacctgtcttt

SEQ ID NO: 8521587 - DNA, 22 bp, Homo sapiens
ttatcgtacgcttcagaaattt

SEQ ID NO: 8521588 - DNA, 22 bp, Homo sapiens
ttatggcatattcctcattgta

SEQ ID NO: 8521589 - DNA, 22 bp, Homo sapiens
ttatctctcacttttaaggaca

SEQ ID NO: 8521590 - DNA, 22 bp, Homo sapiens
ttatggctaaatttcaatatta

SEQ ID NO: 8521591 - DNA, 22 bp, Homo sapiens
ttatggcttctgtgaagaattt

SEQ ID NO: 8521592 - DNA, 18 bp, Homo sapiens
ttatggctgtgaaagagt

SEQ ID NO: 8521593 - DNA, 18 bp, Homo sapiens
ttatggctgtgaaagagt

SEQ ID NO: 8521594 - DNA, 21 bp, Homo sapiens
cctttacaattttgcattcct

SEQ ID NO: 8521595 - DNA, 22 bp, Homo sapiens
cctttacacgtaaggctgttga

SEQ ID NO: 8521596 - DNA, 22 bp, Homo sapiens
cctttacacatggaatgggtct

SEQ ID NO: 8521597 - DNA, 22 bp, Homo sapiens
cctttacagtagcccttttgaa

SEQ ID NO: 8521598 - DNA, 22 bp, Homo sapiens
cctttacagtatggttgtatca

SEQ ID NO: 8521599 - DNA, 22 bp, Homo sapiens
ttatcctgcatcctggaactca

SEQ ID NO: 8521600 - DNA, 22 bp, Homo sapiens
cctttacaaagttcttcatggg

SEQ ID NO: 8521601 - DNA, 18 bp, Homo sapiens
ccttctgacgcttgagaa

SEQ ID NO: 8521602 - DNA, 22 bp, Homo sapiens
ccttctgctccctggccagggc

SEQ ID NO: 8521603 - DNA, 22 bp, Homo sapiens
ccttctgctggtcatcccagtg

SEQ ID NO: 8521604 - DNA, 22 bp, Homo sapiens
ccttctgctccctggccagggc

SEQ ID NO: 8521605 - DNA, 22 bp, Homo sapiens
ccttctggatgtgctaaggaag

SEQ ID NO: 8521606 - DNA, 22 bp, Homo sapiens
ccttctgtctccctcatattga

SEQ ID NO: 8521607 - DNA, 22 bp, Homo sapiens
ccttctgtgtgcccacgtttat

SEQ ID NO: 8521608 - DNA, 22 bp, Homo sapiens
ccttctgtctccctcatattga

SEQ ID NO: 8521609 - DNA, 22 bp, Homo sapiens
ccttctgtgtgcccacgtttat

SEQ ID NO: 8521610 - DNA, 23 bp, Homo sapiens
ccttctgttaaccatctgggggg

SEQ ID NO: 8521611 - DNA, 23 bp, Homo sapiens
ccttctgttaaccatctgggggg

SEQ ID NO: 8521612 - DNA, 22 bp, Homo sapiens
ccttcttctgtgtggcccaaga

SEQ ID NO: 8521613 - DNA, 22 bp, Homo sapiens
ttacccagggaccaagagaaac

SEQ ID NO: 8521614 - DNA, 22 bp, Homo sapiens
ttacctaaaatagctcaattta

SEQ ID NO: 8521615 - DNA, 22 bp, Homo sapiens
ttaccaattcagacatctcttc

SEQ ID NO: 8521616 - DNA, 22 bp, Homo sapiens
ttaccaagctctgcatgttaag

SEQ ID NO: 8521617 - DNA, 22 bp, Homo sapiens
ttaccaaatgaaatagagattt

SEQ ID NO: 8521618 - DNA, 22 bp, Homo sapiens
ttaccacagtgcctgtctaatg

SEQ ID NO: 8521619 - DNA, 22 bp, Homo sapiens
ttaccagttttgccatttgcta

SEQ ID NO: 8521620 - DNA, 22 bp, Homo sapiens
ttacagaagagaaagaattcag

SEQ ID NO: 8521621 - DNA, 22 bp, Homo sapiens
ttacagaagagaaagaattcag

SEQ ID NO: 8521622 - DNA, 22 bp, Homo sapiens
ttacagaagagtaacttggcaa

SEQ ID NO: 8521623 - DNA, 22 bp, Homo sapiens
ttacagaactgtcttgaaattt

SEQ ID NO: 8521624 - DNA, 22 bp, Homo sapiens
ttacagaagagaaagaattcag

SEQ ID NO: 8521625 - DNA, 22 bp, Homo sapiens
ttacagaaggaacactactcag

SEQ ID NO: 8521626 - DNA, 22 bp, Homo sapiens
ttacagaaggaacactactcag

SEQ ID NO: 8521627 - DNA, 22 bp, Homo sapiens
ttacagaaggaacactactcag

SEQ ID NO: 8521628 - DNA, 22 bp, Homo sapiens
ttacagaaggaacactactcag

SEQ ID NO: 8521629 - DNA, 21 bp, Homo sapiens
ccttctcttgcttcagcttca

SEQ ID NO: 8521630 - DNA, 21 bp, Homo sapiens
ccttctcttgcttcagcttca

SEQ ID NO: 8521631 - DNA, 20 bp, Homo sapiens
ccttctctggaattgcctcc

SEQ ID NO: 8521632 - DNA, 21 bp, Homo sapiens
ccttctccacagggtctccgg

SEQ ID NO: 8521633 - DNA, 22 bp, Homo sapiens
ttacagaagtattgagagatcc

SEQ ID NO: 8521634 - DNA, 20 bp, Homo sapiens
ccttctctggaattgcctcc

SEQ ID NO: 8521635 - DNA, 22 bp, Homo sapiens
ttacaatgatgaataaatggca

SEQ ID NO: 8521636 - DNA, 22 bp, Homo sapiens
ttacaatgagaaatggttggca

SEQ ID NO: 8521637 - DNA, 22 bp, Homo sapiens
ttacaatgagaaatggttggca

SEQ ID NO: 8521638 - DNA, 22 bp, Homo sapiens
ttacagaaaatgtgttttaact

SEQ ID NO: 8521639 - DNA, 22 bp, Homo sapiens
ttacagaaaggaaggactgact

SEQ ID NO: 8521640 - DNA, 22 bp, Homo sapiens
ttacagaaaggttgtgggatag

SEQ ID NO: 8521641 - DNA, 23 bp, Homo sapiens
ttacagaaagtatgcttttgttt

SEQ ID NO: 8521642 - DNA, 23 bp, Homo sapiens
ttacagaaagtatgcttttgttt

SEQ ID NO: 8521643 - DNA, 20 bp, Homo sapiens
ttacagaaatgatgttattt

SEQ ID NO: 8521644 - DNA, 20 bp, Homo sapiens
ttacagaaatgatgttattt

SEQ ID NO: 8521645 - DNA, 20 bp, Homo sapiens
ttacagaaatgatgttattt

SEQ ID NO: 8521646 - DNA, 20 bp, Homo sapiens
ttacagaaatgatgttattt

SEQ ID NO: 8521647 - DNA, 22 bp, Homo sapiens
ttacagaactgccctagttggc

SEQ ID NO: 8521648 - DNA, 22 bp, Homo sapiens
ttacagaactgtcttgaaattt

SEQ ID NO: 8521649 - DNA, 22 bp, Homo sapiens
ttacagaactgtcttgaaattt

SEQ ID NO: 8521650 - DNA, 22 bp, Homo sapiens
ttacagaactgtcttgaaattt

SEQ ID NO: 8521651 - DNA, 22 bp, Homo sapiens
ttacagaactgccctagttggc

SEQ ID NO: 8521652 - DNA, 22 bp, Homo sapiens
ttacagaactgtcttgaaattt

SEQ ID NO: 8521653 - DNA, 22 bp, Homo sapiens
tttatatccatctttgaagtaa

SEQ ID NO: 8521654 - DNA, 22 bp, Homo sapiens
tttatatcttatgtcatttcaa

SEQ ID NO: 8521655 - DNA, 22 bp, Homo sapiens
tttatatgaaagtgaccagtgg

SEQ ID NO: 8521656 - DNA, 18 bp, Homo sapiens
tttatatggatagagacc

SEQ ID NO: 8521657 - DNA, 18 bp, Homo sapiens
tttatatggatagagacc

SEQ ID NO: 8521658 - DNA, 22 bp, Homo sapiens
tttatatgtttgtacaattaag

SEQ ID NO: 8521659 - DNA, 22 bp, Homo sapiens
tttatatgtttgtacaattaag

SEQ ID NO: 8521660 - DNA, 22 bp, Homo sapiens
tttatatgtttgtacaattaag

SEQ ID NO: 8521661 - DNA, 22 bp, Homo sapiens
ctcctggacatggagcggagga

SEQ ID NO: 8521662 - DNA, 22 bp, Homo sapiens
ctcctggacatggagcggagga

SEQ ID NO: 8521663 - DNA, 22 bp, Homo sapiens
ctcctggaagcccgccctgctg

SEQ ID NO: 8521664 - DNA, 22 bp, Homo sapiens
ctcctggagcagcaggcgcagg

SEQ ID NO: 8521665 - DNA, 22 bp, Homo sapiens
ctcctggaccagggctattggg

SEQ ID NO: 8521666 - DNA, 22 bp, Homo sapiens
ctcctggaccaccttgtggcca

SEQ ID NO: 8521667 - DNA, 22 bp, Homo sapiens
ctcctggagcagcaggcgcagg

SEQ ID NO: 8521668 - DNA, 22 bp, Homo sapiens
ctcctggaggatagtgactggg

SEQ ID NO: 8521669 - DNA, 22 bp, Homo sapiens
ctcctggaggatagtgactggg

SEQ ID NO: 8521670 - DNA, 23 bp, Homo sapiens
ctcctggagggtccggccctgcc

SEQ ID NO: 8521671 - DNA, 22 bp, Homo sapiens
ctcctggagggccaaagaaata

SEQ ID NO: 8521672 - DNA, 22 bp, Homo sapiens
ctcctggaggctccaagggaga

SEQ ID NO: 8521673 - DNA, 22 bp, Homo sapiens
ctcctggaggatagtgactggg

SEQ ID NO: 8521674 - DNA, 22 bp, Homo sapiens
ctcctggatcttagccagattc

SEQ ID NO: 8521675 - DNA, 22 bp, Homo sapiens
ctcctggagtcctttcctattc

SEQ ID NO: 8521676 - DNA, 23 bp, Homo sapiens
ctcctggagggtccggccctgcc

SEQ ID NO: 8521677 - DNA, 23 bp, Homo sapiens
ctcctggagggtccggccctgcc

SEQ ID NO: 8521678 - DNA, 22 bp, Homo sapiens
tttacaatagggtctgaatgaa

SEQ ID NO: 8521679 - DNA, 20 bp, Homo sapiens
ctcctcagttccatgggagg

SEQ ID NO: 8521680 - DNA, 20 bp, Homo sapiens
ctcctcagttccatgggagg

SEQ ID NO: 8521681 - DNA, 20 bp, Homo sapiens
ctcctcagttccatgggagg

SEQ ID NO: 8521682 - DNA, 22 bp, Homo sapiens
ctcctcagttgtcccatggaga

SEQ ID NO: 8521683 - DNA, 22 bp, Homo sapiens
ctcctcagttgtcccatggaga

SEQ ID NO: 8521684 - DNA, 22 bp, Homo sapiens
tttacaattggttttctctaat

SEQ ID NO: 8521685 - DNA, 22 bp, Homo sapiens
tttacaattggttttctctaat

SEQ ID NO: 8521686 - DNA, 22 bp, Homo sapiens
tttacaattggttttctctaat

SEQ ID NO: 8521687 - DNA, 22 bp, Homo sapiens
tttacaattctggtgccagcta

SEQ ID NO: 8521688 - DNA, 22 bp, Homo sapiens
tttacacaaaagatagcacacc

SEQ ID NO: 8521689 - DNA, 22 bp, Homo sapiens
tttacacaaaagatagcacacc

SEQ ID NO: 8521690 - DNA, 22 bp, Homo sapiens
tttacacaaaagatagcacacc

SEQ ID NO: 8521691 - DNA, 22 bp, Homo sapiens
tttacaattggttttctctaat

SEQ ID NO: 8521692 - DNA, 22 bp, Homo sapiens
ctcctggaagcccgccctgctg

SEQ ID NO: 8521693 - DNA, 22 bp, Homo sapiens
ctcctgagctctgaggaagctt

SEQ ID NO: 8521694 - DNA, 22 bp, Homo sapiens
ctcctgagctctgaggaagctt

SEQ ID NO: 8521695 - DNA, 22 bp, Homo sapiens
tttacacataaatgtgtagaca

SEQ ID NO: 8521696 - DNA, 22 bp, Homo sapiens
tttacacagaggacactgggct

SEQ ID NO: 8521697 - DNA, 22 bp, Homo sapiens
tttacacaaaatgttagtagat

SEQ ID NO: 8521698 - DNA, 22 bp, Homo sapiens
tttacacaaaatgttagtagat

SEQ ID NO: 8521699 - DNA, 22 bp, Homo sapiens
tttacacaaaagatagcacacc

SEQ ID NO: 8521700 - DNA, 22 bp, Homo sapiens
tttcaaagttgggaattgtaat

SEQ ID NO: 8521701 - DNA, 22 bp, Homo sapiens
tttcaaagttgggaattgtaat

SEQ ID NO: 8521702 - DNA, 22 bp, Homo sapiens
tttcaaagtcaatatcattacc

SEQ ID NO: 8521703 - DNA, 22 bp, Homo sapiens
tttcaaataccataaacctaat

SEQ ID NO: 8521704 - DNA, 22 bp, Homo sapiens
tttcaaataccataaacctaat

SEQ ID NO: 8521705 - DNA, 22 bp, Homo sapiens
tttcaaataccataaacctaat

SEQ ID NO: 8521706 - DNA, 22 bp, Homo sapiens
tttcaaagttgggaattgtaat

SEQ ID NO: 8521707 - DNA, 22 bp, Homo sapiens
tttcaaataccataaacctaat

SEQ ID NO: 8521708 - DNA, 22 bp, Homo sapiens
tttcaaatagaatctttccaaa

SEQ ID NO: 8521709 - DNA, 22 bp, Homo sapiens
tttcaaatggagtcgtgaaatg

SEQ ID NO: 8521710 - DNA, 22 bp, Homo sapiens
ctcgttgctgaagccaaagtca

SEQ ID NO: 8521711 - DNA, 22 bp, Homo sapiens
ctcgggtaccatgctaggcact

SEQ ID NO: 8521712 - DNA, 22 bp, Homo sapiens
ctccttcctggttagcacctta

SEQ ID NO: 8521713 - DNA, 22 bp, Homo sapiens
ctcgggcttgaggctgtttacc

SEQ ID NO: 8521714 - DNA, 21 bp, Homo sapiens
ctctacattcccagcaactct

SEQ ID NO: 8521715 - DNA, 22 bp, Homo sapiens
ctctacagctgctgcccctggt

SEQ ID NO: 8521716 - DNA, 22 bp, Homo sapiens
ctctaaatccacggtatagttg

SEQ ID NO: 8521717 - DNA, 22 bp, Homo sapiens
ctctaaatccaaataagtgtcc

SEQ ID NO: 8521718 - DNA, 22 bp, Homo sapiens
tttatattacctggaatagctt

SEQ ID NO: 8521719 - DNA, 22 bp, Homo sapiens
ctcctgggctgtcggcgctctg

SEQ ID NO: 8521720 - DNA, 22 bp, Homo sapiens
ctcctgggcttcgaaggctccc

SEQ ID NO: 8521721 - DNA, 22 bp, Homo sapiens
ctcctgtatgttgggcttcaca

SEQ ID NO: 8521722 - DNA, 22 bp, Homo sapiens
tttatatgtttgtacaattaag

SEQ ID NO: 8521723 - DNA, 22 bp, Homo sapiens
tttatattacctggaatagctt

SEQ ID NO: 8521724 - DNA, 22 bp, Homo sapiens
tttatattacctggaatagctt

SEQ ID NO: 8521725 - DNA, 22 bp, Homo sapiens
ctcctgtcaataggctcctggc

SEQ ID NO: 8521726 - DNA, 22 bp, Homo sapiens
ctcctgtcaataggctcctggc

SEQ ID NO: 8521727 - DNA, 22 bp, Homo sapiens
ctcctgtcaataggctcctggc

SEQ ID NO: 8521728 - DNA, 22 bp, Homo sapiens
ctcctgtcaataggctcctggc

SEQ ID NO: 8521729 - DNA, 22 bp, Homo sapiens
ctcctgtcagaagcatcctgag

SEQ ID NO: 8521730 - DNA, 22 bp, Homo sapiens
ctcctgtcagaagcatcctgag

SEQ ID NO: 8521731 - DNA, 22 bp, Homo sapiens
ctcctgtcagaagcatcctgag

SEQ ID NO: 8521732 - DNA, 22 bp, Homo sapiens
tttcaaagtcaatatcattacc

SEQ ID NO: 8521733 - DNA, 22 bp, Homo sapiens
tttcaaagtcaagaaggatact

SEQ ID NO: 8521734 - DNA, 22 bp, Homo sapiens
tttcaaagtcaagaaggatact

SEQ ID NO: 8521735 - DNA, 22 bp, Homo sapiens
ctcctgtggtactcccagggcc

SEQ ID NO: 8521736 - DNA, 22 bp, Homo sapiens
ctcctgtggtcaagggtgggac

SEQ ID NO: 8521737 - DNA, 22 bp, Homo sapiens
ctcctgtggctttctgatttca

SEQ ID NO: 8521738 - DNA, 20 bp, Homo sapiens
ctcctgtgcctctctgggcc

SEQ ID NO: 8521739 - DNA, 20 bp, Homo sapiens
ctcctgtgcctctctgggcc

SEQ ID NO: 8521740 - DNA, 23 bp, Homo sapiens
ctccctggagtttctggaagatg

SEQ ID NO: 8521741 - DNA, 23 bp, Homo sapiens
ctccctggagtttctggaagatg

SEQ ID NO: 8521742 - DNA, 22 bp, Homo sapiens
ctccctggcacagcgagaggtt

SEQ ID NO: 8521743 - DNA, 22 bp, Homo sapiens
ctccctggcacagcgagaggtt

SEQ ID NO: 8521744 - DNA, 22 bp, Homo sapiens
ctccctggcagccgcactcctg

SEQ ID NO: 8521745 - DNA, 22 bp, Homo sapiens
ctccctgggcagatgtggctct

SEQ ID NO: 8521746 - DNA, 22 bp, Homo sapiens
ctccctgggcagatgtggctct

SEQ ID NO: 8521747 - DNA, 22 bp, Homo sapiens
ctccctgggcagatgtggctct

SEQ ID NO: 8521748 - DNA, 22 bp, Homo sapiens
ctccctgggcagatgtggctct

SEQ ID NO: 8521749 - DNA, 22 bp, Homo sapiens
ctccctggctttgtcctgaggc

SEQ ID NO: 8521750 - DNA, 23 bp, Homo sapiens
ctccctggcccttgggagacctg

SEQ ID NO: 8521751 - DNA, 22 bp, Homo sapiens
ctccctggctttgtcctgaggc

SEQ ID NO: 8521752 - DNA, 22 bp, Homo sapiens
ctccctggaggcccagacctgg

SEQ ID NO: 8521753 - DNA, 22 bp, Homo sapiens
ctccctggaggtgagctggcac

SEQ ID NO: 8521754 - DNA, 22 bp, Homo sapiens
ctccctggaggtgagctggcac

SEQ ID NO: 8521755 - DNA, 22 bp, Homo sapiens
ctccctgccctgtgagttggcc

SEQ ID NO: 8521756 - DNA, 22 bp, Homo sapiens
ctccctggaggcccagacctgg

SEQ ID NO: 8521757 - DNA, 22 bp, Homo sapiens
ctccctgcttgtttcccttcag

SEQ ID NO: 8521758 - DNA, 22 bp, Homo sapiens
ctccctgaaattcagatgcctc

SEQ ID NO: 8521759 - DNA, 23 bp, Homo sapiens
ctccctgaacatgacacaccaga

SEQ ID NO: 8521760 - DNA, 22 bp, Homo sapiens
ctccctgacctggattccaggc

SEQ ID NO: 8521761 - DNA, 22 bp, Homo sapiens
ctccctctgtcttgtccagaaa

SEQ ID NO: 8521762 - DNA, 22 bp, Homo sapiens
ctccctctgtcttgtccagaaa

SEQ ID NO: 8521763 - DNA, 22 bp, Homo sapiens
ctccctctgtcttgtccagaaa

SEQ ID NO: 8521764 - DNA, 22 bp, Homo sapiens
ctccctcacacccttgcccaga

SEQ ID NO: 8521765 - DNA, 22 bp, Homo sapiens
ctccctggtgtcccctccagga

SEQ ID NO: 8521766 - DNA, 22 bp, Homo sapiens
ctccctggtgtcccctccagga

SEQ ID NO: 8521767 - DNA, 22 bp, Homo sapiens
ctccctggtgtcccctccagga

SEQ ID NO: 8521768 - DNA, 22 bp, Homo sapiens
ctccctggtctttcccatcatt

SEQ ID NO: 8521769 - DNA, 22 bp, Homo sapiens
ctccctggtgactcccaaagct

SEQ ID NO: 8521770 - DNA, 22 bp, Homo sapiens
ctccctggggctcctcctattt

SEQ ID NO: 8521771 - DNA, 22 bp, Homo sapiens
ctccctgtgtcttcacttggcc

SEQ ID NO: 8521772 - DNA, 22 bp, Homo sapiens
ctcccttcaggagaggctcaca

SEQ ID NO: 8521773 - DNA, 22 bp, Homo sapiens
ctcccttcaggagaggctcaca

SEQ ID NO: 8521774 - DNA, 22 bp, Homo sapiens
ctcccttccaatgactatgctt

SEQ ID NO: 8521775 - DNA, 22 bp, Homo sapiens
ctcccttctgagccttttgtta

SEQ ID NO: 8521776 - DNA, 22 bp, Homo sapiens
ctcccttctgagccttttgtta

SEQ ID NO: 8521777 - DNA, 22 bp, Homo sapiens
ctcccttcaggagaggctcaca

SEQ ID NO: 8521778 - DNA, 22 bp, Homo sapiens
ctccgcagcgggccaatccgga

SEQ ID NO: 8521779 - DNA, 22 bp, Homo sapiens
ctccgaacagtggctccaaggc

SEQ ID NO: 8521780 - DNA, 22 bp, Homo sapiens
ctcctcagctgggaggagtccc

SEQ ID NO: 8521781 - DNA, 21 bp, Homo sapiens
ctcctcaggaccagccacagg

SEQ ID NO: 8521782 - DNA, 22 bp, Homo sapiens
ctcctcagggctggttacatgg

SEQ ID NO: 8521783 - DNA, 22 bp, Homo sapiens
ctcctcagtcaggtctagggtc

SEQ ID NO: 8521784 - DNA, 22 bp, Homo sapiens
ctcctcagtcaggtctagggtc

SEQ ID NO: 8521785 - DNA, 21 bp, Homo sapiens
ctcctcaggaccagccacagg

SEQ ID NO: 8521786 - DNA, 21 bp, Homo sapiens
ctcctcaggaccagccacagg

SEQ ID NO: 8521787 - DNA, 21 bp, Homo sapiens
ctcctcaggaccagccacagg

SEQ ID NO: 8521788 - DNA, 19 bp, Homo sapiens
ctcctcagtcccagaggtc

SEQ ID NO: 8521789 - DNA, 19 bp, Homo sapiens
ctcctcagtcccagaggtc

SEQ ID NO: 8521790 - DNA, 19 bp, Homo sapiens
ctcctcagtcccagaggtc

SEQ ID NO: 8521791 - DNA, 20 bp, Homo sapiens
ctcctcagttccatgggagg

SEQ ID NO: 8521792 - DNA, 20 bp, Homo sapiens
ctcctcagttccatgggagg

SEQ ID NO: 8521793 - DNA, 22 bp, Homo sapiens
ctcctcagtcaggtctagggtc

SEQ ID NO: 8521794 - DNA, 19 bp, Homo sapiens
ctcctcagtcccagaggtc

SEQ ID NO: 8521795 - DNA, 19 bp, Homo sapiens
ctcctcagtcccagaggtc

SEQ ID NO: 8521796 - DNA, 22 bp, Homo sapiens
ctcaggctgccctgacagcccc

SEQ ID NO: 8521797 - DNA, 21 bp, Homo sapiens
ctcaggctggcagcaggctag

SEQ ID NO: 8521798 - DNA, 22 bp, Homo sapiens
ctcaggctctggccatccaagg

SEQ ID NO: 8521799 - DNA, 22 bp, Homo sapiens
ctcaggcttgggaggaggccca

SEQ ID NO: 8521800 - DNA, 22 bp, Homo sapiens
ctcaggctgtctaatggattag

SEQ ID NO: 8521801 - DNA, 22 bp, Homo sapiens
ctcaggctgtgatgtgatggca

SEQ ID NO: 8521802 - DNA, 22 bp, Homo sapiens
ctcccattgcttcaaagatcct

SEQ ID NO: 8521803 - DNA, 22 bp, Homo sapiens
ctccccacacactaggcctgat

SEQ ID NO: 8521804 - DNA, 22 bp, Homo sapiens
ctcccagggccatcgagtcact

SEQ ID NO: 8521805 - DNA, 22 bp, Homo sapiens
ctcccagggccatcgagtcact

SEQ ID NO: 8521806 - DNA, 22 bp, Homo sapiens
ctcccagtgttgttttctgatg

SEQ ID NO: 8521807 - DNA, 22 bp, Homo sapiens
ctccccacgcctggactaagag

SEQ ID NO: 8521808 - DNA, 22 bp, Homo sapiens
ctccccaccttcgcggtccctg

SEQ ID NO: 8521809 - DNA, 22 bp, Homo sapiens
ctccccacacactaggcctgat

SEQ ID NO: 8521810 - DNA, 22 bp, Homo sapiens
ctccccacatttctccctgtct

SEQ ID NO: 8521811 - DNA, 22 bp, Homo sapiens
ttgtttactaagaacctggtca

SEQ ID NO: 8521812 - DNA, 20 bp, Homo sapiens
ttgtttattatgttctgatc

SEQ ID NO: 8521813 - DNA, 22 bp, Homo sapiens
ttgtttatgtgttgtctatggc

SEQ ID NO: 8521814 - DNA, 22 bp, Homo sapiens
ttgtttcagcccagatctttac

SEQ ID NO: 8521815 - DNA, 22 bp, Homo sapiens
ttgtttcagctgtatgctatgt

SEQ ID NO: 8521816 - DNA, 22 bp, Homo sapiens
ctccctcacaaagcattctctt

SEQ ID NO: 8521817 - DNA, 22 bp, Homo sapiens
ttgtttcaaatatttcagaata

SEQ ID NO: 8521818 - DNA, 22 bp, Homo sapiens
ttgtttcaaatatttcagaata

SEQ ID NO: 8521819 - DNA, 22 bp, Homo sapiens
ttgtttaatgcctcatacatct

SEQ ID NO: 8521820 - DNA, 22 bp, Homo sapiens
ttgtttaatgcctcatacatct

SEQ ID NO: 8521821 - DNA, 22 bp, Homo sapiens
ctccccaggttcaggaggtggg

SEQ ID NO: 8521822 - DNA, 22 bp, Homo sapiens
ctccccaggttcaggaggtggg

SEQ ID NO: 8521823 - DNA, 22 bp, Homo sapiens
ctccccagctcgcgggtgacgg

SEQ ID NO: 8521824 - DNA, 22 bp, Homo sapiens
ctccccagctcgcgggtgacgg

SEQ ID NO: 8521825 - DNA, 22 bp, Homo sapiens
ctccccagctcgcgggtgacgg

SEQ ID NO: 8521826 - DNA, 22 bp, Homo sapiens
ctccccagcattctgacttcct

SEQ ID NO: 8521827 - DNA, 22 bp, Homo sapiens
ctccccagcattctgacttcct

SEQ ID NO: 8521828 - DNA, 22 bp, Homo sapiens
ctctggagggaggctgagctgg

SEQ ID NO: 8521829 - DNA, 22 bp, Homo sapiens
ctctggagggaggctgagctgg

SEQ ID NO: 8521830 - DNA, 22 bp, Homo sapiens
ctctggaggcctaaggaagtgg

SEQ ID NO: 8521831 - DNA, 22 bp, Homo sapiens
ctctggaggcctaaggaagtgg

SEQ ID NO: 8521832 - DNA, 22 bp, Homo sapiens
ctctggaggccgttggccctta

SEQ ID NO: 8521833 - DNA, 22 bp, Homo sapiens
ctctggaggcagcaccagccag

SEQ ID NO: 8521834 - DNA, 22 bp, Homo sapiens
ctctggaggccgttggccctta

SEQ ID NO: 8521835 - DNA, 22 bp, Homo sapiens
ctctggaggccgttggccctta

SEQ ID NO: 8521836 - DNA, 21 bp, Homo sapiens
ctctggaggcaagggagagtg

SEQ ID NO: 8521837 - DNA, 21 bp, Homo sapiens
ctctggaggcaagggagagtg

SEQ ID NO: 8521838 - DNA, 21 bp, Homo sapiens
ctctggaggcaagggagagtg

SEQ ID NO: 8521839 - DNA, 21 bp, Homo sapiens
ctctggagtcaagagcttcca

SEQ ID NO: 8521840 - DNA, 21 bp, Homo sapiens
ctctggagtcaagagcttcca

SEQ ID NO: 8521841 - DNA, 22 bp, Homo sapiens
ctctggagtcaggcagccctgg

SEQ ID NO: 8521842 - DNA, 22 bp, Homo sapiens
ctctggaggttgagcccagcaa

SEQ ID NO: 8521843 - DNA, 22 bp, Homo sapiens
ctctggaggttgagcccagcaa

SEQ ID NO: 8521844 - DNA, 22 bp, Homo sapiens
ctctggaggttgagcccagcaa

SEQ ID NO: 8521845 - DNA, 22 bp, Homo sapiens
ctctggaggtcaggtgtggtgg

SEQ ID NO: 8521846 - DNA, 22 bp, Homo sapiens
ctctggagggaggctgagctgg

SEQ ID NO: 8521847 - DNA, 22 bp, Homo sapiens
ctctggaggtggaggttgcagt

SEQ ID NO: 8521848 - DNA, 22 bp, Homo sapiens
tttgaagtgggcattagaacct

SEQ ID NO: 8521849 - DNA, 22 bp, Homo sapiens
tttgaagtggaaaaggatttaa

SEQ ID NO: 8521850 - DNA, 22 bp, Homo sapiens
tttgaagtcagacactgctttg

SEQ ID NO: 8521851 - DNA, 22 bp, Homo sapiens
tttgaagtcaggctttctaccc

SEQ ID NO: 8521852 - DNA, 22 bp, Homo sapiens
tttgaagggcacgacaatagtt

SEQ ID NO: 8521853 - DNA, 18 bp, Homo sapiens
tttgaaggatggcctgga

SEQ ID NO: 8521854 - DNA, 22 bp, Homo sapiens
ctctgcttgtgtcaggcatgct

SEQ ID NO: 8521855 - DNA, 22 bp, Homo sapiens
tttgaagtcaaagattgattcc

SEQ ID NO: 8521856 - DNA, 22 bp, Homo sapiens
tttgaagtgttatttctatcac

SEQ ID NO: 8521857 - DNA, 23 bp, Homo sapiens
tttgaagttgactgccttccaga

SEQ ID NO: 8521858 - DNA, 22 bp, Homo sapiens
tttgaagttcccccatatcaga

SEQ ID NO: 8521859 - DNA, 22 bp, Homo sapiens
tttgaataaacggttaatgttc

SEQ ID NO: 8521860 - DNA, 22 bp, Homo sapiens
tttgaataatcactgggcatta

SEQ ID NO: 8521861 - DNA, 22 bp, Homo sapiens
ctctggaattgacctgggaggg

SEQ ID NO: 8521862 - DNA, 19 bp, Homo sapiens
ctctggagcagacactgga

SEQ ID NO: 8521863 - DNA, 19 bp, Homo sapiens
ctctggagcagacactgga

SEQ ID NO: 8521864 - DNA, 22 bp, Homo sapiens
ctctggagcatttcacctacat

SEQ ID NO: 8521865 - DNA, 22 bp, Homo sapiens
ctctggagcgctgcttcccgcg

SEQ ID NO: 8521866 - DNA, 22 bp, Homo sapiens
ctctggagcatttcacctacat

SEQ ID NO: 8521867 - DNA, 22 bp, Homo sapiens
ctctggagcatttcacctacat

SEQ ID NO: 8521868 - DNA, 22 bp, Homo sapiens
tttcttcttgagtaaccagatt

SEQ ID NO: 8521869 - DNA, 22 bp, Homo sapiens
tttcttcttgagtaaccagatt

SEQ ID NO: 8521870 - DNA, 22 bp, Homo sapiens
tttcttcttaatactggctgct

SEQ ID NO: 8521871 - DNA, 22 bp, Homo sapiens
tttcttcttgatttaaacaggg

SEQ ID NO: 8521872 - DNA, 22 bp, Homo sapiens
tttcttcttgatttaaacaggg

SEQ ID NO: 8521873 - DNA, 22 bp, Homo sapiens
tttcttcttgatttaaacaggg

SEQ ID NO: 8521874 - DNA, 22 bp, Homo sapiens
tttcttcttgatttaaacaggg

SEQ ID NO: 8521875 - DNA, 22 bp, Homo sapiens
tttcttctttcccagtgatggg

SEQ ID NO: 8521876 - DNA, 22 bp, Homo sapiens
tttcttctttcccagtgatggg

SEQ ID NO: 8521877 - DNA, 22 bp, Homo sapiens
tttcttgaccactatgttgata

SEQ ID NO: 8521878 - DNA, 22 bp, Homo sapiens
tttcttgaagtcctaaccctca

SEQ ID NO: 8521879 - DNA, 22 bp, Homo sapiens
tttcttatactatattgtcatc

SEQ ID NO: 8521880 - DNA, 22 bp, Homo sapiens
tttcttagtcctagagtgattt

SEQ ID NO: 8521881 - DNA, 22 bp, Homo sapiens
tttcttatactatattgtcatc

SEQ ID NO: 8521882 - DNA, 22 bp, Homo sapiens
tttcttatattctgtcattgtt

SEQ ID NO: 8521883 - DNA, 22 bp, Homo sapiens
tttcttatattctgtcattgtt

SEQ ID NO: 8521884 - DNA, 22 bp, Homo sapiens
tttcttctgtttgtagttacac

SEQ ID NO: 8521885 - DNA, 22 bp, Homo sapiens
tttcttctgtttgtagttacac

SEQ ID NO: 8521886 - DNA, 22 bp, Homo sapiens
tttcttaggctctaaaatgact

SEQ ID NO: 8521887 - DNA, 22 bp, Homo sapiens
tttcttagggactgtaaaatag

SEQ ID NO: 8521888 - DNA, 21 bp, Homo sapiens
tttcttaggctctaaaatgac

SEQ ID NO: 8521889 - DNA, 21 bp, Homo sapiens
tttcttaggctctaaaatgac

SEQ ID NO: 8521890 - DNA, 19 bp, Homo sapiens
tttcttaggcctttggcct

SEQ ID NO: 8521891 - DNA, 21 bp, Homo sapiens
ctctgctgtctaccagctgtt

SEQ ID NO: 8521892 - DNA, 21 bp, Homo sapiens
ctctgctgtctaccagctgtt

SEQ ID NO: 8521893 - DNA, 22 bp, Homo sapiens
ctctgctgtctcagatgggcca

SEQ ID NO: 8521894 - DNA, 22 bp, Homo sapiens
ctctgctggtagctcattccat

SEQ ID NO: 8521895 - DNA, 22 bp, Homo sapiens
ctctgctggtagctcattccat

SEQ ID NO: 8521896 - DNA, 19 bp, Homo sapiens
ctctgcttggtccatatgc

SEQ ID NO: 8521897 - DNA, 22 bp, Homo sapiens
ctctgcttggaactggacagaa

SEQ ID NO: 8521898 - DNA, 22 bp, Homo sapiens
ctctgcttggaactggacagaa

SEQ ID NO: 8521899 - DNA, 22 bp, Homo sapiens
ctctgctgttcttatgtgtcct

SEQ ID NO: 8521900 - DNA, 22 bp, Homo sapiens
ctctgcttcatccaccactggc

SEQ ID NO: 8521901 - DNA, 22 bp, Homo sapiens
ctctgcttcatccaccactggc

SEQ ID NO: 8521902 - DNA, 22 bp, Homo sapiens
ctctgctgcccaggcctgctag

SEQ ID NO: 8521903 - DNA, 19 bp, Homo sapiens
ctctgcctctggctgtggc

SEQ ID NO: 8521904 - DNA, 19 bp, Homo sapiens
ctctgcctctggctgtggc

SEQ ID NO: 8521905 - DNA, 19 bp, Homo sapiens
ctctgcctctggctgtggc

SEQ ID NO: 8521906 - DNA, 22 bp, Homo sapiens
tttcttgagctaggaacctggg

SEQ ID NO: 8521907 - DNA, 19 bp, Homo sapiens
ctctgcctctggctgtggc

SEQ ID NO: 8521908 - DNA, 22 bp, Homo sapiens
tttcttgattagctgtggctca

SEQ ID NO: 8521909 - DNA, 22 bp, Homo sapiens
tttcttgagtgatgcttagtgt

SEQ ID NO: 8521910 - DNA, 22 bp, Homo sapiens
tttcttgagtgatgcttagtgt

SEQ ID NO: 8521911 - DNA, 20 bp, Homo sapiens
ctctgctgcccgccggctgc

SEQ ID NO: 8521912 - DNA, 22 bp, Homo sapiens
ctctgctgcttgccagtcattg

SEQ ID NO: 8521913 - DNA, 22 bp, Homo sapiens
ctctgctgctttgccagtggaa

SEQ ID NO: 8521914 - DNA, 22 bp, Homo sapiens
ctctgctgggatgtaaagtctt

SEQ ID NO: 8521915 - DNA, 22 bp, Homo sapiens
ctctgaggtcctacagtgaccc

SEQ ID NO: 8521916 - DNA, 22 bp, Homo sapiens
tttctgataattttgtgaaatc

SEQ ID NO: 8521917 - DNA, 22 bp, Homo sapiens
tttctgatattcatttagaaga

SEQ ID NO: 8521918 - DNA, 22 bp, Homo sapiens
tttctgatatactgtagaatcc

SEQ ID NO: 8521919 - DNA, 22 bp, Homo sapiens
tttctgatatactgtagaatcc

SEQ ID NO: 8521920 - DNA, 22 bp, Homo sapiens
tttctgcaacgagtctttgact

SEQ ID NO: 8521921 - DNA, 22 bp, Homo sapiens
tttctgcaagtgtagataccca

SEQ ID NO: 8521922 - DNA, 22 bp, Homo sapiens
tttctgcaaacttccacgtctc

SEQ ID NO: 8521923 - DNA, 22 bp, Homo sapiens
tttctgcatatgtatgtatgga

SEQ ID NO: 8521924 - DNA, 22 bp, Homo sapiens
tttctgcaggtattgcataagt

SEQ ID NO: 8521925 - DNA, 19 bp, Homo sapiens
tttctgcagctcagagaag

SEQ ID NO: 8521926 - DNA, 19 bp, Homo sapiens
tttctgcagcccagcagca

SEQ ID NO: 8521927 - DNA, 22 bp, Homo sapiens
tttctgcagcagactcagtgtg

SEQ ID NO: 8521928 - DNA, 20 bp, Homo sapiens
tttctgcagatgtttacatg

SEQ ID NO: 8521929 - DNA, 22 bp, Homo sapiens
tttctgttgtacttaaactagg

SEQ ID NO: 8521930 - DNA, 19 bp, Homo sapiens
tttctgtttgcttctggtt

SEQ ID NO: 8521931 - DNA, 19 bp, Homo sapiens
tttctgtttgcttctggtt

SEQ ID NO: 8521932 - DNA, 22 bp, Homo sapiens
ctctgagggtctaaggagtcac

SEQ ID NO: 8521933 - DNA, 19 bp, Homo sapiens
ctctgaggattagctgtgg

SEQ ID NO: 8521934 - DNA, 22 bp, Homo sapiens
ctctgaggcttgttctatgtat

SEQ ID NO: 8521935 - DNA, 22 bp, Homo sapiens
ctctgagctgaaacatgagcat

SEQ ID NO: 8521936 - DNA, 22 bp, Homo sapiens
ctctgagctgaaacatgagcat

SEQ ID NO: 8521937 - DNA, 22 bp, Homo sapiens
ctctgagctgaaacatgagcat

SEQ ID NO: 8521938 - DNA, 22 bp, Homo sapiens
ctctgagctgaaacatgagcat

SEQ ID NO: 8521939 - DNA, 22 bp, Homo sapiens
ctctgagctgaaacatgagcat

SEQ ID NO: 8521940 - DNA, 22 bp, Homo sapiens
ctctgagctgaaacatgagcat

SEQ ID NO: 8521941 - DNA, 22 bp, Homo sapiens
ctctgagctgaaacatgagcat

SEQ ID NO: 8521942 - DNA, 22 bp, Homo sapiens
ctctgacagccttcattatgca

SEQ ID NO: 8521943 - DNA, 22 bp, Homo sapiens
ctctgacagccttcattatgca

SEQ ID NO: 8521944 - DNA, 22 bp, Homo sapiens
ctctgagctcctggaagcgtgc

SEQ ID NO: 8521945 - DNA, 22 bp, Homo sapiens
ctctgagctcgtgcagtacttc

SEQ ID NO: 8521946 - DNA, 22 bp, Homo sapiens
ctctctggcccatcctgttgcc

SEQ ID NO: 8521947 - DNA, 22 bp, Homo sapiens
ctctctggcacttcattgctgt

SEQ ID NO: 8521948 - DNA, 22 bp, Homo sapiens
ctctctggcacttcattgctgt

SEQ ID NO: 8521949 - DNA, 22 bp, Homo sapiens
ctctctggcacttcattgctgt

SEQ ID NO: 8521950 - DNA, 22 bp, Homo sapiens
ctctctggcacttcattgctgt

SEQ ID NO: 8521951 - DNA, 22 bp, Homo sapiens
ctctctggatatttgtatgctg

SEQ ID NO: 8521952 - DNA, 22 bp, Homo sapiens
tttctctggcattaggtataaa

SEQ ID NO: 8521953 - DNA, 22 bp, Homo sapiens
tttctctggcctcagtttaaca

SEQ ID NO: 8521954 - DNA, 22 bp, Homo sapiens
ctctctggaagggggagctgat

SEQ ID NO: 8521955 - DNA, 22 bp, Homo sapiens
tttctctgccagttattttcct

SEQ ID NO: 8521956 - DNA, 22 bp, Homo sapiens
tttctctgctgtgttggcagct

SEQ ID NO: 8521957 - DNA, 22 bp, Homo sapiens
tttctctgctgcctgtgtcgat

SEQ ID NO: 8521958 - DNA, 22 bp, Homo sapiens
tttctctgctgcctgtgtcgat

SEQ ID NO: 8521959 - DNA, 22 bp, Homo sapiens
tttctctgagttgttacaaaac

SEQ ID NO: 8521960 - DNA, 22 bp, Homo sapiens
tttctctgcagagccccaagga

SEQ ID NO: 8521961 - DNA, 22 bp, Homo sapiens
ctctctggacttgagtatcagc

SEQ ID NO: 8521962 - DNA, 22 bp, Homo sapiens
ctctctggacttgagtatcagc

SEQ ID NO: 8521963 - DNA, 22 bp, Homo sapiens
ctctctggacttgagtatcagc

SEQ ID NO: 8521964 - DNA, 20 bp, Homo sapiens
ctctctggaaggtgggagcc

SEQ ID NO: 8521965 - DNA, 20 bp, Homo sapiens
ctctctggaaggtgggagcc

SEQ ID NO: 8521966 - DNA, 22 bp, Homo sapiens
tttctctctggccctgattgtc

SEQ ID NO: 8521967 - DNA, 22 bp, Homo sapiens
tttctctcttaaggagtttaaa

SEQ ID NO: 8521968 - DNA, 22 bp, Homo sapiens
tttctctcttaaggagtttaaa

SEQ ID NO: 8521969 - DNA, 23 bp, Homo sapiens
tttctctgagaagcagttctcta

SEQ ID NO: 8521970 - DNA, 22 bp, Homo sapiens
tttctctcttaaggagtttaaa

SEQ ID NO: 8521971 - DNA, 22 bp, Homo sapiens
tttctctctgactgggagctga

SEQ ID NO: 8521972 - DNA, 16 bp, Homo sapiens
tttctctctgctattt

SEQ ID NO: 8521973 - DNA, 22 bp, Homo sapiens
tttctctctatttagacaggta

SEQ ID NO: 8521974 - DNA, 22 bp, Homo sapiens
tttctctctatttagacaggta

SEQ ID NO: 8521975 - DNA, 19 bp, Homo sapiens
tttctctccctcatcccga

SEQ ID NO: 8521976 - DNA, 19 bp, Homo sapiens
tttctctccctcatcccga

SEQ ID NO: 8521977 - DNA, 22 bp, Homo sapiens
tttctctcctccaaaccaaaga

SEQ ID NO: 8521978 - DNA, 22 bp, Homo sapiens
tttctctctacagtactttcat

SEQ ID NO: 8521979 - DNA, 22 bp, Homo sapiens
tttctctctacagtactttcat

SEQ ID NO: 8521980 - DNA, 22 bp, Homo sapiens
tttctctccccaagtggaattg

SEQ ID NO: 8521981 - DNA, 22 bp, Homo sapiens
tttctctcagcctgtagaaact

SEQ ID NO: 8521982 - DNA, 22 bp, Homo sapiens
tttctctcagcctgtagaaact

SEQ ID NO: 8521983 - DNA, 22 bp, Homo sapiens
tttctctccccaagtggaattg

SEQ ID NO: 8521984 - DNA, 22 bp, Homo sapiens
tttctctcagcctgtagaaact

SEQ ID NO: 8521985 - DNA, 22 bp, Homo sapiens
ctctagctgaggtcactgctat

SEQ ID NO: 8521986 - DNA, 22 bp, Homo sapiens
ctctagagtacgggctggcatg

SEQ ID NO: 8521987 - DNA, 22 bp, Homo sapiens
ctctaggctgcccaggagctga

SEQ ID NO: 8521988 - DNA, 22 bp, Homo sapiens
ctctagcttttgataccagtgt

SEQ ID NO: 8521989 - DNA, 22 bp, Homo sapiens
ctctactcttaacacagctagg

SEQ ID NO: 8521990 - DNA, 22 bp, Homo sapiens
tttctcacccaagagttatttt

SEQ ID NO: 8521991 - DNA, 22 bp, Homo sapiens
tttctcacccaagagttatttt

SEQ ID NO: 8521992 - DNA, 22 bp, Homo sapiens
tttctctattaggggctagctt

SEQ ID NO: 8521993 - DNA, 21 bp, Homo sapiens
tttctcaccatggtatggaaa

SEQ ID NO: 8521994 - DNA, 22 bp, Homo sapiens
ctctcaaagtaaggtgtataca

SEQ ID NO: 8521995 - DNA, 22 bp, Homo sapiens
ctctcaaatgtcattcctctat

SEQ ID NO: 8521996 - DNA, 22 bp, Homo sapiens
ctctatttatggcatctttatg

SEQ ID NO: 8521997 - DNA, 22 bp, Homo sapiens
ctctatttatggcatctttatg

SEQ ID NO: 8521998 - DNA, 22 bp, Homo sapiens
ctctatttttcttggctagtgt

SEQ ID NO: 8521999 - DNA, 22 bp, Homo sapiens
ctgagctgtcaggaatggaaag

SEQ ID NO: 8522000 - DNA, 22 bp, Homo sapiens
ctgagctgtgctaagtgaaatg

SEQ ID NO: 8522001 - DNA, 22 bp, Homo sapiens
ctgagctgtggaataaacactg

SEQ ID NO: 8522002 - DNA, 22 bp, Homo sapiens
ctgagctgtggaataaacactg

SEQ ID NO: 8522003 - DNA, 22 bp, Homo sapiens
ctgagctgttactctgtcctcg

SEQ ID NO: 8522004 - DNA, 22 bp, Homo sapiens
ctgagctggtggaagcatgcag

SEQ ID NO: 8522005 - DNA, 22 bp, Homo sapiens
ctgagctggtgtttcagggtca

SEQ ID NO: 8522006 - DNA, 21 bp, Homo sapiens
ctgagctggggtgaaggttgc

SEQ ID NO: 8522007 - DNA, 22 bp, Homo sapiens
ctgagctgggctctcttgaggg

SEQ ID NO: 8522008 - DNA, 22 bp, Homo sapiens
ctgagctggtctatggacttgg

SEQ ID NO: 8522009 - DNA, 22 bp, Homo sapiens
ctgagcttcagtgcactgggag

SEQ ID NO: 8522010 - DNA, 22 bp, Homo sapiens
ctgagcttaaccctgttagcaa

SEQ ID NO: 8522011 - DNA, 22 bp, Homo sapiens
ctgagcttaaccctgttagcaa

SEQ ID NO: 8522012 - DNA, 22 bp, Homo sapiens
ctgagctgtttaatcccagata

SEQ ID NO: 8522013 - DNA, 22 bp, Homo sapiens
ctgagctgttactctgtcctcg

SEQ ID NO: 8522014 - DNA, 22 bp, Homo sapiens
ctgagcttggccaggaatgaat

SEQ ID NO: 8522015 - DNA, 22 bp, Homo sapiens
ctgagcttggcttatctccagc

SEQ ID NO: 8522016 - DNA, 22 bp, Homo sapiens
ctgagcttccagttcctccagg

SEQ ID NO: 8522017 - DNA, 22 bp, Homo sapiens
ctgagcttccagttcctccagg

SEQ ID NO: 8522018 - DNA, 22 bp, Homo sapiens
ctgagcttccagttcctccagg

SEQ ID NO: 8522019 - DNA, 22 bp, Homo sapiens
ctgaggacattgatgaggcaat

SEQ ID NO: 8522020 - DNA, 22 bp, Homo sapiens
ctgaggaagacagcagctgtgt

SEQ ID NO: 8522021 - DNA, 22 bp, Homo sapiens
ctgagggcaccgacagagtgga

SEQ ID NO: 8522022 - DNA, 18 bp, Homo sapiens
ctgagggcaacagaggct

SEQ ID NO: 8522023 - DNA, 18 bp, Homo sapiens
ctgagggcaacagaggct

SEQ ID NO: 8522024 - DNA, 22 bp, Homo sapiens
ctgagggcatgaacattccata

SEQ ID NO: 8522025 - DNA, 22 bp, Homo sapiens
ctgagggccctgaagcttggca

SEQ ID NO: 8522026 - DNA, 22 bp, Homo sapiens
ctgagggccctgaagcttggca

SEQ ID NO: 8522027 - DNA, 22 bp, Homo sapiens
ctgagggcagtgatgaaggtga

SEQ ID NO: 8522028 - DNA, 22 bp, Homo sapiens
ctgaggctgggcatggggtcca

SEQ ID NO: 8522029 - DNA, 18 bp, Homo sapiens
ctgaggctggcaggagcc

SEQ ID NO: 8522030 - DNA, 18 bp, Homo sapiens
ctgaggctggcaggagcc

SEQ ID NO: 8522031 - DNA, 18 bp, Homo sapiens
ctgaggctggcaggagcc

SEQ ID NO: 8522032 - DNA, 22 bp, Homo sapiens
ctgagggagaagtgatctctac

SEQ ID NO: 8522033 - DNA, 22 bp, Homo sapiens
ctgaataattttctgttgtatg

SEQ ID NO: 8522034 - DNA, 22 bp, Homo sapiens
ctgaatatcatttacatttgga

SEQ ID NO: 8522035 - DNA, 22 bp, Homo sapiens
ctgagagatcaagccacaggat

SEQ ID NO: 8522036 - DNA, 22 bp, Homo sapiens
ctgaataattttatagttgctg

SEQ ID NO: 8522037 - DNA, 22 bp, Homo sapiens
ctgagagatcaagccacaggat

SEQ ID NO: 8522038 - DNA, 22 bp, Homo sapiens
ctgagagatcaagccacaggat

SEQ ID NO: 8522039 - DNA, 22 bp, Homo sapiens
ctgagagatcaagccacaggat

SEQ ID NO: 8522040 - DNA, 22 bp, Homo sapiens
ctgagaggcggaggttgcagtg

SEQ ID NO: 8522041 - DNA, 22 bp, Homo sapiens
ctgagagatgatatagcttaat

SEQ ID NO: 8522042 - DNA, 22 bp, Homo sapiens
ctgagagatgatatagcttaat

SEQ ID NO: 8522043 - DNA, 22 bp, Homo sapiens
ctgaataatgttctcttgtatg

SEQ ID NO: 8522044 - DNA, 22 bp, Homo sapiens
ctgaataatattccattatgag

SEQ ID NO: 8522045 - DNA, 22 bp, Homo sapiens
ctgagagtcagtggagtggtgt

SEQ ID NO: 8522046 - DNA, 22 bp, Homo sapiens
ctgagagtattggcaggcttgg

SEQ ID NO: 8522047 - DNA, 22 bp, Homo sapiens
ctgagagtattggcaggcttgg

SEQ ID NO: 8522048 - DNA, 22 bp, Homo sapiens
ctgagagtagctggagaacatt

SEQ ID NO: 8522049 - DNA, 22 bp, Homo sapiens
ctgagagtagctggagaacatt

SEQ ID NO: 8522050 - DNA, 22 bp, Homo sapiens
ctgagaggtaagcagcgcagtg

SEQ ID NO: 8522051 - DNA, 22 bp, Homo sapiens
ctgagaggtaagcagcgcagtg

SEQ ID NO: 8522052 - DNA, 22 bp, Homo sapiens
ctgagaggtaagcagcgcagtg

SEQ ID NO: 8522053 - DNA, 22 bp, Homo sapiens
ctgagccttgatgtcccttgtc

SEQ ID NO: 8522054 - DNA, 22 bp, Homo sapiens
ctgagccttattcaccagccct

SEQ ID NO: 8522055 - DNA, 20 bp, Homo sapiens
ctgagcgtctaagaggtgag

SEQ ID NO: 8522056 - DNA, 22 bp, Homo sapiens
ctgagcgcgggacctgaggctg

SEQ ID NO: 8522057 - DNA, 22 bp, Homo sapiens
ctgagcaccccaggacctgcgc

SEQ ID NO: 8522058 - DNA, 22 bp, Homo sapiens
ctgagcaatttcagctctcact

SEQ ID NO: 8522059 - DNA, 22 bp, Homo sapiens
ctgagctgggcaactcttagat

SEQ ID NO: 8522060 - DNA, 22 bp, Homo sapiens
ctgagctgggagtagagactct

SEQ ID NO: 8522061 - DNA, 22 bp, Homo sapiens
ctgagctgggagtggatagtgg

SEQ ID NO: 8522062 - DNA, 22 bp, Homo sapiens
ctgagctgggagtggatagtgg

SEQ ID NO: 8522063 - DNA, 22 bp, Homo sapiens
ctgagctgggagtagagactct

SEQ ID NO: 8522064 - DNA, 22 bp, Homo sapiens
ctgagctgggagtagagactct

SEQ ID NO: 8522065 - DNA, 22 bp, Homo sapiens
ctgagctgggagcctggcacca

SEQ ID NO: 8522066 - DNA, 22 bp, Homo sapiens
ctgagctgggagcctggcacca

SEQ ID NO: 8522067 - DNA, 22 bp, Homo sapiens
ctgagagtcagtggagtggtgt

SEQ ID NO: 8522068 - DNA, 22 bp, Homo sapiens
ctgagagtgctctttgatgtca

SEQ ID NO: 8522069 - DNA, 20 bp, Homo sapiens
ctgagagtctgtgcttagtc

SEQ ID NO: 8522070 - DNA, 20 bp, Homo sapiens
ctgagagtctgtgcttagtc

SEQ ID NO: 8522071 - DNA, 22 bp, Homo sapiens
ctgagagttaagagatggggct

SEQ ID NO: 8522072 - DNA, 22 bp, Homo sapiens
ctgagatctttatacgaggcac

SEQ ID NO: 8522073 - DNA, 22 bp, Homo sapiens
ctgagatcccaggcagggtggc

SEQ ID NO: 8522074 - DNA, 22 bp, Homo sapiens
ctgagatcccaggcagggtggc

SEQ ID NO: 8522075 - DNA, 22 bp, Homo sapiens
ctgagatggccactgggtctca

SEQ ID NO: 8522076 - DNA, 22 bp, Homo sapiens
ctgagatggagttttgctcttg

SEQ ID NO: 8522077 - DNA, 22 bp, Homo sapiens
ctgagatggagtttcgctcttc

SEQ ID NO: 8522078 - DNA, 22 bp, Homo sapiens
ctgaaacattgcaataacaaag

SEQ ID NO: 8522079 - DNA, 22 bp, Homo sapiens
ctgaaacattgcaataacaaag

SEQ ID NO: 8522080 - DNA, 22 bp, Homo sapiens
ctgaaacattgcaataacaaag

SEQ ID NO: 8522081 - DNA, 22 bp, Homo sapiens
ctgaaagaataagatgtttaca

SEQ ID NO: 8522082 - DNA, 22 bp, Homo sapiens
ctgaaagaataagatgtttaca

SEQ ID NO: 8522083 - DNA, 22 bp, Homo sapiens
ctgaaactttagttctgcaaca

SEQ ID NO: 8522084 - DNA, 22 bp, Homo sapiens
ctgaaactccatgagaaattgc

SEQ ID NO: 8522085 - DNA, 22 bp, Homo sapiens
ctgaaaaatatgttttggagaa

SEQ ID NO: 8522086 - DNA, 22 bp, Homo sapiens
ctgaaaaatatgttttggagaa

SEQ ID NO: 8522087 - DNA, 22 bp, Homo sapiens
ctgaaaaatatgttttggagaa

SEQ ID NO: 8522088 - DNA, 22 bp, Homo sapiens
ctgaaaaacgggatttggctgg

SEQ ID NO: 8522089 - DNA, 22 bp, Homo sapiens
ctgaaaatgttacacaggaaga

SEQ ID NO: 8522090 - DNA, 22 bp, Homo sapiens
ctgaaaagctttgaaccgttaa

SEQ ID NO: 8522091 - DNA, 22 bp, Homo sapiens
ctgaaaatgttagtgatacgaa

SEQ ID NO: 8522092 - DNA, 22 bp, Homo sapiens
ctgaaaagtgtctgttgagtta

SEQ ID NO: 8522093 - DNA, 19 bp, Homo sapiens
ctgaaacacagagagggct

SEQ ID NO: 8522094 - DNA, 22 bp, Homo sapiens
tttttctggataactgtatctc

SEQ ID NO: 8522095 - DNA, 20 bp, Homo sapiens
tttttctgggcttccatagc

SEQ ID NO: 8522096 - DNA, 22 bp, Homo sapiens
tttttctgtctcttacattgca

SEQ ID NO: 8522097 - DNA, 22 bp, Homo sapiens
tttttcttaaatgtgggttggc

SEQ ID NO: 8522098 - DNA, 22 bp, Homo sapiens
tttttcttaaatgtgggttggc

SEQ ID NO: 8522099 - DNA, 22 bp, Homo sapiens
tttttcttgtgctggatctaat

SEQ ID NO: 8522100 - DNA, 22 bp, Homo sapiens
ctgaaaaacgggatttggctgg

SEQ ID NO: 8522101 - DNA, 22 bp, Homo sapiens
ttttttgttgggtagaacggaa

SEQ ID NO: 8522102 - DNA, 22 bp, Homo sapiens
ttttttgttgggtagaacggaa

SEQ ID NO: 8522103 - DNA, 22 bp, Homo sapiens
ctgaagggggtttcactgagct

SEQ ID NO: 8522104 - DNA, 22 bp, Homo sapiens
ctgaagtcatacactgttctga

SEQ ID NO: 8522105 - DNA, 22 bp, Homo sapiens
ctgaagtcagatggcacaaggt

SEQ ID NO: 8522106 - DNA, 22 bp, Homo sapiens
ctgaaggctgaggctgtgttgt

SEQ ID NO: 8522107 - DNA, 19 bp, Homo sapiens
ctgaagtcttttcagctgg

SEQ ID NO: 8522108 - DNA, 22 bp, Homo sapiens
ctgaagttagttatgcctaaaa

SEQ ID NO: 8522109 - DNA, 22 bp, Homo sapiens
ctgaagttattgtacaaatttg

SEQ ID NO: 8522110 - DNA, 22 bp, Homo sapiens
ctgaagttcatacaatggccat

SEQ ID NO: 8522111 - DNA, 22 bp, Homo sapiens
ctgaaagcaaagtaattcttaa

SEQ ID NO: 8522112 - DNA, 22 bp, Homo sapiens
ctgaagatgtctgagatgctca

SEQ ID NO: 8522113 - DNA, 20 bp, Homo sapiens
ctgaaagacgtaacagtgca

SEQ ID NO: 8522114 - DNA, 22 bp, Homo sapiens
ctgaagattcgcctttgtttat

SEQ ID NO: 8522115 - DNA, 22 bp, Homo sapiens
ctgaagatttttggtaatcatg

SEQ ID NO: 8522116 - DNA, 22 bp, Homo sapiens
ctgaaggatgtgtggtgggagt

SEQ ID NO: 8522117 - DNA, 22 bp, Homo sapiens
ctgaaggagcatagtcagtttt

SEQ ID NO: 8522118 - DNA, 22 bp, Homo sapiens
ctgaaggaggtagagtgacata

SEQ ID NO: 8522119 - DNA, 22 bp, Homo sapiens
ctgaaggagaaggccactgttc

SEQ ID NO: 8522120 - DNA, 22 bp, Homo sapiens
tttttctgccattcaaagagga

SEQ ID NO: 8522121 - DNA, 22 bp, Homo sapiens
tttttctgagaatatgagagga

SEQ ID NO: 8522122 - DNA, 22 bp, Homo sapiens
tttttctcttctgtaaagtggt

SEQ ID NO: 8522123 - DNA, 22 bp, Homo sapiens
tttttctctatgccaggggcct

SEQ ID NO: 8522124 - DNA, 22 bp, Homo sapiens
tttttctctaagtagtcccaaa

SEQ ID NO: 8522125 - DNA, 19 bp, Homo sapiens
tttttacaagtaggtgtga

SEQ ID NO: 8522126 - DNA, 19 bp, Homo sapiens
tttttacaagtaggtgtga

SEQ ID NO: 8522127 - DNA, 22 bp, Homo sapiens
ttttctctccaggtggggtgat

SEQ ID NO: 8522128 - DNA, 19 bp, Homo sapiens
ttttctcgtgcttgtctgc

SEQ ID NO: 8522129 - DNA, 22 bp, Homo sapiens
ttttctctacaaaataaccagc

SEQ ID NO: 8522130 - DNA, 22 bp, Homo sapiens
ttttctctatattgtctgtgaa

SEQ ID NO: 8522131 - DNA, 22 bp, Homo sapiens
ttttctccagggaacaaggtga

SEQ ID NO: 8522132 - DNA, 22 bp, Homo sapiens
ttttcctggagatggagttgtt

SEQ ID NO: 8522133 - DNA, 22 bp, Homo sapiens
ttttcctgcctttgctcaggga

SEQ ID NO: 8522134 - DNA, 22 bp, Homo sapiens
ttttcctggggcttctggactc

SEQ ID NO: 8522135 - DNA, 22 bp, Homo sapiens
ttttcctgggctttctgtgtaa

SEQ ID NO: 8522136 - DNA, 23 bp, Homo sapiens
ttttcctgtggagacatgactgg

SEQ ID NO: 8522137 - DNA, 22 bp, Homo sapiens
ttttctcaggtgcttatctaag

SEQ ID NO: 8522138 - DNA, 22 bp, Homo sapiens
ttttctcaggtgcttatctaag

SEQ ID NO: 8522139 - DNA, 22 bp, Homo sapiens
ttttcctgttaaatctgggcac

SEQ ID NO: 8522140 - DNA, 22 bp, Homo sapiens
ttttcctgttaaatctgggcac

SEQ ID NO: 8522141 - DNA, 22 bp, Homo sapiens
ctctggagtgcagcctggtggc

SEQ ID NO: 8522142 - DNA, 22 bp, Homo sapiens
ctctggagtgcagcctggtggc

SEQ ID NO: 8522143 - DNA, 22 bp, Homo sapiens
ctctggagtgcagcctggtggc

SEQ ID NO: 8522144 - DNA, 22 bp, Homo sapiens
ctctggagtcctgtatcactcc

SEQ ID NO: 8522145 - DNA, 22 bp, Homo sapiens
ttttcctctgtatgcgtgagat

SEQ ID NO: 8522146 - DNA, 22 bp, Homo sapiens
ttttcagtttgcactgcagtgc

SEQ ID NO: 8522147 - DNA, 22 bp, Homo sapiens
ctctggagtgcagcctggtggc

SEQ ID NO: 8522148 - DNA, 22 bp, Homo sapiens
ttttcagttccatctctgctct

SEQ ID NO: 8522149 - DNA, 22 bp, Homo sapiens
ttttcagttgtgctctctagtt

SEQ ID NO: 8522150 - DNA, 22 bp, Homo sapiens
ttttcctctgtatttgaaatgc

SEQ ID NO: 8522151 - DNA, 22 bp, Homo sapiens
ttttcctctgttattagtgtga

SEQ ID NO: 8522152 - DNA, 19 bp, Homo sapiens
ttttcctgcctcattgttt

SEQ ID NO: 8522153 - DNA, 22 bp, Homo sapiens
ttttcctgcctgtctctagagg

SEQ ID NO: 8522154 - DNA, 22 bp, Homo sapiens
ctgcagtatgagctacccaggt

SEQ ID NO: 8522155 - DNA, 22 bp, Homo sapiens
ctgcagtcagcttttaagatct

SEQ ID NO: 8522156 - DNA, 22 bp, Homo sapiens
ctgcagtatcttaaaatttgta

SEQ ID NO: 8522157 - DNA, 22 bp, Homo sapiens
ctgcagtatctgctttgggtag

SEQ ID NO: 8522158 - DNA, 22 bp, Homo sapiens
ctgcagtagtttttgactctag

SEQ ID NO: 8522159 - DNA, 22 bp, Homo sapiens
ctgcagtagcagagctgagtag

SEQ ID NO: 8522160 - DNA, 22 bp, Homo sapiens
ctgcagtagcacctgtggcttt

SEQ ID NO: 8522161 - DNA, 22 bp, Homo sapiens
ctgcagtacaagaagcatctct

SEQ ID NO: 8522162 - DNA, 23 bp, Homo sapiens
ctgcagtcgccggcctgggtgcc

SEQ ID NO: 8522163 - DNA, 23 bp, Homo sapiens
ctgcagtcgccggcctgggtgcc

SEQ ID NO: 8522164 - DNA, 20 bp, Homo sapiens
ctgcagtcccctctgaatca

SEQ ID NO: 8522165 - DNA, 22 bp, Homo sapiens
ctgcagtgaggattcttaggtg

SEQ ID NO: 8522166 - DNA, 22 bp, Homo sapiens
ctgcagtgaaatcaggaagcaa

SEQ ID NO: 8522167 - DNA, 22 bp, Homo sapiens
ctgcagtcttccttccttaggc

SEQ ID NO: 8522168 - DNA, 22 bp, Homo sapiens
ctgcagtgcaagcccagatgga

SEQ ID NO: 8522169 - DNA, 22 bp, Homo sapiens
ctgcagtgcctgccactgagcc

SEQ ID NO: 8522170 - DNA, 22 bp, Homo sapiens
ctgcagtgcctgccactgagcc

SEQ ID NO: 8522171 - DNA, 22 bp, Homo sapiens
ctgcagtgcctgccactgagcc

SEQ ID NO: 8522172 - DNA, 22 bp, Homo sapiens
ctgcatatgagaataggagaaa

SEQ ID NO: 8522173 - DNA, 22 bp, Homo sapiens
ctgcatatgagaataggagaaa

SEQ ID NO: 8522174 - DNA, 22 bp, Homo sapiens
ctgcatatcaaattactcctgg

SEQ ID NO: 8522175 - DNA, 22 bp, Homo sapiens
ctgcatatcaaattactcctgg

SEQ ID NO: 8522176 - DNA, 22 bp, Homo sapiens
ctgcatatgatagatgccttgc

SEQ ID NO: 8522177 - DNA, 22 bp, Homo sapiens
ctgcatatgatagatgccttgc

SEQ ID NO: 8522178 - DNA, 22 bp, Homo sapiens
ctgcatatgatagatgccttgc

SEQ ID NO: 8522179 - DNA, 23 bp, Homo sapiens
ctgcatatggaggttagcaactc

SEQ ID NO: 8522180 - DNA, 22 bp, Homo sapiens
ctgcccctggctggtgaagcag

SEQ ID NO: 8522181 - DNA, 22 bp, Homo sapiens
ctgcatcactcttactggcttt

SEQ ID NO: 8522182 - DNA, 22 bp, Homo sapiens
ctgcccctgctcatggctgtcc

SEQ ID NO: 8522183 - DNA, 22 bp, Homo sapiens
ctgcagtgttctggaatgcatt

SEQ ID NO: 8522184 - DNA, 22 bp, Homo sapiens
ctgcagtgttctggaatgcatt

SEQ ID NO: 8522185 - DNA, 22 bp, Homo sapiens
ctgcagttcttctcctcaaggc

SEQ ID NO: 8522186 - DNA, 22 bp, Homo sapiens
ctgcagtttgctaagagacaaa

SEQ ID NO: 8522187 - DNA, 22 bp, Homo sapiens
ctgcagttgggtgacccaatat

SEQ ID NO: 8522188 - DNA, 22 bp, Homo sapiens
ctgcagttggataaagatactt

SEQ ID NO: 8522189 - DNA, 22 bp, Homo sapiens
ctgagggccttctatgctgagc

SEQ ID NO: 8522190 - DNA, 21 bp, Homo sapiens
ctgagggccgcagctgggctc

SEQ ID NO: 8522191 - DNA, 22 bp, Homo sapiens
ctgagggccgggacccagtttc

SEQ ID NO: 8522192 - DNA, 22 bp, Homo sapiens
ctgagggctggagctgaggcct

SEQ ID NO: 8522193 - DNA, 22 bp, Homo sapiens
ctgagggctggagctgaggcct

SEQ ID NO: 8522194 - DNA, 23 bp, Homo sapiens
ctgagggctggtctgaagtctgc

SEQ ID NO: 8522195 - DNA, 22 bp, Homo sapiens
ctgagggctggagctgaggcct

SEQ ID NO: 8522196 - DNA, 22 bp, Homo sapiens
ctgagggccttggctcctgccc

SEQ ID NO: 8522197 - DNA, 22 bp, Homo sapiens
ctgagggccttggctcctgccc

SEQ ID NO: 8522198 - DNA, 22 bp, Homo sapiens
ctgcaggttaggagcactcctt

SEQ ID NO: 8522199 - DNA, 22 bp, Homo sapiens
ctgcagtaacgatcatggtgcc

SEQ ID NO: 8522200 - DNA, 22 bp, Homo sapiens
ctgcagtaaccactgtaggtgt

SEQ ID NO: 8522201 - DNA, 21 bp, Homo sapiens
ctgcaggtgctgccatcaggg

SEQ ID NO: 8522202 - DNA, 22 bp, Homo sapiens
ctgcaggggcctcgagcacagg

SEQ ID NO: 8522203 - DNA, 23 bp, Homo sapiens
ctgaggggaaaagggcttcaggc

SEQ ID NO: 8522204 - DNA, 22 bp, Homo sapiens
ctgcaggggcctcgagcacagg

SEQ ID NO: 8522205 - DNA, 22 bp, Homo sapiens
ctgcaggggcctcgagcacagg

SEQ ID NO: 8522206 - DNA, 22 bp, Homo sapiens
ctgccctgggagtacctgtcct

SEQ ID NO: 8522207 - DNA, 22 bp, Homo sapiens
ctgccctgggatggtctgtgcg

SEQ ID NO: 8522208 - DNA, 22 bp, Homo sapiens
ctgccctgggatggtctgtgcg

SEQ ID NO: 8522209 - DNA, 22 bp, Homo sapiens
ctgccctggcagcctaccatgg

SEQ ID NO: 8522210 - DNA, 22 bp, Homo sapiens
ctgccctgcttgatgacagcga

SEQ ID NO: 8522211 - DNA, 22 bp, Homo sapiens
ctgccctgcttgatgacagcga

SEQ ID NO: 8522212 - DNA, 22 bp, Homo sapiens
ctgcctctataggagtccacca

SEQ ID NO: 8522213 - DNA, 22 bp, Homo sapiens
ctgcctctattcactgaggcag

SEQ ID NO: 8522214 - DNA, 22 bp, Homo sapiens
ctgcctctattcactgaggcag

SEQ ID NO: 8522215 - DNA, 22 bp, Homo sapiens
ctgcctctattcactgaggcag

SEQ ID NO: 8522216 - DNA, 22 bp, Homo sapiens
ctgcctctattcactgaggcag

SEQ ID NO: 8522217 - DNA, 22 bp, Homo sapiens
ctgcctctattcactgaggcag

SEQ ID NO: 8522218 - DNA, 22 bp, Homo sapiens
ctgcctctggcctcaggcccag

SEQ ID NO: 8522219 - DNA, 22 bp, Homo sapiens
ctgcctctggttttggtccctg

SEQ ID NO: 8522220 - DNA, 22 bp, Homo sapiens
ctgcctctgttgggcatggtct

SEQ ID NO: 8522221 - DNA, 22 bp, Homo sapiens
ctgcccctggctggtgaagcag

SEQ ID NO: 8522222 - DNA, 22 bp, Homo sapiens
ctgcccctggtgatggacgcca

SEQ ID NO: 8522223 - DNA, 22 bp, Homo sapiens
ctgccctgagggcctgtgtgtt

SEQ ID NO: 8522224 - DNA, 22 bp, Homo sapiens
ctgccctgagggcctgtgtgtt

SEQ ID NO: 8522225 - DNA, 22 bp, Homo sapiens
ctgccctgagggcctgtgtgtt

SEQ ID NO: 8522226 - DNA, 22 bp, Homo sapiens
ctgccctgcagctccacggact

SEQ ID NO: 8522227 - DNA, 22 bp, Homo sapiens
ctgccctgcagctccacggact

SEQ ID NO: 8522228 - DNA, 23 bp, Homo sapiens
ctgccctgatcttgatctattgt

SEQ ID NO: 8522229 - DNA, 22 bp, Homo sapiens
ctgccctgagtcatgccagatg

SEQ ID NO: 8522230 - DNA, 22 bp, Homo sapiens
ctgccctgagtcatgccagatg

SEQ ID NO: 8522231 - DNA, 22 bp, Homo sapiens
ctgccctgctggagatcacagt

SEQ ID NO: 8522232 - DNA, 22 bp, Homo sapiens
ctgccctgcccaggccttgggc

SEQ ID NO: 8522233 - DNA, 22 bp, Homo sapiens
ctgccctgcctggccagtgtgg

SEQ ID NO: 8522234 - DNA, 20 bp, Homo sapiens
ctgccctgccctgggtcctg

SEQ ID NO: 8522235 - DNA, 22 bp, Homo sapiens
ctgctgccctagacccagtcct

SEQ ID NO: 8522236 - DNA, 20 bp, Homo sapiens
ctgctgccctgtcagcctct

SEQ ID NO: 8522237 - DNA, 20 bp, Homo sapiens
ctgctgccctgtcagcctct

SEQ ID NO: 8522238 - DNA, 22 bp, Homo sapiens
ctgctgccggcgagcctccctt

SEQ ID NO: 8522239 - DNA, 19 bp, Homo sapiens
ctgctgccggagactcgtc

SEQ ID NO: 8522240 - DNA, 22 bp, Homo sapiens
ctgctgccggcgagcctccctt

SEQ ID NO: 8522241 - DNA, 22 bp, Homo sapiens
ctgctgcccctgagctcagcct

SEQ ID NO: 8522242 - DNA, 22 bp, Homo sapiens
ctgctgcccctgagctcagcct

SEQ ID NO: 8522243 - DNA, 22 bp, Homo sapiens
ctgctgccctagacccagtcct

SEQ ID NO: 8522244 - DNA, 22 bp, Homo sapiens
ctgctgagccctggcacaggtg

SEQ ID NO: 8522245 - DNA, 22 bp, Homo sapiens
ctgctgagccctggcacaggtg

SEQ ID NO: 8522246 - DNA, 19 bp, Homo sapiens
ctgctctccttgacttgga

SEQ ID NO: 8522247 - DNA, 19 bp, Homo sapiens
ctgctctccttgacttgga

SEQ ID NO: 8522248 - DNA, 19 bp, Homo sapiens
ctgctctccttgacttgga

SEQ ID NO: 8522249 - DNA, 22 bp, Homo sapiens
ctgctctctgttcccctggatc

SEQ ID NO: 8522250 - DNA, 22 bp, Homo sapiens
ctgctctgaagccaggattctg

SEQ ID NO: 8522251 - DNA, 22 bp, Homo sapiens
ctgctctgaagccaggattctg

SEQ ID NO: 8522252 - DNA, 22 bp, Homo sapiens
ctgctcggcgcgcatggctgcc

SEQ ID NO: 8522253 - DNA, 22 bp, Homo sapiens
ctgctctaactgcattagtttt

SEQ ID NO: 8522254 - DNA, 22 bp, Homo sapiens
ctgctctagagagcattagtca

SEQ ID NO: 8522255 - DNA, 22 bp, Homo sapiens
ctgctctaatatcagatagact

SEQ ID NO: 8522256 - DNA, 22 bp, Homo sapiens
ctgctctaggttcctgcatatg

SEQ ID NO: 8522257 - DNA, 22 bp, Homo sapiens
ctgctgcttttgcgggagaaca

SEQ ID NO: 8522258 - DNA, 22 bp, Homo sapiens
ctgctgcttagcatagcagagg

SEQ ID NO: 8522259 - DNA, 22 bp, Homo sapiens
ctgctgctgagagctcagcctg

SEQ ID NO: 8522260 - DNA, 22 bp, Homo sapiens
ctgctgctgagagctcagcctg

SEQ ID NO: 8522261 - DNA, 22 bp, Homo sapiens
ctgctgctgctatctacccagg

SEQ ID NO: 8522262 - DNA, 22 bp, Homo sapiens
ctgctgctcttgtgcattagtg

SEQ ID NO: 8522263 - DNA, 22 bp, Homo sapiens
ctgctgctcgaccagtcccagg

SEQ ID NO: 8522264 - DNA, 22 bp, Homo sapiens
ctgctgctcagtgtcatcatgt

SEQ ID NO: 8522265 - DNA, 22 bp, Homo sapiens
ctgctgccttccaaaggccagg

SEQ ID NO: 8522266 - DNA, 22 bp, Homo sapiens
ctgctgcctgattgcagacctc

SEQ ID NO: 8522267 - DNA, 22 bp, Homo sapiens
ctgctgcctgattgcagacctc

SEQ ID NO: 8522268 - DNA, 22 bp, Homo sapiens
ctgctgcctgacaatttaggtt

SEQ ID NO: 8522269 - DNA, 22 bp, Homo sapiens
ctgctgcctagtccaagacgtg

SEQ ID NO: 8522270 - DNA, 22 bp, Homo sapiens
ctgctgcctcgacattgggaca

SEQ ID NO: 8522271 - DNA, 22 bp, Homo sapiens
ctgctggcaagcccagttggag

SEQ ID NO: 8522272 - DNA, 22 bp, Homo sapiens
ctgctggcttctagtcattcaa

SEQ ID NO: 8522273 - DNA, 22 bp, Homo sapiens
ctgctgtgagtttggaggtcta

SEQ ID NO: 8522274 - DNA, 22 bp, Homo sapiens
ctgctgtgagtttggaggtcta

SEQ ID NO: 8522275 - DNA, 20 bp, Homo sapiens
ctgctgtgattccctcctcc

SEQ ID NO: 8522276 - DNA, 19 bp, Homo sapiens
ctgctccaggagctgggga

SEQ ID NO: 8522277 - DNA, 22 bp, Homo sapiens
ctgctccaggatttcaggccag

SEQ ID NO: 8522278 - DNA, 22 bp, Homo sapiens
ctgctccagacacctgcagggg

SEQ ID NO: 8522279 - DNA, 20 bp, Homo sapiens
ctgctccacccggctctcag

SEQ ID NO: 8522280 - DNA, 22 bp, Homo sapiens
ctgctccacctccgggtcaggc

SEQ ID NO: 8522281 - DNA, 22 bp, Homo sapiens
ctgctccacacctccatttcct

SEQ ID NO: 8522282 - DNA, 22 bp, Homo sapiens
ctgctccacacctccatttcct

SEQ ID NO: 8522283 - DNA, 22 bp, Homo sapiens
ctgctccacaccgtccatactc

SEQ ID NO: 8522284 - DNA, 22 bp, Homo sapiens
ctgcgtgttcctgaagcgcgct

SEQ ID NO: 8522285 - DNA, 22 bp, Homo sapiens
ctgcctgcgccaccaccacgtc

SEQ ID NO: 8522286 - DNA, 22 bp, Homo sapiens
ctgcgtgtctctgtctcatggc

SEQ ID NO: 8522287 - DNA, 22 bp, Homo sapiens
ctgcgtgtttgcaccctgtctg

SEQ ID NO: 8522288 - DNA, 22 bp, Homo sapiens
ctgctcctccccatcaggcagc

SEQ ID NO: 8522289 - DNA, 22 bp, Homo sapiens
ctgctcctccccatcaggcagc

SEQ ID NO: 8522290 - DNA, 22 bp, Homo sapiens
ctgctcctggtcatcctccact

SEQ ID NO: 8522291 - DNA, 22 bp, Homo sapiens
ctgctcctggtcatcctccact

SEQ ID NO: 8522292 - DNA, 18 bp, Homo sapiens
ctgctccagtctggccag

SEQ ID NO: 8522293 - DNA, 22 bp, Homo sapiens
ctgcctgagtggaggtcgaggg

SEQ ID NO: 8522294 - DNA, 22 bp, Homo sapiens
ctgcctgcactgcctggctcca

SEQ ID NO: 8522295 - DNA, 22 bp, Homo sapiens
ctgcctgcactgcctggctcca

SEQ ID NO: 8522296 - DNA, 22 bp, Homo sapiens
ctgcctgcactgcctggctcca

SEQ ID NO: 8522297 - DNA, 22 bp, Homo sapiens
ctgcctgcaggacacctcgcta

SEQ ID NO: 8522298 - DNA, 22 bp, Homo sapiens
ctgcctcttgacagatcgtggc

SEQ ID NO: 8522299 - DNA, 22 bp, Homo sapiens
ctgcctcttgacagatcgtggc

SEQ ID NO: 8522300 - DNA, 22 bp, Homo sapiens
ctgcctcttgacagatcgtggc

SEQ ID NO: 8522301 - DNA, 22 bp, Homo sapiens
ctgcctctgttgggcatggtct

SEQ ID NO: 8522302 - DNA, 22 bp, Homo sapiens
ctgcctcttaagtggatggagt

SEQ ID NO: 8522303 - DNA, 22 bp, Homo sapiens
ctgcgtgcatgtctgcgtgcat

SEQ ID NO: 8522304 - DNA, 22 bp, Homo sapiens
ctgcggtgggctgggctgtccc

SEQ ID NO: 8522305 - DNA, 22 bp, Homo sapiens
ctgcgtgtctctgtctcatggc

SEQ ID NO: 8522306 - DNA, 22 bp, Homo sapiens
ctgcgtgcattaatatttcctt

SEQ ID NO: 8522307 - DNA, 22 bp, Homo sapiens
ctgcgtgtctccttggggcaga

SEQ ID NO: 8522308 - DNA, 22 bp, Homo sapiens
ctgcctgccttggcctccagga

SEQ ID NO: 8522309 - DNA, 22 bp, Homo sapiens
ctgcctgcgccaccaccacgtc

SEQ ID NO: 8522310 - DNA, 22 bp, Homo sapiens
ctgcctgccttggcctccagga

SEQ ID NO: 8522311 - DNA, 22 bp, Homo sapiens
ctgcctgccttggcctccagga

SEQ ID NO: 8522312 - DNA, 22 bp, Homo sapiens
ctgcctgccttggcctccagga

SEQ ID NO: 8522313 - DNA, 22 bp, Homo sapiens
ctgcctgccttggcctccagga

SEQ ID NO: 8522314 - DNA, 22 bp, Homo sapiens
ctgcctgcatcccacagtgggg

SEQ ID NO: 8522315 - DNA, 22 bp, Homo sapiens
ctgcctgcatcccacagtgggg

SEQ ID NO: 8522316 - DNA, 22 bp, Homo sapiens
ctgcctgcatcccacagtgggg

SEQ ID NO: 8522317 - DNA, 22 bp, Homo sapiens
ctgcctgcaggacacctcgcta

SEQ ID NO: 8522318 - DNA, 22 bp, Homo sapiens
ctgcctgcatcccacagtgggg

SEQ ID NO: 8522319 - DNA, 22 bp, Homo sapiens
ctgcctgccacgttcagctgta

SEQ ID NO: 8522320 - DNA, 22 bp, Homo sapiens
ctgcctgcatgctgccatagct

SEQ ID NO: 8522321 - DNA, 22 bp, Homo sapiens
ctgcctgcatgctgccatagct

SEQ ID NO: 8522322 - DNA, 22 bp, Homo sapiens
ctgcctgcatgctgccatagct

SEQ ID NO: 8522323 - DNA, 22 bp, Homo sapiens
ctgcctgcctggagacagatgg

SEQ ID NO: 8522324 - DNA, 22 bp, Homo sapiens
ctgcctgcctggagacagatgg

SEQ ID NO: 8522325 - DNA, 22 bp, Homo sapiens
ctgcctgccacgttcagctgta

SEQ ID NO: 8522326 - DNA, 22 bp, Homo sapiens
ctgcctgccacgttcagctgta

SEQ ID NO: 8522327 - DNA, 22 bp, Homo sapiens
ctgcctgcctggagacagatgg

SEQ ID NO: 8522328 - DNA, 22 bp, Homo sapiens
gtaatctcagctacttgggagg

SEQ ID NO: 8522329 - DNA, 22 bp, Homo sapiens
gtaatgaatagatggtggcagg

SEQ ID NO: 8522330 - DNA, 22 bp, Homo sapiens
gtaatctgtagtaaagcaccat

SEQ ID NO: 8522331 - DNA, 22 bp, Homo sapiens
gtaatccaaagtaacattaaac

SEQ ID NO: 8522332 - DNA, 22 bp, Homo sapiens
gtaacactagctctgtcacttt

SEQ ID NO: 8522333 - DNA, 22 bp, Homo sapiens
gtaacacagaaatgaaattcca

SEQ ID NO: 8522334 - DNA, 22 bp, Homo sapiens
gtaacaaagtttctaggtgctg

SEQ ID NO: 8522335 - DNA, 22 bp, Homo sapiens
gtaacagagggtttgcagatat

SEQ ID NO: 8522336 - DNA, 22 bp, Homo sapiens
gtaacagaaagtcatgctcatt

SEQ ID NO: 8522337 - DNA, 17 bp, Homo sapiens
gtaaggcttgcagatgc

SEQ ID NO: 8522338 - DNA, 17 bp, Homo sapiens
gtaaggcttgcagatgc

SEQ ID NO: 8522339 - DNA, 22 bp, Homo sapiens
gtaagttttgtataggcatggg

SEQ ID NO: 8522340 - DNA, 19 bp, Homo sapiens
gtaagggctaatggactat

SEQ ID NO: 8522341 - DNA, 22 bp, Homo sapiens
ggtgggcagctcttggcaggca

SEQ ID NO: 8522342 - DNA, 22 bp, Homo sapiens
ggtgggcagctcttggcaggca

SEQ ID NO: 8522343 - DNA, 22 bp, Homo sapiens
ggtgggcagctcttggcaggca

SEQ ID NO: 8522344 - DNA, 22 bp, Homo sapiens
gtaaatattccctcggttccta

SEQ ID NO: 8522345 - DNA, 22 bp, Homo sapiens
gtaaatattccctcggttccta

SEQ ID NO: 8522346 - DNA, 22 bp, Homo sapiens
gtaaatattccctcggttccta

SEQ ID NO: 8522347 - DNA, 22 bp, Homo sapiens
gtaaatattccctcggttccta

SEQ ID NO: 8522348 - DNA, 22 bp, Homo sapiens
ggtgggcacccgagactggatc

SEQ ID NO: 8522349 - DNA, 22 bp, Homo sapiens
ggtgggcacccgagactggatc

SEQ ID NO: 8522350 - DNA, 22 bp, Homo sapiens
ggtgggcagctcttggcaggca

SEQ ID NO: 8522351 - DNA, 22 bp, Homo sapiens
ggtgggcacccgagactggatc

SEQ ID NO: 8522352 - DNA, 22 bp, Homo sapiens
ggtgggcacattcagtctctgt

SEQ ID NO: 8522353 - DNA, 22 bp, Homo sapiens
ggtgggcacattcagtctctgt

SEQ ID NO: 8522354 - DNA, 22 bp, Homo sapiens
gtaaattatttcaagatcatct

SEQ ID NO: 8522355 - DNA, 22 bp, Homo sapiens
gtaacaaaggataacttggttt

SEQ ID NO: 8522356 - DNA, 22 bp, Homo sapiens
gtaacaaacggttccaagatgc

SEQ ID NO: 8522357 - DNA, 22 bp, Homo sapiens
gtaacaaacggttccaagatgc

SEQ ID NO: 8522358 - DNA, 22 bp, Homo sapiens
gtaacaaaggataacttggttt

SEQ ID NO: 8522359 - DNA, 22 bp, Homo sapiens
gtaaatgtgcttcttttaactt

SEQ ID NO: 8522360 - DNA, 22 bp, Homo sapiens
gtaaatgtgcttcttttaactt

SEQ ID NO: 8522361 - DNA, 22 bp, Homo sapiens
gtaaatgtgaatgtcatttagc

SEQ ID NO: 8522362 - DNA, 22 bp, Homo sapiens
gtaaatcatggtcagaataaat

SEQ ID NO: 8522363 - DNA, 22 bp, Homo sapiens
gtaaatcccatcctttctctgg

SEQ ID NO: 8522364 - DNA, 22 bp, Homo sapiens
gtaaatgagtcaaatgggggaa

SEQ ID NO: 8522365 - DNA, 22 bp, Homo sapiens
gtcaataattttatggagagaa

SEQ ID NO: 8522366 - DNA, 22 bp, Homo sapiens
gtcaataattgatagatattgg

SEQ ID NO: 8522367 - DNA, 22 bp, Homo sapiens
gtcaataattgatagatattgg

SEQ ID NO: 8522368 - DNA, 22 bp, Homo sapiens
gtcaagtttatccgctcattca

SEQ ID NO: 8522369 - DNA, 22 bp, Homo sapiens
gtcaagttaagataaggtcatg

SEQ ID NO: 8522370 - DNA, 22 bp, Homo sapiens
gtcaagttaagataaggtcatg

SEQ ID NO: 8522371 - DNA, 22 bp, Homo sapiens
gtcaagtttatccgctcattca

SEQ ID NO: 8522372 - DNA, 22 bp, Homo sapiens
gtcaactgtacctaaagaaagt

SEQ ID NO: 8522373 - DNA, 17 bp, Homo sapiens
gtcaacaggatttcttt

SEQ ID NO: 8522374 - DNA, 22 bp, Homo sapiens
gtcaacataggcctcagtgagg

SEQ ID NO: 8522375 - DNA, 22 bp, Homo sapiens
gtcaactttaagatgatctttt

SEQ ID NO: 8522376 - DNA, 22 bp, Homo sapiens
gtcaagcagaagataatttaaa

SEQ ID NO: 8522377 - DNA, 22 bp, Homo sapiens
gtaggaagctctgaggctagtt

SEQ ID NO: 8522378 - DNA, 22 bp, Homo sapiens
gtaggaaagtaaatgaaataca

SEQ ID NO: 8522379 - DNA, 22 bp, Homo sapiens
gtagcttattagggataatagt

SEQ ID NO: 8522380 - DNA, 22 bp, Homo sapiens
gtagctgatcctgaggacaggg

SEQ ID NO: 8522381 - DNA, 22 bp, Homo sapiens
gtagctctgtttaaagttcttt

SEQ ID NO: 8522382 - DNA, 22 bp, Homo sapiens
gtagctgatattagcaatgagt

SEQ ID NO: 8522383 - DNA, 22 bp, Homo sapiens
gtagctatttatgatactcatg

SEQ ID NO: 8522384 - DNA, 22 bp, Homo sapiens
gtagctctgtttaaagttcttt

SEQ ID NO: 8522385 - DNA, 22 bp, Homo sapiens
gtagcaatgttgaacactgcgt

SEQ ID NO: 8522386 - DNA, 22 bp, Homo sapiens
gtagcagagctgagagtggaac

SEQ ID NO: 8522387 - DNA, 22 bp, Homo sapiens
gtagcagaatcagtgctacaga

SEQ ID NO: 8522388 - DNA, 22 bp, Homo sapiens
gtagcagagggcccaggtaact

SEQ ID NO: 8522389 - DNA, 22 bp, Homo sapiens
gtagcagcagagcaggtcctcc

SEQ ID NO: 8522390 - DNA, 22 bp, Homo sapiens
gtagcccacctggggagggcga

SEQ ID NO: 8522391 - DNA, 22 bp, Homo sapiens
gtagcccacctggggagggcga

SEQ ID NO: 8522392 - DNA, 22 bp, Homo sapiens
gtagccattggcaatgaagcct

SEQ ID NO: 8522393 - DNA, 22 bp, Homo sapiens
gtagcattctgagttcgcagag

SEQ ID NO: 8522394 - DNA, 22 bp, Homo sapiens
gtagcatctgttggctgctcct

SEQ ID NO: 8522395 - DNA, 22 bp, Homo sapiens
gtagcaggtattctggtgtgag

SEQ ID NO: 8522396 - DNA, 22 bp, Homo sapiens
gtagaccatttatctggggagt

SEQ ID NO: 8522397 - DNA, 22 bp, Homo sapiens
gtagaggcagaaactgaaggac

SEQ ID NO: 8522398 - DNA, 22 bp, Homo sapiens
gtagagcaggacttgagatgtt

SEQ ID NO: 8522399 - DNA, 22 bp, Homo sapiens
gtagaggacatttgacatgatg

SEQ ID NO: 8522400 - DNA, 22 bp, Homo sapiens
gtagatctcagactttgaaatt

SEQ ID NO: 8522401 - DNA, 22 bp, Homo sapiens
gtagatctgccttaacctggga

SEQ ID NO: 8522402 - DNA, 22 bp, Homo sapiens
gtagatgagctcacatgacctt

SEQ ID NO: 8522403 - DNA, 22 bp, Homo sapiens
gtagatcatgagaatgtttttg

SEQ ID NO: 8522404 - DNA, 22 bp, Homo sapiens
gtagattccagtggtctgtgtc

SEQ ID NO: 8522405 - DNA, 22 bp, Homo sapiens
gtagatgagctcacatgacctt

SEQ ID NO: 8522406 - DNA, 22 bp, Homo sapiens
gtagagtcaggacggcaattct

SEQ ID NO: 8522407 - DNA, 22 bp, Homo sapiens
gtcctctgagggggctgcacgc

SEQ ID NO: 8522408 - DNA, 22 bp, Homo sapiens
gtcctctgatttctaggtatat

SEQ ID NO: 8522409 - DNA, 22 bp, Homo sapiens
gtcctctgcccaggtcaaggtt

SEQ ID NO: 8522410 - DNA, 22 bp, Homo sapiens
gtcctctgcccaggtcaaggtt

SEQ ID NO: 8522411 - DNA, 22 bp, Homo sapiens
gtcctctgactcagccttggga

SEQ ID NO: 8522412 - DNA, 22 bp, Homo sapiens
gtcctctgagggggctgcacgc

SEQ ID NO: 8522413 - DNA, 22 bp, Homo sapiens
gtcctctgaaagatgaaccatg

SEQ ID NO: 8522414 - DNA, 22 bp, Homo sapiens
gtcctctgaaagatgaaccatg

SEQ ID NO: 8522415 - DNA, 22 bp, Homo sapiens
gtcctctccaggaggctctgat

SEQ ID NO: 8522416 - DNA, 22 bp, Homo sapiens
gtcctctgaagttgtgcaatgc

SEQ ID NO: 8522417 - DNA, 22 bp, Homo sapiens
gtcctctgaagttgtgcaatgc

SEQ ID NO: 8522418 - DNA, 22 bp, Homo sapiens
gtcctctgactcagccttggga

SEQ ID NO: 8522419 - DNA, 22 bp, Homo sapiens
gtcctccatggtcttgaagtaa

SEQ ID NO: 8522420 - DNA, 22 bp, Homo sapiens
gtcctcagtcagtttggtgggg

SEQ ID NO: 8522421 - DNA, 22 bp, Homo sapiens
gtcctctccaggaggctctgat

SEQ ID NO: 8522422 - DNA, 22 bp, Homo sapiens
gtctcctcttcatatacctgtt

SEQ ID NO: 8522423 - DNA, 22 bp, Homo sapiens
gtctcctccatggagatggtat

SEQ ID NO: 8522424 - DNA, 23 bp, Homo sapiens
gtctcccatagcgctcccaggct

SEQ ID NO: 8522425 - DNA, 22 bp, Homo sapiens
gtctcccatcgtttgtgaggaa

SEQ ID NO: 8522426 - DNA, 22 bp, Homo sapiens
gtcctcaggaaggctttctgac

SEQ ID NO: 8522427 - DNA, 22 bp, Homo sapiens
gtcctcaggaaagcagataaca

SEQ ID NO: 8522428 - DNA, 22 bp, Homo sapiens
gtcctcagtaagagggcctctg

SEQ ID NO: 8522429 - DNA, 22 bp, Homo sapiens
gtcctcagggaatgtggcgggt

SEQ ID NO: 8522430 - DNA, 22 bp, Homo sapiens
gtcctcaggcttgagtgtttat

SEQ ID NO: 8522431 - DNA, 22 bp, Homo sapiens
gtcctcagcaccagaactaggg

SEQ ID NO: 8522432 - DNA, 22 bp, Homo sapiens
gtcctcagaagcctgcttagct

SEQ ID NO: 8522433 - DNA, 23 bp, Homo sapiens
gtcctattttttgaaatactgag

SEQ ID NO: 8522434 - DNA, 22 bp, Homo sapiens
gtcctcagagtgggcaggtcct

SEQ ID NO: 8522435 - DNA, 22 bp, Homo sapiens
gtcatttatcttcagaatttct

SEQ ID NO: 8522436 - DNA, 22 bp, Homo sapiens
gtcatttctgtttcttcagtgc

SEQ ID NO: 8522437 - DNA, 22 bp, Homo sapiens
gtcatttatcatcagaagtcat

SEQ ID NO: 8522438 - DNA, 22 bp, Homo sapiens
gtcatttaaagaccattgtggg

SEQ ID NO: 8522439 - DNA, 22 bp, Homo sapiens
gtcattgattttcagtttgtcc

SEQ ID NO: 8522440 - DNA, 22 bp, Homo sapiens
gtcattgactagaattccaaag

SEQ ID NO: 8522441 - DNA, 22 bp, Homo sapiens
gtcattgagtcgtcagagtctt

SEQ ID NO: 8522442 - DNA, 22 bp, Homo sapiens
gtcattgagtcgtcagagtctt

SEQ ID NO: 8522443 - DNA, 22 bp, Homo sapiens
gtccctggagctgagcagtgct

SEQ ID NO: 8522444 - DNA, 22 bp, Homo sapiens
gtccctggagctgagcagtgct

SEQ ID NO: 8522445 - DNA, 22 bp, Homo sapiens
gtcctattagcatattgaatac

SEQ ID NO: 8522446 - DNA, 22 bp, Homo sapiens
gtccctggatctgggacagctg

SEQ ID NO: 8522447 - DNA, 22 bp, Homo sapiens
gtcattttatgggaacagattt

SEQ ID NO: 8522448 - DNA, 22 bp, Homo sapiens
gtcattttatgggaacagattt

SEQ ID NO: 8522449 - DNA, 22 bp, Homo sapiens
gtcaggtcttggaagataggct

SEQ ID NO: 8522450 - DNA, 22 bp, Homo sapiens
gtcaggggatgtgctggtggcc

SEQ ID NO: 8522451 - DNA, 22 bp, Homo sapiens
gtcaggggatgtgctggtggcc

SEQ ID NO: 8522452 - DNA, 22 bp, Homo sapiens
gtcaggggccatgggccaagga

SEQ ID NO: 8522453 - DNA, 23 bp, Homo sapiens
gtcagggctggggtcagagtgac

SEQ ID NO: 8522454 - DNA, 23 bp, Homo sapiens
gtcagggctggggtcagagtgac

SEQ ID NO: 8522455 - DNA, 20 bp, Homo sapiens
gtcagtgtcttcagtagtga

SEQ ID NO: 8522456 - DNA, 22 bp, Homo sapiens
gtcagtgtcttaacagagatta

SEQ ID NO: 8522457 - DNA, 22 bp, Homo sapiens
gtcattcaaactgtatcacttg

SEQ ID NO: 8522458 - DNA, 22 bp, Homo sapiens
gtcattcagagatgcaggtaga

SEQ ID NO: 8522459 - DNA, 22 bp, Homo sapiens
gtcattcaaactgtatcacttg

SEQ ID NO: 8522460 - DNA, 22 bp, Homo sapiens
gtcattcctatccatttgatac

SEQ ID NO: 8522461 - DNA, 17 bp, Homo sapiens
gtcattctcagaaaatg

SEQ ID NO: 8522462 - DNA, 22 bp, Homo sapiens
gtcagtgtgagataatcttgga

SEQ ID NO: 8522463 - DNA, 22 bp, Homo sapiens
gtcagtgtgagataatcttgga

SEQ ID NO: 8522464 - DNA, 22 bp, Homo sapiens
gtcagtgtgagttgattccata

SEQ ID NO: 8522465 - DNA, 22 bp, Homo sapiens
gtcagttcattagcacttccaa

SEQ ID NO: 8522466 - DNA, 21 bp, Homo sapiens
gtcagggattcaagtgctcac

SEQ ID NO: 8522467 - DNA, 22 bp, Homo sapiens
gtcagggcacagtgacagctcc

SEQ ID NO: 8522468 - DNA, 22 bp, Homo sapiens
gtcaccagtgctaagaggtgga

SEQ ID NO: 8522469 - DNA, 22 bp, Homo sapiens
gtcaccagtcccagctcctgaa

SEQ ID NO: 8522470 - DNA, 22 bp, Homo sapiens
gtcaccagcaccaatgccacat

SEQ ID NO: 8522471 - DNA, 22 bp, Homo sapiens
gtcaccaggtctgatgcagcca

SEQ ID NO: 8522472 - DNA, 22 bp, Homo sapiens
gtcaccaggtctgatgcagcca

SEQ ID NO: 8522473 - DNA, 22 bp, Homo sapiens
gtcacatgccagtgcacacagg

SEQ ID NO: 8522474 - DNA, 22 bp, Homo sapiens
gtcacattcatgcagaatcaaa

SEQ ID NO: 8522475 - DNA, 22 bp, Homo sapiens
gtcacagtgtatctcttcagct

SEQ ID NO: 8522476 - DNA, 22 bp, Homo sapiens
gtcacagtggggtcacagtgtg

SEQ ID NO: 8522477 - DNA, 22 bp, Homo sapiens
gtcaataattgatagatattgg

SEQ ID NO: 8522478 - DNA, 22 bp, Homo sapiens
gtcacaaagcgcggtggtcggt

SEQ ID NO: 8522479 - DNA, 22 bp, Homo sapiens
gtcacaaaggtgagggacatga

SEQ ID NO: 8522480 - DNA, 22 bp, Homo sapiens
gtcacaaaggtgagggacatga

SEQ ID NO: 8522481 - DNA, 22 bp, Homo sapiens
gtcacaaatcccctcagcaact

SEQ ID NO: 8522482 - DNA, 22 bp, Homo sapiens
gtcacaaatcccctcagcaact

SEQ ID NO: 8522483 - DNA, 22 bp, Homo sapiens
gtcacaggtgtggaggtgctgg

SEQ ID NO: 8522484 - DNA, 22 bp, Homo sapiens
gtgcaattttgcatctgtatgc

SEQ ID NO: 8522485 - DNA, 22 bp, Homo sapiens
gtgcacacaagcaatgcactta

SEQ ID NO: 8522486 - DNA, 22 bp, Homo sapiens
gtgcacactcttggggcacttt

SEQ ID NO: 8522487 - DNA, 22 bp, Homo sapiens
gtgcaaccatcaccactgactc

SEQ ID NO: 8522488 - DNA, 22 bp, Homo sapiens
gtgcaagaaggggagactgggt

SEQ ID NO: 8522489 - DNA, 22 bp, Homo sapiens
gtgcaaattccactggaaagct

SEQ ID NO: 8522490 - DNA, 22 bp, Homo sapiens
gtgcaatattgccatgttcttg

SEQ ID NO: 8522491 - DNA, 22 bp, Homo sapiens
gtgccctgatgcaattgtctca

SEQ ID NO: 8522492 - DNA, 22 bp, Homo sapiens
gtgccctgagtgggtaggagag

SEQ ID NO: 8522493 - DNA, 22 bp, Homo sapiens
gtgccctgagtgggtaggagag

SEQ ID NO: 8522494 - DNA, 22 bp, Homo sapiens
gtgccctgcatgccccgggtat

SEQ ID NO: 8522495 - DNA, 22 bp, Homo sapiens
gtgccctggaggggttgaaggg

SEQ ID NO: 8522496 - DNA, 22 bp, Homo sapiens
gtgccctgagcttatgcattct

SEQ ID NO: 8522497 - DNA, 22 bp, Homo sapiens
gtgcacagaaattggtaagact

SEQ ID NO: 8522498 - DNA, 22 bp, Homo sapiens
gtgcacagaaacatacaatgtg

SEQ ID NO: 8522499 - DNA, 22 bp, Homo sapiens
gtgcaaaaggcattgtggtttt

SEQ ID NO: 8522500 - DNA, 22 bp, Homo sapiens
gtgcaaaagcagttgtggtttt

SEQ ID NO: 8522501 - DNA, 22 bp, Homo sapiens
gtgcaaaagtaactgtggtttt

SEQ ID NO: 8522502 - DNA, 22 bp, Homo sapiens
gtgcaaaagtaaatgtggtttt

SEQ ID NO: 8522503 - DNA, 22 bp, Homo sapiens
gtgcaaaagcagttggattttt

SEQ ID NO: 8522504 - DNA, 22 bp, Homo sapiens
gtgcaaaagcaattgcagtttt

SEQ ID NO: 8522505 - DNA, 22 bp, Homo sapiens
gtgcaaaagcaattgcagtttt

SEQ ID NO: 8522506 - DNA, 22 bp, Homo sapiens
gtgcaaaaataattgtggtttt

SEQ ID NO: 8522507 - DNA, 22 bp, Homo sapiens
gtgattttgagacctatatagt

SEQ ID NO: 8522508 - DNA, 22 bp, Homo sapiens
gtgattttgagacctatatagt

SEQ ID NO: 8522509 - DNA, 22 bp, Homo sapiens
gtgattttgagacctatatagt

SEQ ID NO: 8522510 - DNA, 22 bp, Homo sapiens
gtgattttctcctcctagaagt

SEQ ID NO: 8522511 - DNA, 22 bp, Homo sapiens
gtgattaatgccaatgggcctt

SEQ ID NO: 8522512 - DNA, 22 bp, Homo sapiens
gtgattaagcatttcagaattt

SEQ ID NO: 8522513 - DNA, 23 bp, Homo sapiens
gtgatttcagggaacagaatcag

SEQ ID NO: 8522514 - DNA, 22 bp, Homo sapiens
gtgatttcaaatatagagtgag

SEQ ID NO: 8522515 - DNA, 22 bp, Homo sapiens
gtgatttctaatcatctgaatg

SEQ ID NO: 8522516 - DNA, 22 bp, Homo sapiens
gtgccctggtccccagcatata

SEQ ID NO: 8522517 - DNA, 22 bp, Homo sapiens
gtgccctggtccccagcatata

SEQ ID NO: 8522518 - DNA, 22 bp, Homo sapiens
gtgccctggctcacagtgtctc

SEQ ID NO: 8522519 - DNA, 22 bp, Homo sapiens
gtgccctgtctcttgtctccag

SEQ ID NO: 8522520 - DNA, 22 bp, Homo sapiens
gtgccctgtctcttgtctccag

SEQ ID NO: 8522521 - DNA, 22 bp, Homo sapiens
gtgcctctgagctctgctacag

SEQ ID NO: 8522522 - DNA, 22 bp, Homo sapiens
gtgcctctcattggctgagccc

SEQ ID NO: 8522523 - DNA, 22 bp, Homo sapiens
gtgcctctcattggctgagccc

SEQ ID NO: 8522524 - DNA, 22 bp, Homo sapiens
gtgcctcccgggaccatgcact

SEQ ID NO: 8522525 - DNA, 22 bp, Homo sapiens
gtgcctccatcagtgcctccaa

SEQ ID NO: 8522526 - DNA, 22 bp, Homo sapiens
gtgccgtgggccttagtgatct

SEQ ID NO: 8522527 - DNA, 22 bp, Homo sapiens
gtgcctcagcaccgcctgcagc

SEQ ID NO: 8522528 - DNA, 22 bp, Homo sapiens
gtgcctcagcaccgcctgcagc

SEQ ID NO: 8522529 - DNA, 22 bp, Homo sapiens
gtgcctcagcaccgcctgcagc

SEQ ID NO: 8522530 - DNA, 22 bp, Homo sapiens
gtgctgtcattagcatctagag

SEQ ID NO: 8522531 - DNA, 22 bp, Homo sapiens
gtgctgtatcagaatctgctct

SEQ ID NO: 8522532 - DNA, 22 bp, Homo sapiens
gtgcttctttctcctcaagcct

SEQ ID NO: 8522533 - DNA, 23 bp, Homo sapiens
gtgcttgaaagatgcagaattaa

SEQ ID NO: 8522534 - DNA, 23 bp, Homo sapiens
gtgctgtgagccccttggcctcc

SEQ ID NO: 8522535 - DNA, 22 bp, Homo sapiens
gtgcttgggggaagtaacagac

SEQ ID NO: 8522536 - DNA, 22 bp, Homo sapiens
gtgcttggaccaggtcatcttc

SEQ ID NO: 8522537 - DNA, 22 bp, Homo sapiens
gtgctgtaacaacagagtgtct

SEQ ID NO: 8522538 - DNA, 22 bp, Homo sapiens
gtgctgtaacaacagagtgtct

SEQ ID NO: 8522539 - DNA, 22 bp, Homo sapiens
gtgctgtacttctgtgttgaag

SEQ ID NO: 8522540 - DNA, 22 bp, Homo sapiens
gtgctgggtgctgcagacaggt

SEQ ID NO: 8522541 - DNA, 22 bp, Homo sapiens
gtgctgggggtttctgtaggtc

SEQ ID NO: 8522542 - DNA, 22 bp, Homo sapiens
gtgctgggggtttctgtaggtc

SEQ ID NO: 8522543 - DNA, 22 bp, Homo sapiens
gtgctgggccctgagaccaggg

SEQ ID NO: 8522544 - DNA, 23 bp, Homo sapiens
gtgagtcttgcctttgctgtgga

SEQ ID NO: 8522545 - DNA, 22 bp, Homo sapiens
gtgagtctgtggaccgggcact

SEQ ID NO: 8522546 - DNA, 22 bp, Homo sapiens
gtgagtgtcagtcaaaggtttt

SEQ ID NO: 8522547 - DNA, 23 bp, Homo sapiens
gtgagtcttgcctttgctgtgga

SEQ ID NO: 8522548 - DNA, 22 bp, Homo sapiens
gtgagtctgcctagcacatcac

SEQ ID NO: 8522549 - DNA, 22 bp, Homo sapiens
gtgataaaattcaaatagctct

SEQ ID NO: 8522550 - DNA, 22 bp, Homo sapiens
gtgataaaatagaaacagtggt

SEQ ID NO: 8522551 - DNA, 22 bp, Homo sapiens
gtgataaaggggaggaagtgtg

SEQ ID NO: 8522552 - DNA, 22 bp, Homo sapiens
gtgataaaggggaggaagtgtg

SEQ ID NO: 8522553 - DNA, 22 bp, Homo sapiens
gtgagtgtcagtcaaaggtttt

SEQ ID NO: 8522554 - DNA, 22 bp, Homo sapiens
gtgagtgttaacccactgcttc

SEQ ID NO: 8522555 - DNA, 22 bp, Homo sapiens
gtgagtgttaacccactgcttc

SEQ ID NO: 8522556 - DNA, 22 bp, Homo sapiens
gtgagtgttaacccactgcttc

SEQ ID NO: 8522557 - DNA, 22 bp, Homo sapiens
gtgataaaatagaaacagtggt

SEQ ID NO: 8522558 - DNA, 22 bp, Homo sapiens
gtgataagacagtaggcacaag

SEQ ID NO: 8522559 - DNA, 22 bp, Homo sapiens
gtgataattgcagagaaaggag

SEQ ID NO: 8522560 - DNA, 23 bp, Homo sapiens
gtgatattaaggatagagacaag

SEQ ID NO: 8522561 - DNA, 22 bp, Homo sapiens
gtgatctgccagcctcagcctc

SEQ ID NO: 8522562 - DNA, 22 bp, Homo sapiens
gtgatatttcaagagtggggca

SEQ ID NO: 8522563 - DNA, 22 bp, Homo sapiens
gtgatgggtaactgtttaggga

SEQ ID NO: 8522564 - DNA, 22 bp, Homo sapiens
gtgatggagtcaaggctagaac

SEQ ID NO: 8522565 - DNA, 22 bp, Homo sapiens
gtgatgtggggaccgtcctggc

SEQ ID NO: 8522566 - DNA, 22 bp, Homo sapiens
gtgatgtcagcaagaataggaa

SEQ ID NO: 8522567 - DNA, 22 bp, Homo sapiens
gtcttctgtaagatgaggtccc

SEQ ID NO: 8522568 - DNA, 22 bp, Homo sapiens
gtcttctggaagagagccagct

SEQ ID NO: 8522569 - DNA, 22 bp, Homo sapiens
gtcttctgtaagatgaggtccc

SEQ ID NO: 8522570 - DNA, 22 bp, Homo sapiens
gtcttctgtctgtctggcatgt

SEQ ID NO: 8522571 - DNA, 22 bp, Homo sapiens
gtcttctgtctgtctggcatgt

SEQ ID NO: 8522572 - DNA, 22 bp, Homo sapiens
gtcttctgttctgtgaggcttc

SEQ ID NO: 8522573 - DNA, 22 bp, Homo sapiens
gtcttctgttctgtgaggcttc

SEQ ID NO: 8522574 - DNA, 22 bp, Homo sapiens
gtcttctgttctgtgaggcttc

SEQ ID NO: 8522575 - DNA, 22 bp, Homo sapiens
gtcttgaaaagtggccagtttg

SEQ ID NO: 8522576 - DNA, 22 bp, Homo sapiens
gtcttcttttcagtctgcttgt

SEQ ID NO: 8522577 - DNA, 22 bp, Homo sapiens
gtcttcttttcagtctgcttgt

SEQ ID NO: 8522578 - DNA, 22 bp, Homo sapiens
gtgaggtcatatagcgaactcc

SEQ ID NO: 8522579 - DNA, 22 bp, Homo sapiens
gtgaggtcaccggccgttgcca

SEQ ID NO: 8522580 - DNA, 22 bp, Homo sapiens
gtgaggtcctaatagacatcga

SEQ ID NO: 8522581 - DNA, 22 bp, Homo sapiens
gtgaggtccatgttaatgggtt

SEQ ID NO: 8522582 - DNA, 22 bp, Homo sapiens
gtgaggtccagtaacttgtcca

SEQ ID NO: 8522583 - DNA, 22 bp, Homo sapiens
gtgaggccgcacgccccggagt

SEQ ID NO: 8522584 - DNA, 22 bp, Homo sapiens
gtgaggtgactagcaggtgggg

SEQ ID NO: 8522585 - DNA, 22 bp, Homo sapiens
gtgaggtctttgggaggtgatt

SEQ ID NO: 8522586 - DNA, 19 bp, Homo sapiens
gtgaggtctttccttttgt

SEQ ID NO: 8522587 - DNA, 22 bp, Homo sapiens
gtgaggtcctgagaggcttgtg

SEQ ID NO: 8522588 - DNA, 22 bp, Homo sapiens
gtgaggtcctccctgctgggag

SEQ ID NO: 8522589 - DNA, 22 bp, Homo sapiens
gtcttatttaaggacaagaaga

SEQ ID NO: 8522590 - DNA, 20 bp, Homo sapiens
gtcttatttaacacatgact

SEQ ID NO: 8522591 - DNA, 20 bp, Homo sapiens
gtcttatttaacacatgact

SEQ ID NO: 8522592 - DNA, 20 bp, Homo sapiens
gtcttatttaacacatgact

SEQ ID NO: 8522593 - DNA, 22 bp, Homo sapiens
gtcttcaacaataactaccact

SEQ ID NO: 8522594 - DNA, 22 bp, Homo sapiens
gtcttcaattgcatttgatggg

SEQ ID NO: 8522595 - DNA, 22 bp, Homo sapiens
gtcttcaattgcatttgatggg

SEQ ID NO: 8522596 - DNA, 22 bp, Homo sapiens
gtcttcctaatttgctattagg

SEQ ID NO: 8522597 - DNA, 22 bp, Homo sapiens
gtcttcagtggcaaatggatct

SEQ ID NO: 8522598 - DNA, 22 bp, Homo sapiens
gtcttctgatctggttagccat

SEQ ID NO: 8522599 - DNA, 19 bp, Homo sapiens
gtcttctgaatgtggctgc

SEQ ID NO: 8522600 - DNA, 22 bp, Homo sapiens
gtcttcctaatttgctattagg

SEQ ID NO: 8522601 - DNA, 22 bp, Homo sapiens
gtcttctaagtatcaaagcaga

SEQ ID NO: 8522602 - DNA, 22 bp, Homo sapiens
gtcttattatgaggttagactt

SEQ ID NO: 8522603 - DNA, 22 bp, Homo sapiens
gtcttatttaaagagatcatac

SEQ ID NO: 8522604 - DNA, 22 bp, Homo sapiens
gtcttattgcgtatgtatacaa

SEQ ID NO: 8522605 - DNA, 22 bp, Homo sapiens
gtctgggtttcatgggcactgg

SEQ ID NO: 8522606 - DNA, 22 bp, Homo sapiens
gtctggtattcaattattattt

SEQ ID NO: 8522607 - DNA, 22 bp, Homo sapiens
gtctgggtggctgctttcagct

SEQ ID NO: 8522608 - DNA, 22 bp, Homo sapiens
gtctgggtctccacagtcagca

SEQ ID NO: 8522609 - DNA, 22 bp, Homo sapiens
gtctggggtgaggcccgggatt

SEQ ID NO: 8522610 - DNA, 22 bp, Homo sapiens
gtctcctgctagcaagcaccac

SEQ ID NO: 8522611 - DNA, 22 bp, Homo sapiens
gtctcctgcccccggtgcttgg

SEQ ID NO: 8522612 - DNA, 22 bp, Homo sapiens
gtctcctgcccccggtgcttgg

SEQ ID NO: 8522613 - DNA, 22 bp, Homo sapiens
gtctcctgagactgcagtcacc

SEQ ID NO: 8522614 - DNA, 20 bp, Homo sapiens
gtctcctctttgcattccta

SEQ ID NO: 8522615 - DNA, 22 bp, Homo sapiens
gtctcctgagccttgactgcaa

SEQ ID NO: 8522616 - DNA, 22 bp, Homo sapiens
gtctcctgagccttgactgcaa

SEQ ID NO: 8522617 - DNA, 22 bp, Homo sapiens
gtctcctgaggcatccattgaa

SEQ ID NO: 8522618 - DNA, 22 bp, Homo sapiens
gtctggggtactttcatctgat

SEQ ID NO: 8522619 - DNA, 22 bp, Homo sapiens
gtctctctgctaggcctccagt

SEQ ID NO: 8522620 - DNA, 22 bp, Homo sapiens
gtctctctgactggtccacacc

SEQ ID NO: 8522621 - DNA, 22 bp, Homo sapiens
gtctctctcccaagattggcta

SEQ ID NO: 8522622 - DNA, 22 bp, Homo sapiens
gtctctatcatagctgaaccct

SEQ ID NO: 8522623 - DNA, 22 bp, Homo sapiens
gtctccttgtggatctcaagga

SEQ ID NO: 8522624 - DNA, 22 bp, Homo sapiens
gtctcctgtcctgcaggatgga

SEQ ID NO: 8522625 - DNA, 22 bp, Homo sapiens
ggtcagggttccaggtatcttc

SEQ ID NO: 8522626 - DNA, 22 bp, Homo sapiens
ggtcagggttccaggtatcttc

SEQ ID NO: 8522627 - DNA, 22 bp, Homo sapiens
ggtcagggttccaggtatcttc

SEQ ID NO: 8522628 - DNA, 23 bp, Homo sapiens
ggtccaggaaaggcagcagcacc

SEQ ID NO: 8522629 - DNA, 22 bp, Homo sapiens
ggtcagggggatctgtgaggta

SEQ ID NO: 8522630 - DNA, 22 bp, Homo sapiens
ggtcagggggatctgtgaggta

SEQ ID NO: 8522631 - DNA, 22 bp, Homo sapiens
ggtcagggggatctgtgaggta

SEQ ID NO: 8522632 - DNA, 22 bp, Homo sapiens
ggtcagggggatctgtgaggta

SEQ ID NO: 8522633 - DNA, 22 bp, Homo sapiens
ggtcagggtataatcaagtgag

SEQ ID NO: 8522634 - DNA, 22 bp, Homo sapiens
ggtcagggtataatcaagtgag

SEQ ID NO: 8522635 - DNA, 21 bp, Homo sapiens
ggtcagggggtgcctccaggt

SEQ ID NO: 8522636 - DNA, 21 bp, Homo sapiens
ggtcagggggtgcctccaggt

SEQ ID NO: 8522637 - DNA, 21 bp, Homo sapiens
ggtcagggggtgcctccaggt

SEQ ID NO: 8522638 - DNA, 21 bp, Homo sapiens
ggtcagggggtgcctccaggt

SEQ ID NO: 8522639 - DNA, 22 bp, Homo sapiens
ggtcagggctcttccagtggct

SEQ ID NO: 8522640 - DNA, 22 bp, Homo sapiens
ggtcagggctcttccagtggct

SEQ ID NO: 8522641 - DNA, 22 bp, Homo sapiens
ggtcagggctcttccagtggct

SEQ ID NO: 8522642 - DNA, 18 bp, Homo sapiens
ggtcaggggcggagagaa

SEQ ID NO: 8522643 - DNA, 22 bp, Homo sapiens
ggtcagggctgggtatgaagag

SEQ ID NO: 8522644 - DNA, 22 bp, Homo sapiens
ggtcaggggctgctctacagag

SEQ ID NO: 8522645 - DNA, 18 bp, Homo sapiens
ggtcaggggcggagagaa

SEQ ID NO: 8522646 - DNA, 18 bp, Homo sapiens
ggtcaggggcggagagaa

SEQ ID NO: 8522647 - DNA, 22 bp, Homo sapiens
ggtcaggggctgctctacagag

SEQ ID NO: 8522648 - DNA, 22 bp, Homo sapiens
ggtcaggggctgctctacagag

SEQ ID NO: 8522649 - DNA, 20 bp, Homo sapiens
ggtcagccccacctggcagc

SEQ ID NO: 8522650 - DNA, 22 bp, Homo sapiens
ggtcagcccctgctcaaggccg

SEQ ID NO: 8522651 - DNA, 22 bp, Homo sapiens
ggtcagcccctgctcaaggccg

SEQ ID NO: 8522652 - DNA, 22 bp, Homo sapiens
ggtcagccttggatttggtagc

SEQ ID NO: 8522653 - DNA, 22 bp, Homo sapiens
ggtcagccttggatttggtagc

SEQ ID NO: 8522654 - DNA, 22 bp, Homo sapiens
ggtcagctctttgggctggtgg

SEQ ID NO: 8522655 - DNA, 19 bp, Homo sapiens
ggtcagctgggctagaggc

SEQ ID NO: 8522656 - DNA, 21 bp, Homo sapiens
ggtcagctctatccacgcctt

SEQ ID NO: 8522657 - DNA, 22 bp, Homo sapiens
ggtcaggagcccttggccccct

SEQ ID NO: 8522658 - DNA, 22 bp, Homo sapiens
ggtcaggagcccttggccccct

SEQ ID NO: 8522659 - DNA, 22 bp, Homo sapiens
ggtcaggatccaagtctgtgct

SEQ ID NO: 8522660 - DNA, 22 bp, Homo sapiens
ggtcaggatccaagtctgtgct

SEQ ID NO: 8522661 - DNA, 20 bp, Homo sapiens
ggtagctgctgcagttggta

SEQ ID NO: 8522662 - DNA, 22 bp, Homo sapiens
ggtagcagggctgtgagtcaga

SEQ ID NO: 8522663 - DNA, 20 bp, Homo sapiens
ggtagcagctgctgtcatcc

SEQ ID NO: 8522664 - DNA, 22 bp, Homo sapiens
ggtagcacattgcattaggaga

SEQ ID NO: 8522665 - DNA, 23 bp, Homo sapiens
ggtagagccgcgccctgggggaa

SEQ ID NO: 8522666 - DNA, 22 bp, Homo sapiens
ggtagactgtcaaacactagcc

SEQ ID NO: 8522667 - DNA, 22 bp, Homo sapiens
ggtaggagtattttgcagcagt

SEQ ID NO: 8522668 - DNA, 22 bp, Homo sapiens
gggtcaggcctcaaggtgggct

SEQ ID NO: 8522669 - DNA, 22 bp, Homo sapiens
gggtcaggcctcaaggtgggct

SEQ ID NO: 8522670 - DNA, 22 bp, Homo sapiens
gggtcaggaagaattctgccaa

SEQ ID NO: 8522671 - DNA, 22 bp, Homo sapiens
gggtcaggaagaattctgccaa

SEQ ID NO: 8522672 - DNA, 22 bp, Homo sapiens
gggtcaggctagcccagacttc

SEQ ID NO: 8522673 - DNA, 22 bp, Homo sapiens
gggtcaggcctcaaggtgggct

SEQ ID NO: 8522674 - DNA, 22 bp, Homo sapiens
gggtcagggctgcctgggctca

SEQ ID NO: 8522675 - DNA, 22 bp, Homo sapiens
gggtcagggaggccccaccatg

SEQ ID NO: 8522676 - DNA, 22 bp, Homo sapiens
gggtcagggaggccccaccatg

SEQ ID NO: 8522677 - DNA, 22 bp, Homo sapiens
gggtcaggctcagcagggcagc

SEQ ID NO: 8522678 - DNA, 22 bp, Homo sapiens
gggtcaggctcagcagggcagc

SEQ ID NO: 8522679 - DNA, 22 bp, Homo sapiens
gggtcaggctcagcagggcagc

SEQ ID NO: 8522680 - DNA, 22 bp, Homo sapiens
gggtcaggctcagcagggcagc

SEQ ID NO: 8522681 - DNA, 22 bp, Homo sapiens
gggtccagagttgaagaggtta

SEQ ID NO: 8522682 - DNA, 22 bp, Homo sapiens
gggtccagagcctcagcccaga

SEQ ID NO: 8522683 - DNA, 23 bp, Homo sapiens
gggtccagagacaggcatgggtg

SEQ ID NO: 8522684 - DNA, 23 bp, Homo sapiens
gggtccagagaagccattagggc

SEQ ID NO: 8522685 - DNA, 22 bp, Homo sapiens
gggtccagacactccagaggaa

SEQ ID NO: 8522686 - DNA, 22 bp, Homo sapiens
gggtccacctgagcagcagcct

SEQ ID NO: 8522687 - DNA, 22 bp, Homo sapiens
gggtcagggctggctgtcgtca

SEQ ID NO: 8522688 - DNA, 22 bp, Homo sapiens
gggtcagggctgcctgggctca

SEQ ID NO: 8522689 - DNA, 22 bp, Homo sapiens
ggtaataaaattgtgtcaaaca

SEQ ID NO: 8522690 - DNA, 17 bp, Homo sapiens
ggtacaaacccattttt

SEQ ID NO: 8522691 - DNA, 22 bp, Homo sapiens
ggtacaattctggggtatgctc

SEQ ID NO: 8522692 - DNA, 22 bp, Homo sapiens
ggtacagaataaaaatcctaca

SEQ ID NO: 8522693 - DNA, 22 bp, Homo sapiens
ggtacaatgtcttacagaccca

SEQ ID NO: 8522694 - DNA, 22 bp, Homo sapiens
ggtacaatggttcattttatgt

SEQ ID NO: 8522695 - DNA, 22 bp, Homo sapiens
ggtacaatggaccataaaagct

SEQ ID NO: 8522696 - DNA, 22 bp, Homo sapiens
ggtacaatccactgtgggttag

SEQ ID NO: 8522697 - DNA, 22 bp, Homo sapiens
ggtacaaagttagatttaactt

SEQ ID NO: 8522698 - DNA, 22 bp, Homo sapiens
ggtacaaggagtgaaggtttgg

SEQ ID NO: 8522699 - DNA, 22 bp, Homo sapiens
ggtaccaccaattcagctgcca

SEQ ID NO: 8522700 - DNA, 22 bp, Homo sapiens
ggtaccatgagatgccactaat

SEQ ID NO: 8522701 - DNA, 22 bp, Homo sapiens
ggtagaaagcccaagtccccct

SEQ ID NO: 8522702 - DNA, 22 bp, Homo sapiens
ggtagaaggggaagaggtccat

SEQ ID NO: 8522703 - DNA, 22 bp, Homo sapiens
gggtccagcgacagcaggctca

SEQ ID NO: 8522704 - DNA, 23 bp, Homo sapiens
gggtccagccaattccaaggaaa

SEQ ID NO: 8522705 - DNA, 22 bp, Homo sapiens
ggtaaaatgcagattcttagcc

SEQ ID NO: 8522706 - DNA, 19 bp, Homo sapiens
ggtaaaagtgagcttcagg

SEQ ID NO: 8522707 - DNA, 22 bp, Homo sapiens
ggtaactgcagaatgtgcctca

SEQ ID NO: 8522708 - DNA, 22 bp, Homo sapiens
ggtaactgaggccatattctga

SEQ ID NO: 8522709 - DNA, 22 bp, Homo sapiens
ggtaactgcacctttggcctga

SEQ ID NO: 8522710 - DNA, 22 bp, Homo sapiens
ggtaacttagctcatggctgtg

SEQ ID NO: 8522711 - DNA, 22 bp, Homo sapiens
ggtaacagtatgtagagtaaga

SEQ ID NO: 8522712 - DNA, 22 bp, Homo sapiens
ggtaacacaggtgcagttttaa

SEQ ID NO: 8522713 - DNA, 22 bp, Homo sapiens
ggtaacaaggccgatagaaaca

SEQ ID NO: 8522714 - DNA, 22 bp, Homo sapiens
ggtaacaaccctacaaatccac

SEQ ID NO: 8522715 - DNA, 22 bp, Homo sapiens
ggtaacaaccctacaaatccac

SEQ ID NO: 8522716 - DNA, 22 bp, Homo sapiens
ggtcttgaaggacatccagtcc

SEQ ID NO: 8522717 - DNA, 22 bp, Homo sapiens
ggtcttctggaaagcagactgt

SEQ ID NO: 8522718 - DNA, 21 bp, Homo sapiens
ggtcttccaaataaggagaaa

SEQ ID NO: 8522719 - DNA, 21 bp, Homo sapiens
ggtcttccaaataaggagaaa

SEQ ID NO: 8522720 - DNA, 21 bp, Homo sapiens
ggtcttccaaataaggagaaa

SEQ ID NO: 8522721 - DNA, 22 bp, Homo sapiens
ggtcttcaggtctagttggtat

SEQ ID NO: 8522722 - DNA, 21 bp, Homo sapiens
ggtcttcaaagcttttacgat

SEQ ID NO: 8522723 - DNA, 22 bp, Homo sapiens
ggtcttcagctttgcatgtctt

SEQ ID NO: 8522724 - DNA, 22 bp, Homo sapiens
ggtctgtgtgctttgggaagtg

SEQ ID NO: 8522725 - DNA, 17 bp, Homo sapiens
ggtctgtgtctagggaa

SEQ ID NO: 8522726 - DNA, 18 bp, Homo sapiens
ggtctttaggtcagtgtc

SEQ ID NO: 8522727 - DNA, 22 bp, Homo sapiens
ggtgaaatatttttgatatgtt

SEQ ID NO: 8522728 - DNA, 22 bp, Homo sapiens
ggtctttctttgatagtggaga

SEQ ID NO: 8522729 - DNA, 22 bp, Homo sapiens
ggtgaaattccttgtggaaagt

SEQ ID NO: 8522730 - DNA, 22 bp, Homo sapiens
ggtgaacattgatgtggttaca

SEQ ID NO: 8522731 - DNA, 22 bp, Homo sapiens
ggtctggggcaggcatctgaca

SEQ ID NO: 8522732 - DNA, 17 bp, Homo sapiens
ggtctggggccattggc

SEQ ID NO: 8522733 - DNA, 22 bp, Homo sapiens
ggtctgtgtcataggctgagtt

SEQ ID NO: 8522734 - DNA, 22 bp, Homo sapiens
ggtctgtgctctggagcctctg

SEQ ID NO: 8522735 - DNA, 22 bp, Homo sapiens
ggtctgtgatcttatggattct

SEQ ID NO: 8522736 - DNA, 22 bp, Homo sapiens
ggtctgtgctctggagcctctg

SEQ ID NO: 8522737 - DNA, 22 bp, Homo sapiens
ggtctgggcttgagtccttttg

SEQ ID NO: 8522738 - DNA, 22 bp, Homo sapiens
ggtcccagaattggttagcaca

SEQ ID NO: 8522739 - DNA, 22 bp, Homo sapiens
ggtcccaatctaatcacatgag

SEQ ID NO: 8522740 - DNA, 22 bp, Homo sapiens
ggtcccaagtgcttttcctgca

SEQ ID NO: 8522741 - DNA, 22 bp, Homo sapiens
ggtcccaaggaggatgaggcta

SEQ ID NO: 8522742 - DNA, 22 bp, Homo sapiens
ggtcccaagcaatgcccttggc

SEQ ID NO: 8522743 - DNA, 22 bp, Homo sapiens
ggtgcagggagaggcaggcccc

SEQ ID NO: 8522744 - DNA, 22 bp, Homo sapiens
ggtgcagggagaggcaggcccc

SEQ ID NO: 8522745 - DNA, 22 bp, Homo sapiens
ggtgaataagctgaacacttgg

SEQ ID NO: 8522746 - DNA, 22 bp, Homo sapiens
ggtgcagtggtgtggcaaaggg

SEQ ID NO: 8522747 - DNA, 20 bp, Homo sapiens
ggtgcaggtaacgctgtgct

SEQ ID NO: 8522748 - DNA, 22 bp, Homo sapiens
ggtgaagggccttaggagacag

SEQ ID NO: 8522749 - DNA, 22 bp, Homo sapiens
ggtgaagggccttaggagacag

SEQ ID NO: 8522750 - DNA, 22 bp, Homo sapiens
ggtgaagggccttaggagacag

SEQ ID NO: 8522751 - DNA, 22 bp, Homo sapiens
ggtgaagggccttaggagacag

SEQ ID NO: 8522752 - DNA, 22 bp, Homo sapiens
ggtgaaggcacaagagggcaag

SEQ ID NO: 8522753 - DNA, 22 bp, Homo sapiens
ggtgaaggaggaagctgatgga

SEQ ID NO: 8522754 - DNA, 22 bp, Homo sapiens
ggtgaagcgtatttgtggagct

SEQ ID NO: 8522755 - DNA, 22 bp, Homo sapiens
ggtgaaggcacaagagggcaag

SEQ ID NO: 8522756 - DNA, 22 bp, Homo sapiens
ggtgaaggcacaagagggcaag

SEQ ID NO: 8522757 - DNA, 22 bp, Homo sapiens
ggtgaagggtgtcatggcattt

SEQ ID NO: 8522758 - DNA, 22 bp, Homo sapiens
ggtgaagggccttaggagacag

SEQ ID NO: 8522759 - DNA, 22 bp, Homo sapiens
ggtgaaggtctactgtgtgcca

SEQ ID NO: 8522760 - DNA, 22 bp, Homo sapiens
ggtgaaggtcagagcaggaaaa

SEQ ID NO: 8522761 - DNA, 22 bp, Homo sapiens
ggtgaaggtctactgtgtgcca

SEQ ID NO: 8522762 - DNA, 22 bp, Homo sapiens
ggtgaagtaataccaggtgtac

SEQ ID NO: 8522763 - DNA, 22 bp, Homo sapiens
ggtgaaggtggaacgcagagca

SEQ ID NO: 8522764 - DNA, 22 bp, Homo sapiens
ggtggctgaatcaaatcaggcc

SEQ ID NO: 8522765 - DNA, 22 bp, Homo sapiens
ggtggctgaagcagtcttcggg

SEQ ID NO: 8522766 - DNA, 22 bp, Homo sapiens
ggtggctgcaatggctaacttc

SEQ ID NO: 8522767 - DNA, 22 bp, Homo sapiens
ggtggctgcaccctggctaact

SEQ ID NO: 8522768 - DNA, 22 bp, Homo sapiens
ggtgggagagctctgtctccag

SEQ ID NO: 8522769 - DNA, 22 bp, Homo sapiens
ggtgggagagctctgtctccag

SEQ ID NO: 8522770 - DNA, 23 bp, Homo sapiens
ggtgggagattatccagaattat

SEQ ID NO: 8522771 - DNA, 23 bp, Homo sapiens
ggtgggagattatccagaattat

SEQ ID NO: 8522772 - DNA, 22 bp, Homo sapiens
ggtgggaggcaggctgctccca

SEQ ID NO: 8522773 - DNA, 22 bp, Homo sapiens
ggtgggaggcaggctgctccca

SEQ ID NO: 8522774 - DNA, 22 bp, Homo sapiens
ggtgggagggctgcgttcctct

SEQ ID NO: 8522775 - DNA, 22 bp, Homo sapiens
ggtgggagggctgcgttcctct

SEQ ID NO: 8522776 - DNA, 22 bp, Homo sapiens
ggtgggagccaacacccttctg

SEQ ID NO: 8522777 - DNA, 22 bp, Homo sapiens
ggtgggaggcaggctgctccca

SEQ ID NO: 8522778 - DNA, 21 bp, Homo sapiens
ggtgggcacaggagagcagag

SEQ ID NO: 8522779 - DNA, 21 bp, Homo sapiens
ggtgggcacaggagagcagag

SEQ ID NO: 8522780 - DNA, 21 bp, Homo sapiens
ggtgggcacaggagagcagag

SEQ ID NO: 8522781 - DNA, 22 bp, Homo sapiens
ggtgggcaacatttggcctgag

SEQ ID NO: 8522782 - DNA, 22 bp, Homo sapiens
ggtgggcaacatttggcctgag

SEQ ID NO: 8522783 - DNA, 22 bp, Homo sapiens
ggtgggatgcctctggagaagt

SEQ ID NO: 8522784 - DNA, 22 bp, Homo sapiens
ggtgggatgcctctggagaagt

SEQ ID NO: 8522785 - DNA, 22 bp, Homo sapiens
ggtgggatcaaagagtcattcg

SEQ ID NO: 8522786 - DNA, 22 bp, Homo sapiens
ggtgggcaacatttggcctgag

SEQ ID NO: 8522787 - DNA, 22 bp, Homo sapiens
ggtgggagggctgcgttcctct

SEQ ID NO: 8522788 - DNA, 16 bp, Homo sapiens
ggtgggaggtgaggtg

SEQ ID NO: 8522789 - DNA, 16 bp, Homo sapiens
ggtgggaggtgaggtg

SEQ ID NO: 8522790 - DNA, 22 bp, Homo sapiens
ggtgctcaagagggcatcctct

SEQ ID NO: 8522791 - DNA, 20 bp, Homo sapiens
ggtgcgaggccagagcagac

SEQ ID NO: 8522792 - DNA, 20 bp, Homo sapiens
ggtgcgaggccagagcagac

SEQ ID NO: 8522793 - DNA, 22 bp, Homo sapiens
ggtgcctgtatttggggcacag

SEQ ID NO: 8522794 - DNA, 22 bp, Homo sapiens
ggtgccttcctgccagccgcaa

SEQ ID NO: 8522795 - DNA, 22 bp, Homo sapiens
ggtgccctgtaaaagccatgca

SEQ ID NO: 8522796 - DNA, 22 bp, Homo sapiens
ggtgccctgccaggatgtgcca

SEQ ID NO: 8522797 - DNA, 22 bp, Homo sapiens
ggtgccgttgaggaagtaactg

SEQ ID NO: 8522798 - DNA, 22 bp, Homo sapiens
ggtgcccagagccaggaatgag

SEQ ID NO: 8522799 - DNA, 22 bp, Homo sapiens
ggtgcccagagccaggaatgag

SEQ ID NO: 8522800 - DNA, 22 bp, Homo sapiens
ggtgcccacctgtcttcctgga

SEQ ID NO: 8522801 - DNA, 22 bp, Homo sapiens
ggtgcccacctgtcttcctgga

SEQ ID NO: 8522802 - DNA, 22 bp, Homo sapiens
ggtgccatattatatacagttt

SEQ ID NO: 8522803 - DNA, 22 bp, Homo sapiens
ggtgcccagcgaagtggctgtg

SEQ ID NO: 8522804 - DNA, 22 bp, Homo sapiens
ggtgcccagagccaggaatgag

SEQ ID NO: 8522805 - DNA, 22 bp, Homo sapiens
ggtgcccagcgaagtggctgtg

SEQ ID NO: 8522806 - DNA, 22 bp, Homo sapiens
ggtgcccagcaagctttcaatg

SEQ ID NO: 8522807 - DNA, 22 bp, Homo sapiens
ggtgccaggctgtagtcagggt

SEQ ID NO: 8522808 - DNA, 22 bp, Homo sapiens
ggtgccaggctcccagctcagg

SEQ ID NO: 8522809 - DNA, 22 bp, Homo sapiens
ggtgccaggctgtagtcagggt

SEQ ID NO: 8522810 - DNA, 22 bp, Homo sapiens
ggtgccacataaatggagagag

SEQ ID NO: 8522811 - DNA, 22 bp, Homo sapiens
ggtgccagcctagtgcagtggt

SEQ ID NO: 8522812 - DNA, 22 bp, Homo sapiens
ggtgccagcctagtgcagtggt

SEQ ID NO: 8522813 - DNA, 22 bp, Homo sapiens
ggggatggaatgtagtagtgat

SEQ ID NO: 8522814 - DNA, 22 bp, Homo sapiens
gggctggggctcaataatttgt

SEQ ID NO: 8522815 - DNA, 22 bp, Homo sapiens
ggggatggaatgtagtagtgat

SEQ ID NO: 8522816 - DNA, 22 bp, Homo sapiens
ggggatggaatgtagtagtgat

SEQ ID NO: 8522817 - DNA, 22 bp, Homo sapiens
ggggatggaggcgtgtggtcct

SEQ ID NO: 8522818 - DNA, 22 bp, Homo sapiens
ggggatggaggcgtgtggtcct

SEQ ID NO: 8522819 - DNA, 22 bp, Homo sapiens
ggggatggtgggaaggcaatct

SEQ ID NO: 8522820 - DNA, 22 bp, Homo sapiens
ggggatggtggcatttgtaaaa

SEQ ID NO: 8522821 - DNA, 22 bp, Homo sapiens
ggggatggtggcatttgtaaaa

SEQ ID NO: 8522822 - DNA, 22 bp, Homo sapiens
ggggatggtagaccggtgacgt

SEQ ID NO: 8522823 - DNA, 22 bp, Homo sapiens
ggggatggtagaccggtgacgt

SEQ ID NO: 8522824 - DNA, 22 bp, Homo sapiens
ggggatggtagaccggtgacgt

SEQ ID NO: 8522825 - DNA, 22 bp, Homo sapiens
ggggatggaggcgtgtggtcct

SEQ ID NO: 8522826 - DNA, 22 bp, Homo sapiens
ggggatggattccgggtccctg

SEQ ID NO: 8522827 - DNA, 22 bp, Homo sapiens
ggggatggattccgggtccctg

SEQ ID NO: 8522828 - DNA, 22 bp, Homo sapiens
ggggatggtgggaaggcaatct

SEQ ID NO: 8522829 - DNA, 22 bp, Homo sapiens
ggggcacacttttggtagatat

SEQ ID NO: 8522830 - DNA, 22 bp, Homo sapiens
ggggcacacttttggtagatat

SEQ ID NO: 8522831 - DNA, 22 bp, Homo sapiens
ggggcacttccaggctgaggct

SEQ ID NO: 8522832 - DNA, 22 bp, Homo sapiens
ggggcactttactgcctcatct

SEQ ID NO: 8522833 - DNA, 22 bp, Homo sapiens
ggggcagaaagcccacagagtg

SEQ ID NO: 8522834 - DNA, 22 bp, Homo sapiens
ggggcagaaagcccacagagtg

SEQ ID NO: 8522835 - DNA, 22 bp, Homo sapiens
ggggcagaagtagtgcccctga

SEQ ID NO: 8522836 - DNA, 22 bp, Homo sapiens
ggggcagctaccggaagtaggg

SEQ ID NO: 8522837 - DNA, 22 bp, Homo sapiens
ggggcagctcccgagggcagga

SEQ ID NO: 8522838 - DNA, 22 bp, Homo sapiens
ggggcagctcccgagggcagga

SEQ ID NO: 8522839 - DNA, 22 bp, Homo sapiens
gggctgggattgcttgctgtga

SEQ ID NO: 8522840 - DNA, 22 bp, Homo sapiens
gggctgggattgcttgctgtga

SEQ ID NO: 8522841 - DNA, 22 bp, Homo sapiens
gggctgggattgcttgctgtga

SEQ ID NO: 8522842 - DNA, 22 bp, Homo sapiens
gggctgggattgcttgctgtga

SEQ ID NO: 8522843 - DNA, 22 bp, Homo sapiens
gggctgggattgcttgctgtga

SEQ ID NO: 8522844 - DNA, 22 bp, Homo sapiens
gggctgggattgcttgctgtga

SEQ ID NO: 8522845 - DNA, 22 bp, Homo sapiens
gggctgggcatggtgttccctc

SEQ ID NO: 8522846 - DNA, 22 bp, Homo sapiens
gggctggggctcaataatttgt

SEQ ID NO: 8522847 - DNA, 22 bp, Homo sapiens
gggctgggcatggtgttccctc

SEQ ID NO: 8522848 - DNA, 22 bp, Homo sapiens
gggctgggcatggtgttccctc

SEQ ID NO: 8522849 - DNA, 22 bp, Homo sapiens
gggctgggcatggtgttccctc

SEQ ID NO: 8522850 - DNA, 22 bp, Homo sapiens
gggctgggcatggtgttccctc

SEQ ID NO: 8522851 - DNA, 22 bp, Homo sapiens
gggctggggctcaataatttgt

SEQ ID NO: 8522852 - DNA, 22 bp, Homo sapiens
gggctggggctcaataatttgt

SEQ ID NO: 8522853 - DNA, 22 bp, Homo sapiens
gggctggctgattttcctctct

SEQ ID NO: 8522854 - DNA, 22 bp, Homo sapiens
gggctggctgattttcctctct

SEQ ID NO: 8522855 - DNA, 22 bp, Homo sapiens
gggctgggaatggctaagtatg

SEQ ID NO: 8522856 - DNA, 22 bp, Homo sapiens
gggctgggaatggctaagtatg

SEQ ID NO: 8522857 - DNA, 22 bp, Homo sapiens
gggctggctcccaggtgttgaa

SEQ ID NO: 8522858 - DNA, 22 bp, Homo sapiens
gggctggctctgtctagaaagg

SEQ ID NO: 8522859 - DNA, 22 bp, Homo sapiens
gggctggctctgtctagaaagg

SEQ ID NO: 8522860 - DNA, 22 bp, Homo sapiens
gggctgggatggcttgaagatt

SEQ ID NO: 8522861 - DNA, 22 bp, Homo sapiens
gggctgggatggcttgaagatt

SEQ ID NO: 8522862 - DNA, 22 bp, Homo sapiens
gggctgggatggcttgaagatt

SEQ ID NO: 8522863 - DNA, 22 bp, Homo sapiens
gggctgggatggcttgaagatt

SEQ ID NO: 8522864 - DNA, 22 bp, Homo sapiens
gggggcggagcacgtgaccacg

SEQ ID NO: 8522865 - DNA, 22 bp, Homo sapiens
gggggccttgttagtggatgga

SEQ ID NO: 8522866 - DNA, 22 bp, Homo sapiens
gggggccttattcatctgccag

SEQ ID NO: 8522867 - DNA, 22 bp, Homo sapiens
gggggccttgttagtggatgga

SEQ ID NO: 8522868 - DNA, 23 bp, Homo sapiens
gggggccgtcctggggattatag

SEQ ID NO: 8522869 - DNA, 22 bp, Homo sapiens
gggggcagtaaggatatggaaa

SEQ ID NO: 8522870 - DNA, 22 bp, Homo sapiens
gggggccagtcatctcccaaga

SEQ ID NO: 8522871 - DNA, 22 bp, Homo sapiens
gggggagagacgagcggctctg

SEQ ID NO: 8522872 - DNA, 22 bp, Homo sapiens
gggggagagacgagcggctctg

SEQ ID NO: 8522873 - DNA, 22 bp, Homo sapiens
gggggagaagattctgctgctt

SEQ ID NO: 8522874 - DNA, 23 bp, Homo sapiens
gggggcgtgtcatggagggccac

SEQ ID NO: 8522875 - DNA, 22 bp, Homo sapiens
gggtatgagatataggtgaata

SEQ ID NO: 8522876 - DNA, 22 bp, Homo sapiens
gggtatgagatataggtgaata

SEQ ID NO: 8522877 - DNA, 22 bp, Homo sapiens
gggtatgatagggaggtgaaat

SEQ ID NO: 8522878 - DNA, 22 bp, Homo sapiens
gggtatgatagggaggtgaaat

SEQ ID NO: 8522879 - DNA, 22 bp, Homo sapiens
gggggcgggagacagcagtgac

SEQ ID NO: 8522880 - DNA, 22 bp, Homo sapiens
gggggcggagcacgtgaccacg

SEQ ID NO: 8522881 - DNA, 22 bp, Homo sapiens
gggtcagagccgtaacaggact

SEQ ID NO: 8522882 - DNA, 22 bp, Homo sapiens
gggtcagctgctgggggctgac

SEQ ID NO: 8522883 - DNA, 22 bp, Homo sapiens
gggtcagcgatttcaggggcag

SEQ ID NO: 8522884 - DNA, 22 bp, Homo sapiens
gggtcagctccctccccagggc

SEQ ID NO: 8522885 - DNA, 22 bp, Homo sapiens
gggtcagagcaagactggggtc

SEQ ID NO: 8522886 - DNA, 22 bp, Homo sapiens
gggtcaaggctacatggagacc

SEQ ID NO: 8522887 - DNA, 22 bp, Homo sapiens
gggtcaagccgttgcccaaggc

SEQ ID NO: 8522888 - DNA, 22 bp, Homo sapiens
gggggaagaaagaacatggcat

SEQ ID NO: 8522889 - DNA, 22 bp, Homo sapiens
gggggaagaaagaacatggcat

SEQ ID NO: 8522890 - DNA, 22 bp, Homo sapiens
gggggaagactgggctagtgat

SEQ ID NO: 8522891 - DNA, 22 bp, Homo sapiens
gggggaagactgggctagtgat

SEQ ID NO: 8522892 - DNA, 22 bp, Homo sapiens
gggggaagactgggctagtgat

SEQ ID NO: 8522893 - DNA, 22 bp, Homo sapiens
gggggaagtaattataaaccaa

SEQ ID NO: 8522894 - DNA, 22 bp, Homo sapiens
gggggaagaggcatgaagtcct

SEQ ID NO: 8522895 - DNA, 22 bp, Homo sapiens
gggggaagaggcatgaagtcct

SEQ ID NO: 8522896 - DNA, 21 bp, Homo sapiens
gggggaagaggagttgctagt

SEQ ID NO: 8522897 - DNA, 21 bp, Homo sapiens
gggggaagaggagttgctagt

SEQ ID NO: 8522898 - DNA, 21 bp, Homo sapiens
gggggaagaggagttgctagt

SEQ ID NO: 8522899 - DNA, 22 bp, Homo sapiens
gggggactaactggatcctgga

SEQ ID NO: 8522900 - DNA, 22 bp, Homo sapiens
ggggctgtttttggaatggctg

SEQ ID NO: 8522901 - DNA, 22 bp, Homo sapiens
ggggcttttgcacgtgggaggc

SEQ ID NO: 8522902 - DNA, 22 bp, Homo sapiens
ggggcagctcccgagggcagga

SEQ ID NO: 8522903 - DNA, 22 bp, Homo sapiens
ggggcagctcccgagggcagga

SEQ ID NO: 8522904 - DNA, 22 bp, Homo sapiens
ggggcaggagcccttcttcagc

SEQ ID NO: 8522905 - DNA, 22 bp, Homo sapiens
ggggcaggagcccttcttcagc

SEQ ID NO: 8522906 - DNA, 22 bp, Homo sapiens
ggggcaggagcccttcttcagc

SEQ ID NO: 8522907 - DNA, 22 bp, Homo sapiens
ggggcaggagcccttcttcagc

SEQ ID NO: 8522908 - DNA, 22 bp, Homo sapiens
gggcctgcaggttctgagaggc

SEQ ID NO: 8522909 - DNA, 22 bp, Homo sapiens
gggcctgagactgagggtgagg

SEQ ID NO: 8522910 - DNA, 22 bp, Homo sapiens
gggcctgctccccatcgctgct

SEQ ID NO: 8522911 - DNA, 22 bp, Homo sapiens
gggcctggcatgcagccccgtt

SEQ ID NO: 8522912 - DNA, 22 bp, Homo sapiens
gggcctggcatgcagccccgtt

SEQ ID NO: 8522913 - DNA, 22 bp, Homo sapiens
gggcctggtgcttctgactcct

SEQ ID NO: 8522914 - DNA, 22 bp, Homo sapiens
gggcctggtgcttctgactcct

SEQ ID NO: 8522915 - DNA, 22 bp, Homo sapiens
gggcctggggtgacgtacccct

SEQ ID NO: 8522916 - DNA, 22 bp, Homo sapiens
gggcctggggtgacgtacccct

SEQ ID NO: 8522917 - DNA, 22 bp, Homo sapiens
gggcctggggacaccaccatga

SEQ ID NO: 8522918 - DNA, 22 bp, Homo sapiens
gggcctggggacaccaccatga

SEQ ID NO: 8522919 - DNA, 22 bp, Homo sapiens
gggcctggggacaccaccatga

SEQ ID NO: 8522920 - DNA, 22 bp, Homo sapiens
gggcctggggtgacgtacccct

SEQ ID NO: 8522921 - DNA, 21 bp, Homo sapiens
gggcctggctgcgcaggacgg

SEQ ID NO: 8522922 - DNA, 21 bp, Homo sapiens
gggcctggctgcgcaggacgg

SEQ ID NO: 8522923 - DNA, 22 bp, Homo sapiens
gggcctgggaacttgcatttag

SEQ ID NO: 8522924 - DNA, 22 bp, Homo sapiens
gggcctgggaacttgcatttag

SEQ ID NO: 8522925 - DNA, 21 bp, Homo sapiens
gggcctggctgcgcaggacgg

SEQ ID NO: 8522926 - DNA, 21 bp, Homo sapiens
gggcctggctgcgcaggacgg

SEQ ID NO: 8522927 - DNA, 21 bp, Homo sapiens
gggcctggctgcgcaggacgg

SEQ ID NO: 8522928 - DNA, 21 bp, Homo sapiens
gggcctggctgcgcaggacgg

SEQ ID NO: 8522929 - DNA, 22 bp, Homo sapiens
gggcatgagcgagctgctttga

SEQ ID NO: 8522930 - DNA, 22 bp, Homo sapiens
gggcatgagagggcagctggca

SEQ ID NO: 8522931 - DNA, 22 bp, Homo sapiens
gggcatgacttttggagtggga

SEQ ID NO: 8522932 - DNA, 18 bp, Homo sapiens
gggcatcattcacaaagt

SEQ ID NO: 8522933 - DNA, 21 bp, Homo sapiens
gggcatcctttcccaccctgc

SEQ ID NO: 8522934 - DNA, 22 bp, Homo sapiens
gggcatctggtggagcctcagg

SEQ ID NO: 8522935 - DNA, 22 bp, Homo sapiens
gggcagtgttgtggttctctat

SEQ ID NO: 8522936 - DNA, 19 bp, Homo sapiens
gggcatcaaagtgctggtg

SEQ ID NO: 8522937 - DNA, 22 bp, Homo sapiens
gggcctccgtgtgctggtgctc

SEQ ID NO: 8522938 - DNA, 22 bp, Homo sapiens
gggcctccgtgtgctggtgctc

SEQ ID NO: 8522939 - DNA, 22 bp, Homo sapiens
gggcctccggggtgagctgtgg

SEQ ID NO: 8522940 - DNA, 22 bp, Homo sapiens
gggcctccggggtgagctgtgg

SEQ ID NO: 8522941 - DNA, 22 bp, Homo sapiens
gggcctctgtgcagaggggcct

SEQ ID NO: 8522942 - DNA, 22 bp, Homo sapiens
gggcctgaaaccttcagggctt

SEQ ID NO: 8522943 - DNA, 22 bp, Homo sapiens
gggcctcaggttctggagaagg

SEQ ID NO: 8522944 - DNA, 22 bp, Homo sapiens
gggctccagtttggccaggaag

SEQ ID NO: 8522945 - DNA, 22 bp, Homo sapiens
gggctccatcacaggctccatc

SEQ ID NO: 8522946 - DNA, 23 bp, Homo sapiens
gggctccagtctctgctcagttg

SEQ ID NO: 8522947 - DNA, 23 bp, Homo sapiens
gggctccagtctctgctcagttg

SEQ ID NO: 8522948 - DNA, 22 bp, Homo sapiens
gggctccaggcaggcaggaaat

SEQ ID NO: 8522949 - DNA, 22 bp, Homo sapiens
gggctccagcccgggaccaggt

SEQ ID NO: 8522950 - DNA, 22 bp, Homo sapiens
gggctccagcccgggaccaggt

SEQ ID NO: 8522951 - DNA, 22 bp, Homo sapiens
gggctccagcccgggaccaggt

SEQ ID NO: 8522952 - DNA, 22 bp, Homo sapiens
gggctccagcagaggcagccgg

SEQ ID NO: 8522953 - DNA, 22 bp, Homo sapiens
gggctccagccactggctgagg

SEQ ID NO: 8522954 - DNA, 22 bp, Homo sapiens
gggctccagattgcagcgatca

SEQ ID NO: 8522955 - DNA, 22 bp, Homo sapiens
gggctccacgcacgcgagaggt

SEQ ID NO: 8522956 - DNA, 22 bp, Homo sapiens
gggctccacctagggacactgg

SEQ ID NO: 8522957 - DNA, 22 bp, Homo sapiens
gggctccacagcagtgagtgga

SEQ ID NO: 8522958 - DNA, 22 bp, Homo sapiens
gggctggctcccaggtgttgaa

SEQ ID NO: 8522959 - DNA, 22 bp, Homo sapiens
gggctggctcccaggtgttgaa

SEQ ID NO: 8522960 - DNA, 22 bp, Homo sapiens
gggctggctaagacttttctgt

SEQ ID NO: 8522961 - DNA, 22 bp, Homo sapiens
gggctggcgggaaaggcaattc

SEQ ID NO: 8522962 - DNA, 22 bp, Homo sapiens
gggctctgaatcccaggtctgc

SEQ ID NO: 8522963 - DNA, 22 bp, Homo sapiens
gggctggcatcggttgctgaga

SEQ ID NO: 8522964 - DNA, 22 bp, Homo sapiens
gggctggcgggaaaggcaattc

SEQ ID NO: 8522965 - DNA, 20 bp, Homo sapiens
gggctggcgcatggggaaag

SEQ ID NO: 8522966 - DNA, 22 bp, Homo sapiens
gggctcctggcagtcatgctca

SEQ ID NO: 8522967 - DNA, 22 bp, Homo sapiens
gggctcctgcctcctggcacct

SEQ ID NO: 8522968 - DNA, 22 bp, Homo sapiens
gggctcctgcctcctggcacct

SEQ ID NO: 8522969 - DNA, 22 bp, Homo sapiens
gggctcctcctctgactgtggc

SEQ ID NO: 8522970 - DNA, 22 bp, Homo sapiens
gggctctcgattagaccctggg

SEQ ID NO: 8522971 - DNA, 21 bp, Homo sapiens
gggctctcctgaggccatgaa

SEQ ID NO: 8522972 - DNA, 22 bp, Homo sapiens
gggctctcatgagtgtgtggta

SEQ ID NO: 8522973 - DNA, 22 bp, Homo sapiens
ggcaggagctctccagtttgcc

SEQ ID NO: 8522974 - DNA, 22 bp, Homo sapiens
ggcaggaggaagagttagcacc

SEQ ID NO: 8522975 - DNA, 22 bp, Homo sapiens
ggcaggagctctccagtttgcc

SEQ ID NO: 8522976 - DNA, 22 bp, Homo sapiens
ggcaggagctctccagtttgcc

SEQ ID NO: 8522977 - DNA, 22 bp, Homo sapiens
ggcaggagaatggcgtgaactc

SEQ ID NO: 8522978 - DNA, 22 bp, Homo sapiens
ggcaggagataaaatattagtt

SEQ ID NO: 8522979 - DNA, 22 bp, Homo sapiens
ggcaggggtgaggccactctga

SEQ ID NO: 8522980 - DNA, 22 bp, Homo sapiens
ggcaggggtgaggccactctga

SEQ ID NO: 8522981 - DNA, 18 bp, Homo sapiens
ggcaggggtgaaccacag

SEQ ID NO: 8522982 - DNA, 22 bp, Homo sapiens
ggcagggtaaaccgaggtaagt

SEQ ID NO: 8522983 - DNA, 22 bp, Homo sapiens
ggcagggtccacacctgggaaa

SEQ ID NO: 8522984 - DNA, 22 bp, Homo sapiens
ggcagggtctggactgaaagct

SEQ ID NO: 8522985 - DNA, 22 bp, Homo sapiens
ggcagggtctggactgaaagct

SEQ ID NO: 8522986 - DNA, 22 bp, Homo sapiens
ggcagggtgcctggctcctgtt

SEQ ID NO: 8522987 - DNA, 17 bp, Homo sapiens
ggcagggtgctgggtat

SEQ ID NO: 8522988 - DNA, 22 bp, Homo sapiens
ggcagggtggcagaggctcaga

SEQ ID NO: 8522989 - DNA, 22 bp, Homo sapiens
ggcagggtggcagaggctcaga

SEQ ID NO: 8522990 - DNA, 22 bp, Homo sapiens
ggcagggtggccctccagtgag

SEQ ID NO: 8522991 - DNA, 22 bp, Homo sapiens
ggcagggtgtggagttgggaca

SEQ ID NO: 8522992 - DNA, 22 bp, Homo sapiens
ggcagggtgtggagttgggaca

SEQ ID NO: 8522993 - DNA, 22 bp, Homo sapiens
ggcaggtacagcaagaggacaa

SEQ ID NO: 8522994 - DNA, 22 bp, Homo sapiens
ggcaggtactggggagtgaaga

SEQ ID NO: 8522995 - DNA, 19 bp, Homo sapiens
ggcaggtagagggccagtc

SEQ ID NO: 8522996 - DNA, 22 bp, Homo sapiens
ggcagtgggttccccaaggcac

SEQ ID NO: 8522997 - DNA, 22 bp, Homo sapiens
ggcaggtgacggggatgagtat

SEQ ID NO: 8522998 - DNA, 22 bp, Homo sapiens
ggcaggtagcctagaggaggtt

SEQ ID NO: 8522999 - DNA, 22 bp, Homo sapiens
ggcaggtagcctagaggaggtt

SEQ ID NO: 8523000 - DNA, 22 bp, Homo sapiens
ggcatgcatgcaaggtggtgta

SEQ ID NO: 8523001 - DNA, 22 bp, Homo sapiens
ggcatgcatgttgttttaggtg

SEQ ID NO: 8523002 - DNA, 22 bp, Homo sapiens
ggcatgctctttgtccacagta

SEQ ID NO: 8523003 - DNA, 23 bp, Homo sapiens
ggcatgcaatggacagagctgga

SEQ ID NO: 8523004 - DNA, 22 bp, Homo sapiens
ggcatgcatacgtagtgatttt

SEQ ID NO: 8523005 - DNA, 22 bp, Homo sapiens
ggcatgcaaatgtgggtgacct

SEQ ID NO: 8523006 - DNA, 23 bp, Homo sapiens
ggcatgcaatggacagagctgga

SEQ ID NO: 8523007 - DNA, 22 bp, Homo sapiens
ggcatgcaaaacaactcagaga

SEQ ID NO: 8523008 - DNA, 22 bp, Homo sapiens
ggcatgagtggcagtgggcagt

SEQ ID NO: 8523009 - DNA, 22 bp, Homo sapiens
ggcatgagtggcagtgggcagt

SEQ ID NO: 8523010 - DNA, 22 bp, Homo sapiens
ggccagctttgagctgcaggaa

SEQ ID NO: 8523011 - DNA, 22 bp, Homo sapiens
ggccagctttgagctgcaggaa

SEQ ID NO: 8523012 - DNA, 22 bp, Homo sapiens
ggccagctttctgtcttctagg

SEQ ID NO: 8523013 - DNA, 22 bp, Homo sapiens
ggccaggaacttttgggatggg

SEQ ID NO: 8523014 - DNA, 19 bp, Homo sapiens
ggccagctgtctcctgcta

SEQ ID NO: 8523015 - DNA, 22 bp, Homo sapiens
ggccagctgtggggccgagcct

SEQ ID NO: 8523016 - DNA, 22 bp, Homo sapiens
ggccagcttctctgctgcctgt

SEQ ID NO: 8523017 - DNA, 22 bp, Homo sapiens
ggccagcttattagctcagagg

SEQ ID NO: 8523018 - DNA, 22 bp, Homo sapiens
ggccagcttattagctcagagg

SEQ ID NO: 8523019 - DNA, 22 bp, Homo sapiens
ggccagcttctctgctgcctgt

SEQ ID NO: 8523020 - DNA, 22 bp, Homo sapiens
ggccagcttctctgctgcctgt

SEQ ID NO: 8523021 - DNA, 22 bp, Homo sapiens
ggcatctggatctgcttctccc

SEQ ID NO: 8523022 - DNA, 22 bp, Homo sapiens
ggcatctgtccatctctccagc

SEQ ID NO: 8523023 - DNA, 22 bp, Homo sapiens
ggcatcttcaaaattgccaaat

SEQ ID NO: 8523024 - DNA, 22 bp, Homo sapiens
ggcatgagaggtcctggggatt

SEQ ID NO: 8523025 - DNA, 22 bp, Homo sapiens
ggcatgagtaacgtgagtgagg

SEQ ID NO: 8523026 - DNA, 22 bp, Homo sapiens
ggcatgagaggtcctggggatt

SEQ ID NO: 8523027 - DNA, 20 bp, Homo sapiens
ggcatgagatgtgagggagg

SEQ ID NO: 8523028 - DNA, 22 bp, Homo sapiens
ggcatcgtcctgggcataggga

SEQ ID NO: 8523029 - DNA, 22 bp, Homo sapiens
ggcatctccaaaacatgaactc

SEQ ID NO: 8523030 - DNA, 20 bp, Homo sapiens
ggcatccttctgacccagag

SEQ ID NO: 8523031 - DNA, 20 bp, Homo sapiens
ggcatccttttggtcacagc

SEQ ID NO: 8523032 - DNA, 22 bp, Homo sapiens
ggcagtggttagaaacatgagc

SEQ ID NO: 8523033 - DNA, 22 bp, Homo sapiens
ggcagtggtgggaggctcgctc

SEQ ID NO: 8523034 - DNA, 22 bp, Homo sapiens
ggcagtgggttccccaaggcac

SEQ ID NO: 8523035 - DNA, 22 bp, Homo sapiens
ggccctgctgagtggagtggag

SEQ ID NO: 8523036 - DNA, 22 bp, Homo sapiens
ggccctggcagccacgaaagcc

SEQ ID NO: 8523037 - DNA, 22 bp, Homo sapiens
ggccaggcactgtgtgagatat

SEQ ID NO: 8523038 - DNA, 22 bp, Homo sapiens
ggccaggagaggagggcactga

SEQ ID NO: 8523039 - DNA, 22 bp, Homo sapiens
ggccaggagcaagccaggctct

SEQ ID NO: 8523040 - DNA, 22 bp, Homo sapiens
ggccaggagaggagggcactga

SEQ ID NO: 8523041 - DNA, 22 bp, Homo sapiens
ggccaggaagggaagatcagca

SEQ ID NO: 8523042 - DNA, 22 bp, Homo sapiens
ggccaggaagggaagatcagca

SEQ ID NO: 8523043 - DNA, 22 bp, Homo sapiens
ggccaggaagggaagatcagca

SEQ ID NO: 8523044 - DNA, 22 bp, Homo sapiens
ggccaggagctgcacagggctc

SEQ ID NO: 8523045 - DNA, 22 bp, Homo sapiens
ggccaggaggcaggggctcaat

SEQ ID NO: 8523046 - DNA, 22 bp, Homo sapiens
ggccaggagctgcacagggctc

SEQ ID NO: 8523047 - DNA, 22 bp, Homo sapiens
ggccaggaggcaggggctcaat

SEQ ID NO: 8523048 - DNA, 21 bp, Homo sapiens
ggcctaggggcagatggtgct

SEQ ID NO: 8523049 - DNA, 22 bp, Homo sapiens
ggcctagggcttggtcatggca

SEQ ID NO: 8523050 - DNA, 22 bp, Homo sapiens
ggcctagggcttggtcatggca

SEQ ID NO: 8523051 - DNA, 22 bp, Homo sapiens
ggcctcagaaatagagtaaaat

SEQ ID NO: 8523052 - DNA, 22 bp, Homo sapiens
ggcctcacccatcggtgccttt

SEQ ID NO: 8523053 - DNA, 22 bp, Homo sapiens
ggcctaggattctgcatttcta

SEQ ID NO: 8523054 - DNA, 22 bp, Homo sapiens
ggcctagggagtggccatgcct

SEQ ID NO: 8523055 - DNA, 22 bp, Homo sapiens
ggcctaggaaggggatgtaact

SEQ ID NO: 8523056 - DNA, 21 bp, Homo sapiens
ggccctggttacgcctcctct

SEQ ID NO: 8523057 - DNA, 21 bp, Homo sapiens
ggccctggttacgcctcctct

SEQ ID NO: 8523058 - DNA, 22 bp, Homo sapiens
ggccctgggatgctcagcagtg

SEQ ID NO: 8523059 - DNA, 22 bp, Homo sapiens
ggccctgggatgctcagcagtg

SEQ ID NO: 8523060 - DNA, 22 bp, Homo sapiens
ggccctgggacacaacaccgaa

SEQ ID NO: 8523061 - DNA, 22 bp, Homo sapiens
ggccctgggacacaacaccgaa

SEQ ID NO: 8523062 - DNA, 22 bp, Homo sapiens
ggccctgggatgctcagcagtg

SEQ ID NO: 8523063 - DNA, 22 bp, Homo sapiens
ggccctgggcagaggagtgggc

SEQ ID NO: 8523064 - DNA, 22 bp, Homo sapiens
ggccctgggcagaggagtgggc

SEQ ID NO: 8523065 - DNA, 22 bp, Homo sapiens
ggccctgggccctctagcttgt

SEQ ID NO: 8523066 - DNA, 21 bp, Homo sapiens
ggccctggttacgcctcctct

SEQ ID NO: 8523067 - DNA, 22 bp, Homo sapiens
ggcctggaagaggacagagaaa

SEQ ID NO: 8523068 - DNA, 22 bp, Homo sapiens
ggcctgctttccgagcctgcag

SEQ ID NO: 8523069 - DNA, 22 bp, Homo sapiens
ggcctggaagaggacagagaaa

SEQ ID NO: 8523070 - DNA, 22 bp, Homo sapiens
ggcctggaatgctttcctacca

SEQ ID NO: 8523071 - DNA, 22 bp, Homo sapiens
ggcctggaaggacagcgtgatg

SEQ ID NO: 8523072 - DNA, 22 bp, Homo sapiens
ggcctggaatgctttcctacca

SEQ ID NO: 8523073 - DNA, 22 bp, Homo sapiens
ggcctggacaaatgcaccaagg

SEQ ID NO: 8523074 - DNA, 22 bp, Homo sapiens
ggcctgctggctccagcgcccg

SEQ ID NO: 8523075 - DNA, 22 bp, Homo sapiens
ggcctgctggctccagcgcccg

SEQ ID NO: 8523076 - DNA, 22 bp, Homo sapiens
ggcctgctggggcctcagacac

SEQ ID NO: 8523077 - DNA, 22 bp, Homo sapiens
ggcctgctgtgtactgatgtca

SEQ ID NO: 8523078 - DNA, 22 bp, Homo sapiens
ggcctgcttctcagtgagcttg

SEQ ID NO: 8523079 - DNA, 22 bp, Homo sapiens
ggcctcagaaatagagtaaaat

SEQ ID NO: 8523080 - DNA, 19 bp, Homo sapiens
ggcctgcccaatgtctgct

SEQ ID NO: 8523081 - DNA, 22 bp, Homo sapiens
ggcctgcctcacagtcagcacc

SEQ ID NO: 8523082 - DNA, 22 bp, Homo sapiens
ggcctgctattggtgggcagac

SEQ ID NO: 8523083 - DNA, 22 bp, Homo sapiens
ggcctgctccgggggctgagct

SEQ ID NO: 8523084 - DNA, 22 bp, Homo sapiens
ggcctgctcaaacagattcctg

SEQ ID NO: 8523085 - DNA, 22 bp, Homo sapiens
ggcctgctgacccaagtcctgt

SEQ ID NO: 8523086 - DNA, 22 bp, Homo sapiens
ggcctgctctgtttagaggggg

SEQ ID NO: 8523087 - DNA, 22 bp, Homo sapiens
ggcctgctgctatgacttcctg

SEQ ID NO: 8523088 - DNA, 22 bp, Homo sapiens
ggcctgctccgggggctgagct

SEQ ID NO: 8523089 - DNA, 22 bp, Homo sapiens
ggcctgctccgggggctgagct

SEQ ID NO: 8523090 - DNA, 22 bp, Homo sapiens
ggcctgctctgcagcctctaca

SEQ ID NO: 8523091 - DNA, 22 bp, Homo sapiens
ggcctgctctgcagcctctaca

SEQ ID NO: 8523092 - DNA, 19 bp, Homo sapiens
ggcctggatttagggctcc

SEQ ID NO: 8523093 - DNA, 22 bp, Homo sapiens
ggcctggagtttggggaataga

SEQ ID NO: 8523094 - DNA, 22 bp, Homo sapiens
ggcctggagtcagggaaagcaa

SEQ ID NO: 8523095 - DNA, 22 bp, Homo sapiens
ggcctggagtcagggaaagcaa

SEQ ID NO: 8523096 - DNA, 22 bp, Homo sapiens
ggcctggagtcagggaaagcaa

SEQ ID NO: 8523097 - DNA, 22 bp, Homo sapiens
ggcctggcatggggactaaggg

SEQ ID NO: 8523098 - DNA, 22 bp, Homo sapiens
ggcctggcagagcgcgcggctg

SEQ ID NO: 8523099 - DNA, 22 bp, Homo sapiens
ggcctggcagagcgcgcggctg

SEQ ID NO: 8523100 - DNA, 22 bp, Homo sapiens
ggcctggcagagcgcgcggctg

SEQ ID NO: 8523101 - DNA, 22 bp, Homo sapiens
ggcctggcctccagatgtgggc

SEQ ID NO: 8523102 - DNA, 22 bp, Homo sapiens
ggcgggtggcgaggcttctcgg

SEQ ID NO: 8523103 - DNA, 22 bp, Homo sapiens
ggcgggtgtaagtaggacagcg

SEQ ID NO: 8523104 - DNA, 22 bp, Homo sapiens
ggcgggtgtaagtaggacagcg

SEQ ID NO: 8523105 - DNA, 22 bp, Homo sapiens
ggcgggtgcacagacccttccc

SEQ ID NO: 8523106 - DNA, 22 bp, Homo sapiens
ggcggggtctgagcgccgcgcc

SEQ ID NO: 8523107 - DNA, 22 bp, Homo sapiens
ggcctggctcttgcccagcctg

SEQ ID NO: 8523108 - DNA, 22 bp, Homo sapiens
ggcctggctcttgcccagcctg

SEQ ID NO: 8523109 - DNA, 22 bp, Homo sapiens
ggcagcagggtctagattgatg

SEQ ID NO: 8523110 - DNA, 22 bp, Homo sapiens
ggcagcagggtctagattgatg

SEQ ID NO: 8523111 - DNA, 22 bp, Homo sapiens
ggcagcagggtctagattgatg

SEQ ID NO: 8523112 - DNA, 22 bp, Homo sapiens
ggcagcagggtctagattgatg

SEQ ID NO: 8523113 - DNA, 22 bp, Homo sapiens
ggcagcagggtagccatttctc

SEQ ID NO: 8523114 - DNA, 22 bp, Homo sapiens
ggcagcagggtctagattgatg

SEQ ID NO: 8523115 - DNA, 22 bp, Homo sapiens
ggcagcagggtagccatttctc

SEQ ID NO: 8523116 - DNA, 22 bp, Homo sapiens
ggcagcagtccatggcccaagg

SEQ ID NO: 8523117 - DNA, 22 bp, Homo sapiens
ggcagcagtaggagctaatctt

SEQ ID NO: 8523118 - DNA, 22 bp, Homo sapiens
ggcagcagtaggagctaatctt

SEQ ID NO: 8523119 - DNA, 22 bp, Homo sapiens
ggcagcagggctgtctccctac

SEQ ID NO: 8523120 - DNA, 22 bp, Homo sapiens
ggcagcagggctgtctccctac

SEQ ID NO: 8523121 - DNA, 22 bp, Homo sapiens
ggcagcagggtagccatttctc

SEQ ID NO: 8523122 - DNA, 22 bp, Homo sapiens
ggcagcagggctgtctccctac

SEQ ID NO: 8523123 - DNA, 22 bp, Homo sapiens
ggcagcaggcgacttccctatt

SEQ ID NO: 8523124 - DNA, 20 bp, Homo sapiens
ggcagcaggagtttcctctt

SEQ ID NO: 8523125 - DNA, 20 bp, Homo sapiens
ggcagcaggagtttcctctt

SEQ ID NO: 8523126 - DNA, 22 bp, Homo sapiens
ggcagcaggcgacttccctatt

SEQ ID NO: 8523127 - DNA, 22 bp, Homo sapiens
ggcagcagtccatggcccaagg

SEQ ID NO: 8523128 - DNA, 22 bp, Homo sapiens
ggcagcagtccatggcccaagg

SEQ ID NO: 8523129 - DNA, 22 bp, Homo sapiens
ggcagcagtccatggcccaagg

SEQ ID NO: 8523130 - DNA, 22 bp, Homo sapiens
ggcagccaggagggtgtagttt

SEQ ID NO: 8523131 - DNA, 22 bp, Homo sapiens
ggcagccatgctccaggtgcag

SEQ ID NO: 8523132 - DNA, 22 bp, Homo sapiens
ggcagccatgctccaggtgcag

SEQ ID NO: 8523133 - DNA, 22 bp, Homo sapiens
ggcagccatggacactggctag

SEQ ID NO: 8523134 - DNA, 22 bp, Homo sapiens
ggcagccatactcagacctggg

SEQ ID NO: 8523135 - DNA, 22 bp, Homo sapiens
ggcagccatgcacgctgcctgg

SEQ ID NO: 8523136 - DNA, 22 bp, Homo sapiens
ggcagccatgcacgctgcctgg

SEQ ID NO: 8523137 - DNA, 22 bp, Homo sapiens
ggcagcttctcccaggctgttt

SEQ ID NO: 8523138 - DNA, 22 bp, Homo sapiens
ggcaggagaaaggtctcttctt

SEQ ID NO: 8523139 - DNA, 22 bp, Homo sapiens
ggcagctgtttgtcctcctgtt

SEQ ID NO: 8523140 - DNA, 22 bp, Homo sapiens
ggcagctgttggctctctagga

SEQ ID NO: 8523141 - DNA, 22 bp, Homo sapiens
ggcagctgttggctctctagga

SEQ ID NO: 8523142 - DNA, 22 bp, Homo sapiens
ggcagctgtggacgtcgtcatt

SEQ ID NO: 8523143 - DNA, 21 bp, Homo sapiens
ggcagctgtggttaattgaac

SEQ ID NO: 8523144 - DNA, 17 bp, Homo sapiens
ggcagctgtgtgcatgc

SEQ ID NO: 8523145 - DNA, 17 bp, Homo sapiens
ggcagctgtgtgcatgc

SEQ ID NO: 8523146 - DNA, 22 bp, Homo sapiens
ggcagaagataggacagggaat

SEQ ID NO: 8523147 - DNA, 22 bp, Homo sapiens
ggcagaagaaaggctaagtctc

SEQ ID NO: 8523148 - DNA, 22 bp, Homo sapiens
ggcagaagaaaggctaagtctc

SEQ ID NO: 8523149 - DNA, 22 bp, Homo sapiens
ggcagaagataggacagggaat

SEQ ID NO: 8523150 - DNA, 22 bp, Homo sapiens
ggcagaagacaggcaaatcatg

SEQ ID NO: 8523151 - DNA, 19 bp, Homo sapiens
ggcagaaggtgtaggggga

SEQ ID NO: 8523152 - DNA, 22 bp, Homo sapiens
ggcagaaggcctcccagctcct

SEQ ID NO: 8523153 - DNA, 22 bp, Homo sapiens
ggcagaaggcaattagagactg

SEQ ID NO: 8523154 - DNA, 22 bp, Homo sapiens
ggcagaaggcaattagagactg

SEQ ID NO: 8523155 - DNA, 22 bp, Homo sapiens
ggcagaaggcaattagagactg

SEQ ID NO: 8523156 - DNA, 22 bp, Homo sapiens
ggcagaaggcctcccagctcct

SEQ ID NO: 8523157 - DNA, 22 bp, Homo sapiens
ggcagaaggcctcccagctcct

SEQ ID NO: 8523158 - DNA, 22 bp, Homo sapiens
ggcagcagcaaggttggagctg

SEQ ID NO: 8523159 - DNA, 22 bp, Homo sapiens
ggcagcagcaaggttggagctg

SEQ ID NO: 8523160 - DNA, 16 bp, Homo sapiens
ggcagcagctccgtgc

SEQ ID NO: 8523161 - DNA, 22 bp, Homo sapiens
ggcagcaggagccatctggtag

SEQ ID NO: 8523162 - DNA, 22 bp, Homo sapiens
ggcagcaggagccatctggtag

SEQ ID NO: 8523163 - DNA, 22 bp, Homo sapiens
ggcagcaggagccatctggtag

SEQ ID NO: 8523164 - DNA, 22 bp, Homo sapiens
ggcagcagacccctaagtctac

SEQ ID NO: 8523165 - DNA, 21 bp, Homo sapiens
ggcagaagtagcatggacggg

SEQ ID NO: 8523166 - DNA, 21 bp, Homo sapiens
ggcagaagtagcatggacggg

SEQ ID NO: 8523167 - DNA, 22 bp, Homo sapiens
ggcagaaggttgaagtaatttg

SEQ ID NO: 8523168 - DNA, 22 bp, Homo sapiens
ggcagaaggttgaagtaatttg

SEQ ID NO: 8523169 - DNA, 21 bp, Homo sapiens
ggcagaagtagcatggacggg

SEQ ID NO: 8523170 - DNA, 22 bp, Homo sapiens
ggattgagagcactggtagctg

SEQ ID NO: 8523171 - DNA, 22 bp, Homo sapiens
ggatttgggcttgcagcagagc

SEQ ID NO: 8523172 - DNA, 22 bp, Homo sapiens
ggattttagagtacctaagtgt

SEQ ID NO: 8523173 - DNA, 22 bp, Homo sapiens
ggcactgctgtaggcagtgagg

SEQ ID NO: 8523174 - DNA, 22 bp, Homo sapiens
ggcactgctgtaggcagtgagg

SEQ ID NO: 8523175 - DNA, 22 bp, Homo sapiens
ggcactgcccaccctcacaggg

SEQ ID NO: 8523176 - DNA, 21 bp, Homo sapiens
ggattttaaaaactgcacctg

SEQ ID NO: 8523177 - DNA, 22 bp, Homo sapiens
ggcactgcaggtaagtgctgtc

SEQ ID NO: 8523178 - DNA, 20 bp, Homo sapiens
ggcactgcaccagttagtag

SEQ ID NO: 8523179 - DNA, 22 bp, Homo sapiens
ggcacttggatcttagttgggg

SEQ ID NO: 8523180 - DNA, 18 bp, Homo sapiens
ggcactggtgatgcagag

SEQ ID NO: 8523181 - DNA, 18 bp, Homo sapiens
ggcactggtgatgcagag

SEQ ID NO: 8523182 - DNA, 19 bp, Homo sapiens
ggcactggggccaggacca

SEQ ID NO: 8523183 - DNA, 18 bp, Homo sapiens
ggcactggtgatgcagag

SEQ ID NO: 8523184 - DNA, 22 bp, Homo sapiens
ggcactgggtgagggtcactgg

SEQ ID NO: 8523185 - DNA, 22 bp, Homo sapiens
ggatgctgctgcacatcctgca

SEQ ID NO: 8523186 - DNA, 22 bp, Homo sapiens
ggatgctgggagacagcaggca

SEQ ID NO: 8523187 - DNA, 22 bp, Homo sapiens
ggatgctgactttggagcatgg

SEQ ID NO: 8523188 - DNA, 22 bp, Homo sapiens
ggatgctgctatcaggcttcga

SEQ ID NO: 8523189 - DNA, 22 bp, Homo sapiens
ggatgctggggaccaatctctg

SEQ ID NO: 8523190 - DNA, 22 bp, Homo sapiens
ggatgctggggaccaatctctg

SEQ ID NO: 8523191 - DNA, 22 bp, Homo sapiens
ggatgcaggggcagcagagcct

SEQ ID NO: 8523192 - DNA, 22 bp, Homo sapiens
ggatgcaggagttgaagaagga

SEQ ID NO: 8523193 - DNA, 22 bp, Homo sapiens
ggatgcaggggcagcagagcct

SEQ ID NO: 8523194 - DNA, 22 bp, Homo sapiens
ggatgaggtagatgaacaaggg

SEQ ID NO: 8523195 - DNA, 22 bp, Homo sapiens
ggatgaggtagatgaacaaggg

SEQ ID NO: 8523196 - DNA, 19 bp, Homo sapiens
ggatgagggtcaggcatag

SEQ ID NO: 8523197 - DNA, 22 bp, Homo sapiens
ggatgaggtagatgaacaaggg

SEQ ID NO: 8523198 - DNA, 22 bp, Homo sapiens
ggatgcaggacggcatggatgt

SEQ ID NO: 8523199 - DNA, 22 bp, Homo sapiens
ggatgcaggacggcatggatgt

SEQ ID NO: 8523200 - DNA, 22 bp, Homo sapiens
ggatgcaggacggcatggatgt

SEQ ID NO: 8523201 - DNA, 22 bp, Homo sapiens
ggatgttgattgaatggccatt

SEQ ID NO: 8523202 - DNA, 22 bp, Homo sapiens
ggatgttgattgaatggccatt

SEQ ID NO: 8523203 - DNA, 22 bp, Homo sapiens
ggatgggaacttggtagggcat

SEQ ID NO: 8523204 - DNA, 22 bp, Homo sapiens
ggatggccttcttgctcaggaa

SEQ ID NO: 8523205 - DNA, 22 bp, Homo sapiens
ggattagcttttgttcttgact

SEQ ID NO: 8523206 - DNA, 22 bp, Homo sapiens
ggattctactgatcagcaccac

SEQ ID NO: 8523207 - DNA, 22 bp, Homo sapiens
ggatggagatgaccatggtgac

SEQ ID NO: 8523208 - DNA, 22 bp, Homo sapiens
ggatggagatgaccatggtgac

SEQ ID NO: 8523209 - DNA, 22 bp, Homo sapiens
ggatggagatgaccatggtgac

SEQ ID NO: 8523210 - DNA, 22 bp, Homo sapiens
ggatggagatgaccatggtgac

SEQ ID NO: 8523211 - DNA, 22 bp, Homo sapiens
ggatggagatgaccatggtgac

SEQ ID NO: 8523212 - DNA, 22 bp, Homo sapiens
ggatggaggttctcagatgctc

SEQ ID NO: 8523213 - DNA, 22 bp, Homo sapiens
ggatggaggttctcagatgctc

SEQ ID NO: 8523214 - DNA, 20 bp, Homo sapiens
ggatggccggaccagagcct

SEQ ID NO: 8523215 - DNA, 22 bp, Homo sapiens
ggatggcagacagtgagtggct

SEQ ID NO: 8523216 - DNA, 22 bp, Homo sapiens
ggatggcagtctgcatgagaaa

SEQ ID NO: 8523217 - DNA, 23 bp, Homo sapiens
ggagttggattgtacttgctgct

SEQ ID NO: 8523218 - DNA, 22 bp, Homo sapiens
ggagttggaggctccagggaac

SEQ ID NO: 8523219 - DNA, 17 bp, Homo sapiens
ggagcagatccaccatt

SEQ ID NO: 8523220 - DNA, 17 bp, Homo sapiens
ggagcagatccaccatt

SEQ ID NO: 8523221 - DNA, 22 bp, Homo sapiens
ggagcagagctgggcttggctg

SEQ ID NO: 8523222 - DNA, 22 bp, Homo sapiens
ggagcagagctgggcttggctg

SEQ ID NO: 8523223 - DNA, 22 bp, Homo sapiens
ggagcagagctgggcttggctg

SEQ ID NO: 8523224 - DNA, 22 bp, Homo sapiens
ggagcagagctcttcatctgca

SEQ ID NO: 8523225 - DNA, 22 bp, Homo sapiens
ggagcagagctcttcatctgca

SEQ ID NO: 8523226 - DNA, 22 bp, Homo sapiens
ggagcagagcatttcacagcct

SEQ ID NO: 8523227 - DNA, 22 bp, Homo sapiens
ggagcagagcatttcacagcct

SEQ ID NO: 8523228 - DNA, 22 bp, Homo sapiens
ggagcagacataaccttacaga

SEQ ID NO: 8523229 - DNA, 22 bp, Homo sapiens
ggagcagacataaccttacaga

SEQ ID NO: 8523230 - DNA, 22 bp, Homo sapiens
ggatgaggaagattactgagaa

SEQ ID NO: 8523231 - DNA, 22 bp, Homo sapiens
ggatgaggaagattactgagaa

SEQ ID NO: 8523232 - DNA, 19 bp, Homo sapiens
ggatgagggtcaggcatag

SEQ ID NO: 8523233 - DNA, 22 bp, Homo sapiens
ggatgaggaaaccacagtgtcc

SEQ ID NO: 8523234 - DNA, 22 bp, Homo sapiens
ggagttggtgagcaccaggctt

SEQ ID NO: 8523235 - DNA, 22 bp, Homo sapiens
ggagttggtggcccggaatctc

SEQ ID NO: 8523236 - DNA, 22 bp, Homo sapiens
ggagttggtgagcaccaggctt

SEQ ID NO: 8523237 - DNA, 23 bp, Homo sapiens
ggagttggattgtacttgctgct

SEQ ID NO: 8523238 - DNA, 22 bp, Homo sapiens
ggatgacaaggaaagcaaacca

SEQ ID NO: 8523239 - DNA, 22 bp, Homo sapiens
ggagatggctggcaggtagatg

SEQ ID NO: 8523240 - DNA, 22 bp, Homo sapiens
ggagatggctggcaggtagatg

SEQ ID NO: 8523241 - DNA, 21 bp, Homo sapiens
ggagatgggtatcgcctgggc

SEQ ID NO: 8523242 - DNA, 22 bp, Homo sapiens
ggagatggctggcaggtagatg

SEQ ID NO: 8523243 - DNA, 22 bp, Homo sapiens
ggagatggctctgcaaggtcta

SEQ ID NO: 8523244 - DNA, 22 bp, Homo sapiens
ggagatggctctgcaaggtcta

SEQ ID NO: 8523245 - DNA, 22 bp, Homo sapiens
ggagatggtggaagctggtgca

SEQ ID NO: 8523246 - DNA, 22 bp, Homo sapiens
ggagatggtggaagctggtgca

SEQ ID NO: 8523247 - DNA, 22 bp, Homo sapiens
ggagatggtggaagctggtgca

SEQ ID NO: 8523248 - DNA, 22 bp, Homo sapiens
ggagatgtagtgtcactggact

SEQ ID NO: 8523249 - DNA, 22 bp, Homo sapiens
ggagatttatagcacacttcag

SEQ ID NO: 8523250 - DNA, 22 bp, Homo sapiens
ggagcaaatgccaagtgggagg

SEQ ID NO: 8523251 - DNA, 22 bp, Homo sapiens
ggagcaagaggtggtgaaaaat

SEQ ID NO: 8523252 - DNA, 22 bp, Homo sapiens
ggagcaagtcccaggcactagt

SEQ ID NO: 8523253 - DNA, 22 bp, Homo sapiens
ggagcaagtcccaggcactagt

SEQ ID NO: 8523254 - DNA, 22 bp, Homo sapiens
ggagcaagtcccaggcactagt

SEQ ID NO: 8523255 - DNA, 22 bp, Homo sapiens
ggagcacagccttgccagtacc

SEQ ID NO: 8523256 - DNA, 22 bp, Homo sapiens
ggagcaccctgctcagccaagc

SEQ ID NO: 8523257 - DNA, 22 bp, Homo sapiens
gggaagggacttgtttaaggtc

SEQ ID NO: 8523258 - DNA, 22 bp, Homo sapiens
gggaaggctgcctgagggatgg

SEQ ID NO: 8523259 - DNA, 22 bp, Homo sapiens
gggaagggagggcctccagtca

SEQ ID NO: 8523260 - DNA, 22 bp, Homo sapiens
gggaagggagggacctcagtct

SEQ ID NO: 8523261 - DNA, 22 bp, Homo sapiens
gggaagggagggacctcagtct

SEQ ID NO: 8523262 - DNA, 22 bp, Homo sapiens
ggctttctagatctagctctgt

SEQ ID NO: 8523263 - DNA, 22 bp, Homo sapiens
ggctttcaacacaggctttcct

SEQ ID NO: 8523264 - DNA, 20 bp, Homo sapiens
ggctttctgtgatcctcagt

SEQ ID NO: 8523265 - DNA, 22 bp, Homo sapiens
ggctttgcattttgatggaggt

SEQ ID NO: 8523266 - DNA, 22 bp, Homo sapiens
ggctttgcctggaatttccttg

SEQ ID NO: 8523267 - DNA, 22 bp, Homo sapiens
ggctttgacatgctgaattaaa

SEQ ID NO: 8523268 - DNA, 22 bp, Homo sapiens
ggctttgacatgctgaattaaa

SEQ ID NO: 8523269 - DNA, 22 bp, Homo sapiens
ggctgtgcgggcagccgtggga

SEQ ID NO: 8523270 - DNA, 22 bp, Homo sapiens
ggctgtgcctcaaggctactca

SEQ ID NO: 8523271 - DNA, 20 bp, Homo sapiens
ggctgtgcccttccgtggcc

SEQ ID NO: 8523272 - DNA, 22 bp, Homo sapiens
gggaagtttgtgggaggaatat

SEQ ID NO: 8523273 - DNA, 22 bp, Homo sapiens
gggaagtgtggtttctttacag

SEQ ID NO: 8523274 - DNA, 23 bp, Homo sapiens
gggaagtggggatttgaagtcat

SEQ ID NO: 8523275 - DNA, 22 bp, Homo sapiens
gggaagtgtgcagagttctctt

SEQ ID NO: 8523276 - DNA, 23 bp, Homo sapiens
gggaagtggggatttgaagtcat

SEQ ID NO: 8523277 - DNA, 22 bp, Homo sapiens
gggaagtgatggagccaggatt

SEQ ID NO: 8523278 - DNA, 17 bp, Homo sapiens
gggaagtggagaaagct

SEQ ID NO: 8523279 - DNA, 22 bp, Homo sapiens
gggaagggctccttttattgca

SEQ ID NO: 8523280 - DNA, 23 bp, Homo sapiens
gggaagtgaggagcccctcagcc

SEQ ID NO: 8523281 - DNA, 22 bp, Homo sapiens
gggaagtgaagtgtagctgtct

SEQ ID NO: 8523282 - DNA, 22 bp, Homo sapiens
gggaagtgaggagcccctctgc

SEQ ID NO: 8523283 - DNA, 22 bp, Homo sapiens
gggaagtgatggagccaggatt

SEQ ID NO: 8523284 - DNA, 22 bp, Homo sapiens
gggagctgagggacctctgtgg

SEQ ID NO: 8523285 - DNA, 22 bp, Homo sapiens
gggagctgagggacctctgtgg

SEQ ID NO: 8523286 - DNA, 22 bp, Homo sapiens
gggagctgagctggaagagaat

SEQ ID NO: 8523287 - DNA, 19 bp, Homo sapiens
gggagctgaggtctttggt

SEQ ID NO: 8523288 - DNA, 22 bp, Homo sapiens
gggagctggagctggaagactc

SEQ ID NO: 8523289 - DNA, 22 bp, Homo sapiens
gggagctggagctggaagactc

SEQ ID NO: 8523290 - DNA, 22 bp, Homo sapiens
gggagctggagctggaagactc

SEQ ID NO: 8523291 - DNA, 22 bp, Homo sapiens
gggagctggagctggaagactc

SEQ ID NO: 8523292 - DNA, 21 bp, Homo sapiens
gggagctgacagcagcacggc

SEQ ID NO: 8523293 - DNA, 21 bp, Homo sapiens
gggagctgacagcagcacggc

SEQ ID NO: 8523294 - DNA, 22 bp, Homo sapiens
gggagctgagctctgagccacg

SEQ ID NO: 8523295 - DNA, 22 bp, Homo sapiens
gggagctgagctggaagagaat

SEQ ID NO: 8523296 - DNA, 22 bp, Homo sapiens
gggagctgagctggaagagaat

SEQ ID NO: 8523297 - DNA, 22 bp, Homo sapiens
gggagctgagctggaagagaat

SEQ ID NO: 8523298 - DNA, 19 bp, Homo sapiens
gggcagtggcactagggag

SEQ ID NO: 8523299 - DNA, 22 bp, Homo sapiens
gggcagtgttgctctcaaagtc

SEQ ID NO: 8523300 - DNA, 19 bp, Homo sapiens
gggcagtggcactagggag

SEQ ID NO: 8523301 - DNA, 22 bp, Homo sapiens
gggcagtgacaaaggggatgaa

SEQ ID NO: 8523302 - DNA, 22 bp, Homo sapiens
gggcagtgacaaaggggatgaa

SEQ ID NO: 8523303 - DNA, 22 bp, Homo sapiens
gggcagtgacaaaggggatgaa

SEQ ID NO: 8523304 - DNA, 22 bp, Homo sapiens
gggcagtgattttccttagagg

SEQ ID NO: 8523305 - DNA, 22 bp, Homo sapiens
gggcagtgaatattggtgggaa

SEQ ID NO: 8523306 - DNA, 22 bp, Homo sapiens
gggcagtgaatattggtgggaa

SEQ ID NO: 8523307 - DNA, 22 bp, Homo sapiens
gggcaggttattggagtaggga

SEQ ID NO: 8523308 - DNA, 22 bp, Homo sapiens
gggcaggttattggagtaggga

SEQ ID NO: 8523309 - DNA, 18 bp, Homo sapiens
gggcactggggactggag

SEQ ID NO: 8523310 - DNA, 22 bp, Homo sapiens
gggcactggaaggctctcaggc

SEQ ID NO: 8523311 - DNA, 22 bp, Homo sapiens
gggcactgctttgctctgtcac

SEQ ID NO: 8523312 - DNA, 22 bp, Homo sapiens
gggcactgctggaggctccctg

SEQ ID NO: 8523313 - DNA, 22 bp, Homo sapiens
gggcactgctggaggctccctg

SEQ ID NO: 8523314 - DNA, 22 bp, Homo sapiens
gggcactgaatgccaagctagg

SEQ ID NO: 8523315 - DNA, 22 bp, Homo sapiens
gggcacagtctaaagttgggcc

SEQ ID NO: 8523316 - DNA, 22 bp, Homo sapiens
gggcacatgtaaagctggagaa

SEQ ID NO: 8523317 - DNA, 22 bp, Homo sapiens
gggcacatgcttagggaggaaa

SEQ ID NO: 8523318 - DNA, 23 bp, Homo sapiens
gggcaccaggagcaccggacagg

SEQ ID NO: 8523319 - DNA, 23 bp, Homo sapiens
gggcaccaggagcaccggacagg

SEQ ID NO: 8523320 - DNA, 22 bp, Homo sapiens
gggcaccagcggccgcactgcc

SEQ ID NO: 8523321 - DNA, 23 bp, Homo sapiens
gggcaccaggagcaccggacagg

SEQ ID NO: 8523322 - DNA, 22 bp, Homo sapiens
gggagggccaggctcacccagg

SEQ ID NO: 8523323 - DNA, 22 bp, Homo sapiens
gggaggtgatggcaagcagcgg

SEQ ID NO: 8523324 - DNA, 22 bp, Homo sapiens
gggagggattagttctgcctgg

SEQ ID NO: 8523325 - DNA, 22 bp, Homo sapiens
gggagggattagttctgcctgg

SEQ ID NO: 8523326 - DNA, 21 bp, Homo sapiens
gggagggatggaaatgatgtt

SEQ ID NO: 8523327 - DNA, 22 bp, Homo sapiens
gggaggttgaggctgcagtgag

SEQ ID NO: 8523328 - DNA, 22 bp, Homo sapiens
gggaggttgaggctgcagtgag

SEQ ID NO: 8523329 - DNA, 22 bp, Homo sapiens
gggaggttctgttcgcacttga

SEQ ID NO: 8523330 - DNA, 22 bp, Homo sapiens
gggaggtgttctgccaacgcgg

SEQ ID NO: 8523331 - DNA, 22 bp, Homo sapiens
gggaggtgattaggaccatgta

SEQ ID NO: 8523332 - DNA, 22 bp, Homo sapiens
gggaggtgattaggaccatgta

SEQ ID NO: 8523333 - DNA, 22 bp, Homo sapiens
gggagggaggtgatgcttggct

SEQ ID NO: 8523334 - DNA, 22 bp, Homo sapiens
gggagggaggtgatgcttggct

SEQ ID NO: 8523335 - DNA, 22 bp, Homo sapiens
gggagggagaggacagttctat

SEQ ID NO: 8523336 - DNA, 22 bp, Homo sapiens
gggagggagaggacagttctat

SEQ ID NO: 8523337 - DNA, 22 bp, Homo sapiens
gggagggaggtgctggttcacg

SEQ ID NO: 8523338 - DNA, 22 bp, Homo sapiens
gggagggaggtgctggttcacg

SEQ ID NO: 8523339 - DNA, 22 bp, Homo sapiens
gggagggatctgctaggcaatg

SEQ ID NO: 8523340 - DNA, 22 bp, Homo sapiens
gggagggatctgctaggcaatg

SEQ ID NO: 8523341 - DNA, 22 bp, Homo sapiens
gggagctggagctggaagactc

SEQ ID NO: 8523342 - DNA, 22 bp, Homo sapiens
gggagctggagctggaagactc

SEQ ID NO: 8523343 - DNA, 22 bp, Homo sapiens
gggagctggagctggaagactc

SEQ ID NO: 8523344 - DNA, 22 bp, Homo sapiens
gggagctggatcgcgcgcccgg

SEQ ID NO: 8523345 - DNA, 22 bp, Homo sapiens
gggagggacacaaagagttccc

SEQ ID NO: 8523346 - DNA, 22 bp, Homo sapiens
gggagggacacaaagagttccc

SEQ ID NO: 8523347 - DNA, 22 bp, Homo sapiens
ggctacagcggggtggagacgg

SEQ ID NO: 8523348 - DNA, 19 bp, Homo sapiens
ggctaatgtctttgaaata

SEQ ID NO: 8523349 - DNA, 22 bp, Homo sapiens
ggcgtggggccttctgcccgct

SEQ ID NO: 8523350 - DNA, 22 bp, Homo sapiens
ggcgtttcaccatgttgaccag

SEQ ID NO: 8523351 - DNA, 22 bp, Homo sapiens
ggctaaagatgtgttctttgga

SEQ ID NO: 8523352 - DNA, 22 bp, Homo sapiens
ggcgtgggaagtggggcttctg

SEQ ID NO: 8523353 - DNA, 22 bp, Homo sapiens
ggcgtgggcgaggtgctctatc

SEQ ID NO: 8523354 - DNA, 22 bp, Homo sapiens
ggcgtgggaagtggggcttctg

SEQ ID NO: 8523355 - DNA, 22 bp, Homo sapiens
ggctacagtggctcagtgctgg

SEQ ID NO: 8523356 - DNA, 22 bp, Homo sapiens
ggctagagtggaactggagcgg

SEQ ID NO: 8523357 - DNA, 22 bp, Homo sapiens
ggctaggcaggctcagagccta

SEQ ID NO: 8523358 - DNA, 22 bp, Homo sapiens
ggctaggcaggctcagagccta

SEQ ID NO: 8523359 - DNA, 22 bp, Homo sapiens
ggctaggcgggcacatggtgga

SEQ ID NO: 8523360 - DNA, 22 bp, Homo sapiens
ggctccagggagtggagagaag

SEQ ID NO: 8523361 - DNA, 22 bp, Homo sapiens
ggctccagggagtggagagaag

SEQ ID NO: 8523362 - DNA, 22 bp, Homo sapiens
ggctccaggctcctatttcact

SEQ ID NO: 8523363 - DNA, 22 bp, Homo sapiens
ggctccaggctcctatttcact

SEQ ID NO: 8523364 - DNA, 22 bp, Homo sapiens
ggctccaggctcctatttcact

SEQ ID NO: 8523365 - DNA, 22 bp, Homo sapiens
ggctccagtttgtgccttcagc

SEQ ID NO: 8523366 - DNA, 22 bp, Homo sapiens
ggctccagggagtggagagaag

SEQ ID NO: 8523367 - DNA, 22 bp, Homo sapiens
ggctccagtttgtgccttcagc

SEQ ID NO: 8523368 - DNA, 22 bp, Homo sapiens
ggctcccaggagggcctggagg

SEQ ID NO: 8523369 - DNA, 22 bp, Homo sapiens
ggctcccacccatagggcgagt

SEQ ID NO: 8523370 - DNA, 22 bp, Homo sapiens
ggctcccacccatagggcgagt

SEQ ID NO: 8523371 - DNA, 22 bp, Homo sapiens
ggctcccacccatagggcgagt

SEQ ID NO: 8523372 - DNA, 22 bp, Homo sapiens
ggctccctgcaacctccgcctc

SEQ ID NO: 8523373 - DNA, 22 bp, Homo sapiens
ggctccctgcaacctccgcctc

SEQ ID NO: 8523374 - DNA, 23 bp, Homo sapiens
ggctccctcctagctttcccaat

SEQ ID NO: 8523375 - DNA, 22 bp, Homo sapiens
ggctccctagggagagtgggag

SEQ ID NO: 8523376 - DNA, 22 bp, Homo sapiens
ggctccctcaccaccatcacat

SEQ ID NO: 8523377 - DNA, 22 bp, Homo sapiens
ggctccctgggtgctcctgctc

SEQ ID NO: 8523378 - DNA, 22 bp, Homo sapiens
ggctccctgcctgtcctcagtc

SEQ ID NO: 8523379 - DNA, 22 bp, Homo sapiens
ggctccctggaaatcccgaggc

SEQ ID NO: 8523380 - DNA, 22 bp, Homo sapiens
ggctccctgcctgtcctcagtc

SEQ ID NO: 8523381 - DNA, 22 bp, Homo sapiens
ggctccctgcctgtcctcagtc

SEQ ID NO: 8523382 - DNA, 22 bp, Homo sapiens
ggctgagccatgggcactgcag

SEQ ID NO: 8523383 - DNA, 22 bp, Homo sapiens
ggctgagccactgcgcctggct

SEQ ID NO: 8523384 - DNA, 22 bp, Homo sapiens
ggctgagccactgcgcctggct

SEQ ID NO: 8523385 - DNA, 22 bp, Homo sapiens
ggctctgttctaaattaataag

SEQ ID NO: 8523386 - DNA, 23 bp, Homo sapiens
ggctctgtgctgggcctgcagga

SEQ ID NO: 8523387 - DNA, 23 bp, Homo sapiens
ggctctgtgctgggcctgcagga

SEQ ID NO: 8523388 - DNA, 23 bp, Homo sapiens
ggctctgtgctaattgctgaaaa

SEQ ID NO: 8523389 - DNA, 22 bp, Homo sapiens
ggctctgtaaagtgacacctgc

SEQ ID NO: 8523390 - DNA, 22 bp, Homo sapiens
ggctctggttgaccatgatggc

SEQ ID NO: 8523391 - DNA, 22 bp, Homo sapiens
ggctctggtgtgaagcagcctc

SEQ ID NO: 8523392 - DNA, 22 bp, Homo sapiens
ggctctgggtgtgaccttgggt

SEQ ID NO: 8523393 - DNA, 22 bp, Homo sapiens
ggctctggttgaccatgatggc

SEQ ID NO: 8523394 - DNA, 17 bp, Homo sapiens
ggctctgggtgtcacat

SEQ ID NO: 8523395 - DNA, 17 bp, Homo sapiens
ggctctgggtgtcacat

SEQ ID NO: 8523396 - DNA, 22 bp, Homo sapiens
ggctctgggtgtgaccttgggt

SEQ ID NO: 8523397 - DNA, 17 bp, Homo sapiens
ggctctgggtgtcacat

SEQ ID NO: 8523398 - DNA, 22 bp, Homo sapiens
ggctctgggtctgtggggagcg

SEQ ID NO: 8523399 - DNA, 22 bp, Homo sapiens
ggctcctgataggagaatgcgg

SEQ ID NO: 8523400 - DNA, 22 bp, Homo sapiens
ggctcctgataggagaatgcgg

SEQ ID NO: 8523401 - DNA, 22 bp, Homo sapiens
ggctcctgataggagaatgcgg

SEQ ID NO: 8523402 - DNA, 22 bp, Homo sapiens
ggctcctgaggaccaggcacag

SEQ ID NO: 8523403 - DNA, 22 bp, Homo sapiens
ggctccctgttctattccctgg

SEQ ID NO: 8523404 - DNA, 22 bp, Homo sapiens
ggctccctgggtgctcctgctc

SEQ ID NO: 8523405 - DNA, 22 bp, Homo sapiens
ggctccctgggtgctcctgctc

SEQ ID NO: 8523406 - DNA, 22 bp, Homo sapiens
ggctcctctctggccgctcccg

SEQ ID NO: 8523407 - DNA, 22 bp, Homo sapiens
ggctcctgaaagactatgggaa

SEQ ID NO: 8523408 - DNA, 22 bp, Homo sapiens
ggctcctgagaatgggccatca

SEQ ID NO: 8523409 - DNA, 22 bp, Homo sapiens
ggctctgggtaaggcgtttgac

SEQ ID NO: 8523410 - DNA, 22 bp, Homo sapiens
ggctctggggttggcccatctc

SEQ ID NO: 8523411 - DNA, 22 bp, Homo sapiens
ggctctggggttggcccatctc

SEQ ID NO: 8523412 - DNA, 22 bp, Homo sapiens
ggctctggggggaagtctgttg

SEQ ID NO: 8523413 - DNA, 22 bp, Homo sapiens
ggctctggggaagctctcttca

SEQ ID NO: 8523414 - DNA, 22 bp, Homo sapiens
ggctctgggccagagttggctt

SEQ ID NO: 8523415 - DNA, 22 bp, Homo sapiens
ggctctgggcctccaaggtctg

SEQ ID NO: 8523416 - DNA, 22 bp, Homo sapiens
ggctctggggaagctctcttca

SEQ ID NO: 8523417 - DNA, 22 bp, Homo sapiens
ggctggactttctgctgggctc

SEQ ID NO: 8523418 - DNA, 22 bp, Homo sapiens
ggctggactgcctcccagagtc

SEQ ID NO: 8523419 - DNA, 22 bp, Homo sapiens
ggctggactttctgctgggctc

SEQ ID NO: 8523420 - DNA, 22 bp, Homo sapiens
ggctggactttctgctgggctc

SEQ ID NO: 8523421 - DNA, 22 bp, Homo sapiens
ggctggactctgggcctctcca

SEQ ID NO: 8523422 - DNA, 22 bp, Homo sapiens
ggctggaccatgctgccccttc

SEQ ID NO: 8523423 - DNA, 21 bp, Homo sapiens
ggctggacatcccaggagact

SEQ ID NO: 8523424 - DNA, 19 bp, Homo sapiens
ggctggagaaaggaatcag

SEQ ID NO: 8523425 - DNA, 22 bp, Homo sapiens
ggctggagaagggtggttgaca

SEQ ID NO: 8523426 - DNA, 19 bp, Homo sapiens
ggctggagaaaggaatcag

SEQ ID NO: 8523427 - DNA, 19 bp, Homo sapiens
ggctggagaaaggaatcag

SEQ ID NO: 8523428 - DNA, 22 bp, Homo sapiens
ggctgggtacagggcagtgtgc

SEQ ID NO: 8523429 - DNA, 22 bp, Homo sapiens
ggctggagaagggtggttgaca

SEQ ID NO: 8523430 - DNA, 21 bp, Homo sapiens
ggctgggtcatgcagctggcc

SEQ ID NO: 8523431 - DNA, 21 bp, Homo sapiens
ggctgggtcatgcagctggcc

SEQ ID NO: 8523432 - DNA, 19 bp, Homo sapiens
ggctgggtctggcaggttc

SEQ ID NO: 8523433 - DNA, 19 bp, Homo sapiens
ggctgggtctggcaggttc

SEQ ID NO: 8523434 - DNA, 19 bp, Homo sapiens
ggctgggtctggcaggttc

SEQ ID NO: 8523435 - DNA, 22 bp, Homo sapiens
ggctgggtcccagctgggagga

SEQ ID NO: 8523436 - DNA, 21 bp, Homo sapiens
ggctgggtcatgcagctggcc

SEQ ID NO: 8523437 - DNA, 21 bp, Homo sapiens
ggctggtcgcgtgcatgtctc

SEQ ID NO: 8523438 - DNA, 22 bp, Homo sapiens
ggctggtcccgggtcctccggc

SEQ ID NO: 8523439 - DNA, 22 bp, Homo sapiens
ggctggtcctttctctgtccta

SEQ ID NO: 8523440 - DNA, 22 bp, Homo sapiens
ggctggtcacaccactgcaggg

SEQ ID NO: 8523441 - DNA, 22 bp, Homo sapiens
ggctggtcacaccactgcaggg

SEQ ID NO: 8523442 - DNA, 22 bp, Homo sapiens
ggctggtcacaccactgcaggg

SEQ ID NO: 8523443 - DNA, 22 bp, Homo sapiens
ggctggtcaggaaactaggctc

SEQ ID NO: 8523444 - DNA, 22 bp, Homo sapiens
ggctggtcaggaaactaggctc

SEQ ID NO: 8523445 - DNA, 22 bp, Homo sapiens
ggctgggttatttatggccaag

SEQ ID NO: 8523446 - DNA, 22 bp, Homo sapiens
ggctgggttatttatggccaag

SEQ ID NO: 8523447 - DNA, 22 bp, Homo sapiens
ggctgggttctgagaaagagta

SEQ ID NO: 8523448 - DNA, 22 bp, Homo sapiens
ggctgggtttgactcctggctt

SEQ ID NO: 8523449 - DNA, 22 bp, Homo sapiens
ggctggtgagttcagagaaccc

SEQ ID NO: 8523450 - DNA, 22 bp, Homo sapiens
ggctggtctcagtgctgggttc

SEQ ID NO: 8523451 - DNA, 22 bp, Homo sapiens
ggctggtctccaacccccgatc

SEQ ID NO: 8523452 - DNA, 23 bp, Homo sapiens
ggctggtgcccttggccagtcgg

SEQ ID NO: 8523453 - DNA, 23 bp, Homo sapiens
ggctggtgcccttggccagtcgg

SEQ ID NO: 8523454 - DNA, 22 bp, Homo sapiens
ggctgtgattggtggatgtgaa

SEQ ID NO: 8523455 - DNA, 22 bp, Homo sapiens
ggctgtgacccccacaggggtg

SEQ ID NO: 8523456 - DNA, 22 bp, Homo sapiens
ggctggtggggaaagaggacca

SEQ ID NO: 8523457 - DNA, 17 bp, Homo sapiens
ggctgtgccaggtgaga

SEQ ID NO: 8523458 - DNA, 22 bp, Homo sapiens
ggctgagggtatagctgtccca

SEQ ID NO: 8523459 - DNA, 22 bp, Homo sapiens
ggctgaggggcccagaggaaca

SEQ ID NO: 8523460 - DNA, 22 bp, Homo sapiens
ggctgaggggcccagaggaaca

SEQ ID NO: 8523461 - DNA, 22 bp, Homo sapiens
ggctgagggtatagctgtccca

SEQ ID NO: 8523462 - DNA, 22 bp, Homo sapiens
ggctgaggggcccagaggaaca

SEQ ID NO: 8523463 - DNA, 22 bp, Homo sapiens
ggctgagggccagggctagtct

SEQ ID NO: 8523464 - DNA, 22 bp, Homo sapiens
ggctgagggccagggctagtct

SEQ ID NO: 8523465 - DNA, 22 bp, Homo sapiens
ggctgagggccagggctagtct

SEQ ID NO: 8523466 - DNA, 22 bp, Homo sapiens
ggctgagggccagggctagtct

SEQ ID NO: 8523467 - DNA, 22 bp, Homo sapiens
ggctgaggctcatgccatcttg

SEQ ID NO: 8523468 - DNA, 18 bp, Homo sapiens
ggctgaggttgactagaa

SEQ ID NO: 8523469 - DNA, 18 bp, Homo sapiens
ggctgaggttgactagaa

SEQ ID NO: 8523470 - DNA, 18 bp, Homo sapiens
ggctgaggttgactagaa

SEQ ID NO: 8523471 - DNA, 18 bp, Homo sapiens
ggctgaggttgactagaa

SEQ ID NO: 8523472 - DNA, 22 bp, Homo sapiens
ggctgagtggctgggtctagtt

SEQ ID NO: 8523473 - DNA, 22 bp, Homo sapiens
ggctgaggtgtggggaactata

SEQ ID NO: 8523474 - DNA, 22 bp, Homo sapiens
ggctgaggtgtggggaactata

SEQ ID NO: 8523475 - DNA, 22 bp, Homo sapiens
ggctgagggttaagatcagaca

SEQ ID NO: 8523476 - DNA, 22 bp, Homo sapiens
ggctgagggttaagatcagaca

SEQ ID NO: 8523477 - DNA, 22 bp, Homo sapiens
ggctgagggtcccagaccctaa

SEQ ID NO: 8523478 - DNA, 22 bp, Homo sapiens
ggctgagggtcccagaccctaa

SEQ ID NO: 8523479 - DNA, 22 bp, Homo sapiens
ggctgagggtcccagaccctaa

SEQ ID NO: 8523480 - DNA, 22 bp, Homo sapiens
ggctgagttgagaggattactt

SEQ ID NO: 8523481 - DNA, 22 bp, Homo sapiens
ggctgagttgagaggattactt

SEQ ID NO: 8523482 - DNA, 22 bp, Homo sapiens
ggctgagttctcttgctgaatc

SEQ ID NO: 8523483 - DNA, 22 bp, Homo sapiens
ggctgctggggacgtgggagag

SEQ ID NO: 8523484 - DNA, 22 bp, Homo sapiens
ggctgctggggacgtgggagag

SEQ ID NO: 8523485 - DNA, 22 bp, Homo sapiens
ggctgagttctcttgctgaatc

SEQ ID NO: 8523486 - DNA, 22 bp, Homo sapiens
ggctgctggggacgtgggagag

SEQ ID NO: 8523487 - DNA, 21 bp, Homo sapiens
ggctgctgggggttggcacag

SEQ ID NO: 8523488 - DNA, 21 bp, Homo sapiens
ggctgctgggggttggcacag

SEQ ID NO: 8523489 - DNA, 22 bp, Homo sapiens
ggctgctgggtcatgatgcaga

SEQ ID NO: 8523490 - DNA, 22 bp, Homo sapiens
ggctgctgggtcatgatgcaga

SEQ ID NO: 8523491 - DNA, 22 bp, Homo sapiens
ggctgctgtttcagagactgtt

SEQ ID NO: 8523492 - DNA, 22 bp, Homo sapiens
ggctgctgtttcagagactgtt

SEQ ID NO: 8523493 - DNA, 22 bp, Homo sapiens
ggctgcttctcactcatttgca

SEQ ID NO: 8523494 - DNA, 22 bp, Homo sapiens
ggctgcttgctgtttcttggat

SEQ ID NO: 8523495 - DNA, 20 bp, Homo sapiens
ggctgctgtgggcagagagg

SEQ ID NO: 8523496 - DNA, 22 bp, Homo sapiens
ggctggaatgcaactgtgtgtt

SEQ ID NO: 8523497 - DNA, 22 bp, Homo sapiens
ggctggaatagagactgactgg

SEQ ID NO: 8523498 - DNA, 22 bp, Homo sapiens
ggctggaagtccaagatcaagg

SEQ ID NO: 8523499 - DNA, 20 bp, Homo sapiens
ggctggaagtgtgggtttgg

SEQ ID NO: 8523500 - DNA, 22 bp, Homo sapiens
ggctggaatgcaactgtgtgtt

SEQ ID NO: 8523501 - DNA, 22 bp, Homo sapiens
ggctggaagtccaagatcaagg

SEQ ID NO: 8523502 - DNA, 22 bp, Homo sapiens
ggctggaagtccaagatcaaga

SEQ ID NO: 8523503 - DNA, 22 bp, Homo sapiens
ggctggaaggtagaagatgagg

SEQ ID NO: 8523504 - DNA, 22 bp, Homo sapiens
ggctggaagtccaagatcaaga

SEQ ID NO: 8523505 - DNA, 22 bp, Homo sapiens
ggctggaatgtgtggatgtgat

SEQ ID NO: 8523506 - DNA, 22 bp, Homo sapiens
ggctggaatgtgtggatgtgat

SEQ ID NO: 8523507 - DNA, 22 bp, Homo sapiens
ggctgctttatcggctgctgaa

SEQ ID NO: 8523508 - DNA, 22 bp, Homo sapiens
ggctgcttgctgtttcttggat

SEQ ID NO: 8523509 - DNA, 22 bp, Homo sapiens
ggctgctttatcggctgctgaa

SEQ ID NO: 8523510 - DNA, 22 bp, Homo sapiens
ggctggaaaagacaaagctatt

SEQ ID NO: 8523511 - DNA, 22 bp, Homo sapiens
ggctggaaaagacaaagctatt

SEQ ID NO: 8523512 - DNA, 22 bp, Homo sapiens
ggctggaagagactgaggacac

SEQ ID NO: 8523513 - DNA, 22 bp, Homo sapiens
ggctggaaggtagaagatgagg

SEQ ID NO: 8523514 - DNA, 22 bp, Homo sapiens
ggctggaaggccctttgttgat

SEQ ID NO: 8523515 - DNA, 18 bp, Homo sapiens
ggctggaagctgttgctg

SEQ ID NO: 8523516 - DNA, 22 bp, Homo sapiens
ggctggaacttcttctggcatt

SEQ ID NO: 8523517 - DNA, 23 bp, Homo sapiens
ggctggaagaaaacagaattgtt

SEQ ID NO: 8523518 - DNA, 22 bp, Homo sapiens
ggctggaaaggatattttaggt

SEQ ID NO: 8523519 - DNA, 22 bp, Homo sapiens
ggctggaaccagagtgaggcag

SEQ ID NO: 8523520 - DNA, 22 bp, Homo sapiens
ggctggaaactcaggtagggtt

SEQ ID NO: 8523521 - DNA, 22 bp, Homo sapiens
gcctgggtgaatttgatcctaa

SEQ ID NO: 8523522 - DNA, 22 bp, Homo sapiens
gcctgggtccactgatcatgct

SEQ ID NO: 8523523 - DNA, 22 bp, Homo sapiens
gcctgggtgcccaatgatgaga

SEQ ID NO: 8523524 - DNA, 22 bp, Homo sapiens
gcctgggttccatgatctccag

SEQ ID NO: 8523525 - DNA, 22 bp, Homo sapiens
gcctgggtgtcgatcactagtg

SEQ ID NO: 8523526 - DNA, 22 bp, Homo sapiens
gcctggtgataagcagtgacct

SEQ ID NO: 8523527 - DNA, 22 bp, Homo sapiens
gcctggtgaaaggcagagagcg

SEQ ID NO: 8523528 - DNA, 22 bp, Homo sapiens
gcctggtgaaaggcagagagcg

SEQ ID NO: 8523529 - DNA, 22 bp, Homo sapiens
gcctggtgaaaggcagagagcg

SEQ ID NO: 8523530 - DNA, 22 bp, Homo sapiens
gcctggtctctttcatgtcagt

SEQ ID NO: 8523531 - DNA, 22 bp, Homo sapiens
gcctggtctctttcatgtcagt

SEQ ID NO: 8523532 - DNA, 22 bp, Homo sapiens
gcctggggccagcttgggctga

SEQ ID NO: 8523533 - DNA, 22 bp, Homo sapiens
gcctggggaacttgatcctgtc

SEQ ID NO: 8523534 - DNA, 22 bp, Homo sapiens
gcctggggcatgcagctgatac

SEQ ID NO: 8523535 - DNA, 22 bp, Homo sapiens
gcctggggcatgcagctgatac

SEQ ID NO: 8523536 - DNA, 22 bp, Homo sapiens
gcctggggtcccttgttggcac

SEQ ID NO: 8523537 - DNA, 22 bp, Homo sapiens
gcctggggggcatgtcataata

SEQ ID NO: 8523538 - DNA, 22 bp, Homo sapiens
gcctggggtctctgactcacag

SEQ ID NO: 8523539 - DNA, 22 bp, Homo sapiens
gcctggggtctctgactcacag

SEQ ID NO: 8523540 - DNA, 22 bp, Homo sapiens
gccttcagtagtatcctcatga

SEQ ID NO: 8523541 - DNA, 22 bp, Homo sapiens
gccttcagtagtatcctcatga

SEQ ID NO: 8523542 - DNA, 22 bp, Homo sapiens
gccttcagtaactgagacggaa

SEQ ID NO: 8523543 - DNA, 22 bp, Homo sapiens
gccttcagtaactgagacggaa

SEQ ID NO: 8523544 - DNA, 22 bp, Homo sapiens
gccttcaggtgtccctgtgggc

SEQ ID NO: 8523545 - DNA, 22 bp, Homo sapiens
gccttcaggtgtccctgtgggc

SEQ ID NO: 8523546 - DNA, 22 bp, Homo sapiens
gccttcaggtgctgccaggcta

SEQ ID NO: 8523547 - DNA, 22 bp, Homo sapiens
gccttcaggtgctgccaggcta

SEQ ID NO: 8523548 - DNA, 22 bp, Homo sapiens
gccttcagtagtgtcagctgta

SEQ ID NO: 8523549 - DNA, 22 bp, Homo sapiens
gccttcagtagtgtcagctgta

SEQ ID NO: 8523550 - DNA, 22 bp, Homo sapiens
gccttcagtagtgtcagctgta

SEQ ID NO: 8523551 - DNA, 22 bp, Homo sapiens
gccttcagtagtgtcagctgta

SEQ ID NO: 8523552 - DNA, 23 bp, Homo sapiens
gccttcagctcgggaaggctccc

SEQ ID NO: 8523553 - DNA, 23 bp, Homo sapiens
gccttcagctcgggaaggctccc

SEQ ID NO: 8523554 - DNA, 23 bp, Homo sapiens
gccttcagctcgggaaggctccc

SEQ ID NO: 8523555 - DNA, 22 bp, Homo sapiens
gccttcagcggccgctcgctgc

SEQ ID NO: 8523556 - DNA, 23 bp, Homo sapiens
gccttcagctcgggaaggctccc

SEQ ID NO: 8523557 - DNA, 23 bp, Homo sapiens
gccttcagctcgggaaggctccc

SEQ ID NO: 8523558 - DNA, 22 bp, Homo sapiens
gccttcagcggccgctcgctgc

SEQ ID NO: 8523559 - DNA, 22 bp, Homo sapiens
gccttcagcggccgctcgctgc

SEQ ID NO: 8523560 - DNA, 22 bp, Homo sapiens
gccttcagcggccgctcgctgc

SEQ ID NO: 8523561 - DNA, 22 bp, Homo sapiens
gccttcaggaaatcagtccttg

SEQ ID NO: 8523562 - DNA, 22 bp, Homo sapiens
gccttcaggaaatcagtccttg

SEQ ID NO: 8523563 - DNA, 22 bp, Homo sapiens
gccttcaggaaatcagtccttg

SEQ ID NO: 8523564 - DNA, 22 bp, Homo sapiens
gccttcaggagggttccagaca

SEQ ID NO: 8523565 - DNA, 22 bp, Homo sapiens
gccttcaggagggttccagaca

SEQ ID NO: 8523566 - DNA, 22 bp, Homo sapiens
gccttcaggagggttccagaca

SEQ ID NO: 8523567 - DNA, 22 bp, Homo sapiens
gcctggtggacactgggcatca

SEQ ID NO: 8523568 - DNA, 22 bp, Homo sapiens
gcctggtgctatgagggccagc

SEQ ID NO: 8523569 - DNA, 22 bp, Homo sapiens
gcctggtgctatgagggccagc

SEQ ID NO: 8523570 - DNA, 22 bp, Homo sapiens
gcctggtggtgtgctcaagtgg

SEQ ID NO: 8523571 - DNA, 22 bp, Homo sapiens
gcctggtggtatcctggcaaga

SEQ ID NO: 8523572 - DNA, 18 bp, Homo sapiens
gccttcagactgcatgct

SEQ ID NO: 8523573 - DNA, 22 bp, Homo sapiens
gccttcagagtaccatgtcctc

SEQ ID NO: 8523574 - DNA, 22 bp, Homo sapiens
gccttcagccctgactggccag

SEQ ID NO: 8523575 - DNA, 22 bp, Homo sapiens
gccttcagccctgactggccag

SEQ ID NO: 8523576 - DNA, 22 bp, Homo sapiens
gccttcagccctgactggccag

SEQ ID NO: 8523577 - DNA, 22 bp, Homo sapiens
gccttaggggtcagacagagct

SEQ ID NO: 8523578 - DNA, 22 bp, Homo sapiens
gcctggctgtctggcaaggttc

SEQ ID NO: 8523579 - DNA, 22 bp, Homo sapiens
gcctggctgtctggcaaggttc

SEQ ID NO: 8523580 - DNA, 22 bp, Homo sapiens
gcctggctggtcactgcctggc

SEQ ID NO: 8523581 - DNA, 22 bp, Homo sapiens
gcctggctggtcactgcctggc

SEQ ID NO: 8523582 - DNA, 22 bp, Homo sapiens
gcctggctgggcaccaggggag

SEQ ID NO: 8523583 - DNA, 22 bp, Homo sapiens
gcctggctgggctgaatgctta

SEQ ID NO: 8523584 - DNA, 22 bp, Homo sapiens
gcctggctgcttagcctacttc

SEQ ID NO: 8523585 - DNA, 19 bp, Homo sapiens
gcctggctgggatgagccc

SEQ ID NO: 8523586 - DNA, 22 bp, Homo sapiens
gcctggcttcccttggagcatt

SEQ ID NO: 8523587 - DNA, 22 bp, Homo sapiens
gcctggcttcccttggagcatt

SEQ ID NO: 8523588 - DNA, 21 bp, Homo sapiens
gcctggcttcacaggcactga

SEQ ID NO: 8523589 - DNA, 21 bp, Homo sapiens
gcctggcttcacaggcactga

SEQ ID NO: 8523590 - DNA, 21 bp, Homo sapiens
gcctggcttcacaggcactga

SEQ ID NO: 8523591 - DNA, 23 bp, Homo sapiens
gcctggcttccaaggtaggggag

SEQ ID NO: 8523592 - DNA, 22 bp, Homo sapiens
gcctggcttggggctcagtggt

SEQ ID NO: 8523593 - DNA, 22 bp, Homo sapiens
gcctggggaacttgatcctgtc

SEQ ID NO: 8523594 - DNA, 22 bp, Homo sapiens
gcctggggaacttgatcctgtc

SEQ ID NO: 8523595 - DNA, 22 bp, Homo sapiens
gcctggcttgccagccctggcg

SEQ ID NO: 8523596 - DNA, 22 bp, Homo sapiens
gcctggcttgccagccctggcg

SEQ ID NO: 8523597 - DNA, 22 bp, Homo sapiens
gcctggcttgccagccctggcg

SEQ ID NO: 8523598 - DNA, 22 bp, Homo sapiens
gcctcaggccgccctgctgctc

SEQ ID NO: 8523599 - DNA, 22 bp, Homo sapiens
gcctcaggccgccctgctgctc

SEQ ID NO: 8523600 - DNA, 22 bp, Homo sapiens
gcctcaggcctatagctgctgt

SEQ ID NO: 8523601 - DNA, 22 bp, Homo sapiens
gcctcaggcctatagctgctgt

SEQ ID NO: 8523602 - DNA, 22 bp, Homo sapiens
gcctcaggcctatagctgctgt

SEQ ID NO: 8523603 - DNA, 22 bp, Homo sapiens
gcctcagggataggatgagcat

SEQ ID NO: 8523604 - DNA, 22 bp, Homo sapiens
gcctcagggataggatgagcat

SEQ ID NO: 8523605 - DNA, 22 bp, Homo sapiens
gcctcagggataggatgagcat

SEQ ID NO: 8523606 - DNA, 22 bp, Homo sapiens
gcctcagggataggatgagcat

SEQ ID NO: 8523607 - DNA, 21 bp, Homo sapiens
gcctggctagaagctcctagc

SEQ ID NO: 8523608 - DNA, 22 bp, Homo sapiens
gcctggctaattttggtatttt

SEQ ID NO: 8523609 - DNA, 22 bp, Homo sapiens
gcctggctaagcagaaggaccc

SEQ ID NO: 8523610 - DNA, 22 bp, Homo sapiens
gcctggctgctagccagaggca

SEQ ID NO: 8523611 - DNA, 22 bp, Homo sapiens
gcctggctgctagccagaggca

SEQ ID NO: 8523612 - DNA, 22 bp, Homo sapiens
gcctggctgctcagccactcac

SEQ ID NO: 8523613 - DNA, 22 bp, Homo sapiens
gcctggctgcttagcctacttc

SEQ ID NO: 8523614 - DNA, 22 bp, Homo sapiens
gcctggctgctcagccactcac

SEQ ID NO: 8523615 - DNA, 22 bp, Homo sapiens
gcctggctgccggccttggcaa

SEQ ID NO: 8523616 - DNA, 22 bp, Homo sapiens
gcctggctagttagtgtcaggt

SEQ ID NO: 8523617 - DNA, 22 bp, Homo sapiens
gcctggctagttagtgtcaggt

SEQ ID NO: 8523618 - DNA, 22 bp, Homo sapiens
gcgctcagaaaagattttcttc

SEQ ID NO: 8523619 - DNA, 22 bp, Homo sapiens
gcgctcaggtgccaggcctgcg

SEQ ID NO: 8523620 - DNA, 22 bp, Homo sapiens
gcggagggcgagcccgcggagc

SEQ ID NO: 8523621 - DNA, 22 bp, Homo sapiens
gcggagggagataggccttgct

SEQ ID NO: 8523622 - DNA, 22 bp, Homo sapiens
gcgggccaccttggagagcgct

SEQ ID NO: 8523623 - DNA, 22 bp, Homo sapiens
gcgggcgggggttcccaggtct

SEQ ID NO: 8523624 - DNA, 22 bp, Homo sapiens
gcgggcgctcaggctgcagctg

SEQ ID NO: 8523625 - DNA, 19 bp, Homo sapiens
gcgggcggcgcctgcgagg

SEQ ID NO: 8523626 - DNA, 22 bp, Homo sapiens
gcgggcgggggttcccaggtct

SEQ ID NO: 8523627 - DNA, 18 bp, Homo sapiens
gcgggcggtgcagtgggc

SEQ ID NO: 8523628 - DNA, 22 bp, Homo sapiens
gcggggcacagtgatggagcac

SEQ ID NO: 8523629 - DNA, 22 bp, Homo sapiens
gcgggcagggcactggtcccct

SEQ ID NO: 8523630 - DNA, 22 bp, Homo sapiens
gcggcgcctgggacccgccagc

SEQ ID NO: 8523631 - DNA, 22 bp, Homo sapiens
gcggcgcctaagccccgacctc

SEQ ID NO: 8523632 - DNA, 22 bp, Homo sapiens
gcggcgcctaagccccgacctc

SEQ ID NO: 8523633 - DNA, 22 bp, Homo sapiens
gcggcccgagcaggacgggtgg

SEQ ID NO: 8523634 - DNA, 22 bp, Homo sapiens
gcggcccgagcaggacgggtgg

SEQ ID NO: 8523635 - DNA, 22 bp, Homo sapiens
gcggcccgagcaggacgggtgg

SEQ ID NO: 8523636 - DNA, 22 bp, Homo sapiens
gccttctctgtgagctcctagg

SEQ ID NO: 8523637 - DNA, 22 bp, Homo sapiens
gccttctgatatctcttggcat

SEQ ID NO: 8523638 - DNA, 17 bp, Homo sapiens
gccttctctgccctcac

SEQ ID NO: 8523639 - DNA, 22 bp, Homo sapiens
gccttctgcgctcgtgtctccg

SEQ ID NO: 8523640 - DNA, 22 bp, Homo sapiens
gccttctgcgctcgtgtctccg

SEQ ID NO: 8523641 - DNA, 22 bp, Homo sapiens
gccttctgatcgctggactgac

SEQ ID NO: 8523642 - DNA, 22 bp, Homo sapiens
gccttctgattgctggactgac

SEQ ID NO: 8523643 - DNA, 22 bp, Homo sapiens
gccttctgatcgctggactgac

SEQ ID NO: 8523644 - DNA, 22 bp, Homo sapiens
gccttctgattgctggactgac

SEQ ID NO: 8523645 - DNA, 22 bp, Homo sapiens
gccttctgtgctcctggccttt

SEQ ID NO: 8523646 - DNA, 22 bp, Homo sapiens
gcgaatctcagctggtgctgcg

SEQ ID NO: 8523647 - DNA, 22 bp, Homo sapiens
gccttttttgttgctctgtcac

SEQ ID NO: 8523648 - DNA, 22 bp, Homo sapiens
gccttttttgttgctctgtcac

SEQ ID NO: 8523649 - DNA, 22 bp, Homo sapiens
gccttgccaaggggcagcagag

SEQ ID NO: 8523650 - DNA, 22 bp, Homo sapiens
gccttgatctgctgtgtttgag

SEQ ID NO: 8523651 - DNA, 16 bp, Homo sapiens
gcgcctcctcggcctc

SEQ ID NO: 8523652 - DNA, 22 bp, Homo sapiens
gcgcctgccaccatgccaggct

SEQ ID NO: 8523653 - DNA, 22 bp, Homo sapiens
gcgcctggcacacagcaagggc

SEQ ID NO: 8523654 - DNA, 16 bp, Homo sapiens
gcgcctcctcggcctc

SEQ ID NO: 8523655 - DNA, 22 bp, Homo sapiens
gcgagaaactaagtgccctttg

SEQ ID NO: 8523656 - DNA, 22 bp, Homo sapiens
gctcacagccggctggcagggg

SEQ ID NO: 8523657 - DNA, 22 bp, Homo sapiens
gctcacagccggctggcagggg

SEQ ID NO: 8523658 - DNA, 22 bp, Homo sapiens
gctcacagccggctggcagggg

SEQ ID NO: 8523659 - DNA, 22 bp, Homo sapiens
gctcacagccggctggcagggg

SEQ ID NO: 8523660 - DNA, 22 bp, Homo sapiens
gctcacaggcagtgttgggaga

SEQ ID NO: 8523661 - DNA, 22 bp, Homo sapiens
gctcacagcccaggccagcgtg

SEQ ID NO: 8523662 - DNA, 23 bp, Homo sapiens
gctcacagaatgttgaagggaat

SEQ ID NO: 8523663 - DNA, 22 bp, Homo sapiens
gctcacagtctgctgagtgcag

SEQ ID NO: 8523664 - DNA, 22 bp, Homo sapiens
gctcacagtacagtgctggctc

SEQ ID NO: 8523665 - DNA, 22 bp, Homo sapiens
gctcacaggggcagacgagttg

SEQ ID NO: 8523666 - DNA, 22 bp, Homo sapiens
gctcagctgggaccaatgtgtt

SEQ ID NO: 8523667 - DNA, 22 bp, Homo sapiens
gctcagctgggaccaatgtgtt

SEQ ID NO: 8523668 - DNA, 22 bp, Homo sapiens
gctcaggcatgtatgtggttgc

SEQ ID NO: 8523669 - DNA, 22 bp, Homo sapiens
gctcaggcccagcggctggtgt

SEQ ID NO: 8523670 - DNA, 22 bp, Homo sapiens
gctcaccaagcagagactctgg

SEQ ID NO: 8523671 - DNA, 22 bp, Homo sapiens
gctcacctcgctgcaggtgggt

SEQ ID NO: 8523672 - DNA, 21 bp, Homo sapiens
gctcagctgcttggttcctgt

SEQ ID NO: 8523673 - DNA, 22 bp, Homo sapiens
gctcactgcaacctccacctcc

SEQ ID NO: 8523674 - DNA, 22 bp, Homo sapiens
gctcaccttcgtccagcagccg

SEQ ID NO: 8523675 - DNA, 22 bp, Homo sapiens
gctcactgcaacctccacctcc

SEQ ID NO: 8523676 - DNA, 22 bp, Homo sapiens
gctcaccttcgtccagcagccg

SEQ ID NO: 8523677 - DNA, 22 bp, Homo sapiens
gcggggggcagcagtcgctcag

SEQ ID NO: 8523678 - DNA, 22 bp, Homo sapiens
gcggggggaggaacatcttgca

SEQ ID NO: 8523679 - DNA, 22 bp, Homo sapiens
gcgggggcggcgcagacctcag

SEQ ID NO: 8523680 - DNA, 22 bp, Homo sapiens
gcgggggcggcgcagacctcag

SEQ ID NO: 8523681 - DNA, 22 bp, Homo sapiens
gcggggcccccggccgagctct

SEQ ID NO: 8523682 - DNA, 22 bp, Homo sapiens
gcggggcccggacccagcctct

SEQ ID NO: 8523683 - DNA, 22 bp, Homo sapiens
gcggggcccggacccagcctct

SEQ ID NO: 8523684 - DNA, 21 bp, Homo sapiens
gctatgaatgtagaaaattat

SEQ ID NO: 8523685 - DNA, 22 bp, Homo sapiens
gctcaagagagatgcagttctt

SEQ ID NO: 8523686 - DNA, 22 bp, Homo sapiens
gctcaagccttctgcccacctc

SEQ ID NO: 8523687 - DNA, 22 bp, Homo sapiens
gctcaaggcaggcagacatgag

SEQ ID NO: 8523688 - DNA, 22 bp, Homo sapiens
gctcaagggatgggagtgggtg

SEQ ID NO: 8523689 - DNA, 22 bp, Homo sapiens
gctcaaggcaggcagacatgag

SEQ ID NO: 8523690 - DNA, 22 bp, Homo sapiens
gctcaaggcaggcagacatgag

SEQ ID NO: 8523691 - DNA, 22 bp, Homo sapiens
gctgaataatgtgtaatgtctc

SEQ ID NO: 8523692 - DNA, 22 bp, Homo sapiens
gctgaataagagtctactttgc

SEQ ID NO: 8523693 - DNA, 22 bp, Homo sapiens
gctgaagggagtgctgagtctg

SEQ ID NO: 8523694 - DNA, 22 bp, Homo sapiens
gctgaaggtctctggagaggtc

SEQ ID NO: 8523695 - DNA, 22 bp, Homo sapiens
gctgaaggtgtgtggagagagg

SEQ ID NO: 8523696 - DNA, 22 bp, Homo sapiens
gctgaaggcccggaggacaggg

SEQ ID NO: 8523697 - DNA, 22 bp, Homo sapiens
gctgaagctgcagcaggaggaa

SEQ ID NO: 8523698 - DNA, 22 bp, Homo sapiens
gctgaagctgcagcaggaggaa

SEQ ID NO: 8523699 - DNA, 22 bp, Homo sapiens
gctgaagataagtgaagaggct

SEQ ID NO: 8523700 - DNA, 22 bp, Homo sapiens
gctgaagataagtgaagaggct

SEQ ID NO: 8523701 - DNA, 22 bp, Homo sapiens
gctgaagcccacgtggcttgta

SEQ ID NO: 8523702 - DNA, 22 bp, Homo sapiens
gctgaagctgacacatagtgct

SEQ ID NO: 8523703 - DNA, 22 bp, Homo sapiens
gctgaagctgacacatagtgct

SEQ ID NO: 8523704 - DNA, 22 bp, Homo sapiens
gctgcaccagctccaccagggc

SEQ ID NO: 8523705 - DNA, 22 bp, Homo sapiens
gctgcacttgagcctgggagaa

SEQ ID NO: 8523706 - DNA, 22 bp, Homo sapiens
gctgcagaatttccttctcatt

SEQ ID NO: 8523707 - DNA, 22 bp, Homo sapiens
gctgattttgagaagcacagtc

SEQ ID NO: 8523708 - DNA, 22 bp, Homo sapiens
gctgatgtttcaagtatagctt

SEQ ID NO: 8523709 - DNA, 22 bp, Homo sapiens
gctgattattacatgtctgtgg

SEQ ID NO: 8523710 - DNA, 22 bp, Homo sapiens
gctgcaactgttgctctctgca

SEQ ID NO: 8523711 - DNA, 22 bp, Homo sapiens
gctgatggcttgctggctgaca

SEQ ID NO: 8523712 - DNA, 22 bp, Homo sapiens
gctgatgtatatagtgattgag

SEQ ID NO: 8523713 - DNA, 22 bp, Homo sapiens
gctgatgtaagacttttggttt

SEQ ID NO: 8523714 - DNA, 22 bp, Homo sapiens
gctgatgtttagttgatgttac

SEQ ID NO: 8523715 - DNA, 22 bp, Homo sapiens
gctgatgtttagttgatgttac

SEQ ID NO: 8523716 - DNA, 22 bp, Homo sapiens
gctgatccttttatgtctagct

SEQ ID NO: 8523717 - DNA, 22 bp, Homo sapiens
gctgatagactgaatgttggga

SEQ ID NO: 8523718 - DNA, 22 bp, Homo sapiens
gctgaataggactgtcatctct

SEQ ID NO: 8523719 - DNA, 22 bp, Homo sapiens
gctgaatagaagtcttcaaagg

SEQ ID NO: 8523720 - DNA, 22 bp, Homo sapiens
gctgaatacagcatgccttatg

SEQ ID NO: 8523721 - DNA, 22 bp, Homo sapiens
gctgaataattctttgttgtgg

SEQ ID NO: 8523722 - DNA, 22 bp, Homo sapiens
gctgaataatgtgtaatgtctc

SEQ ID NO: 8523723 - DNA, 22 bp, Homo sapiens
gctgcaggatgaggctctgctc

SEQ ID NO: 8523724 - DNA, 22 bp, Homo sapiens
gctgccactctgagcttgcttc

SEQ ID NO: 8523725 - DNA, 22 bp, Homo sapiens
gctgccacttggtcatgtcatg

SEQ ID NO: 8523726 - DNA, 22 bp, Homo sapiens
gctgccagccaacttgctgtgc

SEQ ID NO: 8523727 - DNA, 22 bp, Homo sapiens
gctgccagccagggtgggatcc

SEQ ID NO: 8523728 - DNA, 22 bp, Homo sapiens
gctgccagcacagttcagctgt

SEQ ID NO: 8523729 - DNA, 22 bp, Homo sapiens
gctgcaggagattttgagagtc

SEQ ID NO: 8523730 - DNA, 22 bp, Homo sapiens
gctgcagctttaggatccagtg

SEQ ID NO: 8523731 - DNA, 22 bp, Homo sapiens
gctgcagctttaggatccagtg

SEQ ID NO: 8523732 - DNA, 22 bp, Homo sapiens
gctgcaggagctggagctgtgg

SEQ ID NO: 8523733 - DNA, 22 bp, Homo sapiens
gctgcaggagctggagctgtgg

SEQ ID NO: 8523734 - DNA, 22 bp, Homo sapiens
gctgcagactgggaggcaggtg

SEQ ID NO: 8523735 - DNA, 22 bp, Homo sapiens
gctgcagctttaggatccagtg

SEQ ID NO: 8523736 - DNA, 23 bp, Homo sapiens
gctgcagctgtggatgttctcag

SEQ ID NO: 8523737 - DNA, 22 bp, Homo sapiens
gctgcagactgggaggcaggtg

SEQ ID NO: 8523738 - DNA, 22 bp, Homo sapiens
gctgcagctgtaggacacaatt

SEQ ID NO: 8523739 - DNA, 22 bp, Homo sapiens
gctgccagggaggtggtggagg

SEQ ID NO: 8523740 - DNA, 22 bp, Homo sapiens
gctgccagctttccttggctga

SEQ ID NO: 8523741 - DNA, 22 bp, Homo sapiens
gctgccagccctcggggtctga

SEQ ID NO: 8523742 - DNA, 22 bp, Homo sapiens
gctgccagctcactctcctgag

SEQ ID NO: 8523743 - DNA, 22 bp, Homo sapiens
gctgccagctcactctcctgag

SEQ ID NO: 8523744 - DNA, 22 bp, Homo sapiens
gctgccagtgtggcatgatgca

SEQ ID NO: 8523745 - DNA, 20 bp, Homo sapiens
gctgccagtgcctgatgctt

SEQ ID NO: 8523746 - DNA, 22 bp, Homo sapiens
gctgccagtgtggcatgatgca

SEQ ID NO: 8523747 - DNA, 22 bp, Homo sapiens
gctgccagtagttggagctcca

SEQ ID NO: 8523748 - DNA, 22 bp, Homo sapiens
gctgccagtagttggagctcca

SEQ ID NO: 8523749 - DNA, 22 bp, Homo sapiens
gctgccaggggcagctgtctca

SEQ ID NO: 8523750 - DNA, 19 bp, Homo sapiens
gctcaggctgtgtgtgggg

SEQ ID NO: 8523751 - DNA, 22 bp, Homo sapiens
gctcaggcttcttctataaaga

SEQ ID NO: 8523752 - DNA, 21 bp, Homo sapiens
gctcaggctcttgacagagca

SEQ ID NO: 8523753 - DNA, 22 bp, Homo sapiens
gctcaggctggattgcagtggc

SEQ ID NO: 8523754 - DNA, 22 bp, Homo sapiens
gctcctggtctggagcttcaag

SEQ ID NO: 8523755 - DNA, 22 bp, Homo sapiens
gctcctggtgcaaagtttcttc

SEQ ID NO: 8523756 - DNA, 22 bp, Homo sapiens
gctcagggaaagagctcctgtc

SEQ ID NO: 8523757 - DNA, 22 bp, Homo sapiens
gctcagggaactttttgcaggc

SEQ ID NO: 8523758 - DNA, 22 bp, Homo sapiens
gctcctggtctggagcttcaag

SEQ ID NO: 8523759 - DNA, 22 bp, Homo sapiens
gctcaggcctccagaggggcaa

SEQ ID NO: 8523760 - DNA, 22 bp, Homo sapiens
gctcaggcctccagaggggcaa

SEQ ID NO: 8523761 - DNA, 22 bp, Homo sapiens
gctcaggcctcactccatttgg

SEQ ID NO: 8523762 - DNA, 18 bp, Homo sapiens
gctcaggccctagtcagt

SEQ ID NO: 8523763 - DNA, 18 bp, Homo sapiens
gctcaggccctagtcagt

SEQ ID NO: 8523764 - DNA, 22 bp, Homo sapiens
gctcaggcctggcccatgggac

SEQ ID NO: 8523765 - DNA, 22 bp, Homo sapiens
gctcaggcctcggacacacaat

SEQ ID NO: 8523766 - DNA, 22 bp, Homo sapiens
gctcaggcctcggacacacaat

SEQ ID NO: 8523767 - DNA, 22 bp, Homo sapiens
gctcaggcctccagaggggcaa

SEQ ID NO: 8523768 - DNA, 22 bp, Homo sapiens
gctcaggcctggctatccattg

SEQ ID NO: 8523769 - DNA, 21 bp, Homo sapiens
gctcaggctcaggttcaggtt

SEQ ID NO: 8523770 - DNA, 22 bp, Homo sapiens
gctcaggctctcccaggggaat

SEQ ID NO: 8523771 - DNA, 22 bp, Homo sapiens
gctcaggctctcccaggggaat

SEQ ID NO: 8523772 - DNA, 21 bp, Homo sapiens
gctcaggctcttgacagagca

SEQ ID NO: 8523773 - DNA, 22 bp, Homo sapiens
gctcctgtcatcaaacaatcct

SEQ ID NO: 8523774 - DNA, 18 bp, Homo sapiens
gctcctggttggaaagaa

SEQ ID NO: 8523775 - DNA, 20 bp, Homo sapiens
gctcctgtcctggtggaggg

SEQ ID NO: 8523776 - DNA, 22 bp, Homo sapiens
gctcctgtcttggggcactggc

SEQ ID NO: 8523777 - DNA, 21 bp, Homo sapiens
gctcctggtgctgcgtggcgc

SEQ ID NO: 8523778 - DNA, 21 bp, Homo sapiens
gctcctggtgctgcgtggcgc

SEQ ID NO: 8523779 - DNA, 21 bp, Homo sapiens
gctcctggtgctgcgtggcgc

SEQ ID NO: 8523780 - DNA, 22 bp, Homo sapiens
gctcctggtgctgtagagattt

SEQ ID NO: 8523781 - DNA, 22 bp, Homo sapiens
gctcctggtgctgtagagattt

SEQ ID NO: 8523782 - DNA, 22 bp, Homo sapiens
gctctatgttgaccttcagtgg

SEQ ID NO: 8523783 - DNA, 22 bp, Homo sapiens
gctccttcaggtggtagctgtt

SEQ ID NO: 8523784 - DNA, 22 bp, Homo sapiens
gctcctgtgcaggtctcggttg

SEQ ID NO: 8523785 - DNA, 22 bp, Homo sapiens
gctcctgtttgtttgttcctga

SEQ ID NO: 8523786 - DNA, 22 bp, Homo sapiens
gctctcagcccactgaggggaa

SEQ ID NO: 8523787 - DNA, 21 bp, Homo sapiens
gctctcagctgcctgctggtt

SEQ ID NO: 8523788 - DNA, 22 bp, Homo sapiens
gctctcagaagagccaggctac

SEQ ID NO: 8523789 - DNA, 22 bp, Homo sapiens
gctctcaagtccttttgctcag

SEQ ID NO: 8523790 - DNA, 22 bp, Homo sapiens
gctctgctggagggaaagagaa

SEQ ID NO: 8523791 - DNA, 17 bp, Homo sapiens
gctctggcacaggattg

SEQ ID NO: 8523792 - DNA, 23 bp, Homo sapiens
gctctggcagcttgtgtcagcac

SEQ ID NO: 8523793 - DNA, 23 bp, Homo sapiens
gctctggcagcttgtgtcagcac

SEQ ID NO: 8523794 - DNA, 22 bp, Homo sapiens
gctctgctgcttactagatggt

SEQ ID NO: 8523795 - DNA, 22 bp, Homo sapiens
gctctgctgatccgcagccatc

SEQ ID NO: 8523796 - DNA, 22 bp, Homo sapiens
gctctgctgagatatctgggag

SEQ ID NO: 8523797 - DNA, 22 bp, Homo sapiens
gctctggctactgtggctaccg

SEQ ID NO: 8523798 - DNA, 22 bp, Homo sapiens
gctctggctactgtggctaccg

SEQ ID NO: 8523799 - DNA, 22 bp, Homo sapiens
gctctggctactgtggctaccg

SEQ ID NO: 8523800 - DNA, 22 bp, Homo sapiens
gctgaagagcaaggctgggtct

SEQ ID NO: 8523801 - DNA, 22 bp, Homo sapiens
gctgaagagcaaggctgggtct

SEQ ID NO: 8523802 - DNA, 22 bp, Homo sapiens
gctgaagagagatgcgtccagc

SEQ ID NO: 8523803 - DNA, 22 bp, Homo sapiens
gctctggccagaccctcagtgg

SEQ ID NO: 8523804 - DNA, 22 bp, Homo sapiens
gctctggctactccaccctgtt

SEQ ID NO: 8523805 - DNA, 21 bp, Homo sapiens
gctctggcctactgttccctc

SEQ ID NO: 8523806 - DNA, 17 bp, Homo sapiens
gctctgccccagcctct

SEQ ID NO: 8523807 - DNA, 17 bp, Homo sapiens
gctctgccccagcctct

SEQ ID NO: 8523808 - DNA, 17 bp, Homo sapiens
gctctgccccagcctct

SEQ ID NO: 8523809 - DNA, 18 bp, Homo sapiens
gctctgcccaggctgccc

SEQ ID NO: 8523810 - DNA, 22 bp, Homo sapiens
gctctccaaaccctgtggcttt

SEQ ID NO: 8523811 - DNA, 22 bp, Homo sapiens
gctctccaaaccctgtggcttt

SEQ ID NO: 8523812 - DNA, 22 bp, Homo sapiens
gctctcagggtgatggcatact

SEQ ID NO: 8523813 - DNA, 22 bp, Homo sapiens
gctctcaggtacaaagctgtgt

SEQ ID NO: 8523814 - DNA, 22 bp, Homo sapiens
gctctccactgaccacggggca

SEQ ID NO: 8523815 - DNA, 22 bp, Homo sapiens
gctctgcctggtcgcgtgctgg

SEQ ID NO: 8523816 - DNA, 17 bp, Homo sapiens
gctctgcctctcccacc

SEQ ID NO: 8523817 - DNA, 22 bp, Homo sapiens
gctctgcctctttgctgcgtca

SEQ ID NO: 8523818 - DNA, 22 bp, Homo sapiens
gctctgcctcccctagtgttac

SEQ ID NO: 8523819 - DNA, 22 bp, Homo sapiens
ggagagctggtagctggctcca

SEQ ID NO: 8523820 - DNA, 22 bp, Homo sapiens
ggagagagatgccgccttgctc

SEQ ID NO: 8523821 - DNA, 22 bp, Homo sapiens
ggactgaggcccacttgaggga

SEQ ID NO: 8523822 - DNA, 22 bp, Homo sapiens
ggagagagatgccgccttgctc

SEQ ID NO: 8523823 - DNA, 22 bp, Homo sapiens
ggagagagatgccgccttgctc

SEQ ID NO: 8523824 - DNA, 22 bp, Homo sapiens
ggagagagatgccgccttgctc

SEQ ID NO: 8523825 - DNA, 22 bp, Homo sapiens
ggactgaggacatgtgaggcat

SEQ ID NO: 8523826 - DNA, 22 bp, Homo sapiens
ggactgagctgacatctgttgg

SEQ ID NO: 8523827 - DNA, 22 bp, Homo sapiens
ggactgaatggaagatatatgg

SEQ ID NO: 8523828 - DNA, 22 bp, Homo sapiens
ggactctgttttcctgatcact

SEQ ID NO: 8523829 - DNA, 20 bp, Homo sapiens
ggactgaaaacacaaacctg

SEQ ID NO: 8523830 - DNA, 22 bp, Homo sapiens
ggactgaaatctttccatgtca

SEQ ID NO: 8523831 - DNA, 22 bp, Homo sapiens
ggactgaacacttaaatgtcca

SEQ ID NO: 8523832 - DNA, 22 bp, Homo sapiens
ggactgaaggacaatctggttc

SEQ ID NO: 8523833 - DNA, 22 bp, Homo sapiens
ggacgcagccgagggagcaggg

SEQ ID NO: 8523834 - DNA, 22 bp, Homo sapiens
ggacggggagctggaaagggga

SEQ ID NO: 8523835 - DNA, 22 bp, Homo sapiens
ggacgcagcgagggaagcagcc

SEQ ID NO: 8523836 - DNA, 22 bp, Homo sapiens
ggacggggagctggaaagggga

SEQ ID NO: 8523837 - DNA, 20 bp, Homo sapiens
ggactacaatttgcagtgtg

SEQ ID NO: 8523838 - DNA, 22 bp, Homo sapiens
ggacggggagctggaaagggga

SEQ ID NO: 8523839 - DNA, 18 bp, Homo sapiens
ggactacaggcacaggga

SEQ ID NO: 8523840 - DNA, 22 bp, Homo sapiens
ggactcagcagccaggagtggc

SEQ ID NO: 8523841 - DNA, 23 bp, Homo sapiens
ggactaggcaacagatgggacag

SEQ ID NO: 8523842 - DNA, 22 bp, Homo sapiens
ggactcagcagccaggagtggc

SEQ ID NO: 8523843 - DNA, 22 bp, Homo sapiens
ggactcaggctggtgttcggac

SEQ ID NO: 8523844 - DNA, 22 bp, Homo sapiens
ggagaggagctattgggggctc

SEQ ID NO: 8523845 - DNA, 22 bp, Homo sapiens
ggagaggatgttttagtaactt

SEQ ID NO: 8523846 - DNA, 22 bp, Homo sapiens
ggagaggcgatgagtcacagcc

SEQ ID NO: 8523847 - DNA, 22 bp, Homo sapiens
ggagaggcgatgagtcacagcc

SEQ ID NO: 8523848 - DNA, 19 bp, Homo sapiens
ggagaggctggagggatgc

SEQ ID NO: 8523849 - DNA, 22 bp, Homo sapiens
ggagaggcttccagagtcgtgc

SEQ ID NO: 8523850 - DNA, 22 bp, Homo sapiens
ggagaggcgatgagtcacagcc

SEQ ID NO: 8523851 - DNA, 22 bp, Homo sapiens
ggagaggagctattgggggctc

SEQ ID NO: 8523852 - DNA, 22 bp, Homo sapiens
ggagaggagattgtggcatttt

SEQ ID NO: 8523853 - DNA, 22 bp, Homo sapiens
ggagaggagctattgggggctc

SEQ ID NO: 8523854 - DNA, 22 bp, Homo sapiens
ggagaggagattgtggcatttt

SEQ ID NO: 8523855 - DNA, 22 bp, Homo sapiens
ggagaggagattgtggcatttt

SEQ ID NO: 8523856 - DNA, 22 bp, Homo sapiens
ggagaggaaatgccagcacttc

SEQ ID NO: 8523857 - DNA, 22 bp, Homo sapiens
ggagaggacatggctcccacag

SEQ ID NO: 8523858 - DNA, 22 bp, Homo sapiens
ggagaggacatggctcccacag

SEQ ID NO: 8523859 - DNA, 22 bp, Homo sapiens
ggagaggaaatgccagcacttc

SEQ ID NO: 8523860 - DNA, 22 bp, Homo sapiens
ggagaggaaatgccagcacttc

SEQ ID NO: 8523861 - DNA, 22 bp, Homo sapiens
ggagagctggtatatgaagaca

SEQ ID NO: 8523862 - DNA, 22 bp, Homo sapiens
ggagagctggtatatgaagaca

SEQ ID NO: 8523863 - DNA, 22 bp, Homo sapiens
ggagagcttggagtgcgatttt

SEQ ID NO: 8523864 - DNA, 22 bp, Homo sapiens
ggacagagcagacgagcagcgg

SEQ ID NO: 8523865 - DNA, 22 bp, Homo sapiens
ggacagagcagacgagcagcgg

SEQ ID NO: 8523866 - DNA, 22 bp, Homo sapiens
ggacagagagtgaatatgacat

SEQ ID NO: 8523867 - DNA, 22 bp, Homo sapiens
ggacagagagtgaatatgacat

SEQ ID NO: 8523868 - DNA, 22 bp, Homo sapiens
ggacagagccctggtggcctaa

SEQ ID NO: 8523869 - DNA, 22 bp, Homo sapiens
ggacagagccctggtggcctaa

SEQ ID NO: 8523870 - DNA, 22 bp, Homo sapiens
ggacagagccctggtggcctaa

SEQ ID NO: 8523871 - DNA, 22 bp, Homo sapiens
ggacagagcagacgagcagcgg

SEQ ID NO: 8523872 - DNA, 17 bp, Homo sapiens
ggacacctggagtctcc

SEQ ID NO: 8523873 - DNA, 21 bp, Homo sapiens
ggacaccagtcacactggatt

SEQ ID NO: 8523874 - DNA, 22 bp, Homo sapiens
ggacacgtggctgaaggcggcc

SEQ ID NO: 8523875 - DNA, 17 bp, Homo sapiens
ggacacctggagtctcc

SEQ ID NO: 8523876 - DNA, 22 bp, Homo sapiens
ggacactgaagaatctcagatg

SEQ ID NO: 8523877 - DNA, 21 bp, Homo sapiens
ggacactgataatcttgttgc

SEQ ID NO: 8523878 - DNA, 23 bp, Homo sapiens
ggacactgctataaaggatctgc

SEQ ID NO: 8523879 - DNA, 22 bp, Homo sapiens
ggacactgttcatggggagggg

SEQ ID NO: 8523880 - DNA, 22 bp, Homo sapiens
ggacactttgagttgaaggggt

SEQ ID NO: 8523881 - DNA, 22 bp, Homo sapiens
ggacagaaaccatatgagtgta

SEQ ID NO: 8523882 - DNA, 22 bp, Homo sapiens
ggacactggccacatttcaaaa

SEQ ID NO: 8523883 - DNA, 20 bp, Homo sapiens
ggacactgtagatttcaaac

SEQ ID NO: 8523884 - DNA, 22 bp, Homo sapiens
ggacactgtataagttagagta

SEQ ID NO: 8523885 - DNA, 22 bp, Homo sapiens
ggacactgtataagttagagta

SEQ ID NO: 8523886 - DNA, 23 bp, Homo sapiens
ggacactgtgcagatgctagtgc

SEQ ID NO: 8523887 - DNA, 23 bp, Homo sapiens
ggacactgtgcagatgctagtgc

SEQ ID NO: 8523888 - DNA, 22 bp, Homo sapiens
ggacccagctctgagaccctgc

SEQ ID NO: 8523889 - DNA, 22 bp, Homo sapiens
ggacccaggtagggaggaagat

SEQ ID NO: 8523890 - DNA, 22 bp, Homo sapiens
ggacagagggcaggagcccaga

SEQ ID NO: 8523891 - DNA, 22 bp, Homo sapiens
ggacagagggcaggagcccaga

SEQ ID NO: 8523892 - DNA, 21 bp, Homo sapiens
ggacagaggagaaggcaccct

SEQ ID NO: 8523893 - DNA, 21 bp, Homo sapiens
ggacagaggagaaggcaccct

SEQ ID NO: 8523894 - DNA, 22 bp, Homo sapiens
ggacctgaacataaaacgaggc

SEQ ID NO: 8523895 - DNA, 22 bp, Homo sapiens
ggacctgccagaactcaggcta

SEQ ID NO: 8523896 - DNA, 22 bp, Homo sapiens
ggaccctgggcttgctcctggg

SEQ ID NO: 8523897 - DNA, 22 bp, Homo sapiens
ggaccctgcagccacccgacat

SEQ ID NO: 8523898 - DNA, 22 bp, Homo sapiens
ggaccctggagacccactggga

SEQ ID NO: 8523899 - DNA, 22 bp, Homo sapiens
ggaccctgggctctgggcctat

SEQ ID NO: 8523900 - DNA, 22 bp, Homo sapiens
ggaccctgggcttgctcctggg

SEQ ID NO: 8523901 - DNA, 22 bp, Homo sapiens
ggaccctgggcagctggctgct

SEQ ID NO: 8523902 - DNA, 22 bp, Homo sapiens
ggaccctgggcagctggctgct

SEQ ID NO: 8523903 - DNA, 22 bp, Homo sapiens
ggaaggaacaaaccctgtgtgg

SEQ ID NO: 8523904 - DNA, 22 bp, Homo sapiens
ggaaggaaattggggcagttgt

SEQ ID NO: 8523905 - DNA, 22 bp, Homo sapiens
ggacacagtggaagacagcttg

SEQ ID NO: 8523906 - DNA, 23 bp, Homo sapiens
ggacacatttatttcagaattca

SEQ ID NO: 8523907 - DNA, 21 bp, Homo sapiens
ggacaccagtcacactggatt

SEQ ID NO: 8523908 - DNA, 22 bp, Homo sapiens
ggaaggaagtaaatgatgctat

SEQ ID NO: 8523909 - DNA, 22 bp, Homo sapiens
ggaaggaagaggaccgagctgg

SEQ ID NO: 8523910 - DNA, 22 bp, Homo sapiens
ggaagctgttgtgagtgcagca

SEQ ID NO: 8523911 - DNA, 22 bp, Homo sapiens
ggaagctgttgtgagtgcagca

SEQ ID NO: 8523912 - DNA, 21 bp, Homo sapiens
ggaagctgtgtccatgctcct

SEQ ID NO: 8523913 - DNA, 22 bp, Homo sapiens
ggaagctgttgtgagtgcagca

SEQ ID NO: 8523914 - DNA, 22 bp, Homo sapiens
ggaacctgtacgttgtccttga

SEQ ID NO: 8523915 - DNA, 22 bp, Homo sapiens
ggaacccatgattatggttagg

SEQ ID NO: 8523916 - DNA, 22 bp, Homo sapiens
ggaaccaggagttacacgagtt

SEQ ID NO: 8523917 - DNA, 22 bp, Homo sapiens
ggaacatttcctggcagagagg

SEQ ID NO: 8523918 - DNA, 15 bp, Homo sapiens
ggaacatttctgttt

SEQ ID NO: 8523919 - DNA, 22 bp, Homo sapiens
ggaacattttttaaggcagaaa

SEQ ID NO: 8523920 - DNA, 22 bp, Homo sapiens
ggaacattttttaaggcagaaa

SEQ ID NO: 8523921 - DNA, 21 bp, Homo sapiens
ggaacattgttaatagtctct

SEQ ID NO: 8523922 - DNA, 22 bp, Homo sapiens
ggaacatttcctggcagagagg

SEQ ID NO: 8523923 - DNA, 22 bp, Homo sapiens
ggaacatttaaattcttatttg

SEQ ID NO: 8523924 - DNA, 22 bp, Homo sapiens
ggaacagggatttggcctggtt

SEQ ID NO: 8523925 - DNA, 22 bp, Homo sapiens
ggaacagggatttggcctggtt

SEQ ID NO: 8523926 - DNA, 20 bp, Homo sapiens
ggaacatgaatgtgagtggc

SEQ ID NO: 8523927 - DNA, 20 bp, Homo sapiens
ggaacatgaatgtgagtggc

SEQ ID NO: 8523928 - DNA, 22 bp, Homo sapiens
ggaacatactgtgtagactttg

SEQ ID NO: 8523929 - DNA, 22 bp, Homo sapiens
ggaacatactgtgtagactttg

SEQ ID NO: 8523930 - DNA, 22 bp, Homo sapiens
ggaacattggcattttaaggct

SEQ ID NO: 8523931 - DNA, 22 bp, Homo sapiens
ggaacatgtagagggcctgtag

SEQ ID NO: 8523932 - DNA, 22 bp, Homo sapiens
ggaacattctagagtgttgtga

SEQ ID NO: 8523933 - DNA, 21 bp, Homo sapiens
ggaacattgttaatagtctct

SEQ ID NO: 8523934 - DNA, 22 bp, Homo sapiens
ggaagccaggccaatgagaaca

SEQ ID NO: 8523935 - DNA, 22 bp, Homo sapiens
ggaagccaggcccagagatgct

SEQ ID NO: 8523936 - DNA, 22 bp, Homo sapiens
ggaagccagagtgctgggcagg

SEQ ID NO: 8523937 - DNA, 20 bp, Homo sapiens
ggaagccagggtgcagggga

SEQ ID NO: 8523938 - DNA, 22 bp, Homo sapiens
ggaagccaggcccagagatgct

SEQ ID NO: 8523939 - DNA, 22 bp, Homo sapiens
gcttcctccctgctgctcacta

SEQ ID NO: 8523940 - DNA, 22 bp, Homo sapiens
gcttcctcctggaggtcactca

SEQ ID NO: 8523941 - DNA, 22 bp, Homo sapiens
gcttcctcgctgggcagaggca

SEQ ID NO: 8523942 - DNA, 22 bp, Homo sapiens
gcttcctcgctgggcagaggca

SEQ ID NO: 8523943 - DNA, 17 bp, Homo sapiens
gcttcctcatgcagttc

SEQ ID NO: 8523944 - DNA, 22 bp, Homo sapiens
gcttcctccctgctgctcacta

SEQ ID NO: 8523945 - DNA, 22 bp, Homo sapiens
gcttcctccctgctgctcacta

SEQ ID NO: 8523946 - DNA, 22 bp, Homo sapiens
gcttcctccctgctgctcacta

SEQ ID NO: 8523947 - DNA, 22 bp, Homo sapiens
gcttcctccctgctgctcacta

SEQ ID NO: 8523948 - DNA, 22 bp, Homo sapiens
gcttcctgagaaacaatctgat

SEQ ID NO: 8523949 - DNA, 22 bp, Homo sapiens
gcttcctgagaaacaatctgat

SEQ ID NO: 8523950 - DNA, 22 bp, Homo sapiens
gcttcctgagacaacattgagt

SEQ ID NO: 8523951 - DNA, 18 bp, Homo sapiens
gcttcctgaaagctgccc

SEQ ID NO: 8523952 - DNA, 22 bp, Homo sapiens
gcttcctgagaaacaatctgat

SEQ ID NO: 8523953 - DNA, 22 bp, Homo sapiens
gcttcccacagctggactgggg

SEQ ID NO: 8523954 - DNA, 22 bp, Homo sapiens
gcttcccacagctggactgggg

SEQ ID NO: 8523955 - DNA, 19 bp, Homo sapiens
gcttcccaccagccagccc

SEQ ID NO: 8523956 - DNA, 22 bp, Homo sapiens
gcttcccctccaagcactgcct

SEQ ID NO: 8523957 - DNA, 17 bp, Homo sapiens
gcttcctcatgcagttc

SEQ ID NO: 8523958 - DNA, 22 bp, Homo sapiens
gcttcctagatctgtggtactc

SEQ ID NO: 8523959 - DNA, 22 bp, Homo sapiens
gcttcctaaatgcacagggcag

SEQ ID NO: 8523960 - DNA, 22 bp, Homo sapiens
gcttcctagcattagccattgc

SEQ ID NO: 8523961 - DNA, 22 bp, Homo sapiens
gcttcctagatctgtggtactc

SEQ ID NO: 8523962 - DNA, 22 bp, Homo sapiens
gcttcctacatgtgtctgcgag

SEQ ID NO: 8523963 - DNA, 22 bp, Homo sapiens
ggaaagtggtggtggaaagagg

SEQ ID NO: 8523964 - DNA, 17 bp, Homo sapiens
ggaaaggtagagtaatc

SEQ ID NO: 8523965 - DNA, 22 bp, Homo sapiens
ggaaatctctactttgtcattt

SEQ ID NO: 8523966 - DNA, 22 bp, Homo sapiens
ggaaatattttgtctaatttgt

SEQ ID NO: 8523967 - DNA, 22 bp, Homo sapiens
ggaaaggagatgaataggatta

SEQ ID NO: 8523968 - DNA, 22 bp, Homo sapiens
ggaaaggagatattggagagtg

SEQ ID NO: 8523969 - DNA, 22 bp, Homo sapiens
ggaaagctttgtacttgaaaac

SEQ ID NO: 8523970 - DNA, 22 bp, Homo sapiens
ggaaagctttgttttcctcacc

SEQ ID NO: 8523971 - DNA, 22 bp, Homo sapiens
gcttcctggaacaactgttgct

SEQ ID NO: 8523972 - DNA, 22 bp, Homo sapiens
gcttcctggaacaactgttgct

SEQ ID NO: 8523973 - DNA, 22 bp, Homo sapiens
ggaaagctcagatcttgttgga

SEQ ID NO: 8523974 - DNA, 22 bp, Homo sapiens
gcttcctgagtacaccctcatc

SEQ ID NO: 8523975 - DNA, 22 bp, Homo sapiens
gcttcctgagtacaccctcatc

SEQ ID NO: 8523976 - DNA, 22 bp, Homo sapiens
gcttcctgatattcatactgtt

SEQ ID NO: 8523977 - DNA, 22 bp, Homo sapiens
gcttcctgatattcatactgtt

SEQ ID NO: 8523978 - DNA, 22 bp, Homo sapiens
gctgtgagctgcctgtgtcaca

SEQ ID NO: 8523979 - DNA, 22 bp, Homo sapiens
gctgtgagctgcctgtgtcaca

SEQ ID NO: 8523980 - DNA, 22 bp, Homo sapiens
gctgtgagaaacagggagtgtc

SEQ ID NO: 8523981 - DNA, 22 bp, Homo sapiens
gctgtgagcactgctgggtgga

SEQ ID NO: 8523982 - DNA, 22 bp, Homo sapiens
gctgtcttgctcactcttgcag

SEQ ID NO: 8523983 - DNA, 22 bp, Homo sapiens
gctgtcttgggtagaaagaggt

SEQ ID NO: 8523984 - DNA, 22 bp, Homo sapiens
gctgtcttgctcactcttgcag

SEQ ID NO: 8523985 - DNA, 22 bp, Homo sapiens
gctgtcttgatgattggatgct

SEQ ID NO: 8523986 - DNA, 22 bp, Homo sapiens
gctgtctttcccctgctccaga

SEQ ID NO: 8523987 - DNA, 22 bp, Homo sapiens
gctgtgagggtctagtgaggtg

SEQ ID NO: 8523988 - DNA, 22 bp, Homo sapiens
gctgtgcactacctatacatcc

SEQ ID NO: 8523989 - DNA, 22 bp, Homo sapiens
gctgtgatgtggagggtgctga

SEQ ID NO: 8523990 - DNA, 22 bp, Homo sapiens
gctgtgcaaatcgatttgttgg

SEQ ID NO: 8523991 - DNA, 22 bp, Homo sapiens
gctgtgagtggagttctgtgct

SEQ ID NO: 8523992 - DNA, 22 bp, Homo sapiens
gctgtgattgtcagtcttcaat

SEQ ID NO: 8523993 - DNA, 20 bp, Homo sapiens
gcttcatttgcaagtctagt

SEQ ID NO: 8523994 - DNA, 22 bp, Homo sapiens
gcttccaatgcttctatcacat

SEQ ID NO: 8523995 - DNA, 22 bp, Homo sapiens
gcttcccaaacttgtggataga

SEQ ID NO: 8523996 - DNA, 23 bp, Homo sapiens
gcttccattctagtttgctgtgc

SEQ ID NO: 8523997 - DNA, 22 bp, Homo sapiens
gcttccatgttgctgctggtca

SEQ ID NO: 8523998 - DNA, 22 bp, Homo sapiens
gcttccatctatgtcttcatca

SEQ ID NO: 8523999 - DNA, 22 bp, Homo sapiens
gcttccatctatgtcttcatca

SEQ ID NO: 8524000 - DNA, 22 bp, Homo sapiens
gcttccagtcctcagaggctgg

SEQ ID NO: 8524001 - DNA, 22 bp, Homo sapiens
gcttccagtaagttgctgccat

SEQ ID NO: 8524002 - DNA, 22 bp, Homo sapiens
gcttccagtaagttgctgccat

SEQ ID NO: 8524003 - DNA, 22 bp, Homo sapiens
gctgtgcagccaagtgcctctg

SEQ ID NO: 8524004 - DNA, 22 bp, Homo sapiens
gctgtgcagtctttggtgtgcc

SEQ ID NO: 8524005 - DNA, 22 bp, Homo sapiens
gctgggagtcgcgtctgtggcc

SEQ ID NO: 8524006 - DNA, 16 bp, Homo sapiens
gctgggagggagaggt

SEQ ID NO: 8524007 - DNA, 16 bp, Homo sapiens
gctgggagggagaggt

SEQ ID NO: 8524008 - DNA, 22 bp, Homo sapiens
gctgggaggcagcacctttagc

SEQ ID NO: 8524009 - DNA, 16 bp, Homo sapiens
gctgggagggagaggt

SEQ ID NO: 8524010 - DNA, 16 bp, Homo sapiens
gctgggagggagaggt

SEQ ID NO: 8524011 - DNA, 20 bp, Homo sapiens
gctgggggtgtgctgagtga

SEQ ID NO: 8524012 - DNA, 20 bp, Homo sapiens
gctgggggtgtgctgagtga

SEQ ID NO: 8524013 - DNA, 22 bp, Homo sapiens
gctgggagtcgcgtctgtggcc

SEQ ID NO: 8524014 - DNA, 22 bp, Homo sapiens
gctgggagtgggcaagatgaga

SEQ ID NO: 8524015 - DNA, 22 bp, Homo sapiens
gctgggagtcgcgtctgtggcc

SEQ ID NO: 8524016 - DNA, 22 bp, Homo sapiens
gctgggagtcgcgtctgtggcc

SEQ ID NO: 8524017 - DNA, 22 bp, Homo sapiens
gctgggtccatggtcctcgggt

SEQ ID NO: 8524018 - DNA, 21 bp, Homo sapiens
gctgggtcagcaggtcctctg

SEQ ID NO: 8524019 - DNA, 22 bp, Homo sapiens
gctgggtcagaatctccctgtg

SEQ ID NO: 8524020 - DNA, 22 bp, Homo sapiens
gctgggtattttaagaaaggaa

SEQ ID NO: 8524021 - DNA, 22 bp, Homo sapiens
gctggggtctgtgaggagggct

SEQ ID NO: 8524022 - DNA, 22 bp, Homo sapiens
gctggggtctgtgaggagggct

SEQ ID NO: 8524023 - DNA, 18 bp, Homo sapiens
gctggggttgagctctcc

SEQ ID NO: 8524024 - DNA, 22 bp, Homo sapiens
gctgggtctctccctggtcctg

SEQ ID NO: 8524025 - DNA, 22 bp, Homo sapiens
gctgggtctggatgctcaggtg

SEQ ID NO: 8524026 - DNA, 22 bp, Homo sapiens
gctgggtctggctgtgagccgg

SEQ ID NO: 8524027 - DNA, 22 bp, Homo sapiens
gctgggtctggatgctcaggtg

SEQ ID NO: 8524028 - DNA, 19 bp, Homo sapiens
gctgggtgaggtcgttgga

SEQ ID NO: 8524029 - DNA, 19 bp, Homo sapiens
gctgggtgaggtcgttgga

SEQ ID NO: 8524030 - DNA, 22 bp, Homo sapiens
gctgggtctggctgtgagccgg

SEQ ID NO: 8524031 - DNA, 22 bp, Homo sapiens
gctgggtggatcggaggctctg

SEQ ID NO: 8524032 - DNA, 19 bp, Homo sapiens
gctgggtggggtccacagc

SEQ ID NO: 8524033 - DNA, 22 bp, Homo sapiens
gctgggtgtcacggggctcgtg

SEQ ID NO: 8524034 - DNA, 22 bp, Homo sapiens
gctgggtggatcggaggctctg

SEQ ID NO: 8524035 - DNA, 22 bp, Homo sapiens
gctgggtggatcggaggctctg

SEQ ID NO: 8524036 - DNA, 22 bp, Homo sapiens
gctgggttttcttccgggccta

SEQ ID NO: 8524037 - DNA, 22 bp, Homo sapiens
gctgggttttcttccgggccta

SEQ ID NO: 8524038 - DNA, 22 bp, Homo sapiens
gctgggttttcttccgggccta

SEQ ID NO: 8524039 - DNA, 22 bp, Homo sapiens
gctgggtttccagcaggcagga

SEQ ID NO: 8524040 - DNA, 22 bp, Homo sapiens
gctgtcttcacttcctggtttc

SEQ ID NO: 8524041 - DNA, 22 bp, Homo sapiens
gctgtcttcacttcctggtttc

SEQ ID NO: 8524042 - DNA, 22 bp, Homo sapiens
gctgtctgttcgagcgtgtgtt

SEQ ID NO: 8524043 - DNA, 22 bp, Homo sapiens
gctgtctgttcgagcgtgtgtt

SEQ ID NO: 8524044 - DNA, 22 bp, Homo sapiens
gctggtcagagagaaaggaggc

SEQ ID NO: 8524045 - DNA, 22 bp, Homo sapiens
gctggtcactctgggagctgct

SEQ ID NO: 8524046 - DNA, 22 bp, Homo sapiens
gctggtagacctcactgcactc

SEQ ID NO: 8524047 - DNA, 22 bp, Homo sapiens
gctggctgcagattttagaggt

SEQ ID NO: 8524048 - DNA, 22 bp, Homo sapiens
gctggctgccaatttcagagct

SEQ ID NO: 8524049 - DNA, 22 bp, Homo sapiens
gctggctgccaatttcagagct

SEQ ID NO: 8524050 - DNA, 18 bp, Homo sapiens
gctggctgcacttctgct

SEQ ID NO: 8524051 - DNA, 22 bp, Homo sapiens
gctggctgcacaggggctcact

SEQ ID NO: 8524052 - DNA, 22 bp, Homo sapiens
gctggctgcacaggggctcact

SEQ ID NO: 8524053 - DNA, 22 bp, Homo sapiens
gctggctgcacaggggctcact

SEQ ID NO: 8524054 - DNA, 22 bp, Homo sapiens
gctggctgagttctgtcgtctg

SEQ ID NO: 8524055 - DNA, 22 bp, Homo sapiens
gctggctcctctgtcctcacgg

SEQ ID NO: 8524056 - DNA, 22 bp, Homo sapiens
gctggctcgggaagcaggggat

SEQ ID NO: 8524057 - DNA, 21 bp, Homo sapiens
gctggctctctgacgtgcttt

SEQ ID NO: 8524058 - DNA, 22 bp, Homo sapiens
gctggctcttcagtggagatag

SEQ ID NO: 8524059 - DNA, 21 bp, Homo sapiens
gctggctctctgacgtgcttt

SEQ ID NO: 8524060 - DNA, 22 bp, Homo sapiens
gctggctctgcacccaggcctc

SEQ ID NO: 8524061 - DNA, 22 bp, Homo sapiens
gctgggaagagatgcacatgat

SEQ ID NO: 8524062 - DNA, 22 bp, Homo sapiens
gctgggaagagatgcacatgat

SEQ ID NO: 8524063 - DNA, 22 bp, Homo sapiens
gctgggacaggcttggccctgt

SEQ ID NO: 8524064 - DNA, 22 bp, Homo sapiens
gctgggagacagacttggaacc

SEQ ID NO: 8524065 - DNA, 22 bp, Homo sapiens
gctgggagaggccctgaagtga

SEQ ID NO: 8524066 - DNA, 22 bp, Homo sapiens
gctgggagaggcagctttcgga

SEQ ID NO: 8524067 - DNA, 22 bp, Homo sapiens
gctgggagaggcagctttcgga

SEQ ID NO: 8524068 - DNA, 22 bp, Homo sapiens
gctgggactgagacagtgacct

SEQ ID NO: 8524069 - DNA, 22 bp, Homo sapiens
gctgggagacagacttggaacc

SEQ ID NO: 8524070 - DNA, 22 bp, Homo sapiens
gctgggactgagacagtgacct

SEQ ID NO: 8524071 - DNA, 22 bp, Homo sapiens
gctgggaggatctctccctgtc

SEQ ID NO: 8524072 - DNA, 22 bp, Homo sapiens
gctgggaggatctctccctgtc

SEQ ID NO: 8524073 - DNA, 22 bp, Homo sapiens
gctgggaggatctctccctgtc

SEQ ID NO: 8524074 - DNA, 22 bp, Homo sapiens
gctgggaggatctctccctgtc

SEQ ID NO: 8524075 - DNA, 22 bp, Homo sapiens
gctgggagaggccctgaagtga

SEQ ID NO: 8524076 - DNA, 22 bp, Homo sapiens
gctgggagaggccctgaagtga

SEQ ID NO: 8524077 - DNA, 22 bp, Homo sapiens
gctgggagaggccctgaagtga

SEQ ID NO: 8524078 - DNA, 22 bp, Homo sapiens
gctgggagcaaagccatgcata

SEQ ID NO: 8524079 - DNA, 22 bp, Homo sapiens
gctgggagaggccctgaagtga

SEQ ID NO: 8524080 - DNA, 22 bp, Homo sapiens
gctggcagactgggggcagaac

SEQ ID NO: 8524081 - DNA, 22 bp, Homo sapiens
gctggcagactgggggcagaac

SEQ ID NO: 8524082 - DNA, 22 bp, Homo sapiens
gctggcagactgggggcagaac

SEQ ID NO: 8524083 - DNA, 22 bp, Homo sapiens
gctggcagacttcctctggaac

SEQ ID NO: 8524084 - DNA, 22 bp, Homo sapiens
gctggcagacttcctctggaac

SEQ ID NO: 8524085 - DNA, 22 bp, Homo sapiens
gctggcagaagagctggttcaa

SEQ ID NO: 8524086 - DNA, 21 bp, Homo sapiens
gctgcccaaccctgcatctcc

SEQ ID NO: 8524087 - DNA, 19 bp, Homo sapiens
gctggatggatcctggagt

SEQ ID NO: 8524088 - DNA, 22 bp, Homo sapiens
gctgcccaatggtagtgtcttt

SEQ ID NO: 8524089 - DNA, 22 bp, Homo sapiens
gctggattggagcaatagagtc

SEQ ID NO: 8524090 - DNA, 22 bp, Homo sapiens
gctgccatggtccaggctccag

SEQ ID NO: 8524091 - DNA, 22 bp, Homo sapiens
gctgccatgccacagcactcac

SEQ ID NO: 8524092 - DNA, 22 bp, Homo sapiens
gctgccatgccacagcactcac

SEQ ID NO: 8524093 - DNA, 22 bp, Homo sapiens
gctggcactgggaaggactgag

SEQ ID NO: 8524094 - DNA, 22 bp, Homo sapiens
gctggcacctgcaccaagcagg

SEQ ID NO: 8524095 - DNA, 22 bp, Homo sapiens
gctggcacatggctcagggcct

SEQ ID NO: 8524096 - DNA, 22 bp, Homo sapiens
gctggcagggacagctgcgtgt

SEQ ID NO: 8524097 - DNA, 22 bp, Homo sapiens
gctggcagggacagctgcgtgt

SEQ ID NO: 8524098 - DNA, 22 bp, Homo sapiens
gctggctcagggactagagttt

SEQ ID NO: 8524099 - DNA, 22 bp, Homo sapiens
gctggctcaagtgtgcttccca

SEQ ID NO: 8524100 - DNA, 22 bp, Homo sapiens
gctggctccaaaagcaggggct

SEQ ID NO: 8524101 - DNA, 22 bp, Homo sapiens
gctggctcagggactagagttt

SEQ ID NO: 8524102 - DNA, 22 bp, Homo sapiens
gctggcaggagcctttcccttt

SEQ ID NO: 8524103 - DNA, 22 bp, Homo sapiens
gctggcagagacaagaagacta

SEQ ID NO: 8524104 - DNA, 22 bp, Homo sapiens
gctggcagagacaagaagacta

SEQ ID NO: 8524105 - DNA, 22 bp, Homo sapiens
gctggcagctggaagttgggct

SEQ ID NO: 8524106 - DNA, 22 bp, Homo sapiens
gctggcagccaagtgaagaggg

SEQ ID NO: 8524107 - DNA, 22 bp, Homo sapiens
gcagcaggtctgtcaatgtcat

SEQ ID NO: 8524108 - DNA, 22 bp, Homo sapiens
gcagcaggcacggtctcgacat

SEQ ID NO: 8524109 - DNA, 22 bp, Homo sapiens
gcagcaggagagtttgtcctgc

SEQ ID NO: 8524110 - DNA, 22 bp, Homo sapiens
gcagcaggagagtaatagcggt

SEQ ID NO: 8524111 - DNA, 22 bp, Homo sapiens
gcagcaggaataggataagcaa

SEQ ID NO: 8524112 - DNA, 22 bp, Homo sapiens
gcagcaggaataggataagcaa

SEQ ID NO: 8524113 - DNA, 22 bp, Homo sapiens
gcagcagctgacagtgggtgcc

SEQ ID NO: 8524114 - DNA, 22 bp, Homo sapiens
gcagaggagcaagttgctacag

SEQ ID NO: 8524115 - DNA, 23 bp, Homo sapiens
gcagaggagcaagctggacacca

SEQ ID NO: 8524116 - DNA, 23 bp, Homo sapiens
gcagaggagcaagctggacacca

SEQ ID NO: 8524117 - DNA, 22 bp, Homo sapiens
gcagaggaggacccaggaatta

SEQ ID NO: 8524118 - DNA, 22 bp, Homo sapiens
gcagaggaggacccaggaatta

SEQ ID NO: 8524119 - DNA, 22 bp, Homo sapiens
gcagaggaggacccaggaatta

SEQ ID NO: 8524120 - DNA, 22 bp, Homo sapiens
gcagcagcggggcccctgcgcg

SEQ ID NO: 8524121 - DNA, 22 bp, Homo sapiens
gcagcagctcagttctgggagg

SEQ ID NO: 8524122 - DNA, 22 bp, Homo sapiens
gcagcagctcagttctgggagg

SEQ ID NO: 8524123 - DNA, 22 bp, Homo sapiens
gcagcagctcagccgggcactg

SEQ ID NO: 8524124 - DNA, 22 bp, Homo sapiens
gcagcagctccctatccaggct

SEQ ID NO: 8524125 - DNA, 22 bp, Homo sapiens
gcagcagctctgaatgggcccc

SEQ ID NO: 8524126 - DNA, 22 bp, Homo sapiens
gcagcagctgacagtgggtgcc

SEQ ID NO: 8524127 - DNA, 21 bp, Homo sapiens
gcagcagtgttctagaatact

SEQ ID NO: 8524128 - DNA, 21 bp, Homo sapiens
gcagcagtgttctagaatact

SEQ ID NO: 8524129 - DNA, 22 bp, Homo sapiens
gcagcagtgtctcccatcttgc

SEQ ID NO: 8524130 - DNA, 22 bp, Homo sapiens
gcagcagtgtgggctgaaccta

SEQ ID NO: 8524131 - DNA, 22 bp, Homo sapiens
gcagcagtgtgggctgaaccta

SEQ ID NO: 8524132 - DNA, 22 bp, Homo sapiens
gcagcagtggctgcaggtccca

SEQ ID NO: 8524133 - DNA, 22 bp, Homo sapiens
gcagcagtggcagttaatattt

SEQ ID NO: 8524134 - DNA, 22 bp, Homo sapiens
gcagcagtggctgcaggtccca

SEQ ID NO: 8524135 - DNA, 22 bp, Homo sapiens
gcagcagtggtctgtagaagga

SEQ ID NO: 8524136 - DNA, 22 bp, Homo sapiens
gcagcagtaggaaataacacag

SEQ ID NO: 8524137 - DNA, 22 bp, Homo sapiens
gcagcagtgctttggaatcctg

SEQ ID NO: 8524138 - DNA, 19 bp, Homo sapiens
gcagcagtggaaggaaaaa

SEQ ID NO: 8524139 - DNA, 22 bp, Homo sapiens
gcagcagtgcgggcagctacag

SEQ ID NO: 8524140 - DNA, 20 bp, Homo sapiens
gcagcagtgcaagtcctctt

SEQ ID NO: 8524141 - DNA, 22 bp, Homo sapiens
gcagcatccttggcctccaccc

SEQ ID NO: 8524142 - DNA, 22 bp, Homo sapiens
gcagcatctgtacatagacgct

SEQ ID NO: 8524143 - DNA, 22 bp, Homo sapiens
gcagcatctagggcactggcct

SEQ ID NO: 8524144 - DNA, 22 bp, Homo sapiens
gcagcatctagggcactggcct

SEQ ID NO: 8524145 - DNA, 22 bp, Homo sapiens
gcagcatcaggttcactgcgtg

SEQ ID NO: 8524146 - DNA, 22 bp, Homo sapiens
gcagcatcaatccatgcttctc

SEQ ID NO: 8524147 - DNA, 22 bp, Homo sapiens
gcagcatcctgggccacagtcc

SEQ ID NO: 8524148 - DNA, 22 bp, Homo sapiens
gcagcatcaggttcactgcgtg

SEQ ID NO: 8524149 - DNA, 22 bp, Homo sapiens
gcagcatccccaggcagcaggg

SEQ ID NO: 8524150 - DNA, 21 bp, Homo sapiens
gcagcatgagaaagccccaaa

SEQ ID NO: 8524151 - DNA, 21 bp, Homo sapiens
gcagcatgagaaagccccaaa

SEQ ID NO: 8524152 - DNA, 22 bp, Homo sapiens
gcagcatgagctatacaaagta

SEQ ID NO: 8524153 - DNA, 22 bp, Homo sapiens
gcagcatggagttgtggaatga

SEQ ID NO: 8524154 - DNA, 22 bp, Homo sapiens
gcagcattaccaagacatggca

SEQ ID NO: 8524155 - DNA, 22 bp, Homo sapiens
gcagcattaccaagacatggca

SEQ ID NO: 8524156 - DNA, 22 bp, Homo sapiens
gcagctgccccgactgtgagtc

SEQ ID NO: 8524157 - DNA, 22 bp, Homo sapiens
gcagctgccgtgagctcacgcc

SEQ ID NO: 8524158 - DNA, 22 bp, Homo sapiens
gcagctgccgtgagctcacgcc

SEQ ID NO: 8524159 - DNA, 22 bp, Homo sapiens
gcagctgccgtgagctcacgcc

SEQ ID NO: 8524160 - DNA, 22 bp, Homo sapiens
gcagctgcaggcaggcttgctg

SEQ ID NO: 8524161 - DNA, 22 bp, Homo sapiens
gcagctgcaggtggtcccatgc

SEQ ID NO: 8524162 - DNA, 18 bp, Homo sapiens
gcagctgcagttgtagct

SEQ ID NO: 8524163 - DNA, 20 bp, Homo sapiens
gcagctgcccccagtccctg

SEQ ID NO: 8524164 - DNA, 22 bp, Homo sapiens
gcagctgcagaccctcagtgct

SEQ ID NO: 8524165 - DNA, 22 bp, Homo sapiens
gcagcattgtgaggtcctgccc

SEQ ID NO: 8524166 - DNA, 22 bp, Homo sapiens
gcaggcctctgttgagggcctt

SEQ ID NO: 8524167 - DNA, 22 bp, Homo sapiens
gcaggagttaggcgtcgtggat

SEQ ID NO: 8524168 - DNA, 22 bp, Homo sapiens
gcaggagttagaggtttaatct

SEQ ID NO: 8524169 - DNA, 22 bp, Homo sapiens
gcaggagtgtgtctaatactca

SEQ ID NO: 8524170 - DNA, 22 bp, Homo sapiens
gcaggagttaaaatatgtaatg

SEQ ID NO: 8524171 - DNA, 22 bp, Homo sapiens
gcaggagtgtggtgggacatcc

SEQ ID NO: 8524172 - DNA, 22 bp, Homo sapiens
gcaggagtgtggtgggacatcc

SEQ ID NO: 8524173 - DNA, 22 bp, Homo sapiens
gcaggagtgtatttgcatgtaa

SEQ ID NO: 8524174 - DNA, 22 bp, Homo sapiens
gcaggagtgtatttgcatgtaa

SEQ ID NO: 8524175 - DNA, 22 bp, Homo sapiens
gcaggagtggagaccatgggga

SEQ ID NO: 8524176 - DNA, 22 bp, Homo sapiens
gcaggagtgacatggatgtgga

SEQ ID NO: 8524177 - DNA, 22 bp, Homo sapiens
gcaggagtgacatggatgtgga

SEQ ID NO: 8524178 - DNA, 22 bp, Homo sapiens
gcaggagtcccagaaggttttg

SEQ ID NO: 8524179 - DNA, 22 bp, Homo sapiens
gcaggagtcagccctaccttga

SEQ ID NO: 8524180 - DNA, 22 bp, Homo sapiens
gcaggagtcactgacttggtcc

SEQ ID NO: 8524181 - DNA, 22 bp, Homo sapiens
gcaggagtatctatacattaaa

SEQ ID NO: 8524182 - DNA, 22 bp, Homo sapiens
gcaggagtatgcagctatggtt

SEQ ID NO: 8524183 - DNA, 22 bp, Homo sapiens
gcaggagtcactgacttggtcc

SEQ ID NO: 8524184 - DNA, 16 bp, Homo sapiens
gcaggagtaccacttg

SEQ ID NO: 8524185 - DNA, 22 bp, Homo sapiens
gcaggaggttgagccaggactg

SEQ ID NO: 8524186 - DNA, 22 bp, Homo sapiens
gcaggaggttgagccaggactg

SEQ ID NO: 8524187 - DNA, 22 bp, Homo sapiens
gcaggaggttgagccaggactg

SEQ ID NO: 8524188 - DNA, 22 bp, Homo sapiens
gcagctggatttcaagagggag

SEQ ID NO: 8524189 - DNA, 22 bp, Homo sapiens
gcagctggagccagccagacac

SEQ ID NO: 8524190 - DNA, 22 bp, Homo sapiens
gcagctggagccagccagacac

SEQ ID NO: 8524191 - DNA, 22 bp, Homo sapiens
gcagctggagccagccagacac

SEQ ID NO: 8524192 - DNA, 22 bp, Homo sapiens
gcagctggagccagccagacac

SEQ ID NO: 8524193 - DNA, 22 bp, Homo sapiens
gcagctggagccagccagacac

SEQ ID NO: 8524194 - DNA, 22 bp, Homo sapiens
gcagctggagcatcttctcatc

SEQ ID NO: 8524195 - DNA, 22 bp, Homo sapiens
gcagctggagaaataccaccct

SEQ ID NO: 8524196 - DNA, 22 bp, Homo sapiens
gcagctggacccacacggctta

SEQ ID NO: 8524197 - DNA, 22 bp, Homo sapiens
gcagctgcctattcagggcttg

SEQ ID NO: 8524198 - DNA, 22 bp, Homo sapiens
gcagctggacccacacggctta

SEQ ID NO: 8524199 - DNA, 22 bp, Homo sapiens
gcagctggacccacacggctta

SEQ ID NO: 8524200 - DNA, 22 bp, Homo sapiens
gcagctggccctgacacgcaga

SEQ ID NO: 8524201 - DNA, 22 bp, Homo sapiens
gcagctggccctgacacgcaga

SEQ ID NO: 8524202 - DNA, 22 bp, Homo sapiens
gcagctggccctgacacgcaga

SEQ ID NO: 8524203 - DNA, 22 bp, Homo sapiens
gcaggagctggaaagtgatgtt

SEQ ID NO: 8524204 - DNA, 19 bp, Homo sapiens
gcaggcctcttgggaatta

SEQ ID NO: 8524205 - DNA, 22 bp, Homo sapiens
gcaggctgagttgggaaaccaa

SEQ ID NO: 8524206 - DNA, 22 bp, Homo sapiens
gcaggctgagtattaccctagt

SEQ ID NO: 8524207 - DNA, 22 bp, Homo sapiens
gcaggctgagtattaccctagt

SEQ ID NO: 8524208 - DNA, 22 bp, Homo sapiens
gcaggctgagtattaccctagt

SEQ ID NO: 8524209 - DNA, 22 bp, Homo sapiens
gcaggctgagagtccaagaagg

SEQ ID NO: 8524210 - DNA, 22 bp, Homo sapiens
gcaggctgaaactcggggtcta

SEQ ID NO: 8524211 - DNA, 22 bp, Homo sapiens
gcaggctgaaactcggggtcta

SEQ ID NO: 8524212 - DNA, 22 bp, Homo sapiens
gcaggctgaaactcggggtcta

SEQ ID NO: 8524213 - DNA, 22 bp, Homo sapiens
gcaggctgatagaggattccat

SEQ ID NO: 8524214 - DNA, 22 bp, Homo sapiens
gcaggctgatagaggattccat

SEQ ID NO: 8524215 - DNA, 22 bp, Homo sapiens
gcaggctgatagaggattccat

SEQ ID NO: 8524216 - DNA, 22 bp, Homo sapiens
gcaggctgatgactggagttgg

SEQ ID NO: 8524217 - DNA, 22 bp, Homo sapiens
gcaggctgatgactggagttgg

SEQ ID NO: 8524218 - DNA, 22 bp, Homo sapiens
gcagggccttagcagcggctgc

SEQ ID NO: 8524219 - DNA, 20 bp, Homo sapiens
gcagggcgacacgggggagg

SEQ ID NO: 8524220 - DNA, 22 bp, Homo sapiens
gcagggccttagcagcggctgc

SEQ ID NO: 8524221 - DNA, 22 bp, Homo sapiens
gcagggccttagcagcggctgc

SEQ ID NO: 8524222 - DNA, 22 bp, Homo sapiens
gcagggctaggtcttctagggc

SEQ ID NO: 8524223 - DNA, 22 bp, Homo sapiens
gcagggctattggaaggagatg

SEQ ID NO: 8524224 - DNA, 22 bp, Homo sapiens
gcagggctattggaaggagatg

SEQ ID NO: 8524225 - DNA, 22 bp, Homo sapiens
gcagggctattggaaggagatg

SEQ ID NO: 8524226 - DNA, 22 bp, Homo sapiens
gcagggctattggaaggagatg

SEQ ID NO: 8524227 - DNA, 22 bp, Homo sapiens
gcagggctagatatttgcaagt

SEQ ID NO: 8524228 - DNA, 22 bp, Homo sapiens
gcagggctaatggggcaagtag

SEQ ID NO: 8524229 - DNA, 22 bp, Homo sapiens
gcagggctaatggggcaagtag

SEQ ID NO: 8524230 - DNA, 22 bp, Homo sapiens
gcagggctaatggggcaagtag

SEQ ID NO: 8524231 - DNA, 22 bp, Homo sapiens
gcagggcgcgtttgagcgggct

SEQ ID NO: 8524232 - DNA, 22 bp, Homo sapiens
gcagggcggcccagagcaggcc

SEQ ID NO: 8524233 - DNA, 22 bp, Homo sapiens
gcacaggcacagagggccactg

SEQ ID NO: 8524234 - DNA, 22 bp, Homo sapiens
gcacctgggacccagaggcacc

SEQ ID NO: 8524235 - DNA, 22 bp, Homo sapiens
gcacctgggacccagaggcacc

SEQ ID NO: 8524236 - DNA, 22 bp, Homo sapiens
gcacctgggacccagaggcacc

SEQ ID NO: 8524237 - DNA, 18 bp, Homo sapiens
gcactctgactgcagagc

SEQ ID NO: 8524238 - DNA, 17 bp, Homo sapiens
gcactcccccacctcct

SEQ ID NO: 8524239 - DNA, 17 bp, Homo sapiens
gcactcccccacctcct

SEQ ID NO: 8524240 - DNA, 22 bp, Homo sapiens
gcactctgccaggtctcctgat

SEQ ID NO: 8524241 - DNA, 22 bp, Homo sapiens
gcactctgtgatctgcagagcc

SEQ ID NO: 8524242 - DNA, 18 bp, Homo sapiens
gcactctgactgcagagc

SEQ ID NO: 8524243 - DNA, 22 bp, Homo sapiens
gcactctgtttctcctgtcagc

SEQ ID NO: 8524244 - DNA, 22 bp, Homo sapiens
gcactctgtttctcctgtcagc

SEQ ID NO: 8524245 - DNA, 22 bp, Homo sapiens
gcactgaatgcttttactgtaa

SEQ ID NO: 8524246 - DNA, 19 bp, Homo sapiens
gcactgaagagttggtcac

SEQ ID NO: 8524247 - DNA, 22 bp, Homo sapiens
gcactgaaattatatgcatttg

SEQ ID NO: 8524248 - DNA, 20 bp, Homo sapiens
gcactgaaattcaatgtttg

SEQ ID NO: 8524249 - DNA, 22 bp, Homo sapiens
gcactggagggtgtagttgctg

SEQ ID NO: 8524250 - DNA, 22 bp, Homo sapiens
gcactgggaatgagggcagctt

SEQ ID NO: 8524251 - DNA, 22 bp, Homo sapiens
gcactgggaagaatgagcctgt

SEQ ID NO: 8524252 - DNA, 22 bp, Homo sapiens
gcactgggaagaatgagcctgt

SEQ ID NO: 8524253 - DNA, 22 bp, Homo sapiens
gcactgctttctgagtcattgt

SEQ ID NO: 8524254 - DNA, 22 bp, Homo sapiens
gcactgcctgtgagccctggtt

SEQ ID NO: 8524255 - DNA, 23 bp, Homo sapiens
gcactgccatgtgctctgcaggc

SEQ ID NO: 8524256 - DNA, 22 bp, Homo sapiens
gcactgcatctactggcaagta

SEQ ID NO: 8524257 - DNA, 22 bp, Homo sapiens
gcactgcaggtgggtggagagg

SEQ ID NO: 8524258 - DNA, 22 bp, Homo sapiens
gcactgcaggtgggtggagagg

SEQ ID NO: 8524259 - DNA, 22 bp, Homo sapiens
gcactgatgcaaaaatcactca

SEQ ID NO: 8524260 - DNA, 22 bp, Homo sapiens
gcactgcagcctcagatggtgg

SEQ ID NO: 8524261 - DNA, 22 bp, Homo sapiens
gcagaggagcaagctggacacc

SEQ ID NO: 8524262 - DNA, 22 bp, Homo sapiens
gcagaggacacaggagggcaag

SEQ ID NO: 8524263 - DNA, 22 bp, Homo sapiens
gcagaggacagggatttagatt

SEQ ID NO: 8524264 - DNA, 22 bp, Homo sapiens
gcagaggagatgaagatacttt

SEQ ID NO: 8524265 - DNA, 22 bp, Homo sapiens
gcagagctctgttcttatctcc

SEQ ID NO: 8524266 - DNA, 22 bp, Homo sapiens
gcagagctgcagcgaggcctgg

SEQ ID NO: 8524267 - DNA, 22 bp, Homo sapiens
gcagagctctgttcttatctcc

SEQ ID NO: 8524268 - DNA, 22 bp, Homo sapiens
gcacttggatatacaaatgaag

SEQ ID NO: 8524269 - DNA, 22 bp, Homo sapiens
gcagagctccccaagacaccaa

SEQ ID NO: 8524270 - DNA, 22 bp, Homo sapiens
gcacttgattacattagtgcct

SEQ ID NO: 8524271 - DNA, 22 bp, Homo sapiens
gcacttgatcattgttacagat

SEQ ID NO: 8524272 - DNA, 22 bp, Homo sapiens
gcacttggaggtgcccacacag

SEQ ID NO: 8524273 - DNA, 22 bp, Homo sapiens
gcagaggacacaggagggcaag

SEQ ID NO: 8524274 - DNA, 22 bp, Homo sapiens
gcagaggacacaggagggcaag

SEQ ID NO: 8524275 - DNA, 22 bp, Homo sapiens
gcagaggacacaggagggcaag

SEQ ID NO: 8524276 - DNA, 22 bp, Homo sapiens
gcagaggacacaggagggcaag

SEQ ID NO: 8524277 - DNA, 21 bp, Homo sapiens
gcagaggaatggtatacataa

SEQ ID NO: 8524278 - DNA, 22 bp, Homo sapiens
gcactgtgctagaagccagggg

SEQ ID NO: 8524279 - DNA, 22 bp, Homo sapiens
gcactgtgctagaagccagggg

SEQ ID NO: 8524280 - DNA, 22 bp, Homo sapiens
gcactgggaatgtgagcagctg

SEQ ID NO: 8524281 - DNA, 22 bp, Homo sapiens
gcactgggaatgctgatgggct

SEQ ID NO: 8524282 - DNA, 22 bp, Homo sapiens
gcactgggaatgtgagcagctg

SEQ ID NO: 8524283 - DNA, 22 bp, Homo sapiens
gcacttgaagaattgaactgga

SEQ ID NO: 8524284 - DNA, 22 bp, Homo sapiens
gcacttgaagaattgaactgga

SEQ ID NO: 8524285 - DNA, 22 bp, Homo sapiens
gcacttgaaaagatcaggtgca

SEQ ID NO: 8524286 - DNA, 22 bp, Homo sapiens
gcacttgacccccagagctggt

SEQ ID NO: 8524287 - DNA, 22 bp, Homo sapiens
gcacttgaggacgactcagctg

SEQ ID NO: 8524288 - DNA, 22 bp, Homo sapiens
gcacttgataaatgttaactga

SEQ ID NO: 8524289 - DNA, 22 bp, Homo sapiens
gcacttgagccaatgctagtag

SEQ ID NO: 8524290 - DNA, 22 bp, Homo sapiens
gcacttcaccactgtcctggtt

SEQ ID NO: 8524291 - DNA, 22 bp, Homo sapiens
gcacttcacatgccttttcctg

SEQ ID NO: 8524292 - DNA, 22 bp, Homo sapiens
gcactgttctcagagcattaga

SEQ ID NO: 8524293 - DNA, 22 bp, Homo sapiens
gcactgtgctagaagccagggg

SEQ ID NO: 8524294 - DNA, 20 bp, Homo sapiens
gcactgttacaaagcacacc

SEQ ID NO: 8524295 - DNA, 22 bp, Homo sapiens
gcacagccggaccgaggaaaag

SEQ ID NO: 8524296 - DNA, 22 bp, Homo sapiens
gcacagccagcatctgagggat

SEQ ID NO: 8524297 - DNA, 22 bp, Homo sapiens
gcacagctcgagctcaggaggg

SEQ ID NO: 8524298 - DNA, 22 bp, Homo sapiens
gcacagctcgagctcaggaggg

SEQ ID NO: 8524299 - DNA, 22 bp, Homo sapiens
gcacagctcagtactccctctg

SEQ ID NO: 8524300 - DNA, 22 bp, Homo sapiens
gcacagctccgcttcctcacac

SEQ ID NO: 8524301 - DNA, 18 bp, Homo sapiens
gcacagctaggagggtcc

SEQ ID NO: 8524302 - DNA, 18 bp, Homo sapiens
gcacagctaggagggtcc

SEQ ID NO: 8524303 - DNA, 22 bp, Homo sapiens
gcacaggaggccgatgctcatg

SEQ ID NO: 8524304 - DNA, 19 bp, Homo sapiens
gcacaggacatctgatgga

SEQ ID NO: 8524305 - DNA, 22 bp, Homo sapiens
gcacaggatgatgggttgaggg

SEQ ID NO: 8524306 - DNA, 22 bp, Homo sapiens
gcacaggaaatgactcatgtta

SEQ ID NO: 8524307 - DNA, 22 bp, Homo sapiens
gcacagctctccccaagacgaa

SEQ ID NO: 8524308 - DNA, 22 bp, Homo sapiens
gcacagccacgtaatgtggtca

SEQ ID NO: 8524309 - DNA, 22 bp, Homo sapiens
gcacagccactgagtgagaacc

SEQ ID NO: 8524310 - DNA, 22 bp, Homo sapiens
gcacagccactgagtgagaacc

SEQ ID NO: 8524311 - DNA, 22 bp, Homo sapiens
gcacagcatgaagagaggaagc

SEQ ID NO: 8524312 - DNA, 21 bp, Homo sapiens
gcacagcatgagtgttggcat

SEQ ID NO: 8524313 - DNA, 21 bp, Homo sapiens
gcacagcatgagtgttggcat

SEQ ID NO: 8524314 - DNA, 22 bp, Homo sapiens
gcacagcagtggcataaacaat

SEQ ID NO: 8524315 - DNA, 22 bp, Homo sapiens
gcacagcagtggcataaacaat

SEQ ID NO: 8524316 - DNA, 22 bp, Homo sapiens
gcacagcagtggcataaacaat

SEQ ID NO: 8524317 - DNA, 22 bp, Homo sapiens
gcacagcagctgggggccctgg

SEQ ID NO: 8524318 - DNA, 22 bp, Homo sapiens
gcacagcagtggcataaacaat

SEQ ID NO: 8524319 - DNA, 22 bp, Homo sapiens
gcaaggaacaaatgctctgctt

SEQ ID NO: 8524320 - DNA, 22 bp, Homo sapiens
gcaagctgtccttttgcatggc

SEQ ID NO: 8524321 - DNA, 22 bp, Homo sapiens
gcaagctgctcttatgtggagg

SEQ ID NO: 8524322 - DNA, 22 bp, Homo sapiens
gcaagctggctgttagaggatg

SEQ ID NO: 8524323 - DNA, 22 bp, Homo sapiens
gcaagctgcttaagctcattgt

SEQ ID NO: 8524324 - DNA, 20 bp, Homo sapiens
gcaagcatgaagagtagaga

SEQ ID NO: 8524325 - DNA, 22 bp, Homo sapiens
gcaagctgatgtgatagtgaaa

SEQ ID NO: 8524326 - DNA, 22 bp, Homo sapiens
gcaagcagttgtggcttctgag

SEQ ID NO: 8524327 - DNA, 22 bp, Homo sapiens
gcaagcagttgtggcttctgag

SEQ ID NO: 8524328 - DNA, 22 bp, Homo sapiens
gcaagcagggttccttagggca

SEQ ID NO: 8524329 - DNA, 22 bp, Homo sapiens
gcaagcagactgggcccctgtg

SEQ ID NO: 8524330 - DNA, 22 bp, Homo sapiens
gaggggtgtggagccatcagtt

SEQ ID NO: 8524331 - DNA, 22 bp, Homo sapiens
gaggggtgtggagccatcagtt

SEQ ID NO: 8524332 - DNA, 22 bp, Homo sapiens
gaggggtgtggagccatcagtt

SEQ ID NO: 8524333 - DNA, 22 bp, Homo sapiens
gaggggtggccctggcgtgtac

SEQ ID NO: 8524334 - DNA, 22 bp, Homo sapiens
gaggggtggccctggcgtgtac

SEQ ID NO: 8524335 - DNA, 22 bp, Homo sapiens
gaggggtggcgttggcatttag

SEQ ID NO: 8524336 - DNA, 22 bp, Homo sapiens
gaggggtgggctggaagttata

SEQ ID NO: 8524337 - DNA, 22 bp, Homo sapiens
gagggggcgaacagaagcaagg

SEQ ID NO: 8524338 - DNA, 22 bp, Homo sapiens
gagggggagatgtgcacacact

SEQ ID NO: 8524339 - DNA, 22 bp, Homo sapiens
gaggggtcttttgttgtcaggg

SEQ ID NO: 8524340 - DNA, 22 bp, Homo sapiens
gaggggtcacatgggctggctt

SEQ ID NO: 8524341 - DNA, 22 bp, Homo sapiens
gagggggaaagtccctggagtc

SEQ ID NO: 8524342 - DNA, 22 bp, Homo sapiens
gagggggacgtatcctggtatg

SEQ ID NO: 8524343 - DNA, 22 bp, Homo sapiens
gagggggagatgtgcacacact

SEQ ID NO: 8524344 - DNA, 22 bp, Homo sapiens
gaggggcttgaggccctgatgg

SEQ ID NO: 8524345 - DNA, 22 bp, Homo sapiens
gaggggcttgaggccctgatgg

SEQ ID NO: 8524346 - DNA, 22 bp, Homo sapiens
gaggggctgtggagctctctgg

SEQ ID NO: 8524347 - DNA, 22 bp, Homo sapiens
gaggggctgtggagctctctgg

SEQ ID NO: 8524348 - DNA, 22 bp, Homo sapiens
gaggggctgggtagggcaaccc

SEQ ID NO: 8524349 - DNA, 22 bp, Homo sapiens
gaggggctgggtagggcaaccc

SEQ ID NO: 8524350 - DNA, 22 bp, Homo sapiens
gaggggctgggtagggcaaccc

SEQ ID NO: 8524351 - DNA, 22 bp, Homo sapiens
gaggggctggggttgactccaa

SEQ ID NO: 8524352 - DNA, 22 bp, Homo sapiens
gaggggctgggcagtccctgga

SEQ ID NO: 8524353 - DNA, 22 bp, Homo sapiens
gaggggctggggttgactccaa

SEQ ID NO: 8524354 - DNA, 22 bp, Homo sapiens
gaggggctggggttgactccaa

SEQ ID NO: 8524355 - DNA, 22 bp, Homo sapiens
gcaaatgagttgtaacataaaa

SEQ ID NO: 8524356 - DNA, 22 bp, Homo sapiens
gcaaatgaaggtggtgctacag

SEQ ID NO: 8524357 - DNA, 22 bp, Homo sapiens
gcaagacatgtctaaggtttaa

SEQ ID NO: 8524358 - DNA, 22 bp, Homo sapiens
gcaagacctatctagttgctgt

SEQ ID NO: 8524359 - DNA, 22 bp, Homo sapiens
gcaagacaatggagcataaacg

SEQ ID NO: 8524360 - DNA, 22 bp, Homo sapiens
gcaaatgctaaagtgtagagac

SEQ ID NO: 8524361 - DNA, 22 bp, Homo sapiens
gagggtccctgctcagggccag

SEQ ID NO: 8524362 - DNA, 22 bp, Homo sapiens
gagggtcccgagccctgtcaga

SEQ ID NO: 8524363 - DNA, 22 bp, Homo sapiens
gagggtccccatgcagagctca

SEQ ID NO: 8524364 - DNA, 22 bp, Homo sapiens
gcaagcaaaatgggagattccc

SEQ ID NO: 8524365 - DNA, 22 bp, Homo sapiens
gcaagcaaaatgggagattccc

SEQ ID NO: 8524366 - DNA, 22 bp, Homo sapiens
gcaagcaagtatctggcaggga

SEQ ID NO: 8524367 - DNA, 22 bp, Homo sapiens
gcaagcagacattcaggtaggt

SEQ ID NO: 8524368 - DNA, 22 bp, Homo sapiens
gcaagcaatggacggtgacttt

SEQ ID NO: 8524369 - DNA, 22 bp, Homo sapiens
gcaagcaagcaggtagagctga

SEQ ID NO: 8524370 - DNA, 22 bp, Homo sapiens
gcaagcaagcaggtagagctga

SEQ ID NO: 8524371 - DNA, 22 bp, Homo sapiens
gcaagatgttaacatagggaga

SEQ ID NO: 8524372 - DNA, 22 bp, Homo sapiens
gcaagagcgctctctttcatta

SEQ ID NO: 8524373 - DNA, 22 bp, Homo sapiens
gcaagagttttttctctcttga

SEQ ID NO: 8524374 - DNA, 22 bp, Homo sapiens
gcaagagacttttatgtctgcc

SEQ ID NO: 8524375 - DNA, 22 bp, Homo sapiens
gcccagggctgcaagtggacgc

SEQ ID NO: 8524376 - DNA, 22 bp, Homo sapiens
gcccagggctgcaagtggacgc

SEQ ID NO: 8524377 - DNA, 22 bp, Homo sapiens
gcccagggctgcaagtggacgc

SEQ ID NO: 8524378 - DNA, 22 bp, Homo sapiens
gcccagggctgcaagtggacgc

SEQ ID NO: 8524379 - DNA, 22 bp, Homo sapiens
gcccagggctgcaagtggacgc

SEQ ID NO: 8524380 - DNA, 22 bp, Homo sapiens
gcccagggcgatggtcggggcc

SEQ ID NO: 8524381 - DNA, 22 bp, Homo sapiens
gcccagggcgatggtcggggcc

SEQ ID NO: 8524382 - DNA, 22 bp, Homo sapiens
gcccagggcagggcaagagtga

SEQ ID NO: 8524383 - DNA, 22 bp, Homo sapiens
gcccagggcagggcaagagtga

SEQ ID NO: 8524384 - DNA, 22 bp, Homo sapiens
gcccagggcagggcaagagtga

SEQ ID NO: 8524385 - DNA, 22 bp, Homo sapiens
gcccagggcagggcaagagtga

SEQ ID NO: 8524386 - DNA, 22 bp, Homo sapiens
gcccagggcagggcaagagtga

SEQ ID NO: 8524387 - DNA, 22 bp, Homo sapiens
gcccagggcagggcaagagtga

SEQ ID NO: 8524388 - DNA, 23 bp, Homo sapiens
gcccagggactgggaatcagtgg

SEQ ID NO: 8524389 - DNA, 23 bp, Homo sapiens
gcccagggactgggaatcagtgg

SEQ ID NO: 8524390 - DNA, 22 bp, Homo sapiens
gcccagagtggccacttggctc

SEQ ID NO: 8524391 - DNA, 22 bp, Homo sapiens
gcccagagttcaaggctgcagt

SEQ ID NO: 8524392 - DNA, 22 bp, Homo sapiens
gcccagagttcaaggctgcagt

SEQ ID NO: 8524393 - DNA, 22 bp, Homo sapiens
gcccagagttcaaggctgcagt

SEQ ID NO: 8524394 - DNA, 22 bp, Homo sapiens
gcccagagttcaaggctgcagt

SEQ ID NO: 8524395 - DNA, 22 bp, Homo sapiens
gcccagagtttgaagatacagt

SEQ ID NO: 8524396 - DNA, 22 bp, Homo sapiens
gcccaggctggagtgcagtggt

SEQ ID NO: 8524397 - DNA, 22 bp, Homo sapiens
gcccagcaaggaccaagggccg

SEQ ID NO: 8524398 - DNA, 22 bp, Homo sapiens
gcccagagtttgaagatacagt

SEQ ID NO: 8524399 - DNA, 22 bp, Homo sapiens
gcccagatctcctgaccctcag

SEQ ID NO: 8524400 - DNA, 22 bp, Homo sapiens
gcccagcaaggaccaagggccg

SEQ ID NO: 8524401 - DNA, 22 bp, Homo sapiens
gcccaggctggagtgcagtggt

SEQ ID NO: 8524402 - DNA, 22 bp, Homo sapiens
gcccaggctggagtgcagtggt

SEQ ID NO: 8524403 - DNA, 22 bp, Homo sapiens
gccctctggcagccttggctgg

SEQ ID NO: 8524404 - DNA, 22 bp, Homo sapiens
gccctctggcagccttggctgg

SEQ ID NO: 8524405 - DNA, 22 bp, Homo sapiens
gccctctggcacagagatgcag

SEQ ID NO: 8524406 - DNA, 22 bp, Homo sapiens
gccctctgtgtaacaatccaga

SEQ ID NO: 8524407 - DNA, 22 bp, Homo sapiens
gccctctggtgggtgagccccg

SEQ ID NO: 8524408 - DNA, 22 bp, Homo sapiens
gccctctggtgggtgagccccg

SEQ ID NO: 8524409 - DNA, 22 bp, Homo sapiens
gcccatgctctcaggcgggcct

SEQ ID NO: 8524410 - DNA, 20 bp, Homo sapiens
gcccatgaggactgcagctg

SEQ ID NO: 8524411 - DNA, 22 bp, Homo sapiens
gcccatggacacccaagtgcca

SEQ ID NO: 8524412 - DNA, 22 bp, Homo sapiens
gcccatggacacccaagtgcca

SEQ ID NO: 8524413 - DNA, 22 bp, Homo sapiens
gcccaggggcagcgcatagtgg

SEQ ID NO: 8524414 - DNA, 22 bp, Homo sapiens
gcccaggggcagcgcatagtgg

SEQ ID NO: 8524415 - DNA, 22 bp, Homo sapiens
gcccaggggcagcgcatagtgg

SEQ ID NO: 8524416 - DNA, 22 bp, Homo sapiens
gcccaggggcagcgcatagtgg

SEQ ID NO: 8524417 - DNA, 22 bp, Homo sapiens
gcccaggggagtagtcaattta

SEQ ID NO: 8524418 - DNA, 22 bp, Homo sapiens
gcccaggggcagcgcatagtgg

SEQ ID NO: 8524419 - DNA, 22 bp, Homo sapiens
gcccaggggagtagtcaattta

SEQ ID NO: 8524420 - DNA, 22 bp, Homo sapiens
gcccagggcttcaaagagagaa

SEQ ID NO: 8524421 - DNA, 22 bp, Homo sapiens
gcccagggcttcaaagagagaa

SEQ ID NO: 8524422 - DNA, 22 bp, Homo sapiens
gcccagggcttcaaagagagaa

SEQ ID NO: 8524423 - DNA, 22 bp, Homo sapiens
gcccagggcttcaaagagagaa

SEQ ID NO: 8524424 - DNA, 22 bp, Homo sapiens
gcccagtggtaaaagcaggcct

SEQ ID NO: 8524425 - DNA, 22 bp, Homo sapiens
gcccagtggtaaaagcaggcct

SEQ ID NO: 8524426 - DNA, 22 bp, Homo sapiens
gcccatcttctagcagctgtta

SEQ ID NO: 8524427 - DNA, 22 bp, Homo sapiens
gcccatcatcactgtggaggct

SEQ ID NO: 8524428 - DNA, 22 bp, Homo sapiens
gccctgagactgagcatgggtt

SEQ ID NO: 8524429 - DNA, 22 bp, Homo sapiens
gccctgagactgaagaactgtc

SEQ ID NO: 8524430 - DNA, 22 bp, Homo sapiens
gccctgagactgagcatgggtt

SEQ ID NO: 8524431 - DNA, 22 bp, Homo sapiens
gccctgagaagaagtcggaggg

SEQ ID NO: 8524432 - DNA, 23 bp, Homo sapiens
gccctgactgcggcctcccactc

SEQ ID NO: 8524433 - DNA, 22 bp, Homo sapiens
gccctgagaatgtgtgtgtcta

SEQ ID NO: 8524434 - DNA, 22 bp, Homo sapiens
gccctgaaatatttccacggcc

SEQ ID NO: 8524435 - DNA, 22 bp, Homo sapiens
gccctctgttattgcatcctta

SEQ ID NO: 8524436 - DNA, 22 bp, Homo sapiens
gccctctgttattgcatcctta

SEQ ID NO: 8524437 - DNA, 22 bp, Homo sapiens
gccctgaacgaggggtctggag

SEQ ID NO: 8524438 - DNA, 19 bp, Homo sapiens
gccctgaccttggctgctc

SEQ ID NO: 8524439 - DNA, 22 bp, Homo sapiens
gccctgaataatagagtgggga

SEQ ID NO: 8524440 - DNA, 22 bp, Homo sapiens
gccctgaattcctcaggctgtg

SEQ ID NO: 8524441 - DNA, 22 bp, Homo sapiens
gccctgagccaccaatgccatt

SEQ ID NO: 8524442 - DNA, 22 bp, Homo sapiens
gccctgagcactgctgctgggg

SEQ ID NO: 8524443 - DNA, 22 bp, Homo sapiens
gccctgagaggcaatgactctt

SEQ ID NO: 8524444 - DNA, 19 bp, Homo sapiens
gccctgagagcttgggttc

SEQ ID NO: 8524445 - DNA, 22 bp, Homo sapiens
gccctgagaggcaatgactctt

SEQ ID NO: 8524446 - DNA, 22 bp, Homo sapiens
gccctgagattcttggattctg

SEQ ID NO: 8524447 - DNA, 22 bp, Homo sapiens
gccctgagcacacagtagcaaa

SEQ ID NO: 8524448 - DNA, 22 bp, Homo sapiens
gccctgagcacacagtagcaaa

SEQ ID NO: 8524449 - DNA, 22 bp, Homo sapiens
gccctgagcctatgagcctctc

SEQ ID NO: 8524450 - DNA, 22 bp, Homo sapiens
gccctgaggcaaaagaacagtc

SEQ ID NO: 8524451 - DNA, 22 bp, Homo sapiens
gccctgaggatttgcatttcct

SEQ ID NO: 8524452 - DNA, 22 bp, Homo sapiens
gccctgagctagtgtgggcagg

SEQ ID NO: 8524453 - DNA, 22 bp, Homo sapiens
gcctcagctcccagcccaggct

SEQ ID NO: 8524454 - DNA, 22 bp, Homo sapiens
gcctcagctgttgcaggggccc

SEQ ID NO: 8524455 - DNA, 22 bp, Homo sapiens
gcctcagctcccagcccaggct

SEQ ID NO: 8524456 - DNA, 22 bp, Homo sapiens
gcctcagctcccagcccaggct

SEQ ID NO: 8524457 - DNA, 22 bp, Homo sapiens
gcctcagctgttgcaggggccc

SEQ ID NO: 8524458 - DNA, 22 bp, Homo sapiens
gcctcaggactggcatactcat

SEQ ID NO: 8524459 - DNA, 22 bp, Homo sapiens
gcctcagccggcggacgccagg

SEQ ID NO: 8524460 - DNA, 22 bp, Homo sapiens
gcctcagccggcggacgccagg

SEQ ID NO: 8524461 - DNA, 20 bp, Homo sapiens
gcctcagccaacccatgggg

SEQ ID NO: 8524462 - DNA, 22 bp, Homo sapiens
gccctgaggggtggtgtctgta

SEQ ID NO: 8524463 - DNA, 22 bp, Homo sapiens
gccctgaggggtggtgtctgta

SEQ ID NO: 8524464 - DNA, 22 bp, Homo sapiens
gcctaacttggctttgttcacc

SEQ ID NO: 8524465 - DNA, 22 bp, Homo sapiens
gcctaataactagctgtgtaac

SEQ ID NO: 8524466 - DNA, 22 bp, Homo sapiens
gcctaatatgcaaaattgatac

SEQ ID NO: 8524467 - DNA, 22 bp, Homo sapiens
gcctacagttggctgagggcct

SEQ ID NO: 8524468 - DNA, 22 bp, Homo sapiens
gcccacagtacgaggctcaggc

SEQ ID NO: 8524469 - DNA, 22 bp, Homo sapiens
gcccacagtacgaggctcaggc

SEQ ID NO: 8524470 - DNA, 22 bp, Homo sapiens
gccagtggcatgcggcagggac

SEQ ID NO: 8524471 - DNA, 22 bp, Homo sapiens
gccagtggccctctggagaagg

SEQ ID NO: 8524472 - DNA, 20 bp, Homo sapiens
gccagtaccattctgccact

SEQ ID NO: 8524473 - DNA, 22 bp, Homo sapiens
gccaggttgctgacgacgatct

SEQ ID NO: 8524474 - DNA, 22 bp, Homo sapiens
gccaggttgctgacgacgatct

SEQ ID NO: 8524475 - DNA, 22 bp, Homo sapiens
gccaggttgctgacgacgatct

SEQ ID NO: 8524476 - DNA, 22 bp, Homo sapiens
gccaggttgctgacgacgatct

SEQ ID NO: 8524477 - DNA, 18 bp, Homo sapiens
gccagtgccctggctcac

SEQ ID NO: 8524478 - DNA, 22 bp, Homo sapiens
gccagtgcttgtggagctggca

SEQ ID NO: 8524479 - DNA, 22 bp, Homo sapiens
gccagtggagactgaaacccat

SEQ ID NO: 8524480 - DNA, 22 bp, Homo sapiens
gcccagagtgagtcctgggccc

SEQ ID NO: 8524481 - DNA, 22 bp, Homo sapiens
gcccagagtgagtcctgggccc

SEQ ID NO: 8524482 - DNA, 18 bp, Homo sapiens
gcccagaggtctgggccc

SEQ ID NO: 8524483 - DNA, 18 bp, Homo sapiens
gcccagaggtctgggccc

SEQ ID NO: 8524484 - DNA, 18 bp, Homo sapiens
gcccagaggtctgggccc

SEQ ID NO: 8524485 - DNA, 18 bp, Homo sapiens
gcccagaggtctgggccc

SEQ ID NO: 8524486 - DNA, 22 bp, Homo sapiens
gcccagagggaagaggtgtcat

SEQ ID NO: 8524487 - DNA, 22 bp, Homo sapiens
gcccagagggaagaggtgtcat

SEQ ID NO: 8524488 - DNA, 23 bp, Homo sapiens
gcccagagaggctcaccaggaat

SEQ ID NO: 8524489 - DNA, 22 bp, Homo sapiens
gcccagagagatgctgtagacc

SEQ ID NO: 8524490 - DNA, 22 bp, Homo sapiens
gcccagagagatgctgtagacc

SEQ ID NO: 8524491 - DNA, 22 bp, Homo sapiens
gcccagagagatgaagtgatgg

SEQ ID NO: 8524492 - DNA, 22 bp, Homo sapiens
gcccagagagatgaagtgatgg

SEQ ID NO: 8524493 - DNA, 22 bp, Homo sapiens
gcccagagagatgaagtgatgg

SEQ ID NO: 8524494 - DNA, 22 bp, Homo sapiens
gcccagaagttgaggctgcagt

SEQ ID NO: 8524495 - DNA, 22 bp, Homo sapiens
gcccagaagttgaggctgcagt

SEQ ID NO: 8524496 - DNA, 21 bp, Homo sapiens
gcccagaagactggctctgcc

SEQ ID NO: 8524497 - DNA, 22 bp, Homo sapiens
gcccagaagtgactcagcactg

SEQ ID NO: 8524498 - DNA, 22 bp, Homo sapiens
gcccagaaagactgcctaacag

SEQ ID NO: 8524499 - DNA, 22 bp, Homo sapiens
gcccagaacagtgtcacatgtc

SEQ ID NO: 8524500 - DNA, 22 bp, Homo sapiens
gcccactttctgccagctcacc

SEQ ID NO: 8524501 - DNA, 22 bp, Homo sapiens
gcccactggctggagtgctggt

SEQ ID NO: 8524502 - DNA, 19 bp, Homo sapiens
gccaggacatcctcctgct

SEQ ID NO: 8524503 - DNA, 19 bp, Homo sapiens
gccaggacatcctcctgct

SEQ ID NO: 8524504 - DNA, 22 bp, Homo sapiens
gccaggaatttcaagagccact

SEQ ID NO: 8524505 - DNA, 22 bp, Homo sapiens
gccaggaatggagaggtggcct

SEQ ID NO: 8524506 - DNA, 22 bp, Homo sapiens
gccaggacctcccagagctttc

SEQ ID NO: 8524507 - DNA, 22 bp, Homo sapiens
gccaggagaaaaggcgaatgat

SEQ ID NO: 8524508 - DNA, 22 bp, Homo sapiens
gccaggagaatgctagcagagg

SEQ ID NO: 8524509 - DNA, 22 bp, Homo sapiens
gccaggagccctgggcaagttc

SEQ ID NO: 8524510 - DNA, 22 bp, Homo sapiens
gccaggagccctgggcaagttc

SEQ ID NO: 8524511 - DNA, 22 bp, Homo sapiens
gccaggtgtagtggccacacct

SEQ ID NO: 8524512 - DNA, 22 bp, Homo sapiens
gccaggtggtctggctccagag

SEQ ID NO: 8524513 - DNA, 22 bp, Homo sapiens
gccaggtggtctggctccagag

SEQ ID NO: 8524514 - DNA, 22 bp, Homo sapiens
gccaggtggctgagtgactgag

SEQ ID NO: 8524515 - DNA, 22 bp, Homo sapiens
gccaggtcccctcatggctcct

SEQ ID NO: 8524516 - DNA, 22 bp, Homo sapiens
gccaggtcgtctccatgtccaa

SEQ ID NO: 8524517 - DNA, 22 bp, Homo sapiens
gccaggcacagttctaggtgct

SEQ ID NO: 8524518 - DNA, 22 bp, Homo sapiens
gccaggagttcagatgcatgtt

SEQ ID NO: 8524519 - DNA, 22 bp, Homo sapiens
gccaggagttcagatgcatgtt

SEQ ID NO: 8524520 - DNA, 22 bp, Homo sapiens
gccaggagttcagatgcatgtt

SEQ ID NO: 8524521 - DNA, 22 bp, Homo sapiens
gccaggagttcagatgcatgtt

SEQ ID NO: 8524522 - DNA, 22 bp, Homo sapiens
gccaggcaaattaaggaatgca

SEQ ID NO: 8524523 - DNA, 22 bp, Homo sapiens
gccaggatgactatacaacagc

SEQ ID NO: 8524524 - DNA, 22 bp, Homo sapiens
gcagggctcagccgctcccacc

SEQ ID NO: 8524525 - DNA, 22 bp, Homo sapiens
gcagggctcattctagtacaat

SEQ ID NO: 8524526 - DNA, 22 bp, Homo sapiens
gcagggctcaacaggacacccc

SEQ ID NO: 8524527 - DNA, 22 bp, Homo sapiens
gcagggctcaacaggacacccc

SEQ ID NO: 8524528 - DNA, 22 bp, Homo sapiens
gcagggctcaacaggacacccc

SEQ ID NO: 8524529 - DNA, 22 bp, Homo sapiens
gcagggctccactgtggccaag

SEQ ID NO: 8524530 - DNA, 22 bp, Homo sapiens
gcagggctccactgtggccaag

SEQ ID NO: 8524531 - DNA, 22 bp, Homo sapiens
gcagggctcattgccaggcatt

SEQ ID NO: 8524532 - DNA, 22 bp, Homo sapiens
gcagggctcattgccaggcatt

SEQ ID NO: 8524533 - DNA, 22 bp, Homo sapiens
gcagtatatggattttaaacat

SEQ ID NO: 8524534 - DNA, 22 bp, Homo sapiens
gcagggctctgctgtagtccta

SEQ ID NO: 8524535 - DNA, 22 bp, Homo sapiens
gcagtatgagtgttttagacat

SEQ ID NO: 8524536 - DNA, 22 bp, Homo sapiens
gcagtcacagggagatggtgac

SEQ ID NO: 8524537 - DNA, 22 bp, Homo sapiens
gcagtcagacaggaggagctcc

SEQ ID NO: 8524538 - DNA, 22 bp, Homo sapiens
gcagtcctctcattggcctcct

SEQ ID NO: 8524539 - DNA, 22 bp, Homo sapiens
gcagtcctcgtaaaggtcgaag

SEQ ID NO: 8524540 - DNA, 22 bp, Homo sapiens
gcagtcctcctgcctcagcctc

SEQ ID NO: 8524541 - DNA, 22 bp, Homo sapiens
gcagtcctagggtgctctgcag

SEQ ID NO: 8524542 - DNA, 22 bp, Homo sapiens
gcagtcctctcattggcctcct

SEQ ID NO: 8524543 - DNA, 22 bp, Homo sapiens
gcagtcctggaggaaggtgtga

SEQ ID NO: 8524544 - DNA, 22 bp, Homo sapiens
gcagtcctctcattggcctcct

SEQ ID NO: 8524545 - DNA, 22 bp, Homo sapiens
gcagtccttaggagaggaagta

SEQ ID NO: 8524546 - DNA, 22 bp, Homo sapiens
gcagtcctgggattctgtcctt

SEQ ID NO: 8524547 - DNA, 22 bp, Homo sapiens
gcagtccattgacagaggtctt

SEQ ID NO: 8524548 - DNA, 22 bp, Homo sapiens
gcagtcctagggtgctctgcag

SEQ ID NO: 8524549 - DNA, 22 bp, Homo sapiens
gcagtcatccagcctttccact

SEQ ID NO: 8524550 - DNA, 22 bp, Homo sapiens
gcatctttctgtccattcagca

SEQ ID NO: 8524551 - DNA, 22 bp, Homo sapiens
gcatgaaatgagcgaatataat

SEQ ID NO: 8524552 - DNA, 22 bp, Homo sapiens
gcatctttctgtccattcagca

SEQ ID NO: 8524553 - DNA, 21 bp, Homo sapiens
gcatgaaaacagcctgtgctc

SEQ ID NO: 8524554 - DNA, 22 bp, Homo sapiens
gcatctcttacccacgagccag

SEQ ID NO: 8524555 - DNA, 22 bp, Homo sapiens
gcatcttcacacaaagccagtg

SEQ ID NO: 8524556 - DNA, 22 bp, Homo sapiens
gcatgataccataggttttgcc

SEQ ID NO: 8524557 - DNA, 22 bp, Homo sapiens
gcatgaggttcttggccagcat

SEQ ID NO: 8524558 - DNA, 22 bp, Homo sapiens
gcatgagactagctcatgagca

SEQ ID NO: 8524559 - DNA, 23 bp, Homo sapiens
gcatgaagtgctacgtctacagc

SEQ ID NO: 8524560 - DNA, 22 bp, Homo sapiens
gcatgaggggggttaggaagtt

SEQ ID NO: 8524561 - DNA, 22 bp, Homo sapiens
gcatgaggggggttaggaagtt

SEQ ID NO: 8524562 - DNA, 20 bp, Homo sapiens
gcatgaggaatcattgcagc

SEQ ID NO: 8524563 - DNA, 20 bp, Homo sapiens
gcatgaggaatcattgcagc

SEQ ID NO: 8524564 - DNA, 22 bp, Homo sapiens
gcatttgaaatgcaagaaagtg

SEQ ID NO: 8524565 - DNA, 22 bp, Homo sapiens
gcatttcttcctggtgtgagcc

SEQ ID NO: 8524566 - DNA, 22 bp, Homo sapiens
gcatttctgtgcatacacatga

SEQ ID NO: 8524567 - DNA, 22 bp, Homo sapiens
gcatttctgtgcatacacatga

SEQ ID NO: 8524568 - DNA, 19 bp, Homo sapiens
gcatttctctttacagcca

SEQ ID NO: 8524569 - DNA, 22 bp, Homo sapiens
gcatttctgtgcatacacatga

SEQ ID NO: 8524570 - DNA, 22 bp, Homo sapiens
gcatgatagctaactcccctca

SEQ ID NO: 8524571 - DNA, 22 bp, Homo sapiens
gcatgcaactcccagttctgcc

SEQ ID NO: 8524572 - DNA, 22 bp, Homo sapiens
gcatttcatgtagattgagaac

SEQ ID NO: 8524573 - DNA, 19 bp, Homo sapiens
gcatttcatttaaccatca

SEQ ID NO: 8524574 - DNA, 22 bp, Homo sapiens
gcatttcctgtgcttggcatat

SEQ ID NO: 8524575 - DNA, 22 bp, Homo sapiens
gcatcctggctctaggtgtcat

SEQ ID NO: 8524576 - DNA, 22 bp, Homo sapiens
gcatcctcccggtgctgctggc

SEQ ID NO: 8524577 - DNA, 22 bp, Homo sapiens
gcatcctctgagagctctagat

SEQ ID NO: 8524578 - DNA, 22 bp, Homo sapiens
gcatccatggagagcactctga

SEQ ID NO: 8524579 - DNA, 19 bp, Homo sapiens
gcatccatggaggccgctt

SEQ ID NO: 8524580 - DNA, 22 bp, Homo sapiens
gcatccattgtttatgtgtttc

SEQ ID NO: 8524581 - DNA, 22 bp, Homo sapiens
gcatccattcactcaacttaga

SEQ ID NO: 8524582 - DNA, 20 bp, Homo sapiens
gcatccatatatgcatgtgt

SEQ ID NO: 8524583 - DNA, 22 bp, Homo sapiens
gcatccatcagcagattgactg

SEQ ID NO: 8524584 - DNA, 22 bp, Homo sapiens
gcatccatgcatgcagggtgtg

SEQ ID NO: 8524585 - DNA, 22 bp, Homo sapiens
gcatctaaggtggataacttct

SEQ ID NO: 8524586 - DNA, 22 bp, Homo sapiens
gcatctaaacttgcatcattgt

SEQ ID NO: 8524587 - DNA, 22 bp, Homo sapiens
gcataatatacatgcttgatcc

SEQ ID NO: 8524588 - DNA, 19 bp, Homo sapiens
gcataaatacactattgtc

SEQ ID NO: 8524589 - DNA, 22 bp, Homo sapiens
gcagtgaagatttgggctctgg

SEQ ID NO: 8524590 - DNA, 22 bp, Homo sapiens
gcatccagaggtagccactgtg

SEQ ID NO: 8524591 - DNA, 22 bp, Homo sapiens
gcatccagaggtagccactgtg

SEQ ID NO: 8524592 - DNA, 23 bp, Homo sapiens
gcatccagagctcagtccccttt

SEQ ID NO: 8524593 - DNA, 22 bp, Homo sapiens
gcatccagtcttggctcctgga

SEQ ID NO: 8524594 - DNA, 22 bp, Homo sapiens
gcatccagtcttggctcctgga

SEQ ID NO: 8524595 - DNA, 22 bp, Homo sapiens
gcatccagtcttggctcctgga

SEQ ID NO: 8524596 - DNA, 22 bp, Homo sapiens
gccagcagggcggagccatcta

SEQ ID NO: 8524597 - DNA, 22 bp, Homo sapiens
gccagaggcccaaggacagctg

SEQ ID NO: 8524598 - DNA, 22 bp, Homo sapiens
gccagaggcccaaggacagctg

SEQ ID NO: 8524599 - DNA, 22 bp, Homo sapiens
gccagaggcccaaggacagctg

SEQ ID NO: 8524600 - DNA, 22 bp, Homo sapiens
gccagcaggtggagagatcaag

SEQ ID NO: 8524601 - DNA, 22 bp, Homo sapiens
gccagcaggtggagagatcaag

SEQ ID NO: 8524602 - DNA, 22 bp, Homo sapiens
gccagcaggttgtcaaggagct

SEQ ID NO: 8524603 - DNA, 22 bp, Homo sapiens
gccagcaggttgtcaaggagct

SEQ ID NO: 8524604 - DNA, 22 bp, Homo sapiens
gccagcaggttgtcaaggagct

SEQ ID NO: 8524605 - DNA, 22 bp, Homo sapiens
gccagcagtatgtcctggcagt

SEQ ID NO: 8524606 - DNA, 22 bp, Homo sapiens
gccagaggcccaaggacagctg

SEQ ID NO: 8524607 - DNA, 22 bp, Homo sapiens
gccagaggcccaaggacagctg

SEQ ID NO: 8524608 - DNA, 22 bp, Homo sapiens
gccagaggaacgctgcgcgccc

SEQ ID NO: 8524609 - DNA, 23 bp, Homo sapiens
gccagaggaacgcagagctttct

SEQ ID NO: 8524610 - DNA, 23 bp, Homo sapiens
gccagaggaacgcagagctttct

SEQ ID NO: 8524611 - DNA, 23 bp, Homo sapiens
gccagaggaacgcagagctttct

SEQ ID NO: 8524612 - DNA, 22 bp, Homo sapiens
gccagagctgagacacgagtcc

SEQ ID NO: 8524613 - DNA, 22 bp, Homo sapiens
gccagagctgagacacgagtcc

SEQ ID NO: 8524614 - DNA, 22 bp, Homo sapiens
gccagagctgagacacgagtcc

SEQ ID NO: 8524615 - DNA, 22 bp, Homo sapiens
gccagagctgagacacgagtcc

SEQ ID NO: 8524616 - DNA, 22 bp, Homo sapiens
gccagagctgagtgaggttctt

SEQ ID NO: 8524617 - DNA, 22 bp, Homo sapiens
gccagagctgagtgaggttctt

SEQ ID NO: 8524618 - DNA, 22 bp, Homo sapiens
gccagagcttcccccgagtgtg

SEQ ID NO: 8524619 - DNA, 22 bp, Homo sapiens
gccagagcttggtttttattta

SEQ ID NO: 8524620 - DNA, 22 bp, Homo sapiens
gccagagcttcccccgagtgtg

SEQ ID NO: 8524621 - DNA, 23 bp, Homo sapiens
gccagagctgcctgcccttgctg

SEQ ID NO: 8524622 - DNA, 23 bp, Homo sapiens
gccagagctgcctgcccttgctg

SEQ ID NO: 8524623 - DNA, 22 bp, Homo sapiens
gccagccccagacatcctatcg

SEQ ID NO: 8524624 - DNA, 22 bp, Homo sapiens
gccagccccttagggctctccc

SEQ ID NO: 8524625 - DNA, 22 bp, Homo sapiens
gccagccccttagggctctccc

SEQ ID NO: 8524626 - DNA, 22 bp, Homo sapiens
gccagccataggccagcactgg

SEQ ID NO: 8524627 - DNA, 21 bp, Homo sapiens
gccagccatgcttgcctaggc

SEQ ID NO: 8524628 - DNA, 22 bp, Homo sapiens
gccagcccagctccaggggaaa

SEQ ID NO: 8524629 - DNA, 21 bp, Homo sapiens
gccagccatgcttgcctaggc

SEQ ID NO: 8524630 - DNA, 22 bp, Homo sapiens
gccagcccagctccaggggaaa

SEQ ID NO: 8524631 - DNA, 21 bp, Homo sapiens
gccagccatgcttgcctaggc

SEQ ID NO: 8524632 - DNA, 22 bp, Homo sapiens
gccagcatcctggtggtggttg

SEQ ID NO: 8524633 - DNA, 22 bp, Homo sapiens
gccagcagtggccaccaccagg

SEQ ID NO: 8524634 - DNA, 22 bp, Homo sapiens
gccagcagtcctgctgtgtgcc

SEQ ID NO: 8524635 - DNA, 22 bp, Homo sapiens
gccagcagtatgtcctggcagt

SEQ ID NO: 8524636 - DNA, 22 bp, Homo sapiens
gccagcagtatgtcctggcagt

SEQ ID NO: 8524637 - DNA, 22 bp, Homo sapiens
gccagcagtatgtcctggcagt

SEQ ID NO: 8524638 - DNA, 22 bp, Homo sapiens
gccagcagtccagtccttagtg

SEQ ID NO: 8524639 - DNA, 22 bp, Homo sapiens
gccagcagtccagtccttagtg

SEQ ID NO: 8524640 - DNA, 22 bp, Homo sapiens
gccagcagtcctgctgtgtgcc

SEQ ID NO: 8524641 - DNA, 22 bp, Homo sapiens
gccagcagtcctgctgtgtgcc

SEQ ID NO: 8524642 - DNA, 22 bp, Homo sapiens
gccagcagtcctgctgtgtgcc

SEQ ID NO: 8524643 - DNA, 22 bp, Homo sapiens
gcattttataaagagttatttg

SEQ ID NO: 8524644 - DNA, 22 bp, Homo sapiens
gcattttagaatattggagcaa

SEQ ID NO: 8524645 - DNA, 22 bp, Homo sapiens
gcatttttctaatcattggcat

SEQ ID NO: 8524646 - DNA, 22 bp, Homo sapiens
gcatttttctaatcattggcat

SEQ ID NO: 8524647 - DNA, 22 bp, Homo sapiens
gcatttttcatccctcttgggt

SEQ ID NO: 8524648 - DNA, 22 bp, Homo sapiens
gcattttaatgaggtttatgag

SEQ ID NO: 8524649 - DNA, 18 bp, Homo sapiens
gcattttaatctgaggca

SEQ ID NO: 8524650 - DNA, 22 bp, Homo sapiens
gcatttgtgttcttcctagagc

SEQ ID NO: 8524651 - DNA, 22 bp, Homo sapiens
gcatttgttccgctttgtcatc

SEQ ID NO: 8524652 - DNA, 22 bp, Homo sapiens
gcatttgtttgggctaatctta

SEQ ID NO: 8524653 - DNA, 22 bp, Homo sapiens
gcatttttgatcccactaggat

SEQ ID NO: 8524654 - DNA, 22 bp, Homo sapiens
gccaagctcaccttctgatgga

SEQ ID NO: 8524655 - DNA, 22 bp, Homo sapiens
gcatttttctctcctataggag

SEQ ID NO: 8524656 - DNA, 22 bp, Homo sapiens
gccaagctctttaaaggccaaa

SEQ ID NO: 8524657 - DNA, 22 bp, Homo sapiens
gccaagcttggaaggatcatgg

SEQ ID NO: 8524658 - DNA, 22 bp, Homo sapiens
gccaaggctgaggccctgggct

SEQ ID NO: 8524659 - DNA, 22 bp, Homo sapiens
gccaaggcctctgcaggatgag

SEQ ID NO: 8524660 - DNA, 22 bp, Homo sapiens
gccaaggcctctgcaggatgag

SEQ ID NO: 8524661 - DNA, 22 bp, Homo sapiens
gccagagaggcaaatcctagca

SEQ ID NO: 8524662 - DNA, 22 bp, Homo sapiens
gccagagcacaggctggtagta

SEQ ID NO: 8524663 - DNA, 22 bp, Homo sapiens
gccagagcacaggctggtagta

SEQ ID NO: 8524664 - DNA, 22 bp, Homo sapiens
gccaagggggcagtgcatgggt

SEQ ID NO: 8524665 - DNA, 22 bp, Homo sapiens
gccaagggggcagtgcatgggt

SEQ ID NO: 8524666 - DNA, 22 bp, Homo sapiens
gccaagggaactgagccggagg

SEQ ID NO: 8524667 - DNA, 22 bp, Homo sapiens
gccagagagagtccctgggcct

SEQ ID NO: 8524668 - DNA, 22 bp, Homo sapiens
gccagagagactgatacatgct

SEQ ID NO: 8524669 - DNA, 22 bp, Homo sapiens
gccagagcatgcactgcctgca

SEQ ID NO: 8524670 - DNA, 22 bp, Homo sapiens
gccagagcatgcactgcctgca

SEQ ID NO: 8524671 - DNA, 22 bp, Homo sapiens
gccagagcatgcactgcctgca

SEQ ID NO: 8524672 - DNA, 22 bp, Homo sapiens
gccagagcatgcactgcctgca

SEQ ID NO: 8524673 - DNA, 22 bp, Homo sapiens
gccagagccacttttgggtgat

SEQ ID NO: 8524674 - DNA, 22 bp, Homo sapiens
gccagagccacttttgggtgat

SEQ ID NO: 8524675 - DNA, 22 bp, Homo sapiens
gccagagccacttttgggtgat

SEQ ID NO: 8524676 - DNA, 22 bp, Homo sapiens
gccagagccggcttcacaggat

SEQ ID NO: 8524677 - DNA, 22 bp, Homo sapiens
gccagagcctgtggatttaacc

SEQ ID NO: 8524678 - DNA, 22 bp, Homo sapiens
gccagagccggcttcacaggat

SEQ ID NO: 8524679 - DNA, 22 bp, Homo sapiens
gccagagcagaatagagtggcc

SEQ ID NO: 8524680 - DNA, 22 bp, Homo sapiens
gccagagcagaatagagtggcc

SEQ ID NO: 8524681 - DNA, 22 bp, Homo sapiens
gccagagcagaatagagtggcc

SEQ ID NO: 8524682 - DNA, 22 bp, Homo sapiens
gccagagcagaatagagtggcc

SEQ ID NO: 8524683 - DNA, 21 bp, Homo sapiens
gccagagcagtacaatgaggt

SEQ ID NO: 8524684 - DNA, 21 bp, Homo sapiens
gccagagcagtacaatgaggt

SEQ ID NO: 8524685 - DNA, 22 bp, Homo sapiens
gccagagcagaatagagtggcc

SEQ ID NO: 8524686 - DNA, 22 bp, Homo sapiens
gccagagcatcgcaccctccat

SEQ ID NO: 8524687 - DNA, 22 bp, Homo sapiens
gccagagcatcgcaccctccat

SEQ ID NO: 8524688 - DNA, 18 bp, Homo sapiens
gccagagcatatctccag

SEQ ID NO: 8524689 - DNA, 21 bp, Homo sapiens
gccagagcagtacaatgaggt

SEQ ID NO: 8524690 - DNA, 18 bp, Homo sapiens
gccagagcatatctccag

SEQ ID NO: 8524691 - DNA, 22 bp, Homo sapiens
tatatgtgtggattcttgtaga

SEQ ID NO: 8524692 - DNA, 22 bp, Homo sapiens
tatattaaaccctctctgtagg

SEQ ID NO: 8524693 - DNA, 22 bp, Homo sapiens
tatattaaaccctctctgtagg

SEQ ID NO: 8524694 - DNA, 22 bp, Homo sapiens
tatattaaagtgctttgcagtg

SEQ ID NO: 8524695 - DNA, 22 bp, Homo sapiens
tatattaaaccctctctgtagg

SEQ ID NO: 8524696 - DNA, 22 bp, Homo sapiens
tatattaacacccacttgcctc

SEQ ID NO: 8524697 - DNA, 22 bp, Homo sapiens
tatattaaatgaccagttttaa

SEQ ID NO: 8524698 - DNA, 22 bp, Homo sapiens
tatattaaatgaccagttttaa

SEQ ID NO: 8524699 - DNA, 22 bp, Homo sapiens
tatattaaagtgctttgcagtg

SEQ ID NO: 8524700 - DNA, 22 bp, Homo sapiens
tatattaaagtgctttgcagtg

SEQ ID NO: 8524701 - DNA, 22 bp, Homo sapiens
tatattaacacccacttgcctc

SEQ ID NO: 8524702 - DNA, 22 bp, Homo sapiens
tatattaacacccacttgcctc

SEQ ID NO: 8524703 - DNA, 22 bp, Homo sapiens
tatattaaccatagggttctag

SEQ ID NO: 8524704 - DNA, 22 bp, Homo sapiens
tatattaacttgtgatcctgga

SEQ ID NO: 8524705 - DNA, 22 bp, Homo sapiens
tatattacctgcctgatctata

SEQ ID NO: 8524706 - DNA, 22 bp, Homo sapiens
tatattagtgagatttatccat

SEQ ID NO: 8524707 - DNA, 22 bp, Homo sapiens
tatattataagccctttcagaa

SEQ ID NO: 8524708 - DNA, 22 bp, Homo sapiens
tatattatcataaaaccattca

SEQ ID NO: 8524709 - DNA, 22 bp, Homo sapiens
tatattataagccctttcagaa

SEQ ID NO: 8524710 - DNA, 22 bp, Homo sapiens
tatattcaacaggctaatgtca

SEQ ID NO: 8524711 - DNA, 22 bp, Homo sapiens
tatatgtagtcagtcagagtaa

SEQ ID NO: 8524712 - DNA, 22 bp, Homo sapiens
tatatgtagtcagtcagagtaa

SEQ ID NO: 8524713 - DNA, 22 bp, Homo sapiens
tatatgtagattgtaccaatgt

SEQ ID NO: 8524714 - DNA, 22 bp, Homo sapiens
tatatgtagattgtaccaatgt

SEQ ID NO: 8524715 - DNA, 22 bp, Homo sapiens
tatatgtaagctatgtaagagt

SEQ ID NO: 8524716 - DNA, 22 bp, Homo sapiens
tatatggatagtgatcataaga

SEQ ID NO: 8524717 - DNA, 22 bp, Homo sapiens
tatatgcttgtgcatgtctttg

SEQ ID NO: 8524718 - DNA, 22 bp, Homo sapiens
tatatgtaagctatgtaagagt

SEQ ID NO: 8524719 - DNA, 22 bp, Homo sapiens
tatatgtaagctatgtaagagt

SEQ ID NO: 8524720 - DNA, 22 bp, Homo sapiens
tatatgcatgcccatgtataca

SEQ ID NO: 8524721 - DNA, 22 bp, Homo sapiens
tatagcaaagtactaccaactc

SEQ ID NO: 8524722 - DNA, 22 bp, Homo sapiens
tatagcaactccaaagagactt

SEQ ID NO: 8524723 - DNA, 22 bp, Homo sapiens
tatagcaagcaggacagtctca

SEQ ID NO: 8524724 - DNA, 22 bp, Homo sapiens
tatagcaagctctttgtaacca

SEQ ID NO: 8524725 - DNA, 22 bp, Homo sapiens
tatagcaagctttgagctttca

SEQ ID NO: 8524726 - DNA, 22 bp, Homo sapiens
tatagcaaggacataatatgct

SEQ ID NO: 8524727 - DNA, 22 bp, Homo sapiens
tatagaggtggaaactgaggtt

SEQ ID NO: 8524728 - DNA, 22 bp, Homo sapiens
tatagatagactgacgatacag

SEQ ID NO: 8524729 - DNA, 22 bp, Homo sapiens
tatagacaagcgtaacaagaag

SEQ ID NO: 8524730 - DNA, 22 bp, Homo sapiens
tatagactagcagcagaattta

SEQ ID NO: 8524731 - DNA, 22 bp, Homo sapiens
tatagagctttggcattgatta

SEQ ID NO: 8524732 - DNA, 22 bp, Homo sapiens
tatagacttgatggtattaagt

SEQ ID NO: 8524733 - DNA, 22 bp, Homo sapiens
tatactttcctgcaactttgat

SEQ ID NO: 8524734 - DNA, 22 bp, Homo sapiens
tatagaagagacatgtgcatag

SEQ ID NO: 8524735 - DNA, 22 bp, Homo sapiens
tatagaagtaagcattgtgatg

SEQ ID NO: 8524736 - DNA, 22 bp, Homo sapiens
tatacttatgctaaaaaatgtt

SEQ ID NO: 8524737 - DNA, 22 bp, Homo sapiens
tatacttatgctaaaaaatgtt

SEQ ID NO: 8524738 - DNA, 22 bp, Homo sapiens
tatactttcctgcaactttgat

SEQ ID NO: 8524739 - DNA, 22 bp, Homo sapiens
tatactctgagaaacgtgtcac

SEQ ID NO: 8524740 - DNA, 22 bp, Homo sapiens
tatactctgagaaacgtgtcac

SEQ ID NO: 8524741 - DNA, 22 bp, Homo sapiens
tatactgagtgtgttaatgatg

SEQ ID NO: 8524742 - DNA, 22 bp, Homo sapiens
tatactgatcactgaggtcatc

SEQ ID NO: 8524743 - DNA, 20 bp, Homo sapiens
tatactaacatatatctgtt

SEQ ID NO: 8524744 - DNA, 20 bp, Homo sapiens
tatactaacatatatctgtt

SEQ ID NO: 8524745 - DNA, 20 bp, Homo sapiens
tatactaacatatatctgtt

SEQ ID NO: 8524746 - DNA, 22 bp, Homo sapiens
tatacagatatctaagatgtaa

SEQ ID NO: 8524747 - DNA, 22 bp, Homo sapiens
tatacagatatctaagatgtaa

SEQ ID NO: 8524748 - DNA, 22 bp, Homo sapiens
tatacagataatgaagaccaag

SEQ ID NO: 8524749 - DNA, 22 bp, Homo sapiens
tatacatgttttacataagtga

SEQ ID NO: 8524750 - DNA, 22 bp, Homo sapiens
tatacatgttttacataagtga

SEQ ID NO: 8524751 - DNA, 22 bp, Homo sapiens
tataccaaaaaaattcttgtct

SEQ ID NO: 8524752 - DNA, 22 bp, Homo sapiens
tataccaaaatatcagaaaggg

SEQ ID NO: 8524753 - DNA, 22 bp, Homo sapiens
tataccaaaatatcagaaaggg

SEQ ID NO: 8524754 - DNA, 22 bp, Homo sapiens
tatacagaactgcacgtgcacg

SEQ ID NO: 8524755 - DNA, 22 bp, Homo sapiens
tatacagaactgcacgtgcacg

SEQ ID NO: 8524756 - DNA, 22 bp, Homo sapiens
tatacagaactgcacgtgcacg

SEQ ID NO: 8524757 - DNA, 22 bp, Homo sapiens
tatacagaaccgcctgaagtct

SEQ ID NO: 8524758 - DNA, 22 bp, Homo sapiens
tagttaattctttaagaacaag

SEQ ID NO: 8524759 - DNA, 22 bp, Homo sapiens
tagttaaaataatggagatgtt

SEQ ID NO: 8524760 - DNA, 22 bp, Homo sapiens
tagttaaagattctgttaagag

SEQ ID NO: 8524761 - DNA, 22 bp, Homo sapiens
tagttaaagccctaaattgata

SEQ ID NO: 8524762 - DNA, 22 bp, Homo sapiens
tagttaaagccctaaattgata

SEQ ID NO: 8524763 - DNA, 22 bp, Homo sapiens
tagttaaagccctaaattgata

SEQ ID NO: 8524764 - DNA, 22 bp, Homo sapiens
tagttaaagccctaaattgata

SEQ ID NO: 8524765 - DNA, 22 bp, Homo sapiens
tagttaaagccctaaattgata

SEQ ID NO: 8524766 - DNA, 22 bp, Homo sapiens
tagttaaaataatggagatgtt

SEQ ID NO: 8524767 - DNA, 22 bp, Homo sapiens
tagttaaaataatggagatgtt

SEQ ID NO: 8524768 - DNA, 22 bp, Homo sapiens
tagtgtttagtacatatgcata

SEQ ID NO: 8524769 - DNA, 22 bp, Homo sapiens
tatcttagggaattaactaaaa

SEQ ID NO: 8524770 - DNA, 23 bp, Homo sapiens
tatcttacctcccttctttcctg

SEQ ID NO: 8524771 - DNA, 22 bp, Homo sapiens
tatcttcaatttattcaaggag

SEQ ID NO: 8524772 - DNA, 22 bp, Homo sapiens
tatcttctcagtatatgggatg

SEQ ID NO: 8524773 - DNA, 22 bp, Homo sapiens
tatcttcttgccaggctggtgt

SEQ ID NO: 8524774 - DNA, 22 bp, Homo sapiens
tatcttaaatgcatgatagaca

SEQ ID NO: 8524775 - DNA, 19 bp, Homo sapiens
tatctgtttcctgcttgtc

SEQ ID NO: 8524776 - DNA, 22 bp, Homo sapiens
tatctgtttgctcacaggtgtt

SEQ ID NO: 8524777 - DNA, 22 bp, Homo sapiens
tatctgtttgctcacaggtgtt

SEQ ID NO: 8524778 - DNA, 22 bp, Homo sapiens
tatctgtttattgttactgtca

SEQ ID NO: 8524779 - DNA, 22 bp, Homo sapiens
tatctgttgtcttttacatgta

SEQ ID NO: 8524780 - DNA, 22 bp, Homo sapiens
tatctgttgtccatgcagaaag

SEQ ID NO: 8524781 - DNA, 22 bp, Homo sapiens
tatctgttgtagtacagatgat

SEQ ID NO: 8524782 - DNA, 22 bp, Homo sapiens
tatctttaacttgcagtattta

SEQ ID NO: 8524783 - DNA, 22 bp, Homo sapiens
tatctttaacttgcagtattta

SEQ ID NO: 8524784 - DNA, 22 bp, Homo sapiens
tatctttaatgcttggaggtta

SEQ ID NO: 8524785 - DNA, 22 bp, Homo sapiens
tatctttaacttgcagtattta

SEQ ID NO: 8524786 - DNA, 22 bp, Homo sapiens
tatctttaacttgcagtattta

SEQ ID NO: 8524787 - DNA, 22 bp, Homo sapiens
tatctttaacttgcagtattta

SEQ ID NO: 8524788 - DNA, 22 bp, Homo sapiens
tatcttgtaataggtccacttg

SEQ ID NO: 8524789 - DNA, 22 bp, Homo sapiens
tatcttggcttgaaagatgctt

SEQ ID NO: 8524790 - DNA, 22 bp, Homo sapiens
tatcttgagagacaacacagca

SEQ ID NO: 8524791 - DNA, 22 bp, Homo sapiens
tatctttattatgtctatctgc

SEQ ID NO: 8524792 - DNA, 22 bp, Homo sapiens
tatctttagaggaagagaatct

SEQ ID NO: 8524793 - DNA, 22 bp, Homo sapiens
tatctttagaggaagagaatct

SEQ ID NO: 8524794 - DNA, 22 bp, Homo sapiens
tatctttagaggaagagaatct

SEQ ID NO: 8524795 - DNA, 19 bp, Homo sapiens
tatctttatgcagtggtgg

SEQ ID NO: 8524796 - DNA, 19 bp, Homo sapiens
tatctttatgcagtggtgg

SEQ ID NO: 8524797 - DNA, 22 bp, Homo sapiens
tatctttagaggaagagaatct

SEQ ID NO: 8524798 - DNA, 20 bp, Homo sapiens
tatgataattacaaaatagt

SEQ ID NO: 8524799 - DNA, 20 bp, Homo sapiens
tatgataattacaaaatagt

SEQ ID NO: 8524800 - DNA, 22 bp, Homo sapiens
tatgagtttaaggctaaaatag

SEQ ID NO: 8524801 - DNA, 22 bp, Homo sapiens
tatctttgcaaatatctctaag

SEQ ID NO: 8524802 - DNA, 22 bp, Homo sapiens
tatgcacgtctatttatgaaga

SEQ ID NO: 8524803 - DNA, 22 bp, Homo sapiens
tatgcacattggtttcctcatt

SEQ ID NO: 8524804 - DNA, 22 bp, Homo sapiens
tatgcacattcacacaaaaatg

SEQ ID NO: 8524805 - DNA, 22 bp, Homo sapiens
tatgcacattatctaatccatt

SEQ ID NO: 8524806 - DNA, 22 bp, Homo sapiens
tatgcacatataacctgcactg

SEQ ID NO: 8524807 - DNA, 22 bp, Homo sapiens
tatgatatgcactttatcagaa

SEQ ID NO: 8524808 - DNA, 22 bp, Homo sapiens
tatgcagcaccactcactgcag

SEQ ID NO: 8524809 - DNA, 20 bp, Homo sapiens
tatgcagtatgtgtgtataa

SEQ ID NO: 8524810 - DNA, 22 bp, Homo sapiens
tatgcactggtactattcgtgt

SEQ ID NO: 8524811 - DNA, 22 bp, Homo sapiens
tatgcactggattacaaagcaa

SEQ ID NO: 8524812 - DNA, 22 bp, Homo sapiens
tatgcataattggataagtaga

SEQ ID NO: 8524813 - DNA, 22 bp, Homo sapiens
tatgcataggtatctatactca

SEQ ID NO: 8524814 - DNA, 22 bp, Homo sapiens
tatgcataggtatctatactca

SEQ ID NO: 8524815 - DNA, 22 bp, Homo sapiens
tatgcatatagatgcacacaca

SEQ ID NO: 8524816 - DNA, 22 bp, Homo sapiens
tatgcataattggataagtaga

SEQ ID NO: 8524817 - DNA, 22 bp, Homo sapiens
tatgcagtggtatcattttaaa

SEQ ID NO: 8524818 - DNA, 22 bp, Homo sapiens
tatgcagtgtacgatgtttagt

SEQ ID NO: 8524819 - DNA, 22 bp, Homo sapiens
tatgcagtgtatgcactgagat

SEQ ID NO: 8524820 - DNA, 22 bp, Homo sapiens
tatgcatgtggtatatgcttat

SEQ ID NO: 8524821 - DNA, 22 bp, Homo sapiens
tatgcatatagatgcacacaca

SEQ ID NO: 8524822 - DNA, 22 bp, Homo sapiens
tatgcatatattttcccatctt

SEQ ID NO: 8524823 - DNA, 22 bp, Homo sapiens
tatgcatatgaccccaagcttg

SEQ ID NO: 8524824 - DNA, 22 bp, Homo sapiens
tatgcatatgtgttcattggag

SEQ ID NO: 8524825 - DNA, 22 bp, Homo sapiens
tatgccactgctctccatccta

SEQ ID NO: 8524826 - DNA, 22 bp, Homo sapiens
tatgccactgctctccatccta

SEQ ID NO: 8524827 - DNA, 22 bp, Homo sapiens
tatgccactgctctccatccta

SEQ ID NO: 8524828 - DNA, 22 bp, Homo sapiens
tatgcattcagaggttgggtgt

SEQ ID NO: 8524829 - DNA, 22 bp, Homo sapiens
tatgcattttatagtgcaaagc

SEQ ID NO: 8524830 - DNA, 22 bp, Homo sapiens
tatcaaaggctatgtgattttt

SEQ ID NO: 8524831 - DNA, 22 bp, Homo sapiens
tatcaaaggctatgtgattttt

SEQ ID NO: 8524832 - DNA, 22 bp, Homo sapiens
tatcaaaggctatgtgattttt

SEQ ID NO: 8524833 - DNA, 22 bp, Homo sapiens
tatcaaagttgtcctgtgaagt

SEQ ID NO: 8524834 - DNA, 22 bp, Homo sapiens
tatcaaagttgtcctgtgaagt

SEQ ID NO: 8524835 - DNA, 22 bp, Homo sapiens
tatcaaaaggagttgaaagggg

SEQ ID NO: 8524836 - DNA, 22 bp, Homo sapiens
tatcaaaaggagttgaaagggg

SEQ ID NO: 8524837 - DNA, 20 bp, Homo sapiens
tatattttctctttggcctt

SEQ ID NO: 8524838 - DNA, 22 bp, Homo sapiens
tatattttagacaccctcacgc

SEQ ID NO: 8524839 - DNA, 22 bp, Homo sapiens
tatattttagacaccctcacgc

SEQ ID NO: 8524840 - DNA, 22 bp, Homo sapiens
tatatttaattagttgctggat

SEQ ID NO: 8524841 - DNA, 22 bp, Homo sapiens
tatatttaattagttgctggat

SEQ ID NO: 8524842 - DNA, 22 bp, Homo sapiens
tatatttaatcctagagccatt

SEQ ID NO: 8524843 - DNA, 22 bp, Homo sapiens
tatatttaatcctagagccatt

SEQ ID NO: 8524844 - DNA, 22 bp, Homo sapiens
tatatttaaatccaggttgaaa

SEQ ID NO: 8524845 - DNA, 22 bp, Homo sapiens
tatattcaacaggctaatgtca

SEQ ID NO: 8524846 - DNA, 22 bp, Homo sapiens
tatattcaacaggctaatgtca

SEQ ID NO: 8524847 - DNA, 19 bp, Homo sapiens
tatatttgagtgtgcatgc

SEQ ID NO: 8524848 - DNA, 22 bp, Homo sapiens
tatatttgctaaatgtgtgcaa

SEQ ID NO: 8524849 - DNA, 22 bp, Homo sapiens
tatatttgctaaatgtgtgcaa

SEQ ID NO: 8524850 - DNA, 18 bp, Homo sapiens
tatatttcacacatattc

SEQ ID NO: 8524851 - DNA, 18 bp, Homo sapiens
tatatttcacacatattc

SEQ ID NO: 8524852 - DNA, 22 bp, Homo sapiens
tatcaatacatgttatcagtgt

SEQ ID NO: 8524853 - DNA, 22 bp, Homo sapiens
tatcacactcggaaatctagga

SEQ ID NO: 8524854 - DNA, 22 bp, Homo sapiens
tatcacactgttttaattactt

SEQ ID NO: 8524855 - DNA, 22 bp, Homo sapiens
tatcacacataactaagctgca

SEQ ID NO: 8524856 - DNA, 22 bp, Homo sapiens
tatcacactagcctatagtgga

SEQ ID NO: 8524857 - DNA, 22 bp, Homo sapiens
tatcacacgccttgcttcattt

SEQ ID NO: 8524858 - DNA, 22 bp, Homo sapiens
tatcacaattcctatagtttgt

SEQ ID NO: 8524859 - DNA, 22 bp, Homo sapiens
tatcacaattcctatagtttgt

SEQ ID NO: 8524860 - DNA, 22 bp, Homo sapiens
tatcacaattcctatagtttgt

SEQ ID NO: 8524861 - DNA, 22 bp, Homo sapiens
tatcaacattaatattttctgg

SEQ ID NO: 8524862 - DNA, 22 bp, Homo sapiens
tatcaacattaatattttctgg

SEQ ID NO: 8524863 - DNA, 22 bp, Homo sapiens
tatcaacaaaggccttgtgttt

SEQ ID NO: 8524864 - DNA, 22 bp, Homo sapiens
tatcaagagtctctacattaat

SEQ ID NO: 8524865 - DNA, 22 bp, Homo sapiens
tatcaagagtctctacattaat

SEQ ID NO: 8524866 - DNA, 21 bp, Homo sapiens
tatcaaggcactttttaaaga

SEQ ID NO: 8524867 - DNA, 22 bp, Homo sapiens
tatctagatggattttagtgaa

SEQ ID NO: 8524868 - DNA, 22 bp, Homo sapiens
tatctataagtactaacatggt

SEQ ID NO: 8524869 - DNA, 22 bp, Homo sapiens
tatctgtcacctgtagggtagg

SEQ ID NO: 8524870 - DNA, 22 bp, Homo sapiens
tatctgtgaaatgtgtttgtat

SEQ ID NO: 8524871 - DNA, 22 bp, Homo sapiens
tatctgttccaggcactcagct

SEQ ID NO: 8524872 - DNA, 22 bp, Homo sapiens
tatctgttccaggcactcagct

SEQ ID NO: 8524873 - DNA, 22 bp, Homo sapiens
tatctgttccaggcactcagct

SEQ ID NO: 8524874 - DNA, 22 bp, Homo sapiens
tatctgttcatgtttatatgtc

SEQ ID NO: 8524875 - DNA, 22 bp, Homo sapiens
tatctgttggctcctagttgta

SEQ ID NO: 8524876 - DNA, 22 bp, Homo sapiens
tatctgttggctcctagttgta

SEQ ID NO: 8524877 - DNA, 22 bp, Homo sapiens
tatctgttcttagctatagatg

SEQ ID NO: 8524878 - DNA, 22 bp, Homo sapiens
tatctgttctgcttgattttga

SEQ ID NO: 8524879 - DNA, 22 bp, Homo sapiens
tatctgttcatgtttatatgtc

SEQ ID NO: 8524880 - DNA, 22 bp, Homo sapiens
tatctgttcaatggaagatgac

SEQ ID NO: 8524881 - DNA, 22 bp, Homo sapiens
tatctgttatgggctgaattgc

SEQ ID NO: 8524882 - DNA, 22 bp, Homo sapiens
tatctgttaggatcagagctgg

SEQ ID NO: 8524883 - DNA, 22 bp, Homo sapiens
tatctgttatgggctgaattgc

SEQ ID NO: 8524884 - DNA, 22 bp, Homo sapiens
tatctgttaggatcagagctgg

SEQ ID NO: 8524885 - DNA, 22 bp, Homo sapiens
tatctgtgaaatgtgtttgtat

SEQ ID NO: 8524886 - DNA, 22 bp, Homo sapiens
tatctgttaaaacaagctttaa

SEQ ID NO: 8524887 - DNA, 22 bp, Homo sapiens
tatttctaagctgtaagtctga

SEQ ID NO: 8524888 - DNA, 22 bp, Homo sapiens
tatttctaagctgtaagtctga

SEQ ID NO: 8524889 - DNA, 22 bp, Homo sapiens
tatttctaagctgtaagtctga

SEQ ID NO: 8524890 - DNA, 22 bp, Homo sapiens
tatttggaggccactgttgagt

SEQ ID NO: 8524891 - DNA, 22 bp, Homo sapiens
tatttggatacaatcatttgct

SEQ ID NO: 8524892 - DNA, 22 bp, Homo sapiens
tatttgtatgtgtgtacatata

SEQ ID NO: 8524893 - DNA, 22 bp, Homo sapiens
tatttgtatgtgtgtacatata

SEQ ID NO: 8524894 - DNA, 22 bp, Homo sapiens
tatttgtatgtgtgtacatata

SEQ ID NO: 8524895 - DNA, 22 bp, Homo sapiens
tatttgtatttcatgcagtaaa

SEQ ID NO: 8524896 - DNA, 22 bp, Homo sapiens
tatttccagcagtaagaagaca

SEQ ID NO: 8524897 - DNA, 22 bp, Homo sapiens
tatttcagggagaataaatttg

SEQ ID NO: 8524898 - DNA, 22 bp, Homo sapiens
tatttccatgttagaactaagt

SEQ ID NO: 8524899 - DNA, 18 bp, Homo sapiens
tatttcccaatggaaaca

SEQ ID NO: 8524900 - DNA, 22 bp, Homo sapiens
tatttccatgttagaactaagt

SEQ ID NO: 8524901 - DNA, 22 bp, Homo sapiens
tatttccaggccccactctaga

SEQ ID NO: 8524902 - DNA, 22 bp, Homo sapiens
tatttcctgcatggtgatgtaa

SEQ ID NO: 8524903 - DNA, 22 bp, Homo sapiens
tatttcccagggagcaacaagc

SEQ ID NO: 8524904 - DNA, 22 bp, Homo sapiens
tatttcctgcatggtgatgtaa

SEQ ID NO: 8524905 - DNA, 22 bp, Homo sapiens
tatttcctgtggatacttttag

SEQ ID NO: 8524906 - DNA, 22 bp, Homo sapiens
tatttcctgtggatacttttag

SEQ ID NO: 8524907 - DNA, 22 bp, Homo sapiens
tatttccttgagacggagtctc

SEQ ID NO: 8524908 - DNA, 22 bp, Homo sapiens
tatttctaagagatatctgtac

SEQ ID NO: 8524909 - DNA, 22 bp, Homo sapiens
tatttctaagagatatctgtac

SEQ ID NO: 8524910 - DNA, 22 bp, Homo sapiens
tatttctaagagatatctgtac

SEQ ID NO: 8524911 - DNA, 22 bp, Homo sapiens
tatttgttgagttgttatgtct

SEQ ID NO: 8524912 - DNA, 22 bp, Homo sapiens
tatttgttgagttgttatgtct

SEQ ID NO: 8524913 - DNA, 22 bp, Homo sapiens
tatttgtgagactgactgaagt

SEQ ID NO: 8524914 - DNA, 22 bp, Homo sapiens
tatttgtgtgggtatctatata

SEQ ID NO: 8524915 - DNA, 22 bp, Homo sapiens
tatttgttccagagataaaaat

SEQ ID NO: 8524916 - DNA, 22 bp, Homo sapiens
tatttgttccagagataaaaat

SEQ ID NO: 8524917 - DNA, 22 bp, Homo sapiens
tatttgttccagagataaaaat

SEQ ID NO: 8524918 - DNA, 22 bp, Homo sapiens
tatttgtcacctatggctgtcc

SEQ ID NO: 8524919 - DNA, 22 bp, Homo sapiens
tatttgtatttcatgcagtaaa

SEQ ID NO: 8524920 - DNA, 22 bp, Homo sapiens
tatttgtatttcatgcagtaaa

SEQ ID NO: 8524921 - DNA, 22 bp, Homo sapiens
tatttgtatttcatgcagtaaa

SEQ ID NO: 8524922 - DNA, 22 bp, Homo sapiens
tatttgtctttcttataagaat

SEQ ID NO: 8524923 - DNA, 22 bp, Homo sapiens
tatttgtctaagaggctgacag

SEQ ID NO: 8524924 - DNA, 22 bp, Homo sapiens
tatttgtccttattaagatctg

SEQ ID NO: 8524925 - DNA, 22 bp, Homo sapiens
tatttgtccttattaagatctg

SEQ ID NO: 8524926 - DNA, 22 bp, Homo sapiens
tatttgtcactgcacttgaaat

SEQ ID NO: 8524927 - DNA, 22 bp, Homo sapiens
tatttgtcactagaaagggtaa

SEQ ID NO: 8524928 - DNA, 22 bp, Homo sapiens
tattttcaccttctctggatat

SEQ ID NO: 8524929 - DNA, 22 bp, Homo sapiens
tattttcaccttctctggatat

SEQ ID NO: 8524930 - DNA, 22 bp, Homo sapiens
tattttcaccttctctggatat

SEQ ID NO: 8524931 - DNA, 22 bp, Homo sapiens
tattttcaccttctctggatat

SEQ ID NO: 8524932 - DNA, 22 bp, Homo sapiens
tattttcattctgtgtgactgt

SEQ ID NO: 8524933 - DNA, 22 bp, Homo sapiens
tattttcattctgtgtgactgt

SEQ ID NO: 8524934 - DNA, 22 bp, Homo sapiens
tattttcattctgtgtgactgt

SEQ ID NO: 8524935 - DNA, 22 bp, Homo sapiens
tattttcattctgtgtgactgt

SEQ ID NO: 8524936 - DNA, 22 bp, Homo sapiens
tattttcattctgtgtgactgt

SEQ ID NO: 8524937 - DNA, 22 bp, Homo sapiens
tattttcattctgtgtgactgt

SEQ ID NO: 8524938 - DNA, 22 bp, Homo sapiens
tattttcatcttgtccttggat

SEQ ID NO: 8524939 - DNA, 22 bp, Homo sapiens
tattttcatcttgtccttggat

SEQ ID NO: 8524940 - DNA, 22 bp, Homo sapiens
tattttcatcttgtccttggat

SEQ ID NO: 8524941 - DNA, 22 bp, Homo sapiens
tattttcatcttgtccttggat

SEQ ID NO: 8524942 - DNA, 22 bp, Homo sapiens
tattgcagacaaaatgagctac

SEQ ID NO: 8524943 - DNA, 22 bp, Homo sapiens
tattgcatccccattgtgcccc

SEQ ID NO: 8524944 - DNA, 22 bp, Homo sapiens
tattgattcctgctttctgctc

SEQ ID NO: 8524945 - DNA, 22 bp, Homo sapiens
tattgattctgtcccaagttga

SEQ ID NO: 8524946 - DNA, 22 bp, Homo sapiens
tattgattcctgctttctgctc

SEQ ID NO: 8524947 - DNA, 23 bp, Homo sapiens
tattgcacacatagaaacataga

SEQ ID NO: 8524948 - DNA, 22 bp, Homo sapiens
tattgtacatttcaaagtagct

SEQ ID NO: 8524949 - DNA, 22 bp, Homo sapiens
tattgtacatttcaaagtagct

SEQ ID NO: 8524950 - DNA, 22 bp, Homo sapiens
tattgtacatttcaaagtagct

SEQ ID NO: 8524951 - DNA, 22 bp, Homo sapiens
tattggtgggggcagagagaga

SEQ ID NO: 8524952 - DNA, 22 bp, Homo sapiens
tattggtgggggcagagagaga

SEQ ID NO: 8524953 - DNA, 22 bp, Homo sapiens
tattggtgtacttatagcagag

SEQ ID NO: 8524954 - DNA, 22 bp, Homo sapiens
tattgtacatggttatgcagga

SEQ ID NO: 8524955 - DNA, 22 bp, Homo sapiens
tatttcactcagtataccatag

SEQ ID NO: 8524956 - DNA, 22 bp, Homo sapiens
tatttcactcagtataccatag

SEQ ID NO: 8524957 - DNA, 22 bp, Homo sapiens
tatttcactccgagactctatg

SEQ ID NO: 8524958 - DNA, 20 bp, Homo sapiens
tatttcactctccagatggc

SEQ ID NO: 8524959 - DNA, 22 bp, Homo sapiens
tatttcaggctatatttcttgt

SEQ ID NO: 8524960 - DNA, 22 bp, Homo sapiens
tatttcagcaagaagaatgtgg

SEQ ID NO: 8524961 - DNA, 22 bp, Homo sapiens
tatttcaacgtatgaaaagctg

SEQ ID NO: 8524962 - DNA, 22 bp, Homo sapiens
tattgtatcttaccacatgtat

SEQ ID NO: 8524963 - DNA, 22 bp, Homo sapiens
tatttcaacgtatgaaaagctg

SEQ ID NO: 8524964 - DNA, 22 bp, Homo sapiens
tatttcaagaacttctatccat

SEQ ID NO: 8524965 - DNA, 22 bp, Homo sapiens
tatttcaagaacttctatccat

SEQ ID NO: 8524966 - DNA, 22 bp, Homo sapiens
tatttcacctcacccaggagaa

SEQ ID NO: 8524967 - DNA, 22 bp, Homo sapiens
tatttcaccttactaagctgtg

SEQ ID NO: 8524968 - DNA, 22 bp, Homo sapiens
tatttcacataccacagagtgt

SEQ ID NO: 8524969 - DNA, 22 bp, Homo sapiens
tatttcacagcagctcatttaa

SEQ ID NO: 8524970 - DNA, 22 bp, Homo sapiens
tattcagaaaactgagcgatga

SEQ ID NO: 8524971 - DNA, 22 bp, Homo sapiens
tattcagaaaataaattggatt

SEQ ID NO: 8524972 - DNA, 22 bp, Homo sapiens
tattcacattctcaggcctggt

SEQ ID NO: 8524973 - DNA, 22 bp, Homo sapiens
tattcacattaataagtcttca

SEQ ID NO: 8524974 - DNA, 22 bp, Homo sapiens
tattcacattctcaggcctggt

SEQ ID NO: 8524975 - DNA, 22 bp, Homo sapiens
tattcacattctcaggcctggt

SEQ ID NO: 8524976 - DNA, 22 bp, Homo sapiens
tattcagtgcgggaactcagcc

SEQ ID NO: 8524977 - DNA, 22 bp, Homo sapiens
tattcagtgacagggtattatg

SEQ ID NO: 8524978 - DNA, 21 bp, Homo sapiens
tattcagtccattgatgttta

SEQ ID NO: 8524979 - DNA, 22 bp, Homo sapiens
tattcagtggaaaatgtgttga

SEQ ID NO: 8524980 - DNA, 22 bp, Homo sapiens
tattcagaggtgaagtagggag

SEQ ID NO: 8524981 - DNA, 22 bp, Homo sapiens
tattcagagggttgaattttta

SEQ ID NO: 8524982 - DNA, 22 bp, Homo sapiens
tattcagagtattccatgaggt

SEQ ID NO: 8524983 - DNA, 23 bp, Homo sapiens
tattcagcagtgggatttgttgt

SEQ ID NO: 8524984 - DNA, 19 bp, Homo sapiens
tattcaggatgatggcaca

SEQ ID NO: 8524985 - DNA, 17 bp, Homo sapiens
tattgacctttgtatgt

SEQ ID NO: 8524986 - DNA, 22 bp, Homo sapiens
tattgaccagactgacacacat

SEQ ID NO: 8524987 - DNA, 22 bp, Homo sapiens
tattgagaccagtgcttgctta

SEQ ID NO: 8524988 - DNA, 22 bp, Homo sapiens
tattgagacttccagtatatga

SEQ ID NO: 8524989 - DNA, 22 bp, Homo sapiens
tattgacttttaaagtgatata

SEQ ID NO: 8524990 - DNA, 21 bp, Homo sapiens
tattgattcaatttcttgagt

SEQ ID NO: 8524991 - DNA, 22 bp, Homo sapiens
tattgatgcttggattgggcca

SEQ ID NO: 8524992 - DNA, 22 bp, Homo sapiens
tattgatctggatatttagaca

SEQ ID NO: 8524993 - DNA, 22 bp, Homo sapiens
tattgagttacagaaaatactt

SEQ ID NO: 8524994 - DNA, 22 bp, Homo sapiens
tattgagttacagaaaatactt

SEQ ID NO: 8524995 - DNA, 22 bp, Homo sapiens
tattgagttacagaaaatactt

SEQ ID NO: 8524996 - DNA, 20 bp, Homo sapiens
tattgagtacctactgtata

SEQ ID NO: 8524997 - DNA, 22 bp, Homo sapiens
tattcacatgtacatatgctca

SEQ ID NO: 8524998 - DNA, 22 bp, Homo sapiens
tattcacatgaaaacaaatttt

SEQ ID NO: 8524999 - DNA, 22 bp, Homo sapiens
tattcacatgaaaacaaatttt

SEQ ID NO: 8525000 - DNA, 22 bp, Homo sapiens
tattcacatgaaaacaaatttt

SEQ ID NO: 8525001 - DNA, 22 bp, Homo sapiens
tattcacatgtacatatgctca

SEQ ID NO: 8525002 - DNA, 22 bp, Homo sapiens
tattcacaggctggagtgatgt

SEQ ID NO: 8525003 - DNA, 22 bp, Homo sapiens
tattcacaggctggagtgatgt

SEQ ID NO: 8525004 - DNA, 22 bp, Homo sapiens
tattcacaggctggagtgatgt

SEQ ID NO: 8525005 - DNA, 22 bp, Homo sapiens
tattcacaggttctggggatca

SEQ ID NO: 8525006 - DNA, 22 bp, Homo sapiens
tattcacagttgatttacagtt

SEQ ID NO: 8525007 - DNA, 22 bp, Homo sapiens
tattcacagttgatttacagtt

SEQ ID NO: 8525008 - DNA, 20 bp, Homo sapiens
tattcaactttaaaaactta

SEQ ID NO: 8525009 - DNA, 22 bp, Homo sapiens
tattcaaagtgcgaggtcaggg

SEQ ID NO: 8525010 - DNA, 22 bp, Homo sapiens
tatgtttatactttgatgtact

SEQ ID NO: 8525011 - DNA, 22 bp, Homo sapiens
tattcacagctgccgcactcag

SEQ ID NO: 8525012 - DNA, 22 bp, Homo sapiens
tattcacaaaatgaggtcctca

SEQ ID NO: 8525013 - DNA, 22 bp, Homo sapiens
tattcacagctgccgcactcag

SEQ ID NO: 8525014 - DNA, 22 bp, Homo sapiens
tattcacaaaatgaggtcctca

SEQ ID NO: 8525015 - DNA, 22 bp, Homo sapiens
tattcacaaaatgaggtcctca

SEQ ID NO: 8525016 - DNA, 22 bp, Homo sapiens
tattcacaggcacgaaatattg

SEQ ID NO: 8525017 - DNA, 22 bp, Homo sapiens
tattcacaggcacgaaatattg

SEQ ID NO: 8525018 - DNA, 22 bp, Homo sapiens
tattcacaggcacgaaatattg

SEQ ID NO: 8525019 - DNA, 22 bp, Homo sapiens
tattcacaggcacgaaatattg

SEQ ID NO: 8525020 - DNA, 17 bp, Homo sapiens
tatgtgtgtgtttatac

SEQ ID NO: 8525021 - DNA, 17 bp, Homo sapiens
tatgtgtgtgtttatac

SEQ ID NO: 8525022 - DNA, 16 bp, Homo sapiens
tatgtgtgtgggagtg

SEQ ID NO: 8525023 - DNA, 22 bp, Homo sapiens
tatgtgtgtatgacagacagag

SEQ ID NO: 8525024 - DNA, 19 bp, Homo sapiens
tatgtgtgtgtatttacat

SEQ ID NO: 8525025 - DNA, 22 bp, Homo sapiens
tatgctttaacattaaacaaca

SEQ ID NO: 8525026 - DNA, 22 bp, Homo sapiens
tatgtgtgtatgacagacagag

SEQ ID NO: 8525027 - DNA, 22 bp, Homo sapiens
tatgctgtattctgtatgttag

SEQ ID NO: 8525028 - DNA, 22 bp, Homo sapiens
tatgctgtattctgtatgttag

SEQ ID NO: 8525029 - DNA, 22 bp, Homo sapiens
tatgtgtgtttcagtggaaatg

SEQ ID NO: 8525030 - DNA, 17 bp, Homo sapiens
tatgtgtgtttgcagca

SEQ ID NO: 8525031 - DNA, 17 bp, Homo sapiens
tatgtgtgtttgcagca

SEQ ID NO: 8525032 - DNA, 22 bp, Homo sapiens
tatgtgtgtttcagtggaaatg

SEQ ID NO: 8525033 - DNA, 22 bp, Homo sapiens
tatgtgttatttggtatacatt

SEQ ID NO: 8525034 - DNA, 22 bp, Homo sapiens
tatgtgtttgacaccctgcaag

SEQ ID NO: 8525035 - DNA, 22 bp, Homo sapiens
tatgttaaatgtttgatgttta

SEQ ID NO: 8525036 - DNA, 22 bp, Homo sapiens
tatgtgtttgacaccctgcaag

SEQ ID NO: 8525037 - DNA, 22 bp, Homo sapiens
tatgcgtgcctctgtctgtctg

SEQ ID NO: 8525038 - DNA, 22 bp, Homo sapiens
tatgcgtgcctctgtctgtctg

SEQ ID NO: 8525039 - DNA, 22 bp, Homo sapiens
tatgctctcctcccagtcccag

SEQ ID NO: 8525040 - DNA, 22 bp, Homo sapiens
tatgctccaaagacatgttgcc

SEQ ID NO: 8525041 - DNA, 22 bp, Homo sapiens
tatgctattttaatgaagatgt

SEQ ID NO: 8525042 - DNA, 22 bp, Homo sapiens
tatgctactagaaataaaatgg

SEQ ID NO: 8525043 - DNA, 22 bp, Homo sapiens
tatgccagactgtgagcttctt

SEQ ID NO: 8525044 - DNA, 22 bp, Homo sapiens
tatgccagggactgtttcacca

SEQ ID NO: 8525045 - DNA, 22 bp, Homo sapiens
tatgccagggactgtttcacca

SEQ ID NO: 8525046 - DNA, 22 bp, Homo sapiens
tatgcccagcttaaagtacaca

SEQ ID NO: 8525047 - DNA, 22 bp, Homo sapiens
tatgcccttacaatgagcacaa

SEQ ID NO: 8525048 - DNA, 22 bp, Homo sapiens
tatgcctgataactgtgtctct

SEQ ID NO: 8525049 - DNA, 22 bp, Homo sapiens
tatgcctgataactgtgtctct

SEQ ID NO: 8525050 - DNA, 22 bp, Homo sapiens
tatgttatattttgtcaattgt

SEQ ID NO: 8525051 - DNA, 22 bp, Homo sapiens
tatgttattttcatacaacaga

SEQ ID NO: 8525052 - DNA, 22 bp, Homo sapiens
tatgttaagtgggataatcaaa

SEQ ID NO: 8525053 - DNA, 22 bp, Homo sapiens
tatgttaagtgggataatcaaa

SEQ ID NO: 8525054 - DNA, 22 bp, Homo sapiens
tatgttcatagaaatcatgacc

SEQ ID NO: 8525055 - DNA, 22 bp, Homo sapiens
tatgttattttcatacaacaga

SEQ ID NO: 8525056 - DNA, 22 bp, Homo sapiens
tatgttattttcatacaacaga

SEQ ID NO: 8525057 - DNA, 22 bp, Homo sapiens
tatgttattttcatacaacaga

SEQ ID NO: 8525058 - DNA, 22 bp, Homo sapiens
tatgttctaaccttgtctttcc

SEQ ID NO: 8525059 - DNA, 22 bp, Homo sapiens
tatgttctagacttttgctgtg

SEQ ID NO: 8525060 - DNA, 22 bp, Homo sapiens
tatgttcatctggtgcatcagt

SEQ ID NO: 8525061 - DNA, 22 bp, Homo sapiens
tatgttcatgtcaaacaaatgc

SEQ ID NO: 8525062 - DNA, 22 bp, Homo sapiens
tatgttctttacatctgtgcaa

SEQ ID NO: 8525063 - DNA, 22 bp, Homo sapiens
tatgttgcaccaacctaataat

SEQ ID NO: 8525064 - DNA, 22 bp, Homo sapiens
tatgttctgactctacatggga

SEQ ID NO: 8525065 - DNA, 22 bp, Homo sapiens
tatgttctaggaatggttgatg

SEQ ID NO: 8525066 - DNA, 22 bp, Homo sapiens
tatgttctctgctctaggatgt

SEQ ID NO: 8525067 - DNA, 22 bp, Homo sapiens
tatgttctgactctacatggga

SEQ ID NO: 8525068 - DNA, 22 bp, Homo sapiens
tatgttctgtctgtacagattt

SEQ ID NO: 8525069 - DNA, 22 bp, Homo sapiens
tatgttctgactctacatggga

SEQ ID NO: 8525070 - DNA, 22 bp, Homo sapiens
tatgttctgtctgtacagattt

SEQ ID NO: 8525071 - DNA, 22 bp, Homo sapiens
tatgttcttagaagaggcagca

SEQ ID NO: 8525072 - DNA, 22 bp, Homo sapiens
tatgtttacgctggtagaatta

SEQ ID NO: 8525073 - DNA, 22 bp, Homo sapiens
tatgtttagtatccattttcag

SEQ ID NO: 8525074 - DNA, 22 bp, Homo sapiens
tatgtttacgctggtagaatta

SEQ ID NO: 8525075 - DNA, 22 bp, Homo sapiens
tatgttgtggggtgcatcaaaa

SEQ ID NO: 8525076 - DNA, 22 bp, Homo sapiens
tatgtttaaatgtatgtgtatg

SEQ ID NO: 8525077 - DNA, 22 bp, Homo sapiens
tatgtttaaatgtatgtgtatg

SEQ ID NO: 8525078 - DNA, 22 bp, Homo sapiens
tagcatttggacattgtcacct

SEQ ID NO: 8525079 - DNA, 22 bp, Homo sapiens
tagcatttggacattgtcacct

SEQ ID NO: 8525080 - DNA, 22 bp, Homo sapiens
tagcatttggcaccagttattt

SEQ ID NO: 8525081 - DNA, 22 bp, Homo sapiens
tagcatttggcaccagttattt

SEQ ID NO: 8525082 - DNA, 21 bp, Homo sapiens
tagcatttttgtattgctgaa

SEQ ID NO: 8525083 - DNA, 22 bp, Homo sapiens
tagcatttcccaaatgcatttg

SEQ ID NO: 8525084 - DNA, 22 bp, Homo sapiens
tagcatttcccaaatgcatttg

SEQ ID NO: 8525085 - DNA, 22 bp, Homo sapiens
tagcatttcccaaatgcatttg

SEQ ID NO: 8525086 - DNA, 22 bp, Homo sapiens
tagcatttcactgatcttcact

SEQ ID NO: 8525087 - DNA, 22 bp, Homo sapiens
tagcatttcactgatcttcact

SEQ ID NO: 8525088 - DNA, 22 bp, Homo sapiens
tagcatttatggtcatgtgtcc

SEQ ID NO: 8525089 - DNA, 22 bp, Homo sapiens
tagcatttattccagatttgga

SEQ ID NO: 8525090 - DNA, 22 bp, Homo sapiens
tagcatttatggtcatgtgtcc

SEQ ID NO: 8525091 - DNA, 22 bp, Homo sapiens
tagcagtggaatcttttgtcca

SEQ ID NO: 8525092 - DNA, 21 bp, Homo sapiens
tagccatgttccttatggttc

SEQ ID NO: 8525093 - DNA, 22 bp, Homo sapiens
tagccatgtgtggaacacagcc

SEQ ID NO: 8525094 - DNA, 22 bp, Homo sapiens
tagccatgagcagatcactata

SEQ ID NO: 8525095 - DNA, 21 bp, Homo sapiens
tagccatgttccttatggttc

SEQ ID NO: 8525096 - DNA, 22 bp, Homo sapiens
tagccagtttctttaacagcaa

SEQ ID NO: 8525097 - DNA, 22 bp, Homo sapiens
tagccagtgaatgtttccagtg

SEQ ID NO: 8525098 - DNA, 22 bp, Homo sapiens
tagccagtgagacccagaaata

SEQ ID NO: 8525099 - DNA, 22 bp, Homo sapiens
tagccaggctgcagctgatccg

SEQ ID NO: 8525100 - DNA, 22 bp, Homo sapiens
tagccaggctgcagctgatccg

SEQ ID NO: 8525101 - DNA, 22 bp, Homo sapiens
tagccaggcgaggtcagtgtcg

SEQ ID NO: 8525102 - DNA, 22 bp, Homo sapiens
tagccaggcctttgatcccggc

SEQ ID NO: 8525103 - DNA, 22 bp, Homo sapiens
tagccaggcgaggtcagtgtcg

SEQ ID NO: 8525104 - DNA, 22 bp, Homo sapiens
tagcagggttttgaagagggtt

SEQ ID NO: 8525105 - DNA, 22 bp, Homo sapiens
tagcagaaccagcagtcaattt

SEQ ID NO: 8525106 - DNA, 22 bp, Homo sapiens
tagcagtactgggcatgtgttt

SEQ ID NO: 8525107 - DNA, 22 bp, Homo sapiens
tagcagtgccaggattttgctg

SEQ ID NO: 8525108 - DNA, 22 bp, Homo sapiens
tagcagtgccctgtggaataag

SEQ ID NO: 8525109 - DNA, 21 bp, Homo sapiens
tagcagaaacagttcaggcca

SEQ ID NO: 8525110 - DNA, 21 bp, Homo sapiens
tagcacttcgctgtaattggg

SEQ ID NO: 8525111 - DNA, 22 bp, Homo sapiens
tagcacttgtgttatgccttgt

SEQ ID NO: 8525112 - DNA, 22 bp, Homo sapiens
tagcactgttctagcatgtttt

SEQ ID NO: 8525113 - DNA, 22 bp, Homo sapiens
tagcactgaatcacatgctgct

SEQ ID NO: 8525114 - DNA, 22 bp, Homo sapiens
tagcactatttttcactatcct

SEQ ID NO: 8525115 - DNA, 22 bp, Homo sapiens
tagcaccatacccggcagctcg

SEQ ID NO: 8525116 - DNA, 22 bp, Homo sapiens
tagcaccatacccggcagctcg

SEQ ID NO: 8525117 - DNA, 22 bp, Homo sapiens
tagcacattgttgaccagaagg

SEQ ID NO: 8525118 - DNA, 22 bp, Homo sapiens
tagcacattgttgaccagaagg

SEQ ID NO: 8525119 - DNA, 22 bp, Homo sapiens
tagcacatctggcgcttatagg

SEQ ID NO: 8525120 - DNA, 22 bp, Homo sapiens
tagcacatctggcgcttatagg

SEQ ID NO: 8525121 - DNA, 22 bp, Homo sapiens
tagcacatcttcttggcctgca

SEQ ID NO: 8525122 - DNA, 22 bp, Homo sapiens
tagcacatctggcgcttatagg

SEQ ID NO: 8525123 - DNA, 22 bp, Homo sapiens
tagcacatcttcttggcctgca

SEQ ID NO: 8525124 - DNA, 22 bp, Homo sapiens
tagcacatgccgggagtgatct

SEQ ID NO: 8525125 - DNA, 22 bp, Homo sapiens
tagcacagttcactatgataca

SEQ ID NO: 8525126 - DNA, 22 bp, Homo sapiens
tagcacagttcctgactctttg

SEQ ID NO: 8525127 - DNA, 22 bp, Homo sapiens
tagcacagttcactatgataca

SEQ ID NO: 8525128 - DNA, 22 bp, Homo sapiens
tagcacataacttagaatagtt

SEQ ID NO: 8525129 - DNA, 22 bp, Homo sapiens
tagcacagttcctgactctttg

SEQ ID NO: 8525130 - DNA, 22 bp, Homo sapiens
tagcacatacataatagataga

SEQ ID NO: 8525131 - DNA, 22 bp, Homo sapiens
tagcacatacataatagataga

SEQ ID NO: 8525132 - DNA, 22 bp, Homo sapiens
tagcacataacttagaatagtt

SEQ ID NO: 8525133 - DNA, 22 bp, Homo sapiens
tagatgtgagcccaggctgctt

SEQ ID NO: 8525134 - DNA, 22 bp, Homo sapiens
tagatgtgttgcctggagttgt

SEQ ID NO: 8525135 - DNA, 22 bp, Homo sapiens
tagatgttgaagtcatatttgg

SEQ ID NO: 8525136 - DNA, 20 bp, Homo sapiens
tagatgtttcctgtcataaa

SEQ ID NO: 8525137 - DNA, 22 bp, Homo sapiens
tagatgttttaactcttggtta

SEQ ID NO: 8525138 - DNA, 22 bp, Homo sapiens
tagattttaggagattttactg

SEQ ID NO: 8525139 - DNA, 22 bp, Homo sapiens
tagattttacttctgtcattac

SEQ ID NO: 8525140 - DNA, 22 bp, Homo sapiens
tagcacaagcaactactgaagt

SEQ ID NO: 8525141 - DNA, 22 bp, Homo sapiens
tagcacaagaagtacacataga

SEQ ID NO: 8525142 - DNA, 22 bp, Homo sapiens
tagcaaaaactgcagttacttt

SEQ ID NO: 8525143 - DNA, 22 bp, Homo sapiens
tagcacagtatttctcaactgg

SEQ ID NO: 8525144 - DNA, 22 bp, Homo sapiens
tagcacaggtcttgttgccatt

SEQ ID NO: 8525145 - DNA, 17 bp, Homo sapiens
tagcacagtgcctggta

SEQ ID NO: 8525146 - DNA, 22 bp, Homo sapiens
tagcacagtgttcacaacagtg

SEQ ID NO: 8525147 - DNA, 22 bp, Homo sapiens
tagcacagggcatatgcggtgg

SEQ ID NO: 8525148 - DNA, 22 bp, Homo sapiens
tagcacagcttcttgatgtcac

SEQ ID NO: 8525149 - DNA, 22 bp, Homo sapiens
tagcacagggctcctcaaccca

SEQ ID NO: 8525150 - DNA, 22 bp, Homo sapiens
tagcacaggtcttgttgccatt

SEQ ID NO: 8525151 - DNA, 21 bp, Homo sapiens
tagcacagctgtagacagttt

SEQ ID NO: 8525152 - DNA, 22 bp, Homo sapiens
tagcacagcttcttgatgtcac

SEQ ID NO: 8525153 - DNA, 18 bp, Homo sapiens
tagcacagagcaggatgt

SEQ ID NO: 8525154 - DNA, 22 bp, Homo sapiens
tagcacagagcttttaaacttc

SEQ ID NO: 8525155 - DNA, 22 bp, Homo sapiens
tagcacactaaagatattaaca

SEQ ID NO: 8525156 - DNA, 22 bp, Homo sapiens
tagcacacgcattagcaaatca

SEQ ID NO: 8525157 - DNA, 18 bp, Homo sapiens
tagcacagagcaggatgt

SEQ ID NO: 8525158 - DNA, 22 bp, Homo sapiens
tagcacagacagaatggtcata

SEQ ID NO: 8525159 - DNA, 22 bp, Homo sapiens
tagaagttatgataataatagt

SEQ ID NO: 8525160 - DNA, 22 bp, Homo sapiens
tagaagttcatgcgaattattt

SEQ ID NO: 8525161 - DNA, 22 bp, Homo sapiens
tagaagttaaaggaatacagaa

SEQ ID NO: 8525162 - DNA, 22 bp, Homo sapiens
tagaagttaggaaataggaata

SEQ ID NO: 8525163 - DNA, 22 bp, Homo sapiens
tagaaggaggactggcagtgtt

SEQ ID NO: 8525164 - DNA, 22 bp, Homo sapiens
tagaagtgaaagacttgatgtc

SEQ ID NO: 8525165 - DNA, 22 bp, Homo sapiens
tagaataagttgatgatatatg

SEQ ID NO: 8525166 - DNA, 22 bp, Homo sapiens
tagaataagttgatgatatatg

SEQ ID NO: 8525167 - DNA, 22 bp, Homo sapiens
tagaataagttgatgatatatg

SEQ ID NO: 8525168 - DNA, 22 bp, Homo sapiens
tagaatcagaagatttgactgt

SEQ ID NO: 8525169 - DNA, 22 bp, Homo sapiens
tagaatcattgagaataacagg

SEQ ID NO: 8525170 - DNA, 22 bp, Homo sapiens
tagaatcatacctctaggaaca

SEQ ID NO: 8525171 - DNA, 22 bp, Homo sapiens
tagaatctgaatattcttattt

SEQ ID NO: 8525172 - DNA, 22 bp, Homo sapiens
tacttgtgttctactagagaaa

SEQ ID NO: 8525173 - DNA, 22 bp, Homo sapiens
tactttattgtaaatgctgatg

SEQ ID NO: 8525174 - DNA, 22 bp, Homo sapiens
tactttattgtaaatgctgatg

SEQ ID NO: 8525175 - DNA, 22 bp, Homo sapiens
tacttgctgggtgtaattttct

SEQ ID NO: 8525176 - DNA, 22 bp, Homo sapiens
tacttgctgttagtattttaca

SEQ ID NO: 8525177 - DNA, 22 bp, Homo sapiens
tacttgcttggatttcaccaga

SEQ ID NO: 8525178 - DNA, 22 bp, Homo sapiens
tactttctaagacatacaactt

SEQ ID NO: 8525179 - DNA, 22 bp, Homo sapiens
tactttctaagacatacaactt

SEQ ID NO: 8525180 - DNA, 22 bp, Homo sapiens
tactttcatgtctatacatatt

SEQ ID NO: 8525181 - DNA, 22 bp, Homo sapiens
tactttcatgtctatacatatt

SEQ ID NO: 8525182 - DNA, 22 bp, Homo sapiens
tactttcatgtctatacatatt

SEQ ID NO: 8525183 - DNA, 22 bp, Homo sapiens
tactttctagctctccccagtt

SEQ ID NO: 8525184 - DNA, 22 bp, Homo sapiens
tactttctgtccttctgttaaa

SEQ ID NO: 8525185 - DNA, 22 bp, Homo sapiens
tactttctgtccttctgttaaa

SEQ ID NO: 8525186 - DNA, 22 bp, Homo sapiens
tactttctgtccttctgttaaa

SEQ ID NO: 8525187 - DNA, 22 bp, Homo sapiens
tactttctttctgatccttatg

SEQ ID NO: 8525188 - DNA, 22 bp, Homo sapiens
tagaagcaccactcatcacgtg

SEQ ID NO: 8525189 - DNA, 22 bp, Homo sapiens
tactttcttgttcctttcataa

SEQ ID NO: 8525190 - DNA, 22 bp, Homo sapiens
tactttcttgttcctttcataa

SEQ ID NO: 8525191 - DNA, 22 bp, Homo sapiens
tagaagcagcaggactcatggt

SEQ ID NO: 8525192 - DNA, 22 bp, Homo sapiens
tagatggaggctagatgcaggg

SEQ ID NO: 8525193 - DNA, 22 bp, Homo sapiens
tagatgctgtagaaatacttat

SEQ ID NO: 8525194 - DNA, 22 bp, Homo sapiens
tagatgctgaaacatggaggcg

SEQ ID NO: 8525195 - DNA, 22 bp, Homo sapiens
tagatgaccttgtgttaggcaa

SEQ ID NO: 8525196 - DNA, 22 bp, Homo sapiens
tagatgatagggccagaatttg

SEQ ID NO: 8525197 - DNA, 22 bp, Homo sapiens
tagaggcaccctggaggagact

SEQ ID NO: 8525198 - DNA, 22 bp, Homo sapiens
tagaggcagaagaaattgacaa

SEQ ID NO: 8525199 - DNA, 22 bp, Homo sapiens
tagatgatggaaaaaagcaata

SEQ ID NO: 8525200 - DNA, 22 bp, Homo sapiens
tagagctgctggactgtaacag

SEQ ID NO: 8525201 - DNA, 22 bp, Homo sapiens
tagagctgctggactgtaacag

SEQ ID NO: 8525202 - DNA, 22 bp, Homo sapiens
tagagctgataatgaggccaag

SEQ ID NO: 8525203 - DNA, 22 bp, Homo sapiens
tagaggagggctgttcttcagt

SEQ ID NO: 8525204 - DNA, 22 bp, Homo sapiens
tagaggagggctgttcttcagt

SEQ ID NO: 8525205 - DNA, 22 bp, Homo sapiens
tagagctgataatgaggccaag

SEQ ID NO: 8525206 - DNA, 22 bp, Homo sapiens
tagagctgataatgaggccaag

SEQ ID NO: 8525207 - DNA, 22 bp, Homo sapiens
tagagctgataatgaggccaag

SEQ ID NO: 8525208 - DNA, 22 bp, Homo sapiens
tagagctgataatgaggccaag

SEQ ID NO: 8525209 - DNA, 22 bp, Homo sapiens
tagagctgagttgactccattt

SEQ ID NO: 8525210 - DNA, 22 bp, Homo sapiens
tagagctatttagagcatttta

SEQ ID NO: 8525211 - DNA, 22 bp, Homo sapiens
tagagctatttatcagccagaa

SEQ ID NO: 8525212 - DNA, 21 bp, Homo sapiens
tagagccagtggtgttctgac

SEQ ID NO: 8525213 - DNA, 23 bp, Homo sapiens
tagagcattgctgaggcctccct

SEQ ID NO: 8525214 - DNA, 22 bp, Homo sapiens
tagagcattctatctccaacag

SEQ ID NO: 8525215 - DNA, 22 bp, Homo sapiens
tagagcatttagaggggcagga

SEQ ID NO: 8525216 - DNA, 22 bp, Homo sapiens
tagagctagcttcaaaatgcga

SEQ ID NO: 8525217 - DNA, 20 bp, Homo sapiens
tagagcatgaagtcctatcc

SEQ ID NO: 8525218 - DNA, 22 bp, Homo sapiens
tagagcagttggcagctgtatt

SEQ ID NO: 8525219 - DNA, 22 bp, Homo sapiens
tagagcattatgacaaccccat

SEQ ID NO: 8525220 - DNA, 22 bp, Homo sapiens
tagaatctggaaggggctattc

SEQ ID NO: 8525221 - DNA, 23 bp, Homo sapiens
tagaatctgtatttctgcagttc

SEQ ID NO: 8525222 - DNA, 21 bp, Homo sapiens
tagagatgacgagctctagca

SEQ ID NO: 8525223 - DNA, 22 bp, Homo sapiens
tagagatgccctagctgaagta

SEQ ID NO: 8525224 - DNA, 21 bp, Homo sapiens
tagagatgacgagctctagca

SEQ ID NO: 8525225 - DNA, 22 bp, Homo sapiens
tagagatgaattctgcagtctt

SEQ ID NO: 8525226 - DNA, 22 bp, Homo sapiens
tagagatggggtcttgctatga

SEQ ID NO: 8525227 - DNA, 21 bp, Homo sapiens
tagagatgtttgctaagtagc

SEQ ID NO: 8525228 - DNA, 22 bp, Homo sapiens
tagagatgtgatatagcagagt

SEQ ID NO: 8525229 - DNA, 22 bp, Homo sapiens
tagagatgccctagctgaagta

SEQ ID NO: 8525230 - DNA, 23 bp, Homo sapiens
tagagcagggaaatctgtcagag

SEQ ID NO: 8525231 - DNA, 22 bp, Homo sapiens
tagagcagccttcagagcagtt

SEQ ID NO: 8525232 - DNA, 22 bp, Homo sapiens
tagtatattttgttgcaattca

SEQ ID NO: 8525233 - DNA, 22 bp, Homo sapiens
tagtatattaattctcacggtt

SEQ ID NO: 8525234 - DNA, 22 bp, Homo sapiens
tagtatatgtctatggttgtag

SEQ ID NO: 8525235 - DNA, 22 bp, Homo sapiens
tagtatatctttagtacatagt

SEQ ID NO: 8525236 - DNA, 22 bp, Homo sapiens
tagtatatctttagtacatagt

SEQ ID NO: 8525237 - DNA, 22 bp, Homo sapiens
tagtagaatccaaaccaacagt

SEQ ID NO: 8525238 - DNA, 22 bp, Homo sapiens
tagtacttatctctgtcattgt

SEQ ID NO: 8525239 - DNA, 22 bp, Homo sapiens
tagtacagttttggcacatgga

SEQ ID NO: 8525240 - DNA, 22 bp, Homo sapiens
tagtagtgagtctttataaata

SEQ ID NO: 8525241 - DNA, 22 bp, Homo sapiens
tagtagcagggggtacctctca

SEQ ID NO: 8525242 - DNA, 22 bp, Homo sapiens
tagtagcaaaactcatctcttt

SEQ ID NO: 8525243 - DNA, 22 bp, Homo sapiens
tagtaaaagtttagttgaaagt

SEQ ID NO: 8525244 - DNA, 22 bp, Homo sapiens
tagtaaaagtttagttgaaagt

SEQ ID NO: 8525245 - DNA, 22 bp, Homo sapiens
tagtaaacagctctgccacaat

SEQ ID NO: 8525246 - DNA, 22 bp, Homo sapiens
tagtaaacaggcaagggaccac

SEQ ID NO: 8525247 - DNA, 22 bp, Homo sapiens
tagtacagtttaaatattaata

SEQ ID NO: 8525248 - DNA, 22 bp, Homo sapiens
taggtttaggagtgaaggtgaa

SEQ ID NO: 8525249 - DNA, 22 bp, Homo sapiens
taggtttactgaattagtggaa

SEQ ID NO: 8525250 - DNA, 22 bp, Homo sapiens
taggtttaggagtgaaggtgaa

SEQ ID NO: 8525251 - DNA, 22 bp, Homo sapiens
taggtttcagaggtgccgggaa

SEQ ID NO: 8525252 - DNA, 22 bp, Homo sapiens
taggttttcctaaaattctggt

SEQ ID NO: 8525253 - DNA, 22 bp, Homo sapiens
taggctggaggaagcagtgcct

SEQ ID NO: 8525254 - DNA, 22 bp, Homo sapiens
taggctgggaagaaagattctc

SEQ ID NO: 8525255 - DNA, 22 bp, Homo sapiens
taggctggaggaagcagtgcct

SEQ ID NO: 8525256 - DNA, 22 bp, Homo sapiens
taggctggaggaagcagtgcct

SEQ ID NO: 8525257 - DNA, 22 bp, Homo sapiens
taggctggaacttaggcagagg

SEQ ID NO: 8525258 - DNA, 22 bp, Homo sapiens
taggctggaggaagcagtgcct

SEQ ID NO: 8525259 - DNA, 22 bp, Homo sapiens
taggctggaacttaggcagagg

SEQ ID NO: 8525260 - DNA, 22 bp, Homo sapiens
taggctggaacttaggcagagg

SEQ ID NO: 8525261 - DNA, 22 bp, Homo sapiens
taggctgacttgtttcataaag

SEQ ID NO: 8525262 - DNA, 22 bp, Homo sapiens
taggctgagcttgtagatcgta

SEQ ID NO: 8525263 - DNA, 22 bp, Homo sapiens
taggctgagcttgtagatcgta

SEQ ID NO: 8525264 - DNA, 22 bp, Homo sapiens
taggctgagctaagagagctta

SEQ ID NO: 8525265 - DNA, 22 bp, Homo sapiens
taggctgaggttgatgccaggg

SEQ ID NO: 8525266 - DNA, 22 bp, Homo sapiens
taggctgaggttgatgccaggg

SEQ ID NO: 8525267 - DNA, 22 bp, Homo sapiens
taggctggaacttaggcagagg

SEQ ID NO: 8525268 - DNA, 22 bp, Homo sapiens
taggctgggaagaaagattctc

SEQ ID NO: 8525269 - DNA, 22 bp, Homo sapiens
taggctgggagcctgaggctag

SEQ ID NO: 8525270 - DNA, 18 bp, Homo sapiens
taggttacagccagccag

SEQ ID NO: 8525271 - DNA, 22 bp, Homo sapiens
taggttcaagttcaggctctat

SEQ ID NO: 8525272 - DNA, 22 bp, Homo sapiens
taggttcacacatcttccagat

SEQ ID NO: 8525273 - DNA, 22 bp, Homo sapiens
taggtttactgaattagtggaa

SEQ ID NO: 8525274 - DNA, 22 bp, Homo sapiens
tagtcaaacctcagaatacccc

SEQ ID NO: 8525275 - DNA, 22 bp, Homo sapiens
tagtcaactagtgagcatatgg

SEQ ID NO: 8525276 - DNA, 22 bp, Homo sapiens
tagtattttagaaaaccatgaa

SEQ ID NO: 8525277 - DNA, 22 bp, Homo sapiens
tagtcaaaagcttcactcggaa

SEQ ID NO: 8525278 - DNA, 22 bp, Homo sapiens
tagtcaaaaggaaggatatgct

SEQ ID NO: 8525279 - DNA, 22 bp, Homo sapiens
tagtcacaaccttcaagttgtc

SEQ ID NO: 8525280 - DNA, 22 bp, Homo sapiens
tagtcaaatggcagggatattt

SEQ ID NO: 8525281 - DNA, 22 bp, Homo sapiens
tagtatttgcagatttgtgtca

SEQ ID NO: 8525282 - DNA, 20 bp, Homo sapiens
tagtatttgcataaggatag

SEQ ID NO: 8525283 - DNA, 22 bp, Homo sapiens
tagtattttagaaaaccatgaa

SEQ ID NO: 8525284 - DNA, 20 bp, Homo sapiens
tagtatttgcataaggatag

SEQ ID NO: 8525285 - DNA, 22 bp, Homo sapiens
tagtatttataatcatgcttaa

SEQ ID NO: 8525286 - DNA, 22 bp, Homo sapiens
tagtatttataatcatgcttaa

SEQ ID NO: 8525287 - DNA, 22 bp, Homo sapiens
tagtatttcctgtaagctatag

SEQ ID NO: 8525288 - DNA, 22 bp, Homo sapiens
tagtatttcctgtaagctatag

SEQ ID NO: 8525289 - DNA, 22 bp, Homo sapiens
tagtatctattagtaacaagag

SEQ ID NO: 8525290 - DNA, 22 bp, Homo sapiens
tagtatctttctatatttccca

SEQ ID NO: 8525291 - DNA, 22 bp, Homo sapiens
tagtatctttctatatttccca

SEQ ID NO: 8525292 - DNA, 22 bp, Homo sapiens
tagtatttaatcacttttgtct

SEQ ID NO: 8525293 - DNA, 22 bp, Homo sapiens
tagtatttaatcacttttgtct

SEQ ID NO: 8525294 - DNA, 22 bp, Homo sapiens
tagtcattctccttacaaagcc

SEQ ID NO: 8525295 - DNA, 22 bp, Homo sapiens
tagtcagcatgaaataagcagc

SEQ ID NO: 8525296 - DNA, 22 bp, Homo sapiens
tagtcacaggaagtttcaatgt

SEQ ID NO: 8525297 - DNA, 22 bp, Homo sapiens
tagtcacacaattgtgtacatt

SEQ ID NO: 8525298 - DNA, 22 bp, Homo sapiens
tagtcacctttggcacctgcaa

SEQ ID NO: 8525299 - DNA, 22 bp, Homo sapiens
tagtcacatgatcacaggatcg

SEQ ID NO: 8525300 - DNA, 22 bp, Homo sapiens
tagtggctgcttcattggtgag

SEQ ID NO: 8525301 - DNA, 22 bp, Homo sapiens
tagtggggaaggaggacaagaa

SEQ ID NO: 8525302 - DNA, 22 bp, Homo sapiens
tagtggctgcagggctgtttga

SEQ ID NO: 8525303 - DNA, 22 bp, Homo sapiens
tagtggatgttcagagatttga

SEQ ID NO: 8525304 - DNA, 22 bp, Homo sapiens
tagtctaagaaatctttacttt

SEQ ID NO: 8525305 - DNA, 22 bp, Homo sapiens
tagtggggaaggaggacaagaa

SEQ ID NO: 8525306 - DNA, 22 bp, Homo sapiens
tagtggggcctgggagggttcc

SEQ ID NO: 8525307 - DNA, 22 bp, Homo sapiens
tagtggggaaggaggacaagaa

SEQ ID NO: 8525308 - DNA, 22 bp, Homo sapiens
tagtgggtgatttgatgaggaa

SEQ ID NO: 8525309 - DNA, 23 bp, Homo sapiens
tagtgtatatcaacatttgtccc

SEQ ID NO: 8525310 - DNA, 22 bp, Homo sapiens
tagtccttgctgggcacagagt

SEQ ID NO: 8525311 - DNA, 22 bp, Homo sapiens
tagtcctcagctgaactgctgc

SEQ ID NO: 8525312 - DNA, 22 bp, Homo sapiens
tagtccattttcacactgctga

SEQ ID NO: 8525313 - DNA, 22 bp, Homo sapiens
tagtcccattttgaggtatttg

SEQ ID NO: 8525314 - DNA, 22 bp, Homo sapiens
tagtccagtaaaacagctaacg

SEQ ID NO: 8525315 - DNA, 22 bp, Homo sapiens
tagtccagccttgggtgtagcc

SEQ ID NO: 8525316 - DNA, 22 bp, Homo sapiens
taggaagtagataggttgttct

SEQ ID NO: 8525317 - DNA, 22 bp, Homo sapiens
taggaagggaaaggcttcaact

SEQ ID NO: 8525318 - DNA, 22 bp, Homo sapiens
taggaaggcctgtcactacttg

SEQ ID NO: 8525319 - DNA, 22 bp, Homo sapiens
taggaaggtccatgtcttatct

SEQ ID NO: 8525320 - DNA, 22 bp, Homo sapiens
taggaagggctcagggctcggt

SEQ ID NO: 8525321 - DNA, 22 bp, Homo sapiens
taggaagggctcagggctcggt

SEQ ID NO: 8525322 - DNA, 22 bp, Homo sapiens
taggaagggctcagggctcggt

SEQ ID NO: 8525323 - DNA, 22 bp, Homo sapiens
taggaaggtgtttttaaggagc

SEQ ID NO: 8525324 - DNA, 22 bp, Homo sapiens
taggaattatgatgctatcaag

SEQ ID NO: 8525325 - DNA, 22 bp, Homo sapiens
taggaattatgatgctatcaag

SEQ ID NO: 8525326 - DNA, 22 bp, Homo sapiens
taggaattgaaaagtggtctga

SEQ ID NO: 8525327 - DNA, 22 bp, Homo sapiens
taggaattgcccgtggggtcct

SEQ ID NO: 8525328 - DNA, 22 bp, Homo sapiens
taggaattttgcatgggaattt

SEQ ID NO: 8525329 - DNA, 22 bp, Homo sapiens
taggaatttttgtaatggtact

SEQ ID NO: 8525330 - DNA, 22 bp, Homo sapiens
taggaatttttgtaatggtact

SEQ ID NO: 8525331 - DNA, 22 bp, Homo sapiens
taggaattgcccgtggggtcct

SEQ ID NO: 8525332 - DNA, 22 bp, Homo sapiens
taggaattttgcatgggaattt

SEQ ID NO: 8525333 - DNA, 22 bp, Homo sapiens
taggacagagctggttacaatg

SEQ ID NO: 8525334 - DNA, 22 bp, Homo sapiens
taggacaggctaaaagggataa

SEQ ID NO: 8525335 - DNA, 22 bp, Homo sapiens
taggacaggatcatgatgctgg

SEQ ID NO: 8525336 - DNA, 22 bp, Homo sapiens
taggacaggtgaggggctgtgg

SEQ ID NO: 8525337 - DNA, 22 bp, Homo sapiens
taggacaggtgaggggctgtgg

SEQ ID NO: 8525338 - DNA, 22 bp, Homo sapiens
taggcctaagagatactactgt

SEQ ID NO: 8525339 - DNA, 22 bp, Homo sapiens
taggcctagttactgcttactt

SEQ ID NO: 8525340 - DNA, 19 bp, Homo sapiens
taggccctagctctgcagt

SEQ ID NO: 8525341 - DNA, 22 bp, Homo sapiens
taggcctattgtattcttatct

SEQ ID NO: 8525342 - DNA, 22 bp, Homo sapiens
taggctcacatagcactaagtg

SEQ ID NO: 8525343 - DNA, 22 bp, Homo sapiens
taggccttcggtgtgtgcttgg

SEQ ID NO: 8525344 - DNA, 22 bp, Homo sapiens
taggctgaaaggagaggtgaag

SEQ ID NO: 8525345 - DNA, 23 bp, Homo sapiens
taggctctgtaggtagagatggg

SEQ ID NO: 8525346 - DNA, 22 bp, Homo sapiens
taggaaggaagagcctcagatt

SEQ ID NO: 8525347 - DNA, 22 bp, Homo sapiens
taggaaggaggccatcttggcg

SEQ ID NO: 8525348 - DNA, 18 bp, Homo sapiens
taggaagcttaatgtttt

SEQ ID NO: 8525349 - DNA, 22 bp, Homo sapiens
taggaagctctttgttttgtga

SEQ ID NO: 8525350 - DNA, 22 bp, Homo sapiens
taggaagcctaaattaagtggt

SEQ ID NO: 8525351 - DNA, 22 bp, Homo sapiens
taggaagatgagtatcaacttg

SEQ ID NO: 8525352 - DNA, 22 bp, Homo sapiens
taggaagcatttaaagagatgg

SEQ ID NO: 8525353 - DNA, 22 bp, Homo sapiens
taggaagagctataggtcccca

SEQ ID NO: 8525354 - DNA, 22 bp, Homo sapiens
taggaagatgagtatcaacttg

SEQ ID NO: 8525355 - DNA, 23 bp, Homo sapiens
taggaagacagcaaaagaatgga

SEQ ID NO: 8525356 - DNA, 22 bp, Homo sapiens
taggaaatgctccattgcataa

SEQ ID NO: 8525357 - DNA, 22 bp, Homo sapiens
taggaaatcagagaaagaggtg

SEQ ID NO: 8525358 - DNA, 22 bp, Homo sapiens
tagcccagagagccaggggctt

SEQ ID NO: 8525359 - DNA, 19 bp, Homo sapiens
tagcccagagcctggctac

SEQ ID NO: 8525360 - DNA, 19 bp, Homo sapiens
tagcccagagcctggctac

SEQ ID NO: 8525361 - DNA, 22 bp, Homo sapiens
tagcccagaagagggaagcaac

SEQ ID NO: 8525362 - DNA, 22 bp, Homo sapiens
tagcccagatacaaatcatgat

SEQ ID NO: 8525363 - DNA, 22 bp, Homo sapiens
tagcccagagtcccaattccag

SEQ ID NO: 8525364 - DNA, 22 bp, Homo sapiens
tagcccagagtcccaattccag

SEQ ID NO: 8525365 - DNA, 22 bp, Homo sapiens
tagcccagatgattgaaccatg

SEQ ID NO: 8525366 - DNA, 22 bp, Homo sapiens
taggaaactctcagctggtcat

SEQ ID NO: 8525367 - DNA, 22 bp, Homo sapiens
taggaaagaaatgagtagtgat

SEQ ID NO: 8525368 - DNA, 22 bp, Homo sapiens
taggaaatattgatttcagtca

SEQ ID NO: 8525369 - DNA, 22 bp, Homo sapiens
gtgttaaccagctaaactttgc

SEQ ID NO: 8525370 - DNA, 22 bp, Homo sapiens
gtgttaaatttctaatttgtga

SEQ ID NO: 8525371 - DNA, 22 bp, Homo sapiens
gtgttaaatttctaatttgtga

SEQ ID NO: 8525372 - DNA, 22 bp, Homo sapiens
gtgttaaatgcaatcacatgca

SEQ ID NO: 8525373 - DNA, 22 bp, Homo sapiens
gtgttaaatgcaatcacatgca

SEQ ID NO: 8525374 - DNA, 22 bp, Homo sapiens
gtgttaaatgcaatcacatgca

SEQ ID NO: 8525375 - DNA, 22 bp, Homo sapiens
gtgttaaatgcaatcacatgca

SEQ ID NO: 8525376 - DNA, 22 bp, Homo sapiens
gtgttaaaaatcccatgatatg

SEQ ID NO: 8525377 - DNA, 22 bp, Homo sapiens
gtgttaaaaatcccatgatatg

SEQ ID NO: 8525378 - DNA, 22 bp, Homo sapiens
gtgttaaaaatcccatgatatg

SEQ ID NO: 8525379 - DNA, 22 bp, Homo sapiens
gtgttaaacatgttcacagcat

SEQ ID NO: 8525380 - DNA, 22 bp, Homo sapiens
gtgttaaacatgttcacagcat

SEQ ID NO: 8525381 - DNA, 22 bp, Homo sapiens
gtgttaaacatgttcacagcat

SEQ ID NO: 8525382 - DNA, 18 bp, Homo sapiens
gtgttacaggagtgcagc

SEQ ID NO: 8525383 - DNA, 22 bp, Homo sapiens
gtgttaattattggtgaataga

SEQ ID NO: 8525384 - DNA, 22 bp, Homo sapiens
gtgttaatggtagaatctgagt

SEQ ID NO: 8525385 - DNA, 22 bp, Homo sapiens
gtgttaatggctatgaactgat

SEQ ID NO: 8525386 - DNA, 22 bp, Homo sapiens
gtgttaatggtagaatctgagt

SEQ ID NO: 8525387 - DNA, 22 bp, Homo sapiens
gtgttaatgaaaaacaactcat

SEQ ID NO: 8525388 - DNA, 22 bp, Homo sapiens
gtgtgtgttcaataaatttaag

SEQ ID NO: 8525389 - DNA, 22 bp, Homo sapiens
gtgtgtgttcaataaatttaag

SEQ ID NO: 8525390 - DNA, 22 bp, Homo sapiens
gtgtgtgttcaataaatttaag

SEQ ID NO: 8525391 - DNA, 22 bp, Homo sapiens
gtgtgtttcagaagccaggtgt

SEQ ID NO: 8525392 - DNA, 22 bp, Homo sapiens
gtgtgtttagcattagcagggg

SEQ ID NO: 8525393 - DNA, 22 bp, Homo sapiens
gtgtgtttagcattagcagggg

SEQ ID NO: 8525394 - DNA, 22 bp, Homo sapiens
gtgtgtgtgcctgcacacacac

SEQ ID NO: 8525395 - DNA, 22 bp, Homo sapiens
gtgtgtgtgcatctcttttatt

SEQ ID NO: 8525396 - DNA, 22 bp, Homo sapiens
gtgtgtgtgcatctcttttatt

SEQ ID NO: 8525397 - DNA, 22 bp, Homo sapiens
gtgtgtgtgcctgcacacacac

SEQ ID NO: 8525398 - DNA, 22 bp, Homo sapiens
gtgtgtgtgcatctcttttatt

SEQ ID NO: 8525399 - DNA, 22 bp, Homo sapiens
gtgtgtgtgtaaaaatccagag

SEQ ID NO: 8525400 - DNA, 22 bp, Homo sapiens
gtgtgtgtgcctgcacacacac

SEQ ID NO: 8525401 - DNA, 22 bp, Homo sapiens
gtgtgtgtgtaaaaatccagag

SEQ ID NO: 8525402 - DNA, 22 bp, Homo sapiens
gtgtgtgttcaataaatttaag

SEQ ID NO: 8525403 - DNA, 22 bp, Homo sapiens
gtgtgtgtgtaaaaatccagag

SEQ ID NO: 8525404 - DNA, 22 bp, Homo sapiens
gtgcttttaaaggcaattagta

SEQ ID NO: 8525405 - DNA, 21 bp, Homo sapiens
gtgcttttccttaatgttctt

SEQ ID NO: 8525406 - DNA, 22 bp, Homo sapiens
gtgctttccatcctccctgctg

SEQ ID NO: 8525407 - DNA, 22 bp, Homo sapiens
gtgctttgtcttcaggatcata

SEQ ID NO: 8525408 - DNA, 22 bp, Homo sapiens
gtgctttctgctgcattcctct

SEQ ID NO: 8525409 - DNA, 22 bp, Homo sapiens
gtgctttccatcctccctgctg

SEQ ID NO: 8525410 - DNA, 22 bp, Homo sapiens
gtgctttccatcctccctgctg

SEQ ID NO: 8525411 - DNA, 22 bp, Homo sapiens
gtgcttggcttggtgtgacctg

SEQ ID NO: 8525412 - DNA, 22 bp, Homo sapiens
gtgcttgggggaagtaacagac

SEQ ID NO: 8525413 - DNA, 21 bp, Homo sapiens
gtgtgtctaatgtagtggaaa

SEQ ID NO: 8525414 - DNA, 22 bp, Homo sapiens
gtgtgtgtatctgcctatcaca

SEQ ID NO: 8525415 - DNA, 22 bp, Homo sapiens
gtgtgtgtatctgcctatcaca

SEQ ID NO: 8525416 - DNA, 22 bp, Homo sapiens
gtgtgtgtatctgcctatcaca

SEQ ID NO: 8525417 - DNA, 19 bp, Homo sapiens
gtgctttttaagagctcag

SEQ ID NO: 8525418 - DNA, 22 bp, Homo sapiens
gtgtgtgtctccgcggccgtag

SEQ ID NO: 8525419 - DNA, 22 bp, Homo sapiens
gtgtgtgtctccgcggccgtag

SEQ ID NO: 8525420 - DNA, 22 bp, Homo sapiens
gtgtgtgtgcatataacatata

SEQ ID NO: 8525421 - DNA, 22 bp, Homo sapiens
gtgtgtgtctccgcggccgtag

SEQ ID NO: 8525422 - DNA, 22 bp, Homo sapiens
gtgtgtgtctccgcggccgtag

SEQ ID NO: 8525423 - DNA, 22 bp, Homo sapiens
gtgtgtgtgcatctcttttatt

SEQ ID NO: 8525424 - DNA, 22 bp, Homo sapiens
gtgtgtgtgcatataacatata

SEQ ID NO: 8525425 - DNA, 22 bp, Homo sapiens
gtgtgtgtgcatataacatata

SEQ ID NO: 8525426 - DNA, 22 bp, Homo sapiens
gttataaatacctaataggatt

SEQ ID NO: 8525427 - DNA, 22 bp, Homo sapiens
gttataaatacctaataggatt

SEQ ID NO: 8525428 - DNA, 22 bp, Homo sapiens
gttataaatacctaataggatt

SEQ ID NO: 8525429 - DNA, 22 bp, Homo sapiens
gttataaaggtgataatggtca

SEQ ID NO: 8525430 - DNA, 22 bp, Homo sapiens
gttataaaggtgataatggtca

SEQ ID NO: 8525431 - DNA, 22 bp, Homo sapiens
gttataaaggtgataatggtca

SEQ ID NO: 8525432 - DNA, 22 bp, Homo sapiens
gttagtgtatattgccttcaaa

SEQ ID NO: 8525433 - DNA, 22 bp, Homo sapiens
gttagtgtatattgccttcaaa

SEQ ID NO: 8525434 - DNA, 22 bp, Homo sapiens
gttagtgtgactgaggaatgca

SEQ ID NO: 8525435 - DNA, 22 bp, Homo sapiens
gttagtgggttactctcagccc

SEQ ID NO: 8525436 - DNA, 22 bp, Homo sapiens
gttagtgggttactctcagccc

SEQ ID NO: 8525437 - DNA, 22 bp, Homo sapiens
gttagtgcttattaaatagtat

SEQ ID NO: 8525438 - DNA, 22 bp, Homo sapiens
gttagtagcatttcatgacatg

SEQ ID NO: 8525439 - DNA, 22 bp, Homo sapiens
gttataaaatgcacagttgttt

SEQ ID NO: 8525440 - DNA, 22 bp, Homo sapiens
gttataaaatgcacagttgttt

SEQ ID NO: 8525441 - DNA, 22 bp, Homo sapiens
gttataaaatgcacagttgttt

SEQ ID NO: 8525442 - DNA, 22 bp, Homo sapiens
gttataaaggtgataatggtca

SEQ ID NO: 8525443 - DNA, 22 bp, Homo sapiens
gttataaaatgcacagttgttt

SEQ ID NO: 8525444 - DNA, 22 bp, Homo sapiens
gttcattttactgtaaatagca

SEQ ID NO: 8525445 - DNA, 22 bp, Homo sapiens
gttccacaaaaggtctagttta

SEQ ID NO: 8525446 - DNA, 22 bp, Homo sapiens
gttccaaatttggatctttagg

SEQ ID NO: 8525447 - DNA, 22 bp, Homo sapiens
gttccaaagtctctgagctgag

SEQ ID NO: 8525448 - DNA, 22 bp, Homo sapiens
gttaggtagaagtttactttga

SEQ ID NO: 8525449 - DNA, 20 bp, Homo sapiens
gttaggaggttggacatgga

SEQ ID NO: 8525450 - DNA, 22 bp, Homo sapiens
gttacaaaggtcataaaagtgt

SEQ ID NO: 8525451 - DNA, 22 bp, Homo sapiens
gttactcctggttgagcttggt

SEQ ID NO: 8525452 - DNA, 22 bp, Homo sapiens
gttacaaatgccaaagctgaga

SEQ ID NO: 8525453 - DNA, 22 bp, Homo sapiens
gttagaaacacattcttattga

SEQ ID NO: 8525454 - DNA, 22 bp, Homo sapiens
gttagaaagtgtctgcttgggt

SEQ ID NO: 8525455 - DNA, 22 bp, Homo sapiens
gttagaccatagaaagagcatc

SEQ ID NO: 8525456 - DNA, 22 bp, Homo sapiens
gtttaattttaggttgtcaagc

SEQ ID NO: 8525457 - DNA, 22 bp, Homo sapiens
gtttaattttaggttgtcaagc

SEQ ID NO: 8525458 - DNA, 22 bp, Homo sapiens
gttccttgtatttcagacatga

SEQ ID NO: 8525459 - DNA, 22 bp, Homo sapiens
gttccttgtaatttgttaagga

SEQ ID NO: 8525460 - DNA, 22 bp, Homo sapiens
gttcctgggaggcatgggctgg

SEQ ID NO: 8525461 - DNA, 22 bp, Homo sapiens
gttccttgggaacaacgctgaa

SEQ ID NO: 8525462 - DNA, 22 bp, Homo sapiens
gttccttggaagaacttgaggt

SEQ ID NO: 8525463 - DNA, 23 bp, Homo sapiens
gttccttcatgtggtcattggtt

SEQ ID NO: 8525464 - DNA, 22 bp, Homo sapiens
gttccaggtggtcacagagctc

SEQ ID NO: 8525465 - DNA, 22 bp, Homo sapiens
gttccaggcagtggcaacagct

SEQ ID NO: 8525466 - DNA, 18 bp, Homo sapiens
gttcccagatggtgctga

SEQ ID NO: 8525467 - DNA, 22 bp, Homo sapiens
gttcccacgcctcctctccagc

SEQ ID NO: 8525468 - DNA, 22 bp, Homo sapiens
gttcccacccctgagctccgat

SEQ ID NO: 8525469 - DNA, 22 bp, Homo sapiens
gttcccactagactgctactta

SEQ ID NO: 8525470 - DNA, 22 bp, Homo sapiens
gttcccacttggtgcactatga

SEQ ID NO: 8525471 - DNA, 22 bp, Homo sapiens
gttccacaaaaggtctagttta

SEQ ID NO: 8525472 - DNA, 22 bp, Homo sapiens
gttccacaaaatgtacccagtt

SEQ ID NO: 8525473 - DNA, 22 bp, Homo sapiens
gttccacaaagattgtctctct

SEQ ID NO: 8525474 - DNA, 22 bp, Homo sapiens
gttccaggcaagtgggatagga

SEQ ID NO: 8525475 - DNA, 22 bp, Homo sapiens
gttccaggaccctggcctctga

SEQ ID NO: 8525476 - DNA, 22 bp, Homo sapiens
gttccacatcacactacttgat

SEQ ID NO: 8525477 - DNA, 22 bp, Homo sapiens
gtttacttttcatggagcatat

SEQ ID NO: 8525478 - DNA, 22 bp, Homo sapiens
gtttacttgtgccttggcttaa

SEQ ID NO: 8525479 - DNA, 22 bp, Homo sapiens
gtttagaaaatagtgaagcaag

SEQ ID NO: 8525480 - DNA, 22 bp, Homo sapiens
gtttagaacacggaaatactga

SEQ ID NO: 8525481 - DNA, 21 bp, Homo sapiens
gtttagaagtagtctggctca

SEQ ID NO: 8525482 - DNA, 22 bp, Homo sapiens
gtttagaagccaagatttgggt

SEQ ID NO: 8525483 - DNA, 22 bp, Homo sapiens
gtttacaaatattttaaatggt

SEQ ID NO: 8525484 - DNA, 22 bp, Homo sapiens
gtttacaaatattttaaatggt

SEQ ID NO: 8525485 - DNA, 22 bp, Homo sapiens
gtttacttagatgctcatgcag

SEQ ID NO: 8525486 - DNA, 22 bp, Homo sapiens
gtttagaattctaactttaagg

SEQ ID NO: 8525487 - DNA, 22 bp, Homo sapiens
gtttagaattctaactttaagg

SEQ ID NO: 8525488 - DNA, 22 bp, Homo sapiens
gtttagatgagattttagaaca

SEQ ID NO: 8525489 - DNA, 22 bp, Homo sapiens
gtttagatttcatgaagacact

SEQ ID NO: 8525490 - DNA, 22 bp, Homo sapiens
gtttagatttcatgaagacact

SEQ ID NO: 8525491 - DNA, 22 bp, Homo sapiens
gtttagaatggcaaaattaagt

SEQ ID NO: 8525492 - DNA, 22 bp, Homo sapiens
gtttagaatgaaacttttgagc

SEQ ID NO: 8525493 - DNA, 22 bp, Homo sapiens
gtttagaatggcaaaattaagt

SEQ ID NO: 8525494 - DNA, 22 bp, Homo sapiens
gtttataaattctgcttttgtt

SEQ ID NO: 8525495 - DNA, 22 bp, Homo sapiens
gtttataaggcccaatatttct

SEQ ID NO: 8525496 - DNA, 22 bp, Homo sapiens
gtttataaggcccaatatttct

SEQ ID NO: 8525497 - DNA, 20 bp, Homo sapiens
gtttagcatggcagtgaaag

SEQ ID NO: 8525498 - DNA, 22 bp, Homo sapiens
gtttctctgtctgttacattgg

SEQ ID NO: 8525499 - DNA, 22 bp, Homo sapiens
gtttctctgtacctctgtccca

SEQ ID NO: 8525500 - DNA, 22 bp, Homo sapiens
gtttctgtaagactgaattgac

SEQ ID NO: 8525501 - DNA, 22 bp, Homo sapiens
gtttctggcgccggggcaggcc

SEQ ID NO: 8525502 - DNA, 22 bp, Homo sapiens
gtttctgtgttagatgagtctt

SEQ ID NO: 8525503 - DNA, 22 bp, Homo sapiens
gtttctcttaacacataaagta

SEQ ID NO: 8525504 - DNA, 22 bp, Homo sapiens
gtttctctttgaagcctggctg

SEQ ID NO: 8525505 - DNA, 22 bp, Homo sapiens
gttttacacacctatgaaagac

SEQ ID NO: 8525506 - DNA, 22 bp, Homo sapiens
gttttacacacctatgaaagac

SEQ ID NO: 8525507 - DNA, 22 bp, Homo sapiens
gttttacaaggttaatcagcag

SEQ ID NO: 8525508 - DNA, 23 bp, Homo sapiens
gttttacaggtgagaaaatggag

SEQ ID NO: 8525509 - DNA, 22 bp, Homo sapiens
gttttacacacctatgaaagac

SEQ ID NO: 8525510 - DNA, 22 bp, Homo sapiens
gttttagtgggtggccactgat

SEQ ID NO: 8525511 - DNA, 23 bp, Homo sapiens
gttttacaggtgagaaaatggag

SEQ ID NO: 8525512 - DNA, 22 bp, Homo sapiens
gttttagataaagctgtccttg

SEQ ID NO: 8525513 - DNA, 22 bp, Homo sapiens
gtttcttaaaagaggagttaga

SEQ ID NO: 8525514 - DNA, 22 bp, Homo sapiens
gtttctgttgctcagataatgc

SEQ ID NO: 8525515 - DNA, 22 bp, Homo sapiens
gtttctgttgctcagataatgc

SEQ ID NO: 8525516 - DNA, 22 bp, Homo sapiens
gtttcttaaatgtagcaggacc

SEQ ID NO: 8525517 - DNA, 22 bp, Homo sapiens
gtttcttaaatgtagcaggacc

SEQ ID NO: 8525518 - DNA, 22 bp, Homo sapiens
gtttcttaccacttggacctct

SEQ ID NO: 8525519 - DNA, 22 bp, Homo sapiens
gtttcttaatagcaggggccaa

SEQ ID NO: 8525520 - DNA, 22 bp, Homo sapiens
gtttcttaagttacaaaatctt

SEQ ID NO: 8525521 - DNA, 22 bp, Homo sapiens
gtttcctaggcttatacagctg

SEQ ID NO: 8525522 - DNA, 22 bp, Homo sapiens
gtttcctaccagtggttccaga

SEQ ID NO: 8525523 - DNA, 22 bp, Homo sapiens
gtttcctagatcagtgttctta

SEQ ID NO: 8525524 - DNA, 22 bp, Homo sapiens
gtttcctacactgtagtattat

SEQ ID NO: 8525525 - DNA, 22 bp, Homo sapiens
gtttcccatatctagggagagg

SEQ ID NO: 8525526 - DNA, 22 bp, Homo sapiens
gtttccttttggaattagagct

SEQ ID NO: 8525527 - DNA, 22 bp, Homo sapiens
gtttataaggcccaatatttct

SEQ ID NO: 8525528 - DNA, 22 bp, Homo sapiens
gtttatatgaacttcataccca

SEQ ID NO: 8525529 - DNA, 22 bp, Homo sapiens
gtttctcaagcttgaatgcaca

SEQ ID NO: 8525530 - DNA, 22 bp, Homo sapiens
gtttctcacaaggctgcaatcc

SEQ ID NO: 8525531 - DNA, 22 bp, Homo sapiens
gtttctcagcatgtcagtacaa

SEQ ID NO: 8525532 - DNA, 22 bp, Homo sapiens
gtttctcagcaactatatgact

SEQ ID NO: 8525533 - DNA, 22 bp, Homo sapiens
gtttctcaacatgctttctaac

SEQ ID NO: 8525534 - DNA, 22 bp, Homo sapiens
gtttctcaacatgctttctaac

SEQ ID NO: 8525535 - DNA, 22 bp, Homo sapiens
gtttctcaaattatttcagctt

SEQ ID NO: 8525536 - DNA, 22 bp, Homo sapiens
gtttcgtcaggcttattctatc

SEQ ID NO: 8525537 - DNA, 22 bp, Homo sapiens
gtttcctttttctgccctcaat

SEQ ID NO: 8525538 - DNA, 22 bp, Homo sapiens
gtttctaagggagagctgccag

SEQ ID NO: 8525539 - DNA, 21 bp, Homo sapiens
taaataataagttgctgagat

SEQ ID NO: 8525540 - DNA, 21 bp, Homo sapiens
taaataataagttgctgagat

SEQ ID NO: 8525541 - DNA, 21 bp, Homo sapiens
taaataataagttgctgagat

SEQ ID NO: 8525542 - DNA, 21 bp, Homo sapiens
taaataataagttgctgagat

SEQ ID NO: 8525543 - DNA, 21 bp, Homo sapiens
taaataataagttgctgagat

SEQ ID NO: 8525544 - DNA, 22 bp, Homo sapiens
taaatacagtcatttgagccat

SEQ ID NO: 8525545 - DNA, 22 bp, Homo sapiens
taaatacagtcatttgagccat

SEQ ID NO: 8525546 - DNA, 17 bp, Homo sapiens
taaatacacaagggtat

SEQ ID NO: 8525547 - DNA, 17 bp, Homo sapiens
taaatacacaagggtat

SEQ ID NO: 8525548 - DNA, 17 bp, Homo sapiens
taaatacacaagggtat

SEQ ID NO: 8525549 - DNA, 22 bp, Homo sapiens
taaagtttggcagacaataaca

SEQ ID NO: 8525550 - DNA, 22 bp, Homo sapiens
taaataagtcactgaccattta

SEQ ID NO: 8525551 - DNA, 22 bp, Homo sapiens
taaagtttgtagcaattgatat

SEQ ID NO: 8525552 - DNA, 22 bp, Homo sapiens
taaagtttatttgaacatctct

SEQ ID NO: 8525553 - DNA, 22 bp, Homo sapiens
taaagttcagtgcatgaatgtg

SEQ ID NO: 8525554 - DNA, 22 bp, Homo sapiens
taaagttctggtgagaggtaag

SEQ ID NO: 8525555 - DNA, 22 bp, Homo sapiens
taaagaatagatgggtagggag

SEQ ID NO: 8525556 - DNA, 22 bp, Homo sapiens
taaagacaaacccactagggtt

SEQ ID NO: 8525557 - DNA, 22 bp, Homo sapiens
taaagaataatacccatggagc

SEQ ID NO: 8525558 - DNA, 21 bp, Homo sapiens
taaagaagatgaatgtgatca

SEQ ID NO: 8525559 - DNA, 22 bp, Homo sapiens
taaagacaataggaaagttgtt

SEQ ID NO: 8525560 - DNA, 22 bp, Homo sapiens
taaactgcttctctcagtctgt

SEQ ID NO: 8525561 - DNA, 22 bp, Homo sapiens
taaacatgttgacatcttacct

SEQ ID NO: 8525562 - DNA, 22 bp, Homo sapiens
taaacatgttgacatcttacct

SEQ ID NO: 8525563 - DNA, 22 bp, Homo sapiens
taaactgtgaaaggcttaacat

SEQ ID NO: 8525564 - DNA, 22 bp, Homo sapiens
taaactgtggaatgttctcttt

SEQ ID NO: 8525565 - DNA, 22 bp, Homo sapiens
taaactgtggaatgttctcttt

SEQ ID NO: 8525566 - DNA, 22 bp, Homo sapiens
taaactgtagctctcgtaattc

SEQ ID NO: 8525567 - DNA, 22 bp, Homo sapiens
taaactgtgtaatatgatgtct

SEQ ID NO: 8525568 - DNA, 22 bp, Homo sapiens
taaagaacacagggaatagcac

SEQ ID NO: 8525569 - DNA, 22 bp, Homo sapiens
taaagaacacagggaatagcac

SEQ ID NO: 8525570 - DNA, 21 bp, Homo sapiens
taaagaagatgaatgtgatca

SEQ ID NO: 8525571 - DNA, 21 bp, Homo sapiens
taaagaagatgaatgtgatca

SEQ ID NO: 8525572 - DNA, 22 bp, Homo sapiens
taaagtgtgtatatacatatgg

SEQ ID NO: 8525573 - DNA, 22 bp, Homo sapiens
taaagtgtggatatgattagta

SEQ ID NO: 8525574 - DNA, 22 bp, Homo sapiens
taaagtgtgtgggttctaaatt

SEQ ID NO: 8525575 - DNA, 22 bp, Homo sapiens
taaagtgtttgtatgcagataa

SEQ ID NO: 8525576 - DNA, 22 bp, Homo sapiens
taaagtgttgtacaaatgtatg

SEQ ID NO: 8525577 - DNA, 22 bp, Homo sapiens
taaagtgttgtacaaatgtatg

SEQ ID NO: 8525578 - DNA, 22 bp, Homo sapiens
taaagtgtggacagtatctata

SEQ ID NO: 8525579 - DNA, 22 bp, Homo sapiens
taaagtgtggacagtatctata

SEQ ID NO: 8525580 - DNA, 22 bp, Homo sapiens
taaagtgtgcatggtcaaatat

SEQ ID NO: 8525581 - DNA, 22 bp, Homo sapiens
taaagacaatttcgagctgtag

SEQ ID NO: 8525582 - DNA, 22 bp, Homo sapiens
gttttattggaacacagccatg

SEQ ID NO: 8525583 - DNA, 22 bp, Homo sapiens
gttttatttccatgagagaccg

SEQ ID NO: 8525584 - DNA, 22 bp, Homo sapiens
gttttattggaacacagccatg

SEQ ID NO: 8525585 - DNA, 22 bp, Homo sapiens
gttttattggaacacagccatg

SEQ ID NO: 8525586 - DNA, 22 bp, Homo sapiens
gttttattggaacacagccatg

SEQ ID NO: 8525587 - DNA, 22 bp, Homo sapiens
gttttattggaacacagccatg

SEQ ID NO: 8525588 - DNA, 22 bp, Homo sapiens
gttttattggaacacagccatg

SEQ ID NO: 8525589 - DNA, 22 bp, Homo sapiens
gttttatttccatgagagaccg

SEQ ID NO: 8525590 - DNA, 22 bp, Homo sapiens
gttttatttccatgagagaccg

SEQ ID NO: 8525591 - DNA, 22 bp, Homo sapiens
gttttatttccatgagagaccg

SEQ ID NO: 8525592 - DNA, 22 bp, Homo sapiens
gttttatttccatgagagaccg

SEQ ID NO: 8525593 - DNA, 22 bp, Homo sapiens
gttttatttccatgagagaccg

SEQ ID NO: 8525594 - DNA, 22 bp, Homo sapiens
gttttatttccatgagagaccg

SEQ ID NO: 8525595 - DNA, 22 bp, Homo sapiens
gttttatttccatgagagaccg

SEQ ID NO: 8525596 - DNA, 22 bp, Homo sapiens
gttttataggtgaaatattact

SEQ ID NO: 8525597 - DNA, 22 bp, Homo sapiens
gttttataggtgaaatattact

SEQ ID NO: 8525598 - DNA, 20 bp, Homo sapiens
gttttatgccagttctgtgt

SEQ ID NO: 8525599 - DNA, 22 bp, Homo sapiens
gttttattggaacacagccatg

SEQ ID NO: 8525600 - DNA, 22 bp, Homo sapiens
gttttatgagacctcaggaata

SEQ ID NO: 8525601 - DNA, 22 bp, Homo sapiens
gttttatagttcgggacctgtt

SEQ ID NO: 8525602 - DNA, 22 bp, Homo sapiens
gttttagtgggtggccactgat

SEQ ID NO: 8525603 - DNA, 16 bp, Homo sapiens
taaacagcagacagtt

SEQ ID NO: 8525604 - DNA, 22 bp, Homo sapiens
taaacagcctcccctttcactc

SEQ ID NO: 8525605 - DNA, 22 bp, Homo sapiens
taaacagcctcccctttcactc

SEQ ID NO: 8525606 - DNA, 22 bp, Homo sapiens
taaacagcctaaaactttcttt

SEQ ID NO: 8525607 - DNA, 22 bp, Homo sapiens
taaacagcctaaaactttcttt

SEQ ID NO: 8525608 - DNA, 22 bp, Homo sapiens
taaacagagaagactttgagca

SEQ ID NO: 8525609 - DNA, 21 bp, Homo sapiens
gttttcatgatagagtctgta

SEQ ID NO: 8525610 - DNA, 23 bp, Homo sapiens
gttttcaacacaataaatgtaac

SEQ ID NO: 8525611 - DNA, 22 bp, Homo sapiens
gttttcaattataagatggctt

SEQ ID NO: 8525612 - DNA, 22 bp, Homo sapiens
gttttcaaggggatttaactga

SEQ ID NO: 8525613 - DNA, 22 bp, Homo sapiens
taaacatggattctgatcacag

SEQ ID NO: 8525614 - DNA, 22 bp, Homo sapiens
taaacatgtgagtgtgcatata

SEQ ID NO: 8525615 - DNA, 22 bp, Homo sapiens
taaacatgttgacatcttacct

SEQ ID NO: 8525616 - DNA, 22 bp, Homo sapiens
taaacatgtgagtgtgcatata

SEQ ID NO: 8525617 - DNA, 22 bp, Homo sapiens
taaacatggattctgatcacag

SEQ ID NO: 8525618 - DNA, 22 bp, Homo sapiens
taaacatggattctgatcacag

SEQ ID NO: 8525619 - DNA, 22 bp, Homo sapiens
taaacatctgtcatgtgtttat

SEQ ID NO: 8525620 - DNA, 22 bp, Homo sapiens
taaacatctgtagccttcagtc

SEQ ID NO: 8525621 - DNA, 22 bp, Homo sapiens
taaacagctactgtgtcaaagg

SEQ ID NO: 8525622 - DNA, 22 bp, Homo sapiens
taaacagctactgtgtcaaagg

SEQ ID NO: 8525623 - DNA, 20 bp, Homo sapiens
taaacagtatttactaggag

SEQ ID NO: 8525624 - DNA, 21 bp, Homo sapiens
taaacataaccttgtatggct

SEQ ID NO: 8525625 - DNA, 22 bp, Homo sapiens
taaacatctgaatcctgcttcc

SEQ ID NO: 8525626 - DNA, 22 bp, Homo sapiens
taacacatatttcaagagtagt

SEQ ID NO: 8525627 - DNA, 22 bp, Homo sapiens
taacacatatctacaacatgtg

SEQ ID NO: 8525628 - DNA, 22 bp, Homo sapiens
taacacatatttcaagagtagt

SEQ ID NO: 8525629 - DNA, 22 bp, Homo sapiens
taacacatatttcaagagtagt

SEQ ID NO: 8525630 - DNA, 22 bp, Homo sapiens
taacacatatttgcagtaagca

SEQ ID NO: 8525631 - DNA, 22 bp, Homo sapiens
taacacatggttagtacacaat

SEQ ID NO: 8525632 - DNA, 22 bp, Homo sapiens
taacacagttctctgttgcaca

SEQ ID NO: 8525633 - DNA, 22 bp, Homo sapiens
taacacatagatattttaactt

SEQ ID NO: 8525634 - DNA, 22 bp, Homo sapiens
taacacatagatattttaactt

SEQ ID NO: 8525635 - DNA, 22 bp, Homo sapiens
taacacagtgtctaccattatt

SEQ ID NO: 8525636 - DNA, 22 bp, Homo sapiens
taacacagtgtcctcagaaaca

SEQ ID NO: 8525637 - DNA, 22 bp, Homo sapiens
taacacatggttctgtcaggaa

SEQ ID NO: 8525638 - DNA, 22 bp, Homo sapiens
taacacattttcctcatacgga

SEQ ID NO: 8525639 - DNA, 21 bp, Homo sapiens
taacacattttggtactttgg

SEQ ID NO: 8525640 - DNA, 22 bp, Homo sapiens
taacacagacagccactagtaa

SEQ ID NO: 8525641 - DNA, 22 bp, Homo sapiens
taacacagacagccactagtaa

SEQ ID NO: 8525642 - DNA, 22 bp, Homo sapiens
taacacactgaaggtgagatgg

SEQ ID NO: 8525643 - DNA, 22 bp, Homo sapiens
taacacaaaagaatatgtgtgt

SEQ ID NO: 8525644 - DNA, 22 bp, Homo sapiens
taacaatgattagtgactacag

SEQ ID NO: 8525645 - DNA, 22 bp, Homo sapiens
taacaatgattagtgactacag

SEQ ID NO: 8525646 - DNA, 22 bp, Homo sapiens
taacaatgcaaaatgaatttag

SEQ ID NO: 8525647 - DNA, 22 bp, Homo sapiens
taacaattctcaaaagagggga

SEQ ID NO: 8525648 - DNA, 22 bp, Homo sapiens
taacaatggttttgctgataat

SEQ ID NO: 8525649 - DNA, 22 bp, Homo sapiens
taacaatggttttgctgataat

SEQ ID NO: 8525650 - DNA, 22 bp, Homo sapiens
taacaatgggaaggactgatga

SEQ ID NO: 8525651 - DNA, 22 bp, Homo sapiens
taacaatgggaaggactgatga

SEQ ID NO: 8525652 - DNA, 22 bp, Homo sapiens
taacaatggagttttgagaaag

SEQ ID NO: 8525653 - DNA, 22 bp, Homo sapiens
taacaatggagttttgagaaag

SEQ ID NO: 8525654 - DNA, 23 bp, Homo sapiens
taacaatggactcctcttagcta

SEQ ID NO: 8525655 - DNA, 22 bp, Homo sapiens
taacaatagtgtttgctagtca

SEQ ID NO: 8525656 - DNA, 22 bp, Homo sapiens
taacaatagtgtttgctagtca

SEQ ID NO: 8525657 - DNA, 21 bp, Homo sapiens
taacaaagacttctggtcagg

SEQ ID NO: 8525658 - DNA, 22 bp, Homo sapiens
taaatacttagttttgtgtcta

SEQ ID NO: 8525659 - DNA, 22 bp, Homo sapiens
taaatttttgttaacagcctct

SEQ ID NO: 8525660 - DNA, 22 bp, Homo sapiens
taaatacagtcatttgagccat

SEQ ID NO: 8525661 - DNA, 22 bp, Homo sapiens
taaatacagtcatttgagccat

SEQ ID NO: 8525662 - DNA, 22 bp, Homo sapiens
taacttctggaaatgcatctgc

SEQ ID NO: 8525663 - DNA, 22 bp, Homo sapiens
taacttctggaaatgcatctgc

SEQ ID NO: 8525664 - DNA, 22 bp, Homo sapiens
taacttctgcacagaaaatttg

SEQ ID NO: 8525665 - DNA, 22 bp, Homo sapiens
taagaaacccaggaatttctta

SEQ ID NO: 8525666 - DNA, 22 bp, Homo sapiens
taagaaactaatgcaataagag

SEQ ID NO: 8525667 - DNA, 22 bp, Homo sapiens
taagaaactatggagaagaact

SEQ ID NO: 8525668 - DNA, 22 bp, Homo sapiens
taagaaactgtcacagtactat

SEQ ID NO: 8525669 - DNA, 22 bp, Homo sapiens
taagaaactattgtctctgaac

SEQ ID NO: 8525670 - DNA, 22 bp, Homo sapiens
taagaaatttagttatagaatg

SEQ ID NO: 8525671 - DNA, 22 bp, Homo sapiens
taagaaacttaactgggaacta

SEQ ID NO: 8525672 - DNA, 22 bp, Homo sapiens
taagaaatttagttatagaatg

SEQ ID NO: 8525673 - DNA, 22 bp, Homo sapiens
taagaaatttagttatagaatg

SEQ ID NO: 8525674 - DNA, 22 bp, Homo sapiens
taagaaatttagttatagaatg

SEQ ID NO: 8525675 - DNA, 22 bp, Homo sapiens
taacttcaaaattgccacatgt

SEQ ID NO: 8525676 - DNA, 22 bp, Homo sapiens
taactgttgtgcgggtctctgg

SEQ ID NO: 8525677 - DNA, 23 bp, Homo sapiens
taacttacatcattctgcacaag

SEQ ID NO: 8525678 - DNA, 22 bp, Homo sapiens
taactgtgtgaacgtgatcatt

SEQ ID NO: 8525679 - DNA, 22 bp, Homo sapiens
taactgtgaagtaattgtggat

SEQ ID NO: 8525680 - DNA, 22 bp, Homo sapiens
taactgtgtgaacgtgatcatt

SEQ ID NO: 8525681 - DNA, 22 bp, Homo sapiens
taactgttgtgcgggtctctgg

SEQ ID NO: 8525682 - DNA, 22 bp, Homo sapiens
taacttctctgctatcatagga

SEQ ID NO: 8525683 - DNA, 22 bp, Homo sapiens
taacttcactggactcagcagc

SEQ ID NO: 8525684 - DNA, 22 bp, Homo sapiens
taacttcagcgagttctcttaa

SEQ ID NO: 8525685 - DNA, 22 bp, Homo sapiens
taacttctctgagcctcattcc

SEQ ID NO: 8525686 - DNA, 22 bp, Homo sapiens
taagataaggaacattctgtga

SEQ ID NO: 8525687 - DNA, 22 bp, Homo sapiens
taagataagtgggttgagatgg

SEQ ID NO: 8525688 - DNA, 22 bp, Homo sapiens
taagataagtgggttgagatgg

SEQ ID NO: 8525689 - DNA, 22 bp, Homo sapiens
taagataagtgggttgagatgg

SEQ ID NO: 8525690 - DNA, 22 bp, Homo sapiens
taagataataagtatgtctatg

SEQ ID NO: 8525691 - DNA, 22 bp, Homo sapiens
taagataataagtatgtctatg

SEQ ID NO: 8525692 - DNA, 22 bp, Homo sapiens
taagataataagtatgtctatg

SEQ ID NO: 8525693 - DNA, 22 bp, Homo sapiens
taagagtaagtgattaagaaga

SEQ ID NO: 8525694 - DNA, 22 bp, Homo sapiens
taagagtatctattaagtactt

SEQ ID NO: 8525695 - DNA, 22 bp, Homo sapiens
taagaaatttagttatagaatg

SEQ ID NO: 8525696 - DNA, 22 bp, Homo sapiens
taagaggcagcattcctcgcct

SEQ ID NO: 8525697 - DNA, 22 bp, Homo sapiens
taagaggcattagagacatagc

SEQ ID NO: 8525698 - DNA, 22 bp, Homo sapiens
taagaggcattagagacatagc

SEQ ID NO: 8525699 - DNA, 22 bp, Homo sapiens
taagagtaagtgattaagaaga

SEQ ID NO: 8525700 - DNA, 22 bp, Homo sapiens
taagatgtaagatcagagcttg

SEQ ID NO: 8525701 - DNA, 19 bp, Homo sapiens
taagatggcaagtgtctct

SEQ ID NO: 8525702 - DNA, 22 bp, Homo sapiens
taagatgaggtaggtaagactt

SEQ ID NO: 8525703 - DNA, 22 bp, Homo sapiens
taagatcagttcaaacatgtgt

SEQ ID NO: 8525704 - DNA, 22 bp, Homo sapiens
taagatgactacttaccactga

SEQ ID NO: 8525705 - DNA, 22 bp, Homo sapiens
taagatatggtaggaagtttgg

SEQ ID NO: 8525706 - DNA, 22 bp, Homo sapiens
taagatagaactctgaggctac

SEQ ID NO: 8525707 - DNA, 22 bp, Homo sapiens
taagatatggtaggaagtttgg

SEQ ID NO: 8525708 - DNA, 22 bp, Homo sapiens
taagataatccattataatgtt

SEQ ID NO: 8525709 - DNA, 22 bp, Homo sapiens
taagataatccattataatgtt

SEQ ID NO: 8525710 - DNA, 22 bp, Homo sapiens
tacaggaagcactcaagaaatg

SEQ ID NO: 8525711 - DNA, 22 bp, Homo sapiens
tacaggaactgggcaggacatt

SEQ ID NO: 8525712 - DNA, 22 bp, Homo sapiens
tacaggaactgggcaggacatt

SEQ ID NO: 8525713 - DNA, 18 bp, Homo sapiens
tacaggaaaagtgttaca

SEQ ID NO: 8525714 - DNA, 22 bp, Homo sapiens
tacaggaaagaaatttgaactc

SEQ ID NO: 8525715 - DNA, 22 bp, Homo sapiens
tacagcttttgcagctgttttg

SEQ ID NO: 8525716 - DNA, 18 bp, Homo sapiens
tacaggaaggggttctcg

SEQ ID NO: 8525717 - DNA, 18 bp, Homo sapiens
tacaggaaggggttctcg

SEQ ID NO: 8525718 - DNA, 22 bp, Homo sapiens
tacaggaagcactcaagaaatg

SEQ ID NO: 8525719 - DNA, 22 bp, Homo sapiens
tacaggaagtctcagtacagta

SEQ ID NO: 8525720 - DNA, 22 bp, Homo sapiens
tacaggaagtctcagtacagta

SEQ ID NO: 8525721 - DNA, 22 bp, Homo sapiens
tacagctttagcaaattaccta

SEQ ID NO: 8525722 - DNA, 22 bp, Homo sapiens
tacagcttgatgtttgtgtgtt

SEQ ID NO: 8525723 - DNA, 22 bp, Homo sapiens
tacagctttatacccatcaaaa

SEQ ID NO: 8525724 - DNA, 22 bp, Homo sapiens
tacagctttgggaaggccccat

SEQ ID NO: 8525725 - DNA, 22 bp, Homo sapiens
tacagcttttcatatttgtgtt

SEQ ID NO: 8525726 - DNA, 18 bp, Homo sapiens
tacagcttgagttgactg

SEQ ID NO: 8525727 - DNA, 22 bp, Homo sapiens
tacagcttgatgagagcgcgag

SEQ ID NO: 8525728 - DNA, 22 bp, Homo sapiens
tacagcttgacccataatgtct

SEQ ID NO: 8525729 - DNA, 22 bp, Homo sapiens
tacagcttcagtgtgccccagt

SEQ ID NO: 8525730 - DNA, 22 bp, Homo sapiens
tacagcttaaaagatgcattta

SEQ ID NO: 8525731 - DNA, 22 bp, Homo sapiens
tacagcttatccagcttgatag

SEQ ID NO: 8525732 - DNA, 22 bp, Homo sapiens
tacactatgggctttgtgtaat

SEQ ID NO: 8525733 - DNA, 22 bp, Homo sapiens
tacagtttgttacattgttagt

SEQ ID NO: 8525734 - DNA, 22 bp, Homo sapiens
tacagttactgttatatgtgct

SEQ ID NO: 8525735 - DNA, 22 bp, Homo sapiens
tacagtttgttacattgttagt

SEQ ID NO: 8525736 - DNA, 22 bp, Homo sapiens
tacagtttgttacattgttagt

SEQ ID NO: 8525737 - DNA, 22 bp, Homo sapiens
tacagtttgttacattgttagt

SEQ ID NO: 8525738 - DNA, 22 bp, Homo sapiens
tacagttacgctgagaaacgaa

SEQ ID NO: 8525739 - DNA, 22 bp, Homo sapiens
tacagttactgcatttctaata

SEQ ID NO: 8525740 - DNA, 17 bp, Homo sapiens
tacaggagagcaggaac

SEQ ID NO: 8525741 - DNA, 22 bp, Homo sapiens
tacaggagagatttagtaatca

SEQ ID NO: 8525742 - DNA, 20 bp, Homo sapiens
tacaggaatcaagactgcat

SEQ ID NO: 8525743 - DNA, 20 bp, Homo sapiens
tacaggaatcaagactgcat

SEQ ID NO: 8525744 - DNA, 22 bp, Homo sapiens
tacataattaatctttaagttc

SEQ ID NO: 8525745 - DNA, 22 bp, Homo sapiens
tacatacaagatgtgtttaaaa

SEQ ID NO: 8525746 - DNA, 22 bp, Homo sapiens
tacatacaagatgtgtttaaaa

SEQ ID NO: 8525747 - DNA, 22 bp, Homo sapiens
tacagtttttattcatgacaag

SEQ ID NO: 8525748 - DNA, 22 bp, Homo sapiens
tacagtttttcactgaagatgt

SEQ ID NO: 8525749 - DNA, 22 bp, Homo sapiens
tacagtttttattcatgacaag

SEQ ID NO: 8525750 - DNA, 22 bp, Homo sapiens
tacagtttttattcatgacaag

SEQ ID NO: 8525751 - DNA, 22 bp, Homo sapiens
tacagttttggtgatgatgatg

SEQ ID NO: 8525752 - DNA, 22 bp, Homo sapiens
tacagtttttattcatgacaag

SEQ ID NO: 8525753 - DNA, 22 bp, Homo sapiens
tacattatcctgtctttgtcct

SEQ ID NO: 8525754 - DNA, 22 bp, Homo sapiens
tacattagcaaacatcttggtg

SEQ ID NO: 8525755 - DNA, 22 bp, Homo sapiens
tacattatcttgttatctttca

SEQ ID NO: 8525756 - DNA, 22 bp, Homo sapiens
tacattatcttgttatctttca

SEQ ID NO: 8525757 - DNA, 22 bp, Homo sapiens
tacattatcttgttatctttca

SEQ ID NO: 8525758 - DNA, 22 bp, Homo sapiens
tacattatttcatcagtcatct

SEQ ID NO: 8525759 - DNA, 22 bp, Homo sapiens
tacattatcttgttatctttca

SEQ ID NO: 8525760 - DNA, 22 bp, Homo sapiens
tacattatttcatcagtcatct

SEQ ID NO: 8525761 - DNA, 22 bp, Homo sapiens
tacattcaacatgtcactatgt

SEQ ID NO: 8525762 - DNA, 22 bp, Homo sapiens
tacattcacagttgttcatctc

SEQ ID NO: 8525763 - DNA, 22 bp, Homo sapiens
tacattcaacatgtcactatgt

SEQ ID NO: 8525764 - DNA, 22 bp, Homo sapiens
tacattcaacatgtcactatgt

SEQ ID NO: 8525765 - DNA, 15 bp, Homo sapiens
tacattcatttccac

SEQ ID NO: 8525766 - DNA, 22 bp, Homo sapiens
tacattcatggtgacttgtatg

SEQ ID NO: 8525767 - DNA, 22 bp, Homo sapiens
tacattcagagaaagtttccat

SEQ ID NO: 8525768 - DNA, 22 bp, Homo sapiens
tacattcagaagaatggacacg

SEQ ID NO: 8525769 - DNA, 22 bp, Homo sapiens
tacatacatggtggaatggtta

SEQ ID NO: 8525770 - DNA, 22 bp, Homo sapiens
tacatgtattgatttctcttct

SEQ ID NO: 8525771 - DNA, 22 bp, Homo sapiens
tacatgtatgtttatcttgaga

SEQ ID NO: 8525772 - DNA, 22 bp, Homo sapiens
tacatgtattgatttctcttct

SEQ ID NO: 8525773 - DNA, 22 bp, Homo sapiens
tacatgtctacagccatgtctg

SEQ ID NO: 8525774 - DNA, 22 bp, Homo sapiens
tacatgtctacatgcatttttg

SEQ ID NO: 8525775 - DNA, 22 bp, Homo sapiens
tacatgtctacagccatgtctg

SEQ ID NO: 8525776 - DNA, 22 bp, Homo sapiens
tacatgtctacatgcatttttg

SEQ ID NO: 8525777 - DNA, 22 bp, Homo sapiens
tacatgtctgggttttgtttcc

SEQ ID NO: 8525778 - DNA, 22 bp, Homo sapiens
tacatgtctgggttttgtttcc

SEQ ID NO: 8525779 - DNA, 22 bp, Homo sapiens
tacatgtctacatgcatttttg

SEQ ID NO: 8525780 - DNA, 22 bp, Homo sapiens
tacattaaggatatggacatga

SEQ ID NO: 8525781 - DNA, 22 bp, Homo sapiens
tacattaaggatatggacatga

SEQ ID NO: 8525782 - DNA, 22 bp, Homo sapiens
tacattaacttacgtccacatg

SEQ ID NO: 8525783 - DNA, 22 bp, Homo sapiens
tacattaacttacgtccacatg

SEQ ID NO: 8525784 - DNA, 22 bp, Homo sapiens
tacatacagtggatgctttagg

SEQ ID NO: 8525785 - DNA, 22 bp, Homo sapiens
tacatacagtggatgctttagg

SEQ ID NO: 8525786 - DNA, 22 bp, Homo sapiens
tacatacagtggatgctttagg

SEQ ID NO: 8525787 - DNA, 22 bp, Homo sapiens
tacatacatattcatacaggtg

SEQ ID NO: 8525788 - DNA, 22 bp, Homo sapiens
tacatacatattcatacaggtg

SEQ ID NO: 8525789 - DNA, 22 bp, Homo sapiens
tacatacatattcatacaggtg

SEQ ID NO: 8525790 - DNA, 22 bp, Homo sapiens
tacatacatattcatacaggtg

SEQ ID NO: 8525791 - DNA, 22 bp, Homo sapiens
tacatacacaaatatactgttt

SEQ ID NO: 8525792 - DNA, 22 bp, Homo sapiens
tacatacacaaatatactgttt

SEQ ID NO: 8525793 - DNA, 22 bp, Homo sapiens
tacatacacaaatatactgttt

SEQ ID NO: 8525794 - DNA, 22 bp, Homo sapiens
tacatacacaaatatactgttt

SEQ ID NO: 8525795 - DNA, 22 bp, Homo sapiens
tacatacacaaatatactgttt

SEQ ID NO: 8525796 - DNA, 22 bp, Homo sapiens
tacatacacaaatatactgttt

SEQ ID NO: 8525797 - DNA, 22 bp, Homo sapiens
tacatacaagcattcaatttta

SEQ ID NO: 8525798 - DNA, 22 bp, Homo sapiens
tacatacaagatgtgtttaaaa

SEQ ID NO: 8525799 - DNA, 22 bp, Homo sapiens
tacatacacaaatgctgaatgg

SEQ ID NO: 8525800 - DNA, 22 bp, Homo sapiens
tacatacacaaatgctgaatgg

SEQ ID NO: 8525801 - DNA, 22 bp, Homo sapiens
tacatacacaaatgctgaatgg

SEQ ID NO: 8525802 - DNA, 22 bp, Homo sapiens
tacatacagagatgctagttaa

SEQ ID NO: 8525803 - DNA, 22 bp, Homo sapiens
tacatacagagatgctagttaa

SEQ ID NO: 8525804 - DNA, 22 bp, Homo sapiens
tacatacagccaagtatgaagt

SEQ ID NO: 8525805 - DNA, 22 bp, Homo sapiens
tacatacagccaagtatgaagt

SEQ ID NO: 8525806 - DNA, 22 bp, Homo sapiens
tacatacagccaagtatgaagt

SEQ ID NO: 8525807 - DNA, 22 bp, Homo sapiens
tactgaaatggcagatatataa

SEQ ID NO: 8525808 - DNA, 22 bp, Homo sapiens
tactgaaatggcagatatataa

SEQ ID NO: 8525809 - DNA, 22 bp, Homo sapiens
tactgacacaaagccaatccct

SEQ ID NO: 8525810 - DNA, 22 bp, Homo sapiens
tactgaatggggcagtaagaaa

SEQ ID NO: 8525811 - DNA, 22 bp, Homo sapiens
tactgaagcaccattaaagaca

SEQ ID NO: 8525812 - DNA, 22 bp, Homo sapiens
tactgaaggacttgagggtttc

SEQ ID NO: 8525813 - DNA, 22 bp, Homo sapiens
tactaacttgtacacagcctaa

SEQ ID NO: 8525814 - DNA, 22 bp, Homo sapiens
tactgaaagactgaatatttag

SEQ ID NO: 8525815 - DNA, 22 bp, Homo sapiens
tactgaaagactgaatatttag

SEQ ID NO: 8525816 - DNA, 22 bp, Homo sapiens
tacgttttaaacacggagccag

SEQ ID NO: 8525817 - DNA, 22 bp, Homo sapiens
tacgtttagctttatgagacat

SEQ ID NO: 8525818 - DNA, 21 bp, Homo sapiens
tacgtgtgtgcatgtttatat

SEQ ID NO: 8525819 - DNA, 22 bp, Homo sapiens
tactaaatgattaagcaggaat

SEQ ID NO: 8525820 - DNA, 22 bp, Homo sapiens
tactaaatagtttaattcctca

SEQ ID NO: 8525821 - DNA, 22 bp, Homo sapiens
tacctttgatctggaattttaa

SEQ ID NO: 8525822 - DNA, 22 bp, Homo sapiens
taccttttgcttattatgacac

SEQ ID NO: 8525823 - DNA, 22 bp, Homo sapiens
taccttgggttgagttcattct

SEQ ID NO: 8525824 - DNA, 22 bp, Homo sapiens
tacgcctgtaatcccagcactt

SEQ ID NO: 8525825 - DNA, 22 bp, Homo sapiens
tacgcctgtaatcccagcactt

SEQ ID NO: 8525826 - DNA, 22 bp, Homo sapiens
taccttttgcttattatgacac

SEQ ID NO: 8525827 - DNA, 22 bp, Homo sapiens
tacctggatgtttagattggca

SEQ ID NO: 8525828 - DNA, 22 bp, Homo sapiens
tacctggggctgggctttgatt

SEQ ID NO: 8525829 - DNA, 22 bp, Homo sapiens
tacctgtcaaaagacatggaga

SEQ ID NO: 8525830 - DNA, 22 bp, Homo sapiens
tacctggaaaagttatatgtgt

SEQ ID NO: 8525831 - DNA, 22 bp, Homo sapiens
tacctggaaatggctttagtta

SEQ ID NO: 8525832 - DNA, 22 bp, Homo sapiens
tacctggaatagagtctctcca

SEQ ID NO: 8525833 - DNA, 22 bp, Homo sapiens
tacctggaatcacagaggctga

SEQ ID NO: 8525834 - DNA, 22 bp, Homo sapiens
tacctggaatagagtctctcca

SEQ ID NO: 8525835 - DNA, 22 bp, Homo sapiens
tacctggaatttatatagctat

SEQ ID NO: 8525836 - DNA, 22 bp, Homo sapiens
tacctggatatcattcattctc

SEQ ID NO: 8525837 - DNA, 22 bp, Homo sapiens
tacctggatcctggtagacatc

SEQ ID NO: 8525838 - DNA, 22 bp, Homo sapiens
tacctggatatcattcattctc

SEQ ID NO: 8525839 - DNA, 22 bp, Homo sapiens
tacctggatcctggtagacatc

SEQ ID NO: 8525840 - DNA, 22 bp, Homo sapiens
tacctggagcaggaggcagaat

SEQ ID NO: 8525841 - DNA, 22 bp, Homo sapiens
tacctggaatcacagaggctga

SEQ ID NO: 8525842 - DNA, 22 bp, Homo sapiens
tacctggaatttatatagctat

SEQ ID NO: 8525843 - DNA, 22 bp, Homo sapiens
tacctggacatcagagagacac

SEQ ID NO: 8525844 - DNA, 22 bp, Homo sapiens
tacctggagcaggaggcagaat

SEQ ID NO: 8525845 - DNA, 22 bp, Homo sapiens
taccttctctagatctttattc

SEQ ID NO: 8525846 - DNA, 22 bp, Homo sapiens
taccttgggctattatctttga

SEQ ID NO: 8525847 - DNA, 22 bp, Homo sapiens
taccttggggttttgttgctct

SEQ ID NO: 8525848 - DNA, 22 bp, Homo sapiens
taccttgggttgagttcattct

SEQ ID NO: 8525849 - DNA, 22 bp, Homo sapiens
taccttggggttttgttgctct

SEQ ID NO: 8525850 - DNA, 22 bp, Homo sapiens
taccttggaaatgctagagtaa

SEQ ID NO: 8525851 - DNA, 22 bp, Homo sapiens
taccttggaggccaagcagttt

SEQ ID NO: 8525852 - DNA, 22 bp, Homo sapiens
taccttgggagacgccaggccc

SEQ ID NO: 8525853 - DNA, 22 bp, Homo sapiens
taccttgggctattatctttga

SEQ ID NO: 8525854 - DNA, 22 bp, Homo sapiens
tacctgaattaccaaaagcttt

SEQ ID NO: 8525855 - DNA, 22 bp, Homo sapiens
tacctgagaagaaacccgtgtt

SEQ ID NO: 8525856 - DNA, 22 bp, Homo sapiens
tacctgaagtaacaatgaatat

SEQ ID NO: 8525857 - DNA, 23 bp, Homo sapiens
tacctgaagtaagcattcatcca

SEQ ID NO: 8525858 - DNA, 22 bp, Homo sapiens
tacccagcttcaagtcaggact

SEQ ID NO: 8525859 - DNA, 22 bp, Homo sapiens
tacctgcagcgggaatccatta

SEQ ID NO: 8525860 - DNA, 22 bp, Homo sapiens
tacctgcacagccagccatgtg

SEQ ID NO: 8525861 - DNA, 22 bp, Homo sapiens
tacctgagcccagtgcagcata

SEQ ID NO: 8525862 - DNA, 22 bp, Homo sapiens
tacctgagcccagtgcagcata

SEQ ID NO: 8525863 - DNA, 22 bp, Homo sapiens
tacctgagcccctgctggtgta

SEQ ID NO: 8525864 - DNA, 22 bp, Homo sapiens
tacctgagcccagtgcagcata

SEQ ID NO: 8525865 - DNA, 22 bp, Homo sapiens
tacctgagttatattaataatt

SEQ ID NO: 8525866 - DNA, 22 bp, Homo sapiens
tacctgaggtaaggatgatgag

SEQ ID NO: 8525867 - DNA, 22 bp, Homo sapiens
tacccaaggccctttcaatttc

SEQ ID NO: 8525868 - DNA, 22 bp, Homo sapiens
tacccaaggccctttcaatttc

SEQ ID NO: 8525869 - DNA, 22 bp, Homo sapiens
tacccagattcacaagccaagg

SEQ ID NO: 8525870 - DNA, 22 bp, Homo sapiens
tacattccacaagcattgcttt

SEQ ID NO: 8525871 - DNA, 19 bp, Homo sapiens
tacattccacacaatctct

SEQ ID NO: 8525872 - DNA, 22 bp, Homo sapiens
tacattccatgtgtgtgtattc

SEQ ID NO: 8525873 - DNA, 22 bp, Homo sapiens
tacattcccccaattaccaatg

SEQ ID NO: 8525874 - DNA, 21 bp, Homo sapiens
tactgagacctcacagtgtgc

SEQ ID NO: 8525875 - DNA, 22 bp, Homo sapiens
tactgcatcgaaatgcttttat

SEQ ID NO: 8525876 - DNA, 22 bp, Homo sapiens
tactgcataactggcatgtggg

SEQ ID NO: 8525877 - DNA, 20 bp, Homo sapiens
tactgcaggaatcagctagc

SEQ ID NO: 8525878 - DNA, 22 bp, Homo sapiens
tactgcatagacactgggatat

SEQ ID NO: 8525879 - DNA, 20 bp, Homo sapiens
tactgcaggaatcagctagc

SEQ ID NO: 8525880 - DNA, 22 bp, Homo sapiens
tactgcctgggggagacagctg

SEQ ID NO: 8525881 - DNA, 23 bp, Homo sapiens
tactgcctggggccagagagcgg

SEQ ID NO: 8525882 - DNA, 22 bp, Homo sapiens
tactgcctggagcattggtgct

SEQ ID NO: 8525883 - DNA, 22 bp, Homo sapiens
tactgcatgtgtttgatgatgg

SEQ ID NO: 8525884 - DNA, 22 bp, Homo sapiens
tactgccaaattgcagcaatgt

SEQ ID NO: 8525885 - DNA, 22 bp, Homo sapiens
tactgcatgggtgcatgctgct

SEQ ID NO: 8525886 - DNA, 22 bp, Homo sapiens
tactgctgattagagctgaggt

SEQ ID NO: 8525887 - DNA, 22 bp, Homo sapiens
tactgctgagctgggtagaagg

SEQ ID NO: 8525888 - DNA, 22 bp, Homo sapiens
tactggagatggaatgcttttg

SEQ ID NO: 8525889 - DNA, 22 bp, Homo sapiens
tactggagtcagaaatgccttg

SEQ ID NO: 8525890 - DNA, 20 bp, Homo sapiens
tactgggcaagcccacagac

SEQ ID NO: 8525891 - DNA, 20 bp, Homo sapiens
tactggaaatttctccacct

SEQ ID NO: 8525892 - DNA, 22 bp, Homo sapiens
tactggaaggctggaagtcagg

SEQ ID NO: 8525893 - DNA, 22 bp, Homo sapiens
tacttcctgtttccatgtctgt

SEQ ID NO: 8525894 - DNA, 22 bp, Homo sapiens
tacttctagcctgccccttgtg

SEQ ID NO: 8525895 - DNA, 22 bp, Homo sapiens
tacttctgccttagagaacact

SEQ ID NO: 8525896 - DNA, 20 bp, Homo sapiens
tacttctgaggcactctgaa

SEQ ID NO: 8525897 - DNA, 20 bp, Homo sapiens
tacttgaatgttgcagcagt

SEQ ID NO: 8525898 - DNA, 22 bp, Homo sapiens
tacttcattattctagttttga

SEQ ID NO: 8525899 - DNA, 22 bp, Homo sapiens
tacttcattcctttgtaaaatg

SEQ ID NO: 8525900 - DNA, 22 bp, Homo sapiens
tacttccagcaatctgcatatt

SEQ ID NO: 8525901 - DNA, 22 bp, Homo sapiens
tacttcctgtttccatgtctgt

SEQ ID NO: 8525902 - DNA, 22 bp, Homo sapiens
tacttcccactggggtctacca

SEQ ID NO: 8525903 - DNA, 22 bp, Homo sapiens
tacttcctgtttccatgtctgt

SEQ ID NO: 8525904 - DNA, 22 bp, Homo sapiens
tacttcctgtttccatgtctgt

SEQ ID NO: 8525905 - DNA, 19 bp, Homo sapiens
tacttattagaaatatggg

SEQ ID NO: 8525906 - DNA, 22 bp, Homo sapiens
tacttataaggaggcacacaaa

SEQ ID NO: 8525907 - DNA, 22 bp, Homo sapiens
tacttagagcgataatttatac

SEQ ID NO: 8525908 - DNA, 22 bp, Homo sapiens
taatgctaacatcatatcactg

SEQ ID NO: 8525909 - DNA, 22 bp, Homo sapiens
taatgctcaccctgcatcaggc

SEQ ID NO: 8525910 - DNA, 22 bp, Homo sapiens
taatgccgtctctacaagactc

SEQ ID NO: 8525911 - DNA, 22 bp, Homo sapiens
taatgcttaattttcacaagcc

SEQ ID NO: 8525912 - DNA, 22 bp, Homo sapiens
taatgcttaattttcacaagcc

SEQ ID NO: 8525913 - DNA, 22 bp, Homo sapiens
taatgcttaattttcacaagcc

SEQ ID NO: 8525914 - DNA, 20 bp, Homo sapiens
taatgcttaacacatcccct

SEQ ID NO: 8525915 - DNA, 22 bp, Homo sapiens
taatgcttaacagctggctttt

SEQ ID NO: 8525916 - DNA, 22 bp, Homo sapiens
taatgcttcaatttccttgatt

SEQ ID NO: 8525917 - DNA, 22 bp, Homo sapiens
taatgcttatgttatgcaattt

SEQ ID NO: 8525918 - DNA, 22 bp, Homo sapiens
taatgcttcctatatagcactc

SEQ ID NO: 8525919 - DNA, 22 bp, Homo sapiens
taatgcttctgttaggatcttc

SEQ ID NO: 8525920 - DNA, 22 bp, Homo sapiens
taatgctttgttttgatctaac

SEQ ID NO: 8525921 - DNA, 22 bp, Homo sapiens
taatgcttgcaaattatgggac

SEQ ID NO: 8525922 - DNA, 22 bp, Homo sapiens
taatgctttgtcagcctaaggg

SEQ ID NO: 8525923 - DNA, 22 bp, Homo sapiens
taatgctttgttttgatctaac

SEQ ID NO: 8525924 - DNA, 22 bp, Homo sapiens
taatgcttttccttcaaataag

SEQ ID NO: 8525925 - DNA, 22 bp, Homo sapiens
taatgcttttccttcaaataag

SEQ ID NO: 8525926 - DNA, 22 bp, Homo sapiens
taatgcttttccttcaaataag

SEQ ID NO: 8525927 - DNA, 22 bp, Homo sapiens
taatttcaatagcttgcataat

SEQ ID NO: 8525928 - DNA, 22 bp, Homo sapiens
taatttcaatagcttgcataat

SEQ ID NO: 8525929 - DNA, 22 bp, Homo sapiens
taatttcacagttcaacgcaca

SEQ ID NO: 8525930 - DNA, 22 bp, Homo sapiens
taatggattaacgtccctgtcg

SEQ ID NO: 8525931 - DNA, 22 bp, Homo sapiens
taatggaagttaaatatggtat

SEQ ID NO: 8525932 - DNA, 22 bp, Homo sapiens
taatttctaattcattttcagt

SEQ ID NO: 8525933 - DNA, 22 bp, Homo sapiens
taatttctaattcattttcagt

SEQ ID NO: 8525934 - DNA, 22 bp, Homo sapiens
taatttcaccgttgctagaaat

SEQ ID NO: 8525935 - DNA, 22 bp, Homo sapiens
taatgaactctttactttggga

SEQ ID NO: 8525936 - DNA, 22 bp, Homo sapiens
taatgaacatgcatcgtgtgta

SEQ ID NO: 8525937 - DNA, 19 bp, Homo sapiens
taataagcaatatggaagt

SEQ ID NO: 8525938 - DNA, 22 bp, Homo sapiens
taatgaacatcttaatctgaaa

SEQ ID NO: 8525939 - DNA, 22 bp, Homo sapiens
taatgaataaacttgagagtca

SEQ ID NO: 8525940 - DNA, 22 bp, Homo sapiens
taatgaatgagaatataacaga

SEQ ID NO: 8525941 - DNA, 22 bp, Homo sapiens
taatgaggaaatagagggaatg

SEQ ID NO: 8525942 - DNA, 22 bp, Homo sapiens
taatgaggcaagagtcatggct

SEQ ID NO: 8525943 - DNA, 22 bp, Homo sapiens
taatgcaaggaattccaagtag

SEQ ID NO: 8525944 - DNA, 22 bp, Homo sapiens
taatgcaacgtgagataattaa

SEQ ID NO: 8525945 - DNA, 22 bp, Homo sapiens
taatgcaacgtgagataattaa

SEQ ID NO: 8525946 - DNA, 22 bp, Homo sapiens
taatgcaacgtgagataattaa

SEQ ID NO: 8525947 - DNA, 22 bp, Homo sapiens
taatgcaggtgcccttgggttt

SEQ ID NO: 8525948 - DNA, 22 bp, Homo sapiens
taatgcagtactgatataaaca

SEQ ID NO: 8525949 - DNA, 22 bp, Homo sapiens
taatgcatgtaatgggctgata

SEQ ID NO: 8525950 - DNA, 22 bp, Homo sapiens
taatgccaatttaatgatccat

SEQ ID NO: 8525951 - DNA, 23 bp, Homo sapiens
taatgccagccctgcagttaagc

SEQ ID NO: 8525952 - DNA, 22 bp, Homo sapiens
taatgccacggcagggaacagc

SEQ ID NO: 8525953 - DNA, 22 bp, Homo sapiens
taatgcacagaattgacatggg

SEQ ID NO: 8525954 - DNA, 22 bp, Homo sapiens
taatgcaatttagcaaagtttt

SEQ ID NO: 8525955 - DNA, 22 bp, Homo sapiens
taatgcaatttagcaaagtttt

SEQ ID NO: 8525956 - DNA, 22 bp, Homo sapiens
taatgcacatagaagtacttag

SEQ ID NO: 8525957 - DNA, 22 bp, Homo sapiens
taatgcacatagaagtacttag

SEQ ID NO: 8525958 - DNA, 22 bp, Homo sapiens
taatgcacatgactgaactatt

SEQ ID NO: 8525959 - DNA, 19 bp, Homo sapiens
taatgcacttaacacatgg

SEQ ID NO: 8525960 - DNA, 22 bp, Homo sapiens
taagcatagtaccgtagcagct

SEQ ID NO: 8525961 - DNA, 22 bp, Homo sapiens
taagcatagtaccgtagcagct

SEQ ID NO: 8525962 - DNA, 22 bp, Homo sapiens
taagtgttggtaattacaatga

SEQ ID NO: 8525963 - DNA, 22 bp, Homo sapiens
taagttcaatgaactcagttct

SEQ ID NO: 8525964 - DNA, 22 bp, Homo sapiens
taagttcaatgaactcagttct

SEQ ID NO: 8525965 - DNA, 22 bp, Homo sapiens
taagttcaccagttgtaataag

SEQ ID NO: 8525966 - DNA, 22 bp, Homo sapiens
taagttcaagtcttggatataa

SEQ ID NO: 8525967 - DNA, 22 bp, Homo sapiens
taagttatcggagtgtgtttca

SEQ ID NO: 8525968 - DNA, 17 bp, Homo sapiens
taagttatagcagaaga

SEQ ID NO: 8525969 - DNA, 22 bp, Homo sapiens
taagttcagagttctcatttgt

SEQ ID NO: 8525970 - DNA, 22 bp, Homo sapiens
taagttcagagttctcatttgt

SEQ ID NO: 8525971 - DNA, 22 bp, Homo sapiens
taagttcagttggtcgaagtag

SEQ ID NO: 8525972 - DNA, 22 bp, Homo sapiens
taagttcagttggtcgaagtag

SEQ ID NO: 8525973 - DNA, 22 bp, Homo sapiens
taagttcataagcttattctta

SEQ ID NO: 8525974 - DNA, 22 bp, Homo sapiens
taagttcattagactacagata

SEQ ID NO: 8525975 - DNA, 22 bp, Homo sapiens
taagcaatgctgtagttcagtc

SEQ ID NO: 8525976 - DNA, 22 bp, Homo sapiens
taagcataactaaaaatgattt

SEQ ID NO: 8525977 - DNA, 22 bp, Homo sapiens
taagcataactaaaaatgattt

SEQ ID NO: 8525978 - DNA, 22 bp, Homo sapiens
taagcataactaaaaatgattt

SEQ ID NO: 8525979 - DNA, 22 bp, Homo sapiens
taagcataagatacatgagaca

SEQ ID NO: 8525980 - DNA, 22 bp, Homo sapiens
taagcataagatacatgagaca

SEQ ID NO: 8525981 - DNA, 22 bp, Homo sapiens
taagcataagatacatgagaca

SEQ ID NO: 8525982 - DNA, 22 bp, Homo sapiens
taagcatacattctctcctttc

SEQ ID NO: 8525983 - DNA, 22 bp, Homo sapiens
taagcagtttttcttgtattaa

SEQ ID NO: 8525984 - DNA, 22 bp, Homo sapiens
taagcagtttttcttgtattaa

SEQ ID NO: 8525985 - DNA, 22 bp, Homo sapiens
taataacaattgtaggacatga

SEQ ID NO: 8525986 - DNA, 22 bp, Homo sapiens
taataacaattgtaggacatga

SEQ ID NO: 8525987 - DNA, 22 bp, Homo sapiens
taataacaattgtaggacatga

SEQ ID NO: 8525988 - DNA, 22 bp, Homo sapiens
taataacaattgtaggacatga

SEQ ID NO: 8525989 - DNA, 22 bp, Homo sapiens
taataacaattgtaggacatga

SEQ ID NO: 8525990 - DNA, 22 bp, Homo sapiens
taataacaattgtaggacatga

SEQ ID NO: 8525991 - DNA, 22 bp, Homo sapiens
taataaatgaaagtgctggcat

SEQ ID NO: 8525992 - DNA, 22 bp, Homo sapiens
taataaatgaaagtgctggcat

SEQ ID NO: 8525993 - DNA, 22 bp, Homo sapiens
taataaatgaaagtgctggcat

SEQ ID NO: 8525994 - DNA, 22 bp, Homo sapiens
taataaatgaaagtgctggcat

SEQ ID NO: 8525995 - DNA, 22 bp, Homo sapiens
taataaatgaaagtgctggcat

SEQ ID NO: 8525996 - DNA, 22 bp, Homo sapiens
taataaatgaaagtgctggcat

SEQ ID NO: 8525997 - DNA, 22 bp, Homo sapiens
taataaatgaaagtgctggcat

SEQ ID NO: 8525998 - DNA, 22 bp, Homo sapiens
taataaatgaaagtgctggcat

SEQ ID NO: 8525999 - DNA, 22 bp, Homo sapiens
taagtttaaatgtacatgaagc

SEQ ID NO: 8526000 - DNA, 22 bp, Homo sapiens
taagttctgagtaaatactgtt

SEQ ID NO: 8526001 - DNA, 22 bp, Homo sapiens
taagttctgaagaggcgaggta

SEQ ID NO: 8526002 - DNA, 22 bp, Homo sapiens
taagttcctggaaggcaaggat

SEQ ID NO: 8526003 - DNA, 22 bp, Homo sapiens
taagttgattataaccactgga

SEQ ID NO: 8526004 - DNA, 22 bp, Homo sapiens
taagtttccagattgtaagtcc

SEQ ID NO: 8526005 - DNA, 22 bp, Homo sapiens
taagtttctccaaagcacagaa

SEQ ID NO: 8526006 - DNA, 22 bp, Homo sapiens
taagtttctacttgtcgggtct

SEQ ID NO: 8526007 - DNA, 22 bp, Homo sapiens
tacaagctcacaaatttttaag

SEQ ID NO: 8526008 - DNA, 22 bp, Homo sapiens
tacaagctcacaaatttttaag

SEQ ID NO: 8526009 - DNA, 22 bp, Homo sapiens
tacaagctgaccctgaagatga

SEQ ID NO: 8526010 - DNA, 22 bp, Homo sapiens
taatttttccacgtacactggg

SEQ ID NO: 8526011 - DNA, 22 bp, Homo sapiens
taatttttccacgtacactggg

SEQ ID NO: 8526012 - DNA, 22 bp, Homo sapiens
taatttttccacgtacactggg

SEQ ID NO: 8526013 - DNA, 22 bp, Homo sapiens
tacaatatgtggccttttgtga

SEQ ID NO: 8526014 - DNA, 20 bp, Homo sapiens
tacaatattcccactttgct

SEQ ID NO: 8526015 - DNA, 20 bp, Homo sapiens
tacaatattcccactttgct

SEQ ID NO: 8526016 - DNA, 22 bp, Homo sapiens
tacaatcacccaaaagtggctc

SEQ ID NO: 8526017 - DNA, 22 bp, Homo sapiens
tacaatcacccaaagagccaga

SEQ ID NO: 8526018 - DNA, 22 bp, Homo sapiens
tacaatcacccaaagagccaga

SEQ ID NO: 8526019 - DNA, 22 bp, Homo sapiens
tacaatgagctgtacatctcca

SEQ ID NO: 8526020 - DNA, 22 bp, Homo sapiens
tacaatgagctgagccagaggc

SEQ ID NO: 8526021 - DNA, 22 bp, Homo sapiens
tacaatgagctgtacatctcca

SEQ ID NO: 8526022 - DNA, 22 bp, Homo sapiens
tacaatgatgatactttactgg

SEQ ID NO: 8526023 - DNA, 22 bp, Homo sapiens
tacaatgattagctaacttgcc

SEQ ID NO: 8526024 - DNA, 22 bp, Homo sapiens
tacaatcaggataataatagtg

SEQ ID NO: 8526025 - DNA, 22 bp, Homo sapiens
tacaatcaggataataatagtg

SEQ ID NO: 8526026 - DNA, 22 bp, Homo sapiens
tacaatcaggctctagcttctc

SEQ ID NO: 8526027 - DNA, 22 bp, Homo sapiens
tacaatgactctcagtttggct

SEQ ID NO: 8526028 - DNA, 22 bp, Homo sapiens
tacaatgactctcagtttggct

SEQ ID NO: 8526029 - DNA, 22 bp, Homo sapiens
tacaatgctgtgcatgtaatgg

SEQ ID NO: 8526030 - DNA, 22 bp, Homo sapiens
tacaatgcattcgttgtctcgg

SEQ ID NO: 8526031 - DNA, 22 bp, Homo sapiens
tacaatgcattcatttttgagg

SEQ ID NO: 8526032 - DNA, 22 bp, Homo sapiens
tacaatgcaaaatactgtctgc

SEQ ID NO: 8526033 - DNA, 22 bp, Homo sapiens
tacaatgattagctaacttgcc

SEQ ID NO: 8526034 - DNA, 23 bp, Homo sapiens
tacaatgcaaacttggcccatgg

SEQ ID NO: 8526035 - DNA, 21 bp, Homo sapiens
tacaatgcacaggagagcctc

SEQ ID NO: 8526036 - DNA, 22 bp, Homo sapiens
tacaatgcagtgacctccttta

SEQ ID NO: 8526037 - DNA, 22 bp, Homo sapiens
tacaatgtacttccttgcacag

SEQ ID NO: 8526038 - DNA, 22 bp, Homo sapiens
tacaatgtctctcacctgactt

SEQ ID NO: 8526039 - DNA, 22 bp, Homo sapiens
tacaatgctgtttgtttctact

SEQ ID NO: 8526040 - DNA, 22 bp, Homo sapiens
taattttgctgtgaccattgaa

SEQ ID NO: 8526041 - DNA, 22 bp, Homo sapiens
taattttgtattgccattgtag

SEQ ID NO: 8526042 - DNA, 22 bp, Homo sapiens
taattttgtattgccattgtag

SEQ ID NO: 8526043 - DNA, 22 bp, Homo sapiens
taattttgtcacagtgacatgc

SEQ ID NO: 8526044 - DNA, 22 bp, Homo sapiens
taattttgtcacagtgacatgc

SEQ ID NO: 8526045 - DNA, 22 bp, Homo sapiens
taattttgtccccctgcacata

SEQ ID NO: 8526046 - DNA, 22 bp, Homo sapiens
taattttccactctgtttatct

SEQ ID NO: 8526047 - DNA, 22 bp, Homo sapiens
taattttatgacagtgtatttt

SEQ ID NO: 8526048 - DNA, 22 bp, Homo sapiens
taatttcttcatctctgcagct

SEQ ID NO: 8526049 - DNA, 22 bp, Homo sapiens
taatttctggagggagaaagag

SEQ ID NO: 8526050 - DNA, 20 bp, Homo sapiens
taatttgatatctataagtt

SEQ ID NO: 8526051 - DNA, 22 bp, Homo sapiens
taattttaatagtatgtggcat

SEQ ID NO: 8526052 - DNA, 22 bp, Homo sapiens
taattttaactgtgctgtttgg

SEQ ID NO: 8526053 - DNA, 23 bp, Homo sapiens
taattttagccttacaggaccct

SEQ ID NO: 8526054 - DNA, 22 bp, Homo sapiens
taattttacttcctgagcacct

SEQ ID NO: 8526055 - DNA, 22 bp, Homo sapiens
taattttacttcctgagcacct

SEQ ID NO: 8526056 - DNA, 22 bp, Homo sapiens
taattttacttcctgagcacct

SEQ ID NO: 8526057 - DNA, 21 bp, Homo sapiens
tacacaaagcgtggtccagag

SEQ ID NO: 8526058 - DNA, 22 bp, Homo sapiens
tacacaaaggcactctgttgtt

SEQ ID NO: 8526059 - DNA, 22 bp, Homo sapiens
tacacaaaggcactctgttgtt

SEQ ID NO: 8526060 - DNA, 22 bp, Homo sapiens
tacacaaaggcactctgttgtt

SEQ ID NO: 8526061 - DNA, 22 bp, Homo sapiens
tacacaaaggcactctgttgtt

SEQ ID NO: 8526062 - DNA, 21 bp, Homo sapiens
tacacaaagcgtggtccagag

SEQ ID NO: 8526063 - DNA, 22 bp, Homo sapiens
tacaatgtgtgcttcttgtcac

SEQ ID NO: 8526064 - DNA, 22 bp, Homo sapiens
tacaatgtgtgcttcttgtcac

SEQ ID NO: 8526065 - DNA, 22 bp, Homo sapiens
tacaatgttggtaaagtatcat

SEQ ID NO: 8526066 - DNA, 22 bp, Homo sapiens
tacaatgttggtaaagtatcat

SEQ ID NO: 8526067 - DNA, 22 bp, Homo sapiens
tacaatgttggtaaagtatcat

SEQ ID NO: 8526068 - DNA, 22 bp, Homo sapiens
tacaatgttcgcattctctctg

SEQ ID NO: 8526069 - DNA, 22 bp, Homo sapiens
tacacatcactgtatctttcag

SEQ ID NO: 8526070 - DNA, 22 bp, Homo sapiens
tacacatatgtgtgtatatgtg

SEQ ID NO: 8526071 - DNA, 22 bp, Homo sapiens
tacacatatgtgtgtatatgtg

SEQ ID NO: 8526072 - DNA, 22 bp, Homo sapiens
tacacatatgtccattaatcag

SEQ ID NO: 8526073 - DNA, 22 bp, Homo sapiens
tacacatccatgttttgacttt

SEQ ID NO: 8526074 - DNA, 22 bp, Homo sapiens
tacacatccatgttttgacttt

SEQ ID NO: 8526075 - DNA, 22 bp, Homo sapiens
tacacatcccagactcccagga

SEQ ID NO: 8526076 - DNA, 22 bp, Homo sapiens
tacacatctctgtcagtagtga

SEQ ID NO: 8526077 - DNA, 22 bp, Homo sapiens
tacacatgacagtggactgaga

SEQ ID NO: 8526078 - DNA, 22 bp, Homo sapiens
tacacatgacagtggactgaga

SEQ ID NO: 8526079 - DNA, 22 bp, Homo sapiens
tacacattctagggcacagtta

SEQ ID NO: 8526080 - DNA, 22 bp, Homo sapiens
tacacattacataatactatct

SEQ ID NO: 8526081 - DNA, 22 bp, Homo sapiens
tacacattacataatactatct

SEQ ID NO: 8526082 - DNA, 22 bp, Homo sapiens
tacacattacataatactatct

SEQ ID NO: 8526083 - DNA, 22 bp, Homo sapiens
tacacatgtgcacgcgtgtcct

SEQ ID NO: 8526084 - DNA, 22 bp, Homo sapiens
tacacatgtccaaggtgtcacc

SEQ ID NO: 8526085 - DNA, 22 bp, Homo sapiens
tacacatgtccaaggtgtcacc

SEQ ID NO: 8526086 - DNA, 22 bp, Homo sapiens
tacacatgtatttatgtgtaca

SEQ ID NO: 8526087 - DNA, 22 bp, Homo sapiens
tacacatgtttggcaagtatgt

SEQ ID NO: 8526088 - DNA, 22 bp, Homo sapiens
tacacatgtttggcaagtatgt

SEQ ID NO: 8526089 - DNA, 22 bp, Homo sapiens
tacacatgtttggcaagtatgt

SEQ ID NO: 8526090 - DNA, 22 bp, Homo sapiens
tacacatgtatttatgtgtaca

SEQ ID NO: 8526091 - DNA, 22 bp, Homo sapiens
tacacatgctcagattcctgtg

SEQ ID NO: 8526092 - DNA, 22 bp, Homo sapiens
tacacatgctcagattcctgtg

SEQ ID NO: 8526093 - DNA, 22 bp, Homo sapiens
tacacatgcatgtactccagga

SEQ ID NO: 8526094 - DNA, 22 bp, Homo sapiens
tacacatgcatgtactccagga

SEQ ID NO: 8526095 - DNA, 22 bp, Homo sapiens
tacacatgatcatttagtagca

SEQ ID NO: 8526096 - DNA, 22 bp, Homo sapiens
tacacatttctcttagagacac

SEQ ID NO: 8526097 - DNA, 22 bp, Homo sapiens
tacacccacattgagcatggga

SEQ ID NO: 8526098 - DNA, 22 bp, Homo sapiens
tacacctgctgagcctgtcctc

SEQ ID NO: 8526099 - DNA, 22 bp, Homo sapiens
tacacctgggacccatccaaga

SEQ ID NO: 8526100 - DNA, 22 bp, Homo sapiens
tacacccttctcctgagtgtgt

SEQ ID NO: 8526101 - DNA, 22 bp, Homo sapiens
tacactaatgtttttgcaaagc

SEQ ID NO: 8526102 - DNA, 22 bp, Homo sapiens
tacactaatagccacactaatg

SEQ ID NO: 8526103 - DNA, 20 bp, Homo sapiens
tacactaagtatgaagtgct

SEQ ID NO: 8526104 - DNA, 22 bp, Homo sapiens
tacactaaatcttcatctttta

SEQ ID NO: 8526105 - DNA, 22 bp, Homo sapiens
tccacattctctgttacagata

SEQ ID NO: 8526106 - DNA, 22 bp, Homo sapiens
tccaccagagccttcccatgct

SEQ ID NO: 8526107 - DNA, 22 bp, Homo sapiens
tccaccagagccttcccatgct

SEQ ID NO: 8526108 - DNA, 22 bp, Homo sapiens
tccaccacttcctgcagccatt

SEQ ID NO: 8526109 - DNA, 22 bp, Homo sapiens
tccaccagcttcttcaccagct

SEQ ID NO: 8526110 - DNA, 22 bp, Homo sapiens
tccaccagcttcttcaccagct

SEQ ID NO: 8526111 - DNA, 20 bp, Homo sapiens
tccaccaggaagggtaggga

SEQ ID NO: 8526112 - DNA, 22 bp, Homo sapiens
tccaccaggctccatgttcagt

SEQ ID NO: 8526113 - DNA, 22 bp, Homo sapiens
tccaccagccaggcccaggctg

SEQ ID NO: 8526114 - DNA, 22 bp, Homo sapiens
tccaccagcttcttcaccagct

SEQ ID NO: 8526115 - DNA, 19 bp, Homo sapiens
tccaccccagccagctctg

SEQ ID NO: 8526116 - DNA, 22 bp, Homo sapiens
tccacccagtgtttctacaggt

SEQ ID NO: 8526117 - DNA, 23 bp, Homo sapiens
tccaccccagctgaggcttagcc

SEQ ID NO: 8526118 - DNA, 22 bp, Homo sapiens
tccaccatgtaacaagctctgt

SEQ ID NO: 8526119 - DNA, 22 bp, Homo sapiens
tccaccatgtaacaagctctgt

SEQ ID NO: 8526120 - DNA, 22 bp, Homo sapiens
tccaccatgtaacaagctctgt

SEQ ID NO: 8526121 - DNA, 22 bp, Homo sapiens
tccaccctgctttcttatctcc

SEQ ID NO: 8526122 - DNA, 22 bp, Homo sapiens
tccacctccatgctgggcagag

SEQ ID NO: 8526123 - DNA, 22 bp, Homo sapiens
tccacctgagtttcagttattt

SEQ ID NO: 8526124 - DNA, 22 bp, Homo sapiens
tccacctgggcaacagtgcctc

SEQ ID NO: 8526125 - DNA, 22 bp, Homo sapiens
tccacgctgtgtgaccttgggc

SEQ ID NO: 8526126 - DNA, 22 bp, Homo sapiens
tccacgtgagcttcgtgtgcag

SEQ ID NO: 8526127 - DNA, 22 bp, Homo sapiens
tccacgtgagcttcgtgtgcag

SEQ ID NO: 8526128 - DNA, 22 bp, Homo sapiens
tccacgtgagcttcgtgtgcag

SEQ ID NO: 8526129 - DNA, 22 bp, Homo sapiens
tccactccttatgccagacggt

SEQ ID NO: 8526130 - DNA, 22 bp, Homo sapiens
tccagaaaaagtaatttatttg

SEQ ID NO: 8526131 - DNA, 22 bp, Homo sapiens
tccagaaaattcagaaattgtt

SEQ ID NO: 8526132 - DNA, 22 bp, Homo sapiens
tccactttagcaatgattgaat

SEQ ID NO: 8526133 - DNA, 22 bp, Homo sapiens
tccactgtggtcccttgctgcc

SEQ ID NO: 8526134 - DNA, 22 bp, Homo sapiens
tccactggtatccacagtgggg

SEQ ID NO: 8526135 - DNA, 22 bp, Homo sapiens
tccactgtgcagctctgctgat

SEQ ID NO: 8526136 - DNA, 22 bp, Homo sapiens
tccactgctacaacctcccaga

SEQ ID NO: 8526137 - DNA, 22 bp, Homo sapiens
tccactgcagcttctgatggaa

SEQ ID NO: 8526138 - DNA, 22 bp, Homo sapiens
tccacagctgtcctgtaacagg

SEQ ID NO: 8526139 - DNA, 22 bp, Homo sapiens
tccacagctgtcctgtaacagg

SEQ ID NO: 8526140 - DNA, 22 bp, Homo sapiens
tccacagcttttaaatgtctag

SEQ ID NO: 8526141 - DNA, 22 bp, Homo sapiens
tccacagcacaaagccagtgtg

SEQ ID NO: 8526142 - DNA, 22 bp, Homo sapiens
tcattaaatgtttgttgtgcca

SEQ ID NO: 8526143 - DNA, 22 bp, Homo sapiens
tccacagactattaagtgatct

SEQ ID NO: 8526144 - DNA, 22 bp, Homo sapiens
tccacagaccagtatctgcagc

SEQ ID NO: 8526145 - DNA, 22 bp, Homo sapiens
tccacagaatgtaagatccaca

SEQ ID NO: 8526146 - DNA, 22 bp, Homo sapiens
tccacacttgctgtctgctgag

SEQ ID NO: 8526147 - DNA, 22 bp, Homo sapiens
tccacacacatttctatgtgca

SEQ ID NO: 8526148 - DNA, 22 bp, Homo sapiens
tcatgttttagtaaagtgaagg

SEQ ID NO: 8526149 - DNA, 22 bp, Homo sapiens
tcatgttttagtaaagtgaagg

SEQ ID NO: 8526150 - DNA, 22 bp, Homo sapiens
tcatgtttttgccatatgactc

SEQ ID NO: 8526151 - DNA, 22 bp, Homo sapiens
tcatgtttttgccatatgactc

SEQ ID NO: 8526152 - DNA, 22 bp, Homo sapiens
tcatgttttagctgcaaaatga

SEQ ID NO: 8526153 - DNA, 22 bp, Homo sapiens
tcatgttttagctgcaaaatga

SEQ ID NO: 8526154 - DNA, 22 bp, Homo sapiens
tcatgttttagtaaagtgaagg

SEQ ID NO: 8526155 - DNA, 22 bp, Homo sapiens
tcatgttttagctgcaaaatga

SEQ ID NO: 8526156 - DNA, 22 bp, Homo sapiens
tcatgttttagctgcaaaatga

SEQ ID NO: 8526157 - DNA, 22 bp, Homo sapiens
tcatgttttaatgcctttttct

SEQ ID NO: 8526158 - DNA, 22 bp, Homo sapiens
tcatgtttggagtttgctcact

SEQ ID NO: 8526159 - DNA, 22 bp, Homo sapiens
tcatgtttgttggaaatgtggc

SEQ ID NO: 8526160 - DNA, 22 bp, Homo sapiens
tcatgtttgttggaaatgtggc

SEQ ID NO: 8526161 - DNA, 22 bp, Homo sapiens
tcatgtttgttggaaatgtggc

SEQ ID NO: 8526162 - DNA, 22 bp, Homo sapiens
tcatgtttgccctaagaaaaag

SEQ ID NO: 8526163 - DNA, 22 bp, Homo sapiens
tcatgtttggagtttgctcact

SEQ ID NO: 8526164 - DNA, 22 bp, Homo sapiens
tcatgtttggagtttgctcact

SEQ ID NO: 8526165 - DNA, 22 bp, Homo sapiens
tcatgttattgactcataatat

SEQ ID NO: 8526166 - DNA, 22 bp, Homo sapiens
tcatgtttctcttacagcagct

SEQ ID NO: 8526167 - DNA, 22 bp, Homo sapiens
tcatgtttgccctaagaaaaag

SEQ ID NO: 8526168 - DNA, 22 bp, Homo sapiens
tcatgtttgccctaagaaaaag

SEQ ID NO: 8526169 - DNA, 22 bp, Homo sapiens
tcatgtttgagactaatttttc

SEQ ID NO: 8526170 - DNA, 22 bp, Homo sapiens
tcatgtttgagactaatttttc

SEQ ID NO: 8526171 - DNA, 22 bp, Homo sapiens
tcatgtgtcctagttcatataa

SEQ ID NO: 8526172 - DNA, 18 bp, Homo sapiens
tcatggcttgcagatggt

SEQ ID NO: 8526173 - DNA, 22 bp, Homo sapiens
tcatggcttcaaggaagcaggc

SEQ ID NO: 8526174 - DNA, 20 bp, Homo sapiens
tcatggctgctgagaggttc

SEQ ID NO: 8526175 - DNA, 22 bp, Homo sapiens
tcatggctggaagctcagttag

SEQ ID NO: 8526176 - DNA, 22 bp, Homo sapiens
tcatgtgtgtttcatgtatgga

SEQ ID NO: 8526177 - DNA, 22 bp, Homo sapiens
tcatgttattgactcataatat

SEQ ID NO: 8526178 - DNA, 22 bp, Homo sapiens
tcatgtgtgtttcatgtatgga

SEQ ID NO: 8526179 - DNA, 22 bp, Homo sapiens
tcatgtgtctgctgcagctgtt

SEQ ID NO: 8526180 - DNA, 22 bp, Homo sapiens
tcatgtgtctgccagtgtttat

SEQ ID NO: 8526181 - DNA, 22 bp, Homo sapiens
tcatgtgtctgccagtgtttat

SEQ ID NO: 8526182 - DNA, 22 bp, Homo sapiens
tccagccaccaccttgattgcc

SEQ ID NO: 8526183 - DNA, 22 bp, Homo sapiens
tccagccactcagcagggattg

SEQ ID NO: 8526184 - DNA, 22 bp, Homo sapiens
tccagaaatgcaagccaggtgt

SEQ ID NO: 8526185 - DNA, 22 bp, Homo sapiens
tccagaaacttttccagtctca

SEQ ID NO: 8526186 - DNA, 22 bp, Homo sapiens
tccagaaaattttacagtgcct

SEQ ID NO: 8526187 - DNA, 22 bp, Homo sapiens
tccagaaactgctgagataaga

SEQ ID NO: 8526188 - DNA, 20 bp, Homo sapiens
tccagccacttccgctggtc

SEQ ID NO: 8526189 - DNA, 20 bp, Homo sapiens
tccagccacttccgctggtc

SEQ ID NO: 8526190 - DNA, 22 bp, Homo sapiens
tccagccactcagcagggattg

SEQ ID NO: 8526191 - DNA, 22 bp, Homo sapiens
tccagcccaggctggagtgtag

SEQ ID NO: 8526192 - DNA, 22 bp, Homo sapiens
tccagcccatccctagcctggg

SEQ ID NO: 8526193 - DNA, 22 bp, Homo sapiens
tccagcccatccctagcctggg

SEQ ID NO: 8526194 - DNA, 22 bp, Homo sapiens
tccagccccgaggccggcgacg

SEQ ID NO: 8526195 - DNA, 22 bp, Homo sapiens
tccagcccctcctgagccaagc

SEQ ID NO: 8526196 - DNA, 22 bp, Homo sapiens
tccagcccctcctgagccaagc

SEQ ID NO: 8526197 - DNA, 19 bp, Homo sapiens
tccagcccctctgtgtgtg

SEQ ID NO: 8526198 - DNA, 17 bp, Homo sapiens
tccagccctgcccgacg

SEQ ID NO: 8526199 - DNA, 22 bp, Homo sapiens
tccagccctcctgggatcacag

SEQ ID NO: 8526200 - DNA, 22 bp, Homo sapiens
tccagccctgcactgattagat

SEQ ID NO: 8526201 - DNA, 22 bp, Homo sapiens
tccagccctctggcccgcggtg

SEQ ID NO: 8526202 - DNA, 22 bp, Homo sapiens
tccagcccgactgggcctgccg

SEQ ID NO: 8526203 - DNA, 22 bp, Homo sapiens
tccagcccgactgggcctgccg

SEQ ID NO: 8526204 - DNA, 22 bp, Homo sapiens
tccagcccgactgggcctgccg

SEQ ID NO: 8526205 - DNA, 19 bp, Homo sapiens
tccagcccctctgtgtgtg

SEQ ID NO: 8526206 - DNA, 22 bp, Homo sapiens
tccagccccttttactcattca

SEQ ID NO: 8526207 - DNA, 22 bp, Homo sapiens
tccagcccgggggcaggtgacc

SEQ ID NO: 8526208 - DNA, 22 bp, Homo sapiens
tccagccctcagccaagtggaa

SEQ ID NO: 8526209 - DNA, 22 bp, Homo sapiens
tccagccctcagccaagtggaa

SEQ ID NO: 8526210 - DNA, 19 bp, Homo sapiens
tccagcctgctgtttctct

SEQ ID NO: 8526211 - DNA, 19 bp, Homo sapiens
tccagcctgctgtttctct

SEQ ID NO: 8526212 - DNA, 22 bp, Homo sapiens
tccagcctgaactttgtccaga

SEQ ID NO: 8526213 - DNA, 22 bp, Homo sapiens
tccagccttctcaaggctggct

SEQ ID NO: 8526214 - DNA, 22 bp, Homo sapiens
tccagccttccttttcactctc

SEQ ID NO: 8526215 - DNA, 22 bp, Homo sapiens
tccagccttccttttcactctc

SEQ ID NO: 8526216 - DNA, 23 bp, Homo sapiens
tccagcctcttgctctcacatgc

SEQ ID NO: 8526217 - DNA, 23 bp, Homo sapiens
tccagcctcttgctctcacatgc

SEQ ID NO: 8526218 - DNA, 23 bp, Homo sapiens
tccagcctcttgctctcacatgc

SEQ ID NO: 8526219 - DNA, 23 bp, Homo sapiens
tccagcctcttgctctcacatgc

SEQ ID NO: 8526220 - DNA, 21 bp, Homo sapiens
tccagcctttccctcacttcc

SEQ ID NO: 8526221 - DNA, 21 bp, Homo sapiens
tccagcctttccctcacttcc

SEQ ID NO: 8526222 - DNA, 21 bp, Homo sapiens
tccagcctttccctcacttcc

SEQ ID NO: 8526223 - DNA, 21 bp, Homo sapiens
tccagcctttccctcacttcc

SEQ ID NO: 8526224 - DNA, 22 bp, Homo sapiens
tccagccttctcaaggctggct

SEQ ID NO: 8526225 - DNA, 22 bp, Homo sapiens
tccaggactggttcacacggtg

SEQ ID NO: 8526226 - DNA, 18 bp, Homo sapiens
tccaggactctgcgtggc

SEQ ID NO: 8526227 - DNA, 22 bp, Homo sapiens
tccaggacctcccaggctagag

SEQ ID NO: 8526228 - DNA, 22 bp, Homo sapiens
tccaggacctgactgggcctgc

SEQ ID NO: 8526229 - DNA, 22 bp, Homo sapiens
tccaggacagagtagaagcagc

SEQ ID NO: 8526230 - DNA, 22 bp, Homo sapiens
tccaggacagcggcaggcagat

SEQ ID NO: 8526231 - DNA, 22 bp, Homo sapiens
tccaggaccaaagacacatgta

SEQ ID NO: 8526232 - DNA, 22 bp, Homo sapiens
tccaggaggaggaaggctgcca

SEQ ID NO: 8526233 - DNA, 22 bp, Homo sapiens
tccaggaggaggaaggctgcca

SEQ ID NO: 8526234 - DNA, 22 bp, Homo sapiens
tccaggaggaggaaggctgcca

SEQ ID NO: 8526235 - DNA, 22 bp, Homo sapiens
tccaggaggaggaaggctgcca

SEQ ID NO: 8526236 - DNA, 23 bp, Homo sapiens
tccaggagcatgctggctggcga

SEQ ID NO: 8526237 - DNA, 23 bp, Homo sapiens
tccaggagcatgctggctggcga

SEQ ID NO: 8526238 - DNA, 22 bp, Homo sapiens
tccaggagctcatccacgtcaa

SEQ ID NO: 8526239 - DNA, 22 bp, Homo sapiens
tccaggagctcatccacgtcaa

SEQ ID NO: 8526240 - DNA, 20 bp, Homo sapiens
tccaggagaactgggagccg

SEQ ID NO: 8526241 - DNA, 23 bp, Homo sapiens
tccaggagaacccctgtctgtcc

SEQ ID NO: 8526242 - DNA, 22 bp, Homo sapiens
tccaggagaaaactgacggtgg

SEQ ID NO: 8526243 - DNA, 23 bp, Homo sapiens
tccaggagaacccctgtctgtcc

SEQ ID NO: 8526244 - DNA, 22 bp, Homo sapiens
tccaggagcatccaggtgaagc

SEQ ID NO: 8526245 - DNA, 20 bp, Homo sapiens
tccaggagaactgggagccg

SEQ ID NO: 8526246 - DNA, 22 bp, Homo sapiens
tcccagagttcaatgggaaggt

SEQ ID NO: 8526247 - DNA, 22 bp, Homo sapiens
tcccagagtttcctgtgtccca

SEQ ID NO: 8526248 - DNA, 22 bp, Homo sapiens
tcccagattcctgctcttatat

SEQ ID NO: 8526249 - DNA, 22 bp, Homo sapiens
tcccagattgttgatggcttaa

SEQ ID NO: 8526250 - DNA, 22 bp, Homo sapiens
tcccagattcctgctcttatat

SEQ ID NO: 8526251 - DNA, 22 bp, Homo sapiens
tcccagattcctgctcttatat

SEQ ID NO: 8526252 - DNA, 22 bp, Homo sapiens
tcccagattcctgctcttatat

SEQ ID NO: 8526253 - DNA, 22 bp, Homo sapiens
tcccagattcctgctcttatat

SEQ ID NO: 8526254 - DNA, 22 bp, Homo sapiens
tcccagcacgtctgctgtttct

SEQ ID NO: 8526255 - DNA, 22 bp, Homo sapiens
tcccagcagagccagcaagccg

SEQ ID NO: 8526256 - DNA, 22 bp, Homo sapiens
tcccagcagggccgaccagcct

SEQ ID NO: 8526257 - DNA, 22 bp, Homo sapiens
tcccagcaggagtccagttccc

SEQ ID NO: 8526258 - DNA, 22 bp, Homo sapiens
tcccagcagatgagctgaccta

SEQ ID NO: 8526259 - DNA, 22 bp, Homo sapiens
tcccagcagcatagctcagaat

SEQ ID NO: 8526260 - DNA, 22 bp, Homo sapiens
tcccagcagcatagctcagaat

SEQ ID NO: 8526261 - DNA, 22 bp, Homo sapiens
tcccagcctttcttttctgctg

SEQ ID NO: 8526262 - DNA, 22 bp, Homo sapiens
tcccagcctttcttttctgctg

SEQ ID NO: 8526263 - DNA, 22 bp, Homo sapiens
tcccagcataacaaactgcccg

SEQ ID NO: 8526264 - DNA, 22 bp, Homo sapiens
tcccagcagtcagagctatgtg

SEQ ID NO: 8526265 - DNA, 22 bp, Homo sapiens
tcccagctcacatatggtaact

SEQ ID NO: 8526266 - DNA, 22 bp, Homo sapiens
tcccagctcacatatggtaact

SEQ ID NO: 8526267 - DNA, 22 bp, Homo sapiens
tcccagcgcggggggaggatcc

SEQ ID NO: 8526268 - DNA, 22 bp, Homo sapiens
tcccagcgcggggggaggatcc

SEQ ID NO: 8526269 - DNA, 22 bp, Homo sapiens
tcccagctactctagaggctga

SEQ ID NO: 8526270 - DNA, 22 bp, Homo sapiens
tcccagctgctgagatagtgct

SEQ ID NO: 8526271 - DNA, 22 bp, Homo sapiens
tcccagctgagattgagcaagg

SEQ ID NO: 8526272 - DNA, 22 bp, Homo sapiens
tcccagctgagattgagcaagg

SEQ ID NO: 8526273 - DNA, 22 bp, Homo sapiens
tcccagctgagattgagcaagg

SEQ ID NO: 8526274 - DNA, 22 bp, Homo sapiens
tcccagctgctgagatagtgct

SEQ ID NO: 8526275 - DNA, 21 bp, Homo sapiens
tcccagctgggtcagtgctgc

SEQ ID NO: 8526276 - DNA, 21 bp, Homo sapiens
tcccagctgggtcagtgctgc

SEQ ID NO: 8526277 - DNA, 21 bp, Homo sapiens
tcccagctgggtcagtgctgc

SEQ ID NO: 8526278 - DNA, 22 bp, Homo sapiens
tcccagctgtgtggaggagatg

SEQ ID NO: 8526279 - DNA, 22 bp, Homo sapiens
tcccagctgtgtggaggagatg

SEQ ID NO: 8526280 - DNA, 21 bp, Homo sapiens
tcccagctgggtcagtgctgc

SEQ ID NO: 8526281 - DNA, 21 bp, Homo sapiens
tcccagctgggtcagtgctgc

SEQ ID NO: 8526282 - DNA, 22 bp, Homo sapiens
tcccaggaaaacactcgaggac

SEQ ID NO: 8526283 - DNA, 22 bp, Homo sapiens
tcccaggaaaacactcgaggac

SEQ ID NO: 8526284 - DNA, 22 bp, Homo sapiens
tcccagcttagatttgctcatt

SEQ ID NO: 8526285 - DNA, 22 bp, Homo sapiens
tcccagcttagatttgctcatt

SEQ ID NO: 8526286 - DNA, 22 bp, Homo sapiens
tcccagcttagatttgctcatt

SEQ ID NO: 8526287 - DNA, 19 bp, Homo sapiens
tcccaggaaccttttattt

SEQ ID NO: 8526288 - DNA, 22 bp, Homo sapiens
tcccaggaagatcccagggacc

SEQ ID NO: 8526289 - DNA, 22 bp, Homo sapiens
tcccaggaagatcccagggacc

SEQ ID NO: 8526290 - DNA, 19 bp, Homo sapiens
tcccaggaagcaaatgtca

SEQ ID NO: 8526291 - DNA, 17 bp, Homo sapiens
tcccaggaacagggaat

SEQ ID NO: 8526292 - DNA, 17 bp, Homo sapiens
tcccaggaacagggaat

SEQ ID NO: 8526293 - DNA, 19 bp, Homo sapiens
tcccaggaaccttttattt

SEQ ID NO: 8526294 - DNA, 22 bp, Homo sapiens
tcccaggatgttggcggcaggt

SEQ ID NO: 8526295 - DNA, 22 bp, Homo sapiens
tcccaggatgttggcggcaggt

SEQ ID NO: 8526296 - DNA, 22 bp, Homo sapiens
tcccaggatgttggcggcaggt

SEQ ID NO: 8526297 - DNA, 22 bp, Homo sapiens
tcccaggatgaagacagtgttg

SEQ ID NO: 8526298 - DNA, 22 bp, Homo sapiens
tcccaggatgtgcgtgccgccg

SEQ ID NO: 8526299 - DNA, 22 bp, Homo sapiens
tcccaggatgtgcgtgccgccg

SEQ ID NO: 8526300 - DNA, 22 bp, Homo sapiens
tcccaggatctgagggcagaga

SEQ ID NO: 8526301 - DNA, 22 bp, Homo sapiens
tcccaggaatccgtcctctaga

SEQ ID NO: 8526302 - DNA, 22 bp, Homo sapiens
tcccaggatgaagacagtgttg

SEQ ID NO: 8526303 - DNA, 22 bp, Homo sapiens
tcccaggaaggattcggcattt

SEQ ID NO: 8526304 - DNA, 19 bp, Homo sapiens
tcccaggaagcaaatgtca

SEQ ID NO: 8526305 - DNA, 22 bp, Homo sapiens
tcccaggaatccgtcctctaga

SEQ ID NO: 8526306 - DNA, 22 bp, Homo sapiens
tcccaggaaggattcggcattt

SEQ ID NO: 8526307 - DNA, 19 bp, Homo sapiens
tcccagagtctagaggttg

SEQ ID NO: 8526308 - DNA, 19 bp, Homo sapiens
tcccagagtctagaggttg

SEQ ID NO: 8526309 - DNA, 22 bp, Homo sapiens
tcccagagtcttctcctgtaat

SEQ ID NO: 8526310 - DNA, 22 bp, Homo sapiens
tcccagagtcttctcctgtaat

SEQ ID NO: 8526311 - DNA, 22 bp, Homo sapiens
tcccagagtattagcaattgct

SEQ ID NO: 8526312 - DNA, 22 bp, Homo sapiens
tcccagagaaagtcaaggtctt

SEQ ID NO: 8526313 - DNA, 22 bp, Homo sapiens
tcccagagaaagtcaaggtctt

SEQ ID NO: 8526314 - DNA, 22 bp, Homo sapiens
tcccagagtcagaggtggggcc

SEQ ID NO: 8526315 - DNA, 22 bp, Homo sapiens
tcccagagtcagaggtggggcc

SEQ ID NO: 8526316 - DNA, 19 bp, Homo sapiens
tcccagagtctagaggttg

SEQ ID NO: 8526317 - DNA, 22 bp, Homo sapiens
tcccagagtgagccaggggcag

SEQ ID NO: 8526318 - DNA, 21 bp, Homo sapiens
tcccagagtgcttgggactgc

SEQ ID NO: 8526319 - DNA, 22 bp, Homo sapiens
tcccagagtgtgggcatcaagg

SEQ ID NO: 8526320 - DNA, 22 bp, Homo sapiens
tcccagagtgtgggcatcaagg

SEQ ID NO: 8526321 - DNA, 22 bp, Homo sapiens
tcccagaatctccagtgctaca

SEQ ID NO: 8526322 - DNA, 22 bp, Homo sapiens
tcccagaatctttggaagagca

SEQ ID NO: 8526323 - DNA, 22 bp, Homo sapiens
tcccagaatctccagtgctaca

SEQ ID NO: 8526324 - DNA, 22 bp, Homo sapiens
tcccagaatcctcactctatca

SEQ ID NO: 8526325 - DNA, 22 bp, Homo sapiens
tcccagagaaagtcaaggtctt

SEQ ID NO: 8526326 - DNA, 22 bp, Homo sapiens
tcccagacaatcattggccacc

SEQ ID NO: 8526327 - DNA, 22 bp, Homo sapiens
tcccagaagagatgccacttga

SEQ ID NO: 8526328 - DNA, 22 bp, Homo sapiens
tcccagaaccctgccaggtcct

SEQ ID NO: 8526329 - DNA, 22 bp, Homo sapiens
tcccagaagtccagccatgggc

SEQ ID NO: 8526330 - DNA, 22 bp, Homo sapiens
tcccacagtggtacagccctga

SEQ ID NO: 8526331 - DNA, 22 bp, Homo sapiens
tcccacagtggtacagccctga

SEQ ID NO: 8526332 - DNA, 22 bp, Homo sapiens
tccagttctaggtcactctctg

SEQ ID NO: 8526333 - DNA, 22 bp, Homo sapiens
tcccacatatgcaatcctgaat

SEQ ID NO: 8526334 - DNA, 22 bp, Homo sapiens
tcccacagtggtacagccctga

SEQ ID NO: 8526335 - DNA, 21 bp, Homo sapiens
tcccactgccacagcttcagg

SEQ ID NO: 8526336 - DNA, 20 bp, Homo sapiens
tcccactgggcctcagtttc

SEQ ID NO: 8526337 - DNA, 21 bp, Homo sapiens
tcccactggcccagggctcca

SEQ ID NO: 8526338 - DNA, 22 bp, Homo sapiens
tcccactgtgaatccaaggcct

SEQ ID NO: 8526339 - DNA, 22 bp, Homo sapiens
tcccactgtctgtcttgctgca

SEQ ID NO: 8526340 - DNA, 22 bp, Homo sapiens
tcccactgtgaatccaaggcct

SEQ ID NO: 8526341 - DNA, 22 bp, Homo sapiens
tcccagaaaaaggaggctatga

SEQ ID NO: 8526342 - DNA, 22 bp, Homo sapiens
tcccagaaaaaggaggctatga

SEQ ID NO: 8526343 - DNA, 22 bp, Homo sapiens
tccagtctctactctgagataa

SEQ ID NO: 8526344 - DNA, 22 bp, Homo sapiens
tccagtctggtatgaatcctag

SEQ ID NO: 8526345 - DNA, 22 bp, Homo sapiens
tccagtgcattcagacacttgg

SEQ ID NO: 8526346 - DNA, 22 bp, Homo sapiens
tccagtgatctagggagctgga

SEQ ID NO: 8526347 - DNA, 22 bp, Homo sapiens
tccagtgatctagggagctgga

SEQ ID NO: 8526348 - DNA, 22 bp, Homo sapiens
tccagtcttcttgcagctacat

SEQ ID NO: 8526349 - DNA, 22 bp, Homo sapiens
tccagtcctagaaactggagag

SEQ ID NO: 8526350 - DNA, 22 bp, Homo sapiens
tccagtcccttgcctccacagc

SEQ ID NO: 8526351 - DNA, 22 bp, Homo sapiens
tccagtcctagaaactggagag

SEQ ID NO: 8526352 - DNA, 22 bp, Homo sapiens
tccagtcctatctgcccttgga

SEQ ID NO: 8526353 - DNA, 22 bp, Homo sapiens
tccagtggtacatggagacact

SEQ ID NO: 8526354 - DNA, 22 bp, Homo sapiens
tccagtggtagtaaagaggtct

SEQ ID NO: 8526355 - DNA, 22 bp, Homo sapiens
tccagtggtggtttgaagggca

SEQ ID NO: 8526356 - DNA, 22 bp, Homo sapiens
tccagtggtttgaaaggggtgt

SEQ ID NO: 8526357 - DNA, 22 bp, Homo sapiens
tccagtgggttgctgagggagg

SEQ ID NO: 8526358 - DNA, 22 bp, Homo sapiens
tccagtggaacagatgttgcct

SEQ ID NO: 8526359 - DNA, 22 bp, Homo sapiens
tccagtgctggaccagagcacc

SEQ ID NO: 8526360 - DNA, 22 bp, Homo sapiens
tccagtggcactggagactaga

SEQ ID NO: 8526361 - DNA, 22 bp, Homo sapiens
tccagtggagtgtgggggtgaa

SEQ ID NO: 8526362 - DNA, 22 bp, Homo sapiens
tccagtggcaggcggtgaggtc

SEQ ID NO: 8526363 - DNA, 22 bp, Homo sapiens
tccagggatctttagagtcttt

SEQ ID NO: 8526364 - DNA, 22 bp, Homo sapiens
tccagggatctttagagtcttt

SEQ ID NO: 8526365 - DNA, 22 bp, Homo sapiens
tccagggagtcaaatgaactac

SEQ ID NO: 8526366 - DNA, 22 bp, Homo sapiens
tccagggatggtaatgagcagt

SEQ ID NO: 8526367 - DNA, 22 bp, Homo sapiens
tccagggatgccagccatgttg

SEQ ID NO: 8526368 - DNA, 22 bp, Homo sapiens
tccagggatgtcctgtagcact

SEQ ID NO: 8526369 - DNA, 22 bp, Homo sapiens
tccagggatgtcctgtagcact

SEQ ID NO: 8526370 - DNA, 23 bp, Homo sapiens
tccagggattaatgaagtcagtc

SEQ ID NO: 8526371 - DNA, 20 bp, Homo sapiens
tccagggcaaactcatcacc

SEQ ID NO: 8526372 - DNA, 20 bp, Homo sapiens
tccagggcaaactcatcacc

SEQ ID NO: 8526373 - DNA, 20 bp, Homo sapiens
tccagggcaaactcatcacc

SEQ ID NO: 8526374 - DNA, 20 bp, Homo sapiens
tccagggcaactagagtgtg

SEQ ID NO: 8526375 - DNA, 22 bp, Homo sapiens
tccagggcaccagcgtccccct

SEQ ID NO: 8526376 - DNA, 22 bp, Homo sapiens
tccagggcaccagcgtccccct

SEQ ID NO: 8526377 - DNA, 20 bp, Homo sapiens
tccagggcaactagagtgtg

SEQ ID NO: 8526378 - DNA, 20 bp, Homo sapiens
tccagggcaactagagtgtg

SEQ ID NO: 8526379 - DNA, 20 bp, Homo sapiens
tccagggcaactagagtgtg

SEQ ID NO: 8526380 - DNA, 22 bp, Homo sapiens
tccagtcatttccattgttccc

SEQ ID NO: 8526381 - DNA, 18 bp, Homo sapiens
tccagtcccagctctgcc

SEQ ID NO: 8526382 - DNA, 22 bp, Homo sapiens
tccagggcagccgcgggtgcgc

SEQ ID NO: 8526383 - DNA, 22 bp, Homo sapiens
tccagtcatggtgtcctcacaa

SEQ ID NO: 8526384 - DNA, 22 bp, Homo sapiens
tccagtcatctcccttcacatt

SEQ ID NO: 8526385 - DNA, 22 bp, Homo sapiens
tccagggcagccgcgggtgcgc

SEQ ID NO: 8526386 - DNA, 22 bp, Homo sapiens
tccagggcagccgcgggtgcgc

SEQ ID NO: 8526387 - DNA, 22 bp, Homo sapiens
tccaggccattgactgcatcct

SEQ ID NO: 8526388 - DNA, 22 bp, Homo sapiens
tccaggccattgactgcatcct

SEQ ID NO: 8526389 - DNA, 22 bp, Homo sapiens
tccaggccattgactgcatcct

SEQ ID NO: 8526390 - DNA, 20 bp, Homo sapiens
tccaggcccactcagctgaa

SEQ ID NO: 8526391 - DNA, 20 bp, Homo sapiens
tccaggcccactcagctgaa

SEQ ID NO: 8526392 - DNA, 22 bp, Homo sapiens
tccaggcccagacggggtgagg

SEQ ID NO: 8526393 - DNA, 22 bp, Homo sapiens
tccaggcccagacggggtgagg

SEQ ID NO: 8526394 - DNA, 22 bp, Homo sapiens
tccaggcccactcggtggggct

SEQ ID NO: 8526395 - DNA, 22 bp, Homo sapiens
tccaggcccactcagctgaaat

SEQ ID NO: 8526396 - DNA, 22 bp, Homo sapiens
tccaggcccactcggtggggct

SEQ ID NO: 8526397 - DNA, 22 bp, Homo sapiens
tccaggcccactcagctgaaat

SEQ ID NO: 8526398 - DNA, 22 bp, Homo sapiens
tccaggaggcacctttggacca

SEQ ID NO: 8526399 - DNA, 22 bp, Homo sapiens
tccaggaggcagggctgtgccc

SEQ ID NO: 8526400 - DNA, 22 bp, Homo sapiens
tccaggaggcagggctgtgccc

SEQ ID NO: 8526401 - DNA, 22 bp, Homo sapiens
tccaggaggcagggctgtgccc

SEQ ID NO: 8526402 - DNA, 19 bp, Homo sapiens
tccaggccattcccagagc

SEQ ID NO: 8526403 - DNA, 19 bp, Homo sapiens
tccaggccattcccagagc

SEQ ID NO: 8526404 - DNA, 21 bp, Homo sapiens
tccaggccatggtggggaggc

SEQ ID NO: 8526405 - DNA, 21 bp, Homo sapiens
tccaggccatggtggggaggc

SEQ ID NO: 8526406 - DNA, 22 bp, Homo sapiens
tccaggccagggtaagaggaga

SEQ ID NO: 8526407 - DNA, 22 bp, Homo sapiens
tccaggccgcaggggcagcccc

SEQ ID NO: 8526408 - DNA, 22 bp, Homo sapiens
tccaggccctgggatgggagca

SEQ ID NO: 8526409 - DNA, 22 bp, Homo sapiens
tccaggccctgggatgggagca

SEQ ID NO: 8526410 - DNA, 22 bp, Homo sapiens
tccaggccgcaggggcagcccc

SEQ ID NO: 8526411 - DNA, 22 bp, Homo sapiens
tccaggccgcatagttactctg

SEQ ID NO: 8526412 - DNA, 22 bp, Homo sapiens
tccaggcctaggccaagtgatt

SEQ ID NO: 8526413 - DNA, 22 bp, Homo sapiens
tccaggcctaggccaagtgatt

SEQ ID NO: 8526414 - DNA, 22 bp, Homo sapiens
tccagggacctccctgagagct

SEQ ID NO: 8526415 - DNA, 21 bp, Homo sapiens
tccaggcctcaggaagggatg

SEQ ID NO: 8526416 - DNA, 22 bp, Homo sapiens
tccagggacagcgctggagcta

SEQ ID NO: 8526417 - DNA, 22 bp, Homo sapiens
tccagggagagccgctgctcca

SEQ ID NO: 8526418 - DNA, 22 bp, Homo sapiens
tccagggagatactggctgcca

SEQ ID NO: 8526419 - DNA, 22 bp, Homo sapiens
tccagggagatggcagaggctg

SEQ ID NO: 8526420 - DNA, 22 bp, Homo sapiens
tccagggagatactggctgcca

SEQ ID NO: 8526421 - DNA, 22 bp, Homo sapiens
tcctcccttggggtttcgttat

SEQ ID NO: 8526422 - DNA, 22 bp, Homo sapiens
tcctcctcacgctgttgcttgt

SEQ ID NO: 8526423 - DNA, 23 bp, Homo sapiens
tcctcctgacacagcctgagtga

SEQ ID NO: 8526424 - DNA, 23 bp, Homo sapiens
tcctcctgacacagcctgagtga

SEQ ID NO: 8526425 - DNA, 23 bp, Homo sapiens
tcctcctgacacagcctgagtga

SEQ ID NO: 8526426 - DNA, 23 bp, Homo sapiens
tcctcctgacacagcctgagtga

SEQ ID NO: 8526427 - DNA, 22 bp, Homo sapiens
tcctcctctatcagacagtgcc

SEQ ID NO: 8526428 - DNA, 22 bp, Homo sapiens
tcctcctctatcagacagtgcc

SEQ ID NO: 8526429 - DNA, 22 bp, Homo sapiens
tcctccctaaatcctagactgt

SEQ ID NO: 8526430 - DNA, 23 bp, Homo sapiens
tcctccctgacttctacagcaca

SEQ ID NO: 8526431 - DNA, 23 bp, Homo sapiens
tcctccctgacttctacagcaca

SEQ ID NO: 8526432 - DNA, 23 bp, Homo sapiens
tcctccctgacttctacagcaca

SEQ ID NO: 8526433 - DNA, 22 bp, Homo sapiens
tcctccctgagtggggacagct

SEQ ID NO: 8526434 - DNA, 22 bp, Homo sapiens
tcctccctgagtggggacagct

SEQ ID NO: 8526435 - DNA, 23 bp, Homo sapiens
tcctccctgacttctacagcaca

SEQ ID NO: 8526436 - DNA, 21 bp, Homo sapiens
tcctccctgagctgtggggga

SEQ ID NO: 8526437 - DNA, 22 bp, Homo sapiens
tcctccctgtaccattcctctg

SEQ ID NO: 8526438 - DNA, 22 bp, Homo sapiens
tcctcccttctcactgggaagg

SEQ ID NO: 8526439 - DNA, 22 bp, Homo sapiens
tcctcccttgactcctgctttt

SEQ ID NO: 8526440 - DNA, 22 bp, Homo sapiens
tcctccctgggagcttctgagt

SEQ ID NO: 8526441 - DNA, 22 bp, Homo sapiens
tcctccctgggagcttctgagt

SEQ ID NO: 8526442 - DNA, 22 bp, Homo sapiens
tcctccctgcactcagtgaagt

SEQ ID NO: 8526443 - DNA, 22 bp, Homo sapiens
tcctccctgcactcagtgaagt

SEQ ID NO: 8526444 - DNA, 22 bp, Homo sapiens
tcctccctgcactcagtgaagt

SEQ ID NO: 8526445 - DNA, 22 bp, Homo sapiens
tcctccctgcactcagtgaagt

SEQ ID NO: 8526446 - DNA, 22 bp, Homo sapiens
tcctccctaaatcctagactgt

SEQ ID NO: 8526447 - DNA, 22 bp, Homo sapiens
tcctccagtgtctggggccttg

SEQ ID NO: 8526448 - DNA, 22 bp, Homo sapiens
tcctccagttccttggtttcag

SEQ ID NO: 8526449 - DNA, 22 bp, Homo sapiens
tcctcccctcagggcaacggat

SEQ ID NO: 8526450 - DNA, 22 bp, Homo sapiens
tcctccagtggtactggccaat

SEQ ID NO: 8526451 - DNA, 22 bp, Homo sapiens
tcctccagtggtactggccaat

SEQ ID NO: 8526452 - DNA, 22 bp, Homo sapiens
tcctccagtggtactggccaat

SEQ ID NO: 8526453 - DNA, 22 bp, Homo sapiens
tcctccagtgtctggggccttg

SEQ ID NO: 8526454 - DNA, 22 bp, Homo sapiens
tcctccaggtctagggtggctt

SEQ ID NO: 8526455 - DNA, 22 bp, Homo sapiens
tcctccaggtctagggtggctt

SEQ ID NO: 8526456 - DNA, 22 bp, Homo sapiens
tcctccaggtctagggtggctt

SEQ ID NO: 8526457 - DNA, 22 bp, Homo sapiens
tcctccagtggcccagtccttc

SEQ ID NO: 8526458 - DNA, 22 bp, Homo sapiens
tcctccagtcttggtgaggttg

SEQ ID NO: 8526459 - DNA, 22 bp, Homo sapiens
tcctccagaccacttctgtgcg

SEQ ID NO: 8526460 - DNA, 23 bp, Homo sapiens
tcctccagaggccctccttggcc

SEQ ID NO: 8526461 - DNA, 23 bp, Homo sapiens
tcctccagaggccctccttggcc

SEQ ID NO: 8526462 - DNA, 22 bp, Homo sapiens
tcctccagagatttgagttatt

SEQ ID NO: 8526463 - DNA, 22 bp, Homo sapiens
tcctccagagatttgagttatt

SEQ ID NO: 8526464 - DNA, 22 bp, Homo sapiens
tcctccagcaggactgaggccc

SEQ ID NO: 8526465 - DNA, 22 bp, Homo sapiens
tcctccagcaggactgaggccc

SEQ ID NO: 8526466 - DNA, 22 bp, Homo sapiens
tcctccagctactaggcaaata

SEQ ID NO: 8526467 - DNA, 22 bp, Homo sapiens
tcctccaggataaaatgtgttg

SEQ ID NO: 8526468 - DNA, 22 bp, Homo sapiens
tcctccaggataaaatgtgttg

SEQ ID NO: 8526469 - DNA, 22 bp, Homo sapiens
tcctccaggcacctcactggct

SEQ ID NO: 8526470 - DNA, 22 bp, Homo sapiens
tcctccaggcacctcactggct

SEQ ID NO: 8526471 - DNA, 22 bp, Homo sapiens
tcctccaggcacctcactggct

SEQ ID NO: 8526472 - DNA, 22 bp, Homo sapiens
tcctccaggcacctcactggct

SEQ ID NO: 8526473 - DNA, 22 bp, Homo sapiens
tcctccagggggatcttcagcc

SEQ ID NO: 8526474 - DNA, 22 bp, Homo sapiens
tcctccagcttctcttttgggg

SEQ ID NO: 8526475 - DNA, 22 bp, Homo sapiens
tcctccagctgtatcctgcctg

SEQ ID NO: 8526476 - DNA, 22 bp, Homo sapiens
tcctccagccctctaggaaaat

SEQ ID NO: 8526477 - DNA, 22 bp, Homo sapiens
tcctccagctactaggcaaata

SEQ ID NO: 8526478 - DNA, 22 bp, Homo sapiens
tcctccacgatggcacacctgg

SEQ ID NO: 8526479 - DNA, 20 bp, Homo sapiens
tcctccaaccagctgctaat

SEQ ID NO: 8526480 - DNA, 22 bp, Homo sapiens
tcctcatctgtaccttggggta

SEQ ID NO: 8526481 - DNA, 22 bp, Homo sapiens
tcctccagaaactgaggcagaa

SEQ ID NO: 8526482 - DNA, 22 bp, Homo sapiens
tcctccagaaactgaggcagaa

SEQ ID NO: 8526483 - DNA, 20 bp, Homo sapiens
tcctccagaagggcagggtg

SEQ ID NO: 8526484 - DNA, 20 bp, Homo sapiens
tcctccagaagggcagggtg

SEQ ID NO: 8526485 - DNA, 22 bp, Homo sapiens
tccgggaggcagaggttgcagt

SEQ ID NO: 8526486 - DNA, 22 bp, Homo sapiens
tccgggaggcagaggttgcagt

SEQ ID NO: 8526487 - DNA, 22 bp, Homo sapiens
tccgggagctgaacgtcttgcg

SEQ ID NO: 8526488 - DNA, 22 bp, Homo sapiens
tccgggaggcagaggttgcagt

SEQ ID NO: 8526489 - DNA, 22 bp, Homo sapiens
tccgggcaactgaagggaggtt

SEQ ID NO: 8526490 - DNA, 22 bp, Homo sapiens
tccgggcaactgaagggaggtt

SEQ ID NO: 8526491 - DNA, 22 bp, Homo sapiens
tccgggcaactgaagggaggtt

SEQ ID NO: 8526492 - DNA, 22 bp, Homo sapiens
tccggactcacctgacaatggc

SEQ ID NO: 8526493 - DNA, 22 bp, Homo sapiens
tccggactcacctgacaatggc

SEQ ID NO: 8526494 - DNA, 22 bp, Homo sapiens
tccgaggccaaagctgtgaata

SEQ ID NO: 8526495 - DNA, 22 bp, Homo sapiens
tccgcccgcacgtatggagtgg

SEQ ID NO: 8526496 - DNA, 22 bp, Homo sapiens
tccgaggcgcaccggcgctcct

SEQ ID NO: 8526497 - DNA, 22 bp, Homo sapiens
tccgataagcaattcttgtgct

SEQ ID NO: 8526498 - DNA, 22 bp, Homo sapiens
tccgattagctctttataaaac

SEQ ID NO: 8526499 - DNA, 22 bp, Homo sapiens
tcctcagtcacggtagcacatt

SEQ ID NO: 8526500 - DNA, 22 bp, Homo sapiens
tccggtccgggtactcctctct

SEQ ID NO: 8526501 - DNA, 22 bp, Homo sapiens
tccgggttttacactcacatca

SEQ ID NO: 8526502 - DNA, 22 bp, Homo sapiens
tccgggcaactgaagggaggtt

SEQ ID NO: 8526503 - DNA, 22 bp, Homo sapiens
tccgggttttacactcacatca

SEQ ID NO: 8526504 - DNA, 22 bp, Homo sapiens
tccgggggtggtagatttcctt

SEQ ID NO: 8526505 - DNA, 22 bp, Homo sapiens
tcctcatacatatctcagtctt

SEQ ID NO: 8526506 - DNA, 22 bp, Homo sapiens
tcctcatagactgactgcttgc

SEQ ID NO: 8526507 - DNA, 22 bp, Homo sapiens
tcctcatctcggaacctgccac

SEQ ID NO: 8526508 - DNA, 22 bp, Homo sapiens
tcctcagttataaataggaaac

SEQ ID NO: 8526509 - DNA, 22 bp, Homo sapiens
tcctcagtggggcattcattat

SEQ ID NO: 8526510 - DNA, 22 bp, Homo sapiens
tcctcagtggggcattcattat

SEQ ID NO: 8526511 - DNA, 23 bp, Homo sapiens
tccctgtgtacagcctgcatgag

SEQ ID NO: 8526512 - DNA, 23 bp, Homo sapiens
tccctgtgtacagcctgcatgag

SEQ ID NO: 8526513 - DNA, 23 bp, Homo sapiens
tccctgtgtacagcctgcatgag

SEQ ID NO: 8526514 - DNA, 22 bp, Homo sapiens
tccctgtgggcagaggctgcct

SEQ ID NO: 8526515 - DNA, 22 bp, Homo sapiens
tccctgtgggcagaggctgcct

SEQ ID NO: 8526516 - DNA, 22 bp, Homo sapiens
tccctgtggctaagacatgaca

SEQ ID NO: 8526517 - DNA, 22 bp, Homo sapiens
tccctgtgggatgaggactctg

SEQ ID NO: 8526518 - DNA, 22 bp, Homo sapiens
tcccttaaaactcatgtgttgt

SEQ ID NO: 8526519 - DNA, 22 bp, Homo sapiens
tccctgtgtgtatataaacggt

SEQ ID NO: 8526520 - DNA, 22 bp, Homo sapiens
tccctgtgtcttcctcttgccc

SEQ ID NO: 8526521 - DNA, 22 bp, Homo sapiens
tcccttcacagatgcgatgttt

SEQ ID NO: 8526522 - DNA, 22 bp, Homo sapiens
tcccttcaataattcaacatta

SEQ ID NO: 8526523 - DNA, 22 bp, Homo sapiens
tcccttcaagatttggggaaat

SEQ ID NO: 8526524 - DNA, 22 bp, Homo sapiens
tcccttcaataattcaacatta

SEQ ID NO: 8526525 - DNA, 22 bp, Homo sapiens
tcccttggaaagtagcctcaca

SEQ ID NO: 8526526 - DNA, 21 bp, Homo sapiens
tcccttgggaaactttcttga

SEQ ID NO: 8526527 - DNA, 22 bp, Homo sapiens
tcccttctggcagcagtgtgag

SEQ ID NO: 8526528 - DNA, 22 bp, Homo sapiens
tcccttgagagttggccaattg

SEQ ID NO: 8526529 - DNA, 22 bp, Homo sapiens
tcccttggttaaatatgtagga

SEQ ID NO: 8526530 - DNA, 22 bp, Homo sapiens
tcccttggttaaatatgtagga

SEQ ID NO: 8526531 - DNA, 22 bp, Homo sapiens
tcccttggtaattctgttcctt

SEQ ID NO: 8526532 - DNA, 22 bp, Homo sapiens
tcccttcctcataggcagaagg

SEQ ID NO: 8526533 - DNA, 19 bp, Homo sapiens
tcccttcctgtcgggctcc

SEQ ID NO: 8526534 - DNA, 22 bp, Homo sapiens
tcccttcctcataggcagaagg

SEQ ID NO: 8526535 - DNA, 22 bp, Homo sapiens
tcccttcctcataggcagaagg

SEQ ID NO: 8526536 - DNA, 22 bp, Homo sapiens
tcccttctggcagcagtgtgag

SEQ ID NO: 8526537 - DNA, 22 bp, Homo sapiens
tcccttctggcagcagtgtgag

SEQ ID NO: 8526538 - DNA, 22 bp, Homo sapiens
tccctgtgaatcagaagcaggt

SEQ ID NO: 8526539 - DNA, 22 bp, Homo sapiens
tccctgtgagaaatgaagcagg

SEQ ID NO: 8526540 - DNA, 21 bp, Homo sapiens
tccctgtgagcagctcttcct

SEQ ID NO: 8526541 - DNA, 21 bp, Homo sapiens
tccctgtgagcagctcttcct

SEQ ID NO: 8526542 - DNA, 22 bp, Homo sapiens
tccctgtgagtcaactaaacaa

SEQ ID NO: 8526543 - DNA, 22 bp, Homo sapiens
tccctgtgcctatatgtgctga

SEQ ID NO: 8526544 - DNA, 22 bp, Homo sapiens
tccctgtggatatctgcagctg

SEQ ID NO: 8526545 - DNA, 22 bp, Homo sapiens
tccctgtggatatctgcagctg

SEQ ID NO: 8526546 - DNA, 22 bp, Homo sapiens
tccctgtggctaagacatgaca

SEQ ID NO: 8526547 - DNA, 22 bp, Homo sapiens
tccctgtcctgggcaatcccag

SEQ ID NO: 8526548 - DNA, 22 bp, Homo sapiens
tccctggggcagtggctcggag

SEQ ID NO: 8526549 - DNA, 22 bp, Homo sapiens
tccctggggatgttggcctgcc

SEQ ID NO: 8526550 - DNA, 22 bp, Homo sapiens
tccctggggatgttggcctgcc

SEQ ID NO: 8526551 - DNA, 22 bp, Homo sapiens
tccctggggaagggcaagcaag

SEQ ID NO: 8526552 - DNA, 22 bp, Homo sapiens
tccctgggcttctccagacttg

SEQ ID NO: 8526553 - DNA, 22 bp, Homo sapiens
tccctgggcctatcttagctcc

SEQ ID NO: 8526554 - DNA, 22 bp, Homo sapiens
tccctgggcctcctgctatgca

SEQ ID NO: 8526555 - DNA, 22 bp, Homo sapiens
tccctgggcctatcttagctcc

SEQ ID NO: 8526556 - DNA, 22 bp, Homo sapiens
tccctgggcggacattctccca

SEQ ID NO: 8526557 - DNA, 22 bp, Homo sapiens
tccctgggcctcctgctatgca

SEQ ID NO: 8526558 - DNA, 22 bp, Homo sapiens
tccctgggcctcctgctatgca

SEQ ID NO: 8526559 - DNA, 22 bp, Homo sapiens
tccctgccagtcctggtctgaa

SEQ ID NO: 8526560 - DNA, 22 bp, Homo sapiens
tccctgccagtcctggtctgaa

SEQ ID NO: 8526561 - DNA, 22 bp, Homo sapiens
tccctgccagtcctggtctgaa

SEQ ID NO: 8526562 - DNA, 22 bp, Homo sapiens
tccctgccctcagtgcacccgg

SEQ ID NO: 8526563 - DNA, 22 bp, Homo sapiens
tccctgggcacaatctgctggc

SEQ ID NO: 8526564 - DNA, 22 bp, Homo sapiens
tccctgggcatcacgttgcttc

SEQ ID NO: 8526565 - DNA, 22 bp, Homo sapiens
tccctgggcacaatctgctggc

SEQ ID NO: 8526566 - DNA, 22 bp, Homo sapiens
tccctgggcatcacgttgcttc

SEQ ID NO: 8526567 - DNA, 22 bp, Homo sapiens
tccctgggcatcacgttgcttc

SEQ ID NO: 8526568 - DNA, 22 bp, Homo sapiens
tccctgggcaagtttactcttc

SEQ ID NO: 8526569 - DNA, 22 bp, Homo sapiens
tccctgggccacagctgtgagc

SEQ ID NO: 8526570 - DNA, 23 bp, Homo sapiens
tccctgggcccgtgccagcggtg

SEQ ID NO: 8526571 - DNA, 22 bp, Homo sapiens
tccctgggccacagctgtgagc

SEQ ID NO: 8526572 - DNA, 22 bp, Homo sapiens
tccctgggccacagctgtgagc

SEQ ID NO: 8526573 - DNA, 22 bp, Homo sapiens
tccctgcagcccctgagccttc

SEQ ID NO: 8526574 - DNA, 22 bp, Homo sapiens
tccctgcagcaggtgatcaatg

SEQ ID NO: 8526575 - DNA, 22 bp, Homo sapiens
tccctgcagcccctgagccttc

SEQ ID NO: 8526576 - DNA, 22 bp, Homo sapiens
tccctgcagacgtcctgcgggt

SEQ ID NO: 8526577 - DNA, 22 bp, Homo sapiens
tccctgcacagccgagccatgc

SEQ ID NO: 8526578 - DNA, 22 bp, Homo sapiens
tccctgcacagccgagccatgc

SEQ ID NO: 8526579 - DNA, 22 bp, Homo sapiens
tccctgcacagccgagccatgc

SEQ ID NO: 8526580 - DNA, 21 bp, Homo sapiens
tccctgagttctctgagcatc

SEQ ID NO: 8526581 - DNA, 22 bp, Homo sapiens
tccctgatgccttgatccgtgg

SEQ ID NO: 8526582 - DNA, 19 bp, Homo sapiens
tccctgagttccagcccag

SEQ ID NO: 8526583 - DNA, 22 bp, Homo sapiens
tccctgagggcagctcaagtcc

SEQ ID NO: 8526584 - DNA, 22 bp, Homo sapiens
tccctgagggcagctcaagtcc

SEQ ID NO: 8526585 - DNA, 22 bp, Homo sapiens
tccctgagctgagctcaacagc

SEQ ID NO: 8526586 - DNA, 23 bp, Homo sapiens
tccctgagctggagagactgcac

SEQ ID NO: 8526587 - DNA, 23 bp, Homo sapiens
tccctgagctggagagactgcac

SEQ ID NO: 8526588 - DNA, 22 bp, Homo sapiens
tccctgagcttcatcaggcttt

SEQ ID NO: 8526589 - DNA, 22 bp, Homo sapiens
tccctgagcttctctgaaatgg

SEQ ID NO: 8526590 - DNA, 19 bp, Homo sapiens
tcccaggcaaaggcttctc

SEQ ID NO: 8526591 - DNA, 23 bp, Homo sapiens
tccctgagatgctgctctgtccc

SEQ ID NO: 8526592 - DNA, 22 bp, Homo sapiens
tcccaggatgtttatggctggt

SEQ ID NO: 8526593 - DNA, 22 bp, Homo sapiens
tcccaggatgtttatggctggt

SEQ ID NO: 8526594 - DNA, 22 bp, Homo sapiens
tcccaggattttaggctctcag

SEQ ID NO: 8526595 - DNA, 22 bp, Homo sapiens
tcccaggcaaaggcagctcatt

SEQ ID NO: 8526596 - DNA, 22 bp, Homo sapiens
tcccaggattttaggctctcag

SEQ ID NO: 8526597 - DNA, 20 bp, Homo sapiens
tcaggtagatctttgaggtc

SEQ ID NO: 8526598 - DNA, 22 bp, Homo sapiens
tcaggtccaagatggccatcca

SEQ ID NO: 8526599 - DNA, 22 bp, Homo sapiens
tcaggtccagctcctgtgcctc

SEQ ID NO: 8526600 - DNA, 22 bp, Homo sapiens
tcaggtaagtgtaatatataga

SEQ ID NO: 8526601 - DNA, 22 bp, Homo sapiens
tcagggtaaaccttcactgtga

SEQ ID NO: 8526602 - DNA, 19 bp, Homo sapiens
tcagggggctgataggagg

SEQ ID NO: 8526603 - DNA, 19 bp, Homo sapiens
tcagggggctgataggagg

SEQ ID NO: 8526604 - DNA, 22 bp, Homo sapiens
tcagggtcagattccagagcct

SEQ ID NO: 8526605 - DNA, 22 bp, Homo sapiens
tcagggtatgttctagatctga

SEQ ID NO: 8526606 - DNA, 22 bp, Homo sapiens
tcagggtcaggacccagctgtt

SEQ ID NO: 8526607 - DNA, 22 bp, Homo sapiens
tcagggtgaaccaggcaggaat

SEQ ID NO: 8526608 - DNA, 22 bp, Homo sapiens
tcaggtctgatgcctcatccat

SEQ ID NO: 8526609 - DNA, 20 bp, Homo sapiens
tcaggtgacacacgtggcac

SEQ ID NO: 8526610 - DNA, 22 bp, Homo sapiens
tcaggtccttactgtgctccct

SEQ ID NO: 8526611 - DNA, 22 bp, Homo sapiens
tcaggtccttttggtgtatatt

SEQ ID NO: 8526612 - DNA, 22 bp, Homo sapiens
tcaggtcctctgggtcccagcc

SEQ ID NO: 8526613 - DNA, 22 bp, Homo sapiens
tcaggtgacctgagccactatg

SEQ ID NO: 8526614 - DNA, 22 bp, Homo sapiens
tcaggtgacctgagccactatg

SEQ ID NO: 8526615 - DNA, 22 bp, Homo sapiens
tcaggggaggttgaatcgtctc

SEQ ID NO: 8526616 - DNA, 22 bp, Homo sapiens
tcaggggacttaggagagaagt

SEQ ID NO: 8526617 - DNA, 22 bp, Homo sapiens
tcaggggcagctgtgctttgtg

SEQ ID NO: 8526618 - DNA, 22 bp, Homo sapiens
tcaggggcagccggggaagcca

SEQ ID NO: 8526619 - DNA, 22 bp, Homo sapiens
tcaggggaaatctctcagcgaa

SEQ ID NO: 8526620 - DNA, 22 bp, Homo sapiens
tcaggggaaatctctcagcgaa

SEQ ID NO: 8526621 - DNA, 22 bp, Homo sapiens
tcaggggacttaggagagaagt

SEQ ID NO: 8526622 - DNA, 22 bp, Homo sapiens
tcaggggacttaggagagaagt

SEQ ID NO: 8526623 - DNA, 22 bp, Homo sapiens
tcaggggacagccagctggagg

SEQ ID NO: 8526624 - DNA, 22 bp, Homo sapiens
tcaggggacagccagctggagg

SEQ ID NO: 8526625 - DNA, 22 bp, Homo sapiens
tcaggggcttgaggtgcatgtc

SEQ ID NO: 8526626 - DNA, 22 bp, Homo sapiens
tcaggggcttgaggtgcatgtc

SEQ ID NO: 8526627 - DNA, 21 bp, Homo sapiens
tcaggggctgtgttttccatc

SEQ ID NO: 8526628 - DNA, 22 bp, Homo sapiens
tcaggggctgtgcatttcccag

SEQ ID NO: 8526629 - DNA, 22 bp, Homo sapiens
tcaggggctgtgcatttcccag

SEQ ID NO: 8526630 - DNA, 21 bp, Homo sapiens
tcaggggctgtgttttccatc

SEQ ID NO: 8526631 - DNA, 22 bp, Homo sapiens
tcaggggcccttccctcagcag

SEQ ID NO: 8526632 - DNA, 22 bp, Homo sapiens
tcaggggcccttccctcagcag

SEQ ID NO: 8526633 - DNA, 22 bp, Homo sapiens
tcaggggaaatctctcagcgaa

SEQ ID NO: 8526634 - DNA, 21 bp, Homo sapiens
tcagggcagctgctcttcaga

SEQ ID NO: 8526635 - DNA, 22 bp, Homo sapiens
tcagggcagcctaaggcacctc

SEQ ID NO: 8526636 - DNA, 22 bp, Homo sapiens
tcagggcagcctaaggcacctc

SEQ ID NO: 8526637 - DNA, 22 bp, Homo sapiens
tcagggcagcctaaggcacctc

SEQ ID NO: 8526638 - DNA, 22 bp, Homo sapiens
tcagggcagcctaaggcacctc

SEQ ID NO: 8526639 - DNA, 22 bp, Homo sapiens
tcagggcagaatccaaagaatt

SEQ ID NO: 8526640 - DNA, 22 bp, Homo sapiens
tcagggcagaatccaaagaatt

SEQ ID NO: 8526641 - DNA, 16 bp, Homo sapiens
tcagggcagaatggca

SEQ ID NO: 8526642 - DNA, 22 bp, Homo sapiens
tcagggcagaatccaaagaatt

SEQ ID NO: 8526643 - DNA, 22 bp, Homo sapiens
tcagggcactgtcacctgatat

SEQ ID NO: 8526644 - DNA, 22 bp, Homo sapiens
tcagggcaccaaaaaagatgcc

SEQ ID NO: 8526645 - DNA, 22 bp, Homo sapiens
tcagggcacgtttctgcaatgc

SEQ ID NO: 8526646 - DNA, 22 bp, Homo sapiens
tcaggcgaggcttaatccaagg

SEQ ID NO: 8526647 - DNA, 22 bp, Homo sapiens
tcaggctacactcttttcatgg

SEQ ID NO: 8526648 - DNA, 22 bp, Homo sapiens
tcaggctaaccctaggcagaag

SEQ ID NO: 8526649 - DNA, 22 bp, Homo sapiens
tcaggcctttcttcagagcttc

SEQ ID NO: 8526650 - DNA, 22 bp, Homo sapiens
tcaggctgaaaggactccagtt

SEQ ID NO: 8526651 - DNA, 22 bp, Homo sapiens
tcaggctctgccacctagatta

SEQ ID NO: 8526652 - DNA, 22 bp, Homo sapiens
tcaggctctgagctgatgctaa

SEQ ID NO: 8526653 - DNA, 22 bp, Homo sapiens
tcaggctgaatcatcctagctt

SEQ ID NO: 8526654 - DNA, 22 bp, Homo sapiens
tcaggctgaatcatcctagctt

SEQ ID NO: 8526655 - DNA, 22 bp, Homo sapiens
tcaggctgaatcatcctagctt

SEQ ID NO: 8526656 - DNA, 22 bp, Homo sapiens
tcaggctgaatcatcctagctt

SEQ ID NO: 8526657 - DNA, 22 bp, Homo sapiens
tcaggctgaaggaggcctatct

SEQ ID NO: 8526658 - DNA, 22 bp, Homo sapiens
tcaggctgaaggaggcctatct

SEQ ID NO: 8526659 - DNA, 22 bp, Homo sapiens
tcaggctgaaaggactccagtt

SEQ ID NO: 8526660 - DNA, 22 bp, Homo sapiens
tcaggctgaaaggactccagtt

SEQ ID NO: 8526661 - DNA, 22 bp, Homo sapiens
tcaggctgaccaggttttgctc

SEQ ID NO: 8526662 - DNA, 22 bp, Homo sapiens
tcaggctgaccaggttttgctc

SEQ ID NO: 8526663 - DNA, 22 bp, Homo sapiens
tcaggctgagaaaatctggacc

SEQ ID NO: 8526664 - DNA, 22 bp, Homo sapiens
tcaggctgaggtcatctgcatc

SEQ ID NO: 8526665 - DNA, 22 bp, Homo sapiens
tcaggctgaggtcatctgcatc

SEQ ID NO: 8526666 - DNA, 22 bp, Homo sapiens
tcaggctgagaaaatctggacc

SEQ ID NO: 8526667 - DNA, 22 bp, Homo sapiens
tcagggcaaaagggaaaccatt

SEQ ID NO: 8526668 - DNA, 22 bp, Homo sapiens
tcagggcaaaagggaaaccatt

SEQ ID NO: 8526669 - DNA, 22 bp, Homo sapiens
tcagggcaaaagggaaaccatt

SEQ ID NO: 8526670 - DNA, 22 bp, Homo sapiens
tcagggcaaaagggaaaccatt

SEQ ID NO: 8526671 - DNA, 22 bp, Homo sapiens
tcagggagagcctgtctgacgt

SEQ ID NO: 8526672 - DNA, 22 bp, Homo sapiens
tcagggactgcagagggaagct

SEQ ID NO: 8526673 - DNA, 22 bp, Homo sapiens
tcagggactaggtgctgcctga

SEQ ID NO: 8526674 - DNA, 22 bp, Homo sapiens
tcagggacttacaaaccagaag

SEQ ID NO: 8526675 - DNA, 22 bp, Homo sapiens
tcagggacttacaaaccagaag

SEQ ID NO: 8526676 - DNA, 22 bp, Homo sapiens
tcagggcaaagggcagagtttg

SEQ ID NO: 8526677 - DNA, 22 bp, Homo sapiens
tcagggcaaagggcagagtttg

SEQ ID NO: 8526678 - DNA, 22 bp, Homo sapiens
tcagggcaagattggttaataa

SEQ ID NO: 8526679 - DNA, 22 bp, Homo sapiens
tcagggcaagattggttaataa

SEQ ID NO: 8526680 - DNA, 22 bp, Homo sapiens
tcagggcaaagggcagagtttg

SEQ ID NO: 8526681 - DNA, 22 bp, Homo sapiens
tcagggcaagtctcagaaggtt

SEQ ID NO: 8526682 - DNA, 22 bp, Homo sapiens
tcagggcaagtctcagaaggtt

SEQ ID NO: 8526683 - DNA, 22 bp, Homo sapiens
tcagggcaagtctcagaaggtt

SEQ ID NO: 8526684 - DNA, 22 bp, Homo sapiens
tcagggcacaggcctgtgggtt

SEQ ID NO: 8526685 - DNA, 22 bp, Homo sapiens
tcagggcacaggcctgtgggtt

SEQ ID NO: 8526686 - DNA, 22 bp, Homo sapiens
tcagggcaatgtccctcagaag

SEQ ID NO: 8526687 - DNA, 22 bp, Homo sapiens
tcagggcaatgtccctcagaag

SEQ ID NO: 8526688 - DNA, 22 bp, Homo sapiens
tcagggcaatgtccctcagaag

SEQ ID NO: 8526689 - DNA, 22 bp, Homo sapiens
tcagggcaccaaaaaagatgcc

SEQ ID NO: 8526690 - DNA, 22 bp, Homo sapiens
tcagggcaccaaaaaagatgcc

SEQ ID NO: 8526691 - DNA, 22 bp, Homo sapiens
tcagggcacattctgcagtggc

SEQ ID NO: 8526692 - DNA, 22 bp, Homo sapiens
tcagggcacattctgcagtggc

SEQ ID NO: 8526693 - DNA, 22 bp, Homo sapiens
tcagggcacattctgcagtggc

SEQ ID NO: 8526694 - DNA, 22 bp, Homo sapiens
tcagttacctgacagtggttat

SEQ ID NO: 8526695 - DNA, 22 bp, Homo sapiens
tcagtggtatgcgtgggagctg

SEQ ID NO: 8526696 - DNA, 22 bp, Homo sapiens
tcagttactctgatgtcctgtg

SEQ ID NO: 8526697 - DNA, 22 bp, Homo sapiens
tcagttagggcctcagaagaca

SEQ ID NO: 8526698 - DNA, 22 bp, Homo sapiens
tcagtggagctaagcatgagat

SEQ ID NO: 8526699 - DNA, 22 bp, Homo sapiens
tcagtggatatttctgtggctg

SEQ ID NO: 8526700 - DNA, 22 bp, Homo sapiens
tcagtgcttttgtcacatggtc

SEQ ID NO: 8526701 - DNA, 22 bp, Homo sapiens
tcagtgcttttgagaagctcct

SEQ ID NO: 8526702 - DNA, 22 bp, Homo sapiens
tcagtgcttttgagaagctcct

SEQ ID NO: 8526703 - DNA, 22 bp, Homo sapiens
tcagtgcttgcctctggaggag

SEQ ID NO: 8526704 - DNA, 22 bp, Homo sapiens
tcagtgcttgcctctggaggag

SEQ ID NO: 8526705 - DNA, 22 bp, Homo sapiens
tcagtgcttgacagctctggga

SEQ ID NO: 8526706 - DNA, 22 bp, Homo sapiens
tcagtgcttcggcgagcaccta

SEQ ID NO: 8526707 - DNA, 22 bp, Homo sapiens
tcagtgcttcctggaggaagcc

SEQ ID NO: 8526708 - DNA, 22 bp, Homo sapiens
tcagtgcttcggcgagcaccta

SEQ ID NO: 8526709 - DNA, 22 bp, Homo sapiens
tcagtgcttcggcgagcaccta

SEQ ID NO: 8526710 - DNA, 22 bp, Homo sapiens
tcagtgcttcctggaggaagcc

SEQ ID NO: 8526711 - DNA, 22 bp, Homo sapiens
tcataaaacacaccaggtagtt

SEQ ID NO: 8526712 - DNA, 22 bp, Homo sapiens
tcataaaaatagactctaaagt

SEQ ID NO: 8526713 - DNA, 22 bp, Homo sapiens
tcagttttctcatctgtgaaat

SEQ ID NO: 8526714 - DNA, 23 bp, Homo sapiens
tcagttttggctgttcagtgttg

SEQ ID NO: 8526715 - DNA, 22 bp, Homo sapiens
tcagttcctgttgcacagcatc

SEQ ID NO: 8526716 - DNA, 22 bp, Homo sapiens
tcagtttctaaatcttaccaat

SEQ ID NO: 8526717 - DNA, 22 bp, Homo sapiens
tcagtttcttcatctccctaac

SEQ ID NO: 8526718 - DNA, 22 bp, Homo sapiens
tcagtttctccatcgctccagt

SEQ ID NO: 8526719 - DNA, 23 bp, Homo sapiens
tcagtttgtataatccatatgca

SEQ ID NO: 8526720 - DNA, 22 bp, Homo sapiens
tcagtttgaatgttagcacagt

SEQ ID NO: 8526721 - DNA, 19 bp, Homo sapiens
tcagttttagtcatcagtt

SEQ ID NO: 8526722 - DNA, 22 bp, Homo sapiens
tcagttttcaatttcatcagag

SEQ ID NO: 8526723 - DNA, 22 bp, Homo sapiens
tcatccatcctcgcctttgctt

SEQ ID NO: 8526724 - DNA, 22 bp, Homo sapiens
tcatccatctttgatttcatag

SEQ ID NO: 8526725 - DNA, 22 bp, Homo sapiens
tcatccatgaagagtgacagaa

SEQ ID NO: 8526726 - DNA, 22 bp, Homo sapiens
tcatccatactattgagaggca

SEQ ID NO: 8526727 - DNA, 22 bp, Homo sapiens
tcatccatagtttggttggact

SEQ ID NO: 8526728 - DNA, 22 bp, Homo sapiens
tcatccatatagaaagatgatt

SEQ ID NO: 8526729 - DNA, 22 bp, Homo sapiens
tcatccatatagaaagatgatt

SEQ ID NO: 8526730 - DNA, 22 bp, Homo sapiens
tcatccagttcacatggtgagt

SEQ ID NO: 8526731 - DNA, 22 bp, Homo sapiens
tcatccagttgtggagagggaa

SEQ ID NO: 8526732 - DNA, 22 bp, Homo sapiens
tcatccatactattgagaggca

SEQ ID NO: 8526733 - DNA, 22 bp, Homo sapiens
tcatccgtgaagccaaagaaat

SEQ ID NO: 8526734 - DNA, 22 bp, Homo sapiens
tcatccctctgccaggcccagg

SEQ ID NO: 8526735 - DNA, 22 bp, Homo sapiens
tcatcctgaagaacctgcttcc

SEQ ID NO: 8526736 - DNA, 22 bp, Homo sapiens
tcatccctaaggacagctctgc

SEQ ID NO: 8526737 - DNA, 22 bp, Homo sapiens
tcatccattgtcctcacattag

SEQ ID NO: 8526738 - DNA, 16 bp, Homo sapiens
tcatccatgacagctc

SEQ ID NO: 8526739 - DNA, 21 bp, Homo sapiens
tcatccatggcttttgtgctt

SEQ ID NO: 8526740 - DNA, 22 bp, Homo sapiens
tcatccatgtcagagcatgtat

SEQ ID NO: 8526741 - DNA, 22 bp, Homo sapiens
tcatccatgtgcaaactttggt

SEQ ID NO: 8526742 - DNA, 22 bp, Homo sapiens
tcatccatgtcagagcatgtat

SEQ ID NO: 8526743 - DNA, 22 bp, Homo sapiens
tcatctctccccagtgtcttta

SEQ ID NO: 8526744 - DNA, 22 bp, Homo sapiens
tcatctctcaggataccagcag

SEQ ID NO: 8526745 - DNA, 22 bp, Homo sapiens
tcatctctagacaggaggctgg

SEQ ID NO: 8526746 - DNA, 22 bp, Homo sapiens
tcatctaagagtcttacattta

SEQ ID NO: 8526747 - DNA, 22 bp, Homo sapiens
tcatctaagagtcttacattta

SEQ ID NO: 8526748 - DNA, 22 bp, Homo sapiens
tcatctaagagtcttacattta

SEQ ID NO: 8526749 - DNA, 22 bp, Homo sapiens
tcatctaagagtcttacattta

SEQ ID NO: 8526750 - DNA, 22 bp, Homo sapiens
tcatcctgtatcctcagaccat

SEQ ID NO: 8526751 - DNA, 22 bp, Homo sapiens
tcatcctgtctcactttttgct

SEQ ID NO: 8526752 - DNA, 22 bp, Homo sapiens
tcatccttttgcatgggaaggc

SEQ ID NO: 8526753 - DNA, 22 bp, Homo sapiens
tcatcaaaagccttctgggtta

SEQ ID NO: 8526754 - DNA, 23 bp, Homo sapiens
tcatcaaacagctgctcaagaaa

SEQ ID NO: 8526755 - DNA, 22 bp, Homo sapiens
tcatcaaagcgcttggagtagg

SEQ ID NO: 8526756 - DNA, 22 bp, Homo sapiens
tcatcaaagcgcttggagtagg

SEQ ID NO: 8526757 - DNA, 22 bp, Homo sapiens
tcatattttgcaaggtcagcta

SEQ ID NO: 8526758 - DNA, 20 bp, Homo sapiens
tcatatttttgccctgggcc

SEQ ID NO: 8526759 - DNA, 22 bp, Homo sapiens
tcatcaaaggattgcatgattt

SEQ ID NO: 8526760 - DNA, 22 bp, Homo sapiens
tcatcaaaggattgcatgattt

SEQ ID NO: 8526761 - DNA, 23 bp, Homo sapiens
tcatcaaaggaagtacgtgtcac

SEQ ID NO: 8526762 - DNA, 22 bp, Homo sapiens
tcatcatgtttgatttccacag

SEQ ID NO: 8526763 - DNA, 20 bp, Homo sapiens
tcatccaggacaggagtggc

SEQ ID NO: 8526764 - DNA, 20 bp, Homo sapiens
tcatccaggacaggagtggc

SEQ ID NO: 8526765 - DNA, 20 bp, Homo sapiens
tcatccaggacaggagtggc

SEQ ID NO: 8526766 - DNA, 22 bp, Homo sapiens
tcatccagtaccatggaaggca

SEQ ID NO: 8526767 - DNA, 22 bp, Homo sapiens
tcatccagcctcatcaggagct

SEQ ID NO: 8526768 - DNA, 22 bp, Homo sapiens
tcatccagagcttcataagtaa

SEQ ID NO: 8526769 - DNA, 22 bp, Homo sapiens
tcataaaagtactcatgttcat

SEQ ID NO: 8526770 - DNA, 22 bp, Homo sapiens
tcataaaagtactcatgttcat

SEQ ID NO: 8526771 - DNA, 22 bp, Homo sapiens
tcataaaacacaccaggtagtt

SEQ ID NO: 8526772 - DNA, 20 bp, Homo sapiens
tcataaagaggaaataaata

SEQ ID NO: 8526773 - DNA, 20 bp, Homo sapiens
tcataaagaggaaataaata

SEQ ID NO: 8526774 - DNA, 22 bp, Homo sapiens
tcataaagctcttccaaatgta

SEQ ID NO: 8526775 - DNA, 22 bp, Homo sapiens
tcatatttgggggtgtgtgttt

SEQ ID NO: 8526776 - DNA, 22 bp, Homo sapiens
tcatatttgggggtgtgtgttt

SEQ ID NO: 8526777 - DNA, 22 bp, Homo sapiens
tcataaagcatttcagcttttg

SEQ ID NO: 8526778 - DNA, 22 bp, Homo sapiens
tcataaagcatttcagcttttg

SEQ ID NO: 8526779 - DNA, 22 bp, Homo sapiens
tcataaagatactaagtgagtt

SEQ ID NO: 8526780 - DNA, 22 bp, Homo sapiens
tcataaagagtgctgttgtttt

SEQ ID NO: 8526781 - DNA, 22 bp, Homo sapiens
tcaggaaagagtgtatccatca

SEQ ID NO: 8526782 - DNA, 22 bp, Homo sapiens
tcagctttctcaaagaagctgg

SEQ ID NO: 8526783 - DNA, 22 bp, Homo sapiens
tcaggaaagagtaatgtataca

SEQ ID NO: 8526784 - DNA, 22 bp, Homo sapiens
tcaggagatgtaaccttagctg

SEQ ID NO: 8526785 - DNA, 22 bp, Homo sapiens
tcaggagatgtaaccttagctg

SEQ ID NO: 8526786 - DNA, 22 bp, Homo sapiens
tcaggagatggtctttataggc

SEQ ID NO: 8526787 - DNA, 22 bp, Homo sapiens
tcaggagcagcatgggtgagag

SEQ ID NO: 8526788 - DNA, 22 bp, Homo sapiens
tcaggagggctaagactgtagc

SEQ ID NO: 8526789 - DNA, 22 bp, Homo sapiens
tcaggagggagtgtggatagag

SEQ ID NO: 8526790 - DNA, 22 bp, Homo sapiens
tcaggagcttggtagtgtgatt

SEQ ID NO: 8526791 - DNA, 22 bp, Homo sapiens
tcaggagcagggggaagctctg

SEQ ID NO: 8526792 - DNA, 22 bp, Homo sapiens
tcaggagcctgaaagaggtcta

SEQ ID NO: 8526793 - DNA, 20 bp, Homo sapiens
tcaggagcctaggacatgat

SEQ ID NO: 8526794 - DNA, 22 bp, Homo sapiens
tcaggagctatggactgtcaaa

SEQ ID NO: 8526795 - DNA, 22 bp, Homo sapiens
tcaggagctgtgaatacaaagg

SEQ ID NO: 8526796 - DNA, 22 bp, Homo sapiens
tcaggcagtagaattgcttgaa

SEQ ID NO: 8526797 - DNA, 22 bp, Homo sapiens
tcaggcaggttggctgcaggtc

SEQ ID NO: 8526798 - DNA, 22 bp, Homo sapiens
tcaggcagtagaattgcttgaa

SEQ ID NO: 8526799 - DNA, 22 bp, Homo sapiens
tcaggcaggtggctggctatgg

SEQ ID NO: 8526800 - DNA, 22 bp, Homo sapiens
tcaggcaggttggctgcaggtc

SEQ ID NO: 8526801 - DNA, 22 bp, Homo sapiens
tcaggcaggttggctgcaggtc

SEQ ID NO: 8526802 - DNA, 22 bp, Homo sapiens
tcaggcaggctcagaggaaaac

SEQ ID NO: 8526803 - DNA, 22 bp, Homo sapiens
tcaggcaggctcagaggaaaac

SEQ ID NO: 8526804 - DNA, 22 bp, Homo sapiens
tcaggcaggtggctggctatgg

SEQ ID NO: 8526805 - DNA, 21 bp, Homo sapiens
tcaggcaggtcccactgaaca

SEQ ID NO: 8526806 - DNA, 22 bp, Homo sapiens
tcaggcaggctcagaggaaaac

SEQ ID NO: 8526807 - DNA, 22 bp, Homo sapiens
tcaggcaggatcccagggaagg

SEQ ID NO: 8526808 - DNA, 22 bp, Homo sapiens
tcaggcaggcagagggcaaatg

SEQ ID NO: 8526809 - DNA, 22 bp, Homo sapiens
tcaggcaggcagagggcaaatg

SEQ ID NO: 8526810 - DNA, 21 bp, Homo sapiens
tcaggcaggcgcagagggaag

SEQ ID NO: 8526811 - DNA, 21 bp, Homo sapiens
tcaggcaggcgcagagggaag

SEQ ID NO: 8526812 - DNA, 21 bp, Homo sapiens
tcaggcaggcgcagagggaag

SEQ ID NO: 8526813 - DNA, 22 bp, Homo sapiens
tcaggcaggacaattatttagg

SEQ ID NO: 8526814 - DNA, 22 bp, Homo sapiens
tcaggcaggacaattatttagg

SEQ ID NO: 8526815 - DNA, 22 bp, Homo sapiens
tcaggcaggatcccagggaagg

SEQ ID NO: 8526816 - DNA, 22 bp, Homo sapiens
tcaggcaggaagggaggacttg

SEQ ID NO: 8526817 - DNA, 22 bp, Homo sapiens
tcaggcaggaagcccctgcaca

SEQ ID NO: 8526818 - DNA, 22 bp, Homo sapiens
tcaggcaggaagcccctgcaca

SEQ ID NO: 8526819 - DNA, 22 bp, Homo sapiens
tcaggcagctccaggaatggta

SEQ ID NO: 8526820 - DNA, 22 bp, Homo sapiens
tcaggcagctccaggaatggta

SEQ ID NO: 8526821 - DNA, 22 bp, Homo sapiens
tcaggcagcattaaacttcagc

SEQ ID NO: 8526822 - DNA, 22 bp, Homo sapiens
tcaggcagcattaaacttcagc

SEQ ID NO: 8526823 - DNA, 22 bp, Homo sapiens
tcaggcagatgcagggatggat

SEQ ID NO: 8526824 - DNA, 22 bp, Homo sapiens
tcaggcagcattaaacttcagc

SEQ ID NO: 8526825 - DNA, 22 bp, Homo sapiens
tcaggcagatgcagggatggat

SEQ ID NO: 8526826 - DNA, 22 bp, Homo sapiens
tcaggcagatgcagggatggat

SEQ ID NO: 8526827 - DNA, 22 bp, Homo sapiens
tcaggcagagttaatttgctcc

SEQ ID NO: 8526828 - DNA, 22 bp, Homo sapiens
tcaggcaccccttgagtagggg

SEQ ID NO: 8526829 - DNA, 22 bp, Homo sapiens
tcagccagtatttgagtgctca

SEQ ID NO: 8526830 - DNA, 22 bp, Homo sapiens
tcagccagtatttgagtgctca

SEQ ID NO: 8526831 - DNA, 22 bp, Homo sapiens
tcagccagtgccttgatcttgc

SEQ ID NO: 8526832 - DNA, 22 bp, Homo sapiens
tcagccagggctctggcctcag

SEQ ID NO: 8526833 - DNA, 22 bp, Homo sapiens
tcagccaggtaatgtggagatg

SEQ ID NO: 8526834 - DNA, 22 bp, Homo sapiens
tcagccaggtaatgtggagatg

SEQ ID NO: 8526835 - DNA, 22 bp, Homo sapiens
tcagccagggggagagaatgga

SEQ ID NO: 8526836 - DNA, 22 bp, Homo sapiens
tcagccaggccaggcattcaca

SEQ ID NO: 8526837 - DNA, 22 bp, Homo sapiens
tcagagtgcagggagtagcagc

SEQ ID NO: 8526838 - DNA, 22 bp, Homo sapiens
tcagccagggcagagcaggtga

SEQ ID NO: 8526839 - DNA, 22 bp, Homo sapiens
tcagccaggccctaagagattg

SEQ ID NO: 8526840 - DNA, 22 bp, Homo sapiens
tcagccagggcagagcaggtga

SEQ ID NO: 8526841 - DNA, 22 bp, Homo sapiens
tcagaggtggtaaaggacagca

SEQ ID NO: 8526842 - DNA, 22 bp, Homo sapiens
tcagaggttcttctcagtggcc

SEQ ID NO: 8526843 - DNA, 20 bp, Homo sapiens
tcagagtcatcaaagatggt

SEQ ID NO: 8526844 - DNA, 22 bp, Homo sapiens
tcagagtcattgcaagtagaag

SEQ ID NO: 8526845 - DNA, 21 bp, Homo sapiens
tcagagtctcaggagcaaggg

SEQ ID NO: 8526846 - DNA, 22 bp, Homo sapiens
tcagagtctcccccagtttggg

SEQ ID NO: 8526847 - DNA, 22 bp, Homo sapiens
tcagagggtggctgggagcatc

SEQ ID NO: 8526848 - DNA, 22 bp, Homo sapiens
tcagaggtaaaaactcactgta

SEQ ID NO: 8526849 - DNA, 22 bp, Homo sapiens
tcagaggtaagggctgagagga

SEQ ID NO: 8526850 - DNA, 18 bp, Homo sapiens
tcagaggtacagaaaagt

SEQ ID NO: 8526851 - DNA, 22 bp, Homo sapiens
tcagaggtcacacagcaagttt

SEQ ID NO: 8526852 - DNA, 22 bp, Homo sapiens
tcagaggtcacacagcaagttt

SEQ ID NO: 8526853 - DNA, 22 bp, Homo sapiens
tcagaggtggcaggggtgtcca

SEQ ID NO: 8526854 - DNA, 22 bp, Homo sapiens
tcagaggtggtaaaggacagca

SEQ ID NO: 8526855 - DNA, 22 bp, Homo sapiens
tcagaggtggtaaaggacagca

SEQ ID NO: 8526856 - DNA, 22 bp, Homo sapiens
tcagaggtgcaagaagttctga

SEQ ID NO: 8526857 - DNA, 22 bp, Homo sapiens
tcagaggtccctagcaggagtg

SEQ ID NO: 8526858 - DNA, 22 bp, Homo sapiens
tcagaggtccctagcaggagtg

SEQ ID NO: 8526859 - DNA, 21 bp, Homo sapiens
tcagagggccctggaggctca

SEQ ID NO: 8526860 - DNA, 17 bp, Homo sapiens
tcagagggatgagcagg

SEQ ID NO: 8526861 - DNA, 17 bp, Homo sapiens
tcagagggatgagcagg

SEQ ID NO: 8526862 - DNA, 22 bp, Homo sapiens
tcagaggcttgaagcccaagcc

SEQ ID NO: 8526863 - DNA, 22 bp, Homo sapiens
tcagaggctttcaatgtgtttt

SEQ ID NO: 8526864 - DNA, 22 bp, Homo sapiens
tcagaggcttctggccagtctg

SEQ ID NO: 8526865 - DNA, 22 bp, Homo sapiens
tcagaggcttgaagcccaagcc

SEQ ID NO: 8526866 - DNA, 22 bp, Homo sapiens
tcagaggcttctgctcacctca

SEQ ID NO: 8526867 - DNA, 22 bp, Homo sapiens
tcagaggcttctgctcacctca

SEQ ID NO: 8526868 - DNA, 22 bp, Homo sapiens
tcagaggcttccttcctcggag

SEQ ID NO: 8526869 - DNA, 20 bp, Homo sapiens
tcagaggctgccagctgggg

SEQ ID NO: 8526870 - DNA, 21 bp, Homo sapiens
tcagaggctgggggaatgccc

SEQ ID NO: 8526871 - DNA, 21 bp, Homo sapiens
tcagaggctgggggaatgccc

SEQ ID NO: 8526872 - DNA, 22 bp, Homo sapiens
tcagaggctggaagagcctcct

SEQ ID NO: 8526873 - DNA, 22 bp, Homo sapiens
tcagccagtttgtttattccgg

SEQ ID NO: 8526874 - DNA, 22 bp, Homo sapiens
tcagccagtttgattctatttg

SEQ ID NO: 8526875 - DNA, 22 bp, Homo sapiens
tcagccagttgccccagttagt

SEQ ID NO: 8526876 - DNA, 22 bp, Homo sapiens
tcagccagttaagtcaagaaat

SEQ ID NO: 8526877 - DNA, 22 bp, Homo sapiens
tcagccagtgtgcacctggagt

SEQ ID NO: 8526878 - DNA, 22 bp, Homo sapiens
tcagccagtgccttgatcttgc

SEQ ID NO: 8526879 - DNA, 22 bp, Homo sapiens
tcagccagttaaggcttagaca

SEQ ID NO: 8526880 - DNA, 22 bp, Homo sapiens
tcagccatgtcaggggaatgac

SEQ ID NO: 8526881 - DNA, 22 bp, Homo sapiens
tcagccatggtgagagtgagag

SEQ ID NO: 8526882 - DNA, 22 bp, Homo sapiens
tcagcccagaccacctcattgc

SEQ ID NO: 8526883 - DNA, 22 bp, Homo sapiens
tcagcccaccttcaggggagtt

SEQ ID NO: 8526884 - DNA, 22 bp, Homo sapiens
tcagcccacctggtgtggggct

SEQ ID NO: 8526885 - DNA, 22 bp, Homo sapiens
tcagcccacctggtgtggggct

SEQ ID NO: 8526886 - DNA, 23 bp, Homo sapiens
tcagcccacatctagtcattagc

SEQ ID NO: 8526887 - DNA, 22 bp, Homo sapiens
tcagcccaaccctgcacaagga

SEQ ID NO: 8526888 - DNA, 22 bp, Homo sapiens
tcagcccagcccagcaagtgca

SEQ ID NO: 8526889 - DNA, 18 bp, Homo sapiens
tcagcccagagcccagtt

SEQ ID NO: 8526890 - DNA, 22 bp, Homo sapiens
tcagcctcaggtgttcagattt

SEQ ID NO: 8526891 - DNA, 22 bp, Homo sapiens
tcagcctacactccaacagcat

SEQ ID NO: 8526892 - DNA, 22 bp, Homo sapiens
tcagcctcaggtgttcagattt

SEQ ID NO: 8526893 - DNA, 22 bp, Homo sapiens
tcagcctcattttctgctctgt

SEQ ID NO: 8526894 - DNA, 22 bp, Homo sapiens
tcagcctcattttctgctctgt

SEQ ID NO: 8526895 - DNA, 22 bp, Homo sapiens
tcagcctccgaaagtgctggga

SEQ ID NO: 8526896 - DNA, 22 bp, Homo sapiens
tcagcctctctgagtccagacc

SEQ ID NO: 8526897 - DNA, 22 bp, Homo sapiens
tcagcctctctgagtccagacc

SEQ ID NO: 8526898 - DNA, 22 bp, Homo sapiens
tcagcctcctaatttcctgtga

SEQ ID NO: 8526899 - DNA, 22 bp, Homo sapiens
tcagcctctctgagtccagacc

SEQ ID NO: 8526900 - DNA, 22 bp, Homo sapiens
tcagcttgggaaattgagcaag

SEQ ID NO: 8526901 - DNA, 22 bp, Homo sapiens
tcagcttggacagcttggttga

SEQ ID NO: 8526902 - DNA, 22 bp, Homo sapiens
tcagcttgtgggtcagcctctg

SEQ ID NO: 8526903 - DNA, 22 bp, Homo sapiens
tcagcttgtgggtcagcctctg

SEQ ID NO: 8526904 - DNA, 22 bp, Homo sapiens
tcagctttctatgttgctaaac

SEQ ID NO: 8526905 - DNA, 22 bp, Homo sapiens
tcagctttccttgctttagatt

SEQ ID NO: 8526906 - DNA, 22 bp, Homo sapiens
tcagctttccttgctttagatt

SEQ ID NO: 8526907 - DNA, 22 bp, Homo sapiens
tcagcttctccaagtgacatgg

SEQ ID NO: 8526908 - DNA, 22 bp, Homo sapiens
tcagcttccctatctgaccata

SEQ ID NO: 8526909 - DNA, 22 bp, Homo sapiens
tcagcttccctatctgaccata

SEQ ID NO: 8526910 - DNA, 22 bp, Homo sapiens
tcagcttcctctgtggttccag

SEQ ID NO: 8526911 - DNA, 22 bp, Homo sapiens
tcagcttctcaaaatggcttag

SEQ ID NO: 8526912 - DNA, 22 bp, Homo sapiens
tcagctgtgtatcccagggcct

SEQ ID NO: 8526913 - DNA, 22 bp, Homo sapiens
tcagcttcaaatttggtgaagt

SEQ ID NO: 8526914 - DNA, 18 bp, Homo sapiens
tcagcttccagcatgttt

SEQ ID NO: 8526915 - DNA, 23 bp, Homo sapiens
tcagcttcattgtcttctatggc

SEQ ID NO: 8526916 - DNA, 22 bp, Homo sapiens
tcagctgtaggtatggatgtcc

SEQ ID NO: 8526917 - DNA, 22 bp, Homo sapiens
tcagcctgcgtcatggtgacac

SEQ ID NO: 8526918 - DNA, 22 bp, Homo sapiens
tcagcctgcgtcatggtgacac

SEQ ID NO: 8526919 - DNA, 23 bp, Homo sapiens
tcagcctcttaggacttctcacc

SEQ ID NO: 8526920 - DNA, 23 bp, Homo sapiens
tcagcctcttaggacttctcacc

SEQ ID NO: 8526921 - DNA, 20 bp, Homo sapiens
tcagagagagggtgccactt

SEQ ID NO: 8526922 - DNA, 22 bp, Homo sapiens
tcagagagaaatagtttttgac

SEQ ID NO: 8526923 - DNA, 18 bp, Homo sapiens
tcagagagaatagtaatt

SEQ ID NO: 8526924 - DNA, 22 bp, Homo sapiens
tcagaggacagcagctaaataa

SEQ ID NO: 8526925 - DNA, 22 bp, Homo sapiens
tcagaggacagcagctaaataa

SEQ ID NO: 8526926 - DNA, 22 bp, Homo sapiens
tcagaggaccttactgagaacc

SEQ ID NO: 8526927 - DNA, 22 bp, Homo sapiens
tcagaggaccttactgagaacc

SEQ ID NO: 8526928 - DNA, 22 bp, Homo sapiens
tcagaggacaagctccctggtg

SEQ ID NO: 8526929 - DNA, 22 bp, Homo sapiens
tcagaggacagcagctaaataa

SEQ ID NO: 8526930 - DNA, 22 bp, Homo sapiens
tcagaggacaagctccctggtg

SEQ ID NO: 8526931 - DNA, 22 bp, Homo sapiens
tcagaggacaagctccctggtg

SEQ ID NO: 8526932 - DNA, 22 bp, Homo sapiens
tcagaggaatttgcttttcatg

SEQ ID NO: 8526933 - DNA, 22 bp, Homo sapiens
tcagaggacaagctccctggtg

SEQ ID NO: 8526934 - DNA, 22 bp, Homo sapiens
tcagaggaatttgcttttcatg

SEQ ID NO: 8526935 - DNA, 22 bp, Homo sapiens
tcagaggaataatgctgcattt

SEQ ID NO: 8526936 - DNA, 22 bp, Homo sapiens
tcagaggaataatgctgcattt

SEQ ID NO: 8526937 - DNA, 22 bp, Homo sapiens
tcagaggaatctgtacttgaaa

SEQ ID NO: 8526938 - DNA, 22 bp, Homo sapiens
tcagaggaagccttggtgggag

SEQ ID NO: 8526939 - DNA, 22 bp, Homo sapiens
tcagagaggattttaataagtg

SEQ ID NO: 8526940 - DNA, 23 bp, Homo sapiens
tcagagagctgttgagagctgcc

SEQ ID NO: 8526941 - DNA, 22 bp, Homo sapiens
tcagaggagaagttgggaaaat

SEQ ID NO: 8526942 - DNA, 22 bp, Homo sapiens
tcagaggagaccaaggggaata

SEQ ID NO: 8526943 - DNA, 22 bp, Homo sapiens
tcagaggagaccaaggggaata

SEQ ID NO: 8526944 - DNA, 22 bp, Homo sapiens
tcagaggagaagttgggaaaat

SEQ ID NO: 8526945 - DNA, 22 bp, Homo sapiens
tcagaggagaagttgggaaaat

SEQ ID NO: 8526946 - DNA, 22 bp, Homo sapiens
tcagaggactaccttctccagt

SEQ ID NO: 8526947 - DNA, 22 bp, Homo sapiens
tcagaggactaccttctccagt

SEQ ID NO: 8526948 - DNA, 22 bp, Homo sapiens
tcagaggactaccttctccagt

SEQ ID NO: 8526949 - DNA, 22 bp, Homo sapiens
tcagaggactaccttctccagt

SEQ ID NO: 8526950 - DNA, 22 bp, Homo sapiens
tcagaggaccttactgagaacc

SEQ ID NO: 8526951 - DNA, 22 bp, Homo sapiens
tcagaggacgcactagggttgt

SEQ ID NO: 8526952 - DNA, 19 bp, Homo sapiens
tcagaggatttggctatga

SEQ ID NO: 8526953 - DNA, 19 bp, Homo sapiens
tcagaggatttggctatga

SEQ ID NO: 8526954 - DNA, 19 bp, Homo sapiens
tcagaggatttggctatga

SEQ ID NO: 8526955 - DNA, 22 bp, Homo sapiens
tcagaggattgcctcagcgagc

SEQ ID NO: 8526956 - DNA, 22 bp, Homo sapiens
tcagaggattggacttttatgt

SEQ ID NO: 8526957 - DNA, 22 bp, Homo sapiens
tcagaggattggacttttatgt

SEQ ID NO: 8526958 - DNA, 22 bp, Homo sapiens
tcagaggagaccaaggggaata

SEQ ID NO: 8526959 - DNA, 18 bp, Homo sapiens
tcagaggagatacctaaa

SEQ ID NO: 8526960 - DNA, 22 bp, Homo sapiens
tcagaggattgcctcagcgagc

SEQ ID NO: 8526961 - DNA, 18 bp, Homo sapiens
tcagaggagatacctaaa

SEQ ID NO: 8526962 - DNA, 22 bp, Homo sapiens
tcagaggattgcctcagcgagc

SEQ ID NO: 8526963 - DNA, 22 bp, Homo sapiens
tcagaggccaaactgagcaggg

SEQ ID NO: 8526964 - DNA, 22 bp, Homo sapiens
tcagaggcatcattcatagtta

SEQ ID NO: 8526965 - DNA, 22 bp, Homo sapiens
tcagaggcatcattcatagtta

SEQ ID NO: 8526966 - DNA, 22 bp, Homo sapiens
tcagaggcagctgatgttctgt

SEQ ID NO: 8526967 - DNA, 21 bp, Homo sapiens
tcagaggcactgagagcaatg

SEQ ID NO: 8526968 - DNA, 22 bp, Homo sapiens
tcagaggcaaagaactttatta

SEQ ID NO: 8526969 - DNA, 22 bp, Homo sapiens
tcagaggcagctgatgttctgt

SEQ ID NO: 8526970 - DNA, 21 bp, Homo sapiens
tcagaggcactgagagcaatg

SEQ ID NO: 8526971 - DNA, 21 bp, Homo sapiens
tcagaggcactgagagcaatg

SEQ ID NO: 8526972 - DNA, 22 bp, Homo sapiens
tcagaggctcactgtctacttt

SEQ ID NO: 8526973 - DNA, 22 bp, Homo sapiens
tcagaggctacagtctgggagt

SEQ ID NO: 8526974 - DNA, 22 bp, Homo sapiens
tcagaggctcactgtctacttt

SEQ ID NO: 8526975 - DNA, 22 bp, Homo sapiens
tcagaggctcatctgccttgca

SEQ ID NO: 8526976 - DNA, 20 bp, Homo sapiens
tcagaggctgccagctgggg

SEQ ID NO: 8526977 - DNA, 22 bp, Homo sapiens
tcagaggctgcatttttatcca

SEQ ID NO: 8526978 - DNA, 22 bp, Homo sapiens
tcagaggccttggttatggtat

SEQ ID NO: 8526979 - DNA, 22 bp, Homo sapiens
tcagaggcctatgtctacaact

SEQ ID NO: 8526980 - DNA, 22 bp, Homo sapiens
tcagaggcctgaaagaatttgg

SEQ ID NO: 8526981 - DNA, 22 bp, Homo sapiens
tcagaagcaagcttctacttct

SEQ ID NO: 8526982 - DNA, 22 bp, Homo sapiens
tcagaagcagaaaataggtggg

SEQ ID NO: 8526983 - DNA, 22 bp, Homo sapiens
tcagaagcagaaaataggtggg

SEQ ID NO: 8526984 - DNA, 22 bp, Homo sapiens
tcagaagcaaacatcactctag

SEQ ID NO: 8526985 - DNA, 22 bp, Homo sapiens
tcagaagcaaacatcactctag

SEQ ID NO: 8526986 - DNA, 22 bp, Homo sapiens
tcagaagactactaggacacat

SEQ ID NO: 8526987 - DNA, 22 bp, Homo sapiens
tcagaagagtaatagggtgaga

SEQ ID NO: 8526988 - DNA, 22 bp, Homo sapiens
tcagaagagctggtgctgcctg

SEQ ID NO: 8526989 - DNA, 22 bp, Homo sapiens
tcagaactatagtagtttcatg

SEQ ID NO: 8526990 - DNA, 22 bp, Homo sapiens
tcagaagaaagatgttattact

SEQ ID NO: 8526991 - DNA, 22 bp, Homo sapiens
tcagaacatggcatgttccatc

SEQ ID NO: 8526992 - DNA, 22 bp, Homo sapiens
tcagaacatgtttgagtaagac

SEQ ID NO: 8526993 - DNA, 22 bp, Homo sapiens
tcagaacatgaaggttaatttg

SEQ ID NO: 8526994 - DNA, 22 bp, Homo sapiens
tcagaacattaaggatttgaag

SEQ ID NO: 8526995 - DNA, 22 bp, Homo sapiens
tcagaacattacattttgagct

SEQ ID NO: 8526996 - DNA, 22 bp, Homo sapiens
tcagaacatttaaaaagtggtt

SEQ ID NO: 8526997 - DNA, 22 bp, Homo sapiens
tcagaacatttgggactttggg

SEQ ID NO: 8526998 - DNA, 22 bp, Homo sapiens
tcagaacattgacattcttatt

SEQ ID NO: 8526999 - DNA, 22 bp, Homo sapiens
tcagaacattgacattcttatt

SEQ ID NO: 8527000 - DNA, 22 bp, Homo sapiens
tcagaacattgacattcttatt

SEQ ID NO: 8527001 - DNA, 22 bp, Homo sapiens
tcagaacattctcattgactgc

SEQ ID NO: 8527002 - DNA, 21 bp, Homo sapiens
tcagagaatggcctactctca

SEQ ID NO: 8527003 - DNA, 23 bp, Homo sapiens
tcagagaatggtatgcttttcct

SEQ ID NO: 8527004 - DNA, 22 bp, Homo sapiens
tcagagaatgtccttcttcatt

SEQ ID NO: 8527005 - DNA, 22 bp, Homo sapiens
tcagagaatctctccttagttt

SEQ ID NO: 8527006 - DNA, 22 bp, Homo sapiens
tcagagaatccgtaagtcacaa

SEQ ID NO: 8527007 - DNA, 22 bp, Homo sapiens
tcagagaattctcagatgactc

SEQ ID NO: 8527008 - DNA, 22 bp, Homo sapiens
tcagaagcatgtggggagcctg

SEQ ID NO: 8527009 - DNA, 22 bp, Homo sapiens
tcagaagcaggagtgtgcacaa

SEQ ID NO: 8527010 - DNA, 22 bp, Homo sapiens
tcagaagcagatatttcaaaat

SEQ ID NO: 8527011 - DNA, 22 bp, Homo sapiens
tcagaagcatccatttcaccac

SEQ ID NO: 8527012 - DNA, 22 bp, Homo sapiens
tcagaagcaggagtgtgcacaa

SEQ ID NO: 8527013 - DNA, 23 bp, Homo sapiens
tcagagaagttgtaggctgggga

SEQ ID NO: 8527014 - DNA, 23 bp, Homo sapiens
tcagagaagttgtaggctgggga

SEQ ID NO: 8527015 - DNA, 22 bp, Homo sapiens
tcagagaaggtaagtgacctgc

SEQ ID NO: 8527016 - DNA, 22 bp, Homo sapiens
tcagagaagtaaggtggggtgc

SEQ ID NO: 8527017 - DNA, 22 bp, Homo sapiens
tcagagaagtaaggtggggtgc

SEQ ID NO: 8527018 - DNA, 22 bp, Homo sapiens
tcagagaagtaaggtggggtgc

SEQ ID NO: 8527019 - DNA, 22 bp, Homo sapiens
tcacccctccattctctcatgt

SEQ ID NO: 8527020 - DNA, 22 bp, Homo sapiens
tcaccccttgtgaatgctgctc

SEQ ID NO: 8527021 - DNA, 22 bp, Homo sapiens
tcacccctaccaaggagcactg

SEQ ID NO: 8527022 - DNA, 22 bp, Homo sapiens
tcacccctacatttcccttgct

SEQ ID NO: 8527023 - DNA, 22 bp, Homo sapiens
tcaccccctgtattagtagcta

SEQ ID NO: 8527024 - DNA, 22 bp, Homo sapiens
tcacccaggtccaggctctggc

SEQ ID NO: 8527025 - DNA, 22 bp, Homo sapiens
tcacccttgataatgttcttct

SEQ ID NO: 8527026 - DNA, 22 bp, Homo sapiens
tcacccttagtgtactatcatg

SEQ ID NO: 8527027 - DNA, 22 bp, Homo sapiens
tcaccgaggctggagtgcagtg

SEQ ID NO: 8527028 - DNA, 22 bp, Homo sapiens
tcaccgaggctggagtgcagtg

SEQ ID NO: 8527029 - DNA, 22 bp, Homo sapiens
tcaccgccttgcccggccgggc

SEQ ID NO: 8527030 - DNA, 22 bp, Homo sapiens
tcaccgaggctggagtgcagtg

SEQ ID NO: 8527031 - DNA, 22 bp, Homo sapiens
tcaccgaggctggagtgcagtg

SEQ ID NO: 8527032 - DNA, 22 bp, Homo sapiens
tcaccgaggctggagtgcagtg

SEQ ID NO: 8527033 - DNA, 22 bp, Homo sapiens
tcacctgtattaatacagaact

SEQ ID NO: 8527034 - DNA, 22 bp, Homo sapiens
tcacctgggagggctgtggtag

SEQ ID NO: 8527035 - DNA, 22 bp, Homo sapiens
tcacctgttggatgtatactgt

SEQ ID NO: 8527036 - DNA, 22 bp, Homo sapiens
tcaccttgtgatccgcccacct

SEQ ID NO: 8527037 - DNA, 22 bp, Homo sapiens
tcacctcaccacccttatggtt

SEQ ID NO: 8527038 - DNA, 22 bp, Homo sapiens
tcacctctctggccgtctacct

SEQ ID NO: 8527039 - DNA, 22 bp, Homo sapiens
tcacctctctggccgtctacct

SEQ ID NO: 8527040 - DNA, 22 bp, Homo sapiens
tcaccttgtgatctccctgcct

SEQ ID NO: 8527041 - DNA, 22 bp, Homo sapiens
tcaccttgtgatctccctgcct

SEQ ID NO: 8527042 - DNA, 22 bp, Homo sapiens
tcaccttgtgatctccctgcct

SEQ ID NO: 8527043 - DNA, 22 bp, Homo sapiens
tcaccttgtgatctccctgcct

SEQ ID NO: 8527044 - DNA, 22 bp, Homo sapiens
tcacgtgagggacctgtgtctg

SEQ ID NO: 8527045 - DNA, 21 bp, Homo sapiens
tcacgtggtcacatgagcttt

SEQ ID NO: 8527046 - DNA, 22 bp, Homo sapiens
tcacatgagtcactatcttaat

SEQ ID NO: 8527047 - DNA, 18 bp, Homo sapiens
tcacatgattaccctggg

SEQ ID NO: 8527048 - DNA, 22 bp, Homo sapiens
tcacatgatgtttcctctgtgc

SEQ ID NO: 8527049 - DNA, 22 bp, Homo sapiens
tcacatgagtattattttccaa

SEQ ID NO: 8527050 - DNA, 22 bp, Homo sapiens
tcacatgcacatctctggaacc

SEQ ID NO: 8527051 - DNA, 22 bp, Homo sapiens
tcacatgcacatacttcctgtg

SEQ ID NO: 8527052 - DNA, 22 bp, Homo sapiens
tcacatgccctacctaatctta

SEQ ID NO: 8527053 - DNA, 21 bp, Homo sapiens
tcacatgcccattactggagc

SEQ ID NO: 8527054 - DNA, 22 bp, Homo sapiens
tcacatgccctacctaatctta

SEQ ID NO: 8527055 - DNA, 22 bp, Homo sapiens
tcacatgccacagatgaggcaa

SEQ ID NO: 8527056 - DNA, 20 bp, Homo sapiens
tcacatgcatattcgtttct

SEQ ID NO: 8527057 - DNA, 22 bp, Homo sapiens
tcacatgcagtcactgagcagg

SEQ ID NO: 8527058 - DNA, 22 bp, Homo sapiens
tcacccagggactgtgatggaa

SEQ ID NO: 8527059 - DNA, 22 bp, Homo sapiens
tcacatgccctgtatttaccag

SEQ ID NO: 8527060 - DNA, 22 bp, Homo sapiens
tcacccaggctggtgcgcagtg

SEQ ID NO: 8527061 - DNA, 22 bp, Homo sapiens
tcacatgccttttactctgcac

SEQ ID NO: 8527062 - DNA, 22 bp, Homo sapiens
tcacccaggtaatagcagtttg

SEQ ID NO: 8527063 - DNA, 22 bp, Homo sapiens
tcacccaggtaatagcagtttg

SEQ ID NO: 8527064 - DNA, 22 bp, Homo sapiens
tcacccagggtgtttggtgtct

SEQ ID NO: 8527065 - DNA, 22 bp, Homo sapiens
tcacatcttattagagtatctc

SEQ ID NO: 8527066 - DNA, 22 bp, Homo sapiens
tcacatcttattagagtatctc

SEQ ID NO: 8527067 - DNA, 20 bp, Homo sapiens
tcacatctggcagctgatga

SEQ ID NO: 8527068 - DNA, 22 bp, Homo sapiens
tcacatctgtgtgattgtcatt

SEQ ID NO: 8527069 - DNA, 23 bp, Homo sapiens
tcacatctgccgtagtgtattct

SEQ ID NO: 8527070 - DNA, 20 bp, Homo sapiens
tcacatctggcagctgatga

SEQ ID NO: 8527071 - DNA, 22 bp, Homo sapiens
tcacatcttgtgatgttttcat

SEQ ID NO: 8527072 - DNA, 22 bp, Homo sapiens
tcacatgaaatgctgtaaagaa

SEQ ID NO: 8527073 - DNA, 18 bp, Homo sapiens
tcacatgacagctgttgc

SEQ ID NO: 8527074 - DNA, 19 bp, Homo sapiens
tcacatgaagcctagagaa

SEQ ID NO: 8527075 - DNA, 22 bp, Homo sapiens
tcacatgaagatccctcaattt

SEQ ID NO: 8527076 - DNA, 22 bp, Homo sapiens
tcacatgaggttatgacaaagc

SEQ ID NO: 8527077 - DNA, 22 bp, Homo sapiens
tcacatgaggcatccccgggca

SEQ ID NO: 8527078 - DNA, 18 bp, Homo sapiens
tcacatgacagctgttgc

SEQ ID NO: 8527079 - DNA, 22 bp, Homo sapiens
tcacatgactttttggtggcct

SEQ ID NO: 8527080 - DNA, 20 bp, Homo sapiens
tcacatgagctggggcaggc

SEQ ID NO: 8527081 - DNA, 23 bp, Homo sapiens
tcagaacagttcttggtgcatag

SEQ ID NO: 8527082 - DNA, 22 bp, Homo sapiens
tcagaacagttcttaatattgc

SEQ ID NO: 8527083 - DNA, 22 bp, Homo sapiens
tcagaacagttcttaatattgc

SEQ ID NO: 8527084 - DNA, 22 bp, Homo sapiens
tcagaacagtgcctggcactaa

SEQ ID NO: 8527085 - DNA, 22 bp, Homo sapiens
tcagaacatatattttgtgatg

SEQ ID NO: 8527086 - DNA, 22 bp, Homo sapiens
tcactgtccctgtcctcttatc

SEQ ID NO: 8527087 - DNA, 22 bp, Homo sapiens
tcactgtctgaaagaaatggcc

SEQ ID NO: 8527088 - DNA, 22 bp, Homo sapiens
tcactgtatgtctttttttgat

SEQ ID NO: 8527089 - DNA, 22 bp, Homo sapiens
tcactgtagagtctgtttccac

SEQ ID NO: 8527090 - DNA, 22 bp, Homo sapiens
tcactggtgtgagaggagcaaa

SEQ ID NO: 8527091 - DNA, 22 bp, Homo sapiens
tcactggtgtgagaggagcaaa

SEQ ID NO: 8527092 - DNA, 18 bp, Homo sapiens
tcactgggtgtatgtggc

SEQ ID NO: 8527093 - DNA, 22 bp, Homo sapiens
tcactggggcctttggtcagga

SEQ ID NO: 8527094 - DNA, 22 bp, Homo sapiens
tcactggggcctttggtcagga

SEQ ID NO: 8527095 - DNA, 22 bp, Homo sapiens
tcactggggcctttggtcagga

SEQ ID NO: 8527096 - DNA, 22 bp, Homo sapiens
tcactaagtgccgagtttagtt

SEQ ID NO: 8527097 - DNA, 22 bp, Homo sapiens
tcacgttttactgagtgagata

SEQ ID NO: 8527098 - DNA, 22 bp, Homo sapiens
tcactaagttacatttagtatt

SEQ ID NO: 8527099 - DNA, 22 bp, Homo sapiens
tcactaatgagctaaggaaaag

SEQ ID NO: 8527100 - DNA, 22 bp, Homo sapiens
tcactgctttcaaaaattattg

SEQ ID NO: 8527101 - DNA, 22 bp, Homo sapiens
tcactgcttcttggagaatgtc

SEQ ID NO: 8527102 - DNA, 22 bp, Homo sapiens
tcactgcttcttggagaatgtc

SEQ ID NO: 8527103 - DNA, 22 bp, Homo sapiens
tcactggaaatgcacagctgta

SEQ ID NO: 8527104 - DNA, 22 bp, Homo sapiens
tcactggaaatgcacagctgta

SEQ ID NO: 8527105 - DNA, 22 bp, Homo sapiens
tcactgctttgagccactgagc

SEQ ID NO: 8527106 - DNA, 22 bp, Homo sapiens
tcactgctttgtttacaactat

SEQ ID NO: 8527107 - DNA, 22 bp, Homo sapiens
tcactgggagatgtgggaaggg

SEQ ID NO: 8527108 - DNA, 22 bp, Homo sapiens
tcactggcaacttgtgctccct

SEQ ID NO: 8527109 - DNA, 22 bp, Homo sapiens
tcactggatcctagctgagcct

SEQ ID NO: 8527110 - DNA, 22 bp, Homo sapiens
tcactggggccatgtgagggac

SEQ ID NO: 8527111 - DNA, 22 bp, Homo sapiens
tcactggggccatgtgagggac

SEQ ID NO: 8527112 - DNA, 22 bp, Homo sapiens
tcactggggccatgtgagggac

SEQ ID NO: 8527113 - DNA, 22 bp, Homo sapiens
tcactggggagcactgacatgt

SEQ ID NO: 8527114 - DNA, 17 bp, Homo sapiens
tcactgggcctgctccc

SEQ ID NO: 8527115 - DNA, 17 bp, Homo sapiens
tcactgggcctgctccc

SEQ ID NO: 8527116 - DNA, 22 bp, Homo sapiens
tcactgggcatcggagctgaaa

SEQ ID NO: 8527117 - DNA, 22 bp, Homo sapiens
tcactgggccctgaggtgggac

SEQ ID NO: 8527118 - DNA, 22 bp, Homo sapiens
tcactgggagatgtgggaaggg

SEQ ID NO: 8527119 - DNA, 22 bp, Homo sapiens
tcacagcattgagtgtactaga

SEQ ID NO: 8527120 - DNA, 22 bp, Homo sapiens
tcacagcattgtcacaaggctg

SEQ ID NO: 8527121 - DNA, 22 bp, Homo sapiens
tcacagcattgtcacaaggctg

SEQ ID NO: 8527122 - DNA, 22 bp, Homo sapiens
tcacagcattgagtgtactaga

SEQ ID NO: 8527123 - DNA, 22 bp, Homo sapiens
tcacagcattcgcaatggacag

SEQ ID NO: 8527124 - DNA, 22 bp, Homo sapiens
tcacagcattcgcaatggacag

SEQ ID NO: 8527125 - DNA, 22 bp, Homo sapiens
tcacagcagggtaacaggaaga

SEQ ID NO: 8527126 - DNA, 22 bp, Homo sapiens
tcacagcagggtaacaggaaga

SEQ ID NO: 8527127 - DNA, 19 bp, Homo sapiens
tcacagcatctgtctgaac

SEQ ID NO: 8527128 - DNA, 22 bp, Homo sapiens
tcacagcagtaaagaaaacact

SEQ ID NO: 8527129 - DNA, 22 bp, Homo sapiens
tcacagcaccctgaggtgctgg

SEQ ID NO: 8527130 - DNA, 22 bp, Homo sapiens
tcacagcaccctgaggtgctgg

SEQ ID NO: 8527131 - DNA, 22 bp, Homo sapiens
tcacagcaccctgaggtgctgg

SEQ ID NO: 8527132 - DNA, 22 bp, Homo sapiens
tcacagcaccctgaggtgctgg

SEQ ID NO: 8527133 - DNA, 22 bp, Homo sapiens
tcacagcagaatttaggaggca

SEQ ID NO: 8527134 - DNA, 22 bp, Homo sapiens
tcacagcagaatttaggaggca

SEQ ID NO: 8527135 - DNA, 22 bp, Homo sapiens
tcacagcagaatttaggaggca

SEQ ID NO: 8527136 - DNA, 22 bp, Homo sapiens
tcacagcaacactggggcagac

SEQ ID NO: 8527137 - DNA, 22 bp, Homo sapiens
tcacagcaacactggggcagac

SEQ ID NO: 8527138 - DNA, 22 bp, Homo sapiens
tcacagcaacactggggcagac

SEQ ID NO: 8527139 - DNA, 22 bp, Homo sapiens
tcacagcaaccctgaggcgagt

SEQ ID NO: 8527140 - DNA, 22 bp, Homo sapiens
tcacagcaaccctgaggcgagt

SEQ ID NO: 8527141 - DNA, 22 bp, Homo sapiens
tcacagcaaccctgaggcgagt

SEQ ID NO: 8527142 - DNA, 22 bp, Homo sapiens
tcacagcacatggaccgagtcc

SEQ ID NO: 8527143 - DNA, 22 bp, Homo sapiens
tcacagcaccaggatctctcca

SEQ ID NO: 8527144 - DNA, 22 bp, Homo sapiens
tcacatcacatgacagtaggcc

SEQ ID NO: 8527145 - DNA, 22 bp, Homo sapiens
tcacatcaacattatagcatga

SEQ ID NO: 8527146 - DNA, 17 bp, Homo sapiens
tcacatcacacaagcaa

SEQ ID NO: 8527147 - DNA, 22 bp, Homo sapiens
tcacatcaacattatagcatga

SEQ ID NO: 8527148 - DNA, 22 bp, Homo sapiens
tcacagcatttttagaaagatt

SEQ ID NO: 8527149 - DNA, 22 bp, Homo sapiens
tcacagcatttttagaaagatt

SEQ ID NO: 8527150 - DNA, 22 bp, Homo sapiens
tcacagcctggtcactctgccc

SEQ ID NO: 8527151 - DNA, 22 bp, Homo sapiens
tcacagctattctcatgtattt

SEQ ID NO: 8527152 - DNA, 16 bp, Homo sapiens
tcacatacttccttgc

SEQ ID NO: 8527153 - DNA, 22 bp, Homo sapiens
tcacatctgaaaaaatattgag

SEQ ID NO: 8527154 - DNA, 22 bp, Homo sapiens
tcacatctccctggaggacaca

SEQ ID NO: 8527155 - DNA, 22 bp, Homo sapiens
tcacatctccatgtgttgttca

SEQ ID NO: 8527156 - DNA, 22 bp, Homo sapiens
tcacatctctcattgcctctgc

SEQ ID NO: 8527157 - DNA, 22 bp, Homo sapiens
tcacatctatacccaataattt

SEQ ID NO: 8527158 - DNA, 21 bp, Homo sapiens
tcacatctatgttaagcaaac

SEQ ID NO: 8527159 - DNA, 22 bp, Homo sapiens
tcacatctaattccatttctgc

SEQ ID NO: 8527160 - DNA, 22 bp, Homo sapiens
tcacatctaattccatttctgc

SEQ ID NO: 8527161 - DNA, 20 bp, Homo sapiens
tcacatcctctcccaacatg

SEQ ID NO: 8527162 - DNA, 20 bp, Homo sapiens
tcacatcctctcccaacatg

SEQ ID NO: 8527163 - DNA, 20 bp, Homo sapiens
tcacatcctctcccaacatg

SEQ ID NO: 8527164 - DNA, 20 bp, Homo sapiens
tcacatcctctcccaacatg

SEQ ID NO: 8527165 - DNA, 22 bp, Homo sapiens
tcacatcattaagacttctcct

SEQ ID NO: 8527166 - DNA, 19 bp, Homo sapiens
tcacagacagagcaatcac

SEQ ID NO: 8527167 - DNA, 22 bp, Homo sapiens
tcacagacaccttggccacagt

SEQ ID NO: 8527168 - DNA, 22 bp, Homo sapiens
tcacagacactgggttattgca

SEQ ID NO: 8527169 - DNA, 23 bp, Homo sapiens
tcacagagcatactgcattttgc

SEQ ID NO: 8527170 - DNA, 21 bp, Homo sapiens
tcacagagccacagaattggt

SEQ ID NO: 8527171 - DNA, 22 bp, Homo sapiens
tcacagagcacgtatcatgcct

SEQ ID NO: 8527172 - DNA, 22 bp, Homo sapiens
tcacagagttaaaagtttcttt

SEQ ID NO: 8527173 - DNA, 22 bp, Homo sapiens
tcacagcaaaagtgtgcagagc

SEQ ID NO: 8527174 - DNA, 22 bp, Homo sapiens
tcacagcaaatgctgcttctca

SEQ ID NO: 8527175 - DNA, 22 bp, Homo sapiens
tcacagcaaatgctgcttctca

SEQ ID NO: 8527176 - DNA, 22 bp, Homo sapiens
tcacagcaaaagtgtgcagagc

SEQ ID NO: 8527177 - DNA, 22 bp, Homo sapiens
tcacagcaaaagtgtgcagagc

SEQ ID NO: 8527178 - DNA, 22 bp, Homo sapiens
tcacagcaaaagtgtgcagagc

SEQ ID NO: 8527179 - DNA, 22 bp, Homo sapiens
tcacagcaaaagtgtgcagagc

SEQ ID NO: 8527180 - DNA, 22 bp, Homo sapiens
tcacagagttaaaagtttcttt

SEQ ID NO: 8527181 - DNA, 20 bp, Homo sapiens
tcacagatgaaagttcaaga

SEQ ID NO: 8527182 - DNA, 22 bp, Homo sapiens
tcacacatctcaggtgtttaat

SEQ ID NO: 8527183 - DNA, 22 bp, Homo sapiens
tcacacatactcatgtgtgagt

SEQ ID NO: 8527184 - DNA, 22 bp, Homo sapiens
tcacacatactcatgtgtgagt

SEQ ID NO: 8527185 - DNA, 22 bp, Homo sapiens
tcacacatgagtaaatacaggg

SEQ ID NO: 8527186 - DNA, 22 bp, Homo sapiens
tcacacatctcaggtgtttaat

SEQ ID NO: 8527187 - DNA, 22 bp, Homo sapiens
tcacacatgagtaaatacaggg

SEQ ID NO: 8527188 - DNA, 22 bp, Homo sapiens
tcacacagtggtaaaaccctga

SEQ ID NO: 8527189 - DNA, 22 bp, Homo sapiens
tcacacagtgagaaagtgcgga

SEQ ID NO: 8527190 - DNA, 22 bp, Homo sapiens
tcacacaggtttgcaatgattt

SEQ ID NO: 8527191 - DNA, 22 bp, Homo sapiens
tcacacaggtttgcaatgattt

SEQ ID NO: 8527192 - DNA, 22 bp, Homo sapiens
tcacacagggttctggtctcat

SEQ ID NO: 8527193 - DNA, 22 bp, Homo sapiens
tcacacagggttctggtctcat

SEQ ID NO: 8527194 - DNA, 22 bp, Homo sapiens
tcacagaatgtcagagttgggg

SEQ ID NO: 8527195 - DNA, 22 bp, Homo sapiens
tcacagaatctctgataagtct

SEQ ID NO: 8527196 - DNA, 22 bp, Homo sapiens
tcacagaatctctgataagtct

SEQ ID NO: 8527197 - DNA, 22 bp, Homo sapiens
tcacagaatctctgataagtct

SEQ ID NO: 8527198 - DNA, 22 bp, Homo sapiens
tcacagaatagcactgtaagcg

SEQ ID NO: 8527199 - DNA, 22 bp, Homo sapiens
tcacagaatagcactgtaagcg

SEQ ID NO: 8527200 - DNA, 22 bp, Homo sapiens
tcacagaatagcactgtaagcg

SEQ ID NO: 8527201 - DNA, 22 bp, Homo sapiens
tcacagaatagcactgtaagcg

SEQ ID NO: 8527202 - DNA, 18 bp, Homo sapiens
tcacagaatattgagtgg

SEQ ID NO: 8527203 - DNA, 18 bp, Homo sapiens
tcacagaatattgagtgg

SEQ ID NO: 8527204 - DNA, 22 bp, Homo sapiens
tcacagaatttttgcttccagt

SEQ ID NO: 8527205 - DNA, 22 bp, Homo sapiens
tcacagaatttttgcttccagt

SEQ ID NO: 8527206 - DNA, 22 bp, Homo sapiens
tcacagacaattgttttggtgt

SEQ ID NO: 8527207 - DNA, 22 bp, Homo sapiens
tcacagaatgtctagcataatt

SEQ ID NO: 8527208 - DNA, 22 bp, Homo sapiens
tcacagaatgtctagcataatt

SEQ ID NO: 8527209 - DNA, 22 bp, Homo sapiens
tcacagaatgtcagagttgggg

SEQ ID NO: 8527210 - DNA, 22 bp, Homo sapiens
tcacagaatgtcagagttgggg

SEQ ID NO: 8527211 - DNA, 22 bp, Homo sapiens
tcaaaattagtgaccaaaggca

SEQ ID NO: 8527212 - DNA, 22 bp, Homo sapiens
tcaaaattaaaccaacgtccag

SEQ ID NO: 8527213 - DNA, 22 bp, Homo sapiens
tcaaaatcaaagatacttgaaa

SEQ ID NO: 8527214 - DNA, 18 bp, Homo sapiens
tcaaaatatttctgtgga

SEQ ID NO: 8527215 - DNA, 18 bp, Homo sapiens
tcaaaatatttctgtgga

SEQ ID NO: 8527216 - DNA, 18 bp, Homo sapiens
tcaaaatatttctgtgga

SEQ ID NO: 8527217 - DNA, 22 bp, Homo sapiens
tcaaaatttcagcactagccct

SEQ ID NO: 8527218 - DNA, 22 bp, Homo sapiens
tcaaaatttcagcactagccct

SEQ ID NO: 8527219 - DNA, 22 bp, Homo sapiens
tcaaaattttatttctcaagga

SEQ ID NO: 8527220 - DNA, 22 bp, Homo sapiens
tcaaaattctagggagaatggt

SEQ ID NO: 8527221 - DNA, 20 bp, Homo sapiens
tcaaaataggtgtgggcgga

SEQ ID NO: 8527222 - DNA, 20 bp, Homo sapiens
tcaaaataggtgtgggcgga

SEQ ID NO: 8527223 - DNA, 22 bp, Homo sapiens
tcaaaagtttcacatagagata

SEQ ID NO: 8527224 - DNA, 22 bp, Homo sapiens
tcaaaagtttcacatagagata

SEQ ID NO: 8527225 - DNA, 22 bp, Homo sapiens
tcaaaagtggcctgtaaaatct

SEQ ID NO: 8527226 - DNA, 22 bp, Homo sapiens
tcaaaagtttcacatagagata

SEQ ID NO: 8527227 - DNA, 22 bp, Homo sapiens
tcaaaagtctgcattcttcaca

SEQ ID NO: 8527228 - DNA, 22 bp, Homo sapiens
tcaaaaatggtctttgagctgc

SEQ ID NO: 8527229 - DNA, 22 bp, Homo sapiens
tcaaaaatggtctttgagctgc

SEQ ID NO: 8527230 - DNA, 22 bp, Homo sapiens
tcaaaaatggtctttgagctgc

SEQ ID NO: 8527231 - DNA, 22 bp, Homo sapiens
tcaaaagaaacaccatgttcct

SEQ ID NO: 8527232 - DNA, 22 bp, Homo sapiens
tcaaaccaccttgttactgggg

SEQ ID NO: 8527233 - DNA, 22 bp, Homo sapiens
tcaaactagcctgactggtatt

SEQ ID NO: 8527234 - DNA, 22 bp, Homo sapiens
tcaatacatacaatgtatagtg

SEQ ID NO: 8527235 - DNA, 22 bp, Homo sapiens
tcaatacatacaatgtatagtg

SEQ ID NO: 8527236 - DNA, 22 bp, Homo sapiens
tcaatacatacaatgtatagtg

SEQ ID NO: 8527237 - DNA, 22 bp, Homo sapiens
tcaatacttaagcttaattcta

SEQ ID NO: 8527238 - DNA, 22 bp, Homo sapiens
tcaatacatgtgtgtggatggt

SEQ ID NO: 8527239 - DNA, 22 bp, Homo sapiens
tcaatgcataggaggtggcaga

SEQ ID NO: 8527240 - DNA, 19 bp, Homo sapiens
tcaatgcatgaaatcagcc

SEQ ID NO: 8527241 - DNA, 22 bp, Homo sapiens
tcaatgcacacaggacttggtg

SEQ ID NO: 8527242 - DNA, 22 bp, Homo sapiens
tcaatgcaacttccacctccca

SEQ ID NO: 8527243 - DNA, 22 bp, Homo sapiens
tcaatgatagtacaatcagcct

SEQ ID NO: 8527244 - DNA, 22 bp, Homo sapiens
tcaatgcaacctccacctcccg

SEQ ID NO: 8527245 - DNA, 22 bp, Homo sapiens
tcaaacataggcacacattcag

SEQ ID NO: 8527246 - DNA, 22 bp, Homo sapiens
tcaaacatatctgattttccat

SEQ ID NO: 8527247 - DNA, 23 bp, Homo sapiens
tcaaacaggtttcagagcatctt

SEQ ID NO: 8527248 - DNA, 23 bp, Homo sapiens
tcaaacaggtttcagagcatctt

SEQ ID NO: 8527249 - DNA, 22 bp, Homo sapiens
tcaaacaggactacattctcat

SEQ ID NO: 8527250 - DNA, 22 bp, Homo sapiens
tcaaacagaggaacaattgttt

SEQ ID NO: 8527251 - DNA, 22 bp, Homo sapiens
tcaaacagaggaacaattgttt

SEQ ID NO: 8527252 - DNA, 22 bp, Homo sapiens
tcaaacagaggaacaattgttt

SEQ ID NO: 8527253 - DNA, 23 bp, Homo sapiens
tcaaacatattgtgagacacagg

SEQ ID NO: 8527254 - DNA, 22 bp, Homo sapiens
tcaaacatgttagcagtctgtg

SEQ ID NO: 8527255 - DNA, 22 bp, Homo sapiens
tcaaacatgaaagcttgatttt

SEQ ID NO: 8527256 - DNA, 22 bp, Homo sapiens
tcacacagctcctttccttagt

SEQ ID NO: 8527257 - DNA, 22 bp, Homo sapiens
tcacacagattggtagagctga

SEQ ID NO: 8527258 - DNA, 22 bp, Homo sapiens
tcacacagattggtagagctga

SEQ ID NO: 8527259 - DNA, 22 bp, Homo sapiens
tcacacagctcctttccttagt

SEQ ID NO: 8527260 - DNA, 22 bp, Homo sapiens
tcacacagctgacagagccttt

SEQ ID NO: 8527261 - DNA, 22 bp, Homo sapiens
tcacacagcttggagttatggt

SEQ ID NO: 8527262 - DNA, 23 bp, Homo sapiens
tcacacagctggtcaggtacaga

SEQ ID NO: 8527263 - DNA, 23 bp, Homo sapiens
tcacacagctggtcaggtacaga

SEQ ID NO: 8527264 - DNA, 22 bp, Homo sapiens
tcacacagggtcggaaagagtg

SEQ ID NO: 8527265 - DNA, 22 bp, Homo sapiens
tcacacagggtcggaaagagtg

SEQ ID NO: 8527266 - DNA, 22 bp, Homo sapiens
tcacacagcttggagttatggt

SEQ ID NO: 8527267 - DNA, 22 bp, Homo sapiens
tcacacagggtcggaaagagtg

SEQ ID NO: 8527268 - DNA, 22 bp, Homo sapiens
tcacaattgagatcctcccacc

SEQ ID NO: 8527269 - DNA, 23 bp, Homo sapiens
tcaattgatgatgttctcttttg

SEQ ID NO: 8527270 - DNA, 22 bp, Homo sapiens
tcacacacataatctaagatta

SEQ ID NO: 8527271 - DNA, 22 bp, Homo sapiens
tcacacacataatctaagatta

SEQ ID NO: 8527272 - DNA, 22 bp, Homo sapiens
tcacacacataatctaagatta

SEQ ID NO: 8527273 - DNA, 22 bp, Homo sapiens
tcacacacatggatagtatttt

SEQ ID NO: 8527274 - DNA, 22 bp, Homo sapiens
tcacacacatggatagtatttt

SEQ ID NO: 8527275 - DNA, 22 bp, Homo sapiens
tcacacacatggatagtatttt

SEQ ID NO: 8527276 - DNA, 22 bp, Homo sapiens
tcacacacataatctaagatta

SEQ ID NO: 8527277 - DNA, 22 bp, Homo sapiens
tcacacacatttgctgtctgat

SEQ ID NO: 8527278 - DNA, 22 bp, Homo sapiens
tcacacacatttgctgtctgat

SEQ ID NO: 8527279 - DNA, 22 bp, Homo sapiens
tcacacacatggatagtatttt

SEQ ID NO: 8527280 - DNA, 21 bp, Homo sapiens
tcacacacgtttccaagggca

SEQ ID NO: 8527281 - DNA, 22 bp, Homo sapiens
tcacacacatttgctgtctgat

SEQ ID NO: 8527282 - DNA, 21 bp, Homo sapiens
tcacacacgtttccaagggca

SEQ ID NO: 8527283 - DNA, 21 bp, Homo sapiens
tcacacacgtttccaagggca

SEQ ID NO: 8527284 - DNA, 22 bp, Homo sapiens
tcaattatgccattgcaatatt

SEQ ID NO: 8527285 - DNA, 22 bp, Homo sapiens
tcaattactaaccaaataatgt

SEQ ID NO: 8527286 - DNA, 22 bp, Homo sapiens
tcaattacagcaatgactgtac

SEQ ID NO: 8527287 - DNA, 22 bp, Homo sapiens
tcaattaagaggctaagttact

SEQ ID NO: 8527288 - DNA, 22 bp, Homo sapiens
tcaatgtccgggccccattcca

SEQ ID NO: 8527289 - DNA, 22 bp, Homo sapiens
tcaatgtctgtctatctattta

SEQ ID NO: 8527290 - DNA, 22 bp, Homo sapiens
tcaattctagagccttacattg

SEQ ID NO: 8527291 - DNA, 22 bp, Homo sapiens
tcaattctggtcctcaggaact

SEQ ID NO: 8527292 - DNA, 22 bp, Homo sapiens
tcaattctggtcctcaggaact

SEQ ID NO: 8527293 - DNA, 22 bp, Homo sapiens
tcaattcaacacatgcacattg

SEQ ID NO: 8527294 - DNA, 22 bp, Homo sapiens
ttcgactctgtgcctgaagagc

SEQ ID NO: 8527295 - DNA, 20 bp, Homo sapiens
ttcgctgggagtggccaggc

SEQ ID NO: 8527296 - DNA, 20 bp, Homo sapiens
ttcgctgggagtggccaggc

SEQ ID NO: 8527297 - DNA, 20 bp, Homo sapiens
ttcgctgggagtggccaggc

SEQ ID NO: 8527298 - DNA, 22 bp, Homo sapiens
ttcctttagtgtcatatacttt

SEQ ID NO: 8527299 - DNA, 22 bp, Homo sapiens
ttccttgtttgtagctctggga

SEQ ID NO: 8527300 - DNA, 22 bp, Homo sapiens
ttccctcttttccaacagttgt

SEQ ID NO: 8527301 - DNA, 22 bp, Homo sapiens
ttccctgaagacctcatgtgac

SEQ ID NO: 8527302 - DNA, 22 bp, Homo sapiens
ttccctgaagacctcatgtgac

SEQ ID NO: 8527303 - DNA, 22 bp, Homo sapiens
ttccctgagtctccctgagtct

SEQ ID NO: 8527304 - DNA, 22 bp, Homo sapiens
ttccctcccccagcctggcagg

SEQ ID NO: 8527305 - DNA, 22 bp, Homo sapiens
ttccctaatgtctaacgctatt

SEQ ID NO: 8527306 - DNA, 22 bp, Homo sapiens
ttccctaagcattgcaatggcg

SEQ ID NO: 8527307 - DNA, 22 bp, Homo sapiens
ttcccgtctttgctatgcctgc

SEQ ID NO: 8527308 - DNA, 22 bp, Homo sapiens
ttccctccgaacctcagtgctg

SEQ ID NO: 8527309 - DNA, 22 bp, Homo sapiens
ttccctctctagctttccccaa

SEQ ID NO: 8527310 - DNA, 22 bp, Homo sapiens
ttccctctcctactcaggaaag

SEQ ID NO: 8527311 - DNA, 22 bp, Homo sapiens
ttccctctctccagggctgcct

SEQ ID NO: 8527312 - DNA, 22 bp, Homo sapiens
ttccctctccaggagccctgag

SEQ ID NO: 8527313 - DNA, 22 bp, Homo sapiens
ttctaaacggcttcacaggaat

SEQ ID NO: 8527314 - DNA, 22 bp, Homo sapiens
ttctaaacttcaattctaaatt

SEQ ID NO: 8527315 - DNA, 22 bp, Homo sapiens
ttctaaaataagtttatctggt

SEQ ID NO: 8527316 - DNA, 22 bp, Homo sapiens
ttctaaaataagtttatctggt

SEQ ID NO: 8527317 - DNA, 22 bp, Homo sapiens
ttcggagtattgacatgtgaag

SEQ ID NO: 8527318 - DNA, 22 bp, Homo sapiens
ttcgtgtggagatgtttctgca

SEQ ID NO: 8527319 - DNA, 22 bp, Homo sapiens
ttcgtgtggagatgtttctgca

SEQ ID NO: 8527320 - DNA, 22 bp, Homo sapiens
ttcggtctggctgttatacgct

SEQ ID NO: 8527321 - DNA, 22 bp, Homo sapiens
ttcggtcttgtgtaaacactgt

SEQ ID NO: 8527322 - DNA, 22 bp, Homo sapiens
ttctaaattttggaagatgcag

SEQ ID NO: 8527323 - DNA, 22 bp, Homo sapiens
ttctaaattttggaagatgcag

SEQ ID NO: 8527324 - DNA, 22 bp, Homo sapiens
ttctaaagtgcaatctgacaga

SEQ ID NO: 8527325 - DNA, 22 bp, Homo sapiens
ttctaaagtgcaatctgacaga

SEQ ID NO: 8527326 - DNA, 22 bp, Homo sapiens
ttctaaatggggatcctttctg

SEQ ID NO: 8527327 - DNA, 22 bp, Homo sapiens
ttctaaagcctgtcctatcaga

SEQ ID NO: 8527328 - DNA, 22 bp, Homo sapiens
ttctaaagtgcaatctgacaga

SEQ ID NO: 8527329 - DNA, 22 bp, Homo sapiens
ttctaactctacactagctttg

SEQ ID NO: 8527330 - DNA, 22 bp, Homo sapiens
ttctaactccacttcccactcc

SEQ ID NO: 8527331 - DNA, 22 bp, Homo sapiens
ttctaactccacttcccactcc

SEQ ID NO: 8527332 - DNA, 22 bp, Homo sapiens
ttctaactcaaagcttctttca

SEQ ID NO: 8527333 - DNA, 22 bp, Homo sapiens
ttctaactctgttatgtgtttc

SEQ ID NO: 8527334 - DNA, 22 bp, Homo sapiens
ttctaactctacactagctttg

SEQ ID NO: 8527335 - DNA, 22 bp, Homo sapiens
ttctaactctgttatgtgtttc

SEQ ID NO: 8527336 - DNA, 22 bp, Homo sapiens
ttctaactctgttatgtgtttc

SEQ ID NO: 8527337 - DNA, 22 bp, Homo sapiens
ttctaactaaagtctttgtttt

SEQ ID NO: 8527338 - DNA, 22 bp, Homo sapiens
ttctaactaaagtctttgtttt

SEQ ID NO: 8527339 - DNA, 23 bp, Homo sapiens
ttctaaccttaaagccctttgga

SEQ ID NO: 8527340 - DNA, 22 bp, Homo sapiens
ttctaactcaaagcttctttca

SEQ ID NO: 8527341 - DNA, 20 bp, Homo sapiens
ttctaactactctccctttg

SEQ ID NO: 8527342 - DNA, 22 bp, Homo sapiens
ttctaactcaaagcttctttca

SEQ ID NO: 8527343 - DNA, 21 bp, Homo sapiens
ttctcagagtctattacagtt

SEQ ID NO: 8527344 - DNA, 22 bp, Homo sapiens
ttctcagaggctgctaagtgca

SEQ ID NO: 8527345 - DNA, 22 bp, Homo sapiens
ttctcagagtgaccaagtcttt

SEQ ID NO: 8527346 - DNA, 22 bp, Homo sapiens
ttctcagagtgaccaagtcttt

SEQ ID NO: 8527347 - DNA, 21 bp, Homo sapiens
ttctcagagtctattacagtt

SEQ ID NO: 8527348 - DNA, 22 bp, Homo sapiens
ttctcagatatttgtatggaac

SEQ ID NO: 8527349 - DNA, 22 bp, Homo sapiens
ttctcagatatttactgagcat

SEQ ID NO: 8527350 - DNA, 22 bp, Homo sapiens
ttctcagatatttactgagcat

SEQ ID NO: 8527351 - DNA, 19 bp, Homo sapiens
ttctcagagcttgcagcac

SEQ ID NO: 8527352 - DNA, 22 bp, Homo sapiens
ttctcagaggagtcgggagctg

SEQ ID NO: 8527353 - DNA, 22 bp, Homo sapiens
ttctcagaggagtcgggagctg

SEQ ID NO: 8527354 - DNA, 22 bp, Homo sapiens
ttctcagagctcactgtagtaa

SEQ ID NO: 8527355 - DNA, 22 bp, Homo sapiens
ttctcagagctcactgtagtaa

SEQ ID NO: 8527356 - DNA, 18 bp, Homo sapiens
ttctcagactttggaagt

SEQ ID NO: 8527357 - DNA, 22 bp, Homo sapiens
ttctcagagcactgctgacaaa

SEQ ID NO: 8527358 - DNA, 22 bp, Homo sapiens
ttctcagagcactgctgacaaa

SEQ ID NO: 8527359 - DNA, 22 bp, Homo sapiens
ttctcagacttccagcaccagc

SEQ ID NO: 8527360 - DNA, 22 bp, Homo sapiens
ttctcagaattgactgggagca

SEQ ID NO: 8527361 - DNA, 22 bp, Homo sapiens
ttctccagagtttctctcactg

SEQ ID NO: 8527362 - DNA, 22 bp, Homo sapiens
ttctccagcctattggcctatc

SEQ ID NO: 8527363 - DNA, 19 bp, Homo sapiens
ttctccagcctgacctgag

SEQ ID NO: 8527364 - DNA, 22 bp, Homo sapiens
ttctccagctcatcagggaggg

SEQ ID NO: 8527365 - DNA, 19 bp, Homo sapiens
ttctccagcctgacctgag

SEQ ID NO: 8527366 - DNA, 19 bp, Homo sapiens
ttctccagcctgacctgag

SEQ ID NO: 8527367 - DNA, 22 bp, Homo sapiens
ttctccaggccgcgcagggggc

SEQ ID NO: 8527368 - DNA, 19 bp, Homo sapiens
ttctccaggctgcagaggg

SEQ ID NO: 8527369 - DNA, 19 bp, Homo sapiens
ttctccaggctgcagaggg

SEQ ID NO: 8527370 - DNA, 19 bp, Homo sapiens
ttctccaggctgcagaggg

SEQ ID NO: 8527371 - DNA, 22 bp, Homo sapiens
ttctccaggcttgggccaggtc

SEQ ID NO: 8527372 - DNA, 22 bp, Homo sapiens
ttctccaggggagggttctcca

SEQ ID NO: 8527373 - DNA, 19 bp, Homo sapiens
ttctccagggacttaggga

SEQ ID NO: 8527374 - DNA, 22 bp, Homo sapiens
ttctcacaattcttgtatttgc

SEQ ID NO: 8527375 - DNA, 22 bp, Homo sapiens
ttctcacaattcttgtatttgc

SEQ ID NO: 8527376 - DNA, 22 bp, Homo sapiens
ttctcacagaagcacgaagcct

SEQ ID NO: 8527377 - DNA, 22 bp, Homo sapiens
ttctcacaggctggaatgatga

SEQ ID NO: 8527378 - DNA, 22 bp, Homo sapiens
ttctcacaggatttcttttagt

SEQ ID NO: 8527379 - DNA, 22 bp, Homo sapiens
ttctcacaggctggaatgatga

SEQ ID NO: 8527380 - DNA, 22 bp, Homo sapiens
ttctcacagtacctaacatgta

SEQ ID NO: 8527381 - DNA, 22 bp, Homo sapiens
ttctcactatgtatgtagattg

SEQ ID NO: 8527382 - DNA, 22 bp, Homo sapiens
ttctcacagtacctaacatgta

SEQ ID NO: 8527383 - DNA, 22 bp, Homo sapiens
ttctcacattcagaacttttat

SEQ ID NO: 8527384 - DNA, 22 bp, Homo sapiens
ttctcagaattgactgggagca

SEQ ID NO: 8527385 - DNA, 22 bp, Homo sapiens
ttctcagaaaagcaagctttct

SEQ ID NO: 8527386 - DNA, 22 bp, Homo sapiens
ttctcactatgtatgtagattg

SEQ ID NO: 8527387 - DNA, 22 bp, Homo sapiens
ttctcagaaaatgtagagaaaa

SEQ ID NO: 8527388 - DNA, 22 bp, Homo sapiens
ttctaactttcaaggtcctttc

SEQ ID NO: 8527389 - DNA, 22 bp, Homo sapiens
ttctaacttaacactcctgtga

SEQ ID NO: 8527390 - DNA, 22 bp, Homo sapiens
ttctaacttaacactcctgtga

SEQ ID NO: 8527391 - DNA, 22 bp, Homo sapiens
ttctaactttcaaggtcctttc

SEQ ID NO: 8527392 - DNA, 22 bp, Homo sapiens
ttctaactggcttgacagtttc

SEQ ID NO: 8527393 - DNA, 21 bp, Homo sapiens
ttctaactgggtgggccttga

SEQ ID NO: 8527394 - DNA, 22 bp, Homo sapiens
ttctatgaaggtaagatgtacg

SEQ ID NO: 8527395 - DNA, 22 bp, Homo sapiens
ttctcaaggacaaaatgacatg

SEQ ID NO: 8527396 - DNA, 22 bp, Homo sapiens
ttctcaaagggtggtttgcaaa

SEQ ID NO: 8527397 - DNA, 22 bp, Homo sapiens
ttctcaaagtgtgctccctgga

SEQ ID NO: 8527398 - DNA, 22 bp, Homo sapiens
ttctcaaagaaagctgtcatta

SEQ ID NO: 8527399 - DNA, 19 bp, Homo sapiens
ttctatgattaacatgaga

SEQ ID NO: 8527400 - DNA, 22 bp, Homo sapiens
ttctcttgtgccaagttgttgc

SEQ ID NO: 8527401 - DNA, 23 bp, Homo sapiens
ttctctttagatttacattactc

SEQ ID NO: 8527402 - DNA, 23 bp, Homo sapiens
ttctctttagatttacattactc

SEQ ID NO: 8527403 - DNA, 22 bp, Homo sapiens
ttctcttctgttcagtgcccaa

SEQ ID NO: 8527404 - DNA, 22 bp, Homo sapiens
ttctcttctgttcagtgcccaa

SEQ ID NO: 8527405 - DNA, 17 bp, Homo sapiens
ttctcttcctggatagt

SEQ ID NO: 8527406 - DNA, 17 bp, Homo sapiens
ttctcttcctggatagt

SEQ ID NO: 8527407 - DNA, 22 bp, Homo sapiens
ttctcttcccactttctgtatt

SEQ ID NO: 8527408 - DNA, 22 bp, Homo sapiens
ttctcttcccactttctgtatt

SEQ ID NO: 8527409 - DNA, 17 bp, Homo sapiens
ttctcttcctggatagt

SEQ ID NO: 8527410 - DNA, 22 bp, Homo sapiens
ttctcttcatctcagtaaatgt

SEQ ID NO: 8527411 - DNA, 22 bp, Homo sapiens
ttctcttcatctcagtaaatgt

SEQ ID NO: 8527412 - DNA, 22 bp, Homo sapiens
ttctcttcatctcagtaaatgt

SEQ ID NO: 8527413 - DNA, 22 bp, Homo sapiens
ttctcttcatctcagtaaatgt

SEQ ID NO: 8527414 - DNA, 22 bp, Homo sapiens
ttctcttcccactttctgtatt

SEQ ID NO: 8527415 - DNA, 22 bp, Homo sapiens
ttctctgtagttgcctggtgga

SEQ ID NO: 8527416 - DNA, 22 bp, Homo sapiens
ttctctgtagttgcctggtgga

SEQ ID NO: 8527417 - DNA, 22 bp, Homo sapiens
ttctctgtgagggtgctggatt

SEQ ID NO: 8527418 - DNA, 22 bp, Homo sapiens
ttctctgtggattgggtgagag

SEQ ID NO: 8527419 - DNA, 19 bp, Homo sapiens
ttctctgtgctagactctg

SEQ ID NO: 8527420 - DNA, 22 bp, Homo sapiens
ttctctgtgagggtgctggatt

SEQ ID NO: 8527421 - DNA, 19 bp, Homo sapiens
ttctctgtgctagactctg

SEQ ID NO: 8527422 - DNA, 19 bp, Homo sapiens
ttctctgtgctagactctg

SEQ ID NO: 8527423 - DNA, 22 bp, Homo sapiens
ttctcttacattttctcagcct

SEQ ID NO: 8527424 - DNA, 22 bp, Homo sapiens
ttctctgttttcccctcgatgt

SEQ ID NO: 8527425 - DNA, 22 bp, Homo sapiens
ttctcttagctgtaaagtcaat

SEQ ID NO: 8527426 - DNA, 22 bp, Homo sapiens
ttctcccatctcagtcttacat

SEQ ID NO: 8527427 - DNA, 22 bp, Homo sapiens
ttctcccactccgtgcttcagt

SEQ ID NO: 8527428 - DNA, 22 bp, Homo sapiens
ttctcccactccgtgcttcagt

SEQ ID NO: 8527429 - DNA, 21 bp, Homo sapiens
ttctccccagcgaatcctcgg

SEQ ID NO: 8527430 - DNA, 22 bp, Homo sapiens
ttctccatttaacttccttatg

SEQ ID NO: 8527431 - DNA, 21 bp, Homo sapiens
ttctccagggggagctctctc

SEQ ID NO: 8527432 - DNA, 20 bp, Homo sapiens
ttctccagtgcggtagccat

SEQ ID NO: 8527433 - DNA, 20 bp, Homo sapiens
ttctccagtgcggtagccat

SEQ ID NO: 8527434 - DNA, 22 bp, Homo sapiens
ttctcctctgcaatgactggca

SEQ ID NO: 8527435 - DNA, 22 bp, Homo sapiens
ttctcctctgttggccttccct

SEQ ID NO: 8527436 - DNA, 22 bp, Homo sapiens
ttctcctctgttaccttgcaaa

SEQ ID NO: 8527437 - DNA, 22 bp, Homo sapiens
ttctccgctaagttctctgcag

SEQ ID NO: 8527438 - DNA, 22 bp, Homo sapiens
ttctccgctaagttctctgcag

SEQ ID NO: 8527439 - DNA, 22 bp, Homo sapiens
ttctccgctaagttctctgcag

SEQ ID NO: 8527440 - DNA, 22 bp, Homo sapiens
ttctccctggtatttacttagt

SEQ ID NO: 8527441 - DNA, 22 bp, Homo sapiens
ttctcctaggatcaggggtcct

SEQ ID NO: 8527442 - DNA, 22 bp, Homo sapiens
ttctgcatttaaaatattacta

SEQ ID NO: 8527443 - DNA, 22 bp, Homo sapiens
ttctgcatttctaataagttcc

SEQ ID NO: 8527444 - DNA, 22 bp, Homo sapiens
ttctgcattgacttttatttcc

SEQ ID NO: 8527445 - DNA, 22 bp, Homo sapiens
ttctgccaaaggctttgttttg

SEQ ID NO: 8527446 - DNA, 23 bp, Homo sapiens
ttctgcatgtttcagagctggga

SEQ ID NO: 8527447 - DNA, 21 bp, Homo sapiens
ttctgcattaaggtggagata

SEQ ID NO: 8527448 - DNA, 22 bp, Homo sapiens
ttctgcattatacacaacctaa

SEQ ID NO: 8527449 - DNA, 22 bp, Homo sapiens
ttctgcattcaaattatgtgag

SEQ ID NO: 8527450 - DNA, 22 bp, Homo sapiens
ttctgcagatcaacttgactgc

SEQ ID NO: 8527451 - DNA, 20 bp, Homo sapiens
ttctgcctagggttagcctg

SEQ ID NO: 8527452 - DNA, 22 bp, Homo sapiens
ttctggaggccccttccttctc

SEQ ID NO: 8527453 - DNA, 22 bp, Homo sapiens
ttctctttatgtatttagtggg

SEQ ID NO: 8527454 - DNA, 22 bp, Homo sapiens
ttctctttctacagtgtgattg

SEQ ID NO: 8527455 - DNA, 22 bp, Homo sapiens
ttctctttgacattattcaggt

SEQ ID NO: 8527456 - DNA, 22 bp, Homo sapiens
ttctctttctgctgggctggaa

SEQ ID NO: 8527457 - DNA, 22 bp, Homo sapiens
ttctgaggcactggctctccca

SEQ ID NO: 8527458 - DNA, 22 bp, Homo sapiens
ttctgaggaggagcaaaaactc

SEQ ID NO: 8527459 - DNA, 22 bp, Homo sapiens
ttctgaggccattaccaataaa

SEQ ID NO: 8527460 - DNA, 22 bp, Homo sapiens
ttctgaggcatagaggatgaga

SEQ ID NO: 8527461 - DNA, 22 bp, Homo sapiens
ttctgagctgcaacactaacat

SEQ ID NO: 8527462 - DNA, 20 bp, Homo sapiens
ttctctttgggtccagagaa

SEQ ID NO: 8527463 - DNA, 22 bp, Homo sapiens
ttctgattgctgatgaggccca

SEQ ID NO: 8527464 - DNA, 22 bp, Homo sapiens
ttctgattgctgatgaggccca

SEQ ID NO: 8527465 - DNA, 22 bp, Homo sapiens
ttctgcaatcgctctgaccatt

SEQ ID NO: 8527466 - DNA, 22 bp, Homo sapiens
ttctgaggtccatgcagtactg

SEQ ID NO: 8527467 - DNA, 22 bp, Homo sapiens
ttctgagggctaatgtactgta

SEQ ID NO: 8527468 - DNA, 22 bp, Homo sapiens
ttctgataacaaacaccaattt

SEQ ID NO: 8527469 - DNA, 22 bp, Homo sapiens
ttctgatacagtcccaacacaa

SEQ ID NO: 8527470 - DNA, 22 bp, Homo sapiens
ttctgataataccacatcgcag

SEQ ID NO: 8527471 - DNA, 22 bp, Homo sapiens
ttctgataccttgcaggatcct

SEQ ID NO: 8527472 - DNA, 22 bp, Homo sapiens
ttgaaaaaattggtagaggatg

SEQ ID NO: 8527473 - DNA, 22 bp, Homo sapiens
ttgaaaaaattggtagaggatg

SEQ ID NO: 8527474 - DNA, 23 bp, Homo sapiens
ttgaaaaatatagtcccattgtc

SEQ ID NO: 8527475 - DNA, 23 bp, Homo sapiens
ttgaaaaatatagtcccattgtc

SEQ ID NO: 8527476 - DNA, 22 bp, Homo sapiens
ttgaaaagcaaatgatgggtag

SEQ ID NO: 8527477 - DNA, 22 bp, Homo sapiens
ttgaaaaccgtgggaggctgaa

SEQ ID NO: 8527478 - DNA, 22 bp, Homo sapiens
ttgaaaaccgtgggaggctgaa

SEQ ID NO: 8527479 - DNA, 22 bp, Homo sapiens
ttctttttatcttcccataaga

SEQ ID NO: 8527480 - DNA, 22 bp, Homo sapiens
ttgaaaaaattggtagaggatg

SEQ ID NO: 8527481 - DNA, 22 bp, Homo sapiens
ttctttttggatagctgatgaa

SEQ ID NO: 8527482 - DNA, 22 bp, Homo sapiens
ttgaaaaaattggtagaggatg

SEQ ID NO: 8527483 - DNA, 17 bp, Homo sapiens
ttgaaaagtaagctccc

SEQ ID NO: 8527484 - DNA, 22 bp, Homo sapiens
ttgaaaatatcacaggagcagc

SEQ ID NO: 8527485 - DNA, 22 bp, Homo sapiens
ttgaaaagttttgaaacactct

SEQ ID NO: 8527486 - DNA, 22 bp, Homo sapiens
ttgaaaatatcacaggagcagc

SEQ ID NO: 8527487 - DNA, 22 bp, Homo sapiens
ttgaaaatatcacaggagcagc

SEQ ID NO: 8527488 - DNA, 20 bp, Homo sapiens
ttgaaaatgcattgtgcagt

SEQ ID NO: 8527489 - DNA, 20 bp, Homo sapiens
ttgaaaatgcattgtgcagt

SEQ ID NO: 8527490 - DNA, 19 bp, Homo sapiens
ttgaaaatatggatctgag

SEQ ID NO: 8527491 - DNA, 22 bp, Homo sapiens
ttgaaaatggtaagcatgatat

SEQ ID NO: 8527492 - DNA, 22 bp, Homo sapiens
ttgaaaatggtaagcatgatat

SEQ ID NO: 8527493 - DNA, 22 bp, Homo sapiens
ttgaaacagacaagtaaatgtc

SEQ ID NO: 8527494 - DNA, 22 bp, Homo sapiens
ttgaaacagtagctcatagacc

SEQ ID NO: 8527495 - DNA, 22 bp, Homo sapiens
ttgaaacagacaagtaaatgtc

SEQ ID NO: 8527496 - DNA, 22 bp, Homo sapiens
ttgaaacatatacaaagtggtg

SEQ ID NO: 8527497 - DNA, 22 bp, Homo sapiens
ttgaaagaacaattctgtgatg

SEQ ID NO: 8527498 - DNA, 22 bp, Homo sapiens
ttgaaacttttcttggagaaac

SEQ ID NO: 8527499 - DNA, 22 bp, Homo sapiens
ttgaaagaactcttcagagata

SEQ ID NO: 8527500 - DNA, 22 bp, Homo sapiens
ttgaaagaagaagctgcgatgt

SEQ ID NO: 8527501 - DNA, 22 bp, Homo sapiens
ttgaaagaaggtggtagagaat

SEQ ID NO: 8527502 - DNA, 22 bp, Homo sapiens
ttgaaagaaggtggtagagaat

SEQ ID NO: 8527503 - DNA, 22 bp, Homo sapiens
ttgaaagatagtgaagccagcc

SEQ ID NO: 8527504 - DNA, 22 bp, Homo sapiens
ttgaaagatagtgaagccagcc

SEQ ID NO: 8527505 - DNA, 22 bp, Homo sapiens
ttgaaagacttctcctgtgaaa

SEQ ID NO: 8527506 - DNA, 22 bp, Homo sapiens
ttgaaactcatcttagtgatgt

SEQ ID NO: 8527507 - DNA, 22 bp, Homo sapiens
ttgaaacattacctgtatttcc

SEQ ID NO: 8527508 - DNA, 22 bp, Homo sapiens
ttgaaactgcttattgaatttg

SEQ ID NO: 8527509 - DNA, 22 bp, Homo sapiens
ttgaaactgagtgtgtttgggg

SEQ ID NO: 8527510 - DNA, 22 bp, Homo sapiens
ttgaaactgtcagcttttacgc

SEQ ID NO: 8527511 - DNA, 22 bp, Homo sapiens
ttgaaacttagaaattgagctg

SEQ ID NO: 8527512 - DNA, 22 bp, Homo sapiens
ttgaaagatatgttaatctttc

SEQ ID NO: 8527513 - DNA, 19 bp, Homo sapiens
ttgaaagattagctttcta

SEQ ID NO: 8527514 - DNA, 22 bp, Homo sapiens
ttgacagtatagctttacctat

SEQ ID NO: 8527515 - DNA, 22 bp, Homo sapiens
ttgacataagacttagagtatt

SEQ ID NO: 8527516 - DNA, 22 bp, Homo sapiens
ttgacagttgcaatggtgatct

SEQ ID NO: 8527517 - DNA, 22 bp, Homo sapiens
ttgacagttgagggttgtctaa

SEQ ID NO: 8527518 - DNA, 22 bp, Homo sapiens
ttgagaaacctggcagtagaga

SEQ ID NO: 8527519 - DNA, 22 bp, Homo sapiens
ttgaccatacctccaggcagtt

SEQ ID NO: 8527520 - DNA, 22 bp, Homo sapiens
ttgaccactgaatggttctgaa

SEQ ID NO: 8527521 - DNA, 22 bp, Homo sapiens
ttgaggtatattcacatatatc

SEQ ID NO: 8527522 - DNA, 22 bp, Homo sapiens
ttgaggtagttctattgtgagt

SEQ ID NO: 8527523 - DNA, 22 bp, Homo sapiens
ttgaggtaataaacagccattc

SEQ ID NO: 8527524 - DNA, 22 bp, Homo sapiens
ttgagggtctggatctgctgct

SEQ ID NO: 8527525 - DNA, 22 bp, Homo sapiens
ttgagggtctggatctgctgct

SEQ ID NO: 8527526 - DNA, 22 bp, Homo sapiens
ttgagggtctggatctgctgct

SEQ ID NO: 8527527 - DNA, 19 bp, Homo sapiens
ttgaggggccaggggagat

SEQ ID NO: 8527528 - DNA, 19 bp, Homo sapiens
ttgaggggccaggggagat

SEQ ID NO: 8527529 - DNA, 19 bp, Homo sapiens
ttgaggggccaggggagat

SEQ ID NO: 8527530 - DNA, 21 bp, Homo sapiens
ttgaggggtattgcttttctc

SEQ ID NO: 8527531 - DNA, 21 bp, Homo sapiens
ttgaggggtattgcttttctc

SEQ ID NO: 8527532 - DNA, 22 bp, Homo sapiens
ttgagggtctggatctgctgct

SEQ ID NO: 8527533 - DNA, 21 bp, Homo sapiens
ttgaggggtattgcttttctc

SEQ ID NO: 8527534 - DNA, 18 bp, Homo sapiens
ttgagggaggggcagagt

SEQ ID NO: 8527535 - DNA, 18 bp, Homo sapiens
ttgagggaggggcagagt

SEQ ID NO: 8527536 - DNA, 22 bp, Homo sapiens
ttgagggatttacagaggtggg

SEQ ID NO: 8527537 - DNA, 22 bp, Homo sapiens
ttgagaggatggattagacaaa

SEQ ID NO: 8527538 - DNA, 22 bp, Homo sapiens
ttgagatagatctcatcttccc

SEQ ID NO: 8527539 - DNA, 22 bp, Homo sapiens
ttgagagtgccaagcatcctcc

SEQ ID NO: 8527540 - DNA, 22 bp, Homo sapiens
ttgagagtgccaagcatcctcc

SEQ ID NO: 8527541 - DNA, 22 bp, Homo sapiens
ttgagggacagaggtgctgtct

SEQ ID NO: 8527542 - DNA, 22 bp, Homo sapiens
ttgagggaacatgagaatcatc

SEQ ID NO: 8527543 - DNA, 22 bp, Homo sapiens
ttgaggcccggcaggccgagcg

SEQ ID NO: 8527544 - DNA, 22 bp, Homo sapiens
ttgaggccccatggatgagaac

SEQ ID NO: 8527545 - DNA, 22 bp, Homo sapiens
ttgaggcctgctggaaggtgtt

SEQ ID NO: 8527546 - DNA, 22 bp, Homo sapiens
ttgagacacaaggcacagtaag

SEQ ID NO: 8527547 - DNA, 22 bp, Homo sapiens
ttgagaatgatgagattcttcc

SEQ ID NO: 8527548 - DNA, 22 bp, Homo sapiens
ttgagaatgtgttttgctaagt

SEQ ID NO: 8527549 - DNA, 22 bp, Homo sapiens
ttgagacactttgggcatcact

SEQ ID NO: 8527550 - DNA, 22 bp, Homo sapiens
ttgagactgccttgtcgtctgc

SEQ ID NO: 8527551 - DNA, 22 bp, Homo sapiens
ttgagactcgagtctctcagac

SEQ ID NO: 8527552 - DNA, 22 bp, Homo sapiens
ttgagaatgatgagattcttcc

SEQ ID NO: 8527553 - DNA, 22 bp, Homo sapiens
ttgagaaggtggtcatttgcaa

SEQ ID NO: 8527554 - DNA, 22 bp, Homo sapiens
ttgagaaaggggtcaatatctc

SEQ ID NO: 8527555 - DNA, 22 bp, Homo sapiens
ttgagaaaggggtcaatatctc

SEQ ID NO: 8527556 - DNA, 18 bp, Homo sapiens
ttgagaaataagcactaa

SEQ ID NO: 8527557 - DNA, 18 bp, Homo sapiens
ttgagaaataagcactaa

SEQ ID NO: 8527558 - DNA, 22 bp, Homo sapiens
ttgagaaataagcatgtctaga

SEQ ID NO: 8527559 - DNA, 22 bp, Homo sapiens
ttgagaaatacttttgtagcct

SEQ ID NO: 8527560 - DNA, 22 bp, Homo sapiens
ttgagaaatgttttttaagctg

SEQ ID NO: 8527561 - DNA, 22 bp, Homo sapiens
ttctttggcttacgtctggcct

SEQ ID NO: 8527562 - DNA, 22 bp, Homo sapiens
ttctttggggtctccagcatag

SEQ ID NO: 8527563 - DNA, 22 bp, Homo sapiens
ttctttggggtctccagcatag

SEQ ID NO: 8527564 - DNA, 22 bp, Homo sapiens
ttctttgggcaattgctggccc

SEQ ID NO: 8527565 - DNA, 22 bp, Homo sapiens
ttctttcttggggaacacactc

SEQ ID NO: 8527566 - DNA, 22 bp, Homo sapiens
ttctttcttggggaacacactc

SEQ ID NO: 8527567 - DNA, 22 bp, Homo sapiens
ttctttcttggggaacacactc

SEQ ID NO: 8527568 - DNA, 22 bp, Homo sapiens
ttctttgaatagatgttcccag

SEQ ID NO: 8527569 - DNA, 22 bp, Homo sapiens
ttctttgaaatactgttttgcc

SEQ ID NO: 8527570 - DNA, 22 bp, Homo sapiens
ttctttgagttagtacagtcca

SEQ ID NO: 8527571 - DNA, 22 bp, Homo sapiens
ttctttgcccatgtttcctaag

SEQ ID NO: 8527572 - DNA, 19 bp, Homo sapiens
ttctttgagttcttctgag

SEQ ID NO: 8527573 - DNA, 22 bp, Homo sapiens
ttctttgcccttaatgaaataa

SEQ ID NO: 8527574 - DNA, 22 bp, Homo sapiens
ttcttctgacactgatgctgta

SEQ ID NO: 8527575 - DNA, 22 bp, Homo sapiens
ttcttctgaaacataatcaata

SEQ ID NO: 8527576 - DNA, 22 bp, Homo sapiens
ttcttctgaaacagtgacagac

SEQ ID NO: 8527577 - DNA, 20 bp, Homo sapiens
ttcttctctagttatcttca

SEQ ID NO: 8527578 - DNA, 20 bp, Homo sapiens
ttcttctctagttatcttca

SEQ ID NO: 8527579 - DNA, 22 bp, Homo sapiens
ttcttctctcatagattaaggt

SEQ ID NO: 8527580 - DNA, 20 bp, Homo sapiens
ttcttctctagttatcttca

SEQ ID NO: 8527581 - DNA, 22 bp, Homo sapiens
ttcttctctcatagattaaggt

SEQ ID NO: 8527582 - DNA, 22 bp, Homo sapiens
ttcttctgcctcccacctgata

SEQ ID NO: 8527583 - DNA, 22 bp, Homo sapiens
ttcttctgcctcccacctgata

SEQ ID NO: 8527584 - DNA, 22 bp, Homo sapiens
ttcttctgtgaggtgtgtgcct

SEQ ID NO: 8527585 - DNA, 22 bp, Homo sapiens
ttcttctgtgaggtgtgtgcct

SEQ ID NO: 8527586 - DNA, 22 bp, Homo sapiens
ttcttcttcaagtgctgcattc

SEQ ID NO: 8527587 - DNA, 22 bp, Homo sapiens
ttctttctcactctttaggaag

SEQ ID NO: 8527588 - DNA, 22 bp, Homo sapiens
ttctttctcactctttaggaag

SEQ ID NO: 8527589 - DNA, 22 bp, Homo sapiens
ttctggagtattcctggcacct

SEQ ID NO: 8527590 - DNA, 22 bp, Homo sapiens
ttctggagggcatgctgctgcc

SEQ ID NO: 8527591 - DNA, 22 bp, Homo sapiens
ttctgggacatctggacagttt

SEQ ID NO: 8527592 - DNA, 22 bp, Homo sapiens
ttctgggacatctggacagttt

SEQ ID NO: 8527593 - DNA, 22 bp, Homo sapiens
ttctgggaacaaagtggagtgg

SEQ ID NO: 8527594 - DNA, 22 bp, Homo sapiens
ttcttcctcagcagggctgcct

SEQ ID NO: 8527595 - DNA, 22 bp, Homo sapiens
ttcttcctcagcagggctgcct

SEQ ID NO: 8527596 - DNA, 22 bp, Homo sapiens
ttcttcagcccatatcttccag

SEQ ID NO: 8527597 - DNA, 22 bp, Homo sapiens
ttcttctcctaaggagagtcct

SEQ ID NO: 8527598 - DNA, 22 bp, Homo sapiens
ttcttctcctaaggagagtcct

SEQ ID NO: 8527599 - DNA, 22 bp, Homo sapiens
ttcttctcggctgtcagatagt

SEQ ID NO: 8527600 - DNA, 22 bp, Homo sapiens
ttcttctcctaaggagagtcct

SEQ ID NO: 8527601 - DNA, 22 bp, Homo sapiens
ttcttctcggctgtcagatagt

SEQ ID NO: 8527602 - DNA, 22 bp, Homo sapiens
ttcttctcggctgtcagatagt

SEQ ID NO: 8527603 - DNA, 22 bp, Homo sapiens
ttcttctcagggtcccacatgg

SEQ ID NO: 8527604 - DNA, 23 bp, Homo sapiens
ttcttctcaattagttgattcag

SEQ ID NO: 8527605 - DNA, 23 bp, Homo sapiens
ttcttctcaattagttgattcag

SEQ ID NO: 8527606 - DNA, 22 bp, Homo sapiens
ttcttctccgaggagggctggt

SEQ ID NO: 8527607 - DNA, 22 bp, Homo sapiens
ttcttctccgaggagggctggt

SEQ ID NO: 8527608 - DNA, 22 bp, Homo sapiens
ttcttctcagggtcccacatgg

SEQ ID NO: 8527609 - DNA, 22 bp, Homo sapiens
ttattttctcctcagaaagtgg

SEQ ID NO: 8527610 - DNA, 22 bp, Homo sapiens
ttattttctcctcagaaagtgg

SEQ ID NO: 8527611 - DNA, 22 bp, Homo sapiens
ttattttctcctcagaaagtgg

SEQ ID NO: 8527612 - DNA, 22 bp, Homo sapiens
ttattttgagagaatgtgtgct

SEQ ID NO: 8527613 - DNA, 22 bp, Homo sapiens
ttattttgccacaggtgacctt

SEQ ID NO: 8527614 - DNA, 22 bp, Homo sapiens
ttattttgccacaggtgacctt

SEQ ID NO: 8527615 - DNA, 22 bp, Homo sapiens
ttattttggtaaatgtttgcct

SEQ ID NO: 8527616 - DNA, 22 bp, Homo sapiens
ttattttcagctaggaaagcca

SEQ ID NO: 8527617 - DNA, 22 bp, Homo sapiens
ttattttcagctaggaaagcca

SEQ ID NO: 8527618 - DNA, 22 bp, Homo sapiens
ttattttcagctaggaaagcca

SEQ ID NO: 8527619 - DNA, 22 bp, Homo sapiens
ttattttctcctcagaaagtgg

SEQ ID NO: 8527620 - DNA, 22 bp, Homo sapiens
ttattttaccttcctctgagct

SEQ ID NO: 8527621 - DNA, 22 bp, Homo sapiens
ttattttaccttcctctgagct

SEQ ID NO: 8527622 - DNA, 22 bp, Homo sapiens
ttattttaccttcctctgagct

SEQ ID NO: 8527623 - DNA, 22 bp, Homo sapiens
ttattttaccttcctctgagct

SEQ ID NO: 8527624 - DNA, 22 bp, Homo sapiens
ttcaaaatccgggaggcgcccc

SEQ ID NO: 8527625 - DNA, 21 bp, Homo sapiens
ttcaaaatggtgtgtttgtct

SEQ ID NO: 8527626 - DNA, 22 bp, Homo sapiens
ttcaaaatgcacaaagggctag

SEQ ID NO: 8527627 - DNA, 21 bp, Homo sapiens
ttcaaaatggtgtgtttgtct

SEQ ID NO: 8527628 - DNA, 23 bp, Homo sapiens
ttcaaaactggaaaatcagatgc

SEQ ID NO: 8527629 - DNA, 23 bp, Homo sapiens
ttcaaaactggaaaatcagatgc

SEQ ID NO: 8527630 - DNA, 22 bp, Homo sapiens
ttattttggtaaatgtttgcct

SEQ ID NO: 8527631 - DNA, 22 bp, Homo sapiens
ttattttgtagctctgatcttt

SEQ ID NO: 8527632 - DNA, 22 bp, Homo sapiens
ttcaagcagggattggtgatgg

SEQ ID NO: 8527633 - DNA, 22 bp, Homo sapiens
ttcaagcagggattggtgatgg

SEQ ID NO: 8527634 - DNA, 22 bp, Homo sapiens
ttcaagcagagatatttcaaga

SEQ ID NO: 8527635 - DNA, 22 bp, Homo sapiens
ttcaagcaccaaattagtaggc

SEQ ID NO: 8527636 - DNA, 22 bp, Homo sapiens
ttcaagcaccaaattagtaggc

SEQ ID NO: 8527637 - DNA, 22 bp, Homo sapiens
ttcaagatgtcttcacaatagt

SEQ ID NO: 8527638 - DNA, 22 bp, Homo sapiens
ttcaagatgacccagtcacacg

SEQ ID NO: 8527639 - DNA, 22 bp, Homo sapiens
ttcaaaattgttctaagctctg

SEQ ID NO: 8527640 - DNA, 22 bp, Homo sapiens
ttcaaaattgttctaagctctg

SEQ ID NO: 8527641 - DNA, 22 bp, Homo sapiens
ttcaaaattgttctaagctctg

SEQ ID NO: 8527642 - DNA, 22 bp, Homo sapiens
ttcaaacaactcatttatgcaa

SEQ ID NO: 8527643 - DNA, 22 bp, Homo sapiens
ttcaaacaaaactgttcccata

SEQ ID NO: 8527644 - DNA, 22 bp, Homo sapiens
ttcaagatccagcacaacagtg

SEQ ID NO: 8527645 - DNA, 22 bp, Homo sapiens
ttcaagactgcgactaatgccc

SEQ ID NO: 8527646 - DNA, 22 bp, Homo sapiens
ttcaagaggcttaattctggat

SEQ ID NO: 8527647 - DNA, 22 bp, Homo sapiens
ttcaagaggcttaattctggat

SEQ ID NO: 8527648 - DNA, 22 bp, Homo sapiens
ttcaagagtccaggagagtctg

SEQ ID NO: 8527649 - DNA, 18 bp, Homo sapiens
ttcaagagtttctctagg

SEQ ID NO: 8527650 - DNA, 22 bp, Homo sapiens
ttattgtttgggtataatttga

SEQ ID NO: 8527651 - DNA, 22 bp, Homo sapiens
ttattgtttactagtttgcaga

SEQ ID NO: 8527652 - DNA, 22 bp, Homo sapiens
ttattgtttaaagccatgtaaa

SEQ ID NO: 8527653 - DNA, 22 bp, Homo sapiens
ttattgttagtgagactgtaga

SEQ ID NO: 8527654 - DNA, 22 bp, Homo sapiens
ttattgttagtgagactgtaga

SEQ ID NO: 8527655 - DNA, 22 bp, Homo sapiens
ttatgttcagcatctgctttat

SEQ ID NO: 8527656 - DNA, 22 bp, Homo sapiens
ttatgtttgagtatatgactca

SEQ ID NO: 8527657 - DNA, 22 bp, Homo sapiens
ttatgttgggaaaagtcagatt

SEQ ID NO: 8527658 - DNA, 22 bp, Homo sapiens
ttatgttttaagtgtgtatctt

SEQ ID NO: 8527659 - DNA, 22 bp, Homo sapiens
ttatgtttgagtatatgactca

SEQ ID NO: 8527660 - DNA, 22 bp, Homo sapiens
ttatgttttatggctatatcat

SEQ ID NO: 8527661 - DNA, 22 bp, Homo sapiens
ttatgttttatggctatatcat

SEQ ID NO: 8527662 - DNA, 22 bp, Homo sapiens
ttatgttttatggctatatcat

SEQ ID NO: 8527663 - DNA, 22 bp, Homo sapiens
ttatttaatgtgatctgaagag

SEQ ID NO: 8527664 - DNA, 22 bp, Homo sapiens
ttatttaatgtgatctgaagag

SEQ ID NO: 8527665 - DNA, 22 bp, Homo sapiens
ttatttaaaatgtaggttggga

SEQ ID NO: 8527666 - DNA, 22 bp, Homo sapiens
ttatttaaaagtggtaagattc

SEQ ID NO: 8527667 - DNA, 22 bp, Homo sapiens
ttattgtttgggtataatttga

SEQ ID NO: 8527668 - DNA, 22 bp, Homo sapiens
ttattgtttgggtataatttga

SEQ ID NO: 8527669 - DNA, 22 bp, Homo sapiens
ttattgtttgggtataatttga

SEQ ID NO: 8527670 - DNA, 22 bp, Homo sapiens
ttattgtttgggtataatttga

SEQ ID NO: 8527671 - DNA, 22 bp, Homo sapiens
ttatttaaaagtggtaagattc

SEQ ID NO: 8527672 - DNA, 22 bp, Homo sapiens
ttatttaaaagtggtaagattc

SEQ ID NO: 8527673 - DNA, 22 bp, Homo sapiens
ttatttaaaagtggtaagattc

SEQ ID NO: 8527674 - DNA, 22 bp, Homo sapiens
ttatttaaaagtggtaagattc

SEQ ID NO: 8527675 - DNA, 22 bp, Homo sapiens
ttatttacaactcttctcttcc

SEQ ID NO: 8527676 - DNA, 22 bp, Homo sapiens
ttatttaggagaaggaaccctg

SEQ ID NO: 8527677 - DNA, 22 bp, Homo sapiens
ttatttagtctagatgaatttt

SEQ ID NO: 8527678 - DNA, 22 bp, Homo sapiens
ttatttaggaggaaactgaggt

SEQ ID NO: 8527679 - DNA, 22 bp, Homo sapiens
ttatttaattttctcactcaga

SEQ ID NO: 8527680 - DNA, 22 bp, Homo sapiens
ttatttaatgtgatctgaagag

SEQ ID NO: 8527681 - DNA, 22 bp, Homo sapiens
ttatttaattttctcactcaga

SEQ ID NO: 8527682 - DNA, 22 bp, Homo sapiens
ttatttaattttctcactcaga

SEQ ID NO: 8527683 - DNA, 22 bp, Homo sapiens
ttatttaattttctcactcaga

SEQ ID NO: 8527684 - DNA, 22 bp, Homo sapiens
ttatttaattttctcactcaga

SEQ ID NO: 8527685 - DNA, 22 bp, Homo sapiens
ttatttgttttctgagaagtat

SEQ ID NO: 8527686 - DNA, 20 bp, Homo sapiens
ttatttgtttactttggtcc

SEQ ID NO: 8527687 - DNA, 18 bp, Homo sapiens
ttatttgttacagcacat

SEQ ID NO: 8527688 - DNA, 20 bp, Homo sapiens
ttatttgtttactttggtcc

SEQ ID NO: 8527689 - DNA, 22 bp, Homo sapiens
ttatttgtggcatccatgttgg

SEQ ID NO: 8527690 - DNA, 22 bp, Homo sapiens
ttatttgtggcatccatgttgg

SEQ ID NO: 8527691 - DNA, 22 bp, Homo sapiens
ttatttgtggcatatgagacga

SEQ ID NO: 8527692 - DNA, 22 bp, Homo sapiens
ttatttgtggcatatgagacga

SEQ ID NO: 8527693 - DNA, 22 bp, Homo sapiens
ttatttgtggcatatgagacga

SEQ ID NO: 8527694 - DNA, 22 bp, Homo sapiens
ttatttgtggcatatgagacga

SEQ ID NO: 8527695 - DNA, 22 bp, Homo sapiens
ttatttatatctctgcagttta

SEQ ID NO: 8527696 - DNA, 22 bp, Homo sapiens
ttatttatatctctgcagttta

SEQ ID NO: 8527697 - DNA, 22 bp, Homo sapiens
ttatttatggcactgttggtgg

SEQ ID NO: 8527698 - DNA, 22 bp, Homo sapiens
ttatttatggcactgttggtgg

SEQ ID NO: 8527699 - DNA, 22 bp, Homo sapiens
tcctctggcccagctgcctctg

SEQ ID NO: 8527700 - DNA, 22 bp, Homo sapiens
tcctctggcccagctgcctctg

SEQ ID NO: 8527701 - DNA, 22 bp, Homo sapiens
tcctctggcccagctgcctctg

SEQ ID NO: 8527702 - DNA, 22 bp, Homo sapiens
tcctctggatataagcctcacc

SEQ ID NO: 8527703 - DNA, 22 bp, Homo sapiens
tcctctgggcctatttgttcac

SEQ ID NO: 8527704 - DNA, 22 bp, Homo sapiens
tcctctgggcctatttgttcac

SEQ ID NO: 8527705 - DNA, 22 bp, Homo sapiens
tcctctggaacctcacccttgc

SEQ ID NO: 8527706 - DNA, 22 bp, Homo sapiens
tcctctggatataagcctcacc

SEQ ID NO: 8527707 - DNA, 21 bp, Homo sapiens
tcctctgctctcataccacaa

SEQ ID NO: 8527708 - DNA, 22 bp, Homo sapiens
tcctctgctggaagggcaagag

SEQ ID NO: 8527709 - DNA, 22 bp, Homo sapiens
tcctctgctgttctggttcttt

SEQ ID NO: 8527710 - DNA, 21 bp, Homo sapiens
tcctctgctctcataccacaa

SEQ ID NO: 8527711 - DNA, 22 bp, Homo sapiens
ttagtgtgtccagttctgaaaa

SEQ ID NO: 8527712 - DNA, 22 bp, Homo sapiens
ttagtgtgcatggatgcctcaa

SEQ ID NO: 8527713 - DNA, 22 bp, Homo sapiens
ttagtgtgcatggatctgtgga

SEQ ID NO: 8527714 - DNA, 22 bp, Homo sapiens
ttagtgtcttcttcatcctctg

SEQ ID NO: 8527715 - DNA, 22 bp, Homo sapiens
ttagtgtctggctatatttaaa

SEQ ID NO: 8527716 - DNA, 22 bp, Homo sapiens
ttagttaaaattctgctgacat

SEQ ID NO: 8527717 - DNA, 22 bp, Homo sapiens
ttagttaattgactatgttgca

SEQ ID NO: 8527718 - DNA, 22 bp, Homo sapiens
ttagtgttagggcctgttacct

SEQ ID NO: 8527719 - DNA, 22 bp, Homo sapiens
ttagtgttagggcctgttacct

SEQ ID NO: 8527720 - DNA, 22 bp, Homo sapiens
ttagtgtttaaaggtttcagag

SEQ ID NO: 8527721 - DNA, 22 bp, Homo sapiens
ttagtggtactcagggagggaa

SEQ ID NO: 8527722 - DNA, 22 bp, Homo sapiens
ttagtgcttctgtccaaatata

SEQ ID NO: 8527723 - DNA, 22 bp, Homo sapiens
ttagtgtattttcaaatgtaga

SEQ ID NO: 8527724 - DNA, 22 bp, Homo sapiens
ttagtgtacttagtgctctaag

SEQ ID NO: 8527725 - DNA, 23 bp, Homo sapiens
ttagtgtaaggcaggcacagttg

SEQ ID NO: 8527726 - DNA, 17 bp, Homo sapiens
ttagtgtatctgttttg

SEQ ID NO: 8527727 - DNA, 22 bp, Homo sapiens
tcctcctgtttctcaggcctgg

SEQ ID NO: 8527728 - DNA, 22 bp, Homo sapiens
tcctcctgtttctcaggcctgg

SEQ ID NO: 8527729 - DNA, 19 bp, Homo sapiens
tcctccttacttcctcttg

SEQ ID NO: 8527730 - DNA, 20 bp, Homo sapiens
tcctccttgcagagcccaga

SEQ ID NO: 8527731 - DNA, 22 bp, Homo sapiens
tcctcctgtctaccagttcctg

SEQ ID NO: 8527732 - DNA, 22 bp, Homo sapiens
tcctcctgtctaccagttcctg

SEQ ID NO: 8527733 - DNA, 21 bp, Homo sapiens
tcctcctgtagagggtcctgg

SEQ ID NO: 8527734 - DNA, 21 bp, Homo sapiens
tcctcctgtagagggtcctgg

SEQ ID NO: 8527735 - DNA, 21 bp, Homo sapiens
tcctcctggccaggcggcccc

SEQ ID NO: 8527736 - DNA, 22 bp, Homo sapiens
tcctcggctgggccccaggctt

SEQ ID NO: 8527737 - DNA, 23 bp, Homo sapiens
tcctcgcaggagggagatgatgc

SEQ ID NO: 8527738 - DNA, 22 bp, Homo sapiens
tcctctgctccatctttactgt

SEQ ID NO: 8527739 - DNA, 22 bp, Homo sapiens
tcctctgctccaggctggactt

SEQ ID NO: 8527740 - DNA, 22 bp, Homo sapiens
tcctctgctcagcattcctcac

SEQ ID NO: 8527741 - DNA, 22 bp, Homo sapiens
tcctctccaggtgagccgaaat

SEQ ID NO: 8527742 - DNA, 22 bp, Homo sapiens
tcctctgccccagatgaaattt

SEQ ID NO: 8527743 - DNA, 22 bp, Homo sapiens
tcctctccagcaaactggctat

SEQ ID NO: 8527744 - DNA, 22 bp, Homo sapiens
ttatgtgtgtacatgcatatgt

SEQ ID NO: 8527745 - DNA, 22 bp, Homo sapiens
ttatgttatgaatggatgatct

SEQ ID NO: 8527746 - DNA, 22 bp, Homo sapiens
ttatgtgtataattacaggaag

SEQ ID NO: 8527747 - DNA, 22 bp, Homo sapiens
ttatgtgtgtacatgcatatgt

SEQ ID NO: 8527748 - DNA, 20 bp, Homo sapiens
ttatgtgtacctgtgctccc

SEQ ID NO: 8527749 - DNA, 20 bp, Homo sapiens
ttatgtgtacctgtgctccc

SEQ ID NO: 8527750 - DNA, 22 bp, Homo sapiens
ttatgtcttaagtatgctaatt

SEQ ID NO: 8527751 - DNA, 22 bp, Homo sapiens
ttatggagcagacagctggtca

SEQ ID NO: 8527752 - DNA, 23 bp, Homo sapiens
ttatggagtgccagacatttggc

SEQ ID NO: 8527753 - DNA, 22 bp, Homo sapiens
ttatggagtgcttacctgccag

SEQ ID NO: 8527754 - DNA, 22 bp, Homo sapiens
ttatggaatggagaaagtctgc

SEQ ID NO: 8527755 - DNA, 22 bp, Homo sapiens
ttatggaatttgcaaaaggtta

SEQ ID NO: 8527756 - DNA, 22 bp, Homo sapiens
ttatggaatggagaaagtctgc

SEQ ID NO: 8527757 - DNA, 22 bp, Homo sapiens
ttatggaatacttatgctgcag

SEQ ID NO: 8527758 - DNA, 22 bp, Homo sapiens
ttatggaaaatacaattataag

SEQ ID NO: 8527759 - DNA, 22 bp, Homo sapiens
ttatggaaatgaaattttattg

SEQ ID NO: 8527760 - DNA, 22 bp, Homo sapiens
ttatggaagtgcaaattgtgtg

SEQ ID NO: 8527761 - DNA, 22 bp, Homo sapiens
ttatggaataacctttctgaaa

SEQ ID NO: 8527762 - DNA, 22 bp, Homo sapiens
ttatgctgttaggaaaatcaaa

SEQ ID NO: 8527763 - DNA, 22 bp, Homo sapiens
ttatggaaaactccagagagta

SEQ ID NO: 8527764 - DNA, 22 bp, Homo sapiens
ttatggaaaactccagagagta

SEQ ID NO: 8527765 - DNA, 22 bp, Homo sapiens
ttatgcatatagcagatacgag

SEQ ID NO: 8527766 - DNA, 22 bp, Homo sapiens
ttatgcctccgaaacctggagt

SEQ ID NO: 8527767 - DNA, 22 bp, Homo sapiens
ttatgcatgagataaaaattgg

SEQ ID NO: 8527768 - DNA, 22 bp, Homo sapiens
ttatgcagatggcatgaggagg

SEQ ID NO: 8527769 - DNA, 22 bp, Homo sapiens
ttatgctagtatagtccttaga

SEQ ID NO: 8527770 - DNA, 22 bp, Homo sapiens
ttatgctaagtgcaacaagcca

SEQ ID NO: 8527771 - DNA, 22 bp, Homo sapiens
ttatgctaaatgaatcaagtca

SEQ ID NO: 8527772 - DNA, 22 bp, Homo sapiens
ttataagagtatatagtgtact

SEQ ID NO: 8527773 - DNA, 22 bp, Homo sapiens
ttataattctggcataggctgt

SEQ ID NO: 8527774 - DNA, 22 bp, Homo sapiens
ttataagagtatatagtgtact

SEQ ID NO: 8527775 - DNA, 22 bp, Homo sapiens
ttataagagtatatagtgtact

SEQ ID NO: 8527776 - DNA, 22 bp, Homo sapiens
ttataagactgtagtgagtatt

SEQ ID NO: 8527777 - DNA, 23 bp, Homo sapiens
ttataagaagcatcacaggaaga

SEQ ID NO: 8527778 - DNA, 22 bp, Homo sapiens
ttagtttataattcatttctgt

SEQ ID NO: 8527779 - DNA, 22 bp, Homo sapiens
ttataactttggatatgacaag

SEQ ID NO: 8527780 - DNA, 22 bp, Homo sapiens
ttagttgacccccagtcctggc

SEQ ID NO: 8527781 - DNA, 22 bp, Homo sapiens
ttagttgatcattcaacatggg

SEQ ID NO: 8527782 - DNA, 22 bp, Homo sapiens
ttagttgatgctaagggatccc

SEQ ID NO: 8527783 - DNA, 22 bp, Homo sapiens
ttagttgatgttctggaggtag

SEQ ID NO: 8527784 - DNA, 22 bp, Homo sapiens
ttagttgatagccaaaatttat

SEQ ID NO: 8527785 - DNA, 20 bp, Homo sapiens
ttagttgagtagctcctgaa

SEQ ID NO: 8527786 - DNA, 22 bp, Homo sapiens
ttagttcactgctatatcatca

SEQ ID NO: 8527787 - DNA, 22 bp, Homo sapiens
ttagttagtggggctgtcagtc

SEQ ID NO: 8527788 - DNA, 22 bp, Homo sapiens
ttagttagagccctatgttagg

SEQ ID NO: 8527789 - DNA, 22 bp, Homo sapiens
ttagttagaataatacaagtaa

SEQ ID NO: 8527790 - DNA, 22 bp, Homo sapiens
ttagttagggctcctgaggacc

SEQ ID NO: 8527791 - DNA, 22 bp, Homo sapiens
ttagttaggatttggtggtata

SEQ ID NO: 8527792 - DNA, 22 bp, Homo sapiens
ttatgcaaggacttattacagt

SEQ ID NO: 8527793 - DNA, 23 bp, Homo sapiens
ttatgcaagcttcctggtctcag

SEQ ID NO: 8527794 - DNA, 23 bp, Homo sapiens
ttatgcaagcttcctggtctcag

SEQ ID NO: 8527795 - DNA, 22 bp, Homo sapiens
ttatacagcattgctagtgatg

SEQ ID NO: 8527796 - DNA, 22 bp, Homo sapiens
ttatacagggagtttccctgca

SEQ ID NO: 8527797 - DNA, 20 bp, Homo sapiens
ttatgcaagcatcaatattg

SEQ ID NO: 8527798 - DNA, 22 bp, Homo sapiens
ttatacaggagattccttactt

SEQ ID NO: 8527799 - DNA, 22 bp, Homo sapiens
ttatacagtttatacttagaat

SEQ ID NO: 8527800 - DNA, 22 bp, Homo sapiens
ttatacagtttatacttagaat

SEQ ID NO: 8527801 - DNA, 20 bp, Homo sapiens
ttatgcaagcatcaatattg

SEQ ID NO: 8527802 - DNA, 22 bp, Homo sapiens
ttataattctggcataggctgt

SEQ ID NO: 8527803 - DNA, 22 bp, Homo sapiens
ttatacacgtttatggagctac

SEQ ID NO: 8527804 - DNA, 22 bp, Homo sapiens
ttatacagcattgctagtgatg

SEQ ID NO: 8527805 - DNA, 22 bp, Homo sapiens
ttatacactgcagaaccagcat

SEQ ID NO: 8527806 - DNA, 22 bp, Homo sapiens
ttcatagtgtttccttccagtg

SEQ ID NO: 8527807 - DNA, 22 bp, Homo sapiens
ttcatagtgcttaatttgataa

SEQ ID NO: 8527808 - DNA, 22 bp, Homo sapiens
ttcatagtgtttccttccagtg

SEQ ID NO: 8527809 - DNA, 22 bp, Homo sapiens
ttcatagcagtccctttctggg

SEQ ID NO: 8527810 - DNA, 22 bp, Homo sapiens
ttcatagtgacatgcattctgg

SEQ ID NO: 8527811 - DNA, 22 bp, Homo sapiens
ttcatataaatggaatcagaat

SEQ ID NO: 8527812 - DNA, 22 bp, Homo sapiens
ttcatatatatgcactacgtac

SEQ ID NO: 8527813 - DNA, 22 bp, Homo sapiens
ttcatatatatgcactacgtac

SEQ ID NO: 8527814 - DNA, 22 bp, Homo sapiens
ttcatatgcagattaacaaata

SEQ ID NO: 8527815 - DNA, 22 bp, Homo sapiens
ttcatatgcagattaacaaata

SEQ ID NO: 8527816 - DNA, 22 bp, Homo sapiens
ttcatattatgatttgaaatgc

SEQ ID NO: 8527817 - DNA, 22 bp, Homo sapiens
ttcatattatgatttgaaatgc

SEQ ID NO: 8527818 - DNA, 22 bp, Homo sapiens
ttcatattcaaatactctgctt

SEQ ID NO: 8527819 - DNA, 22 bp, Homo sapiens
ttcatcaccttggtagcactcc

SEQ ID NO: 8527820 - DNA, 22 bp, Homo sapiens
ttcagacaaatttgaggaagct

SEQ ID NO: 8527821 - DNA, 22 bp, Homo sapiens
ttcatactgtttaagttctgtt

SEQ ID NO: 8527822 - DNA, 22 bp, Homo sapiens
ttcatagagcagctcactgaat

SEQ ID NO: 8527823 - DNA, 22 bp, Homo sapiens
ttcatagagcagctcactgaat

SEQ ID NO: 8527824 - DNA, 22 bp, Homo sapiens
ttcatagagcagctcactgaat

SEQ ID NO: 8527825 - DNA, 22 bp, Homo sapiens
ttcatagagcagctcactgaat

SEQ ID NO: 8527826 - DNA, 22 bp, Homo sapiens
ttcatactgtgtttccaagttt

SEQ ID NO: 8527827 - DNA, 22 bp, Homo sapiens
ttcatacatttttactaacagc

SEQ ID NO: 8527828 - DNA, 22 bp, Homo sapiens
ttcatacatttttactaacagc

SEQ ID NO: 8527829 - DNA, 22 bp, Homo sapiens
ttcaagtactgtagatttcagg

SEQ ID NO: 8527830 - DNA, 22 bp, Homo sapiens
ttcaaggtatggtagctggtca

SEQ ID NO: 8527831 - DNA, 22 bp, Homo sapiens
ttcaagtaacacaaatgcaccc

SEQ ID NO: 8527832 - DNA, 22 bp, Homo sapiens
ttcaagtaatgctactcctatg

SEQ ID NO: 8527833 - DNA, 22 bp, Homo sapiens
ttcaagtcaaggaaagaggtct

SEQ ID NO: 8527834 - DNA, 22 bp, Homo sapiens
ttcaagtcaaggaaagaggtct

SEQ ID NO: 8527835 - DNA, 22 bp, Homo sapiens
ttcaatatctctaagaatgagg

SEQ ID NO: 8527836 - DNA, 22 bp, Homo sapiens
ttcaatatctctaagaatgagg

SEQ ID NO: 8527837 - DNA, 22 bp, Homo sapiens
ttcaatatctctaagaatgagg

SEQ ID NO: 8527838 - DNA, 22 bp, Homo sapiens
ttcactgtatgagagggcttga

SEQ ID NO: 8527839 - DNA, 22 bp, Homo sapiens
ttcaatgatttttagggatcat

SEQ ID NO: 8527840 - DNA, 22 bp, Homo sapiens
ttcactgtactgactgtcttat

SEQ ID NO: 8527841 - DNA, 17 bp, Homo sapiens
ttcaatgattaatgcat

SEQ ID NO: 8527842 - DNA, 22 bp, Homo sapiens
ttcaatcatttttacatagtcc

SEQ ID NO: 8527843 - DNA, 22 bp, Homo sapiens
ttcaatcatttttacatagtcc

SEQ ID NO: 8527844 - DNA, 22 bp, Homo sapiens
ttcagaatatttgttttacatg

SEQ ID NO: 8527845 - DNA, 22 bp, Homo sapiens
ttcagaatatccgtttaagttt

SEQ ID NO: 8527846 - DNA, 22 bp, Homo sapiens
ttcagaagttttcaaaactaag

SEQ ID NO: 8527847 - DNA, 22 bp, Homo sapiens
ttcagaagttttcaaaactaag

SEQ ID NO: 8527848 - DNA, 21 bp, Homo sapiens
ttcagaagttgagggcaggtt

SEQ ID NO: 8527849 - DNA, 21 bp, Homo sapiens
ttcagaagttgagggcaggtt

SEQ ID NO: 8527850 - DNA, 22 bp, Homo sapiens
ttcagaaggattttaacacatg

SEQ ID NO: 8527851 - DNA, 22 bp, Homo sapiens
ttcagaaggattttaacacatg

SEQ ID NO: 8527852 - DNA, 22 bp, Homo sapiens
ttcagaaggtgcagcctgggcc

SEQ ID NO: 8527853 - DNA, 23 bp, Homo sapiens
ttcagaagaaatgagtacaggag

SEQ ID NO: 8527854 - DNA, 23 bp, Homo sapiens
ttcagaagaaatgagtacaggag

SEQ ID NO: 8527855 - DNA, 22 bp, Homo sapiens
ttcagaactgtctgtccttttc

SEQ ID NO: 8527856 - DNA, 22 bp, Homo sapiens
ttcactgtgaactcatattcag

SEQ ID NO: 8527857 - DNA, 22 bp, Homo sapiens
ttcagaaatccctcttctaccc

SEQ ID NO: 8527858 - DNA, 20 bp, Homo sapiens
ttcagaaataaggaatgagg

SEQ ID NO: 8527859 - DNA, 22 bp, Homo sapiens
ttcagaacaaccatggttagat

SEQ ID NO: 8527860 - DNA, 22 bp, Homo sapiens
ttcagaaatgtcagccatcaga

SEQ ID NO: 8527861 - DNA, 22 bp, Homo sapiens
ttcagaaatgaatattggtatt

SEQ ID NO: 8527862 - DNA, 22 bp, Homo sapiens
ttcagaaatgaatattggtatt

SEQ ID NO: 8527863 - DNA, 22 bp, Homo sapiens
ttcagaaatcgagtttcatgtc

SEQ ID NO: 8527864 - DNA, 22 bp, Homo sapiens
ttcagaaatcgagtttcatgtc

SEQ ID NO: 8527865 - DNA, 22 bp, Homo sapiens
ttcagaaatcgagtttcatgtc

SEQ ID NO: 8527866 - DNA, 22 bp, Homo sapiens
ttccaagttaggcgagctggtg

SEQ ID NO: 8527867 - DNA, 22 bp, Homo sapiens
ttccaatggaatcatgtcttga

SEQ ID NO: 8527868 - DNA, 22 bp, Homo sapiens
ttccaatccaaacttcaccttt

SEQ ID NO: 8527869 - DNA, 22 bp, Homo sapiens
ttccaatatttacaatgcatta

SEQ ID NO: 8527870 - DNA, 22 bp, Homo sapiens
ttccataaaggtgatagtatac

SEQ ID NO: 8527871 - DNA, 22 bp, Homo sapiens
ttccataatcaccttattcttt

SEQ ID NO: 8527872 - DNA, 22 bp, Homo sapiens
ttccaagagtcagctgatccca

SEQ ID NO: 8527873 - DNA, 22 bp, Homo sapiens
ttccaagagcctttcttctaga

SEQ ID NO: 8527874 - DNA, 22 bp, Homo sapiens
ttccaagagctttaattgttga

SEQ ID NO: 8527875 - DNA, 22 bp, Homo sapiens
ttccaagagctttaattgttga

SEQ ID NO: 8527876 - DNA, 22 bp, Homo sapiens
ttccaagagtaaattcaaattg

SEQ ID NO: 8527877 - DNA, 22 bp, Homo sapiens
ttccaaggcaacagcctaggct

SEQ ID NO: 8527878 - DNA, 22 bp, Homo sapiens
ttccaaaacaatattctgtgaa

SEQ ID NO: 8527879 - DNA, 22 bp, Homo sapiens
ttcatttttaccgcgtgtcaaa

SEQ ID NO: 8527880 - DNA, 22 bp, Homo sapiens
ttcatcaggcatcatgctcaag

SEQ ID NO: 8527881 - DNA, 23 bp, Homo sapiens
ttcatcagttgctgttgcagaac

SEQ ID NO: 8527882 - DNA, 20 bp, Homo sapiens
ttcatcagcaaagcacagca

SEQ ID NO: 8527883 - DNA, 22 bp, Homo sapiens
ttccaaattccaatcccctgaa

SEQ ID NO: 8527884 - DNA, 22 bp, Homo sapiens
ttccaactttgaaaatgttatg

SEQ ID NO: 8527885 - DNA, 22 bp, Homo sapiens
ttccaagaagtcaacaggtagt

SEQ ID NO: 8527886 - DNA, 22 bp, Homo sapiens
ttcccctgtcacagtggttctc

SEQ ID NO: 8527887 - DNA, 22 bp, Homo sapiens
ttcccctgtcacagtggttctc

SEQ ID NO: 8527888 - DNA, 22 bp, Homo sapiens
ttccccaggggctcctgccttt

SEQ ID NO: 8527889 - DNA, 22 bp, Homo sapiens
ttccccaggctggagtgcagtg

SEQ ID NO: 8527890 - DNA, 22 bp, Homo sapiens
ttccccagggaagctcctgcgc

SEQ ID NO: 8527891 - DNA, 22 bp, Homo sapiens
ttccccagtaacatacatgtga

SEQ ID NO: 8527892 - DNA, 22 bp, Homo sapiens
ttccccagtagtgacaatcaaa

SEQ ID NO: 8527893 - DNA, 22 bp, Homo sapiens
ttccccagtagtgacaatcaaa

SEQ ID NO: 8527894 - DNA, 22 bp, Homo sapiens
ttccccagtaacatacatgtga

SEQ ID NO: 8527895 - DNA, 22 bp, Homo sapiens
ttccccaggtgattctcatggc

SEQ ID NO: 8527896 - DNA, 19 bp, Homo sapiens
ttcccctccccagggatag

SEQ ID NO: 8527897 - DNA, 22 bp, Homo sapiens
ttcccctctcagatctggccta

SEQ ID NO: 8527898 - DNA, 22 bp, Homo sapiens
ttcccatttgtggtagtgaatt

SEQ ID NO: 8527899 - DNA, 22 bp, Homo sapiens
ttcccaggtaattctgaggcag

SEQ ID NO: 8527900 - DNA, 22 bp, Homo sapiens
ttcccaggctgtgctaccagag

SEQ ID NO: 8527901 - DNA, 22 bp, Homo sapiens
ttcccagacctgtaggatcaga

SEQ ID NO: 8527902 - DNA, 22 bp, Homo sapiens
ttcccagactccacactgaggc

SEQ ID NO: 8527903 - DNA, 22 bp, Homo sapiens
ttcccagaatgaatggatggag

SEQ ID NO: 8527904 - DNA, 22 bp, Homo sapiens
ttccattgagtacctggagaca

SEQ ID NO: 8527905 - DNA, 22 bp, Homo sapiens
ttcccagagaaggatgaaaaag

SEQ ID NO: 8527906 - DNA, 22 bp, Homo sapiens
ttcccagagaaggatgaaaaag

SEQ ID NO: 8527907 - DNA, 22 bp, Homo sapiens
ttcccagagataagacgtctta

SEQ ID NO: 8527908 - DNA, 19 bp, Homo sapiens
ttcccagagccatgagtga

SEQ ID NO: 8527909 - DNA, 22 bp, Homo sapiens
ttcccagaggagatttgcttat

SEQ ID NO: 8527910 - DNA, 22 bp, Homo sapiens
ttccatgcctctatttagaatt

SEQ ID NO: 8527911 - DNA, 22 bp, Homo sapiens
ttccatgcaagaagtatggctc

SEQ ID NO: 8527912 - DNA, 22 bp, Homo sapiens
ttccatgcctagaacaggattc

SEQ ID NO: 8527913 - DNA, 22 bp, Homo sapiens
ttccatgagctctgagttcaca

SEQ ID NO: 8527914 - DNA, 22 bp, Homo sapiens
ttccatgcaagaagtatggctc

SEQ ID NO: 8527915 - DNA, 22 bp, Homo sapiens
ttccatgactgaagcaggggcg

SEQ ID NO: 8527916 - DNA, 22 bp, Homo sapiens
ttccatgaaggagactgagaag

SEQ ID NO: 8527917 - DNA, 22 bp, Homo sapiens
ttccatgaaagtgaaatggagc

SEQ ID NO: 8527918 - DNA, 22 bp, Homo sapiens
ttccatattgtactctttggag

SEQ ID NO: 8527919 - DNA, 22 bp, Homo sapiens
ttccatctgctaggtaaatgaa

SEQ ID NO: 8527920 - DNA, 22 bp, Homo sapiens
ttccatcctaataaaagaagtt

SEQ ID NO: 8527921 - DNA, 22 bp, Homo sapiens
ttgcccaccttagtcttcagac

SEQ ID NO: 8527922 - DNA, 22 bp, Homo sapiens
ttgcctcaagattttttattga

SEQ ID NO: 8527923 - DNA, 22 bp, Homo sapiens
ttgcctgctacggtcttcactg

SEQ ID NO: 8527924 - DNA, 22 bp, Homo sapiens
ttgcctttgacggtgcagcagt

SEQ ID NO: 8527925 - DNA, 22 bp, Homo sapiens
ttgcctttaagtataactgctg

SEQ ID NO: 8527926 - DNA, 22 bp, Homo sapiens
ttgcctgctacggtcttcactg

SEQ ID NO: 8527927 - DNA, 22 bp, Homo sapiens
ttgcctgtttgagagctgtgtt

SEQ ID NO: 8527928 - DNA, 22 bp, Homo sapiens
ttgcctgtgtcagcaggtggaa

SEQ ID NO: 8527929 - DNA, 22 bp, Homo sapiens
ttgcctgtgaggattctggttg

SEQ ID NO: 8527930 - DNA, 22 bp, Homo sapiens
ttgcctgtgaacgctgagtcct

SEQ ID NO: 8527931 - DNA, 22 bp, Homo sapiens
ttgctcagcactggagccagct

SEQ ID NO: 8527932 - DNA, 22 bp, Homo sapiens
ttgctcagcactggagccagct

SEQ ID NO: 8527933 - DNA, 22 bp, Homo sapiens
ttgctcaggctggtgtgcagtg

SEQ ID NO: 8527934 - DNA, 22 bp, Homo sapiens
ttgctcaggcttagagctacta

SEQ ID NO: 8527935 - DNA, 22 bp, Homo sapiens
ttgctcaggctggtgtgcagtg

SEQ ID NO: 8527936 - DNA, 22 bp, Homo sapiens
ttgcttcatcagagtaaacaag

SEQ ID NO: 8527937 - DNA, 22 bp, Homo sapiens
ttgcttcctctgtgcaatcctc

SEQ ID NO: 8527938 - DNA, 22 bp, Homo sapiens
ttgctagctggtgtatgcattg

SEQ ID NO: 8527939 - DNA, 22 bp, Homo sapiens
ttgctaatcatatttcatcact

SEQ ID NO: 8527940 - DNA, 22 bp, Homo sapiens
ttgctacatggtttcaaagctg

SEQ ID NO: 8527941 - DNA, 22 bp, Homo sapiens
ttgctaagttatagagtatctt

SEQ ID NO: 8527942 - DNA, 22 bp, Homo sapiens
ttgctaacgctcaccctttgcc

SEQ ID NO: 8527943 - DNA, 22 bp, Homo sapiens
ttgctaatagaagatttgggaa

SEQ ID NO: 8527944 - DNA, 22 bp, Homo sapiens
ttgccaggagctcatctgaggg

SEQ ID NO: 8527945 - DNA, 22 bp, Homo sapiens
ttgccagggaacagggagaggc

SEQ ID NO: 8527946 - DNA, 22 bp, Homo sapiens
ttgccatcccttacctcagtca

SEQ ID NO: 8527947 - DNA, 22 bp, Homo sapiens
ttgcatttgctcatttgatatg

SEQ ID NO: 8527948 - DNA, 22 bp, Homo sapiens
ttgcatttgtttgagtagaatg

SEQ ID NO: 8527949 - DNA, 22 bp, Homo sapiens
ttgcatttgtttgagtagaatg

SEQ ID NO: 8527950 - DNA, 22 bp, Homo sapiens
ttgcatttgtggcatgggtgtt

SEQ ID NO: 8527951 - DNA, 22 bp, Homo sapiens
ttgcattttggttgtaaatatg

SEQ ID NO: 8527952 - DNA, 22 bp, Homo sapiens
ttgcattttggttgtaaatatg

SEQ ID NO: 8527953 - DNA, 22 bp, Homo sapiens
ttgcattttggttgtaaatatg

SEQ ID NO: 8527954 - DNA, 21 bp, Homo sapiens
ttgcattttaagtttactgct

SEQ ID NO: 8527955 - DNA, 22 bp, Homo sapiens
ttgcatttttagatgcttctgt

SEQ ID NO: 8527956 - DNA, 22 bp, Homo sapiens
ttgcatttttgagcacgaagtt

SEQ ID NO: 8527957 - DNA, 22 bp, Homo sapiens
ttgccaccgtcatggccattat

SEQ ID NO: 8527958 - DNA, 22 bp, Homo sapiens
ttgcatttttagatgcttctgt

SEQ ID NO: 8527959 - DNA, 22 bp, Homo sapiens
ttgcatttttacaagtagccag

SEQ ID NO: 8527960 - DNA, 22 bp, Homo sapiens
ttgcattttggttgtaaatatg

SEQ ID NO: 8527961 - DNA, 19 bp, Homo sapiens
ttgcatttcatgtttgatt

SEQ ID NO: 8527962 - DNA, 22 bp, Homo sapiens
ttgcatttcccattgagtaatg

SEQ ID NO: 8527963 - DNA, 22 bp, Homo sapiens
ttgcatttcactttcagtaggc

SEQ ID NO: 8527964 - DNA, 19 bp, Homo sapiens
ttgcatttcatgtttgatt

SEQ ID NO: 8527965 - DNA, 22 bp, Homo sapiens
ttgagtcagtaattccatttct

SEQ ID NO: 8527966 - DNA, 22 bp, Homo sapiens
ttgaggtctttgagcaaacgca

SEQ ID NO: 8527967 - DNA, 22 bp, Homo sapiens
ttgcatttgacaaattatttaa

SEQ ID NO: 8527968 - DNA, 22 bp, Homo sapiens
ttgcatttgacaaattatttaa

SEQ ID NO: 8527969 - DNA, 22 bp, Homo sapiens
ttgcatttcctgtactgtttga

SEQ ID NO: 8527970 - DNA, 22 bp, Homo sapiens
ttgcatttcctgtactgtttga

SEQ ID NO: 8527971 - DNA, 22 bp, Homo sapiens
ttgcatttgatcttgggttctc

SEQ ID NO: 8527972 - DNA, 22 bp, Homo sapiens
ttgcatttgagaaagttctcct

SEQ ID NO: 8527973 - DNA, 22 bp, Homo sapiens
ttgcatttgacaaattatttaa

SEQ ID NO: 8527974 - DNA, 22 bp, Homo sapiens
ttgaggtattgatattttatga

SEQ ID NO: 8527975 - DNA, 20 bp, Homo sapiens
ttgaggtcaaggactaggcc

SEQ ID NO: 8527976 - DNA, 22 bp, Homo sapiens
ttgaggtcaaagaagtgagtgg

SEQ ID NO: 8527977 - DNA, 22 bp, Homo sapiens
ttgaggtcccaaacccactgag

SEQ ID NO: 8527978 - DNA, 22 bp, Homo sapiens
ttgaggtccagtctccacccac

SEQ ID NO: 8527979 - DNA, 22 bp, Homo sapiens
ttgaggtccaggtgtgggcagg

SEQ ID NO: 8527980 - DNA, 22 bp, Homo sapiens
ttgaggtcatctgaagtactag

SEQ ID NO: 8527981 - DNA, 22 bp, Homo sapiens
ttgaggtcatatatatttggca

SEQ ID NO: 8527982 - DNA, 22 bp, Homo sapiens
ttgaggtcaattctgtttcctg

SEQ ID NO: 8527983 - DNA, 22 bp, Homo sapiens
ttgaggtcaagtaaccactgga

SEQ ID NO: 8527984 - DNA, 22 bp, Homo sapiens
ttgaggtctgagactgtgcagg

SEQ ID NO: 8527985 - DNA, 22 bp, Homo sapiens
ttgaggtctctacagaagagtg

SEQ ID NO: 8527986 - DNA, 22 bp, Homo sapiens
ttgaggtccccagtacccactg

SEQ ID NO: 8527987 - DNA, 23 bp, Homo sapiens
ttgaggtcggctctctgagcctg

SEQ ID NO: 8527988 - DNA, 22 bp, Homo sapiens
ttgaggtccctgccttgccttc

SEQ ID NO: 8527989 - DNA, 22 bp, Homo sapiens
ttgaggtcttcaggatcaggct

SEQ ID NO: 8527990 - DNA, 22 bp, Homo sapiens
ttgaggtcttgagtactgggga

SEQ ID NO: 8527991 - DNA, 22 bp, Homo sapiens
ttgaggtcttcattcttgggca

SEQ ID NO: 8527992 - DNA, 22 bp, Homo sapiens
ttgaggtcttcagctgacacct

SEQ ID NO: 8527993 - DNA, 22 bp, Homo sapiens
ttgaggtctgtgtaggcagcaa

SEQ ID NO: 8527994 - DNA, 22 bp, Homo sapiens
ttgaggtctgtgataaaagtca

SEQ ID NO: 8527995 - DNA, 22 bp, Homo sapiens
ttgaggtctggcagtagcgttg

SEQ ID NO: 8527996 - DNA, 22 bp, Homo sapiens
ttggcagaaatgtggctgggag

SEQ ID NO: 8527997 - DNA, 22 bp, Homo sapiens
ttggcagaatgggcagcttgag

SEQ ID NO: 8527998 - DNA, 22 bp, Homo sapiens
ttggcagaattaaccactgaag

SEQ ID NO: 8527999 - DNA, 22 bp, Homo sapiens
ttggcactttgaatgagctcag

SEQ ID NO: 8528000 - DNA, 22 bp, Homo sapiens
ttggcacttcacgagacagcta

SEQ ID NO: 8528001 - DNA, 22 bp, Homo sapiens
ttggcaaaatttaaagaagtga

SEQ ID NO: 8528002 - DNA, 23 bp, Homo sapiens
ttggcaaagcctatgaagtcctc

SEQ ID NO: 8528003 - DNA, 22 bp, Homo sapiens
ttggcaaaatttaaagaagtga

SEQ ID NO: 8528004 - DNA, 22 bp, Homo sapiens
ttggcaaaggactcaaagcagg

SEQ ID NO: 8528005 - DNA, 22 bp, Homo sapiens
ttggcaaaggactcaaagcagg

SEQ ID NO: 8528006 - DNA, 22 bp, Homo sapiens
ttggcaatggaccagccactgg

SEQ ID NO: 8528007 - DNA, 22 bp, Homo sapiens
ttggcaatgtctaaacacattt

SEQ ID NO: 8528008 - DNA, 22 bp, Homo sapiens
ttggcaattcaccaaggctcgc

SEQ ID NO: 8528009 - DNA, 22 bp, Homo sapiens
ttggcacaaatttctgaaataa

SEQ ID NO: 8528010 - DNA, 22 bp, Homo sapiens
ttggcacagagctgcagcctgg

SEQ ID NO: 8528011 - DNA, 22 bp, Homo sapiens
ttggcacctccctaggaagaag

SEQ ID NO: 8528012 - DNA, 22 bp, Homo sapiens
ttggcacctccctaggaagaag

SEQ ID NO: 8528013 - DNA, 22 bp, Homo sapiens
ttggaatcattcttaaaggtct

SEQ ID NO: 8528014 - DNA, 20 bp, Homo sapiens
ttggaatcacctggagaggt

SEQ ID NO: 8528015 - DNA, 22 bp, Homo sapiens
ttggaatagggaggctggcata

SEQ ID NO: 8528016 - DNA, 22 bp, Homo sapiens
ttggaatcctgagatgagaatt

SEQ ID NO: 8528017 - DNA, 22 bp, Homo sapiens
ttggaatctgcaatttaacaaa

SEQ ID NO: 8528018 - DNA, 22 bp, Homo sapiens
ttggaatcctgagatgagaatt

SEQ ID NO: 8528019 - DNA, 22 bp, Homo sapiens
ttggaagagtagagttgaataa

SEQ ID NO: 8528020 - DNA, 22 bp, Homo sapiens
ttggaagaccagaggccttgtc

SEQ ID NO: 8528021 - DNA, 21 bp, Homo sapiens
ttggaatcttaggagtgtggg

SEQ ID NO: 8528022 - DNA, 22 bp, Homo sapiens
ttggaattcagcttgcttataa

SEQ ID NO: 8528023 - DNA, 22 bp, Homo sapiens
ttggaattcaagttgtagctta

SEQ ID NO: 8528024 - DNA, 22 bp, Homo sapiens
ttggaggatgcaatgagggagt

SEQ ID NO: 8528025 - DNA, 21 bp, Homo sapiens
ttggatgtatttatgttttag

SEQ ID NO: 8528026 - DNA, 22 bp, Homo sapiens
ttggagggacagatggctaggc

SEQ ID NO: 8528027 - DNA, 22 bp, Homo sapiens
ttggagggacagatggctaggc

SEQ ID NO: 8528028 - DNA, 22 bp, Homo sapiens
ttggaggcaatgggaaggaggc

SEQ ID NO: 8528029 - DNA, 22 bp, Homo sapiens
ttggaggcaatgggaaggaggc

SEQ ID NO: 8528030 - DNA, 22 bp, Homo sapiens
ttgctttacaaaaattgatggt

SEQ ID NO: 8528031 - DNA, 22 bp, Homo sapiens
ttgctttactttgccattcgtt

SEQ ID NO: 8528032 - DNA, 22 bp, Homo sapiens
ttgctttaaggtatctggagaa

SEQ ID NO: 8528033 - DNA, 22 bp, Homo sapiens
ttgctttaatgagattttgcca

SEQ ID NO: 8528034 - DNA, 22 bp, Homo sapiens
ttgctttaactagtaaatgggg

SEQ ID NO: 8528035 - DNA, 22 bp, Homo sapiens
ttgcttggcccattgcttcagt

SEQ ID NO: 8528036 - DNA, 22 bp, Homo sapiens
ttgcttggcaggcttccagtct

SEQ ID NO: 8528037 - DNA, 22 bp, Homo sapiens
ttgcttgggctggagtgcaatg

SEQ ID NO: 8528038 - DNA, 22 bp, Homo sapiens
ttgcttcttagatattcctctc

SEQ ID NO: 8528039 - DNA, 23 bp, Homo sapiens
ttgcttctgtgcaattcagtact

SEQ ID NO: 8528040 - DNA, 23 bp, Homo sapiens
ttgcttctgtgcaattcagtact

SEQ ID NO: 8528041 - DNA, 22 bp, Homo sapiens
ttgcttctggaactttctgttc

SEQ ID NO: 8528042 - DNA, 22 bp, Homo sapiens
ttgctttaggtatagaatccat

SEQ ID NO: 8528043 - DNA, 22 bp, Homo sapiens
ttgctttagggcaaatatttca

SEQ ID NO: 8528044 - DNA, 22 bp, Homo sapiens
ttggaacagaaacagacaaata

SEQ ID NO: 8528045 - DNA, 23 bp, Homo sapiens
ttggaacacagtaaatgcacaat

SEQ ID NO: 8528046 - DNA, 22 bp, Homo sapiens
ttggaacacagcagctgatttt

SEQ ID NO: 8528047 - DNA, 22 bp, Homo sapiens
ttgctttattcacatctatatt

SEQ ID NO: 8528048 - DNA, 22 bp, Homo sapiens
ttgctttattcacatctatatt

SEQ ID NO: 8528049 - DNA, 22 bp, Homo sapiens
ttggaactgatggccttcatcc

SEQ ID NO: 8528050 - DNA, 22 bp, Homo sapiens
ttggaacttaaccctgataggt

SEQ ID NO: 8528051 - DNA, 22 bp, Homo sapiens
ttggaactggatttcatgtagc

SEQ ID NO: 8528052 - DNA, 22 bp, Homo sapiens
ttggaagaaatatcaatagtgt

SEQ ID NO: 8528053 - DNA, 22 bp, Homo sapiens
ttggaactcaataattcttctt

SEQ ID NO: 8528054 - DNA, 22 bp, Homo sapiens
ttggaactcaataattcttctt

SEQ ID NO: 8528055 - DNA, 22 bp, Homo sapiens
ttggaactggaggaacatgcta

SEQ ID NO: 8528056 - DNA, 22 bp, Homo sapiens
ttggaactcgtgttacttgtat

SEQ ID NO: 8528057 - DNA, 22 bp, Homo sapiens
ttggaagacagtgaaacagcac

SEQ ID NO: 8528058 - DNA, 22 bp, Homo sapiens
ttggaacatgccggggtccagg

SEQ ID NO: 8528059 - DNA, 22 bp, Homo sapiens
ttggaacaggattcaattaaag

SEQ ID NO: 8528060 - DNA, 21 bp, Homo sapiens
ttggcctgatatcttggagca

SEQ ID NO: 8528061 - DNA, 21 bp, Homo sapiens
ttggcctgatatcttggagca

SEQ ID NO: 8528062 - DNA, 22 bp, Homo sapiens
ttggccttccctacctgggcca

SEQ ID NO: 8528063 - DNA, 22 bp, Homo sapiens
ttggccctttatgggatgggca

SEQ ID NO: 8528064 - DNA, 22 bp, Homo sapiens
ttggcctccacattttccaggt

SEQ ID NO: 8528065 - DNA, 22 bp, Homo sapiens
ttggcctcatggacagctcatc

SEQ ID NO: 8528066 - DNA, 22 bp, Homo sapiens
ttggccctgaggaggcagctgc

SEQ ID NO: 8528067 - DNA, 22 bp, Homo sapiens
ttggccctccacctggctgtgc

SEQ ID NO: 8528068 - DNA, 22 bp, Homo sapiens
ttggccctagatgattaagttg

SEQ ID NO: 8528069 - DNA, 22 bp, Homo sapiens
ttggccctggcacacccccacg

SEQ ID NO: 8528070 - DNA, 22 bp, Homo sapiens
ttggccctgaggttatcatcta

SEQ ID NO: 8528071 - DNA, 22 bp, Homo sapiens
ttggccctggggccagcttcga

SEQ ID NO: 8528072 - DNA, 22 bp, Homo sapiens
ttggcagaggccgaggtgaaga

SEQ ID NO: 8528073 - DNA, 22 bp, Homo sapiens
ttggcagagccccagccttgga

SEQ ID NO: 8528074 - DNA, 22 bp, Homo sapiens
ttggcagactgacaatctgttt

SEQ ID NO: 8528075 - DNA, 22 bp, Homo sapiens
ttggcagagggaccagcctaca

SEQ ID NO: 8528076 - DNA, 22 bp, Homo sapiens
ttggcagatgagaccaggggtt

SEQ ID NO: 8528077 - DNA, 22 bp, Homo sapiens
ttggcccagggtcagcggcgct

SEQ ID NO: 8528078 - DNA, 22 bp, Homo sapiens
ttggcccactctcagaatgtgg

SEQ ID NO: 8528079 - DNA, 22 bp, Homo sapiens
ttggccctagactctaagtccg

SEQ ID NO: 8528080 - DNA, 22 bp, Homo sapiens
ttggcagatttgtcagtaagct

SEQ ID NO: 8528081 - DNA, 22 bp, Homo sapiens
ttggcagcagagtgtggtgctc

SEQ ID NO: 8528082 - DNA, 22 bp, Homo sapiens
ttggctggtttcaagaaggcat

SEQ ID NO: 8528083 - DNA, 22 bp, Homo sapiens
ttggctggtaagccaaatgaaa

SEQ ID NO: 8528084 - DNA, 22 bp, Homo sapiens
ttggctgtgaaagcttctcaaa

SEQ ID NO: 8528085 - DNA, 22 bp, Homo sapiens
ttggctgtcactgtcagttcag

SEQ ID NO: 8528086 - DNA, 22 bp, Homo sapiens
ttggctgtatgtacatctgtta

SEQ ID NO: 8528087 - DNA, 22 bp, Homo sapiens
ttggctcagtgtgagggagatg

SEQ ID NO: 8528088 - DNA, 22 bp, Homo sapiens
ttggctcatgctgttttgtgca

SEQ ID NO: 8528089 - DNA, 22 bp, Homo sapiens
ttggctcattaaagatgataat

SEQ ID NO: 8528090 - DNA, 20 bp, Homo sapiens
ttggctcatgcaacacctac

SEQ ID NO: 8528091 - DNA, 22 bp, Homo sapiens
ttggctctaggaaccaaagtga

SEQ ID NO: 8528092 - DNA, 22 bp, Homo sapiens
ttggctcagctgggactgttga

SEQ ID NO: 8528093 - DNA, 22 bp, Homo sapiens
ttggctcagcatcttggtgcca

SEQ ID NO: 8528094 - DNA, 22 bp, Homo sapiens
ttggctcaggctttcattgtaa

SEQ ID NO: 8528095 - DNA, 22 bp, Homo sapiens
ttggctcaggacccctgtgact

SEQ ID NO: 8528096 - DNA, 22 bp, Homo sapiens
ttggctcacctggagcctgttg

SEQ ID NO: 8528097 - DNA, 22 bp, Homo sapiens
ttggctcacatgattatggagg

SEQ ID NO: 8528098 - DNA, 22 bp, Homo sapiens
ttggctcacctgtctacccaga

SEQ ID NO: 8528099 - DNA, 20 bp, Homo sapiens
ttggctcagatttttatggg

SEQ ID NO: 8528100 - DNA, 22 bp, Homo sapiens
ttggcgcccaggacgccgccgc

SEQ ID NO: 8528101 - DNA, 22 bp, Homo sapiens
ttggcgtcttttccatggaaag

SEQ ID NO: 8528102 - DNA, 22 bp, Homo sapiens
ttggctaacacgcgttttgttc

SEQ ID NO: 8528103 - DNA, 22 bp, Homo sapiens
ttggctaacctgggttatcagc

SEQ ID NO: 8528104 - DNA, 22 bp, Homo sapiens
ttggctcacaaggacggttgct

SEQ ID NO: 8528105 - DNA, 22 bp, Homo sapiens
ttggctcaaaacttagattcca

SEQ ID NO: 8528106 - DNA, 22 bp, Homo sapiens
ttggctatgcttgtgttcagtt

SEQ ID NO: 8528107 - DNA, 22 bp, Homo sapiens
ttgggctggcagaggtggtctt

SEQ ID NO: 8528108 - DNA, 22 bp, Homo sapiens
ttgggctggcagaggtggtctt

SEQ ID NO: 8528109 - DNA, 22 bp, Homo sapiens
ttggggaagctttgaaatactt

SEQ ID NO: 8528110 - DNA, 22 bp, Homo sapiens
ttgggctttaattccagagagg

SEQ ID NO: 8528111 - DNA, 22 bp, Homo sapiens
ttggggagttaatgccaaagat

SEQ ID NO: 8528112 - DNA, 22 bp, Homo sapiens
ttggggagttaatgccaaagat

SEQ ID NO: 8528113 - DNA, 22 bp, Homo sapiens
ttggggcacctccccagcattt

SEQ ID NO: 8528114 - DNA, 22 bp, Homo sapiens
ttggggagaaatgaaatgaagt

SEQ ID NO: 8528115 - DNA, 22 bp, Homo sapiens
ttggggaggttgccacattcca

SEQ ID NO: 8528116 - DNA, 22 bp, Homo sapiens
ttgggctgaagtagagggcaga

SEQ ID NO: 8528117 - DNA, 22 bp, Homo sapiens
ttgggctgaagtagagggcaga

SEQ ID NO: 8528118 - DNA, 22 bp, Homo sapiens
ttgggctgaagtagagggcaga

SEQ ID NO: 8528119 - DNA, 22 bp, Homo sapiens
ttgggctgaagtagagggcaga

SEQ ID NO: 8528120 - DNA, 22 bp, Homo sapiens
ttgggctgaggagggcgtggcc

SEQ ID NO: 8528121 - DNA, 23 bp, Homo sapiens
ttgggctcagtggcaggaagagt

SEQ ID NO: 8528122 - DNA, 22 bp, Homo sapiens
ttgggctgaaccctgcagctga

SEQ ID NO: 8528123 - DNA, 22 bp, Homo sapiens
ttgggctcctgttgatcctgtc

SEQ ID NO: 8528124 - DNA, 22 bp, Homo sapiens
ttgggctcaggagtttgagacc

SEQ ID NO: 8528125 - DNA, 18 bp, Homo sapiens
ttggctttgagaactggt

SEQ ID NO: 8528126 - DNA, 18 bp, Homo sapiens
ttggctttgagaactggt

SEQ ID NO: 8528127 - DNA, 22 bp, Homo sapiens
ttggcttttatgcagcttaggt

SEQ ID NO: 8528128 - DNA, 22 bp, Homo sapiens
ttggctttagacctgagactgt

SEQ ID NO: 8528129 - DNA, 22 bp, Homo sapiens
ttggctttcagaatccctatct

SEQ ID NO: 8528130 - DNA, 22 bp, Homo sapiens
ttgggaaacagtatagctaaca

SEQ ID NO: 8528131 - DNA, 22 bp, Homo sapiens
ttgggaaatatggattgttatt

SEQ ID NO: 8528132 - DNA, 22 bp, Homo sapiens
ttggctgtgaggggttgcacag

SEQ ID NO: 8528133 - DNA, 22 bp, Homo sapiens
ttggctgtgcagatcttgccta

SEQ ID NO: 8528134 - DNA, 22 bp, Homo sapiens
ttggctgttttatctcctggtg

SEQ ID NO: 8528135 - DNA, 22 bp, Homo sapiens
ttggctgttttataggtcagtt

SEQ ID NO: 8528136 - DNA, 22 bp, Homo sapiens
ttggcttcctgcacttgagttt

SEQ ID NO: 8528137 - DNA, 22 bp, Homo sapiens
ttggcttcccagagcttacgct

SEQ ID NO: 8528138 - DNA, 22 bp, Homo sapiens
ttggcttcttcgcacagcagta

SEQ ID NO: 8528139 - DNA, 22 bp, Homo sapiens
ttgtatatattcttaaagatgt

SEQ ID NO: 8528140 - DNA, 22 bp, Homo sapiens
ttgtatatattcttaaagatgt

SEQ ID NO: 8528141 - DNA, 22 bp, Homo sapiens
ttgtagtggccaaagaactctt

SEQ ID NO: 8528142 - DNA, 22 bp, Homo sapiens
ttgtatagcccagagagtgaga

SEQ ID NO: 8528143 - DNA, 22 bp, Homo sapiens
ttgtatgctgatcaaaagcttc

SEQ ID NO: 8528144 - DNA, 22 bp, Homo sapiens
ttgtatgctgatgacaccacct

SEQ ID NO: 8528145 - DNA, 22 bp, Homo sapiens
ttgtatgctgtaggcatgcatt

SEQ ID NO: 8528146 - DNA, 21 bp, Homo sapiens
ttgtatgcatacatacacaca

SEQ ID NO: 8528147 - DNA, 22 bp, Homo sapiens
ttgtatgatcaaaagaaatgta

SEQ ID NO: 8528148 - DNA, 22 bp, Homo sapiens
ttgtatgagtatggtgtatagg

SEQ ID NO: 8528149 - DNA, 22 bp, Homo sapiens
ttgtattaattgaaatgaatgc

SEQ ID NO: 8528150 - DNA, 22 bp, Homo sapiens
ttgtattagctgtaaattttct

SEQ ID NO: 8528151 - DNA, 22 bp, Homo sapiens
ttgtattagctgtaaattttct

SEQ ID NO: 8528152 - DNA, 22 bp, Homo sapiens
ttgtatttatattgaatagctt

SEQ ID NO: 8528153 - DNA, 18 bp, Homo sapiens
ttggggtgaggccaggaa

SEQ ID NO: 8528154 - DNA, 22 bp, Homo sapiens
ttggggggttgaggagtagata

SEQ ID NO: 8528155 - DNA, 22 bp, Homo sapiens
ttggggtaaaatgtcgtaagag

SEQ ID NO: 8528156 - DNA, 22 bp, Homo sapiens
ttggggtacgcaggtctgggag

SEQ ID NO: 8528157 - DNA, 22 bp, Homo sapiens
ttggggtaagtttgtcaagctg

SEQ ID NO: 8528158 - DNA, 22 bp, Homo sapiens
ttggggtaaggaaatatggctt

SEQ ID NO: 8528159 - DNA, 22 bp, Homo sapiens
ttggggtacgcaggtctgggag

SEQ ID NO: 8528160 - DNA, 20 bp, Homo sapiens
ttggggcatccaccgaatgg

SEQ ID NO: 8528161 - DNA, 22 bp, Homo sapiens
ttgtagcattttaaatgagcat

SEQ ID NO: 8528162 - DNA, 22 bp, Homo sapiens
ttgtagcattttaaatgagcat

SEQ ID NO: 8528163 - DNA, 22 bp, Homo sapiens
ttgtagcttatcaaggctgttt

SEQ ID NO: 8528164 - DNA, 21 bp, Homo sapiens
ttgtagcttgttagaccatgt

SEQ ID NO: 8528165 - DNA, 22 bp, Homo sapiens
ttgtagcagggatcagaataca

SEQ ID NO: 8528166 - DNA, 22 bp, Homo sapiens
ttgtagcatcaatcagtacttt

SEQ ID NO: 8528167 - DNA, 18 bp, Homo sapiens
ttgtagcaaatggcagtg

SEQ ID NO: 8528168 - DNA, 22 bp, Homo sapiens
ttgtagaatttggatctcggca

SEQ ID NO: 8528169 - DNA, 22 bp, Homo sapiens
ttgtagaatcattatttctagt

SEQ ID NO: 8528170 - DNA, 22 bp, Homo sapiens
ttgtagaatcattatttctagt

SEQ ID NO: 8528171 - DNA, 22 bp, Homo sapiens
ttgtagaaaattctcttggata

SEQ ID NO: 8528172 - DNA, 22 bp, Homo sapiens
ttgtagaaaattagatgcatgg

SEQ ID NO: 8528173 - DNA, 22 bp, Homo sapiens
ttgtgcatttctctgagtgtgt

SEQ ID NO: 8528174 - DNA, 22 bp, Homo sapiens
ttgtgcagagaaatctttcttg

SEQ ID NO: 8528175 - DNA, 22 bp, Homo sapiens
ttgtgcagagttgcctttattt

SEQ ID NO: 8528176 - DNA, 22 bp, Homo sapiens
ttgtgcagagttgcctttattt

SEQ ID NO: 8528177 - DNA, 22 bp, Homo sapiens
ttgtgcctggcttgtattcaca

SEQ ID NO: 8528178 - DNA, 22 bp, Homo sapiens
ttgtgctcctatgagaatctaa

SEQ ID NO: 8528179 - DNA, 22 bp, Homo sapiens
ttgtgcaagaagccagcaccaa

SEQ ID NO: 8528180 - DNA, 22 bp, Homo sapiens
ttgtgataaaacattagacatt

SEQ ID NO: 8528181 - DNA, 22 bp, Homo sapiens
ttgtgagtagtgccgcaataaa

SEQ ID NO: 8528182 - DNA, 22 bp, Homo sapiens
ttgtgatactgagcttggcatt

SEQ ID NO: 8528183 - DNA, 22 bp, Homo sapiens
ttgtgagcattttggtgagctt

SEQ ID NO: 8528184 - DNA, 22 bp, Homo sapiens
ttgtggaagccctatgagagac

SEQ ID NO: 8528185 - DNA, 22 bp, Homo sapiens
ttgtgctcctgtgagaatctag

SEQ ID NO: 8528186 - DNA, 22 bp, Homo sapiens
ttgtgctcctgtgagaatctag

SEQ ID NO: 8528187 - DNA, 22 bp, Homo sapiens
ttgtgctcctatgagaatctaa

SEQ ID NO: 8528188 - DNA, 22 bp, Homo sapiens
ttgttcataaagacagttcaga

SEQ ID NO: 8528189 - DNA, 22 bp, Homo sapiens
ttgttcagaagtttaaagaatt

SEQ ID NO: 8528190 - DNA, 22 bp, Homo sapiens
ttgtggcagaccatgagtctaa

SEQ ID NO: 8528191 - DNA, 22 bp, Homo sapiens
ttgtggattctatttcccagaa

SEQ ID NO: 8528192 - DNA, 22 bp, Homo sapiens
ttgttatttacaacaatcctat

SEQ ID NO: 8528193 - DNA, 22 bp, Homo sapiens
ttgttatttaggtctgggttag

SEQ ID NO: 8528194 - DNA, 22 bp, Homo sapiens
ttgttatttaggtctgggttag

SEQ ID NO: 8528195 - DNA, 22 bp, Homo sapiens
ttgttcatctggaacccagagc

SEQ ID NO: 8528196 - DNA, 22 bp, Homo sapiens
ttgttcatcgtccttgctctgt

SEQ ID NO: 8528197 - DNA, 21 bp, Homo sapiens
ttgttcctatctgcctcctgc

SEQ ID NO: 8528198 - DNA, 22 bp, Homo sapiens
ttgttcattagcgcttgggcac

SEQ ID NO: 8528199 - DNA, 22 bp, Homo sapiens
ttgttctagcctcctgttttga

SEQ ID NO: 8528200 - DNA, 22 bp, Homo sapiens
tttcctttgcccaatacatgtc

SEQ ID NO: 8528201 - DNA, 22 bp, Homo sapiens
tttcctttgcccaatacatgtc

SEQ ID NO: 8528202 - DNA, 22 bp, Homo sapiens
tttcctttgagggtcctacact

SEQ ID NO: 8528203 - DNA, 22 bp, Homo sapiens
tttcctttgggagcatgaattt

SEQ ID NO: 8528204 - DNA, 22 bp, Homo sapiens
tttcccacacagtccactgcag

SEQ ID NO: 8528205 - DNA, 22 bp, Homo sapiens
tttcccagaggtatgaataagt

SEQ ID NO: 8528206 - DNA, 22 bp, Homo sapiens
tttccttcttagcggtgttctt

SEQ ID NO: 8528207 - DNA, 22 bp, Homo sapiens
tttccttgcacattggtttcca

SEQ ID NO: 8528208 - DNA, 22 bp, Homo sapiens
tttccttgcacattggtttcca

SEQ ID NO: 8528209 - DNA, 22 bp, Homo sapiens
tttccttgcctcctgtccttct

SEQ ID NO: 8528210 - DNA, 22 bp, Homo sapiens
tttccttgcacattggtttcca

SEQ ID NO: 8528211 - DNA, 22 bp, Homo sapiens
tttcctttctggtttggtcata

SEQ ID NO: 8528212 - DNA, 22 bp, Homo sapiens
tttccatatttaatcaaaataa

SEQ ID NO: 8528213 - DNA, 22 bp, Homo sapiens
tttccatgatcgttatagaact

SEQ ID NO: 8528214 - DNA, 22 bp, Homo sapiens
tttccatgtgtactggccagaa

SEQ ID NO: 8528215 - DNA, 22 bp, Homo sapiens
tttccatgttatcttgcagact

SEQ ID NO: 8528216 - DNA, 22 bp, Homo sapiens
tttccatgttggtgaaatgagg

SEQ ID NO: 8528217 - DNA, 22 bp, Homo sapiens
tttcccacacagtccactgcag

SEQ ID NO: 8528218 - DNA, 22 bp, Homo sapiens
tttcccaattgagaggttctgt

SEQ ID NO: 8528219 - DNA, 22 bp, Homo sapiens
tttcccaagtgtaaacatggca

SEQ ID NO: 8528220 - DNA, 22 bp, Homo sapiens
tttcccaacagtctctctcaaa

SEQ ID NO: 8528221 - DNA, 22 bp, Homo sapiens
tttcccaagaaaaataattgga

SEQ ID NO: 8528222 - DNA, 22 bp, Homo sapiens
tttctaaaatagattttatggt

SEQ ID NO: 8528223 - DNA, 22 bp, Homo sapiens
tttctaaaatagattttatggt

SEQ ID NO: 8528224 - DNA, 21 bp, Homo sapiens
tttcggtcccagatgcctgtg

SEQ ID NO: 8528225 - DNA, 21 bp, Homo sapiens
tttcgcatgtgttaactgtga

SEQ ID NO: 8528226 - DNA, 22 bp, Homo sapiens
tttcgagggattagctaggact

SEQ ID NO: 8528227 - DNA, 22 bp, Homo sapiens
tttctaagcttagtatgaggca

SEQ ID NO: 8528228 - DNA, 22 bp, Homo sapiens
tttctaagcttagtatgaggca

SEQ ID NO: 8528229 - DNA, 21 bp, Homo sapiens
tttctaaggaggaagaaaaga

SEQ ID NO: 8528230 - DNA, 22 bp, Homo sapiens
tttctaacagcaaatgtttatc

SEQ ID NO: 8528231 - DNA, 22 bp, Homo sapiens
tttctaacgtagacagggaggt

SEQ ID NO: 8528232 - DNA, 22 bp, Homo sapiens
tttctaaatggtggctgcattg

SEQ ID NO: 8528233 - DNA, 22 bp, Homo sapiens
tttctaacgtagacagggaggt

SEQ ID NO: 8528234 - DNA, 22 bp, Homo sapiens
tttctaagaatattgctcttaa

SEQ ID NO: 8528235 - DNA, 22 bp, Homo sapiens
tttctaagacatttgtcatctt

SEQ ID NO: 8528236 - DNA, 22 bp, Homo sapiens
tttcatctctctaaaagacagt

SEQ ID NO: 8528237 - DNA, 22 bp, Homo sapiens
tttcatctctctaaaagacagt

SEQ ID NO: 8528238 - DNA, 22 bp, Homo sapiens
tttcatctatttgctttgtgaa

SEQ ID NO: 8528239 - DNA, 22 bp, Homo sapiens
tttcatctctctaaaagacagt

SEQ ID NO: 8528240 - DNA, 22 bp, Homo sapiens
tttcatctatttgctttgtgaa

SEQ ID NO: 8528241 - DNA, 22 bp, Homo sapiens
tttcatctaacactacataggg

SEQ ID NO: 8528242 - DNA, 22 bp, Homo sapiens
tttcatctaacactacataggg

SEQ ID NO: 8528243 - DNA, 22 bp, Homo sapiens
tttcatcatgttggcagattgg

SEQ ID NO: 8528244 - DNA, 22 bp, Homo sapiens
tttcatcatcaaaatagtgagg

SEQ ID NO: 8528245 - DNA, 22 bp, Homo sapiens
tttcataatgtcacagtcaaaa

SEQ ID NO: 8528246 - DNA, 22 bp, Homo sapiens
tttcatagccttctaatgagtt

SEQ ID NO: 8528247 - DNA, 22 bp, Homo sapiens
tttcatagctgaaaatgttgaa

SEQ ID NO: 8528248 - DNA, 22 bp, Homo sapiens
tttcatatgggcattggcaata

SEQ ID NO: 8528249 - DNA, 22 bp, Homo sapiens
tttcatattattccttgagtct

SEQ ID NO: 8528250 - DNA, 22 bp, Homo sapiens
tttcataatgtcacagtcaaaa

SEQ ID NO: 8528251 - DNA, 22 bp, Homo sapiens
tttcataatagtgcagtttgtt

SEQ ID NO: 8528252 - DNA, 22 bp, Homo sapiens
tttcataatatccagagatttt

SEQ ID NO: 8528253 - DNA, 22 bp, Homo sapiens
tttcataaacagtagaagacta

SEQ ID NO: 8528254 - DNA, 22 bp, Homo sapiens
tttcataacctcaagctacagt

SEQ ID NO: 8528255 - DNA, 22 bp, Homo sapiens
tttccagtgaattagtctgttt

SEQ ID NO: 8528256 - DNA, 22 bp, Homo sapiens
tttccagtgagcaaatgtagaa

SEQ ID NO: 8528257 - DNA, 22 bp, Homo sapiens
tttccagtgattgctgctctca

SEQ ID NO: 8528258 - DNA, 22 bp, Homo sapiens
tttccagggctctgtagaagaa

SEQ ID NO: 8528259 - DNA, 22 bp, Homo sapiens
tttccagggaggaatgtggggt

SEQ ID NO: 8528260 - DNA, 22 bp, Homo sapiens
tttccaggtattaatactgtat

SEQ ID NO: 8528261 - DNA, 23 bp, Homo sapiens
tttccaggtgaccgtcagaatta

SEQ ID NO: 8528262 - DNA, 22 bp, Homo sapiens
tttccagagctgagaaggcttg

SEQ ID NO: 8528263 - DNA, 22 bp, Homo sapiens
tttccagagggtgctcagggcg

SEQ ID NO: 8528264 - DNA, 22 bp, Homo sapiens
tttccagattaagataccactt

SEQ ID NO: 8528265 - DNA, 17 bp, Homo sapiens
tttcatctgggaccacc

SEQ ID NO: 8528266 - DNA, 17 bp, Homo sapiens
tttcatctgggaccacc

SEQ ID NO: 8528267 - DNA, 22 bp, Homo sapiens
tttcatctgtgctgccaagact

SEQ ID NO: 8528268 - DNA, 22 bp, Homo sapiens
tttcatcttatttgtctacatc

SEQ ID NO: 8528269 - DNA, 22 bp, Homo sapiens
tttcatcttatttgtctacatc

SEQ ID NO: 8528270 - DNA, 22 bp, Homo sapiens
tttcatcttcccagagaccttg

SEQ ID NO: 8528271 - DNA, 21 bp, Homo sapiens
tttatttatataggacacatg

SEQ ID NO: 8528272 - DNA, 22 bp, Homo sapiens
tttatttatccttctggattgc

SEQ ID NO: 8528273 - DNA, 22 bp, Homo sapiens
tttatttatccttctggattgc

SEQ ID NO: 8528274 - DNA, 22 bp, Homo sapiens
tttatttatccttctggattgc

SEQ ID NO: 8528275 - DNA, 23 bp, Homo sapiens
tttatttatttaggctgagggat

SEQ ID NO: 8528276 - DNA, 23 bp, Homo sapiens
tttatttatttaggctgagggat

SEQ ID NO: 8528277 - DNA, 21 bp, Homo sapiens
tttatttatataggacacatg

SEQ ID NO: 8528278 - DNA, 21 bp, Homo sapiens
tttatttatataggacacatg

SEQ ID NO: 8528279 - DNA, 21 bp, Homo sapiens
tttatttatataggacacatg

SEQ ID NO: 8528280 - DNA, 21 bp, Homo sapiens
tttatttatataggacacatg

SEQ ID NO: 8528281 - DNA, 22 bp, Homo sapiens
tttatttataagccacttgctg

SEQ ID NO: 8528282 - DNA, 22 bp, Homo sapiens
tttatttataagccacttgctg

SEQ ID NO: 8528283 - DNA, 22 bp, Homo sapiens
tttcaagcataactgggaagag

SEQ ID NO: 8528284 - DNA, 22 bp, Homo sapiens
tttcaagcataactgggaagag

SEQ ID NO: 8528285 - DNA, 22 bp, Homo sapiens
tttcacaagacagctactgttg

SEQ ID NO: 8528286 - DNA, 22 bp, Homo sapiens
tttcacaagtaaagtcctaagt

SEQ ID NO: 8528287 - DNA, 22 bp, Homo sapiens
tttcacaagtttcaggattctg

SEQ ID NO: 8528288 - DNA, 22 bp, Homo sapiens
tttcacaactgcttatttgaga

SEQ ID NO: 8528289 - DNA, 18 bp, Homo sapiens
tttcacaacctccagagg

SEQ ID NO: 8528290 - DNA, 18 bp, Homo sapiens
tttcacaacctccagagg

SEQ ID NO: 8528291 - DNA, 22 bp, Homo sapiens
tttcacaacgttgtggtgagag

SEQ ID NO: 8528292 - DNA, 22 bp, Homo sapiens
tttcacaacgttgtggtgagag

SEQ ID NO: 8528293 - DNA, 22 bp, Homo sapiens
tttcacaacgttgtggtgagag

SEQ ID NO: 8528294 - DNA, 22 bp, Homo sapiens
tttcaagttaaatggggtcttt

SEQ ID NO: 8528295 - DNA, 22 bp, Homo sapiens
tttcaatgacacaaaagagaaa

SEQ ID NO: 8528296 - DNA, 22 bp, Homo sapiens
tttcaatcaccataaagcaact

SEQ ID NO: 8528297 - DNA, 22 bp, Homo sapiens
tttcaataacaaagctcatttt

SEQ ID NO: 8528298 - DNA, 22 bp, Homo sapiens
tttcacatcagaggtagattag

SEQ ID NO: 8528299 - DNA, 22 bp, Homo sapiens
tttcacaggattctgatgtagt

SEQ ID NO: 8528300 - DNA, 22 bp, Homo sapiens
tttcacaggccttttgtagccc

SEQ ID NO: 8528301 - DNA, 22 bp, Homo sapiens
tttcacaggggcaacctccatg

SEQ ID NO: 8528302 - DNA, 22 bp, Homo sapiens
tttcacaggatgctgttttata

SEQ ID NO: 8528303 - DNA, 22 bp, Homo sapiens
tttcacaggatgctgttttata

SEQ ID NO: 8528304 - DNA, 22 bp, Homo sapiens
tttcacaggagttgtaccattt

SEQ ID NO: 8528305 - DNA, 22 bp, Homo sapiens
tttcacaggagtcctttctata

SEQ ID NO: 8528306 - DNA, 22 bp, Homo sapiens
tttcacaggagtcctttctata

SEQ ID NO: 8528307 - DNA, 22 bp, Homo sapiens
tttcacaggaatacccggcttt

SEQ ID NO: 8528308 - DNA, 23 bp, Homo sapiens
tttcacagcttttattctgcatc

SEQ ID NO: 8528309 - DNA, 23 bp, Homo sapiens
tttcacagcttttattctgcatc

SEQ ID NO: 8528310 - DNA, 23 bp, Homo sapiens
tttcacagcttttattctgcatc

SEQ ID NO: 8528311 - DNA, 22 bp, Homo sapiens
tttcacaatcaaatggtgaaat

SEQ ID NO: 8528312 - DNA, 20 bp, Homo sapiens
tttcacaatgaacatgtctc

SEQ ID NO: 8528313 - DNA, 22 bp, Homo sapiens
tttcacaatcaaatggtgaaat

SEQ ID NO: 8528314 - DNA, 22 bp, Homo sapiens
tttcacatgtggaatgccaggt

SEQ ID NO: 8528315 - DNA, 22 bp, Homo sapiens
tttcacatgtggaatgccaggt

SEQ ID NO: 8528316 - DNA, 22 bp, Homo sapiens
tttcacatgtatataggcatta

SEQ ID NO: 8528317 - DNA, 22 bp, Homo sapiens
tttcacatgcagcagggaagtg

SEQ ID NO: 8528318 - DNA, 22 bp, Homo sapiens
tttcacatggaagctctcgaga

SEQ ID NO: 8528319 - DNA, 22 bp, Homo sapiens
tttcacatggactttttgttct

SEQ ID NO: 8528320 - DNA, 22 bp, Homo sapiens
tttcacatcatgggatggaagc

SEQ ID NO: 8528321 - DNA, 22 bp, Homo sapiens
tttcacattcttctgaatctac

SEQ ID NO: 8528322 - DNA, 22 bp, Homo sapiens
tttcacattggcttctatttct

SEQ ID NO: 8528323 - DNA, 22 bp, Homo sapiens
tttcacattcttctgaatctac

SEQ ID NO: 8528324 - DNA, 22 bp, Homo sapiens
tttcacattagatatgtcattt

SEQ ID NO: 8528325 - DNA, 22 bp, Homo sapiens
tttcacattagatatgtcattt

SEQ ID NO: 8528326 - DNA, 22 bp, Homo sapiens
tttcacattcagatatagactt

SEQ ID NO: 8528327 - DNA, 22 bp, Homo sapiens
tttcacatttgttttaagaagt

SEQ ID NO: 8528328 - DNA, 22 bp, Homo sapiens
tttcacatttgttttaagaagt

SEQ ID NO: 8528329 - DNA, 22 bp, Homo sapiens
tttcacatttaggcgtgaattg

SEQ ID NO: 8528330 - DNA, 22 bp, Homo sapiens
tttcagtttgaaggaaaggcca

SEQ ID NO: 8528331 - DNA, 22 bp, Homo sapiens
tttcagtttccagctttgtcat

SEQ ID NO: 8528332 - DNA, 22 bp, Homo sapiens
tttcagtttttgctcgatgtat

SEQ ID NO: 8528333 - DNA, 22 bp, Homo sapiens
tttaggatctctcttgttacat

SEQ ID NO: 8528334 - DNA, 22 bp, Homo sapiens
tttaggatattaatgttcagag

SEQ ID NO: 8528335 - DNA, 22 bp, Homo sapiens
tttaggataactccagttttcc

SEQ ID NO: 8528336 - DNA, 22 bp, Homo sapiens
tttagcttcagttctagcttct

SEQ ID NO: 8528337 - DNA, 22 bp, Homo sapiens
tttagcttgaatcttgtttaaa

SEQ ID NO: 8528338 - DNA, 22 bp, Homo sapiens
tttagcttgaaagttttggagg

SEQ ID NO: 8528339 - DNA, 19 bp, Homo sapiens
tttagcttacgtttcattg

SEQ ID NO: 8528340 - DNA, 22 bp, Homo sapiens
tttagccaatcagcttgggagc

SEQ ID NO: 8528341 - DNA, 22 bp, Homo sapiens
tttagctaagacatagattctt

SEQ ID NO: 8528342 - DNA, 22 bp, Homo sapiens
tttagcatgttcctttcataga

SEQ ID NO: 8528343 - DNA, 23 bp, Homo sapiens
tttagcatgaagcagctggagaa

SEQ ID NO: 8528344 - DNA, 22 bp, Homo sapiens
tttagccaatcagcttgggagc

SEQ ID NO: 8528345 - DNA, 22 bp, Homo sapiens
tttagcattcctgggatgattt

SEQ ID NO: 8528346 - DNA, 22 bp, Homo sapiens
tttagcattactaaaatgaaaa

SEQ ID NO: 8528347 - DNA, 22 bp, Homo sapiens
tttagcattaagcttttcaaat

SEQ ID NO: 8528348 - DNA, 22 bp, Homo sapiens
tttagcattactaaaatgaaaa

SEQ ID NO: 8528349 - DNA, 22 bp, Homo sapiens
tttagcattaagcttttcaaat

SEQ ID NO: 8528350 - DNA, 22 bp, Homo sapiens
tttatctgatattcagcgattt

SEQ ID NO: 8528351 - DNA, 22 bp, Homo sapiens
tttatctgcattctgaccatct

SEQ ID NO: 8528352 - DNA, 22 bp, Homo sapiens
tttatctgctatctgctgtgct

SEQ ID NO: 8528353 - DNA, 22 bp, Homo sapiens
tttagtgtttgcgtgtactcct

SEQ ID NO: 8528354 - DNA, 22 bp, Homo sapiens
tttagtgtggcactgatgttca

SEQ ID NO: 8528355 - DNA, 22 bp, Homo sapiens
tttagtgtggcactgatgttca

SEQ ID NO: 8528356 - DNA, 22 bp, Homo sapiens
tttagtgtagcctaagcagaat

SEQ ID NO: 8528357 - DNA, 22 bp, Homo sapiens
tttagtgtagcctaagcagaat

SEQ ID NO: 8528358 - DNA, 22 bp, Homo sapiens
tttagtgtgacagtccccagta

SEQ ID NO: 8528359 - DNA, 22 bp, Homo sapiens
tttagtgtagcattcagagtca

SEQ ID NO: 8528360 - DNA, 22 bp, Homo sapiens
tttagtgtagcctaagcagaat

SEQ ID NO: 8528361 - DNA, 22 bp, Homo sapiens
tttagtgtaattctgccttttg

SEQ ID NO: 8528362 - DNA, 22 bp, Homo sapiens
tttagtgtagcattcagagtca

SEQ ID NO: 8528363 - DNA, 22 bp, Homo sapiens
tttagtgtaagcataaagaaca

SEQ ID NO: 8528364 - DNA, 22 bp, Homo sapiens
tttagtgtaagcataaagaaca

SEQ ID NO: 8528365 - DNA, 22 bp, Homo sapiens
tttaggcagaacatggactttg

SEQ ID NO: 8528366 - DNA, 22 bp, Homo sapiens
tttagtgctttgctattcatgg

SEQ ID NO: 8528367 - DNA, 22 bp, Homo sapiens
tttaggcagcagtgaggatgaa

SEQ ID NO: 8528368 - DNA, 22 bp, Homo sapiens
tttatctttaggactttgcaga

SEQ ID NO: 8528369 - DNA, 22 bp, Homo sapiens
tttatctttaggactttgcaga

SEQ ID NO: 8528370 - DNA, 22 bp, Homo sapiens
tttatctttaggactttgcaga

SEQ ID NO: 8528371 - DNA, 22 bp, Homo sapiens
tttatctttaggactttgcaga

SEQ ID NO: 8528372 - DNA, 22 bp, Homo sapiens
tttatctgttgtacatttatgc

SEQ ID NO: 8528373 - DNA, 22 bp, Homo sapiens
tttatctgttgtacatttatgc

SEQ ID NO: 8528374 - DNA, 22 bp, Homo sapiens
tttatctgttgtacctgcattg

SEQ ID NO: 8528375 - DNA, 22 bp, Homo sapiens
tttatctgttgtacctgcattg

SEQ ID NO: 8528376 - DNA, 22 bp, Homo sapiens
tttatcttctgcagttctggct

SEQ ID NO: 8528377 - DNA, 22 bp, Homo sapiens
tttatctgtcctttgccagtga

SEQ ID NO: 8528378 - DNA, 22 bp, Homo sapiens
tttatctgtgggagttgtttgg

SEQ ID NO: 8528379 - DNA, 20 bp, Homo sapiens
tttatctgtgggagtggaga

SEQ ID NO: 8528380 - DNA, 22 bp, Homo sapiens
tttatctgtggtaaataacatt

SEQ ID NO: 8528381 - DNA, 22 bp, Homo sapiens
tttatctgtggtaaataacatt

SEQ ID NO: 8528382 - DNA, 22 bp, Homo sapiens
tttatctgtatatctcaagtgt

SEQ ID NO: 8528383 - DNA, 22 bp, Homo sapiens
tttatctgggattttgcagtct

SEQ ID NO: 8528384 - DNA, 22 bp, Homo sapiens
tttatctggactgtgatataaa

SEQ ID NO: 8528385 - DNA, 22 bp, Homo sapiens
tttatctggactgtgatataaa

SEQ ID NO: 8528386 - DNA, 22 bp, Homo sapiens
tttattggaacacagccatgac

SEQ ID NO: 8528387 - DNA, 22 bp, Homo sapiens
tttattgctggccacctgtagc

SEQ ID NO: 8528388 - DNA, 22 bp, Homo sapiens
tttattggatatttacaagata

SEQ ID NO: 8528389 - DNA, 20 bp, Homo sapiens
tttattggcctttcaggaac

SEQ ID NO: 8528390 - DNA, 22 bp, Homo sapiens
tttattgggtgcagtgcccaca

SEQ ID NO: 8528391 - DNA, 22 bp, Homo sapiens
tttattgtctatgaactgcttg

SEQ ID NO: 8528392 - DNA, 22 bp, Homo sapiens
tttattgtgttgaaactgaatt

SEQ ID NO: 8528393 - DNA, 22 bp, Homo sapiens
tttattgtgttgaaactgaatt

SEQ ID NO: 8528394 - DNA, 22 bp, Homo sapiens
tttatttataagccacttgctg

SEQ ID NO: 8528395 - DNA, 22 bp, Homo sapiens
tttattgcatacacaaatgtca

SEQ ID NO: 8528396 - DNA, 22 bp, Homo sapiens
tttattgccctgtagtacagga

SEQ ID NO: 8528397 - DNA, 22 bp, Homo sapiens
tttattgccctgtagtacagga

SEQ ID NO: 8528398 - DNA, 22 bp, Homo sapiens
tttatgtttgacaatgatctgg

SEQ ID NO: 8528399 - DNA, 22 bp, Homo sapiens
tttatgttcctcttgagctttc

SEQ ID NO: 8528400 - DNA, 22 bp, Homo sapiens
tttatgtttgacaatgatctgg

SEQ ID NO: 8528401 - DNA, 22 bp, Homo sapiens
tttatgtttgacaatgatctgg

SEQ ID NO: 8528402 - DNA, 19 bp, Homo sapiens
tttatgtcattgaggtcat

SEQ ID NO: 8528403 - DNA, 22 bp, Homo sapiens
tttatgtcactttgaaagagag

SEQ ID NO: 8528404 - DNA, 22 bp, Homo sapiens
tttatgtgatgcatcccagaaa

SEQ ID NO: 8528405 - DNA, 22 bp, Homo sapiens
tttatgttatgggtaggatcaa

SEQ ID NO: 8528406 - DNA, 22 bp, Homo sapiens
tttatgtcaaaactacagttgg

SEQ ID NO: 8528407 - DNA, 22 bp, Homo sapiens
tttatgtagttacggactatca

SEQ ID NO: 8528408 - DNA, 21 bp, Homo sapiens
tttatgtacttcatagagtag

SEQ ID NO: 8528409 - DNA, 21 bp, Homo sapiens
tttatgtacttcatagagtag

SEQ ID NO: 8528410 - DNA, 21 bp, Homo sapiens
tttatgtacttcatagagtag

SEQ ID NO: 8528411 - DNA, 22 bp, Homo sapiens
tttatctttggatcttcagaaa

SEQ ID NO: 8528412 - DNA, 22 bp, Homo sapiens
tttatctttggatcttcagaaa

SEQ ID NO: 8528413 - DNA, 22 bp, Homo sapiens
tttatctttggatcttcagaaa

SEQ ID NO: 8528414 - DNA, 22 bp, Homo sapiens
tttatctttggatcttcagaaa

SEQ ID NO: 8528415 - DNA, 22 bp, Homo sapiens
tttatgacaagcattactgatt

SEQ ID NO: 8528416 - DNA, 22 bp, Homo sapiens
tttatgaactacagatataact

SEQ ID NO: 8528417 - DNA, 22 bp, Homo sapiens
tttatgaactacagatataact

SEQ ID NO: 8528418 - DNA, 22 bp, Homo sapiens
tttatgaactacagatataact

SEQ ID NO: 8528419 - DNA, 22 bp, Homo sapiens
tttatgaactacagatataact

SEQ ID NO: 8528420 - DNA, 22 bp, Homo sapiens
tttatgaactacagatataact

SEQ ID NO: 8528421 - DNA, 22 bp, Homo sapiens
tttatgacttctaatctgaagc

SEQ ID NO: 8528422 - DNA, 22 bp, Homo sapiens
tttatgagcctcaaatctgagt

SEQ ID NO: 8528423 - DNA, 22 bp, Homo sapiens
tttatgacttctaatctgaagc

SEQ ID NO: 8528424 - DNA, 22 bp, Homo sapiens
tttatgacccaagaagatacca

SEQ ID NO: 8528425 - DNA, 22 bp, Homo sapiens
tttatgacattacaatatcaag

SEQ ID NO: 8528426 - DNA, 22 bp, Homo sapiens
tttatgtacatatccacaagga

SEQ ID NO: 8528427 - DNA, 22 bp, Homo sapiens
tttatgtaatttcataggtgtg

SEQ ID NO: 8528428 - DNA, 22 bp, Homo sapiens
tttatgtaatttcataggtgtg

SEQ ID NO: 8528429 - DNA, 22 bp, Homo sapiens
ttgttgggcatgcagtggctgt

SEQ ID NO: 8528430 - DNA, 22 bp, Homo sapiens
ttgttggtggaattgatgctag

SEQ ID NO: 8528431 - DNA, 22 bp, Homo sapiens
ttgttgttggagccaatatgca

SEQ ID NO: 8528432 - DNA, 22 bp, Homo sapiens
ttgtttaaaagaaatcatagaa

SEQ ID NO: 8528433 - DNA, 22 bp, Homo sapiens
ttgtttaaaagaaatcatagaa

SEQ ID NO: 8528434 - DNA, 22 bp, Homo sapiens
ttgtttaaaagaaatcatagaa

SEQ ID NO: 8528435 - DNA, 22 bp, Homo sapiens
ttgttgaatggataaataaatt

SEQ ID NO: 8528436 - DNA, 22 bp, Homo sapiens
ttgttcttgtctttgccttcac

SEQ ID NO: 8528437 - DNA, 22 bp, Homo sapiens
ttgttctttatcctggaagcct

SEQ ID NO: 8528438 - DNA, 21 bp, Homo sapiens
ttgttcttccagaagcaaagt

SEQ ID NO: 8528439 - DNA, 22 bp, Homo sapiens
tttaaattatagttaatgtctg

SEQ ID NO: 8528440 - DNA, 22 bp, Homo sapiens
tttaaattatagttaatgtctg

SEQ ID NO: 8528441 - DNA, 22 bp, Homo sapiens
tttaaattatagttaatgtctg

SEQ ID NO: 8528442 - DNA, 22 bp, Homo sapiens
tttaacagatgtgaaattttca

SEQ ID NO: 8528443 - DNA, 22 bp, Homo sapiens
tttaaattatagttaatgtctg

SEQ ID NO: 8528444 - DNA, 22 bp, Homo sapiens
tttaaattatagttaatgtctg

SEQ ID NO: 8528445 - DNA, 22 bp, Homo sapiens
ttgtttaaaatgtagcaagaaa

SEQ ID NO: 8528446 - DNA, 22 bp, Homo sapiens
tttaacagatgtgaaattttca

SEQ ID NO: 8528447 - DNA, 22 bp, Homo sapiens
tttaacaggtaaagtaaatgtg

SEQ ID NO: 8528448 - DNA, 22 bp, Homo sapiens
tttaacatgtaattgctgcttt

SEQ ID NO: 8528449 - DNA, 22 bp, Homo sapiens
tttaacatgtaattgctgcttt

SEQ ID NO: 8528450 - DNA, 22 bp, Homo sapiens
tttaacatgtgaattttggaag

SEQ ID NO: 8528451 - DNA, 22 bp, Homo sapiens
tttaacatgtgaattttggaag

SEQ ID NO: 8528452 - DNA, 22 bp, Homo sapiens
tttaacatgttcaagaaacata

SEQ ID NO: 8528453 - DNA, 22 bp, Homo sapiens
tttaacatgttcaagaaacata

SEQ ID NO: 8528454 - DNA, 23 bp, Homo sapiens
tttaactttccaataattcattg

SEQ ID NO: 8528455 - DNA, 22 bp, Homo sapiens
tttaacttgatcagtagagcat

SEQ ID NO: 8528456 - DNA, 22 bp, Homo sapiens
tttaacttagaagagatatcct

SEQ ID NO: 8528457 - DNA, 22 bp, Homo sapiens
tttaacttagaagagatatcct

SEQ ID NO: 8528458 - DNA, 22 bp, Homo sapiens
tttaacttaatctgcttgatga

SEQ ID NO: 8528459 - DNA, 20 bp, Homo sapiens
tttaactggccttctggctc

SEQ ID NO: 8528460 - DNA, 22 bp, Homo sapiens
tttaactggtctcctgctgctt

SEQ ID NO: 8528461 - DNA, 22 bp, Homo sapiens
tttaactctgtcattctcttta

SEQ ID NO: 8528462 - DNA, 22 bp, Homo sapiens
tttaactctgtcattctcttta

SEQ ID NO: 8528463 - DNA, 22 bp, Homo sapiens
tttaacatgttcaagaaacata

SEQ ID NO: 8528464 - DNA, 23 bp, Homo sapiens
tttaacatttgaacatgtggcca

SEQ ID NO: 8528465 - DNA, 22 bp, Homo sapiens
tttaacatgttcaagaaacata

SEQ ID NO: 8528466 - DNA, 22 bp, Homo sapiens
tttaactcctagtgtgtattag

SEQ ID NO: 8528467 - DNA, 22 bp, Homo sapiens
tttaacctgtcaatttgcatgc

SEQ ID NO: 8528468 - DNA, 22 bp, Homo sapiens
tttaacctctaatttagttctc

SEQ ID NO: 8528469 - DNA, 22 bp, Homo sapiens
tttaaccagtttacaaagaatt

SEQ ID NO: 8528470 - DNA, 23 bp, Homo sapiens
tttaacatttgaacatgtggcca

SEQ ID NO: 8528471 - DNA, 19 bp, Homo sapiens
tttacaagttctttgtatg

SEQ ID NO: 8528472 - DNA, 22 bp, Homo sapiens
tttacaagtttacagaatgatg

SEQ ID NO: 8528473 - DNA, 22 bp, Homo sapiens
tttacacattattttcagtgtg

SEQ ID NO: 8528474 - DNA, 22 bp, Homo sapiens
tttacacattattttcagtgtg

SEQ ID NO: 8528475 - DNA, 22 bp, Homo sapiens
tttacactgccattctgaatac

SEQ ID NO: 8528476 - DNA, 22 bp, Homo sapiens
tttacactgacagcacataagg

SEQ ID NO: 8528477 - DNA, 22 bp, Homo sapiens
tttacactgacagcacataagg

SEQ ID NO: 8528478 - DNA, 22 bp, Homo sapiens
tttacactgcttgaacaatctc

SEQ ID NO: 8528479 - DNA, 22 bp, Homo sapiens
tttacactgtgaaacaggtatc

SEQ ID NO: 8528480 - DNA, 22 bp, Homo sapiens
tttacacattattttcagtgtg

SEQ ID NO: 8528481 - DNA, 22 bp, Homo sapiens
tttacacattattttcagtgtg

SEQ ID NO: 8528482 - DNA, 22 bp, Homo sapiens
tttacaccaaaatgacacagag

SEQ ID NO: 8528483 - DNA, 22 bp, Homo sapiens
tttacactcctggaaatgatat

SEQ ID NO: 8528484 - DNA, 22 bp, Homo sapiens
tttacacggcattatcttcatg

SEQ ID NO: 8528485 - DNA, 22 bp, Homo sapiens
tttaagagcctgtacaaatatt

SEQ ID NO: 8528486 - DNA, 22 bp, Homo sapiens
tttaagagctagtatgtcattt

SEQ ID NO: 8528487 - DNA, 22 bp, Homo sapiens
tttaagagttaaactttgacct

SEQ ID NO: 8528488 - DNA, 22 bp, Homo sapiens
tttaagagctagtatgtcattt

SEQ ID NO: 8528489 - DNA, 22 bp, Homo sapiens
tttaagatctatcccattttgt

SEQ ID NO: 8528490 - DNA, 22 bp, Homo sapiens
tttaagatcatttgtattatcc

SEQ ID NO: 8528491 - DNA, 22 bp, Homo sapiens
tttaagatcatttgtattatcc

SEQ ID NO: 8528492 - DNA, 22 bp, Homo sapiens
tttaagaagttatgttataaat

SEQ ID NO: 8528493 - DNA, 22 bp, Homo sapiens
tttaagaagttatgttataaat

SEQ ID NO: 8528494 - DNA, 22 bp, Homo sapiens
tttaagactcttgtagtacaca

SEQ ID NO: 8528495 - DNA, 22 bp, Homo sapiens
tttaagacttaggaaagaggat

SEQ ID NO: 8528496 - DNA, 22 bp, Homo sapiens
tttaagagcatttgcaatttat

SEQ ID NO: 8528497 - DNA, 22 bp, Homo sapiens
tttacagagagagaactggact

SEQ ID NO: 8528498 - DNA, 22 bp, Homo sapiens
tttacagaggtgtcctgcattg

SEQ ID NO: 8528499 - DNA, 22 bp, Homo sapiens
tttacagatctgttgatttgtt

SEQ ID NO: 8528500 - DNA, 22 bp, Homo sapiens
tttacagacaacttaatagggg

SEQ ID NO: 8528501 - DNA, 22 bp, Homo sapiens
tttacagagaatgtacataaag

SEQ ID NO: 8528502 - DNA, 22 bp, Homo sapiens
tttacagagaatgtacataaag

SEQ ID NO: 8528503 - DNA, 22 bp, Homo sapiens
tttacagagaatgtacataaag

SEQ ID NO: 8528504 - DNA, 22 bp, Homo sapiens
tttacagaagagaaggatgctt

SEQ ID NO: 8528505 - DNA, 22 bp, Homo sapiens
tttacagaagagaaggatgctt

SEQ ID NO: 8528506 - DNA, 22 bp, Homo sapiens
tttacacttgaggaaactgagg

SEQ ID NO: 8528507 - DNA, 22 bp, Homo sapiens
tttacactttcctgggaacatc

SEQ ID NO: 8528508 - DNA, 22 bp, Homo sapiens
tttacacttgaggaaactgagg

SEQ ID NO: 8528509 - DNA, 22 bp, Homo sapiens
tttacagaatgtcaatttctat

SEQ ID NO: 8528510 - DNA, 22 bp, Homo sapiens
tttacagaatgtcaatttctat

SEQ ID NO: 8528511 - DNA, 22 bp, Homo sapiens
tttacagaatgttgaatttggg

SEQ ID NO: 8528512 - DNA, 22 bp, Homo sapiens
tttacagaatgttgaatttggg

SEQ ID NO: 8528513 - DNA, 22 bp, Homo sapiens
tttacagatctgttgatttgtt

SEQ ID NO: 8528514 - DNA, 22 bp, Homo sapiens
tttacagatgaggaaactgaga

SEQ ID NO: 8528515 - DNA, 22 bp, Homo sapiens
tttacagatgaggaaactgaga

SEQ ID NO: 8528516 - DNA, 22 bp, Homo sapiens
tttacagatgaggatactgagg

SEQ ID NO: 8528517 - DNA, 22 bp, Homo sapiens
tttacagatgaggatactgagg

SEQ ID NO: 8528518 - DNA, 22 bp, Homo sapiens
tttacagatgaggatactgagg

SEQ ID NO: 8528519 - DNA, 22 bp, Homo sapiens
tttacagcaacagtgcagaggt

SEQ ID NO: 8528520 - DNA, 22 bp, Homo sapiens
tttacagcaacagtgcagaggt

SEQ ID NO: 8528521 - DNA, 22 bp, Homo sapiens
tttacagattctgggtattagg

SEQ ID NO: 8528522 - DNA, 22 bp, Homo sapiens
tttacagctagacatacctgag

SEQ ID NO: 8528523 - DNA, 22 bp, Homo sapiens
tttacagcagcatgatttataa

SEQ ID NO: 8528524 - DNA, 22 bp, Homo sapiens
tttacagctactgtcctatttc

SEQ ID NO: 8528525 - DNA, 22 bp, Homo sapiens
tttacagcattgctgaaagttc

SEQ ID NO: 8528526 - DNA, 22 bp, Homo sapiens
tttacagatgtggaaagtgagc

SEQ ID NO: 8528527 - DNA, 22 bp, Homo sapiens
tttacagatgtggaaagtgagc

SEQ ID NO: 8528528 - DNA, 22 bp, Homo sapiens
tttacagatgtggaaagtgagc

SEQ ID NO: 8528529 - DNA, 22 bp, Homo sapiens
tttctattggcgtcactgttgt

SEQ ID NO: 8528530 - DNA, 22 bp, Homo sapiens
tttctattggcgtcactgttgt

SEQ ID NO: 8528531 - DNA, 22 bp, Homo sapiens
tttctattggcgtcactgttgt

SEQ ID NO: 8528532 - DNA, 21 bp, Homo sapiens
tttgaaagtgggtgattcttt

SEQ ID NO: 8528533 - DNA, 22 bp, Homo sapiens
tttctattggcgtcactgttgt

SEQ ID NO: 8528534 - DNA, 22 bp, Homo sapiens
tttctattgatctaataaacat

SEQ ID NO: 8528535 - DNA, 22 bp, Homo sapiens
tttctattgatctaataaacat

SEQ ID NO: 8528536 - DNA, 22 bp, Homo sapiens
tttctatctagggttagagtga

SEQ ID NO: 8528537 - DNA, 22 bp, Homo sapiens
tttctatctgagaagatatcta

SEQ ID NO: 8528538 - DNA, 20 bp, Homo sapiens
tttctatggggccagcacat

SEQ ID NO: 8528539 - DNA, 22 bp, Homo sapiens
tttgaaatctaatcaaggaaca

SEQ ID NO: 8528540 - DNA, 22 bp, Homo sapiens
tttgaaatctaatcaaggaaca

SEQ ID NO: 8528541 - DNA, 22 bp, Homo sapiens
tttgaaatctaatcaaggaaca

SEQ ID NO: 8528542 - DNA, 22 bp, Homo sapiens
tttgaaagtgtttacttgggaa

SEQ ID NO: 8528543 - DNA, 22 bp, Homo sapiens
tttgaaagttcttctgacacta

SEQ ID NO: 8528544 - DNA, 22 bp, Homo sapiens
tttgaaatatgaggcattatga

SEQ ID NO: 8528545 - DNA, 22 bp, Homo sapiens
tttgaaatatgaggcattatga

SEQ ID NO: 8528546 - DNA, 22 bp, Homo sapiens
tttgaaatatgaggcattatga

SEQ ID NO: 8528547 - DNA, 22 bp, Homo sapiens
tttctagtctcgatctcttaat

SEQ ID NO: 8528548 - DNA, 22 bp, Homo sapiens
tttctagtcagccatatctagt

SEQ ID NO: 8528549 - DNA, 22 bp, Homo sapiens
tttctagtcctcatgcatcatt

SEQ ID NO: 8528550 - DNA, 22 bp, Homo sapiens
tttctagtaaaagctaattacc

SEQ ID NO: 8528551 - DNA, 22 bp, Homo sapiens
tttctagtcttccctacctccc

SEQ ID NO: 8528552 - DNA, 22 bp, Homo sapiens
tttctagtggttaagatttaca

SEQ ID NO: 8528553 - DNA, 22 bp, Homo sapiens
tttctagtctcgatctcttaat

SEQ ID NO: 8528554 - DNA, 22 bp, Homo sapiens
tttctataaaaagtgctaggat

SEQ ID NO: 8528555 - DNA, 22 bp, Homo sapiens
tttctataactggactggattg

SEQ ID NO: 8528556 - DNA, 22 bp, Homo sapiens
tttctatatcttacctattgta

SEQ ID NO: 8528557 - DNA, 22 bp, Homo sapiens
tttctagatgcggggcttgtgc

SEQ ID NO: 8528558 - DNA, 22 bp, Homo sapiens
tttctagctgtaggaagctgag

SEQ ID NO: 8528559 - DNA, 22 bp, Homo sapiens
tttctagctgacaaaaatgttt

SEQ ID NO: 8528560 - DNA, 17 bp, Homo sapiens
tttctagattatcctct

SEQ ID NO: 8528561 - DNA, 22 bp, Homo sapiens
tttctagcaagaaagaggtgga

SEQ ID NO: 8528562 - DNA, 22 bp, Homo sapiens
tttctagctgtaggaagctgag

SEQ ID NO: 8528563 - DNA, 22 bp, Homo sapiens
tttctagactcaaagaggatat

SEQ ID NO: 8528564 - DNA, 22 bp, Homo sapiens
tttctagacatttctatgtaca

SEQ ID NO: 8528565 - DNA, 22 bp, Homo sapiens
tttctagacatttctatgtaca

SEQ ID NO: 8528566 - DNA, 22 bp, Homo sapiens
tttctagaggctccaggggagt

SEQ ID NO: 8528567 - DNA, 22 bp, Homo sapiens
tttctagagtgggcatgtctta

SEQ ID NO: 8528568 - DNA, 22 bp, Homo sapiens
tttctagagtgggcatgtctta

SEQ ID NO: 8528569 - DNA, 22 bp, Homo sapiens
tttctagagttcatcatggtaa

SEQ ID NO: 8528570 - DNA, 22 bp, Homo sapiens
tttctagatcaaacttttatat

SEQ ID NO: 8528571 - DNA, 22 bp, Homo sapiens
tttgaagacatttgaatacttt

SEQ ID NO: 8528572 - DNA, 22 bp, Homo sapiens
tttgaagacatttgaatacttt

SEQ ID NO: 8528573 - DNA, 22 bp, Homo sapiens
tttgaagaccttatctctaaat

SEQ ID NO: 8528574 - DNA, 22 bp, Homo sapiens
tttgaagaccttatctctaaat

SEQ ID NO: 8528575 - DNA, 22 bp, Homo sapiens
tttgaagactactgggagtgaa

SEQ ID NO: 8528576 - DNA, 23 bp, Homo sapiens
tttgacagcgtggtttctgtggg

SEQ ID NO: 8528577 - DNA, 22 bp, Homo sapiens
tttgaagactactgggagtgaa

SEQ ID NO: 8528578 - DNA, 22 bp, Homo sapiens
tttgaagacagatcaatataag

SEQ ID NO: 8528579 - DNA, 22 bp, Homo sapiens
tttgaagacatattgttacata

SEQ ID NO: 8528580 - DNA, 22 bp, Homo sapiens
tttgaagacagatcaatataag

SEQ ID NO: 8528581 - DNA, 22 bp, Homo sapiens
tttgaagaagctgacctatttt

SEQ ID NO: 8528582 - DNA, 20 bp, Homo sapiens
tttgaactttgtactctgtt

SEQ ID NO: 8528583 - DNA, 20 bp, Homo sapiens
tttgaactttgtactctgtt

SEQ ID NO: 8528584 - DNA, 22 bp, Homo sapiens
tttgaacttctccattctgatg

SEQ ID NO: 8528585 - DNA, 22 bp, Homo sapiens
tttgaacttctacctgtcatat

SEQ ID NO: 8528586 - DNA, 22 bp, Homo sapiens
tttgaacttctacctgtcatat

SEQ ID NO: 8528587 - DNA, 22 bp, Homo sapiens
tttgaacaggagtatctatagt

SEQ ID NO: 8528588 - DNA, 22 bp, Homo sapiens
tttgaacaggagtatctatagt

SEQ ID NO: 8528589 - DNA, 22 bp, Homo sapiens
tttgaacagggaatgttccaca

SEQ ID NO: 8528590 - DNA, 22 bp, Homo sapiens
tttgaacaagagcttcacatta

SEQ ID NO: 8528591 - DNA, 22 bp, Homo sapiens
tttgaactacctctccttagca

SEQ ID NO: 8528592 - DNA, 21 bp, Homo sapiens
tttgaactagaggtaaattcc

SEQ ID NO: 8528593 - DNA, 22 bp, Homo sapiens
tttgaactgttctaggatttaa

SEQ ID NO: 8528594 - DNA, 22 bp, Homo sapiens
tttgaactgataatcttctgtt

SEQ ID NO: 8528595 - DNA, 22 bp, Homo sapiens
tttgaactgataatcttctgtt

SEQ ID NO: 8528596 - DNA, 22 bp, Homo sapiens
tttgaactcagcttcagacaac

SEQ ID NO: 8528597 - DNA, 23 bp, Homo sapiens
tttgaacatttctagattacata

SEQ ID NO: 8528598 - DNA, 22 bp, Homo sapiens
tttgaacatgctgcatgataat

SEQ ID NO: 8528599 - DNA, 22 bp, Homo sapiens
tttgaacatgctgcatgataat

SEQ ID NO: 8528600 - DNA, 22 bp, Homo sapiens
tttgaacatgctgcatgataat

SEQ ID NO: 8528601 - DNA, 22 bp, Homo sapiens
tttgagaaggtgacaaattcta

SEQ ID NO: 8528602 - DNA, 22 bp, Homo sapiens
tttgagaagctgtcttgggctc

SEQ ID NO: 8528603 - DNA, 22 bp, Homo sapiens
tttgagaagtaattcaagacat

SEQ ID NO: 8528604 - DNA, 22 bp, Homo sapiens
tttgacattgaaagcagaatcg

SEQ ID NO: 8528605 - DNA, 22 bp, Homo sapiens
tttgacattgccaatttgctca

SEQ ID NO: 8528606 - DNA, 22 bp, Homo sapiens
tttgagaagcatctggtccact

SEQ ID NO: 8528607 - DNA, 22 bp, Homo sapiens
tttgacattaaggaacatatat

SEQ ID NO: 8528608 - DNA, 22 bp, Homo sapiens
tttgacattatcctgttactgg

SEQ ID NO: 8528609 - DNA, 22 bp, Homo sapiens
tttgacatgcaaagcactttag

SEQ ID NO: 8528610 - DNA, 22 bp, Homo sapiens
tttgacatgtgcttataacttt

SEQ ID NO: 8528611 - DNA, 22 bp, Homo sapiens
tttgacaggactaacatatggc

SEQ ID NO: 8528612 - DNA, 22 bp, Homo sapiens
tttgacagtcccctgatgtttg

SEQ ID NO: 8528613 - DNA, 22 bp, Homo sapiens
tttgacagtgatgatatataca

SEQ ID NO: 8528614 - DNA, 22 bp, Homo sapiens
tttgacatctaagaattcttac

SEQ ID NO: 8528615 - DNA, 22 bp, Homo sapiens
tttgacatcaataccctagaat

SEQ ID NO: 8528616 - DNA, 22 bp, Homo sapiens
tttggctgagaagttgtgcttt

SEQ ID NO: 8528617 - DNA, 22 bp, Homo sapiens
tttggcttgcactggcaccaac

SEQ ID NO: 8528618 - DNA, 22 bp, Homo sapiens
tttggctctggttctggctcca

SEQ ID NO: 8528619 - DNA, 22 bp, Homo sapiens
tttggctctgtgtcttcaccca

SEQ ID NO: 8528620 - DNA, 19 bp, Homo sapiens
tttggctctggtcagagag

SEQ ID NO: 8528621 - DNA, 22 bp, Homo sapiens
tttggctctgcgtcttcaccca

SEQ ID NO: 8528622 - DNA, 23 bp, Homo sapiens
tttggctccatgggtggctcatt

SEQ ID NO: 8528623 - DNA, 22 bp, Homo sapiens
tttggctcggctgctgatggtg

SEQ ID NO: 8528624 - DNA, 22 bp, Homo sapiens
tttgcttgattaggatatggaa

SEQ ID NO: 8528625 - DNA, 22 bp, Homo sapiens
tttggcatttaataggtgatca

SEQ ID NO: 8528626 - DNA, 22 bp, Homo sapiens
tttgggcagtagatgtatcact

SEQ ID NO: 8528627 - DNA, 22 bp, Homo sapiens
tttgggcaggcttttccctaga

SEQ ID NO: 8528628 - DNA, 22 bp, Homo sapiens
tttggggctcagcaggctgttt

SEQ ID NO: 8528629 - DNA, 22 bp, Homo sapiens
tttggggagacatggccagctg

SEQ ID NO: 8528630 - DNA, 22 bp, Homo sapiens
tttgggctggtttgccatgccc

SEQ ID NO: 8528631 - DNA, 22 bp, Homo sapiens
tttgtcatgtccttaactgtct

SEQ ID NO: 8528632 - DNA, 21 bp, Homo sapiens
tttgtccacctgtgttcacca

SEQ ID NO: 8528633 - DNA, 22 bp, Homo sapiens
tttgtcatgttttgtaatgtct

SEQ ID NO: 8528634 - DNA, 22 bp, Homo sapiens
tttgtcctctccatgtacaata

SEQ ID NO: 8528635 - DNA, 22 bp, Homo sapiens
tttgtcctataatcctcttaca

SEQ ID NO: 8528636 - DNA, 22 bp, Homo sapiens
tttgcattgtaatatttagttc

SEQ ID NO: 8528637 - DNA, 22 bp, Homo sapiens
tttgcattgtttcaaaagtgaa

SEQ ID NO: 8528638 - DNA, 22 bp, Homo sapiens
tttgcttcacaagtatggttct

SEQ ID NO: 8528639 - DNA, 22 bp, Homo sapiens
tttgcttcacaagtatggttct

SEQ ID NO: 8528640 - DNA, 20 bp, Homo sapiens
tttgctgtgggtgtaagaat

SEQ ID NO: 8528641 - DNA, 20 bp, Homo sapiens
tttgctgtgggtgtaagaat

SEQ ID NO: 8528642 - DNA, 22 bp, Homo sapiens
tttgctgtgggatatccatgtg

SEQ ID NO: 8528643 - DNA, 22 bp, Homo sapiens
tttgctgtgaatccattactgt

SEQ ID NO: 8528644 - DNA, 22 bp, Homo sapiens
tttgctgaactaaaattctgaa

SEQ ID NO: 8528645 - DNA, 22 bp, Homo sapiens
tttgctgaatagattgtaaact

SEQ ID NO: 8528646 - DNA, 22 bp, Homo sapiens
tttgcagtttcattgctgaaat

SEQ ID NO: 8528647 - DNA, 22 bp, Homo sapiens
tttgcagtgttcatcagtattt

SEQ ID NO: 8528648 - DNA, 22 bp, Homo sapiens
tttgcataggatggacatttta

SEQ ID NO: 8528649 - DNA, 22 bp, Homo sapiens
tttgcataagtcatgtccagtg

SEQ ID NO: 8528650 - DNA, 22 bp, Homo sapiens
tttgcataaaggagcatttctc

SEQ ID NO: 8528651 - DNA, 22 bp, Homo sapiens
tttgcattacttgactttagtt

SEQ ID NO: 8528652 - DNA, 20 bp, Homo sapiens
tttgagaccagtctgcccaa

SEQ ID NO: 8528653 - DNA, 20 bp, Homo sapiens
tttgagaccagtctgcccaa

SEQ ID NO: 8528654 - DNA, 20 bp, Homo sapiens
tttgagaccagtctgcccaa

SEQ ID NO: 8528655 - DNA, 22 bp, Homo sapiens
tttgagaatggtaagtggatcg

SEQ ID NO: 8528656 - DNA, 19 bp, Homo sapiens
tttgagaagttattatcta

SEQ ID NO: 8528657 - DNA, 19 bp, Homo sapiens
tttgagaagttattatcta

SEQ ID NO: 8528658 - DNA, 22 bp, Homo sapiens
tttgagatggagtcttgctctg

SEQ ID NO: 8528659 - DNA, 22 bp, Homo sapiens
tttgagcagagaaaggacatga

SEQ ID NO: 8528660 - DNA, 22 bp, Homo sapiens
tttgcagtgttcatcagtattt

SEQ ID NO: 8528661 - DNA, 19 bp, Homo sapiens
tttgcagtggttcctttgt

SEQ ID NO: 8528662 - DNA, 22 bp, Homo sapiens
tttgcagtgtcagcttctgtgt

SEQ ID NO: 8528663 - DNA, 22 bp, Homo sapiens
tttgagctatgggcttggattt

SEQ ID NO: 8528664 - DNA, 22 bp, Homo sapiens
tttgagcttgtagcattgctat

SEQ ID NO: 8528665 - DNA, 23 bp, Homo sapiens
ttttccagaatcgactctgtaga

SEQ ID NO: 8528666 - DNA, 22 bp, Homo sapiens
ttttcccagagctgtcctcaag

SEQ ID NO: 8528667 - DNA, 21 bp, Homo sapiens
ttttcccactgaaagctccca

SEQ ID NO: 8528668 - DNA, 19 bp, Homo sapiens
ttttcccaccctttagaat

SEQ ID NO: 8528669 - DNA, 22 bp, Homo sapiens
ttttcctactgataaacagtta

SEQ ID NO: 8528670 - DNA, 22 bp, Homo sapiens
ttttcctagtaggcctattaga

SEQ ID NO: 8528671 - DNA, 22 bp, Homo sapiens
ttttcccatctacaaagcaggg

SEQ ID NO: 8528672 - DNA, 22 bp, Homo sapiens
ttttcctactgataaacagtta

SEQ ID NO: 8528673 - DNA, 22 bp, Homo sapiens
ttttcctcacctaactcaaggt

SEQ ID NO: 8528674 - DNA, 22 bp, Homo sapiens
ttttcctatatgcaaagaatgc

SEQ ID NO: 8528675 - DNA, 22 bp, Homo sapiens
ttttcctatatgcaaagaatgc

SEQ ID NO: 8528676 - DNA, 22 bp, Homo sapiens
ttttcctctgcagagcagttag

SEQ ID NO: 8528677 - DNA, 22 bp, Homo sapiens
ttttcctcaggaatgctaagct

SEQ ID NO: 8528678 - DNA, 20 bp, Homo sapiens
ttttcctcgtgtttgttcta

SEQ ID NO: 8528679 - DNA, 22 bp, Homo sapiens
ttttccttagcttctctgcgag

SEQ ID NO: 8528680 - DNA, 22 bp, Homo sapiens
ttttccttaacagagggagaaa

SEQ ID NO: 8528681 - DNA, 22 bp, Homo sapiens
ttttcctctgcagagcagttag

SEQ ID NO: 8528682 - DNA, 22 bp, Homo sapiens
ttttccttcatatcccttatgt

SEQ ID NO: 8528683 - DNA, 22 bp, Homo sapiens
ttttccttcacctcttgagcct

SEQ ID NO: 8528684 - DNA, 22 bp, Homo sapiens
ttttggttctgggatacagaga

SEQ ID NO: 8528685 - DNA, 22 bp, Homo sapiens
ttttggtcaacagtacatgcgg

SEQ ID NO: 8528686 - DNA, 22 bp, Homo sapiens
ttttggtacatgcaatagcaat

SEQ ID NO: 8528687 - DNA, 22 bp, Homo sapiens
ttttggtagaatcaacaatgta

SEQ ID NO: 8528688 - DNA, 22 bp, Homo sapiens
ttttggggagaacggttgctat

SEQ ID NO: 8528689 - DNA, 19 bp, Homo sapiens
ttttccttctatatgtttc

SEQ ID NO: 8528690 - DNA, 22 bp, Homo sapiens
ttttggctctgtctgtatcttt

SEQ ID NO: 8528691 - DNA, 19 bp, Homo sapiens
ttttccttctatatgtttc

SEQ ID NO: 8528692 - DNA, 18 bp, Homo sapiens
ttttccttccaccttgaa

SEQ ID NO: 8528693 - DNA, 17 bp, Homo sapiens
ttttgttcatcttcaaa

SEQ ID NO: 8528694 - DNA, 22 bp, Homo sapiens
tttttgtagtcattagaagagg

SEQ ID NO: 8528695 - DNA, 22 bp, Homo sapiens
ttttgtgttgccatgttaagca

SEQ ID NO: 8528696 - DNA, 22 bp, Homo sapiens
ttttgtgagcccataaatgcca

SEQ ID NO: 8528697 - DNA, 22 bp, Homo sapiens
ttttgtgagcccataaatgcca

SEQ ID NO: 8528698 - DNA, 22 bp, Homo sapiens
ttttgtgagcccataaatgcca

SEQ ID NO: 8528699 - DNA, 22 bp, Homo sapiens
ttttgtgagctccttggaggta

SEQ ID NO: 8528700 - DNA, 22 bp, Homo sapiens
ttttgtgagctgagaaatgtat

SEQ ID NO: 8528701 - DNA, 22 bp, Homo sapiens
ttttgtgagctgagaaatgtat

SEQ ID NO: 8528702 - DNA, 22 bp, Homo sapiens
ttttgtgatggcattacattta

SEQ ID NO: 8528703 - DNA, 22 bp, Homo sapiens
ttttgtctaagaactttgcaaa

SEQ ID NO: 8528704 - DNA, 22 bp, Homo sapiens
ttttgtctaagaactttgcaaa

SEQ ID NO: 8528705 - DNA, 22 bp, Homo sapiens
ttttgtcagtgagaacagagtt

SEQ ID NO: 8528706 - DNA, 22 bp, Homo sapiens
ttttgtgacacttcttgagaca

SEQ ID NO: 8528707 - DNA, 22 bp, Homo sapiens
ttttgtgaatagtttatctaag

SEQ ID NO: 8528708 - DNA, 22 bp, Homo sapiens
ttttgtgaatagtttatctaag

SEQ ID NO: 8528709 - DNA, 22 bp, Homo sapiens
ttttgtgagatgcgtatgaatg

SEQ ID NO: 8528710 - DNA, 22 bp, Homo sapiens
ttttgtgagatgcgtatgaatg

SEQ ID NO: 8528711 - DNA, 22 bp, Homo sapiens
ttttgtgacagaaagattaagt

SEQ ID NO: 8528712 - DNA, 22 bp, Homo sapiens
ttttgtgacagaaagattaagt

SEQ ID NO: 8528713 - DNA, 22 bp, Homo sapiens
ttttgtgacagaaagattaagt

SEQ ID NO: 8528714 - DNA, 22 bp, Homo sapiens
ttttgtatagtcaaagacaaga

SEQ ID NO: 8528715 - DNA, 22 bp, Homo sapiens
ttttgtaagaaactgccaagcc

SEQ ID NO: 8528716 - DNA, 22 bp, Homo sapiens
ttttgtatcctccctttcactg

SEQ ID NO: 8528717 - DNA, 22 bp, Homo sapiens
ttttgtatgagaagtgctttac

SEQ ID NO: 8528718 - DNA, 22 bp, Homo sapiens
ttttgtatgagaagtgctttac

SEQ ID NO: 8528719 - DNA, 22 bp, Homo sapiens
tttttgttcccagagaatttgt

SEQ ID NO: 8528720 - DNA, 22 bp, Homo sapiens
tttttgttgcagagaggccact

SEQ ID NO: 8528721 - DNA, 22 bp, Homo sapiens
tttttgtatatgcttcgaggat

SEQ ID NO: 8528722 - DNA, 22 bp, Homo sapiens
tttttgtcatctatttctggtg

SEQ ID NO: 8528723 - DNA, 22 bp, Homo sapiens
tttttgtatagaaatgaactaa

SEQ ID NO: 8528724 - DNA, 22 bp, Homo sapiens
tttttgtgatatgacactgtat

SEQ ID NO: 8528725 - DNA, 22 bp, Homo sapiens
tttttgtggtgcagactaaagc

SEQ ID NO: 8528726 - DNA, 22 bp, Homo sapiens
tttttgtgtatcctgctccatg

SEQ ID NO: 8528727 - DNA, 22 bp, Homo sapiens
ttttttatagcaatgaacccac

SEQ ID NO: 8528728 - DNA, 22 bp, Homo sapiens
ttttttatagcaatgaacccac

SEQ ID NO: 8528729 - DNA, 22 bp, Homo sapiens
ttttttagttaggtcagaatgt

SEQ ID NO: 8528730 - DNA, 22 bp, Homo sapiens
ttttttatatcaactgaagtct

SEQ ID NO: 8528731 - DNA, 22 bp, Homo sapiens
ttttttatatcaactgaagtct

SEQ ID NO: 8528732 - DNA, 22 bp, Homo sapiens
ttttttatatcaactgaagtct

SEQ ID NO: 8528733 - DNA, 22 bp, Homo sapiens
ttttttccagcttctagaggcc

SEQ ID NO: 8528734 - DNA, 22 bp, Homo sapiens
ttttttatctatggtagtacca

SEQ ID NO: 8528735 - DNA, 22 bp, Homo sapiens
ttttttcagcctgtctgtgcca

SEQ ID NO: 8528736 - DNA, 22 bp, Homo sapiens
ttttttatctatggtagtacca

SEQ ID NO: 8528737 - DNA, 22 bp, Homo sapiens
ttttttatctatggtagtacca

SEQ ID NO: 8528738 - DNA, 22 bp, Homo sapiens
ttttattgtcaatgaagacaga

SEQ ID NO: 8528739 - DNA, 22 bp, Homo sapiens
ttttattgtcaatgaagacaga

SEQ ID NO: 8528740 - DNA, 22 bp, Homo sapiens
ttttattgtcaatgaagacaga

SEQ ID NO: 8528741 - DNA, 22 bp, Homo sapiens
ttttattgtctcccagttctgg

SEQ ID NO: 8528742 - DNA, 22 bp, Homo sapiens
ttttattgtctcccagttctgg

SEQ ID NO: 8528743 - DNA, 22 bp, Homo sapiens
ttttattgtctcccagttctgg

SEQ ID NO: 8528744 - DNA, 22 bp, Homo sapiens
ttttattgtctgtattgcctat

SEQ ID NO: 8528745 - DNA, 22 bp, Homo sapiens
ttttattgtctgtattgcctat

SEQ ID NO: 8528746 - DNA, 22 bp, Homo sapiens
ttttcaagggcagggaaatcat

SEQ ID NO: 8528747 - DNA, 22 bp, Homo sapiens
ttttcacaagggtccaactagt

SEQ ID NO: 8528748 - DNA, 22 bp, Homo sapiens
ttttcaaagactggaggctgat

SEQ ID NO: 8528749 - DNA, 16 bp, Homo sapiens
ttttattgtgacagcc

SEQ ID NO: 8528750 - DNA, 16 bp, Homo sapiens
ttttattgtgacagcc

SEQ ID NO: 8528751 - DNA, 22 bp, Homo sapiens
ttttagaaagatccctggcagg

SEQ ID NO: 8528752 - DNA, 22 bp, Homo sapiens
ttttagaaagatccctggcagg

SEQ ID NO: 8528753 - DNA, 22 bp, Homo sapiens
ttttagaaatactgatttagtg

SEQ ID NO: 8528754 - DNA, 22 bp, Homo sapiens
ttttactttggatacagtactt

SEQ ID NO: 8528755 - DNA, 22 bp, Homo sapiens
ttttagaaatactgatttagtg

SEQ ID NO: 8528756 - DNA, 22 bp, Homo sapiens
ttttagaaatactgatttagtg

SEQ ID NO: 8528757 - DNA, 22 bp, Homo sapiens
ttttagaaggaatgctatggtg

SEQ ID NO: 8528758 - DNA, 22 bp, Homo sapiens
ttttagaaggaatgctatggtg

SEQ ID NO: 8528759 - DNA, 18 bp, Homo sapiens
ttttactcatagcaggcc

SEQ ID NO: 8528760 - DNA, 22 bp, Homo sapiens
ttttacattgggaaatgcctct

SEQ ID NO: 8528761 - DNA, 22 bp, Homo sapiens
ttttacttcattcctgacttca

SEQ ID NO: 8528762 - DNA, 22 bp, Homo sapiens
ttttactttggatacagtactt

SEQ ID NO: 8528763 - DNA, 22 bp, Homo sapiens
ttttacttcattcctgacttca

SEQ ID NO: 8528764 - DNA, 22 bp, Homo sapiens
ttttattggtaatgataaaagt

SEQ ID NO: 8528765 - DNA, 22 bp, Homo sapiens
ttttattggtaatgataaaagt

SEQ ID NO: 8528766 - DNA, 22 bp, Homo sapiens
ttttattggtaatgataaaagt

SEQ ID NO: 8528767 - DNA, 22 bp, Homo sapiens
ttttattggtaatgataaaagt

SEQ ID NO: 8528768 - DNA, 22 bp, Homo sapiens
ttttattggtaatgataaaagt

SEQ ID NO: 8528769 - DNA, 22 bp, Homo sapiens
ttttattggtaatgataaaagt

SEQ ID NO: 8528770 - DNA, 22 bp, Homo sapiens
ttttattggtaatgataaaagt

SEQ ID NO: 8528771 - DNA, 22 bp, Homo sapiens
ttttagaagtgcctatcctatg

SEQ ID NO: 8528772 - DNA, 22 bp, Homo sapiens
ttttattgggagtcctctactg

SEQ ID NO: 8528773 - DNA, 22 bp, Homo sapiens
ttttattgggagtcctctactg

SEQ ID NO: 8528774 - DNA, 22 bp, Homo sapiens
ttttattgggagtcctctactg

SEQ ID NO: 8528775 - DNA, 22 bp, Homo sapiens
tttgtcttaaatcttgttactg

SEQ ID NO: 8528776 - DNA, 22 bp, Homo sapiens
tttgtcttatccaatctctcag

SEQ ID NO: 8528777 - DNA, 22 bp, Homo sapiens
tttgtcttatccaatctctcag

SEQ ID NO: 8528778 - DNA, 22 bp, Homo sapiens
tttgtcttatccaatctctcag

SEQ ID NO: 8528779 - DNA, 19 bp, Homo sapiens
tttgtctctgaataatatt

SEQ ID NO: 8528780 - DNA, 22 bp, Homo sapiens
tttgtctgccttgctggactgt

SEQ ID NO: 8528781 - DNA, 20 bp, Homo sapiens
tttgtctgttaagtgtttct

SEQ ID NO: 8528782 - DNA, 20 bp, Homo sapiens
tttgtctgttaagtgtttct

SEQ ID NO: 8528783 - DNA, 20 bp, Homo sapiens
tttgtctgttaagtgtttct

SEQ ID NO: 8528784 - DNA, 20 bp, Homo sapiens
tttgtctgttaagtgtttct

SEQ ID NO: 8528785 - DNA, 22 bp, Homo sapiens
tttgtccttgaatcaattcaca

SEQ ID NO: 8528786 - DNA, 22 bp, Homo sapiens
tttgtggaactctcttcttgca

SEQ ID NO: 8528787 - DNA, 22 bp, Homo sapiens
tttgtgcagtggttaagaccat

SEQ ID NO: 8528788 - DNA, 22 bp, Homo sapiens
ttttacagtcagtcaaactcag

SEQ ID NO: 8528789 - DNA, 22 bp, Homo sapiens
ttttacaggtgtgagccaccat

SEQ ID NO: 8528790 - DNA, 22 bp, Homo sapiens
ttttacagttccatgcaaagcg

SEQ ID NO: 8528791 - DNA, 22 bp, Homo sapiens
ttttacagttccatgcaaagcg

SEQ ID NO: 8528792 - DNA, 22 bp, Homo sapiens
ttttacagttccatgcaaagcg

SEQ ID NO: 8528793 - DNA, 22 bp, Homo sapiens
ttttacagttccatgcaaagcg

SEQ ID NO: 8528794 - DNA, 22 bp, Homo sapiens
ttttacaggtgaaaaatgaaga

SEQ ID NO: 8528795 - DNA, 22 bp, Homo sapiens
ttttacaggtcataggtatagt

SEQ ID NO: 8528796 - DNA, 21 bp, Homo sapiens
ttttacagatgaggggaaggg

SEQ ID NO: 8528797 - DNA, 22 bp, Homo sapiens
ttttacaggtcataggtatagt

SEQ ID NO: 8528798 - DNA, 22 bp, Homo sapiens
ttttacacctgttaactctaag

SEQ ID NO: 8528799 - DNA, 22 bp, Homo sapiens
ttttacacttcggttgtgtgca

SEQ ID NO: 8528800 - DNA, 22 bp, Homo sapiens
ttttacaagctgagtcgttaaa

SEQ ID NO: 8528801 - DNA, 22 bp, Homo sapiens
ttttacacctcagatgagcaga

SEQ ID NO: 8528802 - DNA, 22 bp, Homo sapiens
ttttacacctcagatgagcaga

SEQ ID NO: 8528803 - DNA, 22 bp, Homo sapiens
ttttacaagctgagtcgttaaa

SEQ ID NO: 8528804 - DNA, 22 bp, Homo sapiens
ttttacaagctgagtcgttaaa

SEQ ID NO: 8528805 - DNA, 22 bp, Homo sapiens
ttttacaagctgagtcgttaaa

SEQ ID NO: 8528806 - DNA, 22 bp, Homo sapiens
ttttaattttagcccttctggt

SEQ ID NO: 8528807 - DNA, 22 bp, Homo sapiens
ttttaattttgcaaatctggtg

SEQ ID NO: 8528808 - DNA, 23 bp, Homo sapiens
ttttaatttggacataagaagat

SEQ ID NO: 8528809 - DNA, 23 bp, Homo sapiens
ttttaatttggacataagaagat

SEQ ID NO: 8528810 - DNA, 23 bp, Homo sapiens
ttttaatttggacataagaagat

SEQ ID NO: 8528811 - DNA, 23 bp, Homo sapiens
ttttaatttggacataagaagat

SEQ ID NO: 8528812 - DNA, 23 bp, Homo sapiens
ttttaatttggacataagaagat

SEQ ID NO: 8528813 - DNA, 22 bp, Homo sapiens
tttgtggcaggagcggagaccg

SEQ ID NO: 8528814 - DNA, 22 bp, Homo sapiens
tttgtggcaggagcggagaccg

SEQ ID NO: 8528815 - DNA, 22 bp, Homo sapiens
tttgtgtatgtatgcttgtaca

SEQ ID NO: 8528816 - DNA, 22 bp, Homo sapiens
ttttttgtagcaagcgcagata

SEQ ID NO: 8528817 - DNA, 21 bp, Homo sapiens
ttttttcttgcgtgaggcctg

SEQ ID NO: 8528818 - DNA, 21 bp, Homo sapiens
ttttttcttgcgtgaggcctg

SEQ ID NO: 8528819 - DNA, 21 bp, Homo sapiens
ttttttcttgcgtgaggcctg

SEQ ID NO: 8528820 - DNA, 22 bp, Homo sapiens
aagagctgtgggtggtagtcct

SEQ ID NO: 8528821 - DNA, 22 bp, Homo sapiens
aagagctgtgggtggtagtcct

SEQ ID NO: 8528822 - DNA, 22 bp, Homo sapiens
aagagcttccctgttgtagagg

SEQ ID NO: 8528823 - DNA, 22 bp, Homo sapiens
aagagcttggactttcaagtca

SEQ ID NO: 8528824 - DNA, 22 bp, Homo sapiens
aagaggaaatgattgactatat

SEQ ID NO: 8528825 - DNA, 22 bp, Homo sapiens
aagaggaactgggggctgagtc

SEQ ID NO: 8528826 - DNA, 22 bp, Homo sapiens
aagaggaactgggggctgagtc

SEQ ID NO: 8528827 - DNA, 22 bp, Homo sapiens
aagagctggtcacaggtccatt

SEQ ID NO: 8528828 - DNA, 22 bp, Homo sapiens
aagagctggctcttgcagcagc

SEQ ID NO: 8528829 - DNA, 22 bp, Homo sapiens
aagagctggctcttgcagcagc

SEQ ID NO: 8528830 - DNA, 22 bp, Homo sapiens
aagagctggctcttgcagcagc

SEQ ID NO: 8528831 - DNA, 22 bp, Homo sapiens
aagagctgtatgccatatgatt

SEQ ID NO: 8528832 - DNA, 22 bp, Homo sapiens
aagagctgtatgccatatgatt

SEQ ID NO: 8528833 - DNA, 22 bp, Homo sapiens
aagagctggtcacaggtccatt

SEQ ID NO: 8528834 - DNA, 22 bp, Homo sapiens
aagagctggagtttgcagccct

SEQ ID NO: 8528835 - DNA, 22 bp, Homo sapiens
aagagctggagtttgcagccct

SEQ ID NO: 8528836 - DNA, 22 bp, Homo sapiens
aagagctggaagtgaagataac

SEQ ID NO: 8528837 - DNA, 22 bp, Homo sapiens
aagagctggagctgctacagga

SEQ ID NO: 8528838 - DNA, 22 bp, Homo sapiens
aagagctggagctgctacagga

SEQ ID NO: 8528839 - DNA, 22 bp, Homo sapiens
aagagctggagctgctacagga

SEQ ID NO: 8528840 - DNA, 22 bp, Homo sapiens
aagagctggagctgctacagga

SEQ ID NO: 8528841 - DNA, 22 bp, Homo sapiens
aagagctggagctgctacagga

SEQ ID NO: 8528842 - DNA, 22 bp, Homo sapiens
aagagctggattgtgctgcaga

SEQ ID NO: 8528843 - DNA, 22 bp, Homo sapiens
aagagctggattgtgctgcaga

SEQ ID NO: 8528844 - DNA, 22 bp, Homo sapiens
aagagctggattgtgctgcaga

SEQ ID NO: 8528845 - DNA, 22 bp, Homo sapiens
aagagctggcccaatctgagca

SEQ ID NO: 8528846 - DNA, 22 bp, Homo sapiens
aagagctggatgaagaaatcaa

SEQ ID NO: 8528847 - DNA, 21 bp, Homo sapiens
aagagctggatcaaggataag

SEQ ID NO: 8528848 - DNA, 21 bp, Homo sapiens
aagagctggatcaaggataag

SEQ ID NO: 8528849 - DNA, 22 bp, Homo sapiens
aagagctggatggaatctggga

SEQ ID NO: 8528850 - DNA, 22 bp, Homo sapiens
acaaggctgctgtgattgggaa

SEQ ID NO: 8528851 - DNA, 22 bp, Homo sapiens
acaaggctaatttggaagatac

SEQ ID NO: 8528852 - DNA, 22 bp, Homo sapiens
acaaggctgaacagtgaagccg

SEQ ID NO: 8528853 - DNA, 23 bp, Homo sapiens
acaaggcaacatagatcagggca

SEQ ID NO: 8528854 - DNA, 22 bp, Homo sapiens
acaaggcaattcctggtgaatt

SEQ ID NO: 8528855 - DNA, 22 bp, Homo sapiens
acaaggcactttatgaagagga

SEQ ID NO: 8528856 - DNA, 22 bp, Homo sapiens
acaaggcagtacaatgatgaca

SEQ ID NO: 8528857 - DNA, 22 bp, Homo sapiens
acaaggcattccggaagtaacc

SEQ ID NO: 8528858 - DNA, 20 bp, Homo sapiens
aagagctgactcacagtggt

SEQ ID NO: 8528859 - DNA, 22 bp, Homo sapiens
aagagcagtgttttactcagct

SEQ ID NO: 8528860 - DNA, 22 bp, Homo sapiens
aagagctgcccaaggtgaacag

SEQ ID NO: 8528861 - DNA, 22 bp, Homo sapiens
aagagctgcatctaagccatga

SEQ ID NO: 8528862 - DNA, 22 bp, Homo sapiens
aagagctgcacatatttatatc

SEQ ID NO: 8528863 - DNA, 22 bp, Homo sapiens
aagagctgattaagtcatgagg

SEQ ID NO: 8528864 - DNA, 22 bp, Homo sapiens
aagagctgattaagtcatgagg

SEQ ID NO: 8528865 - DNA, 22 bp, Homo sapiens
aagagctgattaagtcatgagg

SEQ ID NO: 8528866 - DNA, 20 bp, Homo sapiens
aagagctgactcacagtggt

SEQ ID NO: 8528867 - DNA, 20 bp, Homo sapiens
aagagctgactcacagtggt

SEQ ID NO: 8528868 - DNA, 22 bp, Homo sapiens
aagagctgattaagtcatgagg

SEQ ID NO: 8528869 - DNA, 22 bp, Homo sapiens
aagacatgactgcacagccaaa

SEQ ID NO: 8528870 - DNA, 22 bp, Homo sapiens
aagacatgttttaagaatattt

SEQ ID NO: 8528871 - DNA, 22 bp, Homo sapiens
aagacatgcagtttgttccatt

SEQ ID NO: 8528872 - DNA, 22 bp, Homo sapiens
aagacatgttttaagaatattt

SEQ ID NO: 8528873 - DNA, 22 bp, Homo sapiens
aagacattactggaatctgact

SEQ ID NO: 8528874 - DNA, 22 bp, Homo sapiens
aagacatcagtgatgacatttg

SEQ ID NO: 8528875 - DNA, 22 bp, Homo sapiens
aagacattactggaatctgact

SEQ ID NO: 8528876 - DNA, 20 bp, Homo sapiens
acaaagactggaaaagcaag

SEQ ID NO: 8528877 - DNA, 22 bp, Homo sapiens
acaaagattcatttgcattatt

SEQ ID NO: 8528878 - DNA, 22 bp, Homo sapiens
aagagagaactcccttcgccag

SEQ ID NO: 8528879 - DNA, 22 bp, Homo sapiens
aagagagaacacagcttgggca

SEQ ID NO: 8528880 - DNA, 22 bp, Homo sapiens
acaaagataagtcagaaagtca

SEQ ID NO: 8528881 - DNA, 22 bp, Homo sapiens
acaaagataagtcagaaagtca

SEQ ID NO: 8528882 - DNA, 22 bp, Homo sapiens
acaaagataagtcagaaagtca

SEQ ID NO: 8528883 - DNA, 22 bp, Homo sapiens
acaaagatgtttaaagcattta

SEQ ID NO: 8528884 - DNA, 22 bp, Homo sapiens
acaaagatgtttaaagcattta

SEQ ID NO: 8528885 - DNA, 22 bp, Homo sapiens
aagagaggggttgcatggaaat

SEQ ID NO: 8528886 - DNA, 22 bp, Homo sapiens
aagagaggggttgcatggaaat

SEQ ID NO: 8528887 - DNA, 22 bp, Homo sapiens
aagagagggacttattaaagtc

SEQ ID NO: 8528888 - DNA, 22 bp, Homo sapiens
aagagagggacttattaaagtc

SEQ ID NO: 8528889 - DNA, 17 bp, Homo sapiens
aagagaggctgagctgg

SEQ ID NO: 8528890 - DNA, 22 bp, Homo sapiens
aagagaggacatggtgaacctg

SEQ ID NO: 8528891 - DNA, 22 bp, Homo sapiens
aagagatgatggcagccagagg

SEQ ID NO: 8528892 - DNA, 22 bp, Homo sapiens
aagagatgaaggtcctgactgt

SEQ ID NO: 8528893 - DNA, 22 bp, Homo sapiens
aagagatgttgaagtttattag

SEQ ID NO: 8528894 - DNA, 20 bp, Homo sapiens
acaaggaaccaggaggtggc

SEQ ID NO: 8528895 - DNA, 22 bp, Homo sapiens
acaaggaccatgaggcagaccc

SEQ ID NO: 8528896 - DNA, 22 bp, Homo sapiens
acaaggacatgcaatttggatt

SEQ ID NO: 8528897 - DNA, 20 bp, Homo sapiens
acaaggaaccaggaggtggc

SEQ ID NO: 8528898 - DNA, 22 bp, Homo sapiens
aagagattggttataagagatt

SEQ ID NO: 8528899 - DNA, 22 bp, Homo sapiens
acaaggagaagaaattggtcat

SEQ ID NO: 8528900 - DNA, 22 bp, Homo sapiens
acaaggatctgtgtaggcaggc

SEQ ID NO: 8528901 - DNA, 22 bp, Homo sapiens
acaaggaggtctggggggccct

SEQ ID NO: 8528902 - DNA, 22 bp, Homo sapiens
acaaggagagcacacatgggga

SEQ ID NO: 8528903 - DNA, 22 bp, Homo sapiens
aagaaatacatggtttttgagt

SEQ ID NO: 8528904 - DNA, 22 bp, Homo sapiens
aagaaatacatggtttttgagt

SEQ ID NO: 8528905 - DNA, 22 bp, Homo sapiens
aagaaatattgggccttataaa

SEQ ID NO: 8528906 - DNA, 22 bp, Homo sapiens
aagaaatacatggtttttgagt

SEQ ID NO: 8528907 - DNA, 22 bp, Homo sapiens
aagaaatacatggtttttgagt

SEQ ID NO: 8528908 - DNA, 22 bp, Homo sapiens
aagaaatacatggtttttgagt

SEQ ID NO: 8528909 - DNA, 22 bp, Homo sapiens
aagaaatattgggccttataaa

SEQ ID NO: 8528910 - DNA, 22 bp, Homo sapiens
aagaaatattgggccttataaa

SEQ ID NO: 8528911 - DNA, 22 bp, Homo sapiens
aagaaatattgggccttataaa

SEQ ID NO: 8528912 - DNA, 22 bp, Homo sapiens
aagaaatcagaaaagcattcgt

SEQ ID NO: 8528913 - DNA, 22 bp, Homo sapiens
aagaaatcatatcatttcttgg

SEQ ID NO: 8528914 - DNA, 22 bp, Homo sapiens
aagaaatcagaaaagcattcgt

SEQ ID NO: 8528915 - DNA, 22 bp, Homo sapiens
aacttattgaacattctcgaat

SEQ ID NO: 8528916 - DNA, 22 bp, Homo sapiens
aacttattgaacattctcgaat

SEQ ID NO: 8528917 - DNA, 22 bp, Homo sapiens
aacttattgaacattctcgaat

SEQ ID NO: 8528918 - DNA, 22 bp, Homo sapiens
aacttcacctttttgccacact

SEQ ID NO: 8528919 - DNA, 22 bp, Homo sapiens
aacttcagagctgtgtggtttg

SEQ ID NO: 8528920 - DNA, 22 bp, Homo sapiens
aacttattccataggctcactg

SEQ ID NO: 8528921 - DNA, 22 bp, Homo sapiens
aacttagtttagggtattgatt

SEQ ID NO: 8528922 - DNA, 22 bp, Homo sapiens
aacttcatgggttcaaagctgg

SEQ ID NO: 8528923 - DNA, 22 bp, Homo sapiens
aacttcagggggcacattcaag

SEQ ID NO: 8528924 - DNA, 22 bp, Homo sapiens
aacttcatgtaatttaaaacag

SEQ ID NO: 8528925 - DNA, 22 bp, Homo sapiens
aagaaagcattagacaggcatt

SEQ ID NO: 8528926 - DNA, 22 bp, Homo sapiens
aatgttttgcattagttttcta

SEQ ID NO: 8528927 - DNA, 22 bp, Homo sapiens
aatgttttgcattagttttcta

SEQ ID NO: 8528928 - DNA, 22 bp, Homo sapiens
aatgttttgcattagttttcta

SEQ ID NO: 8528929 - DNA, 22 bp, Homo sapiens
aagaagcactttcctacatgtt

SEQ ID NO: 8528930 - DNA, 22 bp, Homo sapiens
aatgttttctctgtgaacacat

SEQ ID NO: 8528931 - DNA, 22 bp, Homo sapiens
aatgttttctgactgctaactt

SEQ ID NO: 8528932 - DNA, 22 bp, Homo sapiens
aatgttttctctgtgaacacat

SEQ ID NO: 8528933 - DNA, 22 bp, Homo sapiens
aatgttttctctgtgaacacat

SEQ ID NO: 8528934 - DNA, 22 bp, Homo sapiens
aatgttttcattatcctaactg

SEQ ID NO: 8528935 - DNA, 22 bp, Homo sapiens
aatgttttatagctcaagcaat

SEQ ID NO: 8528936 - DNA, 22 bp, Homo sapiens
aatgttttaaaagagattgaga

SEQ ID NO: 8528937 - DNA, 22 bp, Homo sapiens
aagaaatggcttcatctgagta

SEQ ID NO: 8528938 - DNA, 22 bp, Homo sapiens
aatgttttagattactgctggg

SEQ ID NO: 8528939 - DNA, 22 bp, Homo sapiens
aatgttttatagctcaagcaat

SEQ ID NO: 8528940 - DNA, 22 bp, Homo sapiens
aagaaatgctgatgttggatgg

SEQ ID NO: 8528941 - DNA, 22 bp, Homo sapiens
aagaaatgcagaaatgtgctgg

SEQ ID NO: 8528942 - DNA, 22 bp, Homo sapiens
aagaaatgcacacaactgctgg

SEQ ID NO: 8528943 - DNA, 22 bp, Homo sapiens
aagacaggaaaagctccaggcc

SEQ ID NO: 8528944 - DNA, 22 bp, Homo sapiens
aagacaggaacatagcaaatcc

SEQ ID NO: 8528945 - DNA, 22 bp, Homo sapiens
aagacaggaaaagctccaggcc

SEQ ID NO: 8528946 - DNA, 22 bp, Homo sapiens
aagacagtgtgtcaggcaggtg

SEQ ID NO: 8528947 - DNA, 22 bp, Homo sapiens
aagacagtgatctctgagagat

SEQ ID NO: 8528948 - DNA, 22 bp, Homo sapiens
aagacagtgacagtcacaattg

SEQ ID NO: 8528949 - DNA, 22 bp, Homo sapiens
aagacagtgacagtcacaattg

SEQ ID NO: 8528950 - DNA, 22 bp, Homo sapiens
aagacagcctttccctggtgcc

SEQ ID NO: 8528951 - DNA, 22 bp, Homo sapiens
aagacagcagcacctctcgttt

SEQ ID NO: 8528952 - DNA, 22 bp, Homo sapiens
aagacagcattgctgagggctt

SEQ ID NO: 8528953 - DNA, 22 bp, Homo sapiens
aagacacagcgaaatgttcctg

SEQ ID NO: 8528954 - DNA, 17 bp, Homo sapiens
aattgtcagcagtagct

SEQ ID NO: 8528955 - DNA, 17 bp, Homo sapiens
aattgtcagcagtagct

SEQ ID NO: 8528956 - DNA, 22 bp, Homo sapiens
aattgtcttctccttcctggca

SEQ ID NO: 8528957 - DNA, 22 bp, Homo sapiens
aattgtctttatcacagttcaa

SEQ ID NO: 8528958 - DNA, 22 bp, Homo sapiens
aattgtcttgaaagcaacactt

SEQ ID NO: 8528959 - DNA, 22 bp, Homo sapiens
aattgtacatatttatgagcga

SEQ ID NO: 8528960 - DNA, 22 bp, Homo sapiens
aattgtacaagccttgtgccat

SEQ ID NO: 8528961 - DNA, 22 bp, Homo sapiens
aattgtacaggaagttgctgga

SEQ ID NO: 8528962 - DNA, 22 bp, Homo sapiens
aattgtaactacattgagaaca

SEQ ID NO: 8528963 - DNA, 22 bp, Homo sapiens
aatttaactgagagtactttta

SEQ ID NO: 8528964 - DNA, 22 bp, Homo sapiens
aattgtgcccgtgacatttcat

SEQ ID NO: 8528965 - DNA, 22 bp, Homo sapiens
aattgtgcatttttaaatcacg

SEQ ID NO: 8528966 - DNA, 22 bp, Homo sapiens
aagaataagaggatttagaaca

SEQ ID NO: 8528967 - DNA, 22 bp, Homo sapiens
aagaataagtagatgggagaag

SEQ ID NO: 8528968 - DNA, 22 bp, Homo sapiens
aagaataagtagatgggagaag

SEQ ID NO: 8528969 - DNA, 22 bp, Homo sapiens
aagaataagtagatgggagaag

SEQ ID NO: 8528970 - DNA, 22 bp, Homo sapiens
aagaatacgtatcaacaatggt

SEQ ID NO: 8528971 - DNA, 22 bp, Homo sapiens
aagaatacgtatcaacaatggt

SEQ ID NO: 8528972 - DNA, 22 bp, Homo sapiens
aattggaaaatgctacatatca

SEQ ID NO: 8528973 - DNA, 22 bp, Homo sapiens
aattggactgtgctgctcaaaa

SEQ ID NO: 8528974 - DNA, 22 bp, Homo sapiens
aattggcaagcaagttatccag

SEQ ID NO: 8528975 - DNA, 23 bp, Homo sapiens
aattggacttgctgtcaaacttc

SEQ ID NO: 8528976 - DNA, 22 bp, Homo sapiens
aattggaaaatgctacatatca

SEQ ID NO: 8528977 - DNA, 22 bp, Homo sapiens
aagaatacttcgtaagtaggat

SEQ ID NO: 8528978 - DNA, 22 bp, Homo sapiens
aattggcatagcatacaattca

SEQ ID NO: 8528979 - DNA, 22 bp, Homo sapiens
aagaataaattaagatacttag

SEQ ID NO: 8528980 - DNA, 22 bp, Homo sapiens
aagaataaattaagatacttag

SEQ ID NO: 8528981 - DNA, 22 bp, Homo sapiens
aagaataacacttaggttttgc

SEQ ID NO: 8528982 - DNA, 23 bp, Homo sapiens
aagaataaatgacattaaaggtg

SEQ ID NO: 8528983 - DNA, 21 bp, Homo sapiens
aagaagtttggattttgtcct

SEQ ID NO: 8528984 - DNA, 22 bp, Homo sapiens
aagaataaattaagatacttag

SEQ ID NO: 8528985 - DNA, 22 bp, Homo sapiens
aagatttaccactttattcaag

SEQ ID NO: 8528986 - DNA, 22 bp, Homo sapiens
aagattgttttgggggaagtgg

SEQ ID NO: 8528987 - DNA, 22 bp, Homo sapiens
aagatttaccactttattcaag

SEQ ID NO: 8528988 - DNA, 22 bp, Homo sapiens
aagattctttgaggattttact

SEQ ID NO: 8528989 - DNA, 22 bp, Homo sapiens
aagattgttttggatgctaact

SEQ ID NO: 8528990 - DNA, 22 bp, Homo sapiens
aagattgttttggatgctaact

SEQ ID NO: 8528991 - DNA, 22 bp, Homo sapiens
aagattgacggctttgagtgct

SEQ ID NO: 8528992 - DNA, 22 bp, Homo sapiens
aagatgttctattttcactttt

SEQ ID NO: 8528993 - DNA, 18 bp, Homo sapiens
aagattctgcttctctct

SEQ ID NO: 8528994 - DNA, 22 bp, Homo sapiens
aagattctgtatttctaacaat

SEQ ID NO: 8528995 - DNA, 22 bp, Homo sapiens
aagaggcttcagatccttcaga

SEQ ID NO: 8528996 - DNA, 22 bp, Homo sapiens
aagaggcttatagtcttcctgt

SEQ ID NO: 8528997 - DNA, 22 bp, Homo sapiens
aagaggcttcagatccttcaga

SEQ ID NO: 8528998 - DNA, 22 bp, Homo sapiens
aagaggcttatagtcttcctgt

SEQ ID NO: 8528999 - DNA, 18 bp, Homo sapiens
aagaggctgttctgtggg

SEQ ID NO: 8529000 - DNA, 18 bp, Homo sapiens
aagaggctgttctgtggg

SEQ ID NO: 8529001 - DNA, 18 bp, Homo sapiens
aagaggctgttctgtggg

SEQ ID NO: 8529002 - DNA, 22 bp, Homo sapiens
aagaggctggcattgatggtag

SEQ ID NO: 8529003 - DNA, 20 bp, Homo sapiens
aagaggctgtggatcctact

SEQ ID NO: 8529004 - DNA, 22 bp, Homo sapiens
aagaggctggcattgatggtag

SEQ ID NO: 8529005 - DNA, 22 bp, Homo sapiens
aagaggcctcacctcactgccc

SEQ ID NO: 8529006 - DNA, 22 bp, Homo sapiens
aagaggctagccggctcactaa

SEQ ID NO: 8529007 - DNA, 22 bp, Homo sapiens
aagaggctggaggatactgcgc

SEQ ID NO: 8529008 - DNA, 22 bp, Homo sapiens
aagaggctgaatgagaaagtac

SEQ ID NO: 8529009 - DNA, 22 bp, Homo sapiens
aagaggctgaatgagaaagtac

SEQ ID NO: 8529010 - DNA, 22 bp, Homo sapiens
aagaggctgaatgagaaagtac

SEQ ID NO: 8529011 - DNA, 22 bp, Homo sapiens
aagaggctagccggctcactaa

SEQ ID NO: 8529012 - DNA, 22 bp, Homo sapiens
aagaggctagccggctcactaa

SEQ ID NO: 8529013 - DNA, 22 bp, Homo sapiens
acacagggctgcgcctgacccc

SEQ ID NO: 8529014 - DNA, 22 bp, Homo sapiens
acacaggggaaagtggagctga

SEQ ID NO: 8529015 - DNA, 22 bp, Homo sapiens
acacaggggaaagtggagctga

SEQ ID NO: 8529016 - DNA, 22 bp, Homo sapiens
acacaggggaaagtggagctga

SEQ ID NO: 8529017 - DNA, 22 bp, Homo sapiens
acacagggctgcgcctgacccc

SEQ ID NO: 8529018 - DNA, 22 bp, Homo sapiens
acacagggggcattctaggagt

SEQ ID NO: 8529019 - DNA, 22 bp, Homo sapiens
acacagggggcattctaggagt

SEQ ID NO: 8529020 - DNA, 22 bp, Homo sapiens
acacaggggctcggctgggtgc

SEQ ID NO: 8529021 - DNA, 22 bp, Homo sapiens
acacaggtacacatatgtacct

SEQ ID NO: 8529022 - DNA, 22 bp, Homo sapiens
acacaggttaaaataattggga

SEQ ID NO: 8529023 - DNA, 18 bp, Homo sapiens
acacaggttattctctcc

SEQ ID NO: 8529024 - DNA, 22 bp, Homo sapiens
acacagggtctagagttaggcc

SEQ ID NO: 8529025 - DNA, 22 bp, Homo sapiens
acacagggtctagagttaggcc

SEQ ID NO: 8529026 - DNA, 22 bp, Homo sapiens
aagaggccacagctgacagcac

SEQ ID NO: 8529027 - DNA, 22 bp, Homo sapiens
acacagtagtttgtcattgcta

SEQ ID NO: 8529028 - DNA, 22 bp, Homo sapiens
acacagtaggccaccatgtcat

SEQ ID NO: 8529029 - DNA, 22 bp, Homo sapiens
acacagtaggatagtttgagga

SEQ ID NO: 8529030 - DNA, 20 bp, Homo sapiens
acacagtagcaattagtgca

SEQ ID NO: 8529031 - DNA, 22 bp, Homo sapiens
acacagtaccccaaggctgggc

SEQ ID NO: 8529032 - DNA, 22 bp, Homo sapiens
acacagtaccccaaggctgggc

SEQ ID NO: 8529033 - DNA, 22 bp, Homo sapiens
acacagtaccccaaggctgggc

SEQ ID NO: 8529034 - DNA, 20 bp, Homo sapiens
acacagtagatgagtgactg

SEQ ID NO: 8529035 - DNA, 17 bp, Homo sapiens
acacagtacttttttgc

SEQ ID NO: 8529036 - DNA, 22 bp, Homo sapiens
acacagtaaatatgtattgaat

SEQ ID NO: 8529037 - DNA, 22 bp, Homo sapiens
acacagtaaatattgtctcctc

SEQ ID NO: 8529038 - DNA, 22 bp, Homo sapiens
acacagtaaatatgtattgaat

SEQ ID NO: 8529039 - DNA, 22 bp, Homo sapiens
aagcacagtgggcagagcagcc

SEQ ID NO: 8529040 - DNA, 22 bp, Homo sapiens
aagcacagtgggcagagcagcc

SEQ ID NO: 8529041 - DNA, 22 bp, Homo sapiens
acagaattaggagatcctcttg

SEQ ID NO: 8529042 - DNA, 22 bp, Homo sapiens
aagcacagtgccaagttctatt

SEQ ID NO: 8529043 - DNA, 22 bp, Homo sapiens
aagcacagtaaaagcagatttt

SEQ ID NO: 8529044 - DNA, 22 bp, Homo sapiens
aagcacagtaaaagcagatttt

SEQ ID NO: 8529045 - DNA, 22 bp, Homo sapiens
aagcacaggttgaggattattc

SEQ ID NO: 8529046 - DNA, 22 bp, Homo sapiens
aagcacagggactcaggaccgg

SEQ ID NO: 8529047 - DNA, 22 bp, Homo sapiens
aagcacagggactttaggaata

SEQ ID NO: 8529048 - DNA, 22 bp, Homo sapiens
aagcacagggactttaggaata

SEQ ID NO: 8529049 - DNA, 22 bp, Homo sapiens
aagcacagggactttaggaata

SEQ ID NO: 8529050 - DNA, 22 bp, Homo sapiens
aagcacagggtgtctgcattca

SEQ ID NO: 8529051 - DNA, 22 bp, Homo sapiens
aagcacaggggaaataagttgt

SEQ ID NO: 8529052 - DNA, 18 bp, Homo sapiens
aagcacaggtgtttcagg

SEQ ID NO: 8529053 - DNA, 22 bp, Homo sapiens
aagcacaggagacgcacagcca

SEQ ID NO: 8529054 - DNA, 22 bp, Homo sapiens
aagcacaggagacgcacagcca

SEQ ID NO: 8529055 - DNA, 22 bp, Homo sapiens
aagcacaggatcttgaggagcg

SEQ ID NO: 8529056 - DNA, 22 bp, Homo sapiens
aagcacaggagacgcacagcca

SEQ ID NO: 8529057 - DNA, 22 bp, Homo sapiens
aagcacaggatcttgaggagcg

SEQ ID NO: 8529058 - DNA, 22 bp, Homo sapiens
aagcacagggactcaggaccgg

SEQ ID NO: 8529059 - DNA, 22 bp, Homo sapiens
aagcacagggactcaggaccgg

SEQ ID NO: 8529060 - DNA, 22 bp, Homo sapiens
aagcacaggatcttgaggagcg

SEQ ID NO: 8529061 - DNA, 22 bp, Homo sapiens
aagcacagaaaaggagcatgga

SEQ ID NO: 8529062 - DNA, 22 bp, Homo sapiens
aagcacagaaaaggagcatgga

SEQ ID NO: 8529063 - DNA, 22 bp, Homo sapiens
aagcacagaaaaggagcatgga

SEQ ID NO: 8529064 - DNA, 22 bp, Homo sapiens
acactggtaggaagagatggct

SEQ ID NO: 8529065 - DNA, 22 bp, Homo sapiens
acactgggtaacatatctgtta

SEQ ID NO: 8529066 - DNA, 22 bp, Homo sapiens
acactgctcacttcttcccttg

SEQ ID NO: 8529067 - DNA, 21 bp, Homo sapiens
acactgctgtagcatattggg

SEQ ID NO: 8529068 - DNA, 22 bp, Homo sapiens
acactgctaaacagtaaagatg

SEQ ID NO: 8529069 - DNA, 22 bp, Homo sapiens
acactgcttctctggcagagcc

SEQ ID NO: 8529070 - DNA, 22 bp, Homo sapiens
acactgcttctctggcagagcc

SEQ ID NO: 8529071 - DNA, 22 bp, Homo sapiens
acactgctaaacagtaaagatg

SEQ ID NO: 8529072 - DNA, 22 bp, Homo sapiens
acactggaccatttaaacttga

SEQ ID NO: 8529073 - DNA, 22 bp, Homo sapiens
acactggagcttctagcccacg

SEQ ID NO: 8529074 - DNA, 19 bp, Homo sapiens
acactgggagaagactgct

SEQ ID NO: 8529075 - DNA, 19 bp, Homo sapiens
acactgggagaagactgct

SEQ ID NO: 8529076 - DNA, 18 bp, Homo sapiens
acactgcagcagtctgct

SEQ ID NO: 8529077 - DNA, 22 bp, Homo sapiens
acactgcagcatcagctacgga

SEQ ID NO: 8529078 - DNA, 17 bp, Homo sapiens
aagatttcattagctga

SEQ ID NO: 8529079 - DNA, 22 bp, Homo sapiens
aagatttcctggatgtaattcc

SEQ ID NO: 8529080 - DNA, 22 bp, Homo sapiens
aagatttactagcataatagct

SEQ ID NO: 8529081 - DNA, 22 bp, Homo sapiens
aagatttagggccagtttacat

SEQ ID NO: 8529082 - DNA, 22 bp, Homo sapiens
aagcagcattgtaaccaatgcc

SEQ ID NO: 8529083 - DNA, 22 bp, Homo sapiens
aagcagagtccccttcccatgg

SEQ ID NO: 8529084 - DNA, 18 bp, Homo sapiens
acagacaaaatggaaatg

SEQ ID NO: 8529085 - DNA, 22 bp, Homo sapiens
aagcagcatcctgggcagacct

SEQ ID NO: 8529086 - DNA, 18 bp, Homo sapiens
acagacaaaatggaaatg

SEQ ID NO: 8529087 - DNA, 18 bp, Homo sapiens
acagacaaaatggaaatg

SEQ ID NO: 8529088 - DNA, 22 bp, Homo sapiens
acagaatttacacatctctaaa

SEQ ID NO: 8529089 - DNA, 22 bp, Homo sapiens
acagaatttgcttgggcaatgg

SEQ ID NO: 8529090 - DNA, 22 bp, Homo sapiens
acagaatttttacacagggtaa

SEQ ID NO: 8529091 - DNA, 22 bp, Homo sapiens
acagaattggggttcttgggga

SEQ ID NO: 8529092 - DNA, 22 bp, Homo sapiens
acagaattgatggaaatctcag

SEQ ID NO: 8529093 - DNA, 22 bp, Homo sapiens
acagaattgatggaaatctcag

SEQ ID NO: 8529094 - DNA, 22 bp, Homo sapiens
acagaatttacacatctctaaa

SEQ ID NO: 8529095 - DNA, 22 bp, Homo sapiens
acagaatttacacatctctaaa

SEQ ID NO: 8529096 - DNA, 22 bp, Homo sapiens
acagaatttaaagctctagact

SEQ ID NO: 8529097 - DNA, 22 bp, Homo sapiens
acagaattatcaggaaatgtta

SEQ ID NO: 8529098 - DNA, 22 bp, Homo sapiens
acagaattctagtatgtggctt

SEQ ID NO: 8529099 - DNA, 22 bp, Homo sapiens
acagaattatcaggaaatgtta

SEQ ID NO: 8529100 - DNA, 22 bp, Homo sapiens
acagaattctctctgcagaggc

SEQ ID NO: 8529101 - DNA, 22 bp, Homo sapiens
acagaattctagtatgtggctt

SEQ ID NO: 8529102 - DNA, 22 bp, Homo sapiens
acagaattctctctgcagaggc

SEQ ID NO: 8529103 - DNA, 22 bp, Homo sapiens
acagaattctctctgcagaggc

SEQ ID NO: 8529104 - DNA, 22 bp, Homo sapiens
acagaattgaaagtataatctg

SEQ ID NO: 8529105 - DNA, 22 bp, Homo sapiens
acagaattgaaagtataatctg

SEQ ID NO: 8529106 - DNA, 22 bp, Homo sapiens
acagaattgatggaaatctcag

SEQ ID NO: 8529107 - DNA, 22 bp, Homo sapiens
acagaattgatggaaatctcag

SEQ ID NO: 8529108 - DNA, 22 bp, Homo sapiens
acagaattgaagctgagtaaat

SEQ ID NO: 8529109 - DNA, 22 bp, Homo sapiens
acagaattgaagctgagtaaat

SEQ ID NO: 8529110 - DNA, 22 bp, Homo sapiens
aagcagctgatttcacagctca

SEQ ID NO: 8529111 - DNA, 22 bp, Homo sapiens
aagcagctgatttcacagctca

SEQ ID NO: 8529112 - DNA, 22 bp, Homo sapiens
acagaggtgttccagacctagg

SEQ ID NO: 8529113 - DNA, 22 bp, Homo sapiens
acagaggttaggatgggttgta

SEQ ID NO: 8529114 - DNA, 22 bp, Homo sapiens
acagaggtgtgtgtaggacagt

SEQ ID NO: 8529115 - DNA, 22 bp, Homo sapiens
acagaggtgtgtgtaggacagt

SEQ ID NO: 8529116 - DNA, 22 bp, Homo sapiens
aagcagccacctcatctccact

SEQ ID NO: 8529117 - DNA, 22 bp, Homo sapiens
aagcagccacctcatctccact

SEQ ID NO: 8529118 - DNA, 22 bp, Homo sapiens
aagcagccagccatcatgcccg

SEQ ID NO: 8529119 - DNA, 22 bp, Homo sapiens
aagcagcctggcatgatgcttt

SEQ ID NO: 8529120 - DNA, 22 bp, Homo sapiens
aagcagcctggcatgatgcttt

SEQ ID NO: 8529121 - DNA, 19 bp, Homo sapiens
aagcagccctggcaagagc

SEQ ID NO: 8529122 - DNA, 22 bp, Homo sapiens
aagcagcctggacttgggctgg

SEQ ID NO: 8529123 - DNA, 22 bp, Homo sapiens
aagcagcctggacttgggctgg

SEQ ID NO: 8529124 - DNA, 17 bp, Homo sapiens
acagaggttatacagac

SEQ ID NO: 8529125 - DNA, 22 bp, Homo sapiens
acagaggtttccattgaggttt

SEQ ID NO: 8529126 - DNA, 22 bp, Homo sapiens
acagagtacattcagagactat

SEQ ID NO: 8529127 - DNA, 22 bp, Homo sapiens
acagagtacagacaaaggtcag

SEQ ID NO: 8529128 - DNA, 22 bp, Homo sapiens
acagagtagctcaagaagattg

SEQ ID NO: 8529129 - DNA, 22 bp, Homo sapiens
acagagtattggaaaggcagtg

SEQ ID NO: 8529130 - DNA, 22 bp, Homo sapiens
acagagtatctatcaggagtat

SEQ ID NO: 8529131 - DNA, 21 bp, Homo sapiens
acagagtagttgaaacagaga

SEQ ID NO: 8529132 - DNA, 22 bp, Homo sapiens
acagagtaggtgctcagtaaat

SEQ ID NO: 8529133 - DNA, 22 bp, Homo sapiens
acagagtaggtgctcagtaaat

SEQ ID NO: 8529134 - DNA, 21 bp, Homo sapiens
acagagtagttgaaacagaga

SEQ ID NO: 8529135 - DNA, 22 bp, Homo sapiens
acagagtaggtgctgtcgactg

SEQ ID NO: 8529136 - DNA, 22 bp, Homo sapiens
aagccaggaagagagccttcac

SEQ ID NO: 8529137 - DNA, 22 bp, Homo sapiens
aagccaggaagggagctgtccc

SEQ ID NO: 8529138 - DNA, 22 bp, Homo sapiens
aagccaggaccaaactcatcct

SEQ ID NO: 8529139 - DNA, 22 bp, Homo sapiens
aagccaggcatgcttggacagt

SEQ ID NO: 8529140 - DNA, 22 bp, Homo sapiens
aagccaggagcgaggcctcggc

SEQ ID NO: 8529141 - DNA, 22 bp, Homo sapiens
acagcagctgccttcaggctct

SEQ ID NO: 8529142 - DNA, 22 bp, Homo sapiens
acagcagctaacccctgggcca

SEQ ID NO: 8529143 - DNA, 22 bp, Homo sapiens
acagcagctaacccctgggcca

SEQ ID NO: 8529144 - DNA, 22 bp, Homo sapiens
acagcagctgccttcaggctct

SEQ ID NO: 8529145 - DNA, 22 bp, Homo sapiens
acagcagctgccttcaggctct

SEQ ID NO: 8529146 - DNA, 22 bp, Homo sapiens
acagcagctgggttcccaccat

SEQ ID NO: 8529147 - DNA, 22 bp, Homo sapiens
acagcagcttgtctgttcttta

SEQ ID NO: 8529148 - DNA, 22 bp, Homo sapiens
acagcagcttgtctgttcttta

SEQ ID NO: 8529149 - DNA, 22 bp, Homo sapiens
acagcagcttgcgtgtctggtc

SEQ ID NO: 8529150 - DNA, 22 bp, Homo sapiens
acagcagcttgcgtgtctggtc

SEQ ID NO: 8529151 - DNA, 22 bp, Homo sapiens
aagcatttcaggtagagatatt

SEQ ID NO: 8529152 - DNA, 22 bp, Homo sapiens
aagcatttcaggtagagatatt

SEQ ID NO: 8529153 - DNA, 22 bp, Homo sapiens
aagcatttcaatataatattca

SEQ ID NO: 8529154 - DNA, 22 bp, Homo sapiens
acagcagctaaaggtgtctcct

SEQ ID NO: 8529155 - DNA, 22 bp, Homo sapiens
acagcagctaacccctgggcca

SEQ ID NO: 8529156 - DNA, 22 bp, Homo sapiens
acagcagctaaaggtgtctcct

SEQ ID NO: 8529157 - DNA, 22 bp, Homo sapiens
acagcagctaaaggtgtctcct

SEQ ID NO: 8529158 - DNA, 22 bp, Homo sapiens
aagcatttggttctgaagactc

SEQ ID NO: 8529159 - DNA, 22 bp, Homo sapiens
aagcatttgtgaaattcagatg

SEQ ID NO: 8529160 - DNA, 22 bp, Homo sapiens
acagcagctaaaggtgtctcct

SEQ ID NO: 8529161 - DNA, 22 bp, Homo sapiens
aagcatttatagataagaattt

SEQ ID NO: 8529162 - DNA, 22 bp, Homo sapiens
aagcatttatagataagaattt

SEQ ID NO: 8529163 - DNA, 22 bp, Homo sapiens
aagcattgtaagcagaagatgc

SEQ ID NO: 8529164 - DNA, 22 bp, Homo sapiens
aagcatttatagataagaattt

SEQ ID NO: 8529165 - DNA, 22 bp, Homo sapiens
aagcatttcaatataatattca

SEQ ID NO: 8529166 - DNA, 22 bp, Homo sapiens
aagcatttcaatataatattca

SEQ ID NO: 8529167 - DNA, 22 bp, Homo sapiens
aagcatgtacaatgagtgtctc

SEQ ID NO: 8529168 - DNA, 22 bp, Homo sapiens
aagcatggtttctgacgtcatg

SEQ ID NO: 8529169 - DNA, 22 bp, Homo sapiens
aagcatatattttatatgttgt

SEQ ID NO: 8529170 - DNA, 22 bp, Homo sapiens
aagcatattttaattagccaca

SEQ ID NO: 8529171 - DNA, 23 bp, Homo sapiens
aagcattcgccttcaccctcctc

SEQ ID NO: 8529172 - DNA, 22 bp, Homo sapiens
aagcattctgcattttcaaaga

SEQ ID NO: 8529173 - DNA, 22 bp, Homo sapiens
aagcattgtaagcagaagatgc

SEQ ID NO: 8529174 - DNA, 22 bp, Homo sapiens
aactgttcttcattttcagtat

SEQ ID NO: 8529175 - DNA, 22 bp, Homo sapiens
aactgttcttcattttcagtat

SEQ ID NO: 8529176 - DNA, 18 bp, Homo sapiens
aactgttgaaatagcttg

SEQ ID NO: 8529177 - DNA, 22 bp, Homo sapiens
aactgttacatagttatagatc

SEQ ID NO: 8529178 - DNA, 22 bp, Homo sapiens
aactgttacatagttatagatc

SEQ ID NO: 8529179 - DNA, 22 bp, Homo sapiens
aactgttgtcatatggtcttaa

SEQ ID NO: 8529180 - DNA, 22 bp, Homo sapiens
aactgttgcttgtaatatgtgc

SEQ ID NO: 8529181 - DNA, 22 bp, Homo sapiens
aactgtttggaactcttccaca

SEQ ID NO: 8529182 - DNA, 22 bp, Homo sapiens
aactgtttcagaaatattgttg

SEQ ID NO: 8529183 - DNA, 22 bp, Homo sapiens
aactgtttcagaaatattgttg

SEQ ID NO: 8529184 - DNA, 22 bp, Homo sapiens
aacttaggaaaataaggcatga

SEQ ID NO: 8529185 - DNA, 22 bp, Homo sapiens
aacttagtgagccactcttgca

SEQ ID NO: 8529186 - DNA, 22 bp, Homo sapiens
aacttagtctttcaatttgata

SEQ ID NO: 8529187 - DNA, 22 bp, Homo sapiens
aacttacaaggatgatagctgc

SEQ ID NO: 8529188 - DNA, 22 bp, Homo sapiens
aacttaaacccactcatgtaga

SEQ ID NO: 8529189 - DNA, 22 bp, Homo sapiens
aacttaaacccactcatgtaga

SEQ ID NO: 8529190 - DNA, 22 bp, Homo sapiens
aacttaaacccactcatgtaga

SEQ ID NO: 8529191 - DNA, 22 bp, Homo sapiens
aacttaaacccactcatgtaga

SEQ ID NO: 8529192 - DNA, 22 bp, Homo sapiens
aactgtttttcacgtgtctcat

SEQ ID NO: 8529193 - DNA, 22 bp, Homo sapiens
aacttaaacaagctcccaagtt

SEQ ID NO: 8529194 - DNA, 22 bp, Homo sapiens
aacttaaacccactcatgtaga

SEQ ID NO: 8529195 - DNA, 22 bp, Homo sapiens
aatgatatgcaaattatcatca

SEQ ID NO: 8529196 - DNA, 22 bp, Homo sapiens
aatgatatttattgaatagatg

SEQ ID NO: 8529197 - DNA, 22 bp, Homo sapiens
aatgatcacctggtaaagagag

SEQ ID NO: 8529198 - DNA, 22 bp, Homo sapiens
aatgatatagcagacatagcct

SEQ ID NO: 8529199 - DNA, 22 bp, Homo sapiens
aatgatatagcagacatagcct

SEQ ID NO: 8529200 - DNA, 22 bp, Homo sapiens
aatgatatgcaaattatcatca

SEQ ID NO: 8529201 - DNA, 22 bp, Homo sapiens
aatgatcacctggtaaagagag

SEQ ID NO: 8529202 - DNA, 22 bp, Homo sapiens
aatgatcattataaagtgctct

SEQ ID NO: 8529203 - DNA, 20 bp, Homo sapiens
aatgatcagcatagcaagga

SEQ ID NO: 8529204 - DNA, 22 bp, Homo sapiens
aatgatcacctggtaaagagag

SEQ ID NO: 8529205 - DNA, 22 bp, Homo sapiens
aatgatccttgttgtttaacca

SEQ ID NO: 8529206 - DNA, 22 bp, Homo sapiens
aatgatcctacacatggaattc

SEQ ID NO: 8529207 - DNA, 22 bp, Homo sapiens
aatgatcccatttagaaacaga

SEQ ID NO: 8529208 - DNA, 22 bp, Homo sapiens
aatgatcccatttagaaacaga

SEQ ID NO: 8529209 - DNA, 22 bp, Homo sapiens
aatgataccaaacatgtagata

SEQ ID NO: 8529210 - DNA, 22 bp, Homo sapiens
aatgatacatatgtatcgttag

SEQ ID NO: 8529211 - DNA, 22 bp, Homo sapiens
aatgataccgccaatattacca

SEQ ID NO: 8529212 - DNA, 22 bp, Homo sapiens
aatgatatagcagacatagcct

SEQ ID NO: 8529213 - DNA, 22 bp, Homo sapiens
aactgcttatctttggtagatg

SEQ ID NO: 8529214 - DNA, 21 bp, Homo sapiens
aactgctggtcttttctgtct

SEQ ID NO: 8529215 - DNA, 22 bp, Homo sapiens
aactgctgtggcctagtactta

SEQ ID NO: 8529216 - DNA, 22 bp, Homo sapiens
aactgctcatttgagagtatgc

SEQ ID NO: 8529217 - DNA, 22 bp, Homo sapiens
aactgcatttgcataagtccat

SEQ ID NO: 8529218 - DNA, 22 bp, Homo sapiens
aatccaatcctactcagaaagt

SEQ ID NO: 8529219 - DNA, 22 bp, Homo sapiens
aatcattgttcttcagatttga

SEQ ID NO: 8529220 - DNA, 22 bp, Homo sapiens
aatcattgtaaatggttttgtt

SEQ ID NO: 8529221 - DNA, 22 bp, Homo sapiens
aatcattgttgtcgttcctaga

SEQ ID NO: 8529222 - DNA, 22 bp, Homo sapiens
aatcattgctcctttctctggt

SEQ ID NO: 8529223 - DNA, 22 bp, Homo sapiens
aatcattgctcctttctctggt

SEQ ID NO: 8529224 - DNA, 22 bp, Homo sapiens
aatcattgagacaaattagctt

SEQ ID NO: 8529225 - DNA, 22 bp, Homo sapiens
aatcattgagacaaattagctt

SEQ ID NO: 8529226 - DNA, 22 bp, Homo sapiens
aatcattgagacaaattagctt

SEQ ID NO: 8529227 - DNA, 22 bp, Homo sapiens
aatcatgtttacgtgacatgtc

SEQ ID NO: 8529228 - DNA, 22 bp, Homo sapiens
aatcatgtttcagatgagtttt

SEQ ID NO: 8529229 - DNA, 22 bp, Homo sapiens
aatcattctcatgccagtttcc

SEQ ID NO: 8529230 - DNA, 22 bp, Homo sapiens
aatcattcttatttcacagcaa

SEQ ID NO: 8529231 - DNA, 22 bp, Homo sapiens
aatcatgtccatcttaactttc

SEQ ID NO: 8529232 - DNA, 22 bp, Homo sapiens
aatcatgtactgctgtggcttt

SEQ ID NO: 8529233 - DNA, 22 bp, Homo sapiens
aatcatggcgtgtttagcttaa

SEQ ID NO: 8529234 - DNA, 22 bp, Homo sapiens
aatcatcctgaagtcaataaag

SEQ ID NO: 8529235 - DNA, 22 bp, Homo sapiens
aatcatgaaatatcagttcttt

SEQ ID NO: 8529236 - DNA, 22 bp, Homo sapiens
aatcatcacgaacacaacagcg

SEQ ID NO: 8529237 - DNA, 22 bp, Homo sapiens
aatcatcccaactgagaatccc

SEQ ID NO: 8529238 - DNA, 22 bp, Homo sapiens
aatcatcctgaagtcaataaag

SEQ ID NO: 8529239 - DNA, 22 bp, Homo sapiens
aatcatctccgaaaaaagagta

SEQ ID NO: 8529240 - DNA, 22 bp, Homo sapiens
aatcatctccgaaaaaagagta

SEQ ID NO: 8529241 - DNA, 21 bp, Homo sapiens
aatcatacaaaacatgtcagg

SEQ ID NO: 8529242 - DNA, 21 bp, Homo sapiens
aatcatacaaaacatgtcagg

SEQ ID NO: 8529243 - DNA, 22 bp, Homo sapiens
aactgcaataacttgtgcacca

SEQ ID NO: 8529244 - DNA, 22 bp, Homo sapiens
aactgcaagtggggcttgtcat

SEQ ID NO: 8529245 - DNA, 22 bp, Homo sapiens
aactgcaagtggggcttgtcat

SEQ ID NO: 8529246 - DNA, 23 bp, Homo sapiens
aactgcaaggttgctgggaagta

SEQ ID NO: 8529247 - DNA, 22 bp, Homo sapiens
aactgcaagctctttactgcta

SEQ ID NO: 8529248 - DNA, 22 bp, Homo sapiens
aactgcaacttgtttgattctt

SEQ ID NO: 8529249 - DNA, 22 bp, Homo sapiens
aactgcaacttcgtaaagtgag

SEQ ID NO: 8529250 - DNA, 22 bp, Homo sapiens
aactgcaagagtaaatgtctag

SEQ ID NO: 8529251 - DNA, 22 bp, Homo sapiens
aatccaatcctactcagaaagt

SEQ ID NO: 8529252 - DNA, 22 bp, Homo sapiens
aactgaaacgtatttttgagat

SEQ ID NO: 8529253 - DNA, 22 bp, Homo sapiens
aactgcaatcacttttgcacca

SEQ ID NO: 8529254 - DNA, 22 bp, Homo sapiens
aactgcaattacttttgcacca

SEQ ID NO: 8529255 - DNA, 22 bp, Homo sapiens
aactgcagagaacatctgggtt

SEQ ID NO: 8529256 - DNA, 22 bp, Homo sapiens
aactgcaattacttttgcacta

SEQ ID NO: 8529257 - DNA, 22 bp, Homo sapiens
aactgcaattacttttgcgcca

SEQ ID NO: 8529258 - DNA, 22 bp, Homo sapiens
aactgcattcagaaagctcact

SEQ ID NO: 8529259 - DNA, 22 bp, Homo sapiens
aactgcattcagaaagctcact

SEQ ID NO: 8529260 - DNA, 22 bp, Homo sapiens
aacgtcttctctccaagtaaat

SEQ ID NO: 8529261 - DNA, 22 bp, Homo sapiens
aacgtgcattaggacctctcca

SEQ ID NO: 8529262 - DNA, 22 bp, Homo sapiens
aacgtgcaccaggaggtcatga

SEQ ID NO: 8529263 - DNA, 22 bp, Homo sapiens
aacgcccgtggttgccaaggta

SEQ ID NO: 8529264 - DNA, 22 bp, Homo sapiens
aactacagaaaaggtaagctct

SEQ ID NO: 8529265 - DNA, 22 bp, Homo sapiens
aactacagaaaaggtaagctct

SEQ ID NO: 8529266 - DNA, 22 bp, Homo sapiens
aactacagaaaaggtaagctct

SEQ ID NO: 8529267 - DNA, 22 bp, Homo sapiens
aactacagaatcatagaaaata

SEQ ID NO: 8529268 - DNA, 22 bp, Homo sapiens
aactacagaatcatagaaaata

SEQ ID NO: 8529269 - DNA, 22 bp, Homo sapiens
aactacagaatcatagaaaata

SEQ ID NO: 8529270 - DNA, 22 bp, Homo sapiens
aactacagcatctatacaaata

SEQ ID NO: 8529271 - DNA, 20 bp, Homo sapiens
aatataattctctgaattta

SEQ ID NO: 8529272 - DNA, 22 bp, Homo sapiens
aacgcccgtggttgccaaggta

SEQ ID NO: 8529273 - DNA, 22 bp, Homo sapiens
aatataatgctgttttatgcca

SEQ ID NO: 8529274 - DNA, 22 bp, Homo sapiens
aatataaattcctgggcccagc

SEQ ID NO: 8529275 - DNA, 22 bp, Homo sapiens
aatataatgctgttttatgcca

SEQ ID NO: 8529276 - DNA, 22 bp, Homo sapiens
aactacagcatctatacaaata

SEQ ID NO: 8529277 - DNA, 22 bp, Homo sapiens
aactacagcatctatacaaata

SEQ ID NO: 8529278 - DNA, 19 bp, Homo sapiens
aactacagcgcactgtcct

SEQ ID NO: 8529279 - DNA, 22 bp, Homo sapiens
aactacagctcttgtctttctg

SEQ ID NO: 8529280 - DNA, 19 bp, Homo sapiens
aactacagcgcactgtcct

SEQ ID NO: 8529281 - DNA, 19 bp, Homo sapiens
aactacagcgcactgtcct

SEQ ID NO: 8529282 - DNA, 22 bp, Homo sapiens
aactacagggggtggcaggcgg

SEQ ID NO: 8529283 - DNA, 22 bp, Homo sapiens
aactacagtatgtccaaagaat

SEQ ID NO: 8529284 - DNA, 22 bp, Homo sapiens
aactacagtatgtccaaagaat

SEQ ID NO: 8529285 - DNA, 22 bp, Homo sapiens
aactacagggggtggcaggcgg

SEQ ID NO: 8529286 - DNA, 22 bp, Homo sapiens
aactacagtagtttgcccttct

SEQ ID NO: 8529287 - DNA, 21 bp, Homo sapiens
aactacagttgttccttcatt

SEQ ID NO: 8529288 - DNA, 22 bp, Homo sapiens
aactacagtgggcagaggcaat

SEQ ID NO: 8529289 - DNA, 22 bp, Homo sapiens
aactacagtgggcagaggcaat

SEQ ID NO: 8529290 - DNA, 22 bp, Homo sapiens
aactacagtgggcagaggcaat

SEQ ID NO: 8529291 - DNA, 22 bp, Homo sapiens
aactacagtgggcagaggcaat

SEQ ID NO: 8529292 - DNA, 22 bp, Homo sapiens
aactacatagaaattagtattt

SEQ ID NO: 8529293 - DNA, 22 bp, Homo sapiens
aatcataattttgtgaatgtag

SEQ ID NO: 8529294 - DNA, 22 bp, Homo sapiens
aacaggctggccttgaagcagt

SEQ ID NO: 8529295 - DNA, 22 bp, Homo sapiens
aacaggcttccaggagggacga

SEQ ID NO: 8529296 - DNA, 20 bp, Homo sapiens
aacagggcagaagcggagac

SEQ ID NO: 8529297 - DNA, 20 bp, Homo sapiens
aacagggcagaagcggagac

SEQ ID NO: 8529298 - DNA, 22 bp, Homo sapiens
aacagggctttggaagtctccg

SEQ ID NO: 8529299 - DNA, 22 bp, Homo sapiens
aacaggcagcagactgaatctg

SEQ ID NO: 8529300 - DNA, 22 bp, Homo sapiens
aacaggaattgcaggcagatct

SEQ ID NO: 8529301 - DNA, 22 bp, Homo sapiens
aacaggagaggggaatgtagag

SEQ ID NO: 8529302 - DNA, 22 bp, Homo sapiens
aacaggagagtaaatatatgat

SEQ ID NO: 8529303 - DNA, 22 bp, Homo sapiens
aacaggaggccttccagtccag

SEQ ID NO: 8529304 - DNA, 22 bp, Homo sapiens
aacaggaggccttccagtccag

SEQ ID NO: 8529305 - DNA, 22 bp, Homo sapiens
aacaggagtcattgtcattatt

SEQ ID NO: 8529306 - DNA, 22 bp, Homo sapiens
aacaggcactaagcatgtgggg

SEQ ID NO: 8529307 - DNA, 22 bp, Homo sapiens
aacaggcaatttaggactcttt

SEQ ID NO: 8529308 - DNA, 22 bp, Homo sapiens
aacaggcaatttaggactcttt

SEQ ID NO: 8529309 - DNA, 22 bp, Homo sapiens
aacaggcaacagttgactctga

SEQ ID NO: 8529310 - DNA, 22 bp, Homo sapiens
aacaggcaacagttgactctga

SEQ ID NO: 8529311 - DNA, 22 bp, Homo sapiens
aacaggcaacagttgactctga

SEQ ID NO: 8529312 - DNA, 22 bp, Homo sapiens
aacaggcaaactgtgggatccc

SEQ ID NO: 8529313 - DNA, 22 bp, Homo sapiens
aacaggagtcattgtcattatt

SEQ ID NO: 8529314 - DNA, 22 bp, Homo sapiens
aacatgctgcctttctacgagt

SEQ ID NO: 8529315 - DNA, 22 bp, Homo sapiens
aacatgctctgtttcttggatg

SEQ ID NO: 8529316 - DNA, 22 bp, Homo sapiens
aacatgctgcctttctacgagt

SEQ ID NO: 8529317 - DNA, 22 bp, Homo sapiens
aacatgcttgcttagaatcagc

SEQ ID NO: 8529318 - DNA, 22 bp, Homo sapiens
aacatgctgggtgtttttgatg

SEQ ID NO: 8529319 - DNA, 22 bp, Homo sapiens
aacatgctcttcctggctagtc

SEQ ID NO: 8529320 - DNA, 22 bp, Homo sapiens
aacatgctctgtttcttggatg

SEQ ID NO: 8529321 - DNA, 22 bp, Homo sapiens
aacatgctctgtttcttggatg

SEQ ID NO: 8529322 - DNA, 22 bp, Homo sapiens
aacatgcatttgtgggatggaa

SEQ ID NO: 8529323 - DNA, 18 bp, Homo sapiens
aacatgcattagaactgc

SEQ ID NO: 8529324 - DNA, 18 bp, Homo sapiens
aacatgcattagaactgc

SEQ ID NO: 8529325 - DNA, 18 bp, Homo sapiens
aacatgcattagaactgc

SEQ ID NO: 8529326 - DNA, 22 bp, Homo sapiens
aacatgcatgttatttatcagt

SEQ ID NO: 8529327 - DNA, 22 bp, Homo sapiens
aacatgcatgaagaagttatat

SEQ ID NO: 8529328 - DNA, 22 bp, Homo sapiens
aacatgcatgaagaagttatat

SEQ ID NO: 8529329 - DNA, 22 bp, Homo sapiens
aacatgcatgaagaagttatat

SEQ ID NO: 8529330 - DNA, 22 bp, Homo sapiens
aacaggtagggactctaacttg

SEQ ID NO: 8529331 - DNA, 22 bp, Homo sapiens
aacaggggtgggtgctactgga

SEQ ID NO: 8529332 - DNA, 22 bp, Homo sapiens
aacagtaaaaatcatttagttg

SEQ ID NO: 8529333 - DNA, 22 bp, Homo sapiens
aacagtaaaaatcatttagttg

SEQ ID NO: 8529334 - DNA, 20 bp, Homo sapiens
aacagggggctgcagagggc

SEQ ID NO: 8529335 - DNA, 20 bp, Homo sapiens
aacagggggctgcagagggc

SEQ ID NO: 8529336 - DNA, 22 bp, Homo sapiens
aacaggggattagatagcaggc

SEQ ID NO: 8529337 - DNA, 22 bp, Homo sapiens
aacatgaaacccaaacagaata

SEQ ID NO: 8529338 - DNA, 22 bp, Homo sapiens
aacatgcatataggtaaatgga

SEQ ID NO: 8529339 - DNA, 22 bp, Homo sapiens
aacatggaggcagacagacgtg

SEQ ID NO: 8529340 - DNA, 19 bp, Homo sapiens
aacatggaactggagaggg

SEQ ID NO: 8529341 - DNA, 22 bp, Homo sapiens
aacatgctttgataaataaaag

SEQ ID NO: 8529342 - DNA, 22 bp, Homo sapiens
aataacttcatcttcaggatag

SEQ ID NO: 8529343 - DNA, 22 bp, Homo sapiens
aataacttcagttcttacatta

SEQ ID NO: 8529344 - DNA, 22 bp, Homo sapiens
aacatgtaaatatcattgtact

SEQ ID NO: 8529345 - DNA, 22 bp, Homo sapiens
aacatgtaaatatcattgtact

SEQ ID NO: 8529346 - DNA, 22 bp, Homo sapiens
aataacttttaaaagaccctgg

SEQ ID NO: 8529347 - DNA, 22 bp, Homo sapiens
aataacttgtatggttattcca

SEQ ID NO: 8529348 - DNA, 22 bp, Homo sapiens
aataacttgtatggttattcca

SEQ ID NO: 8529349 - DNA, 22 bp, Homo sapiens
aataacttgaagatctcttcca

SEQ ID NO: 8529350 - DNA, 22 bp, Homo sapiens
aataacttgaagatctcttcca

SEQ ID NO: 8529351 - DNA, 22 bp, Homo sapiens
aataacttcatgtaacatttaa

SEQ ID NO: 8529352 - DNA, 22 bp, Homo sapiens
aataacttcatgtaacatttaa

SEQ ID NO: 8529353 - DNA, 22 bp, Homo sapiens
aataacttcatgtaacatttaa

SEQ ID NO: 8529354 - DNA, 22 bp, Homo sapiens
aataacttttaaaagaccctgg

SEQ ID NO: 8529355 - DNA, 22 bp, Homo sapiens
aataagaacaactaaggtttat

SEQ ID NO: 8529356 - DNA, 22 bp, Homo sapiens
aacatttttaagaccaagtgct

SEQ ID NO: 8529357 - DNA, 21 bp, Homo sapiens
aacatttcaggatccaaattg

SEQ ID NO: 8529358 - DNA, 21 bp, Homo sapiens
aacatttcaggatccaaattg

SEQ ID NO: 8529359 - DNA, 22 bp, Homo sapiens
aaccaccattctctcctcttcc

SEQ ID NO: 8529360 - DNA, 22 bp, Homo sapiens
aaccagaaggaatctgagctga

SEQ ID NO: 8529361 - DNA, 22 bp, Homo sapiens
aaccaccattctctcctcttcc

SEQ ID NO: 8529362 - DNA, 22 bp, Homo sapiens
aaccaccattctctcctcttcc

SEQ ID NO: 8529363 - DNA, 22 bp, Homo sapiens
aaccaccattctctcctcttcc

SEQ ID NO: 8529364 - DNA, 22 bp, Homo sapiens
aaccacagagccccctcagatg

SEQ ID NO: 8529365 - DNA, 22 bp, Homo sapiens
aaccacagacccagactagaga

SEQ ID NO: 8529366 - DNA, 22 bp, Homo sapiens
aaccaaggacagctagtgatgc

SEQ ID NO: 8529367 - DNA, 22 bp, Homo sapiens
aaccaagctcaatggtctgagt

SEQ ID NO: 8529368 - DNA, 22 bp, Homo sapiens
aaccaagagggttttccttgaa

SEQ ID NO: 8529369 - DNA, 22 bp, Homo sapiens
aatagttctagctcagaagctc

SEQ ID NO: 8529370 - DNA, 22 bp, Homo sapiens
aatataaattcctgggcccagc

SEQ ID NO: 8529371 - DNA, 22 bp, Homo sapiens
aatagtgttgttcactcaggag

SEQ ID NO: 8529372 - DNA, 22 bp, Homo sapiens
aaatgttcccaatatgaagctg

SEQ ID NO: 8529373 - DNA, 22 bp, Homo sapiens
aaatgttctaaattacatgtga

SEQ ID NO: 8529374 - DNA, 22 bp, Homo sapiens
aaatgttccgggtaaggagaaa

SEQ ID NO: 8529375 - DNA, 22 bp, Homo sapiens
aaatgtgtttcgaaaactggtg

SEQ ID NO: 8529376 - DNA, 22 bp, Homo sapiens
aaatgtgtttagatggtttatt

SEQ ID NO: 8529377 - DNA, 22 bp, Homo sapiens
aaatgtgtttagatggtttatt

SEQ ID NO: 8529378 - DNA, 22 bp, Homo sapiens
aaatgtgtttcgaaaactggtg

SEQ ID NO: 8529379 - DNA, 22 bp, Homo sapiens
aaatgtgttcctttgctacaga

SEQ ID NO: 8529380 - DNA, 22 bp, Homo sapiens
aaatgtgtttgataggaatatt

SEQ ID NO: 8529381 - DNA, 22 bp, Homo sapiens
aaatgtgtttctttgtgaatgg

SEQ ID NO: 8529382 - DNA, 22 bp, Homo sapiens
aaatgtgtttctttgtgaatgg

SEQ ID NO: 8529383 - DNA, 22 bp, Homo sapiens
aaatgtgtttgataggaatatt

SEQ ID NO: 8529384 - DNA, 22 bp, Homo sapiens
aaatgtttctacttgtgagcat

SEQ ID NO: 8529385 - DNA, 22 bp, Homo sapiens
aaattcactctgttcctcatgg

SEQ ID NO: 8529386 - DNA, 22 bp, Homo sapiens
aaattctaaggtcacaatgttg

SEQ ID NO: 8529387 - DNA, 22 bp, Homo sapiens
aaattcactctgttcctcatgg

SEQ ID NO: 8529388 - DNA, 22 bp, Homo sapiens
aaattccattttgtgactattc

SEQ ID NO: 8529389 - DNA, 22 bp, Homo sapiens
aagctgaggcccatggcaaggt

SEQ ID NO: 8529390 - DNA, 22 bp, Homo sapiens
aagctgaggctcccctgaggga

SEQ ID NO: 8529391 - DNA, 22 bp, Homo sapiens
aagctgaggctcccctgaggga

SEQ ID NO: 8529392 - DNA, 22 bp, Homo sapiens
aagctgaggtcaagtagctagt

SEQ ID NO: 8529393 - DNA, 22 bp, Homo sapiens
aagctgaggcccatggcaaggt

SEQ ID NO: 8529394 - DNA, 22 bp, Homo sapiens
aagctgagccagtggcaagtgc

SEQ ID NO: 8529395 - DNA, 22 bp, Homo sapiens
aaatgtgagttatagcaataga

SEQ ID NO: 8529396 - DNA, 22 bp, Homo sapiens
aaatgtgatactgttcttttta

SEQ ID NO: 8529397 - DNA, 22 bp, Homo sapiens
aaatgtctatctggcatattcc

SEQ ID NO: 8529398 - DNA, 22 bp, Homo sapiens
aaatgtctatctggcatattcc

SEQ ID NO: 8529399 - DNA, 19 bp, Homo sapiens
aaatgtgatggtacaattc

SEQ ID NO: 8529400 - DNA, 19 bp, Homo sapiens
aaatgtgatggtacaattc

SEQ ID NO: 8529401 - DNA, 19 bp, Homo sapiens
aaatgtgatggtacaattc

SEQ ID NO: 8529402 - DNA, 22 bp, Homo sapiens
aaatgtgcttgtgatcagctgt

SEQ ID NO: 8529403 - DNA, 22 bp, Homo sapiens
aaatgtgcttgtgatcagctgt

SEQ ID NO: 8529404 - DNA, 22 bp, Homo sapiens
aaatgtgggtaatgggactgga

SEQ ID NO: 8529405 - DNA, 22 bp, Homo sapiens
aaatgtgtcagtttcattctct

SEQ ID NO: 8529406 - DNA, 22 bp, Homo sapiens
aaatgtgtatatgaaacatgat

SEQ ID NO: 8529407 - DNA, 22 bp, Homo sapiens
aaatgtgtatatgaaacatgat

SEQ ID NO: 8529408 - DNA, 22 bp, Homo sapiens
aaatgtgtatatgaaacatgat

SEQ ID NO: 8529409 - DNA, 22 bp, Homo sapiens
aaatgtgtgtatgtacatatat

SEQ ID NO: 8529410 - DNA, 22 bp, Homo sapiens
aaatgtgtgcacaaagacagct

SEQ ID NO: 8529411 - DNA, 22 bp, Homo sapiens
aaatgtgtcatattcaaagtca

SEQ ID NO: 8529412 - DNA, 22 bp, Homo sapiens
aaatgtgtcatattcaaagtca

SEQ ID NO: 8529413 - DNA, 21 bp, Homo sapiens
aaatgtgttccataatgcttt

SEQ ID NO: 8529414 - DNA, 22 bp, Homo sapiens
aaatgtgtgtatgtacatatat

SEQ ID NO: 8529415 - DNA, 21 bp, Homo sapiens
aaatgtgttccataatgcttt

SEQ ID NO: 8529416 - DNA, 22 bp, Homo sapiens
aaatgtgttcctttgctacaga

SEQ ID NO: 8529417 - DNA, 22 bp, Homo sapiens
aaattctatgtcaatgtttatt

SEQ ID NO: 8529418 - DNA, 22 bp, Homo sapiens
aaattctcaagtgatcctgttg

SEQ ID NO: 8529419 - DNA, 22 bp, Homo sapiens
aaattctatgtcaatgtttatt

SEQ ID NO: 8529420 - DNA, 22 bp, Homo sapiens
aaattctaaggtcacaatgttg

SEQ ID NO: 8529421 - DNA, 22 bp, Homo sapiens
aaattctaaggtcacaatgttg

SEQ ID NO: 8529422 - DNA, 22 bp, Homo sapiens
aaattcttcaggtaattttgat

SEQ ID NO: 8529423 - DNA, 22 bp, Homo sapiens
aaattctcttcagaggaaccag

SEQ ID NO: 8529424 - DNA, 22 bp, Homo sapiens
aaattgcagatgctaaatgact

SEQ ID NO: 8529425 - DNA, 22 bp, Homo sapiens
aaattgcagatgctaaatgact

SEQ ID NO: 8529426 - DNA, 22 bp, Homo sapiens
aaattgcacaatatagacatga

SEQ ID NO: 8529427 - DNA, 22 bp, Homo sapiens
aaattgcaaaagtacttttagg

SEQ ID NO: 8529428 - DNA, 22 bp, Homo sapiens
aaattgcaaaagtacttttagg

SEQ ID NO: 8529429 - DNA, 22 bp, Homo sapiens
aaattgcaaaagtacttttagg

SEQ ID NO: 8529430 - DNA, 22 bp, Homo sapiens
aaattgatgttcccagttgaaa

SEQ ID NO: 8529431 - DNA, 22 bp, Homo sapiens
aaattgaatgattaagtggtga

SEQ ID NO: 8529432 - DNA, 22 bp, Homo sapiens
aaattgaatttgggaaacattg

SEQ ID NO: 8529433 - DNA, 22 bp, Homo sapiens
aaattgaatttgggaaacattg

SEQ ID NO: 8529434 - DNA, 22 bp, Homo sapiens
aaattctttcatggctaataag

SEQ ID NO: 8529435 - DNA, 22 bp, Homo sapiens
aaattctttcatggctaataag

SEQ ID NO: 8529436 - DNA, 22 bp, Homo sapiens
aaattctttggcctactttgaa

SEQ ID NO: 8529437 - DNA, 21 bp, Homo sapiens
aacaaagggatgctcatcttt

SEQ ID NO: 8529438 - DNA, 21 bp, Homo sapiens
aacaaagggatgctcatcttt

SEQ ID NO: 8529439 - DNA, 22 bp, Homo sapiens
aacaaaggccgttaataaccac

SEQ ID NO: 8529440 - DNA, 22 bp, Homo sapiens
aacaaagtacttttcagtgctt

SEQ ID NO: 8529441 - DNA, 22 bp, Homo sapiens
aacaaactcaaatggaagagtg

SEQ ID NO: 8529442 - DNA, 22 bp, Homo sapiens
aacaaagatgggtgggaaagag

SEQ ID NO: 8529443 - DNA, 22 bp, Homo sapiens
aacaaacctgggtggagaaagg

SEQ ID NO: 8529444 - DNA, 20 bp, Homo sapiens
aacaaactacaaaattatgt

SEQ ID NO: 8529445 - DNA, 20 bp, Homo sapiens
aacaaactacaaaattatgt

SEQ ID NO: 8529446 - DNA, 22 bp, Homo sapiens
aacaaacattacctggtgctgg

SEQ ID NO: 8529447 - DNA, 22 bp, Homo sapiens
aaattgcaggtaggtgggtgat

SEQ ID NO: 8529448 - DNA, 22 bp, Homo sapiens
aaattgcattcaggatgcagga

SEQ ID NO: 8529449 - DNA, 22 bp, Homo sapiens
aaattgcattcaggatgcagga

SEQ ID NO: 8529450 - DNA, 22 bp, Homo sapiens
aaattttagaccaggcaaaact

SEQ ID NO: 8529451 - DNA, 22 bp, Homo sapiens
aaattttagaccaggcaaaact

SEQ ID NO: 8529452 - DNA, 22 bp, Homo sapiens
aaattttagactcctgggtcta

SEQ ID NO: 8529453 - DNA, 22 bp, Homo sapiens
aacaaacagttaagtgtggatg

SEQ ID NO: 8529454 - DNA, 22 bp, Homo sapiens
aacactcaatttacaaactctg

SEQ ID NO: 8529455 - DNA, 22 bp, Homo sapiens
aacactaacatatagtcagtgg

SEQ ID NO: 8529456 - DNA, 22 bp, Homo sapiens
aacactaatgggagaacaaccc

SEQ ID NO: 8529457 - DNA, 22 bp, Homo sapiens
aacactaatgggagaacaaccc

SEQ ID NO: 8529458 - DNA, 22 bp, Homo sapiens
aacactctctgttggtaaggct

SEQ ID NO: 8529459 - DNA, 22 bp, Homo sapiens
aacactctacgtgcagctccta

SEQ ID NO: 8529460 - DNA, 22 bp, Homo sapiens
aacactgaaacattgattgaca

SEQ ID NO: 8529461 - DNA, 22 bp, Homo sapiens
aacactgaaacattgattgaca

SEQ ID NO: 8529462 - DNA, 19 bp, Homo sapiens
aacaccagagtcaggagtc

SEQ ID NO: 8529463 - DNA, 22 bp, Homo sapiens
aacactaaaggtcagttagaag

SEQ ID NO: 8529464 - DNA, 22 bp, Homo sapiens
aacaccagtcccaagagaggct

SEQ ID NO: 8529465 - DNA, 22 bp, Homo sapiens
aacacatagacgtttgatatca

SEQ ID NO: 8529466 - DNA, 22 bp, Homo sapiens
aacacatagacgtttgatatca

SEQ ID NO: 8529467 - DNA, 22 bp, Homo sapiens
aacacatagacgtttgatatca

SEQ ID NO: 8529468 - DNA, 22 bp, Homo sapiens
aacaaatgtaaaatgcagatgc

SEQ ID NO: 8529469 - DNA, 22 bp, Homo sapiens
aacaaatgacctgatttcttcc

SEQ ID NO: 8529470 - DNA, 22 bp, Homo sapiens
aacaaatgacctgatttcttcc

SEQ ID NO: 8529471 - DNA, 22 bp, Homo sapiens
aacaaatgacctgatttcttcc

SEQ ID NO: 8529472 - DNA, 22 bp, Homo sapiens
aacaaagtgtacttccatactg

SEQ ID NO: 8529473 - DNA, 22 bp, Homo sapiens
aacaaagtgtacttccatactg

SEQ ID NO: 8529474 - DNA, 22 bp, Homo sapiens
aacaaagtttcaggaagataga

SEQ ID NO: 8529475 - DNA, 22 bp, Homo sapiens
aacaaagtttcaggaagataga

SEQ ID NO: 8529476 - DNA, 22 bp, Homo sapiens
aacaaatgattgttggttggag

SEQ ID NO: 8529477 - DNA, 22 bp, Homo sapiens
aacaaatgataccagttctcaa

SEQ ID NO: 8529478 - DNA, 22 bp, Homo sapiens
aacaaatgataccagttctcaa

SEQ ID NO: 8529479 - DNA, 22 bp, Homo sapiens
aacaaatggaacacaaatcttt

SEQ ID NO: 8529480 - DNA, 22 bp, Homo sapiens
aacaaatggaacacaaatcttt

SEQ ID NO: 8529481 - DNA, 22 bp, Homo sapiens
aacaaatggggccttgtatgaa

SEQ ID NO: 8529482 - DNA, 22 bp, Homo sapiens
aacactgagaacaatacagagt

SEQ ID NO: 8529483 - DNA, 22 bp, Homo sapiens
aacactgagaactgttggtggt

SEQ ID NO: 8529484 - DNA, 22 bp, Homo sapiens
aacactgagaacaatacagagt

SEQ ID NO: 8529485 - DNA, 22 bp, Homo sapiens
aacactgacgacgtgaactaaa

SEQ ID NO: 8529486 - DNA, 22 bp, Homo sapiens
aacactgagaggggagtggcac

SEQ ID NO: 8529487 - DNA, 22 bp, Homo sapiens
aacactgagctattacggtgga

SEQ ID NO: 8529488 - DNA, 22 bp, Homo sapiens
aaggtatatgtacaatagacat

SEQ ID NO: 8529489 - DNA, 22 bp, Homo sapiens
aaggtatatctgatccatgagg

SEQ ID NO: 8529490 - DNA, 22 bp, Homo sapiens
aacactgacctctaccctcagt

SEQ ID NO: 8529491 - DNA, 22 bp, Homo sapiens
aacactgaagtagtgaatactg

SEQ ID NO: 8529492 - DNA, 22 bp, Homo sapiens
aacactgaaatgtcttaagatt

SEQ ID NO: 8529493 - DNA, 22 bp, Homo sapiens
aacactgaagaccaggtaattt

SEQ ID NO: 8529494 - DNA, 22 bp, Homo sapiens
aacactgaagccgttaaacctt

SEQ ID NO: 8529495 - DNA, 22 bp, Homo sapiens
aaggtcagagcaggaaggagtc

SEQ ID NO: 8529496 - DNA, 22 bp, Homo sapiens
aaggtcactgatcagttgagta

SEQ ID NO: 8529497 - DNA, 22 bp, Homo sapiens
aaggtcatttaacaatttatga

SEQ ID NO: 8529498 - DNA, 20 bp, Homo sapiens
aaggtccaaactctgtgttc

SEQ ID NO: 8529499 - DNA, 22 bp, Homo sapiens
aaggtattttctaatgtatact

SEQ ID NO: 8529500 - DNA, 22 bp, Homo sapiens
aaggtattatttgcaatcattt

SEQ ID NO: 8529501 - DNA, 22 bp, Homo sapiens
aaggtattattgtctatgtact

SEQ ID NO: 8529502 - DNA, 22 bp, Homo sapiens
aacagcataccaatgtacatat

SEQ ID NO: 8529503 - DNA, 22 bp, Homo sapiens
aacagcagtggcaggagaaggc

SEQ ID NO: 8529504 - DNA, 22 bp, Homo sapiens
aacagcagtggcaggagaaggc

SEQ ID NO: 8529505 - DNA, 22 bp, Homo sapiens
aacagcatatttcatatattga

SEQ ID NO: 8529506 - DNA, 22 bp, Homo sapiens
aacagcatcaccccataacatt

SEQ ID NO: 8529507 - DNA, 22 bp, Homo sapiens
aacagcatcaccccataacatt

SEQ ID NO: 8529508 - DNA, 22 bp, Homo sapiens
aacagcatatttcatatattga

SEQ ID NO: 8529509 - DNA, 22 bp, Homo sapiens
aacagcagggaaattccaagtc

SEQ ID NO: 8529510 - DNA, 22 bp, Homo sapiens
aacagcagggacttgaatggaa

SEQ ID NO: 8529511 - DNA, 22 bp, Homo sapiens
aacagcaggtcctggcatgggt

SEQ ID NO: 8529512 - DNA, 22 bp, Homo sapiens
aacagcaggtcctggcatgggt

SEQ ID NO: 8529513 - DNA, 22 bp, Homo sapiens
aacagcagggggacctgctggt

SEQ ID NO: 8529514 - DNA, 22 bp, Homo sapiens
aacagcagggatgacatggcca

SEQ ID NO: 8529515 - DNA, 22 bp, Homo sapiens
aacagcagggatgacatggcca

SEQ ID NO: 8529516 - DNA, 22 bp, Homo sapiens
aacagcagctttcaggatcatc

SEQ ID NO: 8529517 - DNA, 23 bp, Homo sapiens
aacagcaggatgatagaggaggt

SEQ ID NO: 8529518 - DNA, 22 bp, Homo sapiens
aacagcaggcaccaaggctatg

SEQ ID NO: 8529519 - DNA, 22 bp, Homo sapiens
aacagcaggcaccaaggctatg

SEQ ID NO: 8529520 - DNA, 22 bp, Homo sapiens
aacagcaggcaccaaggctatg

SEQ ID NO: 8529521 - DNA, 22 bp, Homo sapiens
aacagcaggcatttcttagctc

SEQ ID NO: 8529522 - DNA, 22 bp, Homo sapiens
aacagcaggcatttcttagctc

SEQ ID NO: 8529523 - DNA, 22 bp, Homo sapiens
aacagcagctttcaggatcatc

SEQ ID NO: 8529524 - DNA, 22 bp, Homo sapiens
aacagaggctccctgcacttgt

SEQ ID NO: 8529525 - DNA, 22 bp, Homo sapiens
aacagcagctgaggagctgggc

SEQ ID NO: 8529526 - DNA, 22 bp, Homo sapiens
aaggtctcaagttttccaaagt

SEQ ID NO: 8529527 - DNA, 22 bp, Homo sapiens
aaggtccttttgcagtgtgatc

SEQ ID NO: 8529528 - DNA, 22 bp, Homo sapiens
aaggtccatgactcggcatagt

SEQ ID NO: 8529529 - DNA, 22 bp, Homo sapiens
aaggtcctgtagccacagagcc

SEQ ID NO: 8529530 - DNA, 22 bp, Homo sapiens
aacagaggctccctgcacttgt

SEQ ID NO: 8529531 - DNA, 22 bp, Homo sapiens
aacagaggatgtttgaaattca

SEQ ID NO: 8529532 - DNA, 22 bp, Homo sapiens
aaggtctgagttttgccaggcc

SEQ ID NO: 8529533 - DNA, 22 bp, Homo sapiens
aaggtctgcttgttttcttgag

SEQ ID NO: 8529534 - DNA, 22 bp, Homo sapiens
aagtcatgagtcctcttctgtg

SEQ ID NO: 8529535 - DNA, 22 bp, Homo sapiens
aacagcctcagtgagattagga

SEQ ID NO: 8529536 - DNA, 22 bp, Homo sapiens
aagtcatcttgagtctaagatt

SEQ ID NO: 8529537 - DNA, 22 bp, Homo sapiens
aacagccactgatactgaatag

SEQ ID NO: 8529538 - DNA, 22 bp, Homo sapiens
aacagcatgctgggtaacattg

SEQ ID NO: 8529539 - DNA, 22 bp, Homo sapiens
aagtccaaggtcaccattcaca

SEQ ID NO: 8529540 - DNA, 22 bp, Homo sapiens
aagtccaaggtcaccattcaca

SEQ ID NO: 8529541 - DNA, 22 bp, Homo sapiens
aagtcattggtagcttgatagg

SEQ ID NO: 8529542 - DNA, 17 bp, Homo sapiens
aagtccagagttgagca

SEQ ID NO: 8529543 - DNA, 22 bp, Homo sapiens
aacagcttgaggaatatcatca

SEQ ID NO: 8529544 - DNA, 22 bp, Homo sapiens
aacaggaattgatgggagtcct

SEQ ID NO: 8529545 - DNA, 22 bp, Homo sapiens
aacaggaatgaggagaaaaggt

SEQ ID NO: 8529546 - DNA, 22 bp, Homo sapiens
aaataattgagttggtcaatat

SEQ ID NO: 8529547 - DNA, 22 bp, Homo sapiens
aaataattgagttggtcaatat

SEQ ID NO: 8529548 - DNA, 22 bp, Homo sapiens
aaataattgagttggtcaatat

SEQ ID NO: 8529549 - DNA, 22 bp, Homo sapiens
aaataattatagcgagtctatc

SEQ ID NO: 8529550 - DNA, 22 bp, Homo sapiens
aaataattatagcgagtctatc

SEQ ID NO: 8529551 - DNA, 22 bp, Homo sapiens
aaataattatagcgagtctatc

SEQ ID NO: 8529552 - DNA, 22 bp, Homo sapiens
aaatagacaggcttaaatagga

SEQ ID NO: 8529553 - DNA, 22 bp, Homo sapiens
aaatagacaggcttaaatagga

SEQ ID NO: 8529554 - DNA, 22 bp, Homo sapiens
aaatagacaggcttaaatagga

SEQ ID NO: 8529555 - DNA, 22 bp, Homo sapiens
aaatagacaggcttaaatagga

SEQ ID NO: 8529556 - DNA, 22 bp, Homo sapiens
aaatactgtagataatagagtt

SEQ ID NO: 8529557 - DNA, 22 bp, Homo sapiens
aaatactgtagataatagagtt

SEQ ID NO: 8529558 - DNA, 22 bp, Homo sapiens
aaatagacacatgcgttcatat

SEQ ID NO: 8529559 - DNA, 22 bp, Homo sapiens
aaatagagctgggttaaacttt

SEQ ID NO: 8529560 - DNA, 22 bp, Homo sapiens
aaatagatttaacatccatccc

SEQ ID NO: 8529561 - DNA, 22 bp, Homo sapiens
aaatagatttcctagcattgga

SEQ ID NO: 8529562 - DNA, 22 bp, Homo sapiens
aaatagatttcctagcattgga

SEQ ID NO: 8529563 - DNA, 22 bp, Homo sapiens
aaatagcagaagcagagggggt

SEQ ID NO: 8529564 - DNA, 22 bp, Homo sapiens
aaatagcaatgtgaaaagagga

SEQ ID NO: 8529565 - DNA, 22 bp, Homo sapiens
aaatagcaatgtgaaaagagga

SEQ ID NO: 8529566 - DNA, 22 bp, Homo sapiens
aaatagcagcctttagttaaca

SEQ ID NO: 8529567 - DNA, 22 bp, Homo sapiens
aaatagcagcctttagttaaca

SEQ ID NO: 8529568 - DNA, 22 bp, Homo sapiens
aaatagcttttcataattctca

SEQ ID NO: 8529569 - DNA, 22 bp, Homo sapiens
aaataggaatgtggtcctggga

SEQ ID NO: 8529570 - DNA, 22 bp, Homo sapiens
aaatagctacatgatctctagg

SEQ ID NO: 8529571 - DNA, 22 bp, Homo sapiens
aaatagctacatgatctctagg

SEQ ID NO: 8529572 - DNA, 22 bp, Homo sapiens
aaatagctacatgatctctagg

SEQ ID NO: 8529573 - DNA, 22 bp, Homo sapiens
aaatagcataaaataggaagct

SEQ ID NO: 8529574 - DNA, 22 bp, Homo sapiens
aaatagcagctttgacagcaca

SEQ ID NO: 8529575 - DNA, 22 bp, Homo sapiens
aaatccatcaaatcttctagaa

SEQ ID NO: 8529576 - DNA, 22 bp, Homo sapiens
aaatccattctgttttaaaagt

SEQ ID NO: 8529577 - DNA, 23 bp, Homo sapiens
aaataggagtatctggatcatga

SEQ ID NO: 8529578 - DNA, 23 bp, Homo sapiens
aaataggagtatctggatcatga

SEQ ID NO: 8529579 - DNA, 23 bp, Homo sapiens
aaataggagtatctggatcatga

SEQ ID NO: 8529580 - DNA, 22 bp, Homo sapiens
aaataggagcttaagcacttct

SEQ ID NO: 8529581 - DNA, 23 bp, Homo sapiens
aaataggagtatctggatcatga

SEQ ID NO: 8529582 - DNA, 23 bp, Homo sapiens
aaataggagtatctggatcatga

SEQ ID NO: 8529583 - DNA, 22 bp, Homo sapiens
aaataagtgtgggccagtcaaa

SEQ ID NO: 8529584 - DNA, 22 bp, Homo sapiens
aaataagtgtgggccagtcaaa

SEQ ID NO: 8529585 - DNA, 22 bp, Homo sapiens
aaataagtagtttagtgttgtg

SEQ ID NO: 8529586 - DNA, 22 bp, Homo sapiens
aaataagttaaactagaatgat

SEQ ID NO: 8529587 - DNA, 22 bp, Homo sapiens
aaataagttaaactagaatgat

SEQ ID NO: 8529588 - DNA, 22 bp, Homo sapiens
aaataagttaaactagaatgat

SEQ ID NO: 8529589 - DNA, 22 bp, Homo sapiens
aaataagttaaactagaatgat

SEQ ID NO: 8529590 - DNA, 22 bp, Homo sapiens
aaataagttaaactagaatgat

SEQ ID NO: 8529591 - DNA, 22 bp, Homo sapiens
aaataagttagcagattccagt

SEQ ID NO: 8529592 - DNA, 22 bp, Homo sapiens
aaataatcaatttttgtagata

SEQ ID NO: 8529593 - DNA, 22 bp, Homo sapiens
aaataagttagcagattccagt

SEQ ID NO: 8529594 - DNA, 22 bp, Homo sapiens
aaataatcaatttttgtagata

SEQ ID NO: 8529595 - DNA, 22 bp, Homo sapiens
aaataatgttaggcctttgctc

SEQ ID NO: 8529596 - DNA, 22 bp, Homo sapiens
aaataagttagcagattccagt

SEQ ID NO: 8529597 - DNA, 22 bp, Homo sapiens
aaataatgttaggcctttgctc

SEQ ID NO: 8529598 - DNA, 22 bp, Homo sapiens
aaataagcacttaactgtatca

SEQ ID NO: 8529599 - DNA, 22 bp, Homo sapiens
aaataagtaatgtcttcctttt

SEQ ID NO: 8529600 - DNA, 22 bp, Homo sapiens
aaataagcacttaactgtatca

SEQ ID NO: 8529601 - DNA, 22 bp, Homo sapiens
aaataagaggacagatgtttgg

SEQ ID NO: 8529602 - DNA, 22 bp, Homo sapiens
aaataagaaattcttctttgca

SEQ ID NO: 8529603 - DNA, 22 bp, Homo sapiens
aaataagaaattcttctttgca

SEQ ID NO: 8529604 - DNA, 22 bp, Homo sapiens
aaataactttctgtgtatagtc

SEQ ID NO: 8529605 - DNA, 21 bp, Homo sapiens
aaagtgttcagaccagttctg

SEQ ID NO: 8529606 - DNA, 22 bp, Homo sapiens
aaagtgttgatatgtgacatcc

SEQ ID NO: 8529607 - DNA, 22 bp, Homo sapiens
aaagtgttgggaagaaagtgca

SEQ ID NO: 8529608 - DNA, 21 bp, Homo sapiens
aaagtgtgtggggaagaagga

SEQ ID NO: 8529609 - DNA, 22 bp, Homo sapiens
aaagtgtggcacaagtcacatc

SEQ ID NO: 8529610 - DNA, 21 bp, Homo sapiens
aaagtgtgtggggaagaagga

SEQ ID NO: 8529611 - DNA, 22 bp, Homo sapiens
aaagtgtaggcttcaaagaggg

SEQ ID NO: 8529612 - DNA, 23 bp, Homo sapiens
aaagtgtagccaggttaagaacc

SEQ ID NO: 8529613 - DNA, 22 bp, Homo sapiens
aaagtgtggagattgaactaaa

SEQ ID NO: 8529614 - DNA, 23 bp, Homo sapiens
aaagtgtagccaggttaagaacc

SEQ ID NO: 8529615 - DNA, 23 bp, Homo sapiens
aaagtgtagccaggttaagaacc

SEQ ID NO: 8529616 - DNA, 23 bp, Homo sapiens
aaagtgtagccaggttaagaacc

SEQ ID NO: 8529617 - DNA, 22 bp, Homo sapiens
aaagtgtagagtgcctcaaaat

SEQ ID NO: 8529618 - DNA, 22 bp, Homo sapiens
aaataacagtcagggacaacat

SEQ ID NO: 8529619 - DNA, 19 bp, Homo sapiens
aaagtgttttcttttctgt

SEQ ID NO: 8529620 - DNA, 22 bp, Homo sapiens
aaagtgttgggattacaggtgt

SEQ ID NO: 8529621 - DNA, 22 bp, Homo sapiens
aaatgcaggttcttgagccaag

SEQ ID NO: 8529622 - DNA, 22 bp, Homo sapiens
aaatgcaggtagtatttatttt

SEQ ID NO: 8529623 - DNA, 23 bp, Homo sapiens
aaatgcagggtcgcaggttacag

SEQ ID NO: 8529624 - DNA, 22 bp, Homo sapiens
aaatgcatcagctcataagaga

SEQ ID NO: 8529625 - DNA, 22 bp, Homo sapiens
aaatgcatcagctcataagaga

SEQ ID NO: 8529626 - DNA, 22 bp, Homo sapiens
aaatgcatgagaaagtattctg

SEQ ID NO: 8529627 - DNA, 22 bp, Homo sapiens
aagcatcaacactatattgatg

SEQ ID NO: 8529628 - DNA, 22 bp, Homo sapiens
aaatgcatgagaaagtattctg

SEQ ID NO: 8529629 - DNA, 22 bp, Homo sapiens
aaatgcatgagaaagtattctg

SEQ ID NO: 8529630 - DNA, 22 bp, Homo sapiens
aaatgcatatcaaagacttgaa

SEQ ID NO: 8529631 - DNA, 22 bp, Homo sapiens
aaatgcatatcaaagacttgaa

SEQ ID NO: 8529632 - DNA, 22 bp, Homo sapiens
aaatgcatcagctcataagaga

SEQ ID NO: 8529633 - DNA, 22 bp, Homo sapiens
aagcacagcagagccttgcttg

SEQ ID NO: 8529634 - DNA, 22 bp, Homo sapiens
aagcacagattgctgcatccat

SEQ ID NO: 8529635 - DNA, 22 bp, Homo sapiens
aagcacagccaggttaggggct

SEQ ID NO: 8529636 - DNA, 22 bp, Homo sapiens
aagcacagctggaacagcagga

SEQ ID NO: 8529637 - DNA, 22 bp, Homo sapiens
aagcacagataaaacaggattc

SEQ ID NO: 8529638 - DNA, 22 bp, Homo sapiens
aagcacagataaaacaggattc

SEQ ID NO: 8529639 - DNA, 22 bp, Homo sapiens
aagcacagattgctgcatccat

SEQ ID NO: 8529640 - DNA, 22 bp, Homo sapiens
aagcacagatgcaagggggacc

SEQ ID NO: 8529641 - DNA, 22 bp, Homo sapiens
aagcacagatgcaagggggacc

SEQ ID NO: 8529642 - DNA, 22 bp, Homo sapiens
aaatgcaggaaattatgctttt

SEQ ID NO: 8529643 - DNA, 22 bp, Homo sapiens
aaatgcacaggttttaaatcct

SEQ ID NO: 8529644 - DNA, 22 bp, Homo sapiens
aaatgcaccttgctgtgagact

SEQ ID NO: 8529645 - DNA, 23 bp, Homo sapiens
aaatgcacagtattgatttttaa

SEQ ID NO: 8529646 - DNA, 22 bp, Homo sapiens
aaatgcaggaaattatgctttt

SEQ ID NO: 8529647 - DNA, 22 bp, Homo sapiens
aaatgcaggaaattatgctttt

SEQ ID NO: 8529648 - DNA, 22 bp, Homo sapiens
aagcacagaaaaggagcatgga

SEQ ID NO: 8529649 - DNA, 22 bp, Homo sapiens
aaatctcaaaggcttagcatct

SEQ ID NO: 8529650 - DNA, 22 bp, Homo sapiens
aagcacagacacaaaaggcttt

SEQ ID NO: 8529651 - DNA, 23 bp, Homo sapiens
aagcacagaatggtttaggagtt

SEQ ID NO: 8529652 - DNA, 22 bp, Homo sapiens
aagcacagaccagatctccagg

SEQ ID NO: 8529653 - DNA, 22 bp, Homo sapiens
aagcacagactccctctgagtg

SEQ ID NO: 8529654 - DNA, 22 bp, Homo sapiens
aagcacagactccctctgagtg

SEQ ID NO: 8529655 - DNA, 22 bp, Homo sapiens
aagcacagactccctctgagtg

SEQ ID NO: 8529656 - DNA, 22 bp, Homo sapiens
aagcacagagaggtaaagtaac

SEQ ID NO: 8529657 - DNA, 22 bp, Homo sapiens
aagcacagagaggtaaagtaac

SEQ ID NO: 8529658 - DNA, 22 bp, Homo sapiens
aagcacagagaggtaaagtaac

SEQ ID NO: 8529659 - DNA, 22 bp, Homo sapiens
aagcacagagatgggcacgcct

SEQ ID NO: 8529660 - DNA, 22 bp, Homo sapiens
aagcacagagatgggcacgcct

SEQ ID NO: 8529661 - DNA, 22 bp, Homo sapiens
aagcacagataaaacaggattc

SEQ ID NO: 8529662 - DNA, 22 bp, Homo sapiens
aagcacagagatgggcacgcct

SEQ ID NO: 8529663 - DNA, 22 bp, Homo sapiens
aaatcgtttcgttcctggtttt

SEQ ID NO: 8529664 - DNA, 22 bp, Homo sapiens
aaatcgtggaagacaccagtgg

SEQ ID NO: 8529665 - DNA, 22 bp, Homo sapiens
aaatcgttataatgttaagcct

SEQ ID NO: 8529666 - DNA, 22 bp, Homo sapiens
aaatcggttggttcaaggtaat

SEQ ID NO: 8529667 - DNA, 22 bp, Homo sapiens
aaatccttttctatacagcata

SEQ ID NO: 8529668 - DNA, 22 bp, Homo sapiens
aaatcctttggaggacatgatg

SEQ ID NO: 8529669 - DNA, 22 bp, Homo sapiens
aaatccttttctatacagcata

SEQ ID NO: 8529670 - DNA, 22 bp, Homo sapiens
aaatcctttggaggacatgatg

SEQ ID NO: 8529671 - DNA, 22 bp, Homo sapiens
aaatccttgatagtttgcccta

SEQ ID NO: 8529672 - DNA, 22 bp, Homo sapiens
aaatccgtcattggcctggttg

SEQ ID NO: 8529673 - DNA, 22 bp, Homo sapiens
aaatcctaagcagaggaattta

SEQ ID NO: 8529674 - DNA, 22 bp, Homo sapiens
aaatcccttgctctctcagacc

SEQ ID NO: 8529675 - DNA, 22 bp, Homo sapiens
aaatccctgataatgtaggtct

SEQ ID NO: 8529676 - DNA, 22 bp, Homo sapiens
aaatcctaatgacaagtttagt

SEQ ID NO: 8529677 - DNA, 22 bp, Homo sapiens
aaatcctaatgacaagtttagt

SEQ ID NO: 8529678 - DNA, 22 bp, Homo sapiens
aagcatcttaaaaagtatcaga

SEQ ID NO: 8529679 - DNA, 22 bp, Homo sapiens
aagcatcttagacctgagttcc

SEQ ID NO: 8529680 - DNA, 22 bp, Homo sapiens
aagcatcttctatcagttagac

SEQ ID NO: 8529681 - DNA, 20 bp, Homo sapiens
aagcatctggatgtagcaat

SEQ ID NO: 8529682 - DNA, 20 bp, Homo sapiens
aagcatctggatgtagcaat

SEQ ID NO: 8529683 - DNA, 22 bp, Homo sapiens
aagcatctgtaaagacccttat

SEQ ID NO: 8529684 - DNA, 20 bp, Homo sapiens
aagcatctggatgtagcaat

SEQ ID NO: 8529685 - DNA, 22 bp, Homo sapiens
aagcatctgtaaagacccttat

SEQ ID NO: 8529686 - DNA, 23 bp, Homo sapiens
aagcatcttttcctagctccatc

SEQ ID NO: 8529687 - DNA, 19 bp, Homo sapiens
aagcatctttgaaactggg

SEQ ID NO: 8529688 - DNA, 22 bp, Homo sapiens
aagcatgcaatctgtgataagg

SEQ ID NO: 8529689 - DNA, 22 bp, Homo sapiens
aagcatgcaatctgtgataagg

SEQ ID NO: 8529690 - DNA, 22 bp, Homo sapiens
aagcatctcctcatcatttggg

SEQ ID NO: 8529691 - DNA, 22 bp, Homo sapiens
aagcatctcctcatcatttggg

SEQ ID NO: 8529692 - DNA, 22 bp, Homo sapiens
aagcatctctatgtggagagtg

SEQ ID NO: 8529693 - DNA, 22 bp, Homo sapiens
aagcatctcacctgcccccacg

SEQ ID NO: 8529694 - DNA, 22 bp, Homo sapiens
aagcatctatattccactgtga

SEQ ID NO: 8529695 - DNA, 22 bp, Homo sapiens
aagcatctcctcatcatttggg

SEQ ID NO: 8529696 - DNA, 22 bp, Homo sapiens
aagcatctcattcttgcctgtc

SEQ ID NO: 8529697 - DNA, 22 bp, Homo sapiens
aagcatctcattcttgcctgtc

SEQ ID NO: 8529698 - DNA, 22 bp, Homo sapiens
aagcatctataggttctaggag

SEQ ID NO: 8529699 - DNA, 22 bp, Homo sapiens
aagcatctatattccactgtga

SEQ ID NO: 8529700 - DNA, 22 bp, Homo sapiens
aagcatctaggtgactgacata

SEQ ID NO: 8529701 - DNA, 22 bp, Homo sapiens
aagcatctaggtgactgacata

SEQ ID NO: 8529702 - DNA, 20 bp, Homo sapiens
aagcatggtcaaaacttatg

SEQ ID NO: 8529703 - DNA, 19 bp, Homo sapiens
aagcatggtgcctcacctc

SEQ ID NO: 8529704 - DNA, 20 bp, Homo sapiens
aagcatggtcaaaacttatg

SEQ ID NO: 8529705 - DNA, 22 bp, Homo sapiens
aagcatggctgttctagctata

SEQ ID NO: 8529706 - DNA, 22 bp, Homo sapiens
aagcatggctgttctagctata

SEQ ID NO: 8529707 - DNA, 22 bp, Homo sapiens
aagcatggagcaatagaatgac

SEQ ID NO: 8529708 - DNA, 22 bp, Homo sapiens
aagcatggctgagtgcaatggt

SEQ ID NO: 8529709 - DNA, 22 bp, Homo sapiens
aaatggcaggctctttgctagt

SEQ ID NO: 8529710 - DNA, 22 bp, Homo sapiens
aaatggcaggctctttgctagt

SEQ ID NO: 8529711 - DNA, 22 bp, Homo sapiens
aaatgtaagtctttgtttctta

SEQ ID NO: 8529712 - DNA, 22 bp, Homo sapiens
aaatgtaagtctttgtttctta

SEQ ID NO: 8529713 - DNA, 22 bp, Homo sapiens
aaatgtacaacatccatatata

SEQ ID NO: 8529714 - DNA, 22 bp, Homo sapiens
aaatgtacaacatccatatata

SEQ ID NO: 8529715 - DNA, 22 bp, Homo sapiens
aaatgtacactttgcatcttga

SEQ ID NO: 8529716 - DNA, 22 bp, Homo sapiens
aaatgtacactttgcatcttga

SEQ ID NO: 8529717 - DNA, 22 bp, Homo sapiens
aagctgaattttctaaaagaat

SEQ ID NO: 8529718 - DNA, 22 bp, Homo sapiens
aagctgaatctgaaatagaatt

SEQ ID NO: 8529719 - DNA, 22 bp, Homo sapiens
aagctgaagccggatcaaaaag

SEQ ID NO: 8529720 - DNA, 22 bp, Homo sapiens
aagctgaagccggatcaaaaag

SEQ ID NO: 8529721 - DNA, 22 bp, Homo sapiens
aagctgaagacacagctccagt

SEQ ID NO: 8529722 - DNA, 22 bp, Homo sapiens
aaatgtaccttgatagtttggt

SEQ ID NO: 8529723 - DNA, 22 bp, Homo sapiens
aaatgtacgggagtagaattag

SEQ ID NO: 8529724 - DNA, 18 bp, Homo sapiens
aaatgtactgtccatggc

SEQ ID NO: 8529725 - DNA, 22 bp, Homo sapiens
aaatgtagacctatagggacct

SEQ ID NO: 8529726 - DNA, 22 bp, Homo sapiens
aaatgtactgatacttatttta

SEQ ID NO: 8529727 - DNA, 18 bp, Homo sapiens
aaatgtactgtccatggc

SEQ ID NO: 8529728 - DNA, 22 bp, Homo sapiens
aaatgtatcctacttcctgagt

SEQ ID NO: 8529729 - DNA, 22 bp, Homo sapiens
aaatgtattgcataggatattt

SEQ ID NO: 8529730 - DNA, 22 bp, Homo sapiens
aaatgtatcctacttcctgagt

SEQ ID NO: 8529731 - DNA, 22 bp, Homo sapiens
aaatgtagtatgttgcatgtat

SEQ ID NO: 8529732 - DNA, 22 bp, Homo sapiens
aaagtcaaaatgctctcctgtc

SEQ ID NO: 8529733 - DNA, 22 bp, Homo sapiens
aaagtatttttgacaggcatta

SEQ ID NO: 8529734 - DNA, 22 bp, Homo sapiens
aaagtcaaaatgctctcctgtc

SEQ ID NO: 8529735 - DNA, 22 bp, Homo sapiens
aaagtatttgtgatttttacca

SEQ ID NO: 8529736 - DNA, 22 bp, Homo sapiens
aaagtatttgtgatttttacca

SEQ ID NO: 8529737 - DNA, 22 bp, Homo sapiens
aaagtattcttgactgtttttc

SEQ ID NO: 8529738 - DNA, 22 bp, Homo sapiens
aaagtattcttgactgtttttc

SEQ ID NO: 8529739 - DNA, 22 bp, Homo sapiens
aaagtagtctctttcatctttt

SEQ ID NO: 8529740 - DNA, 22 bp, Homo sapiens
aaagtagagttgtggaattact

SEQ ID NO: 8529741 - DNA, 22 bp, Homo sapiens
aaagtatatttacttactgtga

SEQ ID NO: 8529742 - DNA, 22 bp, Homo sapiens
aaagtcaatgatttctcctgga

SEQ ID NO: 8529743 - DNA, 22 bp, Homo sapiens
aaagtcaatgatttctcctgga

SEQ ID NO: 8529744 - DNA, 22 bp, Homo sapiens
aaagtcacagtttaggggatat

SEQ ID NO: 8529745 - DNA, 22 bp, Homo sapiens
aaagtgcagcttgtgatcccta

SEQ ID NO: 8529746 - DNA, 22 bp, Homo sapiens
aaagtgcagggtgctctggtat

SEQ ID NO: 8529747 - DNA, 22 bp, Homo sapiens
aaagtgcagtaacttgcccaag

SEQ ID NO: 8529748 - DNA, 22 bp, Homo sapiens
aaagtggccatcctctgcatcg

SEQ ID NO: 8529749 - DNA, 22 bp, Homo sapiens
aaagtggccatcctctgcatcg

SEQ ID NO: 8529750 - DNA, 22 bp, Homo sapiens
aaagtgctgtgggctgtaagtg

SEQ ID NO: 8529751 - DNA, 22 bp, Homo sapiens
aaagtgctgtgggctgtaagtg

SEQ ID NO: 8529752 - DNA, 22 bp, Homo sapiens
aaagtgggaacaatggagagtg

SEQ ID NO: 8529753 - DNA, 21 bp, Homo sapiens
aaagtggtaaggattattttg

SEQ ID NO: 8529754 - DNA, 22 bp, Homo sapiens
aaagtggtcaccttctcatttc

SEQ ID NO: 8529755 - DNA, 20 bp, Homo sapiens
aaagtgtaagcatataatta

SEQ ID NO: 8529756 - DNA, 20 bp, Homo sapiens
aaagtgtaagcatataatta

SEQ ID NO: 8529757 - DNA, 20 bp, Homo sapiens
aaagtgtaagcatataatta

SEQ ID NO: 8529758 - DNA, 20 bp, Homo sapiens
aaagtgtaagcatataatta

SEQ ID NO: 8529759 - DNA, 22 bp, Homo sapiens
aaagtgtaaaagcatgttaggg

SEQ ID NO: 8529760 - DNA, 22 bp, Homo sapiens
aaagtgtaaaagcatgttaggg

SEQ ID NO: 8529761 - DNA, 22 bp, Homo sapiens
aaagtgtaaggaatttaagtaa

SEQ ID NO: 8529762 - DNA, 20 bp, Homo sapiens
aaagtgtaaggcaaagttgt

SEQ ID NO: 8529763 - DNA, 22 bp, Homo sapiens
aaagtgtactatgtcatgaaca

SEQ ID NO: 8529764 - DNA, 22 bp, Homo sapiens
aaagtgtagagactttggaacc

SEQ ID NO: 8529765 - DNA, 22 bp, Homo sapiens
aaagtgtagagtgcctcaaaat

SEQ ID NO: 8529766 - DNA, 22 bp, Homo sapiens
aaagtgtactatgtcatgaaca

SEQ ID NO: 8529767 - DNA, 22 bp, Homo sapiens
aaagtgtactatgtcatgaaca

SEQ ID NO: 8529768 - DNA, 22 bp, Homo sapiens
aaagtgtactatgtcatgaaca

SEQ ID NO: 8529769 - DNA, 22 bp, Homo sapiens
aaaggtttatttaatcagggag

SEQ ID NO: 8529770 - DNA, 22 bp, Homo sapiens
aaaggtttccgagctttaattt

SEQ ID NO: 8529771 - DNA, 22 bp, Homo sapiens
aaaggtttatttgttgctcaca

SEQ ID NO: 8529772 - DNA, 22 bp, Homo sapiens
aaaggtttattgctatggttgt

SEQ ID NO: 8529773 - DNA, 22 bp, Homo sapiens
aaaggtttattgattctgctct

SEQ ID NO: 8529774 - DNA, 22 bp, Homo sapiens
aaaggttctacttttaaagaat

SEQ ID NO: 8529775 - DNA, 22 bp, Homo sapiens
aaaggttctcttgttcattatt

SEQ ID NO: 8529776 - DNA, 22 bp, Homo sapiens
aaaggtttgcatggaatttacc

SEQ ID NO: 8529777 - DNA, 22 bp, Homo sapiens
aaaggtttgcatggaatttacc

SEQ ID NO: 8529778 - DNA, 22 bp, Homo sapiens
aaaggtttgaggtgggaagagg

SEQ ID NO: 8529779 - DNA, 22 bp, Homo sapiens
aaaggttttattctgagctctg

SEQ ID NO: 8529780 - DNA, 22 bp, Homo sapiens
aaaggttttcatcacagcaaga

SEQ ID NO: 8529781 - DNA, 22 bp, Homo sapiens
aaaggttttatgttttccactt

SEQ ID NO: 8529782 - DNA, 22 bp, Homo sapiens
aaaggtttgccgacctctgctt

SEQ ID NO: 8529783 - DNA, 22 bp, Homo sapiens
aaagggcctccgcctgggcagg

SEQ ID NO: 8529784 - DNA, 22 bp, Homo sapiens
aaagggccaatggagagtgtgg

SEQ ID NO: 8529785 - DNA, 22 bp, Homo sapiens
aaaggttagttcttagaagtgc

SEQ ID NO: 8529786 - DNA, 22 bp, Homo sapiens
aaaggttattattactattgtc

SEQ ID NO: 8529787 - DNA, 22 bp, Homo sapiens
aaaggaagatgccaggactctg

SEQ ID NO: 8529788 - DNA, 22 bp, Homo sapiens
aaaggaagatgccaggactctg

SEQ ID NO: 8529789 - DNA, 22 bp, Homo sapiens
aaagcttttgttttcgtaactg

SEQ ID NO: 8529790 - DNA, 22 bp, Homo sapiens
aaagctttgtaaataaacaggt

SEQ ID NO: 8529791 - DNA, 22 bp, Homo sapiens
aaagcttttgttttcgtaactg

SEQ ID NO: 8529792 - DNA, 22 bp, Homo sapiens
aaagtactgatgccatcagcac

SEQ ID NO: 8529793 - DNA, 22 bp, Homo sapiens
aaagtacaaatgttctagccat

SEQ ID NO: 8529794 - DNA, 22 bp, Homo sapiens
aactaacagtcattaaaagaac

SEQ ID NO: 8529795 - DNA, 22 bp, Homo sapiens
aactaacagtcattaaaagaac

SEQ ID NO: 8529796 - DNA, 22 bp, Homo sapiens
aaaggttttctagggttgaggg

SEQ ID NO: 8529797 - DNA, 22 bp, Homo sapiens
aacgttttatcgtgtgctcttc

SEQ ID NO: 8529798 - DNA, 22 bp, Homo sapiens
aactaaaagtgtgtctcttgta

SEQ ID NO: 8529799 - DNA, 18 bp, Homo sapiens
aactaaagatctttaagc

SEQ ID NO: 8529800 - DNA, 22 bp, Homo sapiens
aactaaatctggcatttagagc

SEQ ID NO: 8529801 - DNA, 22 bp, Homo sapiens
aactaaagtaaccaaggatatc

SEQ ID NO: 8529802 - DNA, 22 bp, Homo sapiens
aactaaaggctgttgcagggaa

SEQ ID NO: 8529803 - DNA, 22 bp, Homo sapiens
aactaaatctggcatttagagc

SEQ ID NO: 8529804 - DNA, 22 bp, Homo sapiens
aactaaatctggcatttagagc

SEQ ID NO: 8529805 - DNA, 22 bp, Homo sapiens
aactaaatctggcatttagagc

SEQ ID NO: 8529806 - DNA, 21 bp, Homo sapiens
aaattttcttggctgtagtgt

SEQ ID NO: 8529807 - DNA, 22 bp, Homo sapiens
aaattttgtattctagttctag

SEQ ID NO: 8529808 - DNA, 22 bp, Homo sapiens
aaattttcagagcactagagaa

SEQ ID NO: 8529809 - DNA, 22 bp, Homo sapiens
aaattttagtaaggaagttgag

SEQ ID NO: 8529810 - DNA, 22 bp, Homo sapiens
aaattttagtaaggaagttgag

SEQ ID NO: 8529811 - DNA, 22 bp, Homo sapiens
aaattttagactcctgggtcta

SEQ ID NO: 8529812 - DNA, 22 bp, Homo sapiens
aaattgtgctcacactgatatt

SEQ ID NO: 8529813 - DNA, 22 bp, Homo sapiens
aaattgtgagctatagatctag

SEQ ID NO: 8529814 - DNA, 22 bp, Homo sapiens
aacaaacaaacattttgtcatc

SEQ ID NO: 8529815 - DNA, 22 bp, Homo sapiens
aacaaacaaacattttgtcatc

SEQ ID NO: 8529816 - DNA, 22 bp, Homo sapiens
aaagagtttccattgacatttc

SEQ ID NO: 8529817 - DNA, 22 bp, Homo sapiens
aaagagtttccattgacatttc

SEQ ID NO: 8529818 - DNA, 22 bp, Homo sapiens
aaagataatgtttccttattct

SEQ ID NO: 8529819 - DNA, 22 bp, Homo sapiens
aaagataatgtttccttattct

SEQ ID NO: 8529820 - DNA, 22 bp, Homo sapiens
aaagataatgtttccttattct

SEQ ID NO: 8529821 - DNA, 22 bp, Homo sapiens
aaagagtttggagacaagatca

SEQ ID NO: 8529822 - DNA, 22 bp, Homo sapiens
aaagagtttggagacaagatca

SEQ ID NO: 8529823 - DNA, 22 bp, Homo sapiens
aacaaaacatttgtcttgtttc

SEQ ID NO: 8529824 - DNA, 22 bp, Homo sapiens
aacaaaacatttgtcttgtttc

SEQ ID NO: 8529825 - DNA, 22 bp, Homo sapiens
aacaaacaaacattttgtcatc

SEQ ID NO: 8529826 - DNA, 22 bp, Homo sapiens
aacaaacaaacattttgtcatc

SEQ ID NO: 8529827 - DNA, 22 bp, Homo sapiens
aaagccatcagtaaaatgattt

SEQ ID NO: 8529828 - DNA, 22 bp, Homo sapiens
aaagccatcagtaaaatgattt

SEQ ID NO: 8529829 - DNA, 22 bp, Homo sapiens
aaagccatcagtaaaatgattt

SEQ ID NO: 8529830 - DNA, 22 bp, Homo sapiens
aaagccataagcctaatactaa

SEQ ID NO: 8529831 - DNA, 22 bp, Homo sapiens
aaagccataagcctaatactaa

SEQ ID NO: 8529832 - DNA, 22 bp, Homo sapiens
aaagccagtttgtctctttaaa

SEQ ID NO: 8529833 - DNA, 22 bp, Homo sapiens
aaagccagtttctggaagtacc

SEQ ID NO: 8529834 - DNA, 22 bp, Homo sapiens
aaagccagttcttttatattgg

SEQ ID NO: 8529835 - DNA, 22 bp, Homo sapiens
aaagccagttcttttatattgg

SEQ ID NO: 8529836 - DNA, 22 bp, Homo sapiens
aaagccagtttctggaagtacc

SEQ ID NO: 8529837 - DNA, 22 bp, Homo sapiens
aaagccagttcttagagaaagc

SEQ ID NO: 8529838 - DNA, 22 bp, Homo sapiens
aaagccagttcttagagaaagc

SEQ ID NO: 8529839 - DNA, 22 bp, Homo sapiens
aaagccagtggtatgagagaaa

SEQ ID NO: 8529840 - DNA, 22 bp, Homo sapiens
aaagccaggttgtgtgcaggaa

SEQ ID NO: 8529841 - DNA, 22 bp, Homo sapiens
aaagccaggttgtgtgcaggaa

SEQ ID NO: 8529842 - DNA, 22 bp, Homo sapiens
aaagccagggtccaggcctgcc

SEQ ID NO: 8529843 - DNA, 22 bp, Homo sapiens
aaagccaggggagggattccca

SEQ ID NO: 8529844 - DNA, 22 bp, Homo sapiens
aaagatacttaatagttgtctg

SEQ ID NO: 8529845 - DNA, 22 bp, Homo sapiens
aaagatatgtctccaaagagat

SEQ ID NO: 8529846 - DNA, 20 bp, Homo sapiens
aaagatactttttgtaatgg

SEQ ID NO: 8529847 - DNA, 22 bp, Homo sapiens
aaagatcaagtaggcatggcct

SEQ ID NO: 8529848 - DNA, 22 bp, Homo sapiens
aaagatcaatagataaagctac

SEQ ID NO: 8529849 - DNA, 22 bp, Homo sapiens
aaagatcaatagataaagctac

SEQ ID NO: 8529850 - DNA, 22 bp, Homo sapiens
aaagatatgtctccaaagagat

SEQ ID NO: 8529851 - DNA, 22 bp, Homo sapiens
aaagccaggggagggattccca

SEQ ID NO: 8529852 - DNA, 22 bp, Homo sapiens
aaagatcagaggatagctgagt

SEQ ID NO: 8529853 - DNA, 22 bp, Homo sapiens
aaagatcagaggatagctgagt

SEQ ID NO: 8529854 - DNA, 22 bp, Homo sapiens
aaagatcacgtcccaggactcg

SEQ ID NO: 8529855 - DNA, 22 bp, Homo sapiens
aaagctacctttgtgttcatag

SEQ ID NO: 8529856 - DNA, 22 bp, Homo sapiens
aacagcagcaagtaagcaggtc

SEQ ID NO: 8529857 - DNA, 22 bp, Homo sapiens
aacagcaatagcactattcatt

SEQ ID NO: 8529858 - DNA, 22 bp, Homo sapiens
aacagcaatagcactattcatt

SEQ ID NO: 8529859 - DNA, 22 bp, Homo sapiens
aacagcaatagcactattcatt

SEQ ID NO: 8529860 - DNA, 22 bp, Homo sapiens
aacagcagaaactgcaagctac

SEQ ID NO: 8529861 - DNA, 22 bp, Homo sapiens
aacagcagcaagtaagcaggtc

SEQ ID NO: 8529862 - DNA, 22 bp, Homo sapiens
aacagcagcaagtaagcaggtc

SEQ ID NO: 8529863 - DNA, 22 bp, Homo sapiens
aacagcagaggagcgatggctg

SEQ ID NO: 8529864 - DNA, 22 bp, Homo sapiens
aacagcagaaactgcaagctac

SEQ ID NO: 8529865 - DNA, 22 bp, Homo sapiens
aaagccatctgtattaagtgaa

SEQ ID NO: 8529866 - DNA, 22 bp, Homo sapiens
aaagccatgaatgttatagagg

SEQ ID NO: 8529867 - DNA, 22 bp, Homo sapiens
aaagccatgaatgttatagagg

SEQ ID NO: 8529868 - DNA, 22 bp, Homo sapiens
aaagccatgaatgttatagagg

SEQ ID NO: 8529869 - DNA, 22 bp, Homo sapiens
aacagagtggagccaaactttg

SEQ ID NO: 8529870 - DNA, 22 bp, Homo sapiens
aacagataagtatatctatgta

SEQ ID NO: 8529871 - DNA, 22 bp, Homo sapiens
aacagataagtatatctatgta

SEQ ID NO: 8529872 - DNA, 22 bp, Homo sapiens
aacagagtttcaaataacatct

SEQ ID NO: 8529873 - DNA, 22 bp, Homo sapiens
aacagataagtatatctatgta

SEQ ID NO: 8529874 - DNA, 22 bp, Homo sapiens
aacagataatttctaagttact

SEQ ID NO: 8529875 - DNA, 22 bp, Homo sapiens
aacagatataggcagaactttg

SEQ ID NO: 8529876 - DNA, 22 bp, Homo sapiens
aacagatataggcagaactttg

SEQ ID NO: 8529877 - DNA, 22 bp, Homo sapiens
aacagatttgtgaagctactca

SEQ ID NO: 8529878 - DNA, 22 bp, Homo sapiens
aacagatggccaagtgcatggg

SEQ ID NO: 8529879 - DNA, 19 bp, Homo sapiens
aacagcaacttcctagtca

SEQ ID NO: 8529880 - DNA, 22 bp, Homo sapiens
aaagctgccctacacggaagca

SEQ ID NO: 8529881 - DNA, 22 bp, Homo sapiens
aaagctgcccagctgcctgttt

SEQ ID NO: 8529882 - DNA, 22 bp, Homo sapiens
aaagctgcaagctcctgaggaa

SEQ ID NO: 8529883 - DNA, 22 bp, Homo sapiens
aaagctgccaaggagaatacta

SEQ ID NO: 8529884 - DNA, 22 bp, Homo sapiens
aaagctgcaagctcctgaggaa

SEQ ID NO: 8529885 - DNA, 22 bp, Homo sapiens
aaagctgatgtctactagagaa

SEQ ID NO: 8529886 - DNA, 22 bp, Homo sapiens
aaagctcttttccaagtattga

SEQ ID NO: 8529887 - DNA, 22 bp, Homo sapiens
aaagctgggctggccaacccag

SEQ ID NO: 8529888 - DNA, 22 bp, Homo sapiens
aaagctggcctctcaggcttta

SEQ ID NO: 8529889 - DNA, 22 bp, Homo sapiens
aaagctggcttttacaggggct

SEQ ID NO: 8529890 - DNA, 22 bp, Homo sapiens
aaagctgctttaaacatctatg

SEQ ID NO: 8529891 - DNA, 22 bp, Homo sapiens
aaagctgctgccaatcaggctt

SEQ ID NO: 8529892 - DNA, 22 bp, Homo sapiens
aaagctgctgccaatcaggctt

SEQ ID NO: 8529893 - DNA, 22 bp, Homo sapiens
aaagctgccctacacggaagca

SEQ ID NO: 8529894 - DNA, 22 bp, Homo sapiens
aaagctggttattctgaggcag

SEQ ID NO: 8529895 - DNA, 22 bp, Homo sapiens
aaagctgtaatgcatgctttct

SEQ ID NO: 8529896 - DNA, 22 bp, Homo sapiens
aaagctgttgtatggcccttgg

SEQ ID NO: 8529897 - DNA, 18 bp, Homo sapiens
aaagctgttattccagaa

SEQ ID NO: 8529898 - DNA, 22 bp, Homo sapiens
aaagctgtcaaggcaggaggct

SEQ ID NO: 8529899 - DNA, 22 bp, Homo sapiens
aaagctgtagaatcatcttaat

SEQ ID NO: 8529900 - DNA, 22 bp, Homo sapiens
aaagctgttaaatgcataatgc

SEQ ID NO: 8529901 - DNA, 22 bp, Homo sapiens
aaagcttagcattttcaaaatg

SEQ ID NO: 8529902 - DNA, 22 bp, Homo sapiens
aaagcttctattcacttacttg

SEQ ID NO: 8529903 - DNA, 22 bp, Homo sapiens
aaagctttctagctatgttcta

SEQ ID NO: 8529904 - DNA, 22 bp, Homo sapiens
aaatgcagattgtcattcagga

SEQ ID NO: 8529905 - DNA, 22 bp, Homo sapiens
aaatgcagattgtcattcagga

SEQ ID NO: 8529906 - DNA, 22 bp, Homo sapiens
aaatgcagattgtcattcagga

SEQ ID NO: 8529907 - DNA, 22 bp, Homo sapiens
aaatgcagattttgatgcagca

SEQ ID NO: 8529908 - DNA, 22 bp, Homo sapiens
aaatgcagatccctgaatctca

SEQ ID NO: 8529909 - DNA, 22 bp, Homo sapiens
aaatgcagatccctgaatctca

SEQ ID NO: 8529910 - DNA, 22 bp, Homo sapiens
aaatgcagatccctgaatctca

SEQ ID NO: 8529911 - DNA, 22 bp, Homo sapiens
aaatgcagaatgatttcatcta

SEQ ID NO: 8529912 - DNA, 22 bp, Homo sapiens
aaatgcactgaatattccaaat

SEQ ID NO: 8529913 - DNA, 22 bp, Homo sapiens
aaatgcactgaacacatgttgt

SEQ ID NO: 8529914 - DNA, 22 bp, Homo sapiens
aaatgcactgaatattccaaat

SEQ ID NO: 8529915 - DNA, 22 bp, Homo sapiens
aaatgcaccttgctgtgagact

SEQ ID NO: 8529916 - DNA, 22 bp, Homo sapiens
aaatgcacgctacccagctaga

SEQ ID NO: 8529917 - DNA, 22 bp, Homo sapiens
aaatgcactctgcttctgtgac

SEQ ID NO: 8529918 - DNA, 22 bp, Homo sapiens
aaatgcactgaacacatgttgt

SEQ ID NO: 8529919 - DNA, 22 bp, Homo sapiens
aaagagcaccctcaatgtctga

SEQ ID NO: 8529920 - DNA, 22 bp, Homo sapiens
aaatgcagcagctaattgaaaa

SEQ ID NO: 8529921 - DNA, 22 bp, Homo sapiens
aaatgcagcagctaattgaaaa

SEQ ID NO: 8529922 - DNA, 22 bp, Homo sapiens
aaagaggctcaaggtgggccag

SEQ ID NO: 8529923 - DNA, 22 bp, Homo sapiens
aaagaggcaggtgttactggaa

SEQ ID NO: 8529924 - DNA, 22 bp, Homo sapiens
aaagaggcaatcaatgtagcaa

SEQ ID NO: 8529925 - DNA, 22 bp, Homo sapiens
aaagaggaaccaagagcacgtg

SEQ ID NO: 8529926 - DNA, 22 bp, Homo sapiens
aaagaggatggagtagtcagct

SEQ ID NO: 8529927 - DNA, 22 bp, Homo sapiens
aaagaggatggagtagtcagct

SEQ ID NO: 8529928 - DNA, 22 bp, Homo sapiens
aaattaagggtgagaagagttg

SEQ ID NO: 8529929 - DNA, 22 bp, Homo sapiens
aaattaagggtgagaagagttg

SEQ ID NO: 8529930 - DNA, 22 bp, Homo sapiens
aaattacagatcaccaatgcat

SEQ ID NO: 8529931 - DNA, 22 bp, Homo sapiens
aaattagaaatactttcaaagc

SEQ ID NO: 8529932 - DNA, 22 bp, Homo sapiens
aaattagaagtgctcaggaata

SEQ ID NO: 8529933 - DNA, 22 bp, Homo sapiens
aaattagaagtgctcaggaata

SEQ ID NO: 8529934 - DNA, 22 bp, Homo sapiens
aaattagaccagggctcctgga

SEQ ID NO: 8529935 - DNA, 22 bp, Homo sapiens
aaattgtctctattttgattcg

SEQ ID NO: 8529936 - DNA, 22 bp, Homo sapiens
aaattgtctttaatcaggtcat

SEQ ID NO: 8529937 - DNA, 22 bp, Homo sapiens
aaagagtctggcgttttaatgg

SEQ ID NO: 8529938 - DNA, 21 bp, Homo sapiens
aaagaggttaatattgtaagt

SEQ ID NO: 8529939 - DNA, 21 bp, Homo sapiens
aaagaggttaatattgtaagt

SEQ ID NO: 8529940 - DNA, 21 bp, Homo sapiens
aaagaggttaatattgtaagt

SEQ ID NO: 8529941 - DNA, 22 bp, Homo sapiens
aaagagttctgtttgagctgaa

SEQ ID NO: 8529942 - DNA, 22 bp, Homo sapiens
aaattaagagtaactctgtaga

SEQ ID NO: 8529943 - DNA, 22 bp, Homo sapiens
aaactctttccacgattacttt

SEQ ID NO: 8529944 - DNA, 22 bp, Homo sapiens
aaactctgttgagataatattt

SEQ ID NO: 8529945 - DNA, 22 bp, Homo sapiens
aaactctgtatttgctgtgggt

SEQ ID NO: 8529946 - DNA, 22 bp, Homo sapiens
aaactctgttgagataatattt

SEQ ID NO: 8529947 - DNA, 22 bp, Homo sapiens
aaactctgtagctaaacataat

SEQ ID NO: 8529948 - DNA, 22 bp, Homo sapiens
aaactctgggggtggagcccag

SEQ ID NO: 8529949 - DNA, 22 bp, Homo sapiens
aaactctggattggagtccagc

SEQ ID NO: 8529950 - DNA, 22 bp, Homo sapiens
aaactctggattggagtccagc

SEQ ID NO: 8529951 - DNA, 22 bp, Homo sapiens
aaactctggagatgtttatgca

SEQ ID NO: 8529952 - DNA, 22 bp, Homo sapiens
aaactctgatgcttattgggaa

SEQ ID NO: 8529953 - DNA, 22 bp, Homo sapiens
aaactctgcactgcggtaaggt

SEQ ID NO: 8529954 - DNA, 22 bp, Homo sapiens
aaactctgccatttttggcctg

SEQ ID NO: 8529955 - DNA, 22 bp, Homo sapiens
aaactctggagatgtttatgca

SEQ ID NO: 8529956 - DNA, 21 bp, Homo sapiens
aaactgaagagacaggaactt

SEQ ID NO: 8529957 - DNA, 21 bp, Homo sapiens
aaactgaagagacaggaactt

SEQ ID NO: 8529958 - DNA, 22 bp, Homo sapiens
aaactgaaacatcatcatgttg

SEQ ID NO: 8529959 - DNA, 22 bp, Homo sapiens
aaactgaaacatcatcatgttg

SEQ ID NO: 8529960 - DNA, 22 bp, Homo sapiens
aaactgaaacatcatcatgttg

SEQ ID NO: 8529961 - DNA, 17 bp, Homo sapiens
aaactgaaaaattcact

SEQ ID NO: 8529962 - DNA, 17 bp, Homo sapiens
aaactgaaaaattcact

SEQ ID NO: 8529963 - DNA, 17 bp, Homo sapiens
aaactgaaaaattcact

SEQ ID NO: 8529964 - DNA, 22 bp, Homo sapiens
aaactcttttgcatattagagg

SEQ ID NO: 8529965 - DNA, 22 bp, Homo sapiens
aaactgagaccgaaaggggtag

SEQ ID NO: 8529966 - DNA, 22 bp, Homo sapiens
aaactgaggaacaaggaaggat

SEQ ID NO: 8529967 - DNA, 22 bp, Homo sapiens
aaactgaggctcccgagggtgt

SEQ ID NO: 8529968 - DNA, 21 bp, Homo sapiens
aaactgaggcttcaagcagtg

SEQ ID NO: 8529969 - DNA, 21 bp, Homo sapiens
aaactgaggcttcaagcagtg

SEQ ID NO: 8529970 - DNA, 22 bp, Homo sapiens
aaactgaggagttagactaggg

SEQ ID NO: 8529971 - DNA, 22 bp, Homo sapiens
aaactgaggagttagactaggg

SEQ ID NO: 8529972 - DNA, 22 bp, Homo sapiens
aaactgaggagttagactaggg

SEQ ID NO: 8529973 - DNA, 22 bp, Homo sapiens
aaactgaattcccaagggcatg

SEQ ID NO: 8529974 - DNA, 22 bp, Homo sapiens
aaactgaattcaagtatccagt

SEQ ID NO: 8529975 - DNA, 22 bp, Homo sapiens
aaactgaagtagattctgaaat

SEQ ID NO: 8529976 - DNA, 22 bp, Homo sapiens
aaactgaagagctttttgacac

SEQ ID NO: 8529977 - DNA, 21 bp, Homo sapiens
aaactgaccttgcctgagaca

SEQ ID NO: 8529978 - DNA, 21 bp, Homo sapiens
aaactgaccttgcctgagaca

SEQ ID NO: 8529979 - DNA, 21 bp, Homo sapiens
aaactgaccttgcctgagaca

SEQ ID NO: 8529980 - DNA, 22 bp, Homo sapiens
aaagaatactccttttgccttg

SEQ ID NO: 8529981 - DNA, 22 bp, Homo sapiens
aaagaatagttaagtttagggc

SEQ ID NO: 8529982 - DNA, 22 bp, Homo sapiens
aaagaatagttaagtttagggc

SEQ ID NO: 8529983 - DNA, 22 bp, Homo sapiens
aaagaatagcctttgtccaaat

SEQ ID NO: 8529984 - DNA, 22 bp, Homo sapiens
aaagacacaaatgtagaccaaa

SEQ ID NO: 8529985 - DNA, 22 bp, Homo sapiens
aaagacacaaatgtagaccaaa

SEQ ID NO: 8529986 - DNA, 22 bp, Homo sapiens
aaagacacaaatgtagaccaaa

SEQ ID NO: 8529987 - DNA, 22 bp, Homo sapiens
aaagaatgtctgaacagctggc

SEQ ID NO: 8529988 - DNA, 22 bp, Homo sapiens
aaagaatttgtacaccctacta

SEQ ID NO: 8529989 - DNA, 22 bp, Homo sapiens
aaagaatgtctgaacagctggc

SEQ ID NO: 8529990 - DNA, 22 bp, Homo sapiens
aaagaatcagaagtctcaaaca

SEQ ID NO: 8529991 - DNA, 22 bp, Homo sapiens
aaagaatcagaagtctcaaaca

SEQ ID NO: 8529992 - DNA, 21 bp, Homo sapiens
aaagaatcatgggtaatttca

SEQ ID NO: 8529993 - DNA, 22 bp, Homo sapiens
aaagaatcgtgtgtagtttgaa

SEQ ID NO: 8529994 - DNA, 22 bp, Homo sapiens
aaagaacatcggagtgggcggg

SEQ ID NO: 8529995 - DNA, 22 bp, Homo sapiens
aaagaactaatgtgcaaggttt

SEQ ID NO: 8529996 - DNA, 22 bp, Homo sapiens
aaagaactaatgtgcaaggttt

SEQ ID NO: 8529997 - DNA, 22 bp, Homo sapiens
aaactgcaatgacaggtaggag

SEQ ID NO: 8529998 - DNA, 21 bp, Homo sapiens
aaagaacaggcagatgttctt

SEQ ID NO: 8529999 - DNA, 22 bp, Homo sapiens
aaactgataaaataagtacatt

SEQ ID NO: 8530000 - DNA, 22 bp, Homo sapiens
aaagaagtgttgaatttgcaag

SEQ ID NO: 8530001 - DNA, 22 bp, Homo sapiens
aaactagagcatgtgagtggga

SEQ ID NO: 8530002 - DNA, 22 bp, Homo sapiens
aaactagaaatcagcaagatag

SEQ ID NO: 8530003 - DNA, 22 bp, Homo sapiens
aaagttcatggtgttatagaaa

SEQ ID NO: 8530004 - DNA, 20 bp, Homo sapiens
aaagttcatgtttgcacttt

SEQ ID NO: 8530005 - DNA, 21 bp, Homo sapiens
aaagttcatgctttaatattc

SEQ ID NO: 8530006 - DNA, 21 bp, Homo sapiens
aaagttcatgctttaatattc

SEQ ID NO: 8530007 - DNA, 21 bp, Homo sapiens
aaagttcatgctttaatattc

SEQ ID NO: 8530008 - DNA, 22 bp, Homo sapiens
aaactctagtaaaatgtattca

SEQ ID NO: 8530009 - DNA, 22 bp, Homo sapiens
aaactctagttatgaagtttgt

SEQ ID NO: 8530010 - DNA, 22 bp, Homo sapiens
aaactctagttatgaagtttgt

SEQ ID NO: 8530011 - DNA, 22 bp, Homo sapiens
aaactctagggctccacattcc

SEQ ID NO: 8530012 - DNA, 22 bp, Homo sapiens
aaactagatgaaacgagtaaag

SEQ ID NO: 8530013 - DNA, 22 bp, Homo sapiens
aaactagatgaaacgagtaaag

SEQ ID NO: 8530014 - DNA, 22 bp, Homo sapiens
aaactctcattttagtgcactg

SEQ ID NO: 8530015 - DNA, 19 bp, Homo sapiens
aaactctgaaggccactgg

SEQ ID NO: 8530016 - DNA, 22 bp, Homo sapiens
aaactctcttttcttcagtagg

SEQ ID NO: 8530017 - DNA, 19 bp, Homo sapiens
aaactctgaaggccactgg

SEQ ID NO: 8530018 - DNA, 22 bp, Homo sapiens
aaagttcagtgccttctataca

SEQ ID NO: 8530019 - DNA, 22 bp, Homo sapiens
aaagttcagtgccttctataca

SEQ ID NO: 8530020 - DNA, 22 bp, Homo sapiens
aaagttcagattagactcaaga

SEQ ID NO: 8530021 - DNA, 22 bp, Homo sapiens
aaagttcactgaccagcactgg

SEQ ID NO: 8530022 - DNA, 22 bp, Homo sapiens
aaagttcagattagactcaaga

SEQ ID NO: 8530023 - DNA, 22 bp, Homo sapiens
aaagttagaatgatatcaacga

SEQ ID NO: 8530024 - DNA, 22 bp, Homo sapiens
aaagttacccaatctctatgaa

SEQ ID NO: 8530025 - DNA, 22 bp, Homo sapiens
aaagttactatcacaatgaaat

SEQ ID NO: 8530026 - DNA, 22 bp, Homo sapiens
aaaccttttcagctgaatggag

SEQ ID NO: 8530027 - DNA, 22 bp, Homo sapiens
aaacctagaaggaagggtctct

SEQ ID NO: 8530028 - DNA, 22 bp, Homo sapiens
aaaccggggcctttccacaatg

SEQ ID NO: 8530029 - DNA, 22 bp, Homo sapiens
aaaccgggtccagatcttcagg

SEQ ID NO: 8530030 - DNA, 22 bp, Homo sapiens
aaacctaggtttcctcattcag

SEQ ID NO: 8530031 - DNA, 22 bp, Homo sapiens
aaacctaggtttcctcattcag

SEQ ID NO: 8530032 - DNA, 22 bp, Homo sapiens
aaacctattggcaagaataata

SEQ ID NO: 8530033 - DNA, 22 bp, Homo sapiens
aaacattgtacattctgtagct

SEQ ID NO: 8530034 - DNA, 22 bp, Homo sapiens
aaacattgttatgataaattac

SEQ ID NO: 8530035 - DNA, 22 bp, Homo sapiens
aaacccagggttttgtcttccc

SEQ ID NO: 8530036 - DNA, 22 bp, Homo sapiens
aaacccagggttttgtcttccc

SEQ ID NO: 8530037 - DNA, 22 bp, Homo sapiens
aaaccctgcccttcccaagatg

SEQ ID NO: 8530038 - DNA, 22 bp, Homo sapiens
aaacccatggctgatatcacta

SEQ ID NO: 8530039 - DNA, 22 bp, Homo sapiens
aaaggtcttttttctaacacca

SEQ ID NO: 8530040 - DNA, 22 bp, Homo sapiens
aaaggtcttgtcttgacagagt

SEQ ID NO: 8530041 - DNA, 22 bp, Homo sapiens
aaacattgtaattttagcatgg

SEQ ID NO: 8530042 - DNA, 22 bp, Homo sapiens
aaaggtgactgcagcagctatt

SEQ ID NO: 8530043 - DNA, 22 bp, Homo sapiens
aaaggtgacactctgccagctg

SEQ ID NO: 8530044 - DNA, 22 bp, Homo sapiens
aaacctgaaggatgatacaaca

SEQ ID NO: 8530045 - DNA, 22 bp, Homo sapiens
aaacctcttttaaggagttgtt

SEQ ID NO: 8530046 - DNA, 22 bp, Homo sapiens
aaacctcttctcaagatttctg

SEQ ID NO: 8530047 - DNA, 22 bp, Homo sapiens
aaacctctttccattagaggaa

SEQ ID NO: 8530048 - DNA, 22 bp, Homo sapiens
aaacctctccactacatgacag

SEQ ID NO: 8530049 - DNA, 22 bp, Homo sapiens
aaacctctgaatactgttggca

SEQ ID NO: 8530050 - DNA, 22 bp, Homo sapiens
aaacctctgggttccgtggttt

SEQ ID NO: 8530051 - DNA, 22 bp, Homo sapiens
aaacctctgtgctatgacaccc

SEQ ID NO: 8530052 - DNA, 22 bp, Homo sapiens
aaacctcttaatggcctgtaat

SEQ ID NO: 8530053 - DNA, 22 bp, Homo sapiens
aaacctgaagtacgttacataa

SEQ ID NO: 8530054 - DNA, 22 bp, Homo sapiens
aaacctgaagtacgttacataa

SEQ ID NO: 8530055 - DNA, 22 bp, Homo sapiens
aaacctgaatgtatgtcagaag

SEQ ID NO: 8530056 - DNA, 22 bp, Homo sapiens
aaacctggacttgtaatgataa

SEQ ID NO: 8530057 - DNA, 22 bp, Homo sapiens
aaacctgatagattttcagaat

SEQ ID NO: 8530058 - DNA, 22 bp, Homo sapiens
aaacctggaacatttgactagg

SEQ ID NO: 8530059 - DNA, 22 bp, Homo sapiens
aaacctggtggaacggtgaata

SEQ ID NO: 8530060 - DNA, 22 bp, Homo sapiens
aaacctggtggaacggtgaata

SEQ ID NO: 8530061 - DNA, 22 bp, Homo sapiens
aaacctgtggccactaaatttg

SEQ ID NO: 8530062 - DNA, 22 bp, Homo sapiens
aaacctgtctgattatggagac

SEQ ID NO: 8530063 - DNA, 22 bp, Homo sapiens
aaacctgtagcagtttgttaca

SEQ ID NO: 8530064 - DNA, 19 bp, Homo sapiens
aaacctgttagtagagcac

SEQ ID NO: 8530065 - DNA, 22 bp, Homo sapiens
aaacctgttaatagagcgatgc

SEQ ID NO: 8530066 - DNA, 19 bp, Homo sapiens
aaacctgttagtagagcac

SEQ ID NO: 8530067 - DNA, 22 bp, Homo sapiens
aaaccttaaaccaagctcttga

SEQ ID NO: 8530068 - DNA, 22 bp, Homo sapiens
aaacctttaccagactagcaag

SEQ ID NO: 8530069 - DNA, 22 bp, Homo sapiens
aaacctttctcagtgctaaaat

SEQ ID NO: 8530070 - DNA, 22 bp, Homo sapiens
aaacctttctgctctcagcgta

SEQ ID NO: 8530071 - DNA, 22 bp, Homo sapiens
aaacctttgtgtgtctgtgcct

SEQ ID NO: 8530072 - DNA, 22 bp, Homo sapiens
aaaccttttcagctgaatggag

SEQ ID NO: 8530073 - DNA, 22 bp, Homo sapiens
aaacagtggccaattctggaga

SEQ ID NO: 8530074 - DNA, 22 bp, Homo sapiens
aaacagtgtttttatgatttat

SEQ ID NO: 8530075 - DNA, 22 bp, Homo sapiens
aaacagtgtgtttcagagaggc

SEQ ID NO: 8530076 - DNA, 22 bp, Homo sapiens
aaacagtgtgtttcagagaggc

SEQ ID NO: 8530077 - DNA, 22 bp, Homo sapiens
aaacagtttcattttcatgacc

SEQ ID NO: 8530078 - DNA, 22 bp, Homo sapiens
aaacagtttcattttcatgacc

SEQ ID NO: 8530079 - DNA, 22 bp, Homo sapiens
aaacagtttataacatgatact

SEQ ID NO: 8530080 - DNA, 22 bp, Homo sapiens
aaacagtttataacatgatact

SEQ ID NO: 8530081 - DNA, 22 bp, Homo sapiens
aaaggtagtacttctagaaggg

SEQ ID NO: 8530082 - DNA, 22 bp, Homo sapiens
aaaggtatgatactgtgacatg

SEQ ID NO: 8530083 - DNA, 22 bp, Homo sapiens
aaaggtatgatactgtgacatg

SEQ ID NO: 8530084 - DNA, 22 bp, Homo sapiens
aaaggtcaagctggactcaggt

SEQ ID NO: 8530085 - DNA, 22 bp, Homo sapiens
aaaggtcttaaggttaagcagg

SEQ ID NO: 8530086 - DNA, 22 bp, Homo sapiens
aaaggtaactggggttttgcca

SEQ ID NO: 8530087 - DNA, 22 bp, Homo sapiens
aaaggtaaagtatctgcccaag

SEQ ID NO: 8530088 - DNA, 22 bp, Homo sapiens
aaaggtaaagtatctgcccaag

SEQ ID NO: 8530089 - DNA, 22 bp, Homo sapiens
aaacagtttctaatcatggaga

SEQ ID NO: 8530090 - DNA, 22 bp, Homo sapiens
aaagggctgtcaaataagcaac

SEQ ID NO: 8530091 - DNA, 22 bp, Homo sapiens
aaacaatgaaattcattcttca

SEQ ID NO: 8530092 - DNA, 22 bp, Homo sapiens
aaacaatgaaattcattcttca

SEQ ID NO: 8530093 - DNA, 22 bp, Homo sapiens
aaacaatgaaattcattcttca

SEQ ID NO: 8530094 - DNA, 22 bp, Homo sapiens
aaacaatgaaattcattcttca

SEQ ID NO: 8530095 - DNA, 22 bp, Homo sapiens
aaacaatgagcttttacacact

SEQ ID NO: 8530096 - DNA, 22 bp, Homo sapiens
aaacaatgagcttttacacact

SEQ ID NO: 8530097 - DNA, 17 bp, Homo sapiens
aaacaatgcagacaagc

SEQ ID NO: 8530098 - DNA, 22 bp, Homo sapiens
aaacaatgtagattaccattta

SEQ ID NO: 8530099 - DNA, 22 bp, Homo sapiens
aaacaatgtacatttataatgc

SEQ ID NO: 8530100 - DNA, 17 bp, Homo sapiens
aaacaatgcagacaagc

SEQ ID NO: 8530101 - DNA, 22 bp, Homo sapiens
aaacaatgtacatttataatgc

SEQ ID NO: 8530102 - DNA, 22 bp, Homo sapiens
aaacagtgactggtacataata

SEQ ID NO: 8530103 - DNA, 22 bp, Homo sapiens
aaacagtgactggtacataata

SEQ ID NO: 8530104 - DNA, 22 bp, Homo sapiens
aaacagctgtcattgttttaaa

SEQ ID NO: 8530105 - DNA, 22 bp, Homo sapiens
aaacagcttgtaaggtgtaatt

SEQ ID NO: 8530106 - DNA, 22 bp, Homo sapiens
aaacagtgcaggaagttaagca

SEQ ID NO: 8530107 - DNA, 22 bp, Homo sapiens
aaacaatgttgtctccaagagg

SEQ ID NO: 8530108 - DNA, 22 bp, Homo sapiens
aaacaatgttgtctccaagagg

SEQ ID NO: 8530109 - DNA, 22 bp, Homo sapiens
aaacaatgtagattaccattta

SEQ ID NO: 8530110 - DNA, 22 bp, Homo sapiens
aaacaatgttcctatattagag

SEQ ID NO: 8530111 - DNA, 22 bp, Homo sapiens
aaacaatgttcctatattagag

SEQ ID NO: 8530112 - DNA, 22 bp, Homo sapiens
aaacagactgcactgccagtca

SEQ ID NO: 8530113 - DNA, 22 bp, Homo sapiens
aaacagaagggtaggtaaacat

SEQ ID NO: 8530114 - DNA, 22 bp, Homo sapiens
aaacagaagggtaggtaaacat

SEQ ID NO: 8530115 - DNA, 22 bp, Homo sapiens
aaacagagagatgtatgtggag

SEQ ID NO: 8530116 - DNA, 22 bp, Homo sapiens
aaaagacatctatttcaggcag

SEQ ID NO: 8530117 - DNA, 22 bp, Homo sapiens
aaaagacatctatttcaggcag

SEQ ID NO: 8530118 - DNA, 22 bp, Homo sapiens
aaaagagaaagtggcaggcttt

SEQ ID NO: 8530119 - DNA, 22 bp, Homo sapiens
aaaagacatctatttcaggcag

SEQ ID NO: 8530120 - DNA, 22 bp, Homo sapiens
aaaagacatatgtgggcattct

SEQ ID NO: 8530121 - DNA, 22 bp, Homo sapiens
aaaagacatatgtgggcattct

SEQ ID NO: 8530122 - DNA, 22 bp, Homo sapiens
aaacagaaatttcctcatgctc

SEQ ID NO: 8530123 - DNA, 22 bp, Homo sapiens
aaacagaaatttcctcatgctc

SEQ ID NO: 8530124 - DNA, 22 bp, Homo sapiens
aaacagaaatttcctcatgctc

SEQ ID NO: 8530125 - DNA, 22 bp, Homo sapiens
aaacactttagaaagggacttg

SEQ ID NO: 8530126 - DNA, 22 bp, Homo sapiens
aaacacttcttaggtcttaagt

SEQ ID NO: 8530127 - DNA, 22 bp, Homo sapiens
aaacacttcttaggtcttaagt

SEQ ID NO: 8530128 - DNA, 22 bp, Homo sapiens
aaacacttgcaaaatggttcct

SEQ ID NO: 8530129 - DNA, 22 bp, Homo sapiens
aaacacttcctgtaacatgaca

SEQ ID NO: 8530130 - DNA, 22 bp, Homo sapiens
aaacacttcaaggacttctgtc

SEQ ID NO: 8530131 - DNA, 22 bp, Homo sapiens
aaaaatcacttttataggcagc

SEQ ID NO: 8530132 - DNA, 22 bp, Homo sapiens
aaaaatcacttttataggcagc

SEQ ID NO: 8530133 - DNA, 22 bp, Homo sapiens
aaacactgtgggacatcttact

SEQ ID NO: 8530134 - DNA, 22 bp, Homo sapiens
aaacacatcattcatgtcgtca

SEQ ID NO: 8530135 - DNA, 22 bp, Homo sapiens
aaacacatcattcatgtcgtca

SEQ ID NO: 8530136 - DNA, 22 bp, Homo sapiens
aaacacaggtactgcagaagtg

SEQ ID NO: 8530137 - DNA, 22 bp, Homo sapiens
aaaaataggtcaaccgtgtatg

SEQ ID NO: 8530138 - DNA, 22 bp, Homo sapiens
aaaaataggtcaaccgtgtatg

SEQ ID NO: 8530139 - DNA, 22 bp, Homo sapiens
aaaaatcacttttataggcagc

SEQ ID NO: 8530140 - DNA, 22 bp, Homo sapiens
aaaaatagcttctcttgtccct

SEQ ID NO: 8530141 - DNA, 22 bp, Homo sapiens
aaaaatagcttctcttgtccct

SEQ ID NO: 8530142 - DNA, 22 bp, Homo sapiens
aaaaataggtcaaccgtgtatg

SEQ ID NO: 8530143 - DNA, 22 bp, Homo sapiens
aaaaatagcttctcttgtccct

SEQ ID NO: 8530144 - DNA, 22 bp, Homo sapiens
aaaaatagaaggattgactgag

SEQ ID NO: 8530145 - DNA, 22 bp, Homo sapiens
aaaaatagaaggattgactgag

SEQ ID NO: 8530146 - DNA, 22 bp, Homo sapiens
aaaaatagaaggattgactgag

SEQ ID NO: 8530147 - DNA, 22 bp, Homo sapiens
aaaaatagaaggattgactgag

SEQ ID NO: 8530148 - DNA, 22 bp, Homo sapiens
aaaatgaataagttaacccagg

SEQ ID NO: 8530149 - DNA, 22 bp, Homo sapiens
aaaatgaataagttaacccagg

SEQ ID NO: 8530150 - DNA, 22 bp, Homo sapiens
aaaatgaataagttaacccagg

SEQ ID NO: 8530151 - DNA, 22 bp, Homo sapiens
aaaatgaataagttaacccagg

SEQ ID NO: 8530152 - DNA, 22 bp, Homo sapiens
aaaaacctttcccatactaaga

SEQ ID NO: 8530153 - DNA, 22 bp, Homo sapiens
aaaaacctttcattgcaaatgt

SEQ ID NO: 8530154 - DNA, 22 bp, Homo sapiens
aaaaacctttcccatactaaga

SEQ ID NO: 8530155 - DNA, 22 bp, Homo sapiens
aaaaacctttcccatactaaga

SEQ ID NO: 8530156 - DNA, 22 bp, Homo sapiens
aaaatagttaacgttcagagta

SEQ ID NO: 8530157 - DNA, 22 bp, Homo sapiens
aaaatctggtaatttgaatgtg

SEQ ID NO: 8530158 - DNA, 22 bp, Homo sapiens
aaaatagttaacgttcagagta

SEQ ID NO: 8530159 - DNA, 22 bp, Homo sapiens
aaaaacctcaattacttttgca

SEQ ID NO: 8530160 - DNA, 22 bp, Homo sapiens
aaaaacctcaattacttttgca

SEQ ID NO: 8530161 - DNA, 22 bp, Homo sapiens
aaaaacctttcattgcaaatgt

SEQ ID NO: 8530162 - DNA, 22 bp, Homo sapiens
aaaaacctttcattgcaaatgt

SEQ ID NO: 8530163 - DNA, 22 bp, Homo sapiens
aaaaaccattgtcttcagtctc

SEQ ID NO: 8530164 - DNA, 22 bp, Homo sapiens
aaaaaccattgtcttcagtctc

SEQ ID NO: 8530165 - DNA, 22 bp, Homo sapiens
aaaatgaacagaacaatgggga

SEQ ID NO: 8530166 - DNA, 22 bp, Homo sapiens
aaaatcttgtgacttaggaagg

SEQ ID NO: 8530167 - DNA, 22 bp, Homo sapiens
aaaatgaacagaacaatgggga

SEQ ID NO: 8530168 - DNA, 22 bp, Homo sapiens
aaaatcttgtgacttaggaagg

SEQ ID NO: 8530169 - DNA, 22 bp, Homo sapiens
aaaatcttgtgacttaggaagg

SEQ ID NO: 8530170 - DNA, 22 bp, Homo sapiens
aaaatcttgactgtttttagaa

SEQ ID NO: 8530171 - DNA, 23 bp, Homo sapiens
aaaatcttctgcctatgaagaaa

SEQ ID NO: 8530172 - DNA, 23 bp, Homo sapiens
aaaaaaccatgtaggcactcagt

SEQ ID NO: 8530173 - DNA, 23 bp, Homo sapiens
aaaaaaccatgtaggcactcagt

SEQ ID NO: 8530174 - DNA, 22 bp, Homo sapiens
aaaaaagattgatggtggatgc

SEQ ID NO: 8530175 - DNA, 22 bp, Homo sapiens
aaaaaattatcatagttcctga

SEQ ID NO: 8530176 - DNA, 22 bp, Homo sapiens
aaaaaatcagatctttggttaa

SEQ ID NO: 8530177 - DNA, 22 bp, Homo sapiens
aaaaaatcagatctttggttaa

SEQ ID NO: 8530178 - DNA, 22 bp, Homo sapiens
aaaaacagaatgtgtctaactc

SEQ ID NO: 8530179 - DNA, 20 bp, Homo sapiens
aaaaacagtaatgctgaaga

SEQ ID NO: 8530180 - DNA, 20 bp, Homo sapiens
aaaaacagtaatgctgaaga

SEQ ID NO: 8530181 - DNA, 20 bp, Homo sapiens
aaaaacagtaatgctgaaga

SEQ ID NO: 8530182 - DNA, 22 bp, Homo sapiens
aaaaacagaatgtgtctaactc

SEQ ID NO: 8530183 - DNA, 20 bp, Homo sapiens
aaaaacagtaatgctgaaga

SEQ ID NO: 8530184 - DNA, 22 bp, Homo sapiens
aaaaacactgggctgggagtca

SEQ ID NO: 8530185 - DNA, 22 bp, Homo sapiens
aaaaacactgggctgggagtca

SEQ ID NO: 8530186 - DNA, 22 bp, Homo sapiens
aaaaacacaactgtctttctct

SEQ ID NO: 8530187 - DNA, 22 bp, Homo sapiens
aaaaacacaactgtctttctct

SEQ ID NO: 8530188 - DNA, 22 bp, Homo sapiens
aaaaacacaactgtctttctct

SEQ ID NO: 8530189 - DNA, 22 bp, Homo sapiens
aaaatcctctaattctagaata

SEQ ID NO: 8530190 - DNA, 22 bp, Homo sapiens
aaaatcctgctgactcgagatg

SEQ ID NO: 8530191 - DNA, 22 bp, Homo sapiens
aaaatcctgctgactcgagatg

SEQ ID NO: 8530192 - DNA, 22 bp, Homo sapiens
aaaatcctctaattctagaata

SEQ ID NO: 8530193 - DNA, 22 bp, Homo sapiens
aaaatcctctaattctagaata

SEQ ID NO: 8530194 - DNA, 22 bp, Homo sapiens
aaaatcacaagcttgggtcact

SEQ ID NO: 8530195 - DNA, 22 bp, Homo sapiens
aaaatcacacaagtagatgggg

SEQ ID NO: 8530196 - DNA, 22 bp, Homo sapiens
aaaatcagtacactttattttg

SEQ ID NO: 8530197 - DNA, 21 bp, Homo sapiens
aaaatcaccttaggtcactgg

SEQ ID NO: 8530198 - DNA, 22 bp, Homo sapiens
aaaatcagtacactttattttg

SEQ ID NO: 8530199 - DNA, 22 bp, Homo sapiens
aaagacattagcttagatgtca

SEQ ID NO: 8530200 - DNA, 22 bp, Homo sapiens
aaagacattagcttagatgtca

SEQ ID NO: 8530201 - DNA, 22 bp, Homo sapiens
aaagacattagcttagatgtca

SEQ ID NO: 8530202 - DNA, 22 bp, Homo sapiens
aaagacattagcttagatgtca

SEQ ID NO: 8530203 - DNA, 22 bp, Homo sapiens
aaagacatggcaagagatgggg

SEQ ID NO: 8530204 - DNA, 22 bp, Homo sapiens
aaagacatggcaagagatgggg

SEQ ID NO: 8530205 - DNA, 22 bp, Homo sapiens
aaagacatggaactagagatgg

SEQ ID NO: 8530206 - DNA, 22 bp, Homo sapiens
aaagacattagattaacgtaca

SEQ ID NO: 8530207 - DNA, 22 bp, Homo sapiens
aaagacattagattaacgtaca

SEQ ID NO: 8530208 - DNA, 23 bp, Homo sapiens
aaagacctaggatgagggagacg

SEQ ID NO: 8530209 - DNA, 23 bp, Homo sapiens
aaagacctaggatgagggagacg

SEQ ID NO: 8530210 - DNA, 22 bp, Homo sapiens
aaagacctgaaatataatctag

SEQ ID NO: 8530211 - DNA, 22 bp, Homo sapiens
aaagacattgaagaaggactta

SEQ ID NO: 8530212 - DNA, 22 bp, Homo sapiens
aaagacattgaagaaggactta

SEQ ID NO: 8530213 - DNA, 20 bp, Homo sapiens
aaacaaggttgctctgagga

SEQ ID NO: 8530214 - DNA, 22 bp, Homo sapiens
aaacaaggtacacagtaatggt

SEQ ID NO: 8530215 - DNA, 22 bp, Homo sapiens
aaacaagagtcttgctccacct

SEQ ID NO: 8530216 - DNA, 22 bp, Homo sapiens
aaacaaacaattagttgtgtgg

SEQ ID NO: 8530217 - DNA, 22 bp, Homo sapiens
aaaatctcattatcaggaaggg

SEQ ID NO: 8530218 - DNA, 22 bp, Homo sapiens
aaaatccttagccgagtgaggt

SEQ ID NO: 8530219 - DNA, 22 bp, Homo sapiens
aaaatccttagccgagtgaggt

SEQ ID NO: 8530220 - DNA, 22 bp, Homo sapiens
aaaatctaagtagcgagtaagg

SEQ ID NO: 8530221 - DNA, 20 bp, Homo sapiens
aaaatctcccagaaacttat

SEQ ID NO: 8530222 - DNA, 22 bp, Homo sapiens
aaaattttgccctatccttcat

SEQ ID NO: 8530223 - DNA, 22 bp, Homo sapiens
aaacaatccaggaacctgttta

SEQ ID NO: 8530224 - DNA, 22 bp, Homo sapiens
aaacaatgaaatatttttatgg

SEQ ID NO: 8530225 - DNA, 22 bp, Homo sapiens
aaacaatgaaatatttttatgg

SEQ ID NO: 8530226 - DNA, 22 bp, Homo sapiens
aaacaatgaaatatttttatgg

SEQ ID NO: 8530227 - DNA, 22 bp, Homo sapiens
aaacaagtgtaaactagtctgt

SEQ ID NO: 8530228 - DNA, 22 bp, Homo sapiens
aaacaagtttagaataatgaat

SEQ ID NO: 8530229 - DNA, 22 bp, Homo sapiens
aaagaaggggtctacatccaat

SEQ ID NO: 8530230 - DNA, 22 bp, Homo sapiens
aaagaaggggtctacatccaat

SEQ ID NO: 8530231 - DNA, 22 bp, Homo sapiens
aaagacatggaactagagatgg

SEQ ID NO: 8530232 - DNA, 22 bp, Homo sapiens
aaagacatggaactagagatgg

SEQ ID NO: 8530233 - DNA, 22 bp, Homo sapiens
aaagacatggaactagagatgg

SEQ ID NO: 8530234 - DNA, 22 bp, Homo sapiens
aaagacatggaactagagatgg

SEQ ID NO: 8530235 - DNA, 22 bp, Homo sapiens
aaaagtatggtggtccttttta

SEQ ID NO: 8530236 - DNA, 22 bp, Homo sapiens
aaaagtatggtggtccttttta

SEQ ID NO: 8530237 - DNA, 22 bp, Homo sapiens
aaaagtattggccaccatttct

SEQ ID NO: 8530238 - DNA, 22 bp, Homo sapiens
aaaagtattggccaccatttct

SEQ ID NO: 8530239 - DNA, 22 bp, Homo sapiens
aaaagtattggccaccatttct

SEQ ID NO: 8530240 - DNA, 22 bp, Homo sapiens
aaactctagctactaggataac

SEQ ID NO: 8530241 - DNA, 22 bp, Homo sapiens
aaactctaatcaaatatagcat

SEQ ID NO: 8530242 - DNA, 22 bp, Homo sapiens
aaactcctgggctcaagcagtt

SEQ ID NO: 8530243 - DNA, 22 bp, Homo sapiens
aaactcctgcatactcagaagc

SEQ ID NO: 8530244 - DNA, 22 bp, Homo sapiens
aaaagtatagggtttggagtca

SEQ ID NO: 8530245 - DNA, 22 bp, Homo sapiens
aaaagtactattttaacaaagt

SEQ ID NO: 8530246 - DNA, 22 bp, Homo sapiens
aaaagtactattttaacaaagt

SEQ ID NO: 8530247 - DNA, 22 bp, Homo sapiens
aaaagtaattgtggtttttgct

SEQ ID NO: 8530248 - DNA, 22 bp, Homo sapiens
aaaagtaattgtggtttttgct

SEQ ID NO: 8530249 - DNA, 22 bp, Homo sapiens
aaaagtaattgtggtttttgct

SEQ ID NO: 8530250 - DNA, 22 bp, Homo sapiens
aaaagtactattttaacaaagt

SEQ ID NO: 8530251 - DNA, 22 bp, Homo sapiens
aaaagagagttgccagtctgta

SEQ ID NO: 8530252 - DNA, 22 bp, Homo sapiens
aaaagagagttgccagtctgta

SEQ ID NO: 8530253 - DNA, 22 bp, Homo sapiens
aaacccagagactagaaagacc

SEQ ID NO: 8530254 - DNA, 18 bp, Homo sapiens
aaacccactcagcgctga

SEQ ID NO: 8530255 - DNA, 22 bp, Homo sapiens
aaacccagagactagaaagacc

SEQ ID NO: 8530256 - DNA, 22 bp, Homo sapiens
aaaagagaatcctgtacagaga

SEQ ID NO: 8530257 - DNA, 22 bp, Homo sapiens
aaaagagagctgaggagctcca

SEQ ID NO: 8530258 - DNA, 22 bp, Homo sapiens
aaaagagaatcctgtacagaga

SEQ ID NO: 8530259 - DNA, 22 bp, Homo sapiens
aaaagagaatcctgtacagaga

SEQ ID NO: 8530260 - DNA, 22 bp, Homo sapiens
aaaagagaatcctgtacagaga

SEQ ID NO: 8530261 - DNA, 22 bp, Homo sapiens
aaaagagaaagtggcaggcttt

SEQ ID NO: 8530262 - DNA, 22 bp, Homo sapiens
aaactcaagtctatgaacaagg

SEQ ID NO: 8530263 - DNA, 22 bp, Homo sapiens
aaactcagaaggtacagaaggg

SEQ ID NO: 8530264 - DNA, 22 bp, Homo sapiens
aaactcaagtttcttaatgtca

SEQ ID NO: 8530265 - DNA, 22 bp, Homo sapiens
aaactcagatgtggtgaagacc

SEQ ID NO: 8530266 - DNA, 22 bp, Homo sapiens
aaactcagacacagtatctgtt

SEQ ID NO: 8530267 - DNA, 22 bp, Homo sapiens
aaactcatgccattaatccttt

SEQ ID NO: 8530268 - DNA, 19 bp, Homo sapiens
aaactcatagactcatatt

SEQ ID NO: 8530269 - DNA, 19 bp, Homo sapiens
aaactcatagactcatatt

SEQ ID NO: 8530270 - DNA, 19 bp, Homo sapiens
acaaactgagtacacttgt

SEQ ID NO: 8530271 - DNA, 22 bp, Homo sapiens
acaaactgaatgggttttctgt

SEQ ID NO: 8530272 - DNA, 22 bp, Homo sapiens
acaaactacctacagatgttca

SEQ ID NO: 8530273 - DNA, 21 bp, Homo sapiens
acaaactgaaatgagtttcct

SEQ ID NO: 8530274 - DNA, 22 bp, Homo sapiens
acaaactacctacagatgttca

SEQ ID NO: 8530275 - DNA, 22 bp, Homo sapiens
acaaacttcccagacaagctcc

SEQ ID NO: 8530276 - DNA, 22 bp, Homo sapiens
acaaatgagaatgtagacagag

SEQ ID NO: 8530277 - DNA, 22 bp, Homo sapiens
acaaatgactcaaacaccactt

SEQ ID NO: 8530278 - DNA, 22 bp, Homo sapiens
acaaatgattatcacagaggag

SEQ ID NO: 8530279 - DNA, 22 bp, Homo sapiens
acaaatgattttccaagccagt

SEQ ID NO: 8530280 - DNA, 22 bp, Homo sapiens
acaaatgagaatgtagacagag

SEQ ID NO: 8530281 - DNA, 19 bp, Homo sapiens
acaaatgatgttgcactga

SEQ ID NO: 8530282 - DNA, 22 bp, Homo sapiens
acaaatgagaatgtagacagag

SEQ ID NO: 8530283 - DNA, 22 bp, Homo sapiens
acaaatgcaagttttatgtcaa

SEQ ID NO: 8530284 - DNA, 22 bp, Homo sapiens
acaaatgcagcataaagtgaac

SEQ ID NO: 8530285 - DNA, 20 bp, Homo sapiens
acaaatgcattctgtgacat

SEQ ID NO: 8530286 - DNA, 22 bp, Homo sapiens
acaaatgccatatataaattct

SEQ ID NO: 8530287 - DNA, 23 bp, Homo sapiens
acaaatgcccatacatctagttc

SEQ ID NO: 8530288 - DNA, 22 bp, Homo sapiens
acaaatgcttagttcaccaaaa

SEQ ID NO: 8530289 - DNA, 22 bp, Homo sapiens
acaaaatcaaaggagtgattca

SEQ ID NO: 8530290 - DNA, 22 bp, Homo sapiens
acaaaattacctagttattttc

SEQ ID NO: 8530291 - DNA, 22 bp, Homo sapiens
acaaaattatgaagaggccttg

SEQ ID NO: 8530292 - DNA, 22 bp, Homo sapiens
acaaaattatgaagaggccttg

SEQ ID NO: 8530293 - DNA, 22 bp, Homo sapiens
acaaaattgtgttaaactttat

SEQ ID NO: 8530294 - DNA, 22 bp, Homo sapiens
acaaacacgagacgccactgtg

SEQ ID NO: 8530295 - DNA, 22 bp, Homo sapiens
acaaacacgagacgccactgtg

SEQ ID NO: 8530296 - DNA, 22 bp, Homo sapiens
acaaaatttttagacaaggctt

SEQ ID NO: 8530297 - DNA, 22 bp, Homo sapiens
acaaacagagttgaaaaatagg

SEQ ID NO: 8530298 - DNA, 22 bp, Homo sapiens
acaaacagagttgaaaaatagg

SEQ ID NO: 8530299 - DNA, 22 bp, Homo sapiens
acaaacagagttgaaaaatagg

SEQ ID NO: 8530300 - DNA, 22 bp, Homo sapiens
acaaacagctaacatatgttaa

SEQ ID NO: 8530301 - DNA, 22 bp, Homo sapiens
acaaacagctaacatatgttaa

SEQ ID NO: 8530302 - DNA, 22 bp, Homo sapiens
acaaactaaaattctttattga

SEQ ID NO: 8530303 - DNA, 22 bp, Homo sapiens
aattttattaactggatgtagc

SEQ ID NO: 8530304 - DNA, 22 bp, Homo sapiens
aattttatgccttgcacgttgg

SEQ ID NO: 8530305 - DNA, 22 bp, Homo sapiens
aattttattaactggatgtagc

SEQ ID NO: 8530306 - DNA, 22 bp, Homo sapiens
aattttatgccttgcacgttgg

SEQ ID NO: 8530307 - DNA, 22 bp, Homo sapiens
aattttatgccttgcacgttgg

SEQ ID NO: 8530308 - DNA, 22 bp, Homo sapiens
aattttattagaaggcaagggg

SEQ ID NO: 8530309 - DNA, 22 bp, Homo sapiens
aattttattaactggatgtagc

SEQ ID NO: 8530310 - DNA, 22 bp, Homo sapiens
aattttattagaaggcaagggg

SEQ ID NO: 8530311 - DNA, 22 bp, Homo sapiens
aattttattagaaggcaagggg

SEQ ID NO: 8530312 - DNA, 22 bp, Homo sapiens
aattttcacagtgctgtgagat

SEQ ID NO: 8530313 - DNA, 22 bp, Homo sapiens
aattttcacagtgctgtgagat

SEQ ID NO: 8530314 - DNA, 22 bp, Homo sapiens
aattttcacagtgctgtgagat

SEQ ID NO: 8530315 - DNA, 22 bp, Homo sapiens
agagctggggccagagtcaagg

SEQ ID NO: 8530316 - DNA, 22 bp, Homo sapiens
agagctgggtgaagtgccatca

SEQ ID NO: 8530317 - DNA, 22 bp, Homo sapiens
agagctggggctctgggtttaa

SEQ ID NO: 8530318 - DNA, 22 bp, Homo sapiens
agagctgggtgaagtgccatca

SEQ ID NO: 8530319 - DNA, 22 bp, Homo sapiens
agagctgggtgaagtgccatca

SEQ ID NO: 8530320 - DNA, 22 bp, Homo sapiens
aatttgtggccacattgtggaa

SEQ ID NO: 8530321 - DNA, 22 bp, Homo sapiens
aatttgtggccacattgtggaa

SEQ ID NO: 8530322 - DNA, 22 bp, Homo sapiens
aatttgtgttatacctgctcct

SEQ ID NO: 8530323 - DNA, 22 bp, Homo sapiens
aatttgtgttagtccacgttca

SEQ ID NO: 8530324 - DNA, 22 bp, Homo sapiens
aatttgttaaaagtgagtgaca

SEQ ID NO: 8530325 - DNA, 22 bp, Homo sapiens
agagctgggtggtggtgactca

SEQ ID NO: 8530326 - DNA, 22 bp, Homo sapiens
aatttgtgaatctgtctcttga

SEQ ID NO: 8530327 - DNA, 20 bp, Homo sapiens
agaggccagttaggagtcta

SEQ ID NO: 8530328 - DNA, 20 bp, Homo sapiens
agaggccagttaggagtcta

SEQ ID NO: 8530329 - DNA, 20 bp, Homo sapiens
agaggccagttaggagtcta

SEQ ID NO: 8530330 - DNA, 22 bp, Homo sapiens
agaggccatgctagaggcctgg

SEQ ID NO: 8530331 - DNA, 22 bp, Homo sapiens
agaggccatctgctctgtgggg

SEQ ID NO: 8530332 - DNA, 22 bp, Homo sapiens
agaggccatctgctctgtgggg

SEQ ID NO: 8530333 - DNA, 22 bp, Homo sapiens
aattttctaaggtgatgatctg

SEQ ID NO: 8530334 - DNA, 22 bp, Homo sapiens
aattttctgatgatgaagcacg

SEQ ID NO: 8530335 - DNA, 22 bp, Homo sapiens
aattttctgcctagcaaaaact

SEQ ID NO: 8530336 - DNA, 22 bp, Homo sapiens
agaggccagtggctgtgctgtc

SEQ ID NO: 8530337 - DNA, 22 bp, Homo sapiens
agaggccagtggctgtgctgtc

SEQ ID NO: 8530338 - DNA, 22 bp, Homo sapiens
agaggccaggtccagagtttgt

SEQ ID NO: 8530339 - DNA, 22 bp, Homo sapiens
agaggccaggtccagagtttgt

SEQ ID NO: 8530340 - DNA, 21 bp, Homo sapiens
agaggccctcggactgggcgt

SEQ ID NO: 8530341 - DNA, 22 bp, Homo sapiens
agaggccccatgggatggcggt

SEQ ID NO: 8530342 - DNA, 22 bp, Homo sapiens
agaggccatgctagaggcctgg

SEQ ID NO: 8530343 - DNA, 22 bp, Homo sapiens
agaggccatgctagaggcctgg

SEQ ID NO: 8530344 - DNA, 22 bp, Homo sapiens
agaggccatggggcatttttca

SEQ ID NO: 8530345 - DNA, 20 bp, Homo sapiens
acaaaataggtactgggtag

SEQ ID NO: 8530346 - DNA, 22 bp, Homo sapiens
acaaaaagggagatgaggtaga

SEQ ID NO: 8530347 - DNA, 21 bp, Homo sapiens
agaggccctcggactgggcgt

SEQ ID NO: 8530348 - DNA, 22 bp, Homo sapiens
agatggggtttcatcatgttgg

SEQ ID NO: 8530349 - DNA, 22 bp, Homo sapiens
agatggggctgaaagttccaat

SEQ ID NO: 8530350 - DNA, 22 bp, Homo sapiens
agatggggctgaaagttccaat

SEQ ID NO: 8530351 - DNA, 22 bp, Homo sapiens
agatggggctcagtgtggaggc

SEQ ID NO: 8530352 - DNA, 22 bp, Homo sapiens
agatggggctcagtgtggaggc

SEQ ID NO: 8530353 - DNA, 22 bp, Homo sapiens
agatggggctcagtgtggaggc

SEQ ID NO: 8530354 - DNA, 22 bp, Homo sapiens
agatggggctcagtgtggaggc

SEQ ID NO: 8530355 - DNA, 22 bp, Homo sapiens
acaatgctgttgagacattctt

SEQ ID NO: 8530356 - DNA, 22 bp, Homo sapiens
agatgggtaactggagtctgct

SEQ ID NO: 8530357 - DNA, 22 bp, Homo sapiens
acaatggcatgctagcaaatgg

SEQ ID NO: 8530358 - DNA, 22 bp, Homo sapiens
acaatgtagaggctgaaagcaa

SEQ ID NO: 8530359 - DNA, 22 bp, Homo sapiens
acaatgtttttgttcaaagagt

SEQ ID NO: 8530360 - DNA, 22 bp, Homo sapiens
acaatgtttttgttcaaagagt

SEQ ID NO: 8530361 - DNA, 22 bp, Homo sapiens
acaatgttttgaaacatctagg

SEQ ID NO: 8530362 - DNA, 22 bp, Homo sapiens
acaattactcaactttgctgct

SEQ ID NO: 8530363 - DNA, 22 bp, Homo sapiens
acaattagtgatcagtgatgcc

SEQ ID NO: 8530364 - DNA, 22 bp, Homo sapiens
acaattcaagaagagagatgaa

SEQ ID NO: 8530365 - DNA, 22 bp, Homo sapiens
acaattcaagatgagattcagg

SEQ ID NO: 8530366 - DNA, 22 bp, Homo sapiens
acaattcaagatgagattcagg

SEQ ID NO: 8530367 - DNA, 22 bp, Homo sapiens
acaattctctcatatcttatta

SEQ ID NO: 8530368 - DNA, 22 bp, Homo sapiens
acaattctgatggtttcccagt

SEQ ID NO: 8530369 - DNA, 22 bp, Homo sapiens
acaattcctgagaatacttgtt

SEQ ID NO: 8530370 - DNA, 22 bp, Homo sapiens
acaattctctcatatcttatta

SEQ ID NO: 8530371 - DNA, 20 bp, Homo sapiens
agcaccagtgggggcagccc

SEQ ID NO: 8530372 - DNA, 20 bp, Homo sapiens
agcaccagtgggggcagccc

SEQ ID NO: 8530373 - DNA, 22 bp, Homo sapiens
agcacaggtacggagatgctac

SEQ ID NO: 8530374 - DNA, 22 bp, Homo sapiens
agcacaggtacggagatgctac

SEQ ID NO: 8530375 - DNA, 22 bp, Homo sapiens
agcaaggcagctttcactgctt

SEQ ID NO: 8530376 - DNA, 22 bp, Homo sapiens
agcaccagtttcgtcgtgacaa

SEQ ID NO: 8530377 - DNA, 21 bp, Homo sapiens
agcaccagttttatgccaggc

SEQ ID NO: 8530378 - DNA, 22 bp, Homo sapiens
agcaaggaaagtaggcacggaa

SEQ ID NO: 8530379 - DNA, 22 bp, Homo sapiens
agcaaggaaagtaggcacggaa

SEQ ID NO: 8530380 - DNA, 22 bp, Homo sapiens
agcaaggagtagaacaagagtg

SEQ ID NO: 8530381 - DNA, 21 bp, Homo sapiens
agcaaggcagcctctcagcct

SEQ ID NO: 8530382 - DNA, 22 bp, Homo sapiens
agcaaggattatcctgggaagg

SEQ ID NO: 8530383 - DNA, 22 bp, Homo sapiens
agcacaggtacggagatgctac

SEQ ID NO: 8530384 - DNA, 22 bp, Homo sapiens
agcaagcattgctggttaggtc

SEQ ID NO: 8530385 - DNA, 22 bp, Homo sapiens
agcaagctacctagatagtcta

SEQ ID NO: 8530386 - DNA, 22 bp, Homo sapiens
agcaagctaacataggagattg

SEQ ID NO: 8530387 - DNA, 21 bp, Homo sapiens
agcaagcagaatccatctaga

SEQ ID NO: 8530388 - DNA, 18 bp, Homo sapiens
agcaagcagttttcatgt

SEQ ID NO: 8530389 - DNA, 22 bp, Homo sapiens
agcaaggaaactatggagagat

SEQ ID NO: 8530390 - DNA, 22 bp, Homo sapiens
agcaaggaaactatggagagat

SEQ ID NO: 8530391 - DNA, 22 bp, Homo sapiens
agcaaggaaactatggagagat

SEQ ID NO: 8530392 - DNA, 22 bp, Homo sapiens
agcaaggaaactatggagagat

SEQ ID NO: 8530393 - DNA, 22 bp, Homo sapiens
agcaagctgtcaagagagctga

SEQ ID NO: 8530394 - DNA, 22 bp, Homo sapiens
agcaagcagaaatgccatggca

SEQ ID NO: 8530395 - DNA, 22 bp, Homo sapiens
agcaagcacacttcatgtgaac

SEQ ID NO: 8530396 - DNA, 22 bp, Homo sapiens
agcaagcagaaatgccatggca

SEQ ID NO: 8530397 - DNA, 22 bp, Homo sapiens
agcaagcagaattctgtcctct

SEQ ID NO: 8530398 - DNA, 22 bp, Homo sapiens
agcaagatttttcaggttagta

SEQ ID NO: 8530399 - DNA, 22 bp, Homo sapiens
agcaagattttccttgaatgtt

SEQ ID NO: 8530400 - DNA, 22 bp, Homo sapiens
acaaattatagaaaattgagct

SEQ ID NO: 8530401 - DNA, 22 bp, Homo sapiens
acaaattctacaatcatatgat

SEQ ID NO: 8530402 - DNA, 22 bp, Homo sapiens
acaaggaacaagcatgtagttt

SEQ ID NO: 8530403 - DNA, 22 bp, Homo sapiens
acaaggaacaagcatgtagttt

SEQ ID NO: 8530404 - DNA, 22 bp, Homo sapiens
acaagggattgttgagtagtct

SEQ ID NO: 8530405 - DNA, 19 bp, Homo sapiens
acaagggcaggcaaggtga

SEQ ID NO: 8530406 - DNA, 22 bp, Homo sapiens
acaaggaacaagcatgtagttt

SEQ ID NO: 8530407 - DNA, 22 bp, Homo sapiens
acaaatgtctacattgagaata

SEQ ID NO: 8530408 - DNA, 22 bp, Homo sapiens
acaaatgtctacattgagaata

SEQ ID NO: 8530409 - DNA, 18 bp, Homo sapiens
acaaatgtagtgtcttaa

SEQ ID NO: 8530410 - DNA, 22 bp, Homo sapiens
acaaatgtgattgtttctgaaa

SEQ ID NO: 8530411 - DNA, 22 bp, Homo sapiens
acaaatgtgattgtttctgaaa

SEQ ID NO: 8530412 - DNA, 22 bp, Homo sapiens
acaaatgtggacatggataatg

SEQ ID NO: 8530413 - DNA, 22 bp, Homo sapiens
acaaatgtggacatggataatg

SEQ ID NO: 8530414 - DNA, 22 bp, Homo sapiens
acaaatgtggacatggataatg

SEQ ID NO: 8530415 - DNA, 22 bp, Homo sapiens
acaaggttgattctggcatctg

SEQ ID NO: 8530416 - DNA, 22 bp, Homo sapiens
acaaggtatccacattaaatgt

SEQ ID NO: 8530417 - DNA, 19 bp, Homo sapiens
acaagtcacttacttagta

SEQ ID NO: 8530418 - DNA, 22 bp, Homo sapiens
acaaggtttaaatagccatcag

SEQ ID NO: 8530419 - DNA, 22 bp, Homo sapiens
acaaggtttggtaccacatcca

SEQ ID NO: 8530420 - DNA, 22 bp, Homo sapiens
acaagtgttgcattttgccatt

SEQ ID NO: 8530421 - DNA, 22 bp, Homo sapiens
acaagtgggtcctacataaagc

SEQ ID NO: 8530422 - DNA, 22 bp, Homo sapiens
acaagtgtgtgcagtttgtaaa

SEQ ID NO: 8530423 - DNA, 22 bp, Homo sapiens
acaagtgcatggaatcagctgt

SEQ ID NO: 8530424 - DNA, 22 bp, Homo sapiens
acaagtctttttcatgtcttct

SEQ ID NO: 8530425 - DNA, 22 bp, Homo sapiens
acaagtctttttcatgtcttct

SEQ ID NO: 8530426 - DNA, 22 bp, Homo sapiens
acaagtcagtggaattaatatt

SEQ ID NO: 8530427 - DNA, 22 bp, Homo sapiens
acaagtctgttatgcacctgga

SEQ ID NO: 8530428 - DNA, 22 bp, Homo sapiens
agatggggctcagtgtggaggc

SEQ ID NO: 8530429 - DNA, 22 bp, Homo sapiens
agatggggcagaatggagccat

SEQ ID NO: 8530430 - DNA, 22 bp, Homo sapiens
agatggggcagaatggagccat

SEQ ID NO: 8530431 - DNA, 22 bp, Homo sapiens
agatggggcagaatggagccat

SEQ ID NO: 8530432 - DNA, 19 bp, Homo sapiens
agatggggaagagtgtgag

SEQ ID NO: 8530433 - DNA, 19 bp, Homo sapiens
agatggggaagagtgtgag

SEQ ID NO: 8530434 - DNA, 22 bp, Homo sapiens
acaagttaccaaaaaagattca

SEQ ID NO: 8530435 - DNA, 22 bp, Homo sapiens
aatgtcactctgtttcctctgc

SEQ ID NO: 8530436 - DNA, 22 bp, Homo sapiens
aatgtcatagcaaagagagtga

SEQ ID NO: 8530437 - DNA, 22 bp, Homo sapiens
aatgtcatgggaatttattcat

SEQ ID NO: 8530438 - DNA, 22 bp, Homo sapiens
aatgtcatagcatttcttcaat

SEQ ID NO: 8530439 - DNA, 22 bp, Homo sapiens
aatgtcatagcatttcttcaat

SEQ ID NO: 8530440 - DNA, 22 bp, Homo sapiens
aatgtcatgggaatttattcat

SEQ ID NO: 8530441 - DNA, 21 bp, Homo sapiens
aatgtcattgaatggtgagac

SEQ ID NO: 8530442 - DNA, 22 bp, Homo sapiens
aatgtcattggtaaagattagg

SEQ ID NO: 8530443 - DNA, 22 bp, Homo sapiens
aatgtcattgagctccaatcct

SEQ ID NO: 8530444 - DNA, 21 bp, Homo sapiens
aatgtcattgaatggtgagac

SEQ ID NO: 8530445 - DNA, 22 bp, Homo sapiens
aatgtcattgagctccaatcct

SEQ ID NO: 8530446 - DNA, 22 bp, Homo sapiens
agacagggtgatcgcttgagcc

SEQ ID NO: 8530447 - DNA, 22 bp, Homo sapiens
agacagggtgatcgcttgagcc

SEQ ID NO: 8530448 - DNA, 22 bp, Homo sapiens
aatgtattcctcatgcaagagt

SEQ ID NO: 8530449 - DNA, 22 bp, Homo sapiens
agacagggtgatcgcttgagcc

SEQ ID NO: 8530450 - DNA, 22 bp, Homo sapiens
agacagggtcttgatcagagct

SEQ ID NO: 8530451 - DNA, 22 bp, Homo sapiens
agacagggtcttgatcagagct

SEQ ID NO: 8530452 - DNA, 22 bp, Homo sapiens
agacagggtgatcgcttgagcc

SEQ ID NO: 8530453 - DNA, 22 bp, Homo sapiens
agacagggtcttgatcagagct

SEQ ID NO: 8530454 - DNA, 22 bp, Homo sapiens
agacagggtcttgatcagagct

SEQ ID NO: 8530455 - DNA, 22 bp, Homo sapiens
agacagggccactcatcctcac

SEQ ID NO: 8530456 - DNA, 22 bp, Homo sapiens
agacagggtcttgatcagagct

SEQ ID NO: 8530457 - DNA, 22 bp, Homo sapiens
agacagggagggagcgcggctg

SEQ ID NO: 8530458 - DNA, 17 bp, Homo sapiens
aatgtccttggaccaca

SEQ ID NO: 8530459 - DNA, 17 bp, Homo sapiens
aatgtccttggaccaca

SEQ ID NO: 8530460 - DNA, 22 bp, Homo sapiens
aatgtcctaggcatgattttgt

SEQ ID NO: 8530461 - DNA, 22 bp, Homo sapiens
aatgtctatgatcctttaagtt

SEQ ID NO: 8530462 - DNA, 22 bp, Homo sapiens
aatgtcatttaaaataattctg

SEQ ID NO: 8530463 - DNA, 22 bp, Homo sapiens
aatgtcatttaaaataattctg

SEQ ID NO: 8530464 - DNA, 22 bp, Homo sapiens
aatgtcattggtaaagattagg

SEQ ID NO: 8530465 - DNA, 22 bp, Homo sapiens
aatgtcattggtaaagattagg

SEQ ID NO: 8530466 - DNA, 22 bp, Homo sapiens
aatgtcatttttaaatgtgaga

SEQ ID NO: 8530467 - DNA, 22 bp, Homo sapiens
aatgtcatttaggattatgttt

SEQ ID NO: 8530468 - DNA, 22 bp, Homo sapiens
aatgtgttcacaggaaatacag

SEQ ID NO: 8530469 - DNA, 22 bp, Homo sapiens
aatgtgttatttcagaatccag

SEQ ID NO: 8530470 - DNA, 22 bp, Homo sapiens
aatgtcttcagtgtatacatgg

SEQ ID NO: 8530471 - DNA, 22 bp, Homo sapiens
aatgtgttagtattgatttgtc

SEQ ID NO: 8530472 - DNA, 22 bp, Homo sapiens
aatgtgtttagttaatgagttg

SEQ ID NO: 8530473 - DNA, 22 bp, Homo sapiens
aatgtgttgaataaattgtgcc

SEQ ID NO: 8530474 - DNA, 22 bp, Homo sapiens
aatgtgttcagttaaatgaact

SEQ ID NO: 8530475 - DNA, 22 bp, Homo sapiens
aatgtcttaaagtcgtgttaca

SEQ ID NO: 8530476 - DNA, 22 bp, Homo sapiens
aatgtcttcagtgtatacatgg

SEQ ID NO: 8530477 - DNA, 22 bp, Homo sapiens
aatgtctgcctgaactttatat

SEQ ID NO: 8530478 - DNA, 22 bp, Homo sapiens
aatgtctgctctactcaggagg

SEQ ID NO: 8530479 - DNA, 22 bp, Homo sapiens
aatgtctgccagaactgatcat

SEQ ID NO: 8530480 - DNA, 22 bp, Homo sapiens
aatgtctgagtctctgtatccc

SEQ ID NO: 8530481 - DNA, 22 bp, Homo sapiens
aatgtctgagtctctgtatccc

SEQ ID NO: 8530482 - DNA, 22 bp, Homo sapiens
aatgtctgaggctcatctgagg

SEQ ID NO: 8530483 - DNA, 19 bp, Homo sapiens
aatgtctctatctgttctc

SEQ ID NO: 8530484 - DNA, 22 bp, Homo sapiens
aatgtctctctaaataaacttt

SEQ ID NO: 8530485 - DNA, 22 bp, Homo sapiens
aatgcaaagcaagcagagattt

SEQ ID NO: 8530486 - DNA, 22 bp, Homo sapiens
aatgcaaagcaagcagagattt

SEQ ID NO: 8530487 - DNA, 22 bp, Homo sapiens
aatgcaaagagttgcttatcaa

SEQ ID NO: 8530488 - DNA, 22 bp, Homo sapiens
aatgcaaacttcttgttacttg

SEQ ID NO: 8530489 - DNA, 22 bp, Homo sapiens
aatgcaaacttcttgttacttg

SEQ ID NO: 8530490 - DNA, 22 bp, Homo sapiens
aatgcaaacttcttgttacttg

SEQ ID NO: 8530491 - DNA, 22 bp, Homo sapiens
aatgcaaacttcttgttacttg

SEQ ID NO: 8530492 - DNA, 22 bp, Homo sapiens
aatgcaaagtgaggtgagtggc

SEQ ID NO: 8530493 - DNA, 22 bp, Homo sapiens
aatgcaaagctctttaatcctt

SEQ ID NO: 8530494 - DNA, 22 bp, Homo sapiens
aatgcaacctgctgatctgaca

SEQ ID NO: 8530495 - DNA, 22 bp, Homo sapiens
agaagtatcttgggaaggcact

SEQ ID NO: 8530496 - DNA, 22 bp, Homo sapiens
agaagtatgtgagaaattatcc

SEQ ID NO: 8530497 - DNA, 22 bp, Homo sapiens
agaagtataactatttgctttc

SEQ ID NO: 8530498 - DNA, 22 bp, Homo sapiens
agaagtatcaggaagattctca

SEQ ID NO: 8530499 - DNA, 22 bp, Homo sapiens
agaagtagtccagtggaaagta

SEQ ID NO: 8530500 - DNA, 22 bp, Homo sapiens
agaagtagtccagtggaaagta

SEQ ID NO: 8530501 - DNA, 22 bp, Homo sapiens
agaagtaggcagggctgtatca

SEQ ID NO: 8530502 - DNA, 22 bp, Homo sapiens
agaagtaggcagggctgtatca

SEQ ID NO: 8530503 - DNA, 22 bp, Homo sapiens
agaagtagtccagtggaaagta

SEQ ID NO: 8530504 - DNA, 22 bp, Homo sapiens
agaagtaggcagggctgtatca

SEQ ID NO: 8530505 - DNA, 22 bp, Homo sapiens
agaagggctacacgggctctcc

SEQ ID NO: 8530506 - DNA, 22 bp, Homo sapiens
agaaggggagaagctaccagga

SEQ ID NO: 8530507 - DNA, 22 bp, Homo sapiens
agaaggggagaagctaccagga

SEQ ID NO: 8530508 - DNA, 22 bp, Homo sapiens
agaaggggagaagctaccagga

SEQ ID NO: 8530509 - DNA, 22 bp, Homo sapiens
agaaggggcccaaggatgtcag

SEQ ID NO: 8530510 - DNA, 22 bp, Homo sapiens
agaaggggcccaaggatgtcag

SEQ ID NO: 8530511 - DNA, 19 bp, Homo sapiens
agacagagctcagtgggtt

SEQ ID NO: 8530512 - DNA, 19 bp, Homo sapiens
agacagagctcagtgggtt

SEQ ID NO: 8530513 - DNA, 19 bp, Homo sapiens
agacagagctcagtgggtt

SEQ ID NO: 8530514 - DNA, 19 bp, Homo sapiens
agacagagctcagtgggtt

SEQ ID NO: 8530515 - DNA, 22 bp, Homo sapiens
agacagagatactatgttgtca

SEQ ID NO: 8530516 - DNA, 19 bp, Homo sapiens
agacagagactgaaataga

SEQ ID NO: 8530517 - DNA, 22 bp, Homo sapiens
agacagagatactatgttgtca

SEQ ID NO: 8530518 - DNA, 21 bp, Homo sapiens
agacactggtttagcattcat

SEQ ID NO: 8530519 - DNA, 21 bp, Homo sapiens
agacactggtttagcattcat

SEQ ID NO: 8530520 - DNA, 22 bp, Homo sapiens
agacagactttgatctggatgt

SEQ ID NO: 8530521 - DNA, 23 bp, Homo sapiens
agacactgtaaagaattgcagtt

SEQ ID NO: 8530522 - DNA, 23 bp, Homo sapiens
agacactgtaaagaattgcagtt

SEQ ID NO: 8530523 - DNA, 23 bp, Homo sapiens
agacactgtaaagaattgcagtt

SEQ ID NO: 8530524 - DNA, 22 bp, Homo sapiens
aatgcaatgcagcacctccttg

SEQ ID NO: 8530525 - DNA, 22 bp, Homo sapiens
aatgcaatgcagcacctccttg

SEQ ID NO: 8530526 - DNA, 22 bp, Homo sapiens
aatgcaatacctttttatgctg

SEQ ID NO: 8530527 - DNA, 22 bp, Homo sapiens
agacaggccactctggtctggt

SEQ ID NO: 8530528 - DNA, 22 bp, Homo sapiens
agacaggctgctgtctgctagg

SEQ ID NO: 8530529 - DNA, 22 bp, Homo sapiens
agacaggccactctggtctggt

SEQ ID NO: 8530530 - DNA, 22 bp, Homo sapiens
agacagcacttttgtatggggg

SEQ ID NO: 8530531 - DNA, 22 bp, Homo sapiens
agacaggcatgaggctggattg

SEQ ID NO: 8530532 - DNA, 23 bp, Homo sapiens
agacagaggctgaggctggccgc

SEQ ID NO: 8530533 - DNA, 23 bp, Homo sapiens
agacagaggctgaggctggccgc

SEQ ID NO: 8530534 - DNA, 23 bp, Homo sapiens
agacagaggctgaggctggccgc

SEQ ID NO: 8530535 - DNA, 23 bp, Homo sapiens
agacagaggctgaggctggccgc

SEQ ID NO: 8530536 - DNA, 21 bp, Homo sapiens
agacagagtgcagtctacata

SEQ ID NO: 8530537 - DNA, 21 bp, Homo sapiens
agacagagtgcagtctacata

SEQ ID NO: 8530538 - DNA, 20 bp, Homo sapiens
aatgttcagtaattgtttta

SEQ ID NO: 8530539 - DNA, 22 bp, Homo sapiens
aatgttcagaggacaatataaa

SEQ ID NO: 8530540 - DNA, 22 bp, Homo sapiens
aatgttatttctgcatagtagt

SEQ ID NO: 8530541 - DNA, 22 bp, Homo sapiens
aatgttattgtcctttccaaaa

SEQ ID NO: 8530542 - DNA, 22 bp, Homo sapiens
aatgtgtttatttagtgattta

SEQ ID NO: 8530543 - DNA, 22 bp, Homo sapiens
aatgtgtttatttagtgattta

SEQ ID NO: 8530544 - DNA, 22 bp, Homo sapiens
aatgttcaaaagcatcagtgaa

SEQ ID NO: 8530545 - DNA, 22 bp, Homo sapiens
aatgttcaaacagatcacttag

SEQ ID NO: 8530546 - DNA, 22 bp, Homo sapiens
aatgttatttctgcatagtagt

SEQ ID NO: 8530547 - DNA, 22 bp, Homo sapiens
aatgttgaggatatcagaaaat

SEQ ID NO: 8530548 - DNA, 22 bp, Homo sapiens
aatgttcattgattaaatgaat

SEQ ID NO: 8530549 - DNA, 22 bp, Homo sapiens
aatgttcattgttttccatatg

SEQ ID NO: 8530550 - DNA, 22 bp, Homo sapiens
aatgttctcaacaaaaggaagc

SEQ ID NO: 8530551 - DNA, 22 bp, Homo sapiens
aatgttcagtgcctttaaacat

SEQ ID NO: 8530552 - DNA, 22 bp, Homo sapiens
aatgttcattagcattgttgac

SEQ ID NO: 8530553 - DNA, 22 bp, Homo sapiens
aatgtttggactggaaggtccc

SEQ ID NO: 8530554 - DNA, 22 bp, Homo sapiens
aattaccaggatttttcagtat

SEQ ID NO: 8530555 - DNA, 22 bp, Homo sapiens
aattagtaacctaattccatct

SEQ ID NO: 8530556 - DNA, 22 bp, Homo sapiens
aattagtattgcgattcattag

SEQ ID NO: 8530557 - DNA, 22 bp, Homo sapiens
aattagtaacctaattccatct

SEQ ID NO: 8530558 - DNA, 22 bp, Homo sapiens
aattagtattgcgattcattag

SEQ ID NO: 8530559 - DNA, 22 bp, Homo sapiens
aattaggaaattcagccatttt

SEQ ID NO: 8530560 - DNA, 22 bp, Homo sapiens
aatgtttgaactttgcatattt

SEQ ID NO: 8530561 - DNA, 22 bp, Homo sapiens
aatgtttgagcatctacatgct

SEQ ID NO: 8530562 - DNA, 22 bp, Homo sapiens
aatgtttgagcatctacatgct

SEQ ID NO: 8530563 - DNA, 22 bp, Homo sapiens
aatgttgtttttctgcatgtct

SEQ ID NO: 8530564 - DNA, 22 bp, Homo sapiens
aatgttgtttttctgcatgtct

SEQ ID NO: 8530565 - DNA, 19 bp, Homo sapiens
aatgtttaagagaaaaagg

SEQ ID NO: 8530566 - DNA, 22 bp, Homo sapiens
aatgtttaatgttagtggtaat

SEQ ID NO: 8530567 - DNA, 22 bp, Homo sapiens
aatgtttaatgttagtggtaat

SEQ ID NO: 8530568 - DNA, 19 bp, Homo sapiens
aatgtttaagagaaaaagg

SEQ ID NO: 8530569 - DNA, 22 bp, Homo sapiens
aatgttgttggctcttcatgat

SEQ ID NO: 8530570 - DNA, 22 bp, Homo sapiens
aatgttgttggctcttcatgat

SEQ ID NO: 8530571 - DNA, 20 bp, Homo sapiens
aatttactcacagaatgaat

SEQ ID NO: 8530572 - DNA, 22 bp, Homo sapiens
aatttagaattcgctagctaat

SEQ ID NO: 8530573 - DNA, 22 bp, Homo sapiens
aatttacagttgctgatggtac

SEQ ID NO: 8530574 - DNA, 22 bp, Homo sapiens
aatttacacttcatttggaggg

SEQ ID NO: 8530575 - DNA, 22 bp, Homo sapiens
agagctggggccagagtcaagg

SEQ ID NO: 8530576 - DNA, 22 bp, Homo sapiens
agagctggggccagagtcaagg

SEQ ID NO: 8530577 - DNA, 22 bp, Homo sapiens
agagctgggacttggactcaat

SEQ ID NO: 8530578 - DNA, 22 bp, Homo sapiens
agagctggggcataaatgccac

SEQ ID NO: 8530579 - DNA, 22 bp, Homo sapiens
agagctgggacttggactcaat

SEQ ID NO: 8530580 - DNA, 22 bp, Homo sapiens
aatttatatgtaattaggcaca

SEQ ID NO: 8530581 - DNA, 22 bp, Homo sapiens
aatttatatgtaattaggcaca

SEQ ID NO: 8530582 - DNA, 22 bp, Homo sapiens
aatttatatgtaattaggcaca

SEQ ID NO: 8530583 - DNA, 22 bp, Homo sapiens
aatttagattgataaacatgga

SEQ ID NO: 8530584 - DNA, 22 bp, Homo sapiens
aatttataataaatagggcttt

SEQ ID NO: 8530585 - DNA, 22 bp, Homo sapiens
aattatccacctttgcatgatt

SEQ ID NO: 8530586 - DNA, 22 bp, Homo sapiens
aattatcagatataaaactgca

SEQ ID NO: 8530587 - DNA, 22 bp, Homo sapiens
aattatattgtggtgtgaatgt

SEQ ID NO: 8530588 - DNA, 22 bp, Homo sapiens
aattatgaggtagatatcacat

SEQ ID NO: 8530589 - DNA, 22 bp, Homo sapiens
aattatgattggtctaaaccag

SEQ ID NO: 8530590 - DNA, 22 bp, Homo sapiens
aattatggaatttttagagaag

SEQ ID NO: 8530591 - DNA, 22 bp, Homo sapiens
aattatggtcactgttcctggg

SEQ ID NO: 8530592 - DNA, 22 bp, Homo sapiens
aattatggtatgttcaacaact

SEQ ID NO: 8530593 - DNA, 22 bp, Homo sapiens
aattggaaaaagacttaattgc

SEQ ID NO: 8530594 - DNA, 22 bp, Homo sapiens
aattggaaaaagacttaattgc

SEQ ID NO: 8530595 - DNA, 22 bp, Homo sapiens
aattatggtggatcccagtggg

SEQ ID NO: 8530596 - DNA, 22 bp, Homo sapiens
aattatggtgtgtggttaaggg

SEQ ID NO: 8530597 - DNA, 22 bp, Homo sapiens
aattatattgaagttgaatgtc

SEQ ID NO: 8530598 - DNA, 22 bp, Homo sapiens
aattatatgttaatcttcaatt

SEQ ID NO: 8530599 - DNA, 22 bp, Homo sapiens
aattatatgttaatcttcaatt

SEQ ID NO: 8530600 - DNA, 20 bp, Homo sapiens
aattatataactccaacatt

SEQ ID NO: 8530601 - DNA, 22 bp, Homo sapiens
aattatatgttaatcttcaatt

SEQ ID NO: 8530602 - DNA, 20 bp, Homo sapiens
aattatataactccaacatt

SEQ ID NO: 8530603 - DNA, 22 bp, Homo sapiens
aattatacattgaacaatctag

SEQ ID NO: 8530604 - DNA, 22 bp, Homo sapiens
aattatacattgaacaatctag

SEQ ID NO: 8530605 - DNA, 22 bp, Homo sapiens
aattatacaattgtcaagttct

SEQ ID NO: 8530606 - DNA, 22 bp, Homo sapiens
aattatacatgaaggcattata

SEQ ID NO: 8530607 - DNA, 22 bp, Homo sapiens
acactgtagctgagggcatgcg

SEQ ID NO: 8530608 - DNA, 19 bp, Homo sapiens
acactgtagatatagctat

SEQ ID NO: 8530609 - DNA, 22 bp, Homo sapiens
acactgtaaattgagtgcgtga

SEQ ID NO: 8530610 - DNA, 18 bp, Homo sapiens
acactgcagcagtctgct

SEQ ID NO: 8530611 - DNA, 18 bp, Homo sapiens
acactgcagcagtctgct

SEQ ID NO: 8530612 - DNA, 22 bp, Homo sapiens
acactgcagatgtaatttgagt

SEQ ID NO: 8530613 - DNA, 22 bp, Homo sapiens
acactgtctgggactcaggagt

SEQ ID NO: 8530614 - DNA, 22 bp, Homo sapiens
acactgtctcatatgaggggac

SEQ ID NO: 8530615 - DNA, 23 bp, Homo sapiens
acactgtctcatggatagactgc

SEQ ID NO: 8530616 - DNA, 23 bp, Homo sapiens
acactgtctcatggatagactgc

SEQ ID NO: 8530617 - DNA, 22 bp, Homo sapiens
acactgtctgggactcaggagt

SEQ ID NO: 8530618 - DNA, 23 bp, Homo sapiens
agcagggccagaatacttgctgt

SEQ ID NO: 8530619 - DNA, 22 bp, Homo sapiens
agcagggcccactaggggagat

SEQ ID NO: 8530620 - DNA, 22 bp, Homo sapiens
agcagggcccactaggggagat

SEQ ID NO: 8530621 - DNA, 22 bp, Homo sapiens
acactgcagatgaaagcataag

SEQ ID NO: 8530622 - DNA, 22 bp, Homo sapiens
agcagggccaacagtaaacacc

SEQ ID NO: 8530623 - DNA, 22 bp, Homo sapiens
agcagggcagttaaagggtcct

SEQ ID NO: 8530624 - DNA, 22 bp, Homo sapiens
acacatttgctaaaatgagctc

SEQ ID NO: 8530625 - DNA, 22 bp, Homo sapiens
acacatttgggctcctacataa

SEQ ID NO: 8530626 - DNA, 19 bp, Homo sapiens
acacatttgcacaatccac

SEQ ID NO: 8530627 - DNA, 22 bp, Homo sapiens
acacatttgcataatacctcat

SEQ ID NO: 8530628 - DNA, 23 bp, Homo sapiens
agcaggaaaccgagggtgatgtt

SEQ ID NO: 8530629 - DNA, 23 bp, Homo sapiens
agcaggaaaccgagggtgatgtt

SEQ ID NO: 8530630 - DNA, 22 bp, Homo sapiens
agcaggaaagaaaaatctgtgt

SEQ ID NO: 8530631 - DNA, 22 bp, Homo sapiens
acacattataggcaatcaaaag

SEQ ID NO: 8530632 - DNA, 22 bp, Homo sapiens
acacattatctcattaaatact

SEQ ID NO: 8530633 - DNA, 22 bp, Homo sapiens
acacattatctcattaaatact

SEQ ID NO: 8530634 - DNA, 22 bp, Homo sapiens
acaccagggatatgaggaagga

SEQ ID NO: 8530635 - DNA, 22 bp, Homo sapiens
acaccaaagtagaattaatgta

SEQ ID NO: 8530636 - DNA, 23 bp, Homo sapiens
acacatttttcccgttctgaggt

SEQ ID NO: 8530637 - DNA, 23 bp, Homo sapiens
acacatttttcccgttctgaggt

SEQ ID NO: 8530638 - DNA, 22 bp, Homo sapiens
acacattttcaacactgtcaag

SEQ ID NO: 8530639 - DNA, 22 bp, Homo sapiens
acactgtgtctagcattttaca

SEQ ID NO: 8530640 - DNA, 21 bp, Homo sapiens
acactgtgtcataatgcttaa

SEQ ID NO: 8530641 - DNA, 21 bp, Homo sapiens
acactgtgtcataatgcttaa

SEQ ID NO: 8530642 - DNA, 20 bp, Homo sapiens
acactgtgctaaggattttc

SEQ ID NO: 8530643 - DNA, 22 bp, Homo sapiens
acactgtgcatgcatatacaca

SEQ ID NO: 8530644 - DNA, 22 bp, Homo sapiens
acactgtgcatgcatatacaca

SEQ ID NO: 8530645 - DNA, 22 bp, Homo sapiens
acactgtgatcttgagaaaggt

SEQ ID NO: 8530646 - DNA, 22 bp, Homo sapiens
agcagtgggggagtgttagttt

SEQ ID NO: 8530647 - DNA, 22 bp, Homo sapiens
agcagtggctggatggtgtgct

SEQ ID NO: 8530648 - DNA, 22 bp, Homo sapiens
agcagtggctggatggtgtgct

SEQ ID NO: 8530649 - DNA, 22 bp, Homo sapiens
agcagtgggtgacagagctgag

SEQ ID NO: 8530650 - DNA, 22 bp, Homo sapiens
agcagtgggtgacagagctgag

SEQ ID NO: 8530651 - DNA, 22 bp, Homo sapiens
agcagtgttttgattctgggag

SEQ ID NO: 8530652 - DNA, 22 bp, Homo sapiens
agcagtgttctaatctggctag

SEQ ID NO: 8530653 - DNA, 20 bp, Homo sapiens
agcagtgtttcttgactcta

SEQ ID NO: 8530654 - DNA, 22 bp, Homo sapiens
agcagtgttggtgggagcatct

SEQ ID NO: 8530655 - DNA, 22 bp, Homo sapiens
acagaaagataggcacaaggtc

SEQ ID NO: 8530656 - DNA, 19 bp, Homo sapiens
acagaaatgtaagtgagac

SEQ ID NO: 8530657 - DNA, 22 bp, Homo sapiens
agcagtggtgtgaggagggctc

SEQ ID NO: 8530658 - DNA, 20 bp, Homo sapiens
agcagtgtggggagactgtg

SEQ ID NO: 8530659 - DNA, 22 bp, Homo sapiens
agcagtgttcaatgatacactg

SEQ ID NO: 8530660 - DNA, 22 bp, Homo sapiens
agcagtgtgcttcgtttcatga

SEQ ID NO: 8530661 - DNA, 22 bp, Homo sapiens
agcagtgtgcttcgtttcatga

SEQ ID NO: 8530662 - DNA, 18 bp, Homo sapiens
agcagtgtggcaagcaga

SEQ ID NO: 8530663 - DNA, 22 bp, Homo sapiens
agccacaggccatgagatacca

SEQ ID NO: 8530664 - DNA, 22 bp, Homo sapiens
agccacaggaaacagagacagc

SEQ ID NO: 8530665 - DNA, 22 bp, Homo sapiens
agccacagggggtgagggacaa

SEQ ID NO: 8530666 - DNA, 22 bp, Homo sapiens
agccacagggggtgagggacaa

SEQ ID NO: 8530667 - DNA, 22 bp, Homo sapiens
acagaacaagacctgcttattg

SEQ ID NO: 8530668 - DNA, 22 bp, Homo sapiens
acagaacaagacctgcttattg

SEQ ID NO: 8530669 - DNA, 22 bp, Homo sapiens
acagaacaacaaggtggaccag

SEQ ID NO: 8530670 - DNA, 22 bp, Homo sapiens
acagaacaacaaggtggaccag

SEQ ID NO: 8530671 - DNA, 22 bp, Homo sapiens
acagaaattgggcaaatggaag

SEQ ID NO: 8530672 - DNA, 22 bp, Homo sapiens
acagaaattgggcaaatggaag

SEQ ID NO: 8530673 - DNA, 19 bp, Homo sapiens
acagaaattagttattttc

SEQ ID NO: 8530674 - DNA, 22 bp, Homo sapiens
acagaaattcaaactggaattt

SEQ ID NO: 8530675 - DNA, 22 bp, Homo sapiens
acagaaattagcagtgagttta

SEQ ID NO: 8530676 - DNA, 22 bp, Homo sapiens
acagaaattagcagtgagttta

SEQ ID NO: 8530677 - DNA, 22 bp, Homo sapiens
acagaaattctgggacagaaaa

SEQ ID NO: 8530678 - DNA, 22 bp, Homo sapiens
acacaggcaatgtgagtgggag

SEQ ID NO: 8530679 - DNA, 22 bp, Homo sapiens
agcagcaggtgacctcgatgcc

SEQ ID NO: 8530680 - DNA, 22 bp, Homo sapiens
agcagcaggtgcttctggatct

SEQ ID NO: 8530681 - DNA, 22 bp, Homo sapiens
agcagcaggtgcttctggatct

SEQ ID NO: 8530682 - DNA, 22 bp, Homo sapiens
agcagcagtatccttccccggc

SEQ ID NO: 8530683 - DNA, 22 bp, Homo sapiens
agcagcagtcctttgtgtaatt

SEQ ID NO: 8530684 - DNA, 22 bp, Homo sapiens
agcagcagtcatgcctatgctc

SEQ ID NO: 8530685 - DNA, 22 bp, Homo sapiens
agcagcagtacatataagacta

SEQ ID NO: 8530686 - DNA, 22 bp, Homo sapiens
agcagcagtacatataagacta

SEQ ID NO: 8530687 - DNA, 22 bp, Homo sapiens
agcagcagtgtgtggtcatgtt

SEQ ID NO: 8530688 - DNA, 22 bp, Homo sapiens
agcagcagtgttctggaattct

SEQ ID NO: 8530689 - DNA, 22 bp, Homo sapiens
agcagcagtgttctggaattct

SEQ ID NO: 8530690 - DNA, 22 bp, Homo sapiens
acacatatatgtgcgtgtatat

SEQ ID NO: 8530691 - DNA, 22 bp, Homo sapiens
acacatatattatttgtggctc

SEQ ID NO: 8530692 - DNA, 22 bp, Homo sapiens
acacataagaaactacaaagag

SEQ ID NO: 8530693 - DNA, 22 bp, Homo sapiens
acacataagaaactacaaagag

SEQ ID NO: 8530694 - DNA, 22 bp, Homo sapiens
agcagcagtgtggtttggggaa

SEQ ID NO: 8530695 - DNA, 23 bp, Homo sapiens
agcagcagtgagaggtgtcttac

SEQ ID NO: 8530696 - DNA, 22 bp, Homo sapiens
agcagcagtcctttgtgtaatt

SEQ ID NO: 8530697 - DNA, 22 bp, Homo sapiens
agcagcagtcctttgtgtaatt

SEQ ID NO: 8530698 - DNA, 22 bp, Homo sapiens
agcagcagtgacagccgaaagc

SEQ ID NO: 8530699 - DNA, 22 bp, Homo sapiens
agcagcagtgacagccgaaagc

SEQ ID NO: 8530700 - DNA, 22 bp, Homo sapiens
acacatatctaagatagatgac

SEQ ID NO: 8530701 - DNA, 22 bp, Homo sapiens
acacatatatttgcatatacac

SEQ ID NO: 8530702 - DNA, 22 bp, Homo sapiens
acacatatatttgcatatacac

SEQ ID NO: 8530703 - DNA, 22 bp, Homo sapiens
acacatatatttgcatatacac

SEQ ID NO: 8530704 - DNA, 22 bp, Homo sapiens
acacatatatttgcatatacac

SEQ ID NO: 8530705 - DNA, 23 bp, Homo sapiens
acacatatattcagatacagatg

SEQ ID NO: 8530706 - DNA, 23 bp, Homo sapiens
acacatatattcagatacagatg

SEQ ID NO: 8530707 - DNA, 22 bp, Homo sapiens
acacatatggttgctgcagtga

SEQ ID NO: 8530708 - DNA, 22 bp, Homo sapiens
acacatatggttgctgcagtga

SEQ ID NO: 8530709 - DNA, 22 bp, Homo sapiens
acacatatgccattacagcaaa

SEQ ID NO: 8530710 - DNA, 22 bp, Homo sapiens
acacatatgcagatcccccaca

SEQ ID NO: 8530711 - DNA, 22 bp, Homo sapiens
acacatatctaagatagatgac

SEQ ID NO: 8530712 - DNA, 22 bp, Homo sapiens
acacatatctaagatagatgac

SEQ ID NO: 8530713 - DNA, 22 bp, Homo sapiens
acacatatgtatgcatcatgtg

SEQ ID NO: 8530714 - DNA, 22 bp, Homo sapiens
acacatatggttggtaggagtt

SEQ ID NO: 8530715 - DNA, 22 bp, Homo sapiens
acacatatgtatgcatcatgtg

SEQ ID NO: 8530716 - DNA, 22 bp, Homo sapiens
acacatatgtatgcatcatgtg

SEQ ID NO: 8530717 - DNA, 22 bp, Homo sapiens
acacatatgtcattgaaaaatc

SEQ ID NO: 8530718 - DNA, 22 bp, Homo sapiens
acacatatgtatgcatcatgtg

SEQ ID NO: 8530719 - DNA, 20 bp, Homo sapiens
agcaggaaaagtgccagtct

SEQ ID NO: 8530720 - DNA, 22 bp, Homo sapiens
acacaggaagtcagcactgatg

SEQ ID NO: 8530721 - DNA, 22 bp, Homo sapiens
acacaggaagtcagcactgatg

SEQ ID NO: 8530722 - DNA, 22 bp, Homo sapiens
acacaggaagtcagcactgatg

SEQ ID NO: 8530723 - DNA, 22 bp, Homo sapiens
acacaggacagggatgtgtttt

SEQ ID NO: 8530724 - DNA, 22 bp, Homo sapiens
acacaggacagggatgtgtttt

SEQ ID NO: 8530725 - DNA, 22 bp, Homo sapiens
acacaggagaaaagatctccca

SEQ ID NO: 8530726 - DNA, 22 bp, Homo sapiens
acacaggagatatgtaatggct

SEQ ID NO: 8530727 - DNA, 22 bp, Homo sapiens
acacaggagatatgtaatggct

SEQ ID NO: 8530728 - DNA, 22 bp, Homo sapiens
acacaggagatatgtaatggct

SEQ ID NO: 8530729 - DNA, 22 bp, Homo sapiens
acacaggaggaggatggtggtc

SEQ ID NO: 8530730 - DNA, 22 bp, Homo sapiens
acacaggaggaggatggtggtc

SEQ ID NO: 8530731 - DNA, 22 bp, Homo sapiens
acaattttaagccagagtgggt

SEQ ID NO: 8530732 - DNA, 22 bp, Homo sapiens
acaatttgtgtcttttgcttat

SEQ ID NO: 8530733 - DNA, 22 bp, Homo sapiens
acaatttgtgtcttttgcttat

SEQ ID NO: 8530734 - DNA, 22 bp, Homo sapiens
acacagcaacttgcagtatgga

SEQ ID NO: 8530735 - DNA, 22 bp, Homo sapiens
acacagatgggtagaaaacaga

SEQ ID NO: 8530736 - DNA, 22 bp, Homo sapiens
acacagattttacatgttatgc

SEQ ID NO: 8530737 - DNA, 22 bp, Homo sapiens
acacaggaagagagataataat

SEQ ID NO: 8530738 - DNA, 22 bp, Homo sapiens
acacaggaactctgagaggtgg

SEQ ID NO: 8530739 - DNA, 22 bp, Homo sapiens
acacaggaactctgagaggtgg

SEQ ID NO: 8530740 - DNA, 22 bp, Homo sapiens
agcacctgcacagtggaggaaa

SEQ ID NO: 8530741 - DNA, 22 bp, Homo sapiens
agcacctgcacagtggaggaaa

SEQ ID NO: 8530742 - DNA, 22 bp, Homo sapiens
agcacctccttagctatgacca

SEQ ID NO: 8530743 - DNA, 22 bp, Homo sapiens
agcacctccgtgcagcgtggcc

SEQ ID NO: 8530744 - DNA, 22 bp, Homo sapiens
agcaccatgaccttgccattga

SEQ ID NO: 8530745 - DNA, 22 bp, Homo sapiens
agcaccattgcaaatatggcag

SEQ ID NO: 8530746 - DNA, 22 bp, Homo sapiens
agcaccatttatcatctaggta

SEQ ID NO: 8530747 - DNA, 22 bp, Homo sapiens
agcaccctggggaagcacaaag

SEQ ID NO: 8530748 - DNA, 22 bp, Homo sapiens
agcacccttcagcccagcctgg

SEQ ID NO: 8530749 - DNA, 22 bp, Homo sapiens
acaattgtggcaatttgtatgt

SEQ ID NO: 8530750 - DNA, 22 bp, Homo sapiens
acaattgctaatgcttctgttg

SEQ ID NO: 8530751 - DNA, 22 bp, Homo sapiens
acaatttatccattgtatagtt

SEQ ID NO: 8530752 - DNA, 22 bp, Homo sapiens
acaattctgggtatttatatag

SEQ ID NO: 8530753 - DNA, 22 bp, Homo sapiens
acaattctgatggtttcccagt

SEQ ID NO: 8530754 - DNA, 22 bp, Homo sapiens
acaattctgatggtttcccagt

SEQ ID NO: 8530755 - DNA, 22 bp, Homo sapiens
acaattctgggtatttatatag

SEQ ID NO: 8530756 - DNA, 22 bp, Homo sapiens
acaattctgatggtttcccagt

SEQ ID NO: 8530757 - DNA, 22 bp, Homo sapiens
agcacctgctatgtgtcaggga

SEQ ID NO: 8530758 - DNA, 22 bp, Homo sapiens
agcacctgcctgcattggctat

SEQ ID NO: 8530759 - DNA, 22 bp, Homo sapiens
agcacctgcctgcattggctat

SEQ ID NO: 8530760 - DNA, 22 bp, Homo sapiens
acagcaaaggacgaacactctg

SEQ ID NO: 8530761 - DNA, 22 bp, Homo sapiens
acagcaaaggacgaacactctg

SEQ ID NO: 8530762 - DNA, 22 bp, Homo sapiens
acagcaactcctgcttctgagt

SEQ ID NO: 8530763 - DNA, 22 bp, Homo sapiens
agcctgccttgggctgcttgag

SEQ ID NO: 8530764 - DNA, 22 bp, Homo sapiens
agcctgccttgggctgcttgag

SEQ ID NO: 8530765 - DNA, 22 bp, Homo sapiens
agcctgccttgggctgcttgag

SEQ ID NO: 8530766 - DNA, 22 bp, Homo sapiens
agcctgcgatcccacctggcct

SEQ ID NO: 8530767 - DNA, 17 bp, Homo sapiens
agcctgctgatctcaca

SEQ ID NO: 8530768 - DNA, 22 bp, Homo sapiens
acagattgatcttgagaattat

SEQ ID NO: 8530769 - DNA, 17 bp, Homo sapiens
agcctgctgatctcaca

SEQ ID NO: 8530770 - DNA, 17 bp, Homo sapiens
agcctgctgatctcaca

SEQ ID NO: 8530771 - DNA, 17 bp, Homo sapiens
agcctgccccatgctgc

SEQ ID NO: 8530772 - DNA, 22 bp, Homo sapiens
agcctgcctcagactcaggata

SEQ ID NO: 8530773 - DNA, 21 bp, Homo sapiens
agcctgcctgaactctgtggc

SEQ ID NO: 8530774 - DNA, 21 bp, Homo sapiens
agcctgcctgaactctgtggc

SEQ ID NO: 8530775 - DNA, 22 bp, Homo sapiens
agcctgcaggatgggcagcacc

SEQ ID NO: 8530776 - DNA, 22 bp, Homo sapiens
agcctgccaggcgctgcctgga

SEQ ID NO: 8530777 - DNA, 22 bp, Homo sapiens
agcctgccaggcgctgcctgga

SEQ ID NO: 8530778 - DNA, 22 bp, Homo sapiens
agcctgccaggcgctgcctgga

SEQ ID NO: 8530779 - DNA, 20 bp, Homo sapiens
agcctgccagctggcccaga

SEQ ID NO: 8530780 - DNA, 20 bp, Homo sapiens
agcctgccagctggcccaga

SEQ ID NO: 8530781 - DNA, 22 bp, Homo sapiens
agctatgtataaataggccact

SEQ ID NO: 8530782 - DNA, 22 bp, Homo sapiens
agctatcagtaggaccatgttc

SEQ ID NO: 8530783 - DNA, 22 bp, Homo sapiens
agctatcaccttaataaactga

SEQ ID NO: 8530784 - DNA, 22 bp, Homo sapiens
agctatggaacagagtggctgt

SEQ ID NO: 8530785 - DNA, 22 bp, Homo sapiens
agctagttcactgaagcctatg

SEQ ID NO: 8530786 - DNA, 22 bp, Homo sapiens
agctatagtacttggcttttct

SEQ ID NO: 8530787 - DNA, 22 bp, Homo sapiens
agctatatagatggtgtgtttg

SEQ ID NO: 8530788 - DNA, 22 bp, Homo sapiens
agctatagctggatcttaagtg

SEQ ID NO: 8530789 - DNA, 22 bp, Homo sapiens
agctagggctttcgtagacagt

SEQ ID NO: 8530790 - DNA, 22 bp, Homo sapiens
agctaggggaccaaggtggccc

SEQ ID NO: 8530791 - DNA, 22 bp, Homo sapiens
agctaggggaccaaggtggccc

SEQ ID NO: 8530792 - DNA, 19 bp, Homo sapiens
agctagtgctcagctgtca

SEQ ID NO: 8530793 - DNA, 23 bp, Homo sapiens
acagcaagaggaccagatgtgag

SEQ ID NO: 8530794 - DNA, 23 bp, Homo sapiens
acagcaagaggaccagatgtgag

SEQ ID NO: 8530795 - DNA, 22 bp, Homo sapiens
acagcaagccagcttgtcactg

SEQ ID NO: 8530796 - DNA, 23 bp, Homo sapiens
acagcaagaggaccagatgtgag

SEQ ID NO: 8530797 - DNA, 21 bp, Homo sapiens
acagcaagccttcctttcagg

SEQ ID NO: 8530798 - DNA, 21 bp, Homo sapiens
acagcaagccttcacatgagt

SEQ ID NO: 8530799 - DNA, 21 bp, Homo sapiens
acagcaagccttcacatgagt

SEQ ID NO: 8530800 - DNA, 21 bp, Homo sapiens
acagcaagccttcacatgagt

SEQ ID NO: 8530801 - DNA, 22 bp, Homo sapiens
acagcaatctgagagacatagt

SEQ ID NO: 8530802 - DNA, 22 bp, Homo sapiens
acagcaataggaaatacttgca

SEQ ID NO: 8530803 - DNA, 22 bp, Homo sapiens
acagcaataggaaatacttgca

SEQ ID NO: 8530804 - DNA, 22 bp, Homo sapiens
acagcaggcatgaatgacactg

SEQ ID NO: 8530805 - DNA, 22 bp, Homo sapiens
acagcaggcatgaatgacactg

SEQ ID NO: 8530806 - DNA, 22 bp, Homo sapiens
agctcctgtgtgcccacctgct

SEQ ID NO: 8530807 - DNA, 22 bp, Homo sapiens
agctcctgtgtgcccacctgct

SEQ ID NO: 8530808 - DNA, 22 bp, Homo sapiens
acagcaggcatgaagaaatgtt

SEQ ID NO: 8530809 - DNA, 22 bp, Homo sapiens
acagcaggatttggcgatgttg

SEQ ID NO: 8530810 - DNA, 22 bp, Homo sapiens
acagcaggatttggcgatgttg

SEQ ID NO: 8530811 - DNA, 22 bp, Homo sapiens
acagcaggcacacaaggataga

SEQ ID NO: 8530812 - DNA, 22 bp, Homo sapiens
agctcaagagtagttcgagggg

SEQ ID NO: 8530813 - DNA, 22 bp, Homo sapiens
acagcagcgtgaagtgtgttat

SEQ ID NO: 8530814 - DNA, 22 bp, Homo sapiens
agctatttcaaagtttgagaca

SEQ ID NO: 8530815 - DNA, 21 bp, Homo sapiens
agctatttcagatttgagagc

SEQ ID NO: 8530816 - DNA, 21 bp, Homo sapiens
agctatttcagatttgagagc

SEQ ID NO: 8530817 - DNA, 22 bp, Homo sapiens
agctatgttcctcgatgctcag

SEQ ID NO: 8530818 - DNA, 22 bp, Homo sapiens
agctattgtgtgcccagcagga

SEQ ID NO: 8530819 - DNA, 22 bp, Homo sapiens
agctatttcaaagtttgagaca

SEQ ID NO: 8530820 - DNA, 22 bp, Homo sapiens
acagcaggaattaacatataag

SEQ ID NO: 8530821 - DNA, 22 bp, Homo sapiens
acagcagctaaaggtgtctcct

SEQ ID NO: 8530822 - DNA, 22 bp, Homo sapiens
agctccttgaaggcagtagctg

SEQ ID NO: 8530823 - DNA, 19 bp, Homo sapiens
agctcctgttcagcagctc

SEQ ID NO: 8530824 - DNA, 22 bp, Homo sapiens
agctccttgaagggctctggga

SEQ ID NO: 8530825 - DNA, 22 bp, Homo sapiens
agctccttgcaggttgccttgg

SEQ ID NO: 8530826 - DNA, 23 bp, Homo sapiens
agctcctttgaaagtatgttttt

SEQ ID NO: 8530827 - DNA, 22 bp, Homo sapiens
agctctatcacctgtcagttgc

SEQ ID NO: 8530828 - DNA, 22 bp, Homo sapiens
agctctaaatggaattttgcct

SEQ ID NO: 8530829 - DNA, 20 bp, Homo sapiens
agctcctttgtgtccaggat

SEQ ID NO: 8530830 - DNA, 21 bp, Homo sapiens
agctctatgacttggccaggt

SEQ ID NO: 8530831 - DNA, 22 bp, Homo sapiens
agctctatcacctgtcagttgc

SEQ ID NO: 8530832 - DNA, 22 bp, Homo sapiens
agctctcaagataagaaagaac

SEQ ID NO: 8530833 - DNA, 22 bp, Homo sapiens
agctctccacacataggactag

SEQ ID NO: 8530834 - DNA, 22 bp, Homo sapiens
agctctccacacataggactag

SEQ ID NO: 8530835 - DNA, 22 bp, Homo sapiens
agctctccacacataggactag

SEQ ID NO: 8530836 - DNA, 21 bp, Homo sapiens
agctctatgacttggccaggt

SEQ ID NO: 8530837 - DNA, 22 bp, Homo sapiens
agctctccatctatctgtgatg

SEQ ID NO: 8530838 - DNA, 22 bp, Homo sapiens
agctctccatctatctgtgatg

SEQ ID NO: 8530839 - DNA, 22 bp, Homo sapiens
agctctcccaccttcttcttac

SEQ ID NO: 8530840 - DNA, 22 bp, Homo sapiens
agctctgggctgacatgctccc

SEQ ID NO: 8530841 - DNA, 22 bp, Homo sapiens
agctctggggcctgtcccacat

SEQ ID NO: 8530842 - DNA, 22 bp, Homo sapiens
agctctggggcctgtcccacat

SEQ ID NO: 8530843 - DNA, 22 bp, Homo sapiens
agctctgggggaaagtctgctc

SEQ ID NO: 8530844 - DNA, 22 bp, Homo sapiens
agcccagctcctccacagaata

SEQ ID NO: 8530845 - DNA, 18 bp, Homo sapiens
agcccagcggagtgaatc

SEQ ID NO: 8530846 - DNA, 22 bp, Homo sapiens
agcccagcggagcgggcccggg

SEQ ID NO: 8530847 - DNA, 18 bp, Homo sapiens
agcccagcggagtgaatc

SEQ ID NO: 8530848 - DNA, 22 bp, Homo sapiens
agcccagctgcctgcctgctgt

SEQ ID NO: 8530849 - DNA, 22 bp, Homo sapiens
agcccagctgcctgcctgctgt

SEQ ID NO: 8530850 - DNA, 22 bp, Homo sapiens
agcccagctgcctgcctgctgt

SEQ ID NO: 8530851 - DNA, 22 bp, Homo sapiens
agcccagctcctccacagaata

SEQ ID NO: 8530852 - DNA, 22 bp, Homo sapiens
agccattttggtaatgataaca

SEQ ID NO: 8530853 - DNA, 22 bp, Homo sapiens
agccattttcctgaaatataac

SEQ ID NO: 8530854 - DNA, 22 bp, Homo sapiens
agccattttcctgaaatataac

SEQ ID NO: 8530855 - DNA, 22 bp, Homo sapiens
agcccagcctgattctacaccc

SEQ ID NO: 8530856 - DNA, 22 bp, Homo sapiens
agcccagcggagcgggcccggg

SEQ ID NO: 8530857 - DNA, 22 bp, Homo sapiens
agccattttggtaatgataaca

SEQ ID NO: 8530858 - DNA, 17 bp, Homo sapiens
acagagcacatcaagat

SEQ ID NO: 8530859 - DNA, 22 bp, Homo sapiens
acagagcaggtccagaagtgcc

SEQ ID NO: 8530860 - DNA, 22 bp, Homo sapiens
acagagcagtaagaacacagct

SEQ ID NO: 8530861 - DNA, 22 bp, Homo sapiens
acagagcactgccctgtgccgc

SEQ ID NO: 8530862 - DNA, 22 bp, Homo sapiens
acagagcactgccctgtgccgc

SEQ ID NO: 8530863 - DNA, 22 bp, Homo sapiens
agcccagcttccttctgtctct

SEQ ID NO: 8530864 - DNA, 22 bp, Homo sapiens
agcccagctgctatgtacctgg

SEQ ID NO: 8530865 - DNA, 19 bp, Homo sapiens
agcccagcttatttgtcag

SEQ ID NO: 8530866 - DNA, 21 bp, Homo sapiens
agccagggtggacactgtatg

SEQ ID NO: 8530867 - DNA, 21 bp, Homo sapiens
agccagggtggacactgtatg

SEQ ID NO: 8530868 - DNA, 22 bp, Homo sapiens
agccacagtctgatgcctgaga

SEQ ID NO: 8530869 - DNA, 22 bp, Homo sapiens
agccatcctcccacctcagcct

SEQ ID NO: 8530870 - DNA, 22 bp, Homo sapiens
agccacagtcaacctgtccata

SEQ ID NO: 8530871 - DNA, 22 bp, Homo sapiens
agccacagtcaacctgtccata

SEQ ID NO: 8530872 - DNA, 22 bp, Homo sapiens
agccacagtcaacctgtccata

SEQ ID NO: 8530873 - DNA, 22 bp, Homo sapiens
agccatggcgccactagaggga

SEQ ID NO: 8530874 - DNA, 22 bp, Homo sapiens
agccatgcaccttactcttgct

SEQ ID NO: 8530875 - DNA, 22 bp, Homo sapiens
agccatgattttctcattttca

SEQ ID NO: 8530876 - DNA, 22 bp, Homo sapiens
agccatgggctcccagtccttt

SEQ ID NO: 8530877 - DNA, 22 bp, Homo sapiens
agccattggctgcctggtgcgt

SEQ ID NO: 8530878 - DNA, 22 bp, Homo sapiens
agccattgaatttagtgccttt

SEQ ID NO: 8530879 - DNA, 22 bp, Homo sapiens
agcccctctccgccctgagtcg

SEQ ID NO: 8530880 - DNA, 22 bp, Homo sapiens
agcccctccagtggcataaaat

SEQ ID NO: 8530881 - DNA, 22 bp, Homo sapiens
agcccctccagtggcataaaat

SEQ ID NO: 8530882 - DNA, 22 bp, Homo sapiens
agcccctctgtggctctgcctc

SEQ ID NO: 8530883 - DNA, 22 bp, Homo sapiens
agcccctctgtagctaatagta

SEQ ID NO: 8530884 - DNA, 22 bp, Homo sapiens
agcccctctgtagctaatagta

SEQ ID NO: 8530885 - DNA, 22 bp, Homo sapiens
agcccctctccgccctgagtcg

SEQ ID NO: 8530886 - DNA, 17 bp, Homo sapiens
agcccctcagcgtcacc

SEQ ID NO: 8530887 - DNA, 17 bp, Homo sapiens
agcccctcagcgtcacc

SEQ ID NO: 8530888 - DNA, 17 bp, Homo sapiens
agcccctcagcgtcacc

SEQ ID NO: 8530889 - DNA, 23 bp, Homo sapiens
agcccctcatatctgctttctct

SEQ ID NO: 8530890 - DNA, 23 bp, Homo sapiens
agcccctcatggtgtctagacag

SEQ ID NO: 8530891 - DNA, 22 bp, Homo sapiens
agcccccaggagtctccacgcc

SEQ ID NO: 8530892 - DNA, 22 bp, Homo sapiens
agcccccaggagtctccacgcc

SEQ ID NO: 8530893 - DNA, 22 bp, Homo sapiens
acagagcatttgggacagagag

SEQ ID NO: 8530894 - DNA, 22 bp, Homo sapiens
acagagcatttgggacagagag

SEQ ID NO: 8530895 - DNA, 22 bp, Homo sapiens
acagagcatttgggacagagag

SEQ ID NO: 8530896 - DNA, 22 bp, Homo sapiens
acagagcatgctcagtgtgtga

SEQ ID NO: 8530897 - DNA, 22 bp, Homo sapiens
acagagcatttgggacagagag

SEQ ID NO: 8530898 - DNA, 22 bp, Homo sapiens
acagagcatataaagtgctttg

SEQ ID NO: 8530899 - DNA, 22 bp, Homo sapiens
acagagcatcagatgaaatcaa

SEQ ID NO: 8530900 - DNA, 22 bp, Homo sapiens
acagagcataatgtctagcaca

SEQ ID NO: 8530901 - DNA, 22 bp, Homo sapiens
acagagcataatgtctagcaca

SEQ ID NO: 8530902 - DNA, 22 bp, Homo sapiens
acagagcataatgtctagcaca

SEQ ID NO: 8530903 - DNA, 22 bp, Homo sapiens
acagagcataatgtctagcaca

SEQ ID NO: 8530904 - DNA, 22 bp, Homo sapiens
acagagcataatgtctagcaca

SEQ ID NO: 8530905 - DNA, 22 bp, Homo sapiens
acagagcagtaagaacacagct

SEQ ID NO: 8530906 - DNA, 22 bp, Homo sapiens
acagagcagttctggagctggc

SEQ ID NO: 8530907 - DNA, 22 bp, Homo sapiens
acagataaaagttgtttaaaat

SEQ ID NO: 8530908 - DNA, 22 bp, Homo sapiens
acagagtttatgtgtgtacaaa

SEQ ID NO: 8530909 - DNA, 22 bp, Homo sapiens
acagataaaagttgtttaaaat

SEQ ID NO: 8530910 - DNA, 22 bp, Homo sapiens
acagagtttatgtgtgtacaaa

SEQ ID NO: 8530911 - DNA, 22 bp, Homo sapiens
acagagttgtgtttgtacaacg

SEQ ID NO: 8530912 - DNA, 22 bp, Homo sapiens
agcctgagtgcttaggactgtt

SEQ ID NO: 8530913 - DNA, 22 bp, Homo sapiens
acagataatacattgtgctaca

SEQ ID NO: 8530914 - DNA, 22 bp, Homo sapiens
acagataatacattgtgctaca

SEQ ID NO: 8530915 - DNA, 22 bp, Homo sapiens
acagataatacattgtgctaca

SEQ ID NO: 8530916 - DNA, 22 bp, Homo sapiens
acagataaggcagttaagagtt

SEQ ID NO: 8530917 - DNA, 22 bp, Homo sapiens
acagataaatttataggagtgt

SEQ ID NO: 8530918 - DNA, 22 bp, Homo sapiens
acagagttgtaaacatttacca

SEQ ID NO: 8530919 - DNA, 22 bp, Homo sapiens
acagagttgtgtttgtacaacg

SEQ ID NO: 8530920 - DNA, 22 bp, Homo sapiens
acagagttgtgtttgtacaacg

SEQ ID NO: 8530921 - DNA, 22 bp, Homo sapiens
acagagttgtgtttgtacaacg

SEQ ID NO: 8530922 - DNA, 22 bp, Homo sapiens
acagagttaatggataggcagg

SEQ ID NO: 8530923 - DNA, 22 bp, Homo sapiens
acagagttaatggataggcagg

SEQ ID NO: 8530924 - DNA, 22 bp, Homo sapiens
acagagttaaagtggagtttaa

SEQ ID NO: 8530925 - DNA, 22 bp, Homo sapiens
agcccctgggagtagctgctgc

SEQ ID NO: 8530926 - DNA, 23 bp, Homo sapiens
acagaggtccaaacagtataagc

SEQ ID NO: 8530927 - DNA, 22 bp, Homo sapiens
agcccctgtaccctgagtgctt

SEQ ID NO: 8530928 - DNA, 22 bp, Homo sapiens
agcccctctgtggctctgcctc

SEQ ID NO: 8530929 - DNA, 22 bp, Homo sapiens
acagagtcttacgtggtgataa

SEQ ID NO: 8530930 - DNA, 22 bp, Homo sapiens
acagagtctgacaggtaggcgc

SEQ ID NO: 8530931 - DNA, 22 bp, Homo sapiens
acagagtctcagggatgaaagc

SEQ ID NO: 8530932 - DNA, 22 bp, Homo sapiens
acagagtctcaaacctacaaag

SEQ ID NO: 8530933 - DNA, 23 bp, Homo sapiens
acagaggtccaaacagtataagc

SEQ ID NO: 8530934 - DNA, 22 bp, Homo sapiens
acagagtcattcactgatgaag

SEQ ID NO: 8530935 - DNA, 22 bp, Homo sapiens
acagaggtggacctcagcaggc

SEQ ID NO: 8530936 - DNA, 22 bp, Homo sapiens
acagaggtggacctcagcaggc

SEQ ID NO: 8530937 - DNA, 22 bp, Homo sapiens
accatcttaaggggacttctta

SEQ ID NO: 8530938 - DNA, 22 bp, Homo sapiens
accatcttagtggccagctctc

SEQ ID NO: 8530939 - DNA, 21 bp, Homo sapiens
accatcttccatgcattatat

SEQ ID NO: 8530940 - DNA, 21 bp, Homo sapiens
accatcttccatgcattatat

SEQ ID NO: 8530941 - DNA, 22 bp, Homo sapiens
accatcttttcctctgcctcct

SEQ ID NO: 8530942 - DNA, 22 bp, Homo sapiens
aaggtggccctgagcatgacaa

SEQ ID NO: 8530943 - DNA, 22 bp, Homo sapiens
aaggtgggtggatcacgaggtc

SEQ ID NO: 8530944 - DNA, 22 bp, Homo sapiens
accatgtcatttattggccaaa

SEQ ID NO: 8530945 - DNA, 22 bp, Homo sapiens
accatgtcatttattggccaaa

SEQ ID NO: 8530946 - DNA, 22 bp, Homo sapiens
accatgttggccaagctggtct

SEQ ID NO: 8530947 - DNA, 22 bp, Homo sapiens
accatgttggccaagctggtct

SEQ ID NO: 8530948 - DNA, 23 bp, Homo sapiens
aagtaacagggataatagcagtt

SEQ ID NO: 8530949 - DNA, 23 bp, Homo sapiens
aagtaacagggataatagcagtt

SEQ ID NO: 8530950 - DNA, 23 bp, Homo sapiens
aagtaacagggataatagcagtt

SEQ ID NO: 8530951 - DNA, 22 bp, Homo sapiens
accatgatgcatccttaaggaa

SEQ ID NO: 8530952 - DNA, 23 bp, Homo sapiens
accatgatgggagtgcaaataag

SEQ ID NO: 8530953 - DNA, 22 bp, Homo sapiens
accatgcacagctgttctatta

SEQ ID NO: 8530954 - DNA, 22 bp, Homo sapiens
accatgcatcaaagctaatata

SEQ ID NO: 8530955 - DNA, 22 bp, Homo sapiens
accatgggtcagccacctcagc

SEQ ID NO: 8530956 - DNA, 22 bp, Homo sapiens
accatggaccatagttcctatt

SEQ ID NO: 8530957 - DNA, 22 bp, Homo sapiens
aaggtctgtgaggctgtttgtc

SEQ ID NO: 8530958 - DNA, 22 bp, Homo sapiens
aaggtgaactggtaatgacaga

SEQ ID NO: 8530959 - DNA, 22 bp, Homo sapiens
aaggtgctcgttatggccagtg

SEQ ID NO: 8530960 - DNA, 19 bp, Homo sapiens
aaggtggcagcaggtatta

SEQ ID NO: 8530961 - DNA, 22 bp, Homo sapiens
aaggtgctcacgggctcaggga

SEQ ID NO: 8530962 - DNA, 22 bp, Homo sapiens
aagggctgagaagtggggctgg

SEQ ID NO: 8530963 - DNA, 22 bp, Homo sapiens
aaggtagcttgcttcctgagta

SEQ ID NO: 8530964 - DNA, 22 bp, Homo sapiens
aagggctgagcacagtgagcca

SEQ ID NO: 8530965 - DNA, 22 bp, Homo sapiens
aagggctgagaagtggggctgg

SEQ ID NO: 8530966 - DNA, 22 bp, Homo sapiens
aagggctgaatgaagggttgaa

SEQ ID NO: 8530967 - DNA, 22 bp, Homo sapiens
aagggctgaaagaccttgggca

SEQ ID NO: 8530968 - DNA, 22 bp, Homo sapiens
aagtcaattagtaaacttggaa

SEQ ID NO: 8530969 - DNA, 22 bp, Homo sapiens
aagtcacaaagtgctgtacatg

SEQ ID NO: 8530970 - DNA, 22 bp, Homo sapiens
aagtcacaagcatatatgcatt

SEQ ID NO: 8530971 - DNA, 22 bp, Homo sapiens
aagtcacaagcatatatgcatt

SEQ ID NO: 8530972 - DNA, 22 bp, Homo sapiens
aagtcacaagcatatatgcatt

SEQ ID NO: 8530973 - DNA, 22 bp, Homo sapiens
aagtcacacagttaacatgagg

SEQ ID NO: 8530974 - DNA, 22 bp, Homo sapiens
aagtcaatcacatgcacactga

SEQ ID NO: 8530975 - DNA, 22 bp, Homo sapiens
accccccagataatcccttgag

SEQ ID NO: 8530976 - DNA, 22 bp, Homo sapiens
acccccacggaaggccgtacgc

SEQ ID NO: 8530977 - DNA, 22 bp, Homo sapiens
acccccacggaaggccgtacgc

SEQ ID NO: 8530978 - DNA, 21 bp, Homo sapiens
acccccacacctccttagttc

SEQ ID NO: 8530979 - DNA, 21 bp, Homo sapiens
acccccacacctccttagttc

SEQ ID NO: 8530980 - DNA, 22 bp, Homo sapiens
accccaggtctccaggctctgg

SEQ ID NO: 8530981 - DNA, 22 bp, Homo sapiens
acccccaagaggggccttcagc

SEQ ID NO: 8530982 - DNA, 22 bp, Homo sapiens
acccccaaacatgatcatggtg

SEQ ID NO: 8530983 - DNA, 22 bp, Homo sapiens
acccccaaacatgatcatggtg

SEQ ID NO: 8530984 - DNA, 22 bp, Homo sapiens
accccaggtcatctgagagtcc

SEQ ID NO: 8530985 - DNA, 22 bp, Homo sapiens
accccaggtccaggttacagag

SEQ ID NO: 8530986 - DNA, 22 bp, Homo sapiens
accccaggtccaggttacagag

SEQ ID NO: 8530987 - DNA, 22 bp, Homo sapiens
accccaggtctccaggctctgg

SEQ ID NO: 8530988 - DNA, 22 bp, Homo sapiens
accccagggctgccagcctcct

SEQ ID NO: 8530989 - DNA, 22 bp, Homo sapiens
accccagggctgccagcctcct

SEQ ID NO: 8530990 - DNA, 22 bp, Homo sapiens
accccagggctgccagcctcct

SEQ ID NO: 8530991 - DNA, 23 bp, Homo sapiens
accccaggcatcgcattcctctt

SEQ ID NO: 8530992 - DNA, 23 bp, Homo sapiens
accccaggcatcgcattcctctt

SEQ ID NO: 8530993 - DNA, 22 bp, Homo sapiens
accccaggcccagggaagaggc

SEQ ID NO: 8530994 - DNA, 22 bp, Homo sapiens
accccaggcccagggaagaggc

SEQ ID NO: 8530995 - DNA, 22 bp, Homo sapiens
accccaggagctgtgcctagtc

SEQ ID NO: 8530996 - DNA, 22 bp, Homo sapiens
accccaggagctgtgcctagtc

SEQ ID NO: 8530997 - DNA, 22 bp, Homo sapiens
aagtagaaaaccgcactggact

SEQ ID NO: 8530998 - DNA, 22 bp, Homo sapiens
aagtacatttttaacttacagc

SEQ ID NO: 8530999 - DNA, 22 bp, Homo sapiens
aagtacatttttaacttacagc

SEQ ID NO: 8531000 - DNA, 22 bp, Homo sapiens
aagtacatgctgtaatgattgg

SEQ ID NO: 8531001 - DNA, 22 bp, Homo sapiens
aagtacatgctttattcagagt

SEQ ID NO: 8531002 - DNA, 22 bp, Homo sapiens
aagtacatgctgtaatgattgg

SEQ ID NO: 8531003 - DNA, 22 bp, Homo sapiens
aagtacatggaggatagctgct

SEQ ID NO: 8531004 - DNA, 22 bp, Homo sapiens
aagtacattatatgagcagaat

SEQ ID NO: 8531005 - DNA, 22 bp, Homo sapiens
aagtacatggaggatagctgct

SEQ ID NO: 8531006 - DNA, 22 bp, Homo sapiens
aagtacatgttgctcaacagcc

SEQ ID NO: 8531007 - DNA, 22 bp, Homo sapiens
aagtacataaaggaattagcca

SEQ ID NO: 8531008 - DNA, 23 bp, Homo sapiens
aagtacatatatttagatagtga

SEQ ID NO: 8531009 - DNA, 22 bp, Homo sapiens
aagtacagccagcacccagact

SEQ ID NO: 8531010 - DNA, 22 bp, Homo sapiens
aagtacatatatttatgattct

SEQ ID NO: 8531011 - DNA, 22 bp, Homo sapiens
aagtacatcaaatgtttggcta

SEQ ID NO: 8531012 - DNA, 22 bp, Homo sapiens
aagtacatcctagtctctttca

SEQ ID NO: 8531013 - DNA, 22 bp, Homo sapiens
aagtacatatatttatgattct

SEQ ID NO: 8531014 - DNA, 23 bp, Homo sapiens
aagtacatatatttagatagtga

SEQ ID NO: 8531015 - DNA, 22 bp, Homo sapiens
acatgtgtggacatgaatctac

SEQ ID NO: 8531016 - DNA, 22 bp, Homo sapiens
acatgtgtgacaacagaggtga

SEQ ID NO: 8531017 - DNA, 22 bp, Homo sapiens
acatgtgtggacatgaatctac

SEQ ID NO: 8531018 - DNA, 22 bp, Homo sapiens
acatgtgtacttttaaggatgt

SEQ ID NO: 8531019 - DNA, 22 bp, Homo sapiens
acatgtgtatagcctgtataga

SEQ ID NO: 8531020 - DNA, 22 bp, Homo sapiens
acatgtgtctaagaatgaaaga

SEQ ID NO: 8531021 - DNA, 22 bp, Homo sapiens
aaggctggggtgcagacggcct

SEQ ID NO: 8531022 - DNA, 22 bp, Homo sapiens
aaggctggggtgcagacggcct

SEQ ID NO: 8531023 - DNA, 22 bp, Homo sapiens
aaggctgtcttttcctcttccc

SEQ ID NO: 8531024 - DNA, 22 bp, Homo sapiens
aaggctgtgtcagaagctccct

SEQ ID NO: 8531025 - DNA, 22 bp, Homo sapiens
aaggctgtttgagcactggagc

SEQ ID NO: 8531026 - DNA, 22 bp, Homo sapiens
aaggcttggagtaagcttggct

SEQ ID NO: 8531027 - DNA, 19 bp, Homo sapiens
aaggcttggctgagctggg

SEQ ID NO: 8531028 - DNA, 22 bp, Homo sapiens
aaggcttgtagatttgggcttt

SEQ ID NO: 8531029 - DNA, 22 bp, Homo sapiens
aaggcttgtgtgttcagtgagg

SEQ ID NO: 8531030 - DNA, 22 bp, Homo sapiens
aaggctttaaataaccgtaaag

SEQ ID NO: 8531031 - DNA, 22 bp, Homo sapiens
aaggctgattagactgatagct

SEQ ID NO: 8531032 - DNA, 22 bp, Homo sapiens
aaggctgagtaaaacagagaac

SEQ ID NO: 8531033 - DNA, 22 bp, Homo sapiens
aaggctgagtaaaacagagaac

SEQ ID NO: 8531034 - DNA, 22 bp, Homo sapiens
aaggctgagggctgtacctggc

SEQ ID NO: 8531035 - DNA, 22 bp, Homo sapiens
aaggctgagggctgtacctggc

SEQ ID NO: 8531036 - DNA, 22 bp, Homo sapiens
aaggctgaggtagggcctaaaa

SEQ ID NO: 8531037 - DNA, 22 bp, Homo sapiens
acatgtgtacatatatatgtgc

SEQ ID NO: 8531038 - DNA, 22 bp, Homo sapiens
acatgtgtacatatatatgtgc

SEQ ID NO: 8531039 - DNA, 16 bp, Homo sapiens
aaggctgattttccct

SEQ ID NO: 8531040 - DNA, 16 bp, Homo sapiens
aaggctgattttccct

SEQ ID NO: 8531041 - DNA, 22 bp, Homo sapiens
aaggctgattagactgatagct

SEQ ID NO: 8531042 - DNA, 22 bp, Homo sapiens
aaggctgcctctgccagaggag

SEQ ID NO: 8531043 - DNA, 22 bp, Homo sapiens
aaggctgcctctgccagaggag

SEQ ID NO: 8531044 - DNA, 22 bp, Homo sapiens
aaggctgcctctgccagaggag

SEQ ID NO: 8531045 - DNA, 22 bp, Homo sapiens
aaggctgcctctgccagaggag

SEQ ID NO: 8531046 - DNA, 22 bp, Homo sapiens
aaggctcttggagtgaatgcag

SEQ ID NO: 8531047 - DNA, 22 bp, Homo sapiens
aaggctcttggagtgaatgcag

SEQ ID NO: 8531048 - DNA, 22 bp, Homo sapiens
aaggctgaggagggcctgcagg

SEQ ID NO: 8531049 - DNA, 22 bp, Homo sapiens
aaggctgaggagggcctgcagg

SEQ ID NO: 8531050 - DNA, 22 bp, Homo sapiens
aaggctgaggcagtgaggcaga

SEQ ID NO: 8531051 - DNA, 22 bp, Homo sapiens
aaggctgaggctggagaattac

SEQ ID NO: 8531052 - DNA, 22 bp, Homo sapiens
aaggcataggacaaatcagtga

SEQ ID NO: 8531053 - DNA, 22 bp, Homo sapiens
aaggcatctggatggaggagga

SEQ ID NO: 8531054 - DNA, 22 bp, Homo sapiens
aaggcatgatgtaatcaatgat

SEQ ID NO: 8531055 - DNA, 22 bp, Homo sapiens
aaggctcttgagtggtgatagt

SEQ ID NO: 8531056 - DNA, 22 bp, Homo sapiens
aaggcatggcagggtttacaca

SEQ ID NO: 8531057 - DNA, 22 bp, Homo sapiens
aagggcccattctctcagaaaa

SEQ ID NO: 8531058 - DNA, 22 bp, Homo sapiens
aagggcccggctgtgggcagag

SEQ ID NO: 8531059 - DNA, 22 bp, Homo sapiens
aagggcctcctggggagcctgg

SEQ ID NO: 8531060 - DNA, 22 bp, Homo sapiens
aagggctccacttgaatcacac

SEQ ID NO: 8531061 - DNA, 22 bp, Homo sapiens
aagggccataacttgcagtgtt

SEQ ID NO: 8531062 - DNA, 22 bp, Homo sapiens
aagggccatcccagaacagaaa

SEQ ID NO: 8531063 - DNA, 22 bp, Homo sapiens
aagggccattgctgagagcagt

SEQ ID NO: 8531064 - DNA, 22 bp, Homo sapiens
aagggcaggtgggcatttctgg

SEQ ID NO: 8531065 - DNA, 22 bp, Homo sapiens
aaggcttttgggaattttcaac

SEQ ID NO: 8531066 - DNA, 22 bp, Homo sapiens
aaggctttgtgggctgcaggca

SEQ ID NO: 8531067 - DNA, 22 bp, Homo sapiens
aaggctttgattccattgccct

SEQ ID NO: 8531068 - DNA, 22 bp, Homo sapiens
aaggctttgattccattgccct

SEQ ID NO: 8531069 - DNA, 22 bp, Homo sapiens
aagggagaaaacttgtggctta

SEQ ID NO: 8531070 - DNA, 22 bp, Homo sapiens
aagggagaaaacttgtggctta

SEQ ID NO: 8531071 - DNA, 22 bp, Homo sapiens
aagggactttgtcagctttcca

SEQ ID NO: 8531072 - DNA, 22 bp, Homo sapiens
aagggaaatcctcagcccagga

SEQ ID NO: 8531073 - DNA, 22 bp, Homo sapiens
aagggaaaatagttgatgacca

SEQ ID NO: 8531074 - DNA, 22 bp, Homo sapiens
aagggaaactttcacaatgtcc

SEQ ID NO: 8531075 - DNA, 22 bp, Homo sapiens
aagggaaatcatatggtgcagt

SEQ ID NO: 8531076 - DNA, 22 bp, Homo sapiens
aagctttaaggaattttatgga

SEQ ID NO: 8531077 - DNA, 22 bp, Homo sapiens
aagctttaagtgtcagtcagcc

SEQ ID NO: 8531078 - DNA, 22 bp, Homo sapiens
aaggaaagacaggacggaattc

SEQ ID NO: 8531079 - DNA, 22 bp, Homo sapiens
acaggcatatttctagattaca

SEQ ID NO: 8531080 - DNA, 22 bp, Homo sapiens
acaggcagttgaggtttgtgtg

SEQ ID NO: 8531081 - DNA, 22 bp, Homo sapiens
aaggaaatacaacatgtattca

SEQ ID NO: 8531082 - DNA, 22 bp, Homo sapiens
aaggaaagattctctctctaga

SEQ ID NO: 8531083 - DNA, 22 bp, Homo sapiens
aaggaaagctgtggttctgaga

SEQ ID NO: 8531084 - DNA, 22 bp, Homo sapiens
aaggaaagattctctctctaga

SEQ ID NO: 8531085 - DNA, 22 bp, Homo sapiens
aaggaaagctgtggttctgaga

SEQ ID NO: 8531086 - DNA, 22 bp, Homo sapiens
acagggcttagaacttggcctc

SEQ ID NO: 8531087 - DNA, 22 bp, Homo sapiens
acagtacataatcctgagtctg

SEQ ID NO: 8531088 - DNA, 22 bp, Homo sapiens
acagtacagtgcagaggaagat

SEQ ID NO: 8531089 - DNA, 22 bp, Homo sapiens
acagtacatagatctctaccct

SEQ ID NO: 8531090 - DNA, 22 bp, Homo sapiens
acagtacctgctctcaagcaaa

SEQ ID NO: 8531091 - DNA, 22 bp, Homo sapiens
acagtacagtgcagaggaagat

SEQ ID NO: 8531092 - DNA, 22 bp, Homo sapiens
acagtacaggacgagttttcct

SEQ ID NO: 8531093 - DNA, 22 bp, Homo sapiens
acagtacagctgaaactttagt

SEQ ID NO: 8531094 - DNA, 22 bp, Homo sapiens
acagtacagctgaaactttagt

SEQ ID NO: 8531095 - DNA, 19 bp, Homo sapiens
acagggctctggacgccat

SEQ ID NO: 8531096 - DNA, 23 bp, Homo sapiens
acagggctggcagctgcaagacc

SEQ ID NO: 8531097 - DNA, 22 bp, Homo sapiens
acagggctggcgttgggacaga

SEQ ID NO: 8531098 - DNA, 22 bp, Homo sapiens
acagggctggggcacttggctg

SEQ ID NO: 8531099 - DNA, 22 bp, Homo sapiens
acagggctggggaaagaggcta

SEQ ID NO: 8531100 - DNA, 22 bp, Homo sapiens
acagggctggcgttgggacaga

SEQ ID NO: 8531101 - DNA, 23 bp, Homo sapiens
acagggctggcagctgcaagacc

SEQ ID NO: 8531102 - DNA, 22 bp, Homo sapiens
acagggctcgtcgggccctcgg

SEQ ID NO: 8531103 - DNA, 22 bp, Homo sapiens
acagggctcgtcgggccctcgg

SEQ ID NO: 8531104 - DNA, 22 bp, Homo sapiens
acagggctccttgggctgacac

SEQ ID NO: 8531105 - DNA, 22 bp, Homo sapiens
acagggctcgtcgggccctcgg

SEQ ID NO: 8531106 - DNA, 22 bp, Homo sapiens
acagggctcccagcaggtctgt

SEQ ID NO: 8531107 - DNA, 22 bp, Homo sapiens
acagggctcccagcaggtctgt

SEQ ID NO: 8531108 - DNA, 22 bp, Homo sapiens
acagggctcctaggtggtgtgc

SEQ ID NO: 8531109 - DNA, 22 bp, Homo sapiens
acagggctccttgggctgacac

SEQ ID NO: 8531110 - DNA, 22 bp, Homo sapiens
aagccagggtttgtggatctat

SEQ ID NO: 8531111 - DNA, 22 bp, Homo sapiens
aagccaggtgttgtggtaagag

SEQ ID NO: 8531112 - DNA, 22 bp, Homo sapiens
aagccaggtgttgtggtaagag

SEQ ID NO: 8531113 - DNA, 22 bp, Homo sapiens
aagccaggtgtttaggccagcg

SEQ ID NO: 8531114 - DNA, 22 bp, Homo sapiens
aagccaggtgtttaggccagcg

SEQ ID NO: 8531115 - DNA, 22 bp, Homo sapiens
aagccagggtcaggggcctcct

SEQ ID NO: 8531116 - DNA, 22 bp, Homo sapiens
aagccaggggttggtatgctat

SEQ ID NO: 8531117 - DNA, 22 bp, Homo sapiens
aagccagggattcctgagggag

SEQ ID NO: 8531118 - DNA, 22 bp, Homo sapiens
aagccaggggctgcttaggaga

SEQ ID NO: 8531119 - DNA, 22 bp, Homo sapiens
aagccaggggctgcttaggaga

SEQ ID NO: 8531120 - DNA, 22 bp, Homo sapiens
aagccagggattcctgagggag

SEQ ID NO: 8531121 - DNA, 22 bp, Homo sapiens
aagccaggctgcacttgctggg

SEQ ID NO: 8531122 - DNA, 22 bp, Homo sapiens
aagccaggctgcacttgctggg

SEQ ID NO: 8531123 - DNA, 22 bp, Homo sapiens
aagccaggcatgcttggacagt

SEQ ID NO: 8531124 - DNA, 22 bp, Homo sapiens
aagctgccagctgagctgaggc

SEQ ID NO: 8531125 - DNA, 22 bp, Homo sapiens
aagctgccagctgagctgaggc

SEQ ID NO: 8531126 - DNA, 22 bp, Homo sapiens
aagctgccagattcagtctgct

SEQ ID NO: 8531127 - DNA, 22 bp, Homo sapiens
aagctgccacacggtgagtact

SEQ ID NO: 8531128 - DNA, 22 bp, Homo sapiens
aagctgccaccagcccagggca

SEQ ID NO: 8531129 - DNA, 22 bp, Homo sapiens
aagctgccagctgagctgaggc

SEQ ID NO: 8531130 - DNA, 22 bp, Homo sapiens
aagctgccacacggtgagtact

SEQ ID NO: 8531131 - DNA, 22 bp, Homo sapiens
aagctgccaccagcccagggca

SEQ ID NO: 8531132 - DNA, 22 bp, Homo sapiens
aagctgccaatggtaagctgct

SEQ ID NO: 8531133 - DNA, 22 bp, Homo sapiens
aagctgccaatggtaagctgct

SEQ ID NO: 8531134 - DNA, 22 bp, Homo sapiens
aagctgcagaccccctgtctca

SEQ ID NO: 8531135 - DNA, 22 bp, Homo sapiens
aagctgcagatgtgcctgtgga

SEQ ID NO: 8531136 - DNA, 22 bp, Homo sapiens
aagctgcagcacagagaggtgg

SEQ ID NO: 8531137 - DNA, 22 bp, Homo sapiens
acaggcagtgatttcctctggt

SEQ ID NO: 8531138 - DNA, 22 bp, Homo sapiens
acaggcagtgatttcctctggt

SEQ ID NO: 8531139 - DNA, 22 bp, Homo sapiens
acaggcagtgatttcctctggt

SEQ ID NO: 8531140 - DNA, 22 bp, Homo sapiens
acaggcaggttgagaaacattt

SEQ ID NO: 8531141 - DNA, 22 bp, Homo sapiens
acaggcaggtcctgtcccagct

SEQ ID NO: 8531142 - DNA, 22 bp, Homo sapiens
acaggcaggtcctgtcccagct

SEQ ID NO: 8531143 - DNA, 22 bp, Homo sapiens
aagctgcccaagactgaagcat

SEQ ID NO: 8531144 - DNA, 18 bp, Homo sapiens
aagctgccctcaggcagg

SEQ ID NO: 8531145 - DNA, 22 bp, Homo sapiens
aagctgccatagaacgagaggt

SEQ ID NO: 8531146 - DNA, 22 bp, Homo sapiens
aagctgcccaagactgaagcat

SEQ ID NO: 8531147 - DNA, 22 bp, Homo sapiens
aagctgccatagaacgagaggt

SEQ ID NO: 8531148 - DNA, 23 bp, Homo sapiens
aagctgccagtctgaagcctggg

SEQ ID NO: 8531149 - DNA, 23 bp, Homo sapiens
aagctgccagtctgaagcctggg

SEQ ID NO: 8531150 - DNA, 22 bp, Homo sapiens
aagctgccagattcagtctgct

SEQ ID NO: 8531151 - DNA, 23 bp, Homo sapiens
aagctgccagtctgaagcctggg

SEQ ID NO: 8531152 - DNA, 22 bp, Homo sapiens
aaggcagccgtgtgactgcatg

SEQ ID NO: 8531153 - DNA, 22 bp, Homo sapiens
aaggcagcctctgccagccggg

SEQ ID NO: 8531154 - DNA, 22 bp, Homo sapiens
aaggcagcctctgccagccggg

SEQ ID NO: 8531155 - DNA, 22 bp, Homo sapiens
aaggcagcctctgccagccggg

SEQ ID NO: 8531156 - DNA, 22 bp, Homo sapiens
aaggcagatataaagactagag

SEQ ID NO: 8531157 - DNA, 22 bp, Homo sapiens
acagttgagatgcaactttggg

SEQ ID NO: 8531158 - DNA, 22 bp, Homo sapiens
acagttggttaacacaaatatt

SEQ ID NO: 8531159 - DNA, 22 bp, Homo sapiens
acagttcttaaaacttgaatta

SEQ ID NO: 8531160 - DNA, 22 bp, Homo sapiens
acagttctgtcctagacttcgt

SEQ ID NO: 8531161 - DNA, 21 bp, Homo sapiens
acagttctgccggcatctttc

SEQ ID NO: 8531162 - DNA, 22 bp, Homo sapiens
acagttctgcctgtttgagaag

SEQ ID NO: 8531163 - DNA, 22 bp, Homo sapiens
acagttctgagctataattgct

SEQ ID NO: 8531164 - DNA, 22 bp, Homo sapiens
acagttctgaagactagagcct

SEQ ID NO: 8531165 - DNA, 19 bp, Homo sapiens
acagttctaatttctgtgg

SEQ ID NO: 8531166 - DNA, 22 bp, Homo sapiens
aaggcagcttcaccacagcatt

SEQ ID NO: 8531167 - DNA, 22 bp, Homo sapiens
aaggcagcttcaccacagcatt

SEQ ID NO: 8531168 - DNA, 22 bp, Homo sapiens
aaggcaggatgcggacccatct

SEQ ID NO: 8531169 - DNA, 22 bp, Homo sapiens
aaggcaggatgggaaaagattt

SEQ ID NO: 8531170 - DNA, 22 bp, Homo sapiens
aaggcagttcactcacgcagcc

SEQ ID NO: 8531171 - DNA, 22 bp, Homo sapiens
aaggcagtcaaagcagacttct

SEQ ID NO: 8531172 - DNA, 22 bp, Homo sapiens
aaggcagtcagttgttttgaaa

SEQ ID NO: 8531173 - DNA, 22 bp, Homo sapiens
aaggcagtactttatgtccata

SEQ ID NO: 8531174 - DNA, 22 bp, Homo sapiens
aaggcaggtattgatgccacag

SEQ ID NO: 8531175 - DNA, 22 bp, Homo sapiens
aaggcagtaggatcttccacag

SEQ ID NO: 8531176 - DNA, 22 bp, Homo sapiens
aaggaactgatgctcaaagaat

SEQ ID NO: 8531177 - DNA, 22 bp, Homo sapiens
aaggcacttgcccagagctgca

SEQ ID NO: 8531178 - DNA, 22 bp, Homo sapiens
aaggcacttttcctgagatgat

SEQ ID NO: 8531179 - DNA, 22 bp, Homo sapiens
aaggaagaagactctttactcc

SEQ ID NO: 8531180 - DNA, 22 bp, Homo sapiens
aaggcaccattgtcaacggtaa

SEQ ID NO: 8531181 - DNA, 22 bp, Homo sapiens
aaggcaccatgagatgctggtt

SEQ ID NO: 8531182 - DNA, 22 bp, Homo sapiens
aaggcagaaagggatgtgagtg

SEQ ID NO: 8531183 - DNA, 22 bp, Homo sapiens
aaggcagaaagggatgtgagtg

SEQ ID NO: 8531184 - DNA, 22 bp, Homo sapiens
aaggcagaaagggatgtgagtg

SEQ ID NO: 8531185 - DNA, 22 bp, Homo sapiens
aaggcacttttcctgagatgat

SEQ ID NO: 8531186 - DNA, 22 bp, Homo sapiens
aaggcacttttctaaagacctt

SEQ ID NO: 8531187 - DNA, 19 bp, Homo sapiens
aaggcagaagttggatatg

SEQ ID NO: 8531188 - DNA, 21 bp, Homo sapiens
aaggcagaagcatggaatgag

SEQ ID NO: 8531189 - DNA, 22 bp, Homo sapiens
aaggcagaaattcaactactgg

SEQ ID NO: 8531190 - DNA, 22 bp, Homo sapiens
aaggcagaaattcaactactgg

SEQ ID NO: 8531191 - DNA, 22 bp, Homo sapiens
aaggaaccatttgtgtgcatgg

SEQ ID NO: 8531192 - DNA, 22 bp, Homo sapiens
aaggaacctggagtagagggag

SEQ ID NO: 8531193 - DNA, 22 bp, Homo sapiens
aaggaacactacaaggctggga

SEQ ID NO: 8531194 - DNA, 22 bp, Homo sapiens
aaggaaatctttgtaacatctt

SEQ ID NO: 8531195 - DNA, 22 bp, Homo sapiens
acagtataccattgtgactttg

SEQ ID NO: 8531196 - DNA, 22 bp, Homo sapiens
acagtataccattgtgactttg

SEQ ID NO: 8531197 - DNA, 22 bp, Homo sapiens
acagtatacattgattaggacc

SEQ ID NO: 8531198 - DNA, 22 bp, Homo sapiens
acagtataactccatgccaccc

SEQ ID NO: 8531199 - DNA, 22 bp, Homo sapiens
acagtatacattgattaggacc

SEQ ID NO: 8531200 - DNA, 22 bp, Homo sapiens
acagtataaactcctaaaagcc

SEQ ID NO: 8531201 - DNA, 22 bp, Homo sapiens
acagtagtctcaggaataggca

SEQ ID NO: 8531202 - DNA, 22 bp, Homo sapiens
acagtagtcctttattttggtt

SEQ ID NO: 8531203 - DNA, 22 bp, Homo sapiens
acagtagtgccatgacctacag

SEQ ID NO: 8531204 - DNA, 22 bp, Homo sapiens
acagtagtcttaatttcatgta

SEQ ID NO: 8531205 - DNA, 22 bp, Homo sapiens
acagtagtgctcaatcagtgtt

SEQ ID NO: 8531206 - DNA, 22 bp, Homo sapiens
acagtagctaatattgcattat

SEQ ID NO: 8531207 - DNA, 22 bp, Homo sapiens
acagtagattggtatgatgtca

SEQ ID NO: 8531208 - DNA, 22 bp, Homo sapiens
acagtagtctcaggaataggca

SEQ ID NO: 8531209 - DNA, 22 bp, Homo sapiens
acagtagtacacatctatgtcc

SEQ ID NO: 8531210 - DNA, 22 bp, Homo sapiens
acagtaggaatagatgtagata

SEQ ID NO: 8531211 - DNA, 21 bp, Homo sapiens
acagtacttgagatcttttga

SEQ ID NO: 8531212 - DNA, 22 bp, Homo sapiens
acagtactgagtactgagttgg

SEQ ID NO: 8531213 - DNA, 22 bp, Homo sapiens
acagtactgctgttcttgtcct

SEQ ID NO: 8531214 - DNA, 22 bp, Homo sapiens
acagtagaccctggataaacat

SEQ ID NO: 8531215 - DNA, 22 bp, Homo sapiens
acagtagagcatttgttttgat

SEQ ID NO: 8531216 - DNA, 22 bp, Homo sapiens
acagtagagtaaatggttagat

SEQ ID NO: 8531217 - DNA, 22 bp, Homo sapiens
actaagacctagatactagggg

SEQ ID NO: 8531218 - DNA, 22 bp, Homo sapiens
actaacttgctgagtgaccatg

SEQ ID NO: 8531219 - DNA, 20 bp, Homo sapiens
actaaggtggtagcagcagg

SEQ ID NO: 8531220 - DNA, 22 bp, Homo sapiens
actaagatgcaggaaatgctag

SEQ ID NO: 8531221 - DNA, 22 bp, Homo sapiens
actaagtgggacatttactagg

SEQ ID NO: 8531222 - DNA, 22 bp, Homo sapiens
actacaatactcttagtaaaag

SEQ ID NO: 8531223 - DNA, 22 bp, Homo sapiens
actacaatactcttagtaaaag

SEQ ID NO: 8531224 - DNA, 22 bp, Homo sapiens
actacaaaagcactgggtatta

SEQ ID NO: 8531225 - DNA, 22 bp, Homo sapiens
actacaatactcttagtaaaag

SEQ ID NO: 8531226 - DNA, 22 bp, Homo sapiens
aagttactatgactcttctttt

SEQ ID NO: 8531227 - DNA, 22 bp, Homo sapiens
aagttactggcaagggctgcag

SEQ ID NO: 8531228 - DNA, 22 bp, Homo sapiens
aagttactggcaagggctgcag

SEQ ID NO: 8531229 - DNA, 22 bp, Homo sapiens
aagttactttacctctttagct

SEQ ID NO: 8531230 - DNA, 22 bp, Homo sapiens
aagttatatcatctcattgacg

SEQ ID NO: 8531231 - DNA, 22 bp, Homo sapiens
aagttatatcatctcattgacg

SEQ ID NO: 8531232 - DNA, 22 bp, Homo sapiens
aagttatatcatctcattgacg

SEQ ID NO: 8531233 - DNA, 22 bp, Homo sapiens
aagttaggatgaatgccttagc

SEQ ID NO: 8531234 - DNA, 22 bp, Homo sapiens
aagttatatcatctcattgacg

SEQ ID NO: 8531235 - DNA, 22 bp, Homo sapiens
aagttatatcatctcattgacg

SEQ ID NO: 8531236 - DNA, 22 bp, Homo sapiens
aagttattgcagcaatccaagt

SEQ ID NO: 8531237 - DNA, 22 bp, Homo sapiens
aagttatgaaatttggacagct

SEQ ID NO: 8531238 - DNA, 22 bp, Homo sapiens
actccaggtgtgttggactcta

SEQ ID NO: 8531239 - DNA, 22 bp, Homo sapiens
actccaggtgtgttggactcta

SEQ ID NO: 8531240 - DNA, 20 bp, Homo sapiens
actccaggtggcatgaggac

SEQ ID NO: 8531241 - DNA, 20 bp, Homo sapiens
actccaggtggcatgaggac

SEQ ID NO: 8531242 - DNA, 22 bp, Homo sapiens
actccaggtaggcacattgaca

SEQ ID NO: 8531243 - DNA, 22 bp, Homo sapiens
aagttcaaggaagcctccagtt

SEQ ID NO: 8531244 - DNA, 22 bp, Homo sapiens
actccagggttttgcacctgga

SEQ ID NO: 8531245 - DNA, 22 bp, Homo sapiens
actccaggtaggcacattgaca

SEQ ID NO: 8531246 - DNA, 22 bp, Homo sapiens
actccaggtaggcacattgaca

SEQ ID NO: 8531247 - DNA, 22 bp, Homo sapiens
aagttcaagagtgacatattag

SEQ ID NO: 8531248 - DNA, 22 bp, Homo sapiens
aagttcaagatcaaggttccag

SEQ ID NO: 8531249 - DNA, 22 bp, Homo sapiens
aagttcaagctctgcctaaaat

SEQ ID NO: 8531250 - DNA, 22 bp, Homo sapiens
aagttcaagctctgcctaaaat

SEQ ID NO: 8531251 - DNA, 22 bp, Homo sapiens
aagttatttttcaagatccttt

SEQ ID NO: 8531252 - DNA, 22 bp, Homo sapiens
aagttattgcagcaatccaagt

SEQ ID NO: 8531253 - DNA, 22 bp, Homo sapiens
aagttattgcagcaatccaagt

SEQ ID NO: 8531254 - DNA, 22 bp, Homo sapiens
aagttatttcctcgtgactgaa

SEQ ID NO: 8531255 - DNA, 22 bp, Homo sapiens
actccagttctcttgtttataa

SEQ ID NO: 8531256 - DNA, 22 bp, Homo sapiens
actccagttaccttggctgagg

SEQ ID NO: 8531257 - DNA, 22 bp, Homo sapiens
actccaggttttttcactgaag

SEQ ID NO: 8531258 - DNA, 22 bp, Homo sapiens
actccaggttttttcactgaag

SEQ ID NO: 8531259 - DNA, 22 bp, Homo sapiens
actccaggttttctctcaagtt

SEQ ID NO: 8531260 - DNA, 22 bp, Homo sapiens
actccaggttttctctcaagtt

SEQ ID NO: 8531261 - DNA, 22 bp, Homo sapiens
actcccaggttgcctggcaggc

SEQ ID NO: 8531262 - DNA, 22 bp, Homo sapiens
actcccactccagagtagaagc

SEQ ID NO: 8531263 - DNA, 22 bp, Homo sapiens
actccatacaatggcaggctgt

SEQ ID NO: 8531264 - DNA, 22 bp, Homo sapiens
actcccagaacatgctcttctt

SEQ ID NO: 8531265 - DNA, 22 bp, Homo sapiens
actccccagactgccatgctgg

SEQ ID NO: 8531266 - DNA, 18 bp, Homo sapiens
actccccacaggctctgt

SEQ ID NO: 8531267 - DNA, 22 bp, Homo sapiens
actccccagactgccatgctgg

SEQ ID NO: 8531268 - DNA, 22 bp, Homo sapiens
actcccaggttgcctggcaggc

SEQ ID NO: 8531269 - DNA, 22 bp, Homo sapiens
actcccaggttgcctggcaggc

SEQ ID NO: 8531270 - DNA, 22 bp, Homo sapiens
actcccaggttgcctggcaggc

SEQ ID NO: 8531271 - DNA, 22 bp, Homo sapiens
actccccaaaactaaccatgca

SEQ ID NO: 8531272 - DNA, 22 bp, Homo sapiens
actccccaaaactaaccatgca

SEQ ID NO: 8531273 - DNA, 18 bp, Homo sapiens
actccccacaggctctgt

SEQ ID NO: 8531274 - DNA, 22 bp, Homo sapiens
aagtcagagatcaaggtgtcta

SEQ ID NO: 8531275 - DNA, 22 bp, Homo sapiens
aagtcagagcaactgagacatt

SEQ ID NO: 8531276 - DNA, 22 bp, Homo sapiens
aagtcagagcaactgagacatt

SEQ ID NO: 8531277 - DNA, 22 bp, Homo sapiens
aagtcagagatgccaaagatta

SEQ ID NO: 8531278 - DNA, 22 bp, Homo sapiens
aagtcagataggtgagtccaaa

SEQ ID NO: 8531279 - DNA, 22 bp, Homo sapiens
aagtcagagcaactgagacatt

SEQ ID NO: 8531280 - DNA, 22 bp, Homo sapiens
aagtcagacagctgagctgcct

SEQ ID NO: 8531281 - DNA, 22 bp, Homo sapiens
aagtcactggaggaactctact

SEQ ID NO: 8531282 - DNA, 22 bp, Homo sapiens
aagtcactaagtgaaccactgg

SEQ ID NO: 8531283 - DNA, 22 bp, Homo sapiens
aagtcacattctgaggtattgg

SEQ ID NO: 8531284 - DNA, 22 bp, Homo sapiens
aagtcacattctgaggtattgg

SEQ ID NO: 8531285 - DNA, 22 bp, Homo sapiens
aagtcacttcttaggaaaggag

SEQ ID NO: 8531286 - DNA, 22 bp, Homo sapiens
aagtcacagagttggaagtcag

SEQ ID NO: 8531287 - DNA, 22 bp, Homo sapiens
aagtcacagaacccattgtaac

SEQ ID NO: 8531288 - DNA, 22 bp, Homo sapiens
aagtcacagaacccattgtaac

SEQ ID NO: 8531289 - DNA, 22 bp, Homo sapiens
aagtcacagaacccattgtaac

SEQ ID NO: 8531290 - DNA, 22 bp, Homo sapiens
aagtcacactgctgggaactct

SEQ ID NO: 8531291 - DNA, 22 bp, Homo sapiens
aagtcacactagacaactgagg

SEQ ID NO: 8531292 - DNA, 22 bp, Homo sapiens
aagtcacactgctgggaactct

SEQ ID NO: 8531293 - DNA, 22 bp, Homo sapiens
aagtcacagagttggaagtcag

SEQ ID NO: 8531294 - DNA, 22 bp, Homo sapiens
aagtcacagaacccattgtaac

SEQ ID NO: 8531295 - DNA, 22 bp, Homo sapiens
aagtcacagctaaatagctaag

SEQ ID NO: 8531296 - DNA, 22 bp, Homo sapiens
aagtcacagctaaatagctaag

SEQ ID NO: 8531297 - DNA, 22 bp, Homo sapiens
aagtcacattctgaggtattgg

SEQ ID NO: 8531298 - DNA, 22 bp, Homo sapiens
aagtcacattctgaggtattgg

SEQ ID NO: 8531299 - DNA, 22 bp, Homo sapiens
aagtcagtgaaaaggcatcatc

SEQ ID NO: 8531300 - DNA, 21 bp, Homo sapiens
aagtcagtcagttctatacta

SEQ ID NO: 8531301 - DNA, 22 bp, Homo sapiens
aagtgcataataactcccaagt

SEQ ID NO: 8531302 - DNA, 22 bp, Homo sapiens
aagtgcatacactagttaattg

SEQ ID NO: 8531303 - DNA, 22 bp, Homo sapiens
aagtgcatagtaatggagtcaa

SEQ ID NO: 8531304 - DNA, 22 bp, Homo sapiens
aagtgcatacactagttaattg

SEQ ID NO: 8531305 - DNA, 22 bp, Homo sapiens
aagtgctttacaaatgtctgtt

SEQ ID NO: 8531306 - DNA, 22 bp, Homo sapiens
aagtggaagagaagttatctta

SEQ ID NO: 8531307 - DNA, 22 bp, Homo sapiens
aagtggactaatacaaggacta

SEQ ID NO: 8531308 - DNA, 21 bp, Homo sapiens
aagtggagaagaaaagctgga

SEQ ID NO: 8531309 - DNA, 21 bp, Homo sapiens
aagtggagaagaaaagctgga

SEQ ID NO: 8531310 - DNA, 22 bp, Homo sapiens
aagtggagagccctggaggtct

SEQ ID NO: 8531311 - DNA, 22 bp, Homo sapiens
aagtggagccagggaaactgaa

SEQ ID NO: 8531312 - DNA, 22 bp, Homo sapiens
actaaatttgtcaatgacactt

SEQ ID NO: 8531313 - DNA, 22 bp, Homo sapiens
actaacttctgagaaccaattg

SEQ ID NO: 8531314 - DNA, 22 bp, Homo sapiens
actaacatgttaatcaaaagaa

SEQ ID NO: 8531315 - DNA, 23 bp, Homo sapiens
actaaatggggctttgcttaaag

SEQ ID NO: 8531316 - DNA, 22 bp, Homo sapiens
actaaatgctgcataaatgctt

SEQ ID NO: 8531317 - DNA, 22 bp, Homo sapiens
actaaatgagatactgtcttca

SEQ ID NO: 8531318 - DNA, 22 bp, Homo sapiens
actaaatgaactattaatactt

SEQ ID NO: 8531319 - DNA, 22 bp, Homo sapiens
aagtggagccagggaaactgaa

SEQ ID NO: 8531320 - DNA, 22 bp, Homo sapiens
aataatttccagccaactggaa

SEQ ID NO: 8531321 - DNA, 22 bp, Homo sapiens
aataattgtcaactatgctaca

SEQ ID NO: 8531322 - DNA, 22 bp, Homo sapiens
aataattatttgagagcagacc

SEQ ID NO: 8531323 - DNA, 22 bp, Homo sapiens
aataattatttgagagcagacc

SEQ ID NO: 8531324 - DNA, 22 bp, Homo sapiens
aataattagtgggacagagaac

SEQ ID NO: 8531325 - DNA, 22 bp, Homo sapiens
aataattagtgggacagagaac

SEQ ID NO: 8531326 - DNA, 22 bp, Homo sapiens
aataattatttgagagcagacc

SEQ ID NO: 8531327 - DNA, 22 bp, Homo sapiens
aataattatttgagagcagacc

SEQ ID NO: 8531328 - DNA, 22 bp, Homo sapiens
aataattatttgagagcagacc

SEQ ID NO: 8531329 - DNA, 22 bp, Homo sapiens
aataattatttgagagcagacc

SEQ ID NO: 8531330 - DNA, 22 bp, Homo sapiens
aataattttagctcagagttgt

SEQ ID NO: 8531331 - DNA, 22 bp, Homo sapiens
aataattttagctcagagttgt

SEQ ID NO: 8531332 - DNA, 22 bp, Homo sapiens
aataattttgagagcctggaaa

SEQ ID NO: 8531333 - DNA, 22 bp, Homo sapiens
aataattttgagagcctggaaa

SEQ ID NO: 8531334 - DNA, 22 bp, Homo sapiens
aatacaagatttatagttgttt

SEQ ID NO: 8531335 - DNA, 22 bp, Homo sapiens
aatacaagatttatagttgttt

SEQ ID NO: 8531336 - DNA, 22 bp, Homo sapiens
aatacaatcaaattcactagca

SEQ ID NO: 8531337 - DNA, 22 bp, Homo sapiens
aatacaatcaaattcactagca

SEQ ID NO: 8531338 - DNA, 22 bp, Homo sapiens
aataattagtgggacagagaac

SEQ ID NO: 8531339 - DNA, 22 bp, Homo sapiens
aataattagtgggacagagaac

SEQ ID NO: 8531340 - DNA, 22 bp, Homo sapiens
aataattagtgggacagagaac

SEQ ID NO: 8531341 - DNA, 22 bp, Homo sapiens
aataattagtgggacagagaac

SEQ ID NO: 8531342 - DNA, 22 bp, Homo sapiens
aataattagtgggacagagaac

SEQ ID NO: 8531343 - DNA, 22 bp, Homo sapiens
aataattacccatctttttgta

SEQ ID NO: 8531344 - DNA, 22 bp, Homo sapiens
aataatgtttatttgtattctc

SEQ ID NO: 8531345 - DNA, 22 bp, Homo sapiens
aataatgttgacgatagtctta

SEQ ID NO: 8531346 - DNA, 19 bp, Homo sapiens
aataatgttcatgagattg

SEQ ID NO: 8531347 - DNA, 22 bp, Homo sapiens
aataagatgtgcttgagtttgg

SEQ ID NO: 8531348 - DNA, 22 bp, Homo sapiens
aataagattgacacaagtacct

SEQ ID NO: 8531349 - DNA, 22 bp, Homo sapiens
aataagattgacacaagtacct

SEQ ID NO: 8531350 - DNA, 22 bp, Homo sapiens
aataagatcttaaaggttatat

SEQ ID NO: 8531351 - DNA, 22 bp, Homo sapiens
actgcctgtttggcatggcccc

SEQ ID NO: 8531352 - DNA, 22 bp, Homo sapiens
actgcctgtttggcatggcccc

SEQ ID NO: 8531353 - DNA, 22 bp, Homo sapiens
actgcctgtttggcatggcccc

SEQ ID NO: 8531354 - DNA, 23 bp, Homo sapiens
actgcctgtgccgatctctctca

SEQ ID NO: 8531355 - DNA, 22 bp, Homo sapiens
actgcctgtgtcccttcagtgc

SEQ ID NO: 8531356 - DNA, 22 bp, Homo sapiens
aataatagttgcaaagtgttta

SEQ ID NO: 8531357 - DNA, 22 bp, Homo sapiens
aataatagttgcaaagtgttta

SEQ ID NO: 8531358 - DNA, 22 bp, Homo sapiens
aataagaatttacttgtcaaga

SEQ ID NO: 8531359 - DNA, 22 bp, Homo sapiens
aataagaatttacttgtcaaga

SEQ ID NO: 8531360 - DNA, 22 bp, Homo sapiens
aataagaattgccagatttgaa

SEQ ID NO: 8531361 - DNA, 22 bp, Homo sapiens
aataacttaagaaatttcccca

SEQ ID NO: 8531362 - DNA, 22 bp, Homo sapiens
aataacttcagttcttacatta

SEQ ID NO: 8531363 - DNA, 22 bp, Homo sapiens
aataagaatttacttgtcaaga

SEQ ID NO: 8531364 - DNA, 22 bp, Homo sapiens
aataagatcctgaagatatgtt

SEQ ID NO: 8531365 - DNA, 22 bp, Homo sapiens
aataagatcctgaagatatgtt

SEQ ID NO: 8531366 - DNA, 22 bp, Homo sapiens
aataagatcctgaagatatgtt

SEQ ID NO: 8531367 - DNA, 22 bp, Homo sapiens
aataagatcctgaagatatgtt

SEQ ID NO: 8531368 - DNA, 22 bp, Homo sapiens
aagtttcaaatgttgattatgc

SEQ ID NO: 8531369 - DNA, 22 bp, Homo sapiens
aagtttatgttggtaagatatc

SEQ ID NO: 8531370 - DNA, 22 bp, Homo sapiens
aagtttatgttggtaagatatc

SEQ ID NO: 8531371 - DNA, 20 bp, Homo sapiens
aagtttcatgctctggggat

SEQ ID NO: 8531372 - DNA, 22 bp, Homo sapiens
aagtttcatgatgtaattattg

SEQ ID NO: 8531373 - DNA, 22 bp, Homo sapiens
aagtttcatgacttggttatta

SEQ ID NO: 8531374 - DNA, 22 bp, Homo sapiens
aagtttcatgtggaggtagact

SEQ ID NO: 8531375 - DNA, 22 bp, Homo sapiens
aagtttcattgttcatgtaaca

SEQ ID NO: 8531376 - DNA, 22 bp, Homo sapiens
aagttctaattttgcattcagg

SEQ ID NO: 8531377 - DNA, 22 bp, Homo sapiens
aagttctactgtgggtaaaatg

SEQ ID NO: 8531378 - DNA, 22 bp, Homo sapiens
aagttctagaggttgatttggt

SEQ ID NO: 8531379 - DNA, 20 bp, Homo sapiens
aagttggctcctcctagcaa

SEQ ID NO: 8531380 - DNA, 22 bp, Homo sapiens
aagttggtgtatgagacagaag

SEQ ID NO: 8531381 - DNA, 22 bp, Homo sapiens
aagttggtaggagacagaaggt

SEQ ID NO: 8531382 - DNA, 22 bp, Homo sapiens
aagttgtagtcagatgtcagtt

SEQ ID NO: 8531383 - DNA, 22 bp, Homo sapiens
aagttgtatataccgctttaag

SEQ ID NO: 8531384 - DNA, 22 bp, Homo sapiens
aagtttaaggtggaagtggtgg

SEQ ID NO: 8531385 - DNA, 22 bp, Homo sapiens
aagtttacataagtgatgatga

SEQ ID NO: 8531386 - DNA, 22 bp, Homo sapiens
aagtttaacttgaattctttct

SEQ ID NO: 8531387 - DNA, 22 bp, Homo sapiens
aagttgttgttgaggtgggtaa

SEQ ID NO: 8531388 - DNA, 23 bp, Homo sapiens
aagttgtttttggccagggaaag

SEQ ID NO: 8531389 - DNA, 21 bp, Homo sapiens
aagttgtctcttttggttcct

SEQ ID NO: 8531390 - DNA, 22 bp, Homo sapiens
aagttgtatgtcttagaaagta

SEQ ID NO: 8531391 - DNA, 21 bp, Homo sapiens
aagttgtctcttttggttcct

SEQ ID NO: 8531392 - DNA, 22 bp, Homo sapiens
aagtttatgttctttgaaggca

SEQ ID NO: 8531393 - DNA, 22 bp, Homo sapiens
aagtttatccctctcacagtta

SEQ ID NO: 8531394 - DNA, 22 bp, Homo sapiens
aagtttactggggagatcacct

SEQ ID NO: 8531395 - DNA, 22 bp, Homo sapiens
aagtttatccctctcacagtta

SEQ ID NO: 8531396 - DNA, 22 bp, Homo sapiens
aatccatagaataaaattgcag

SEQ ID NO: 8531397 - DNA, 22 bp, Homo sapiens
aatccataggtttttccaagag

SEQ ID NO: 8531398 - DNA, 22 bp, Homo sapiens
aatccaggtggcggaggttgtg

SEQ ID NO: 8531399 - DNA, 22 bp, Homo sapiens
aatccataatgttgtggggttt

SEQ ID NO: 8531400 - DNA, 22 bp, Homo sapiens
aatccagctgtgtcacaggtga

SEQ ID NO: 8531401 - DNA, 22 bp, Homo sapiens
aatcataattgtatacattcat

SEQ ID NO: 8531402 - DNA, 22 bp, Homo sapiens
aatcataattgtatacattcat

SEQ ID NO: 8531403 - DNA, 22 bp, Homo sapiens
acttgtttcaactgtactctcc

SEQ ID NO: 8531404 - DNA, 22 bp, Homo sapiens
acttgtttcaactgtactctca

SEQ ID NO: 8531405 - DNA, 22 bp, Homo sapiens
acttgtttgaatctctctagag

SEQ ID NO: 8531406 - DNA, 22 bp, Homo sapiens
acttgtttggtctcatgtttaa

SEQ ID NO: 8531407 - DNA, 22 bp, Homo sapiens
acttgtttgcctaaaattttga

SEQ ID NO: 8531408 - DNA, 22 bp, Homo sapiens
acttgtttggtctcatgtttaa

SEQ ID NO: 8531409 - DNA, 22 bp, Homo sapiens
actttaaaaagagccttctaac

SEQ ID NO: 8531410 - DNA, 19 bp, Homo sapiens
acttgttttggaggtgatg

SEQ ID NO: 8531411 - DNA, 22 bp, Homo sapiens
aatcctgaggcaaagagatgag

SEQ ID NO: 8531412 - DNA, 22 bp, Homo sapiens
aatcctgacctgggcatgcttg

SEQ ID NO: 8531413 - DNA, 22 bp, Homo sapiens
aatccctactagagcataccgt

SEQ ID NO: 8531414 - DNA, 22 bp, Homo sapiens
aatccctttttcatttaataga

SEQ ID NO: 8531415 - DNA, 22 bp, Homo sapiens
aatccgattcgtgtacattaat

SEQ ID NO: 8531416 - DNA, 22 bp, Homo sapiens
aatccattaaaaacaagcgcat

SEQ ID NO: 8531417 - DNA, 22 bp, Homo sapiens
aatccattcagaaattgggaat

SEQ ID NO: 8531418 - DNA, 22 bp, Homo sapiens
aatccattgctgtgctgccagg

SEQ ID NO: 8531419 - DNA, 22 bp, Homo sapiens
aatccatgcatgcaaggaaagg

SEQ ID NO: 8531420 - DNA, 22 bp, Homo sapiens
aatccatgttgatgtatatttt

SEQ ID NO: 8531421 - DNA, 22 bp, Homo sapiens
aatccatctctccgagaagttt

SEQ ID NO: 8531422 - DNA, 22 bp, Homo sapiens
aatccatttactctttacaaga

SEQ ID NO: 8531423 - DNA, 22 bp, Homo sapiens
aatcccagctactcaggaagtt

SEQ ID NO: 8531424 - DNA, 22 bp, Homo sapiens
aatccatttactctttacaaga

SEQ ID NO: 8531425 - DNA, 22 bp, Homo sapiens
acttgtttacaagcagttctga

SEQ ID NO: 8531426 - DNA, 22 bp, Homo sapiens
acttgttcattgagtacatatg

SEQ ID NO: 8531427 - DNA, 22 bp, Homo sapiens
acttgttcattgagtacatatg

SEQ ID NO: 8531428 - DNA, 22 bp, Homo sapiens
acttgttagttttatctgcatg

SEQ ID NO: 8531429 - DNA, 22 bp, Homo sapiens
acttgtgtaacacagaaagaac

SEQ ID NO: 8531430 - DNA, 22 bp, Homo sapiens
aatattttaggctttccaggct

SEQ ID NO: 8531431 - DNA, 22 bp, Homo sapiens
aatattttaggctttccaggct

SEQ ID NO: 8531432 - DNA, 22 bp, Homo sapiens
aatatttttgaggccctgttat

SEQ ID NO: 8531433 - DNA, 22 bp, Homo sapiens
aatatttttgaggccctgttat

SEQ ID NO: 8531434 - DNA, 22 bp, Homo sapiens
aatcaaaacctacagaggtaat

SEQ ID NO: 8531435 - DNA, 22 bp, Homo sapiens
aatcaaaacctacagaggtaat

SEQ ID NO: 8531436 - DNA, 22 bp, Homo sapiens
aatcaacattgttttaagtcaa

SEQ ID NO: 8531437 - DNA, 22 bp, Homo sapiens
aatcaacaggatgtgcattgta

SEQ ID NO: 8531438 - DNA, 22 bp, Homo sapiens
aatatatgactccactgcatga

SEQ ID NO: 8531439 - DNA, 22 bp, Homo sapiens
aatatatagaagtacccgttgt

SEQ ID NO: 8531440 - DNA, 22 bp, Homo sapiens
aatatatagaagtacccgttgt

SEQ ID NO: 8531441 - DNA, 22 bp, Homo sapiens
acttgaatttagtttttcctaa

SEQ ID NO: 8531442 - DNA, 22 bp, Homo sapiens
aatatatagaagtacccgttgt

SEQ ID NO: 8531443 - DNA, 22 bp, Homo sapiens
aatatatagaagtacccgttgt

SEQ ID NO: 8531444 - DNA, 23 bp, Homo sapiens
acttgattattgttgatagattc

SEQ ID NO: 8531445 - DNA, 22 bp, Homo sapiens
aatatatttgaatcaggaacaa

SEQ ID NO: 8531446 - DNA, 22 bp, Homo sapiens
aatatcaacagtgtccttctaa

SEQ ID NO: 8531447 - DNA, 22 bp, Homo sapiens
aatatcaacagtgtccttctaa

SEQ ID NO: 8531448 - DNA, 23 bp, Homo sapiens
aatatcaaggtgatgttcccaga

SEQ ID NO: 8531449 - DNA, 22 bp, Homo sapiens
aatatcacaggaggagaccaag

SEQ ID NO: 8531450 - DNA, 22 bp, Homo sapiens
aatatcagaatgtaatggtcct

SEQ ID NO: 8531451 - DNA, 22 bp, Homo sapiens
aatattcatttgcagaagaagt

SEQ ID NO: 8531452 - DNA, 23 bp, Homo sapiens
aatattcctgccattaatgactc

SEQ ID NO: 8531453 - DNA, 22 bp, Homo sapiens
aatattcatttgcagaagaagt

SEQ ID NO: 8531454 - DNA, 19 bp, Homo sapiens
aatattttagcctcttcct

SEQ ID NO: 8531455 - DNA, 19 bp, Homo sapiens
aatattttagcctcttcct

SEQ ID NO: 8531456 - DNA, 22 bp, Homo sapiens
aatattctaataaatgcccatc

SEQ ID NO: 8531457 - DNA, 22 bp, Homo sapiens
aatatttgttagtgttttaatg

SEQ ID NO: 8531458 - DNA, 22 bp, Homo sapiens
aatatttgttagtgttttaatg

SEQ ID NO: 8531459 - DNA, 22 bp, Homo sapiens
acttgaattatatttctagaga

SEQ ID NO: 8531460 - DNA, 22 bp, Homo sapiens
acttgaattcaaagcgaaagca

SEQ ID NO: 8531461 - DNA, 22 bp, Homo sapiens
acttgaattaggccttgagaga

SEQ ID NO: 8531462 - DNA, 22 bp, Homo sapiens
acttgaataggtgtcaaggcca

SEQ ID NO: 8531463 - DNA, 22 bp, Homo sapiens
acttgaataggaaagccacaaa

SEQ ID NO: 8531464 - DNA, 22 bp, Homo sapiens
acttgaaaggaagctctaaaac

SEQ ID NO: 8531465 - DNA, 19 bp, Homo sapiens
acttgaaagcagagagttt

SEQ ID NO: 8531466 - DNA, 19 bp, Homo sapiens
acttgaaagcagagagttt

SEQ ID NO: 8531467 - DNA, 19 bp, Homo sapiens
acttcttttcaacacagga

SEQ ID NO: 8531468 - DNA, 22 bp, Homo sapiens
acttgaaaagctcagcagtagt

SEQ ID NO: 8531469 - DNA, 22 bp, Homo sapiens
acttgaaacatctttaaatgta

SEQ ID NO: 8531470 - DNA, 22 bp, Homo sapiens
acttgaaaccctgagatgataa

SEQ ID NO: 8531471 - DNA, 22 bp, Homo sapiens
acttgaaacatctttaaatgta

SEQ ID NO: 8531472 - DNA, 22 bp, Homo sapiens
acttgaaaccctgagatgataa

SEQ ID NO: 8531473 - DNA, 22 bp, Homo sapiens
acttgaaaccctgagatgataa

SEQ ID NO: 8531474 - DNA, 22 bp, Homo sapiens
acttcctggattcccaagggct

SEQ ID NO: 8531475 - DNA, 22 bp, Homo sapiens
acttcctgctatgagcttctgt

SEQ ID NO: 8531476 - DNA, 22 bp, Homo sapiens
acttcttttcaaatcatgcaaa

SEQ ID NO: 8531477 - DNA, 22 bp, Homo sapiens
acttcttttcaaatcatgcaaa

SEQ ID NO: 8531478 - DNA, 19 bp, Homo sapiens
acttcttttcaacacagga

SEQ ID NO: 8531479 - DNA, 19 bp, Homo sapiens
acttcttttcaacacagga

SEQ ID NO: 8531480 - DNA, 22 bp, Homo sapiens
aatacagagaatgttatttgga

SEQ ID NO: 8531481 - DNA, 22 bp, Homo sapiens
aatacaatcaaattcactagca

SEQ ID NO: 8531482 - DNA, 22 bp, Homo sapiens
aatacaatcaaattcactagca

SEQ ID NO: 8531483 - DNA, 22 bp, Homo sapiens
aatgacatggagcatcttttca

SEQ ID NO: 8531484 - DNA, 22 bp, Homo sapiens
aatgacctgggtgtcatttcat

SEQ ID NO: 8531485 - DNA, 22 bp, Homo sapiens
aatgaccagcgcctgcagaggg

SEQ ID NO: 8531486 - DNA, 22 bp, Homo sapiens
aatgactctgctgcagagacac

SEQ ID NO: 8531487 - DNA, 22 bp, Homo sapiens
aatgaatgtgattaacttcaag

SEQ ID NO: 8531488 - DNA, 22 bp, Homo sapiens
agaaatactgcctaagactgta

SEQ ID NO: 8531489 - DNA, 22 bp, Homo sapiens
agaaatactgtgagagcagcct

SEQ ID NO: 8531490 - DNA, 19 bp, Homo sapiens
aatgactgagtacattgtc

SEQ ID NO: 8531491 - DNA, 22 bp, Homo sapiens
aatgactgtagtcatattaagg

SEQ ID NO: 8531492 - DNA, 22 bp, Homo sapiens
aatgactttgaaatatttgagt

SEQ ID NO: 8531493 - DNA, 22 bp, Homo sapiens
aatgagaagcctaggtgtactg

SEQ ID NO: 8531494 - DNA, 22 bp, Homo sapiens
aatgagacacgtgaagcagatg

SEQ ID NO: 8531495 - DNA, 22 bp, Homo sapiens
aatgagacacgtgaagcagatg

SEQ ID NO: 8531496 - DNA, 22 bp, Homo sapiens
aatgagttagatgagaaaataa

SEQ ID NO: 8531497 - DNA, 19 bp, Homo sapiens
aatgagttccatgaaaaga

SEQ ID NO: 8531498 - DNA, 18 bp, Homo sapiens
agaaggagctatgggcag

SEQ ID NO: 8531499 - DNA, 18 bp, Homo sapiens
agaaggagctatgggcag

SEQ ID NO: 8531500 - DNA, 22 bp, Homo sapiens
aatgagttctgacacttcacga

SEQ ID NO: 8531501 - DNA, 22 bp, Homo sapiens
agaagggagagaaagttggtta

SEQ ID NO: 8531502 - DNA, 21 bp, Homo sapiens
agaagggattgtggtaaagat

SEQ ID NO: 8531503 - DNA, 21 bp, Homo sapiens
agaagggattgtggtaaagat

SEQ ID NO: 8531504 - DNA, 18 bp, Homo sapiens
agaaggagctatgggcag

SEQ ID NO: 8531505 - DNA, 22 bp, Homo sapiens
agaagggaactcagagatgatt

SEQ ID NO: 8531506 - DNA, 22 bp, Homo sapiens
aatgagcttctataatcttgtc

SEQ ID NO: 8531507 - DNA, 22 bp, Homo sapiens
aatgaggccagtagaaggaagt

SEQ ID NO: 8531508 - DNA, 22 bp, Homo sapiens
aatgaggcttgcattgtgaact

SEQ ID NO: 8531509 - DNA, 22 bp, Homo sapiens
aatgagggggatgggaaagtgt

SEQ ID NO: 8531510 - DNA, 22 bp, Homo sapiens
aatgagggggatgggaaagtgt

SEQ ID NO: 8531511 - DNA, 22 bp, Homo sapiens
aatgaggtgaggaaggcctcag

SEQ ID NO: 8531512 - DNA, 22 bp, Homo sapiens
aatgagctagacctgcttcctc

SEQ ID NO: 8531513 - DNA, 22 bp, Homo sapiens
aatgagatggaattcccgccta

SEQ ID NO: 8531514 - DNA, 22 bp, Homo sapiens
agaaatacaaagtactaagata

SEQ ID NO: 8531515 - DNA, 20 bp, Homo sapiens
agaaatacatgcatgcatga

SEQ ID NO: 8531516 - DNA, 22 bp, Homo sapiens
agaaataagagctttccttggg

SEQ ID NO: 8531517 - DNA, 22 bp, Homo sapiens
agaaataagagctttccttggg

SEQ ID NO: 8531518 - DNA, 22 bp, Homo sapiens
agaaataatcagcttaggggca

SEQ ID NO: 8531519 - DNA, 22 bp, Homo sapiens
agaaataagagctttccttggg

SEQ ID NO: 8531520 - DNA, 22 bp, Homo sapiens
agaaatactaggaatattcata

SEQ ID NO: 8531521 - DNA, 22 bp, Homo sapiens
agaaatactaggaatattcata

SEQ ID NO: 8531522 - DNA, 22 bp, Homo sapiens
agaaatactaggaatattcata

SEQ ID NO: 8531523 - DNA, 20 bp, Homo sapiens
agaaatacatgcatgcatga

SEQ ID NO: 8531524 - DNA, 22 bp, Homo sapiens
aatgaacaggtgaatgtcagat

SEQ ID NO: 8531525 - DNA, 22 bp, Homo sapiens
aatgaacagtgggtgaggtacc

SEQ ID NO: 8531526 - DNA, 22 bp, Homo sapiens
aatgaacagtgggtgaggtacc

SEQ ID NO: 8531527 - DNA, 22 bp, Homo sapiens
aatgaacatataaagagatctt

SEQ ID NO: 8531528 - DNA, 22 bp, Homo sapiens
aatgaacatataaagagatctt

SEQ ID NO: 8531529 - DNA, 22 bp, Homo sapiens
aatgaacaggtgaatgtcagat

SEQ ID NO: 8531530 - DNA, 22 bp, Homo sapiens
aatgaacatggacaagttaata

SEQ ID NO: 8531531 - DNA, 22 bp, Homo sapiens
aatgaacatcaaatgcctacca

SEQ ID NO: 8531532 - DNA, 22 bp, Homo sapiens
aatgaactccgaacatttacat

SEQ ID NO: 8531533 - DNA, 22 bp, Homo sapiens
aatgaacccttcaagctctgat

SEQ ID NO: 8531534 - DNA, 22 bp, Homo sapiens
aatgaacacagccctctacttt

SEQ ID NO: 8531535 - DNA, 22 bp, Homo sapiens
aatgaacacagccctctacttt

SEQ ID NO: 8531536 - DNA, 22 bp, Homo sapiens
aatgaacacagccctctacttt

SEQ ID NO: 8531537 - DNA, 22 bp, Homo sapiens
aatgaacacatgtggtcagttt

SEQ ID NO: 8531538 - DNA, 22 bp, Homo sapiens
aatgaacacttagcctttctat

SEQ ID NO: 8531539 - DNA, 22 bp, Homo sapiens
agaaaactctacatctgtatgt

SEQ ID NO: 8531540 - DNA, 22 bp, Homo sapiens
agaaaacattacataggtgtgt

SEQ ID NO: 8531541 - DNA, 22 bp, Homo sapiens
agaaaacattacataggtgtgt

SEQ ID NO: 8531542 - DNA, 22 bp, Homo sapiens
agaaaacattacataggtgtgt

SEQ ID NO: 8531543 - DNA, 22 bp, Homo sapiens
aatgaaactatatttagagagg

SEQ ID NO: 8531544 - DNA, 22 bp, Homo sapiens
agaaaactctacatctgtatgt

SEQ ID NO: 8531545 - DNA, 22 bp, Homo sapiens
agaaaactgcagagtagcctca

SEQ ID NO: 8531546 - DNA, 22 bp, Homo sapiens
agaaaacataggagacaggaaa

SEQ ID NO: 8531547 - DNA, 22 bp, Homo sapiens
agaaaacataggagacaggaaa

SEQ ID NO: 8531548 - DNA, 22 bp, Homo sapiens
agaaaacataggagacaggaaa

SEQ ID NO: 8531549 - DNA, 22 bp, Homo sapiens
agaaaacataggagacaggaaa

SEQ ID NO: 8531550 - DNA, 22 bp, Homo sapiens
agaaaacactgccccctctctc

SEQ ID NO: 8531551 - DNA, 22 bp, Homo sapiens
agaaaacactgccccctctctc

SEQ ID NO: 8531552 - DNA, 22 bp, Homo sapiens
aatcctggcatgtgccttggga

SEQ ID NO: 8531553 - DNA, 22 bp, Homo sapiens
aatcctggcatgtgccttggga

SEQ ID NO: 8531554 - DNA, 22 bp, Homo sapiens
aatcctggaatgagtttgctga

SEQ ID NO: 8531555 - DNA, 22 bp, Homo sapiens
agaaaaatcttggcgcttgtct

SEQ ID NO: 8531556 - DNA, 22 bp, Homo sapiens
agaaaaatcttggcgcttgtct

SEQ ID NO: 8531557 - DNA, 22 bp, Homo sapiens
agaaaaatcttggcgcttgtct

SEQ ID NO: 8531558 - DNA, 22 bp, Homo sapiens
atggcctgggcccgcttcagat

SEQ ID NO: 8531559 - DNA, 22 bp, Homo sapiens
atggcctgggcccgcttcagat

SEQ ID NO: 8531560 - DNA, 22 bp, Homo sapiens
atggcctggccagagctctgct

SEQ ID NO: 8531561 - DNA, 22 bp, Homo sapiens
atggcctggccagagctctgct

SEQ ID NO: 8531562 - DNA, 22 bp, Homo sapiens
agagacctttctcctgcctttc

SEQ ID NO: 8531563 - DNA, 22 bp, Homo sapiens
agagaccttcctgactccagag

SEQ ID NO: 8531564 - DNA, 22 bp, Homo sapiens
agagacctttgttattctagga

SEQ ID NO: 8531565 - DNA, 22 bp, Homo sapiens
agagacctttctcctgcctttc

SEQ ID NO: 8531566 - DNA, 22 bp, Homo sapiens
agagactgatggagctcactct

SEQ ID NO: 8531567 - DNA, 22 bp, Homo sapiens
agagagttgtaccacactcata

SEQ ID NO: 8531568 - DNA, 22 bp, Homo sapiens
atggctcagcccatggaagaaa

SEQ ID NO: 8531569 - DNA, 22 bp, Homo sapiens
atggctcagcgcctttctgtgg

SEQ ID NO: 8531570 - DNA, 22 bp, Homo sapiens
agagatgaagggcattccccag

SEQ ID NO: 8531571 - DNA, 22 bp, Homo sapiens
atggctagcaccgcgttgctgg

SEQ ID NO: 8531572 - DNA, 17 bp, Homo sapiens
atggctcacctgtgggc

SEQ ID NO: 8531573 - DNA, 17 bp, Homo sapiens
atggctcacctgtgggc

SEQ ID NO: 8531574 - DNA, 22 bp, Homo sapiens
atggccttggctgcagagacat

SEQ ID NO: 8531575 - DNA, 22 bp, Homo sapiens
atggcctttctcagtggtgctt

SEQ ID NO: 8531576 - DNA, 22 bp, Homo sapiens
atggctaaacctgaactggtct

SEQ ID NO: 8531577 - DNA, 22 bp, Homo sapiens
agagaccaagggaatagtctca

SEQ ID NO: 8531578 - DNA, 22 bp, Homo sapiens
agagaccaagggaatagtctca

SEQ ID NO: 8531579 - DNA, 22 bp, Homo sapiens
agagaccagaatccagctgcct

SEQ ID NO: 8531580 - DNA, 22 bp, Homo sapiens
agagacagggttttgtcgtgtt

SEQ ID NO: 8531581 - DNA, 22 bp, Homo sapiens
agagacagggttttgtcgtgtt

SEQ ID NO: 8531582 - DNA, 22 bp, Homo sapiens
agagacagggttttgtcgtgtt

SEQ ID NO: 8531583 - DNA, 22 bp, Homo sapiens
agagacatggagaggcaaagtt

SEQ ID NO: 8531584 - DNA, 22 bp, Homo sapiens
agagaaggaaagctgacatggg

SEQ ID NO: 8531585 - DNA, 21 bp, Homo sapiens
agagacagagaaagtaacatt

SEQ ID NO: 8531586 - DNA, 22 bp, Homo sapiens
agagaagctgacaggggcgtgc

SEQ ID NO: 8531587 - DNA, 22 bp, Homo sapiens
agagacagaggcaatatagctt

SEQ ID NO: 8531588 - DNA, 22 bp, Homo sapiens
agagaagcagggagtcatctgt

SEQ ID NO: 8531589 - DNA, 22 bp, Homo sapiens
agagaagcagggagtcatctgt

SEQ ID NO: 8531590 - DNA, 22 bp, Homo sapiens
agagaagcattcttctcagggc

SEQ ID NO: 8531591 - DNA, 22 bp, Homo sapiens
agagaagctgacaggggcgtgc

SEQ ID NO: 8531592 - DNA, 22 bp, Homo sapiens
agagaaggaaagctgacatggg

SEQ ID NO: 8531593 - DNA, 22 bp, Homo sapiens
agagaagagtcttgtcaaatta

SEQ ID NO: 8531594 - DNA, 22 bp, Homo sapiens
agagaagattcttatatgtctt

SEQ ID NO: 8531595 - DNA, 22 bp, Homo sapiens
agagaagattcttatatgtctt

SEQ ID NO: 8531596 - DNA, 22 bp, Homo sapiens
agaccactaaaactttctctat

SEQ ID NO: 8531597 - DNA, 22 bp, Homo sapiens
agaccacagtcaggctcctggt

SEQ ID NO: 8531598 - DNA, 22 bp, Homo sapiens
agaccaagactataatgagagg

SEQ ID NO: 8531599 - DNA, 22 bp, Homo sapiens
agacattttggaaagtattact

SEQ ID NO: 8531600 - DNA, 22 bp, Homo sapiens
agacattttgcaatgggtagct

SEQ ID NO: 8531601 - DNA, 22 bp, Homo sapiens
agacattttgatacccctaccg

SEQ ID NO: 8531602 - DNA, 22 bp, Homo sapiens
agacattttacattcttccatt

SEQ ID NO: 8531603 - DNA, 23 bp, Homo sapiens
agacattttaataaggacttttt

SEQ ID NO: 8531604 - DNA, 22 bp, Homo sapiens
agacattttagacataaaagat

SEQ ID NO: 8531605 - DNA, 22 bp, Homo sapiens
agacccacactttgagtagcaa

SEQ ID NO: 8531606 - DNA, 22 bp, Homo sapiens
agaccatgggctctgaagagca

SEQ ID NO: 8531607 - DNA, 22 bp, Homo sapiens
agacccagaaagcagctgcatt

SEQ ID NO: 8531608 - DNA, 22 bp, Homo sapiens
agacccagaaagcagctgcatt

SEQ ID NO: 8531609 - DNA, 22 bp, Homo sapiens
agacccagaaagcagctgcatt

SEQ ID NO: 8531610 - DNA, 22 bp, Homo sapiens
agaccatgacctgccactaagc

SEQ ID NO: 8531611 - DNA, 22 bp, Homo sapiens
agaccatggccatcctaggaaa

SEQ ID NO: 8531612 - DNA, 22 bp, Homo sapiens
agaccagggtcccacagagtct

SEQ ID NO: 8531613 - DNA, 22 bp, Homo sapiens
agaccagggtcccacagagtct

SEQ ID NO: 8531614 - DNA, 22 bp, Homo sapiens
agaccacttggataagaaacag

SEQ ID NO: 8531615 - DNA, 22 bp, Homo sapiens
agaccacttggataagaaacag

SEQ ID NO: 8531616 - DNA, 22 bp, Homo sapiens
agaccactggcctcctgcagac

SEQ ID NO: 8531617 - DNA, 22 bp, Homo sapiens
agaccagctgcctcccagggcc

SEQ ID NO: 8531618 - DNA, 23 bp, Homo sapiens
agacccagagactggctctgctc

SEQ ID NO: 8531619 - DNA, 23 bp, Homo sapiens
agacccagagactggctctgctc

SEQ ID NO: 8531620 - DNA, 22 bp, Homo sapiens
agacccagagggctgctgggag

SEQ ID NO: 8531621 - DNA, 22 bp, Homo sapiens
atggccagcaagttcagaattt

SEQ ID NO: 8531622 - DNA, 22 bp, Homo sapiens
atggcagcctgtggacagtcaa

SEQ ID NO: 8531623 - DNA, 22 bp, Homo sapiens
atggccagcccttcccgcagct

SEQ ID NO: 8531624 - DNA, 22 bp, Homo sapiens
atggccagccactcctgatggc

SEQ ID NO: 8531625 - DNA, 22 bp, Homo sapiens
atggccagctagcacttgcatt

SEQ ID NO: 8531626 - DNA, 22 bp, Homo sapiens
atggccagcctggtacttggca

SEQ ID NO: 8531627 - DNA, 21 bp, Homo sapiens
agagaagaggactttctcaca

SEQ ID NO: 8531628 - DNA, 22 bp, Homo sapiens
agagaagagcaatgataaattt

SEQ ID NO: 8531629 - DNA, 22 bp, Homo sapiens
agagaagagcaatgataaattt

SEQ ID NO: 8531630 - DNA, 22 bp, Homo sapiens
agagaagagcaatgataaattt

SEQ ID NO: 8531631 - DNA, 22 bp, Homo sapiens
atggccagtcaagcctctggct

SEQ ID NO: 8531632 - DNA, 22 bp, Homo sapiens
atggccagggtggcactgtggt

SEQ ID NO: 8531633 - DNA, 22 bp, Homo sapiens
atggccagggccaaaagagatg

SEQ ID NO: 8531634 - DNA, 22 bp, Homo sapiens
atggccagggtggcactgtggt

SEQ ID NO: 8531635 - DNA, 22 bp, Homo sapiens
atggccagcttataggggctca

SEQ ID NO: 8531636 - DNA, 22 bp, Homo sapiens
atggccaggcacctctggctga

SEQ ID NO: 8531637 - DNA, 22 bp, Homo sapiens
atggccagggccaaaagagatg

SEQ ID NO: 8531638 - DNA, 22 bp, Homo sapiens
atggggtgagactaggattaaa

SEQ ID NO: 8531639 - DNA, 22 bp, Homo sapiens
atggggtgagactaggattaaa

SEQ ID NO: 8531640 - DNA, 22 bp, Homo sapiens
atggggtgcatgcagattggga

SEQ ID NO: 8531641 - DNA, 20 bp, Homo sapiens
atggggtgagtgacgccctc

SEQ ID NO: 8531642 - DNA, 22 bp, Homo sapiens
atggggtgaccatgagcattta

SEQ ID NO: 8531643 - DNA, 22 bp, Homo sapiens
atgggggcctgaacaggcaaaa

SEQ ID NO: 8531644 - DNA, 22 bp, Homo sapiens
atggggctgttctctgccctgc

SEQ ID NO: 8531645 - DNA, 19 bp, Homo sapiens
agagatgctaagagtcttt

SEQ ID NO: 8531646 - DNA, 22 bp, Homo sapiens
agagatggatgttattatgggt

SEQ ID NO: 8531647 - DNA, 22 bp, Homo sapiens
agagatggatgttattatgggt

SEQ ID NO: 8531648 - DNA, 22 bp, Homo sapiens
agagatggagagcactggggct

SEQ ID NO: 8531649 - DNA, 22 bp, Homo sapiens
agagatgactgatggctgatta

SEQ ID NO: 8531650 - DNA, 22 bp, Homo sapiens
agagatgagaacatgcttggat

SEQ ID NO: 8531651 - DNA, 22 bp, Homo sapiens
agagatgcagggtacatggaat

SEQ ID NO: 8531652 - DNA, 22 bp, Homo sapiens
agagccagagacctgggttcac

SEQ ID NO: 8531653 - DNA, 22 bp, Homo sapiens
agagccagagacctgggttcac

SEQ ID NO: 8531654 - DNA, 22 bp, Homo sapiens
agagccagagacctgggttcac

SEQ ID NO: 8531655 - DNA, 22 bp, Homo sapiens
agagccagatggagccgtgtgt

SEQ ID NO: 8531656 - DNA, 22 bp, Homo sapiens
agagccagatggagccgtgtgt

SEQ ID NO: 8531657 - DNA, 22 bp, Homo sapiens
agagccagagacctgggttcac

SEQ ID NO: 8531658 - DNA, 22 bp, Homo sapiens
agagccagaccattgccgtgca

SEQ ID NO: 8531659 - DNA, 22 bp, Homo sapiens
agagccagaccattgccgtgca

SEQ ID NO: 8531660 - DNA, 22 bp, Homo sapiens
agagccagaccattgccgtgca

SEQ ID NO: 8531661 - DNA, 22 bp, Homo sapiens
agagccactgggagacagagca

SEQ ID NO: 8531662 - DNA, 22 bp, Homo sapiens
agagccactgggagacagagca

SEQ ID NO: 8531663 - DNA, 22 bp, Homo sapiens
agagccactgggagacagagca

SEQ ID NO: 8531664 - DNA, 22 bp, Homo sapiens
agagccacagtggataggagcc

SEQ ID NO: 8531665 - DNA, 22 bp, Homo sapiens
agagccacagtggataggagcc

SEQ ID NO: 8531666 - DNA, 22 bp, Homo sapiens
agagcagtgctgaagagtaggg

SEQ ID NO: 8531667 - DNA, 22 bp, Homo sapiens
agagcagcctgtgatgatgcac

SEQ ID NO: 8531668 - DNA, 22 bp, Homo sapiens
agagcatccatttttgtcacat

SEQ ID NO: 8531669 - DNA, 22 bp, Homo sapiens
agagcatccatttttgtcacat

SEQ ID NO: 8531670 - DNA, 22 bp, Homo sapiens
atgggtggaggagaaaggcatc

SEQ ID NO: 8531671 - DNA, 22 bp, Homo sapiens
atgggtggaggagaaaggcatc

SEQ ID NO: 8531672 - DNA, 22 bp, Homo sapiens
atgggtggagggtgacacggat

SEQ ID NO: 8531673 - DNA, 22 bp, Homo sapiens
atgggtggagggtgacacggat

SEQ ID NO: 8531674 - DNA, 22 bp, Homo sapiens
atggggtggagtccgggcagcg

SEQ ID NO: 8531675 - DNA, 22 bp, Homo sapiens
atggggtggagtccgggcagcg

SEQ ID NO: 8531676 - DNA, 22 bp, Homo sapiens
atggggtggagtccgggcagcg

SEQ ID NO: 8531677 - DNA, 22 bp, Homo sapiens
atgggtaaggctgaaggaaagt

SEQ ID NO: 8531678 - DNA, 22 bp, Homo sapiens
atgggtaaagcaggaagagagt

SEQ ID NO: 8531679 - DNA, 22 bp, Homo sapiens
atgggtaggatttactcagatg

SEQ ID NO: 8531680 - DNA, 22 bp, Homo sapiens
atgggtaagggtgtttggttag

SEQ ID NO: 8531681 - DNA, 22 bp, Homo sapiens
atgggtagactgacaaagtcaa

SEQ ID NO: 8531682 - DNA, 22 bp, Homo sapiens
atgtatttgcgtatggacatac

SEQ ID NO: 8531683 - DNA, 22 bp, Homo sapiens
atgtatttgcgtatggacatac

SEQ ID NO: 8531684 - DNA, 22 bp, Homo sapiens
atgtatttgcgtatggacatac

SEQ ID NO: 8531685 - DNA, 22 bp, Homo sapiens
atgtatttgcttgttatggatt

SEQ ID NO: 8531686 - DNA, 22 bp, Homo sapiens
atgtatttgcgaggttaggaaa

SEQ ID NO: 8531687 - DNA, 22 bp, Homo sapiens
atgtatttgaaatttgagacat

SEQ ID NO: 8531688 - DNA, 22 bp, Homo sapiens
agagccagcaagtgaatagtga

SEQ ID NO: 8531689 - DNA, 22 bp, Homo sapiens
agagccagcaagtgaatagtga

SEQ ID NO: 8531690 - DNA, 22 bp, Homo sapiens
agagccagcaactctagccctg

SEQ ID NO: 8531691 - DNA, 22 bp, Homo sapiens
agagccagcaactctagccctg

SEQ ID NO: 8531692 - DNA, 22 bp, Homo sapiens
agagccagcaactctagccctg

SEQ ID NO: 8531693 - DNA, 22 bp, Homo sapiens
agagccagcaactctagccctg

SEQ ID NO: 8531694 - DNA, 22 bp, Homo sapiens
atgtcaaatcagttttatcaga

SEQ ID NO: 8531695 - DNA, 22 bp, Homo sapiens
atgtattttgccagactgtctc

SEQ ID NO: 8531696 - DNA, 22 bp, Homo sapiens
atgtcaaacacaacaccagtgg

SEQ ID NO: 8531697 - DNA, 22 bp, Homo sapiens
atgtattttaagatttgcctca

SEQ ID NO: 8531698 - DNA, 22 bp, Homo sapiens
agagcctgggaatttgcatgtt

SEQ ID NO: 8531699 - DNA, 22 bp, Homo sapiens
agagcctgggaatttgcatgtt

SEQ ID NO: 8531700 - DNA, 22 bp, Homo sapiens
agagcctggggattggcaaggg

SEQ ID NO: 8531701 - DNA, 22 bp, Homo sapiens
agagcctggggattggcaaggg

SEQ ID NO: 8531702 - DNA, 22 bp, Homo sapiens
agagcctgggcagctcctctgg

SEQ ID NO: 8531703 - DNA, 22 bp, Homo sapiens
agagcctgggcagctcctctgg

SEQ ID NO: 8531704 - DNA, 22 bp, Homo sapiens
agagcctgggcagctcctctgg

SEQ ID NO: 8531705 - DNA, 22 bp, Homo sapiens
atgtggggacaaaatgatggcc

SEQ ID NO: 8531706 - DNA, 20 bp, Homo sapiens
atgtggctttttgacctgct

SEQ ID NO: 8531707 - DNA, 22 bp, Homo sapiens
atgtggcttttctaacccttcc

SEQ ID NO: 8531708 - DNA, 22 bp, Homo sapiens
atgtgggccgtgcgggtgtcct

SEQ ID NO: 8531709 - DNA, 22 bp, Homo sapiens
atgtgggccgtgcgggtgtcct

SEQ ID NO: 8531710 - DNA, 22 bp, Homo sapiens
atgtgggagatttcaggaggtg

SEQ ID NO: 8531711 - DNA, 22 bp, Homo sapiens
atgtgtaaaaagtgcttaatat

SEQ ID NO: 8531712 - DNA, 22 bp, Homo sapiens
atgtgtaaaaggcatgttttat

SEQ ID NO: 8531713 - DNA, 22 bp, Homo sapiens
atgtggttgaagaattacatct

SEQ ID NO: 8531714 - DNA, 22 bp, Homo sapiens
atgtgtacaaccaagcactaaa

SEQ ID NO: 8531715 - DNA, 22 bp, Homo sapiens
atgtgtaatgtggtattttaat

SEQ ID NO: 8531716 - DNA, 22 bp, Homo sapiens
atgtgtacaaccaagcactaaa

SEQ ID NO: 8531717 - DNA, 22 bp, Homo sapiens
atgtgtaaagttagatgtctga

SEQ ID NO: 8531718 - DNA, 22 bp, Homo sapiens
atgtgtaaagttagatgtctga

SEQ ID NO: 8531719 - DNA, 22 bp, Homo sapiens
agagcctgtaacatctttctta

SEQ ID NO: 8531720 - DNA, 22 bp, Homo sapiens
agagcctgtaacatctttctta

SEQ ID NO: 8531721 - DNA, 22 bp, Homo sapiens
agagcctggtctgagataggac

SEQ ID NO: 8531722 - DNA, 22 bp, Homo sapiens
agagcctggttcaaattttacc

SEQ ID NO: 8531723 - DNA, 22 bp, Homo sapiens
agagcctggggattggcaaggg

SEQ ID NO: 8531724 - DNA, 22 bp, Homo sapiens
agagcctgtacttttctgtgaa

SEQ ID NO: 8531725 - DNA, 22 bp, Homo sapiens
agagcctgtacttttctgtgaa

SEQ ID NO: 8531726 - DNA, 22 bp, Homo sapiens
agagcctgtcaattgtaaagag

SEQ ID NO: 8531727 - DNA, 22 bp, Homo sapiens
agagcctgtcaattgtaaagag

SEQ ID NO: 8531728 - DNA, 22 bp, Homo sapiens
agagcctgtctgcctttctacc

SEQ ID NO: 8531729 - DNA, 22 bp, Homo sapiens
agagcctgtctgcctttctacc

SEQ ID NO: 8531730 - DNA, 22 bp, Homo sapiens
agagcctgtctgcctttctacc

SEQ ID NO: 8531731 - DNA, 22 bp, Homo sapiens
agagcctgtgattgtcatcacc

SEQ ID NO: 8531732 - DNA, 22 bp, Homo sapiens
agagcctgtgattgtcatcacc

SEQ ID NO: 8531733 - DNA, 22 bp, Homo sapiens
agagcctgtgattgtcatcacc

SEQ ID NO: 8531734 - DNA, 22 bp, Homo sapiens
agagcctgtgattgtcatcacc

SEQ ID NO: 8531735 - DNA, 22 bp, Homo sapiens
agagcctgtgattgtcatcacc

SEQ ID NO: 8531736 - DNA, 22 bp, Homo sapiens
agagcctgtgggagatgcagct

SEQ ID NO: 8531737 - DNA, 22 bp, Homo sapiens
atgaaactgggataactatagc

SEQ ID NO: 8531738 - DNA, 22 bp, Homo sapiens
atgaaactgggataactatagc

SEQ ID NO: 8531739 - DNA, 22 bp, Homo sapiens
atgaaagatgatttaaagtact

SEQ ID NO: 8531740 - DNA, 22 bp, Homo sapiens
atgaaactgggataactatagc

SEQ ID NO: 8531741 - DNA, 22 bp, Homo sapiens
atgaaagatgatttaaagtact

SEQ ID NO: 8531742 - DNA, 22 bp, Homo sapiens
atgaaagcacgtgggaagataa

SEQ ID NO: 8531743 - DNA, 22 bp, Homo sapiens
atgaaagcaaattataggccat

SEQ ID NO: 8531744 - DNA, 22 bp, Homo sapiens
atgaaagatgatttaaagtact

SEQ ID NO: 8531745 - DNA, 22 bp, Homo sapiens
atgaaagtacctgtaatatgtt

SEQ ID NO: 8531746 - DNA, 22 bp, Homo sapiens
atgaaagtggcttgattaaatg

SEQ ID NO: 8531747 - DNA, 22 bp, Homo sapiens
atgaaagtgaaggtttactaag

SEQ ID NO: 8531748 - DNA, 22 bp, Homo sapiens
atgaaagtgtttaagtttatgt

SEQ ID NO: 8531749 - DNA, 23 bp, Homo sapiens
atgaaagttcttaaaatgtcatg

SEQ ID NO: 8531750 - DNA, 22 bp, Homo sapiens
atgaaattgatcttgaactttt

SEQ ID NO: 8531751 - DNA, 22 bp, Homo sapiens
atgaaatttgaccaattattta

SEQ ID NO: 8531752 - DNA, 22 bp, Homo sapiens
atgaacaataaaatagatcaca

SEQ ID NO: 8531753 - DNA, 22 bp, Homo sapiens
atgaacaagtatttgcatgagc

SEQ ID NO: 8531754 - DNA, 22 bp, Homo sapiens
atgaacaagagagggaagattc

SEQ ID NO: 8531755 - DNA, 22 bp, Homo sapiens
atgaaattttaattatacctct

SEQ ID NO: 8531756 - DNA, 22 bp, Homo sapiens
atgaaattttaattatacctct

SEQ ID NO: 8531757 - DNA, 22 bp, Homo sapiens
atgaacaaaaacaaggcctgtt

SEQ ID NO: 8531758 - DNA, 22 bp, Homo sapiens
atgaaatttgctgctaagttcc

SEQ ID NO: 8531759 - DNA, 22 bp, Homo sapiens
agacaaatgaacaaatatgtga

SEQ ID NO: 8531760 - DNA, 22 bp, Homo sapiens
agacaaataactttttatgtcc

SEQ ID NO: 8531761 - DNA, 22 bp, Homo sapiens
agacaaagacagcatctcaggt

SEQ ID NO: 8531762 - DNA, 22 bp, Homo sapiens
agacaaaggattaatgatgatg

SEQ ID NO: 8531763 - DNA, 22 bp, Homo sapiens
agacaaaggattaatgatgatg

SEQ ID NO: 8531764 - DNA, 22 bp, Homo sapiens
agacaaaggattaatgatgatg

SEQ ID NO: 8531765 - DNA, 22 bp, Homo sapiens
agacaaatggtaattatgtcta

SEQ ID NO: 8531766 - DNA, 22 bp, Homo sapiens
agacaaattgggacattgtgtt

SEQ ID NO: 8531767 - DNA, 22 bp, Homo sapiens
agacaaatggagtatgagcaac

SEQ ID NO: 8531768 - DNA, 18 bp, Homo sapiens
agacaaacttcttctgcc

SEQ ID NO: 8531769 - DNA, 22 bp, Homo sapiens
agacaaagacagcatctcaggt

SEQ ID NO: 8531770 - DNA, 22 bp, Homo sapiens
agacaaagacagcatctcaggt

SEQ ID NO: 8531771 - DNA, 22 bp, Homo sapiens
agacaaagaaaccgtagaagca

SEQ ID NO: 8531772 - DNA, 22 bp, Homo sapiens
agacaaagaaaccgtagaagca

SEQ ID NO: 8531773 - DNA, 22 bp, Homo sapiens
atgaacaataatcatgtctatg

SEQ ID NO: 8531774 - DNA, 22 bp, Homo sapiens
atgaacaatctgttgacttctg

SEQ ID NO: 8531775 - DNA, 22 bp, Homo sapiens
agaattcttggtggttagaata

SEQ ID NO: 8531776 - DNA, 18 bp, Homo sapiens
agaattgctgcttcttct

SEQ ID NO: 8531777 - DNA, 22 bp, Homo sapiens
atgaacaatgactacatattga

SEQ ID NO: 8531778 - DNA, 21 bp, Homo sapiens
agaagtcaattgaactgaaat

SEQ ID NO: 8531779 - DNA, 21 bp, Homo sapiens
agaagtcaattgaactgaaat

SEQ ID NO: 8531780 - DNA, 22 bp, Homo sapiens
agaagtgccatactgtggtcca

SEQ ID NO: 8531781 - DNA, 22 bp, Homo sapiens
agaagtgagactcagttgatga

SEQ ID NO: 8531782 - DNA, 22 bp, Homo sapiens
agaagtgaggaaatcctcttta

SEQ ID NO: 8531783 - DNA, 22 bp, Homo sapiens
agaagtgagtgtgactcagcag

SEQ ID NO: 8531784 - DNA, 22 bp, Homo sapiens
agaagtcaagtggtctatgaaa

SEQ ID NO: 8531785 - DNA, 22 bp, Homo sapiens
agaagtcaatgatgagagtgct

SEQ ID NO: 8531786 - DNA, 22 bp, Homo sapiens
agaagtcaagtggtctatgaaa

SEQ ID NO: 8531787 - DNA, 22 bp, Homo sapiens
agaagtcaatagttgtttgatg

SEQ ID NO: 8531788 - DNA, 22 bp, Homo sapiens
agaaggcttaaaacatggaata

SEQ ID NO: 8531789 - DNA, 22 bp, Homo sapiens
agaaggctggccctgggtggcc

SEQ ID NO: 8531790 - DNA, 22 bp, Homo sapiens
atctcagaaacatatctaatcc

SEQ ID NO: 8531791 - DNA, 22 bp, Homo sapiens
atctcagaaacatatctaatcc

SEQ ID NO: 8531792 - DNA, 22 bp, Homo sapiens
atctcagagaaatttgaatgca

SEQ ID NO: 8531793 - DNA, 22 bp, Homo sapiens
atctcagatctacagatctaca

SEQ ID NO: 8531794 - DNA, 22 bp, Homo sapiens
atctcaggaggaccctgatgct

SEQ ID NO: 8531795 - DNA, 22 bp, Homo sapiens
atgaaactgaaggacaaccaga

SEQ ID NO: 8531796 - DNA, 22 bp, Homo sapiens
atgaaactgaaggacaaccaga

SEQ ID NO: 8531797 - DNA, 22 bp, Homo sapiens
atgaaactctaacttaacaagt

SEQ ID NO: 8531798 - DNA, 22 bp, Homo sapiens
atgaaactctaacttaacaagt

SEQ ID NO: 8531799 - DNA, 22 bp, Homo sapiens
atgaaactctaacttaacaagt

SEQ ID NO: 8531800 - DNA, 22 bp, Homo sapiens
atgaaactaaactacataagtt

SEQ ID NO: 8531801 - DNA, 22 bp, Homo sapiens
atgaaactaaactacataagtt

SEQ ID NO: 8531802 - DNA, 22 bp, Homo sapiens
atctttgttgctctcatttctg

SEQ ID NO: 8531803 - DNA, 22 bp, Homo sapiens
agaagtttggtcctataaactc

SEQ ID NO: 8531804 - DNA, 22 bp, Homo sapiens
agaagtttggtcctataaactc

SEQ ID NO: 8531805 - DNA, 20 bp, Homo sapiens
agaagtttgggggtgtggag

SEQ ID NO: 8531806 - DNA, 19 bp, Homo sapiens
agaagttagacattgcaat

SEQ ID NO: 8531807 - DNA, 22 bp, Homo sapiens
agaagttatccaccttagatgc

SEQ ID NO: 8531808 - DNA, 23 bp, Homo sapiens
agaagttcaagaccagcctgccc

SEQ ID NO: 8531809 - DNA, 22 bp, Homo sapiens
agaagtttcacaatgggtttta

SEQ ID NO: 8531810 - DNA, 22 bp, Homo sapiens
agaagtggtctgtcttccagat

SEQ ID NO: 8531811 - DNA, 22 bp, Homo sapiens
agaagtggtgtgtggccgagct

SEQ ID NO: 8531812 - DNA, 22 bp, Homo sapiens
agaagtggtgtgtggccgagct

SEQ ID NO: 8531813 - DNA, 22 bp, Homo sapiens
agaagttaccacatacttctct

SEQ ID NO: 8531814 - DNA, 22 bp, Homo sapiens
agacagctctgggttccacact

SEQ ID NO: 8531815 - DNA, 22 bp, Homo sapiens
agacagctaataaatgagtgtg

SEQ ID NO: 8531816 - DNA, 22 bp, Homo sapiens
agacagcatggagctgataaca

SEQ ID NO: 8531817 - DNA, 22 bp, Homo sapiens
agacagcatttcccggaaccgc

SEQ ID NO: 8531818 - DNA, 22 bp, Homo sapiens
agacagcatttctagcaccagg

SEQ ID NO: 8531819 - DNA, 22 bp, Homo sapiens
agacagcatgatacatgatgct

SEQ ID NO: 8531820 - DNA, 22 bp, Homo sapiens
agacagcatgatacatgatgct

SEQ ID NO: 8531821 - DNA, 22 bp, Homo sapiens
agacagcatgatacatgatgct

SEQ ID NO: 8531822 - DNA, 22 bp, Homo sapiens
agacagcatggagctgataaca

SEQ ID NO: 8531823 - DNA, 22 bp, Homo sapiens
agacagcatggagctgataaca

SEQ ID NO: 8531824 - DNA, 22 bp, Homo sapiens
agacagcatgatacatgatgct

SEQ ID NO: 8531825 - DNA, 22 bp, Homo sapiens
agacagcatgagcctgctgatg

SEQ ID NO: 8531826 - DNA, 22 bp, Homo sapiens
agacagcatgagcctgctgatg

SEQ ID NO: 8531827 - DNA, 22 bp, Homo sapiens
agacagcagggagcaggattca

SEQ ID NO: 8531828 - DNA, 22 bp, Homo sapiens
agacagcaggggagtctggttt

SEQ ID NO: 8531829 - DNA, 22 bp, Homo sapiens
agacagcaggggagtctggttt

SEQ ID NO: 8531830 - DNA, 21 bp, Homo sapiens
agacagcagtctccaaacccc

SEQ ID NO: 8531831 - DNA, 22 bp, Homo sapiens
agacagactggtttgaattggt

SEQ ID NO: 8531832 - DNA, 22 bp, Homo sapiens
agacagactggtttgaattggt

SEQ ID NO: 8531833 - DNA, 22 bp, Homo sapiens
agacagacttgaaaatgttctt

SEQ ID NO: 8531834 - DNA, 22 bp, Homo sapiens
agacagcagcagaggggctccc

SEQ ID NO: 8531835 - DNA, 22 bp, Homo sapiens
agacagctgttccttcatgttt

SEQ ID NO: 8531836 - DNA, 22 bp, Homo sapiens
agacaggacacaagctgcataa

SEQ ID NO: 8531837 - DNA, 22 bp, Homo sapiens
agacaggacacaagctgcataa

SEQ ID NO: 8531838 - DNA, 22 bp, Homo sapiens
agacaggacacaagctgcataa

SEQ ID NO: 8531839 - DNA, 22 bp, Homo sapiens
agacaggacacaagctgcataa

SEQ ID NO: 8531840 - DNA, 22 bp, Homo sapiens
agacagctgctcgcagagctat

SEQ ID NO: 8531841 - DNA, 22 bp, Homo sapiens
agacaggatgcatactcttggt

SEQ ID NO: 8531842 - DNA, 22 bp, Homo sapiens
agacaggagagggaactgccgg

SEQ ID NO: 8531843 - DNA, 20 bp, Homo sapiens
agacaggagcccccattcag

SEQ ID NO: 8531844 - DNA, 22 bp, Homo sapiens
agacaggagagggaactgccgg

SEQ ID NO: 8531845 - DNA, 22 bp, Homo sapiens
agacaggagagggaactgccgg

SEQ ID NO: 8531846 - DNA, 22 bp, Homo sapiens
agacaggagagggaactgccgg

SEQ ID NO: 8531847 - DNA, 22 bp, Homo sapiens
agacaggacacaagctgcataa

SEQ ID NO: 8531848 - DNA, 22 bp, Homo sapiens
agacatatattgcaattcactg

SEQ ID NO: 8531849 - DNA, 22 bp, Homo sapiens
agacatttcctagacatcaatg

SEQ ID NO: 8531850 - DNA, 22 bp, Homo sapiens
agacatttattcacacatttat

SEQ ID NO: 8531851 - DNA, 22 bp, Homo sapiens
agacatttggaagatacacata

SEQ ID NO: 8531852 - DNA, 22 bp, Homo sapiens
agacatttggaagatacacata

SEQ ID NO: 8531853 - DNA, 22 bp, Homo sapiens
agacatttggagccaactttcc

SEQ ID NO: 8531854 - DNA, 22 bp, Homo sapiens
agacattttaacatctgggttt

SEQ ID NO: 8531855 - DNA, 21 bp, Homo sapiens
agacagactgcctgacccacg

SEQ ID NO: 8531856 - DNA, 22 bp, Homo sapiens
agacagacgtagtgtgagagta

SEQ ID NO: 8531857 - DNA, 22 bp, Homo sapiens
agacagacgtagtgtgagagta

SEQ ID NO: 8531858 - DNA, 17 bp, Homo sapiens
agacagacctctgcatc

SEQ ID NO: 8531859 - DNA, 17 bp, Homo sapiens
agacagacctctgcatc

SEQ ID NO: 8531860 - DNA, 17 bp, Homo sapiens
agacagacctctgcatc

SEQ ID NO: 8531861 - DNA, 22 bp, Homo sapiens
atgcactgttggatatatttgt

SEQ ID NO: 8531862 - DNA, 22 bp, Homo sapiens
atgcacttaaataacataactt

SEQ ID NO: 8531863 - DNA, 22 bp, Homo sapiens
agacagaccatggctattcaga

SEQ ID NO: 8531864 - DNA, 22 bp, Homo sapiens
agacagaccatggctattcaga

SEQ ID NO: 8531865 - DNA, 22 bp, Homo sapiens
agacagacattctagagccacc

SEQ ID NO: 8531866 - DNA, 22 bp, Homo sapiens
atgcacccagtgtctggactat

SEQ ID NO: 8531867 - DNA, 22 bp, Homo sapiens
atgcacatgtatgtcaatattt

SEQ ID NO: 8531868 - DNA, 22 bp, Homo sapiens
atgcacatgtggctttatgtat

SEQ ID NO: 8531869 - DNA, 22 bp, Homo sapiens
atgcacattgtagccacacaat

SEQ ID NO: 8531870 - DNA, 17 bp, Homo sapiens
atgcacatgtaagagga

SEQ ID NO: 8531871 - DNA, 22 bp, Homo sapiens
atgcacatgaggcaagcaaaat

SEQ ID NO: 8531872 - DNA, 22 bp, Homo sapiens
atgcacctgaactccatcagct

SEQ ID NO: 8531873 - DNA, 22 bp, Homo sapiens
atgcacctgaactccatcagct

SEQ ID NO: 8531874 - DNA, 22 bp, Homo sapiens
atgcacgccccacactggtgtg

SEQ ID NO: 8531875 - DNA, 22 bp, Homo sapiens
atgcactacttggctttactga

SEQ ID NO: 8531876 - DNA, 22 bp, Homo sapiens
atgcactatgatgagctagtct

SEQ ID NO: 8531877 - DNA, 22 bp, Homo sapiens
atgcactgggtgaggaaggaga

SEQ ID NO: 8531878 - DNA, 23 bp, Homo sapiens
atgcaacattgccagtatgggca

SEQ ID NO: 8531879 - DNA, 23 bp, Homo sapiens
atgcaacattgccagtatgggca

SEQ ID NO: 8531880 - DNA, 22 bp, Homo sapiens
atgcacatacatatgctctata

SEQ ID NO: 8531881 - DNA, 19 bp, Homo sapiens
atgcacagtcatttgtaag

SEQ ID NO: 8531882 - DNA, 19 bp, Homo sapiens
atgcacagtcatttgtaag

SEQ ID NO: 8531883 - DNA, 22 bp, Homo sapiens
atgcacatcttacagatgcaga

SEQ ID NO: 8531884 - DNA, 22 bp, Homo sapiens
atgcacatcttacagatgcaga

SEQ ID NO: 8531885 - DNA, 22 bp, Homo sapiens
atgcaacatacattctgaagct

SEQ ID NO: 8531886 - DNA, 22 bp, Homo sapiens
atgcaacatacattctgaagct

SEQ ID NO: 8531887 - DNA, 22 bp, Homo sapiens
atgcaacatccaattccttttg

SEQ ID NO: 8531888 - DNA, 22 bp, Homo sapiens
atgcaacatccaattccttttg

SEQ ID NO: 8531889 - DNA, 22 bp, Homo sapiens
atgacaagggagggtcctgcta

SEQ ID NO: 8531890 - DNA, 22 bp, Homo sapiens
atgacaagagtgttcagggaga

SEQ ID NO: 8531891 - DNA, 22 bp, Homo sapiens
atgacaaattcagaccatagca

SEQ ID NO: 8531892 - DNA, 22 bp, Homo sapiens
atgacaacctgtgagctggtat

SEQ ID NO: 8531893 - DNA, 22 bp, Homo sapiens
atgacaaaggctgaaagggaaa

SEQ ID NO: 8531894 - DNA, 22 bp, Homo sapiens
atgacaaacccaggatgtaaca

SEQ ID NO: 8531895 - DNA, 23 bp, Homo sapiens
atgacaaacaggacatcttgtgc

SEQ ID NO: 8531896 - DNA, 23 bp, Homo sapiens
atgacaaacaggacatcttgtgc

SEQ ID NO: 8531897 - DNA, 22 bp, Homo sapiens
atgacaaaattcacaggtgtga

SEQ ID NO: 8531898 - DNA, 23 bp, Homo sapiens
atgacaaacaggacatcttgtgc

SEQ ID NO: 8531899 - DNA, 22 bp, Homo sapiens
atgacaaaatgaatgcagctag

SEQ ID NO: 8531900 - DNA, 22 bp, Homo sapiens
atgacaaaataaatggtctctg

SEQ ID NO: 8531901 - DNA, 22 bp, Homo sapiens
atgacaaaagaagacatgaggt

SEQ ID NO: 8531902 - DNA, 22 bp, Homo sapiens
atgacaaaagaagacatgaggt

SEQ ID NO: 8531903 - DNA, 22 bp, Homo sapiens
agaggaagctgagatgcctctt

SEQ ID NO: 8531904 - DNA, 22 bp, Homo sapiens
agaggaagctgagatgcctctt

SEQ ID NO: 8531905 - DNA, 22 bp, Homo sapiens
agaggaagctgagatgcctctt

SEQ ID NO: 8531906 - DNA, 22 bp, Homo sapiens
agaggacaaaatgagaagtgct

SEQ ID NO: 8531907 - DNA, 22 bp, Homo sapiens
agaggaagccattgcttactga

SEQ ID NO: 8531908 - DNA, 22 bp, Homo sapiens
atgtttatgttgggctatattt

SEQ ID NO: 8531909 - DNA, 22 bp, Homo sapiens
atgtttatggagcaggtattag

SEQ ID NO: 8531910 - DNA, 22 bp, Homo sapiens
atgtttatggagcaggtattag

SEQ ID NO: 8531911 - DNA, 22 bp, Homo sapiens
agaggacagacggaaagtgcca

SEQ ID NO: 8531912 - DNA, 22 bp, Homo sapiens
agaggacagacggaaagtgcca

SEQ ID NO: 8531913 - DNA, 22 bp, Homo sapiens
agaggacagacggaaagtgcca

SEQ ID NO: 8531914 - DNA, 22 bp, Homo sapiens
agaggacacatctttcctcaaa

SEQ ID NO: 8531915 - DNA, 22 bp, Homo sapiens
agaggacaaaatgagaagtgct

SEQ ID NO: 8531916 - DNA, 22 bp, Homo sapiens
agaggacagagtgctggattta

SEQ ID NO: 8531917 - DNA, 22 bp, Homo sapiens
agaggacagacggaaagtgcca

SEQ ID NO: 8531918 - DNA, 22 bp, Homo sapiens
agaggacagagtgctggattta

SEQ ID NO: 8531919 - DNA, 22 bp, Homo sapiens
agaggacaggttttccatgggc

SEQ ID NO: 8531920 - DNA, 21 bp, Homo sapiens
atgtttacactgactactgtg

SEQ ID NO: 8531921 - DNA, 19 bp, Homo sapiens
atgtttacactcaggggct

SEQ ID NO: 8531922 - DNA, 22 bp, Homo sapiens
atgtttactgaaaagatttcaa

SEQ ID NO: 8531923 - DNA, 22 bp, Homo sapiens
atgtttacagaggaagtgcctc

SEQ ID NO: 8531924 - DNA, 22 bp, Homo sapiens
atgtttacaattcagtattaca

SEQ ID NO: 8531925 - DNA, 22 bp, Homo sapiens
atgtttacaattcagtattaca

SEQ ID NO: 8531926 - DNA, 22 bp, Homo sapiens
atgtttacaattcagtattaca

SEQ ID NO: 8531927 - DNA, 22 bp, Homo sapiens
agagctgtttgtctagagagtg

SEQ ID NO: 8531928 - DNA, 22 bp, Homo sapiens
atgtttacaaaaaggaggcttg

SEQ ID NO: 8531929 - DNA, 22 bp, Homo sapiens
agagctgtttggacatctgagt

SEQ ID NO: 8531930 - DNA, 22 bp, Homo sapiens
agagctgtttggacatctgagt

SEQ ID NO: 8531931 - DNA, 22 bp, Homo sapiens
atgtttatgcaaacatgtgagt

SEQ ID NO: 8531932 - DNA, 22 bp, Homo sapiens
atgtttatgcaaacatgtgagt

SEQ ID NO: 8531933 - DNA, 22 bp, Homo sapiens
atgtttactggtttatagaata

SEQ ID NO: 8531934 - DNA, 22 bp, Homo sapiens
atgtttactggtttatagaata

SEQ ID NO: 8531935 - DNA, 22 bp, Homo sapiens
atgtttatgacctccataagga

SEQ ID NO: 8531936 - DNA, 22 bp, Homo sapiens
atgtttatgacctccataagga

SEQ ID NO: 8531937 - DNA, 22 bp, Homo sapiens
agagctgtgttaagaacaggcc

SEQ ID NO: 8531938 - DNA, 22 bp, Homo sapiens
agagctgtgtcctgtgcactag

SEQ ID NO: 8531939 - DNA, 22 bp, Homo sapiens
agagctgtgtcctgtgcactag

SEQ ID NO: 8531940 - DNA, 22 bp, Homo sapiens
agagctgttcaacgtagcaatg

SEQ ID NO: 8531941 - DNA, 22 bp, Homo sapiens
agagctgttaattttgcactgg

SEQ ID NO: 8531942 - DNA, 22 bp, Homo sapiens
agagctgttaattttgcactgg

SEQ ID NO: 8531943 - DNA, 22 bp, Homo sapiens
agagctgtgtttagtagttacg

SEQ ID NO: 8531944 - DNA, 22 bp, Homo sapiens
agagctgttaattttgcactgg

SEQ ID NO: 8531945 - DNA, 22 bp, Homo sapiens
agagctgtttggacatctgagt

SEQ ID NO: 8531946 - DNA, 22 bp, Homo sapiens
agagctgtttattgatgtcaca

SEQ ID NO: 8531947 - DNA, 22 bp, Homo sapiens
agagctgtttattgatgtcaca

SEQ ID NO: 8531948 - DNA, 22 bp, Homo sapiens
agagctgttcagcagccaggtt

SEQ ID NO: 8531949 - DNA, 22 bp, Homo sapiens
agagctgttcagcagccaggtt

SEQ ID NO: 8531950 - DNA, 22 bp, Homo sapiens
agagctgttcaacgtagcaatg

SEQ ID NO: 8531951 - DNA, 22 bp, Homo sapiens
agagctgtatccccttaccagt

SEQ ID NO: 8531952 - DNA, 22 bp, Homo sapiens
agagctgtcacatagagccaga

SEQ ID NO: 8531953 - DNA, 22 bp, Homo sapiens
agagctgtagcttcctagagcc

SEQ ID NO: 8531954 - DNA, 22 bp, Homo sapiens
agagctgtagcttcctagagcc

SEQ ID NO: 8531955 - DNA, 22 bp, Homo sapiens
agagctgtagcttcctagagcc

SEQ ID NO: 8531956 - DNA, 22 bp, Homo sapiens
agagctgtatccccttaccagt

SEQ ID NO: 8531957 - DNA, 22 bp, Homo sapiens
agagctgtatccccttaccagt

SEQ ID NO: 8531958 - DNA, 22 bp, Homo sapiens
agagctgtgctttgcaccacgt

SEQ ID NO: 8531959 - DNA, 22 bp, Homo sapiens
agagctgtgctttgcaccacgt

SEQ ID NO: 8531960 - DNA, 22 bp, Homo sapiens
agagctgtggatagtcctggat

SEQ ID NO: 8531961 - DNA, 22 bp, Homo sapiens
agagctgtggatagtcctggat

SEQ ID NO: 8531962 - DNA, 22 bp, Homo sapiens
agagctgtgctttgcaccacgt

SEQ ID NO: 8531963 - DNA, 22 bp, Homo sapiens
agagctgtgaaaatgaggtttg

SEQ ID NO: 8531964 - DNA, 22 bp, Homo sapiens
agagctgtcagcgttttggcca

SEQ ID NO: 8531965 - DNA, 22 bp, Homo sapiens
agagctgtgaaaatgaggtttg

SEQ ID NO: 8531966 - DNA, 22 bp, Homo sapiens
atgtgtatatttggtgtcaata

SEQ ID NO: 8531967 - DNA, 22 bp, Homo sapiens
atgtgtatatttattgtagttt

SEQ ID NO: 8531968 - DNA, 22 bp, Homo sapiens
atgtgtatatttattgtagttt

SEQ ID NO: 8531969 - DNA, 22 bp, Homo sapiens
atgtgtagaactgtaatgccca

SEQ ID NO: 8531970 - DNA, 22 bp, Homo sapiens
atgtgtaggtgaatcgaggctg

SEQ ID NO: 8531971 - DNA, 22 bp, Homo sapiens
atgtgtaggtgaatcgaggctg

SEQ ID NO: 8531972 - DNA, 22 bp, Homo sapiens
atgtgtatacttgtgcttactc

SEQ ID NO: 8531973 - DNA, 22 bp, Homo sapiens
atgtgtatacttgtgcttactc

SEQ ID NO: 8531974 - DNA, 21 bp, Homo sapiens
agagctggtaggtaggtaggt

SEQ ID NO: 8531975 - DNA, 22 bp, Homo sapiens
agagctgggacttggactcaat

SEQ ID NO: 8531976 - DNA, 22 bp, Homo sapiens
agagctggtgcatattcagaaa

SEQ ID NO: 8531977 - DNA, 22 bp, Homo sapiens
agagctggtttactcaggaatt

SEQ ID NO: 8531978 - DNA, 22 bp, Homo sapiens
agagctggtttactcaggaatt

SEQ ID NO: 8531979 - DNA, 22 bp, Homo sapiens
agagctggtgcatattcagaaa

SEQ ID NO: 8531980 - DNA, 22 bp, Homo sapiens
agagctggtgcatattcagaaa

SEQ ID NO: 8531981 - DNA, 22 bp, Homo sapiens
agaggaggatttgtaaaggtct

SEQ ID NO: 8531982 - DNA, 22 bp, Homo sapiens
agaggaggaagagctttaaaat

SEQ ID NO: 8531983 - DNA, 22 bp, Homo sapiens
agaggagctgggaggccctcgt

SEQ ID NO: 8531984 - DNA, 22 bp, Homo sapiens
agaggacaggttttccatgggc

SEQ ID NO: 8531985 - DNA, 22 bp, Homo sapiens
agaggacaggttttccatgggc

SEQ ID NO: 8531986 - DNA, 22 bp, Homo sapiens
agaggagaatccgtttccttgc

SEQ ID NO: 8531987 - DNA, 22 bp, Homo sapiens
agaggaggcagcttaactcagt

SEQ ID NO: 8531988 - DNA, 22 bp, Homo sapiens
agaggaggcagcttaactcagt

SEQ ID NO: 8531989 - DNA, 22 bp, Homo sapiens
agaggaggatttgtaaaggtct

SEQ ID NO: 8531990 - DNA, 22 bp, Homo sapiens
agaggaggatttgtaaaggtct

SEQ ID NO: 8531991 - DNA, 22 bp, Homo sapiens
agaggaggccaggcccacacct

SEQ ID NO: 8531992 - DNA, 22 bp, Homo sapiens
agaggaggctctgggatcgtcc

SEQ ID NO: 8531993 - DNA, 22 bp, Homo sapiens
agaggaggctctgggatcgtcc

SEQ ID NO: 8531994 - DNA, 22 bp, Homo sapiens
attattattgttgatgttaggg

SEQ ID NO: 8531995 - DNA, 22 bp, Homo sapiens
attattattgttgatgttaggg

SEQ ID NO: 8531996 - DNA, 21 bp, Homo sapiens
attattatttctgtgtccagc

SEQ ID NO: 8531997 - DNA, 22 bp, Homo sapiens
attattcaaattcccactatac

SEQ ID NO: 8531998 - DNA, 22 bp, Homo sapiens
attattcaaattcccactatac

SEQ ID NO: 8531999 - DNA, 22 bp, Homo sapiens
attattcaaattcccactatac

SEQ ID NO: 8532000 - DNA, 22 bp, Homo sapiens
attattcaacacttgagaaatt

SEQ ID NO: 8532001 - DNA, 22 bp, Homo sapiens
attattcaacacttgagaaatt

SEQ ID NO: 8532002 - DNA, 22 bp, Homo sapiens
attattcaacacttgagaaatt

SEQ ID NO: 8532003 - DNA, 22 bp, Homo sapiens
agaggcagaagtgttcaaaccc

SEQ ID NO: 8532004 - DNA, 22 bp, Homo sapiens
attataggcttgagccaccgtg

SEQ ID NO: 8532005 - DNA, 23 bp, Homo sapiens
attattaaggacatggactttgt

SEQ ID NO: 8532006 - DNA, 22 bp, Homo sapiens
attattactcctgattgtactg

SEQ ID NO: 8532007 - DNA, 22 bp, Homo sapiens
attattaaagcttaggtcttat

SEQ ID NO: 8532008 - DNA, 22 bp, Homo sapiens
attattatatagggaaagtccc

SEQ ID NO: 8532009 - DNA, 17 bp, Homo sapiens
agaggcagatacttgga

SEQ ID NO: 8532010 - DNA, 17 bp, Homo sapiens
agaggcagatacttgga

SEQ ID NO: 8532011 - DNA, 22 bp, Homo sapiens
agaggcagcagtcatactacag

SEQ ID NO: 8532012 - DNA, 22 bp, Homo sapiens
agaggcagcagtcatactacag

SEQ ID NO: 8532013 - DNA, 22 bp, Homo sapiens
agaggcagccgtatttcaaagg

SEQ ID NO: 8532014 - DNA, 22 bp, Homo sapiens
agaggcaggaggttgacttgag

SEQ ID NO: 8532015 - DNA, 22 bp, Homo sapiens
agaggcaggaggttgacttgag

SEQ ID NO: 8532016 - DNA, 22 bp, Homo sapiens
agaggcaggaagagctgatttt

SEQ ID NO: 8532017 - DNA, 22 bp, Homo sapiens
agaggcaggaagagctgatttt

SEQ ID NO: 8532018 - DNA, 22 bp, Homo sapiens
agaggcaggaagagctgatttt

SEQ ID NO: 8532019 - DNA, 22 bp, Homo sapiens
agaggcaggaagagctgatttt

SEQ ID NO: 8532020 - DNA, 22 bp, Homo sapiens
agaggcaggaagagctgatttt

SEQ ID NO: 8532021 - DNA, 22 bp, Homo sapiens
attcagtaggtctagaataaga

SEQ ID NO: 8532022 - DNA, 22 bp, Homo sapiens
attcagtaggtctagaataaga

SEQ ID NO: 8532023 - DNA, 22 bp, Homo sapiens
attcagtagaagttagctatta

SEQ ID NO: 8532024 - DNA, 20 bp, Homo sapiens
attcatgtctttataaaagc

SEQ ID NO: 8532025 - DNA, 22 bp, Homo sapiens
attcatggcagtggtaacgttt

SEQ ID NO: 8532026 - DNA, 22 bp, Homo sapiens
attcagtaggtgtgaacttatt

SEQ ID NO: 8532027 - DNA, 22 bp, Homo sapiens
attcagtattctgctgcataat

SEQ ID NO: 8532028 - DNA, 22 bp, Homo sapiens
attcatgttagcccacatgtag

SEQ ID NO: 8532029 - DNA, 22 bp, Homo sapiens
attcatgttcggggccacgttg

SEQ ID NO: 8532030 - DNA, 22 bp, Homo sapiens
attcatgtggggagccttctgt

SEQ ID NO: 8532031 - DNA, 20 bp, Homo sapiens
attcatgtctttataaaagc

SEQ ID NO: 8532032 - DNA, 22 bp, Homo sapiens
attcattagccactaactagca

SEQ ID NO: 8532033 - DNA, 22 bp, Homo sapiens
attcattagccactaactagca

SEQ ID NO: 8532034 - DNA, 22 bp, Homo sapiens
attcattccaggtcagtcagac

SEQ ID NO: 8532035 - DNA, 19 bp, Homo sapiens
attcattggccagggtggt

SEQ ID NO: 8532036 - DNA, 22 bp, Homo sapiens
attcattcttggtatgaacagc

SEQ ID NO: 8532037 - DNA, 22 bp, Homo sapiens
attcattccaggtcagtcagac

SEQ ID NO: 8532038 - DNA, 22 bp, Homo sapiens
attcattctgacctcaagagaa

SEQ ID NO: 8532039 - DNA, 22 bp, Homo sapiens
agaggctccaccttctctgtcc

SEQ ID NO: 8532040 - DNA, 22 bp, Homo sapiens
agaggctccaccttctctgtcc

SEQ ID NO: 8532041 - DNA, 22 bp, Homo sapiens
agaggctcctagccactggctt

SEQ ID NO: 8532042 - DNA, 22 bp, Homo sapiens
agaggctcctagccactggctt

SEQ ID NO: 8532043 - DNA, 22 bp, Homo sapiens
agaggctcctcggtgcctcgtg

SEQ ID NO: 8532044 - DNA, 22 bp, Homo sapiens
agaggctcagaggcctggtcct

SEQ ID NO: 8532045 - DNA, 22 bp, Homo sapiens
agaggctaggaccatgtatcat

SEQ ID NO: 8532046 - DNA, 22 bp, Homo sapiens
agaggcggaggttgcagtgagc

SEQ ID NO: 8532047 - DNA, 22 bp, Homo sapiens
agaggcggaggttgcagtgagc

SEQ ID NO: 8532048 - DNA, 22 bp, Homo sapiens
agaggcggagcttgcagtgagc

SEQ ID NO: 8532049 - DNA, 21 bp, Homo sapiens
agaggcggggttttggaggcc

SEQ ID NO: 8532050 - DNA, 22 bp, Homo sapiens
agaggcggaggttgcagtgagc

SEQ ID NO: 8532051 - DNA, 22 bp, Homo sapiens
agaggcggagcttgcagtgagc

SEQ ID NO: 8532052 - DNA, 22 bp, Homo sapiens
agaggcggagcttgcagtgagc

SEQ ID NO: 8532053 - DNA, 22 bp, Homo sapiens
attcatttaggtattcacttac

SEQ ID NO: 8532054 - DNA, 22 bp, Homo sapiens
attcatttaggtattcacttac

SEQ ID NO: 8532055 - DNA, 22 bp, Homo sapiens
attcatttagagggattaagca

SEQ ID NO: 8532056 - DNA, 22 bp, Homo sapiens
attcattggcttgaactccacc

SEQ ID NO: 8532057 - DNA, 22 bp, Homo sapiens
attcatttgctattgtgtatgg

SEQ ID NO: 8532058 - DNA, 22 bp, Homo sapiens
attcatttgctattgtgtatgg

SEQ ID NO: 8532059 - DNA, 22 bp, Homo sapiens
attcatttgctattgtgtatgg

SEQ ID NO: 8532060 - DNA, 22 bp, Homo sapiens
agaggcctgtgtgctccagtgg

SEQ ID NO: 8532061 - DNA, 22 bp, Homo sapiens
agaggcctgtgtgctccagtgg

SEQ ID NO: 8532062 - DNA, 22 bp, Homo sapiens
agaggctgtctcatattttgta

SEQ ID NO: 8532063 - DNA, 22 bp, Homo sapiens
agaggctgtgcagagggagtgc

SEQ ID NO: 8532064 - DNA, 22 bp, Homo sapiens
agagggaaaaactcatgtcatt

SEQ ID NO: 8532065 - DNA, 22 bp, Homo sapiens
agagggaaaaactcatgtcatt

SEQ ID NO: 8532066 - DNA, 17 bp, Homo sapiens
agagggaaaatgcggtt

SEQ ID NO: 8532067 - DNA, 17 bp, Homo sapiens
agagggaaaatgcggtt

SEQ ID NO: 8532068 - DNA, 22 bp, Homo sapiens
agagggaacggatcccagcgcg

SEQ ID NO: 8532069 - DNA, 22 bp, Homo sapiens
agagggaaatccaggagtgctt

SEQ ID NO: 8532070 - DNA, 18 bp, Homo sapiens
agagggaaagcaggctga

SEQ ID NO: 8532071 - DNA, 22 bp, Homo sapiens
attccagatgcttgtatttaaa

SEQ ID NO: 8532072 - DNA, 22 bp, Homo sapiens
attccagatgaattgcatagtt

SEQ ID NO: 8532073 - DNA, 22 bp, Homo sapiens
agagggaatgtgattgcaccat

SEQ ID NO: 8532074 - DNA, 22 bp, Homo sapiens
agagggaatgtgattgcaccat

SEQ ID NO: 8532075 - DNA, 22 bp, Homo sapiens
agagggagaaaagaatcagttg

SEQ ID NO: 8532076 - DNA, 22 bp, Homo sapiens
agagggagaaaagaatcagttg

SEQ ID NO: 8532077 - DNA, 22 bp, Homo sapiens
agagggagaaaagaatcagttg

SEQ ID NO: 8532078 - DNA, 22 bp, Homo sapiens
agagggagaagctaaaataact

SEQ ID NO: 8532079 - DNA, 22 bp, Homo sapiens
attccagtgtgcatggtacaca

SEQ ID NO: 8532080 - DNA, 22 bp, Homo sapiens
attccagtgtgcttccttgcta

SEQ ID NO: 8532081 - DNA, 21 bp, Homo sapiens
attccagtataagcctctttg

SEQ ID NO: 8532082 - DNA, 22 bp, Homo sapiens
attccagttctcctctctaaag

SEQ ID NO: 8532083 - DNA, 22 bp, Homo sapiens
attccagatgttactgaaaggc

SEQ ID NO: 8532084 - DNA, 22 bp, Homo sapiens
attgcagctggtcagggtaatt

SEQ ID NO: 8532085 - DNA, 22 bp, Homo sapiens
attgataaattgcaatggggct

SEQ ID NO: 8532086 - DNA, 22 bp, Homo sapiens
attgagtagtaggaaaataact

SEQ ID NO: 8532087 - DNA, 22 bp, Homo sapiens
attgagtacttagtgtcatata

SEQ ID NO: 8532088 - DNA, 22 bp, Homo sapiens
attgagtaataattgatcttgg

SEQ ID NO: 8532089 - DNA, 22 bp, Homo sapiens
attcccacagctggtataaata

SEQ ID NO: 8532090 - DNA, 22 bp, Homo sapiens
attcccaccaacaatgtacagg

SEQ ID NO: 8532091 - DNA, 22 bp, Homo sapiens
attccattgtgtaaggatatcg

SEQ ID NO: 8532092 - DNA, 22 bp, Homo sapiens
attgcattcattgacatatgag

SEQ ID NO: 8532093 - DNA, 22 bp, Homo sapiens
attgcagggaggcaggtagatg

SEQ ID NO: 8532094 - DNA, 22 bp, Homo sapiens
attgcagggactcaataagaat

SEQ ID NO: 8532095 - DNA, 22 bp, Homo sapiens
attgcagtgatggttgcataat

SEQ ID NO: 8532096 - DNA, 22 bp, Homo sapiens
agagtttcttgtgagcactgac

SEQ ID NO: 8532097 - DNA, 22 bp, Homo sapiens
agagtttgaagttatctttgac

SEQ ID NO: 8532098 - DNA, 22 bp, Homo sapiens
agagttggcccacgtgtaggcg

SEQ ID NO: 8532099 - DNA, 22 bp, Homo sapiens
agagttggccaaaaggggcatt

SEQ ID NO: 8532100 - DNA, 22 bp, Homo sapiens
agagtgggtgatctctgttgtc

SEQ ID NO: 8532101 - DNA, 22 bp, Homo sapiens
agagtggggacagggcctgtcc

SEQ ID NO: 8532102 - DNA, 22 bp, Homo sapiens
agaggtcttttggtctgcagaa

SEQ ID NO: 8532103 - DNA, 22 bp, Homo sapiens
agaggtcttttggtctgcagaa

SEQ ID NO: 8532104 - DNA, 22 bp, Homo sapiens
agaggtcttaagttccttgatg

SEQ ID NO: 8532105 - DNA, 22 bp, Homo sapiens
agaggtcttaagatctagactg

SEQ ID NO: 8532106 - DNA, 22 bp, Homo sapiens
agagtgggtgatctctgttgtc

SEQ ID NO: 8532107 - DNA, 22 bp, Homo sapiens
agagttctgaaattatctttac

SEQ ID NO: 8532108 - DNA, 22 bp, Homo sapiens
agagttctgctcttctcagtga

SEQ ID NO: 8532109 - DNA, 22 bp, Homo sapiens
agagttctgctcttctcagtga

SEQ ID NO: 8532110 - DNA, 22 bp, Homo sapiens
agagttctgaattttattctct

SEQ ID NO: 8532111 - DNA, 22 bp, Homo sapiens
agagttctgctcttctcagtga

SEQ ID NO: 8532112 - DNA, 22 bp, Homo sapiens
agagttctgtctgccacacgaa

SEQ ID NO: 8532113 - DNA, 22 bp, Homo sapiens
attgcattgtattgtaaatgtt

SEQ ID NO: 8532114 - DNA, 22 bp, Homo sapiens
attgctgaaagtattttatgac

SEQ ID NO: 8532115 - DNA, 22 bp, Homo sapiens
attgctaatgtgcgaatgtgta

SEQ ID NO: 8532116 - DNA, 22 bp, Homo sapiens
attgctcagcacaagcagcaga

SEQ ID NO: 8532117 - DNA, 22 bp, Homo sapiens
agaggtcagagcaggaaaggca

SEQ ID NO: 8532118 - DNA, 22 bp, Homo sapiens
agaggtcagaggtcgccaggtc

SEQ ID NO: 8532119 - DNA, 22 bp, Homo sapiens
agaggtcatatctcagaagaga

SEQ ID NO: 8532120 - DNA, 22 bp, Homo sapiens
agaggtctgagcaatctcaagc

SEQ ID NO: 8532121 - DNA, 22 bp, Homo sapiens
agaggtctcagttatgtttaaa

SEQ ID NO: 8532122 - DNA, 22 bp, Homo sapiens
agaggtcagaacaggaaagtgt

SEQ ID NO: 8532123 - DNA, 22 bp, Homo sapiens
agaggtcagaacaggaaagtgt

SEQ ID NO: 8532124 - DNA, 22 bp, Homo sapiens
agaggtattagatttgcatagg

SEQ ID NO: 8532125 - DNA, 22 bp, Homo sapiens
agaggtattaggtaattcagta

SEQ ID NO: 8532126 - DNA, 22 bp, Homo sapiens
agatacagtgttacatttttat

SEQ ID NO: 8532127 - DNA, 21 bp, Homo sapiens
atttcagaaatattggtggga

SEQ ID NO: 8532128 - DNA, 17 bp, Homo sapiens
atttcacttagcatgag

SEQ ID NO: 8532129 - DNA, 22 bp, Homo sapiens
agatacatagctgtgagcacac

SEQ ID NO: 8532130 - DNA, 22 bp, Homo sapiens
agatacatagctgtgagcacac

SEQ ID NO: 8532131 - DNA, 22 bp, Homo sapiens
agatacatagctgtgagcacac

SEQ ID NO: 8532132 - DNA, 22 bp, Homo sapiens
agatacatatagaaaacatcaa

SEQ ID NO: 8532133 - DNA, 22 bp, Homo sapiens
agatacatatagaaaacatcaa

SEQ ID NO: 8532134 - DNA, 22 bp, Homo sapiens
agatacatagctgtgagcacac

SEQ ID NO: 8532135 - DNA, 22 bp, Homo sapiens
agatacatagctgtgagcacac

SEQ ID NO: 8532136 - DNA, 22 bp, Homo sapiens
agatacattgagtttcctcctg

SEQ ID NO: 8532137 - DNA, 22 bp, Homo sapiens
agatacattgcacgatgcagat

SEQ ID NO: 8532138 - DNA, 22 bp, Homo sapiens
agatacattgagtttcctcctg

SEQ ID NO: 8532139 - DNA, 22 bp, Homo sapiens
agatacattagtagttacttgt

SEQ ID NO: 8532140 - DNA, 22 bp, Homo sapiens
agatacatgtcaagagacttat

SEQ ID NO: 8532141 - DNA, 22 bp, Homo sapiens
agatacatgtcaagagacttat

SEQ ID NO: 8532142 - DNA, 22 bp, Homo sapiens
agatacatcttgaacttctaga

SEQ ID NO: 8532143 - DNA, 22 bp, Homo sapiens
agatacatcttgaacttctaga

SEQ ID NO: 8532144 - DNA, 22 bp, Homo sapiens
agatacatggaacgtcaaacct

SEQ ID NO: 8532145 - DNA, 22 bp, Homo sapiens
agatacatcatttataccttca

SEQ ID NO: 8532146 - DNA, 22 bp, Homo sapiens
atttcacattaatttgatgctc

SEQ ID NO: 8532147 - DNA, 22 bp, Homo sapiens
atttcactcattcatgttactt

SEQ ID NO: 8532148 - DNA, 22 bp, Homo sapiens
atttcactctccctgccactta

SEQ ID NO: 8532149 - DNA, 22 bp, Homo sapiens
atttcacattaatttgatgctc

SEQ ID NO: 8532150 - DNA, 22 bp, Homo sapiens
atttcacattaatttgatgctc

SEQ ID NO: 8532151 - DNA, 22 bp, Homo sapiens
atttcacattaatttgatgctc

SEQ ID NO: 8532152 - DNA, 22 bp, Homo sapiens
atttcacagctgtcagtgttac

SEQ ID NO: 8532153 - DNA, 22 bp, Homo sapiens
atttcacagctgtcagtgttac

SEQ ID NO: 8532154 - DNA, 22 bp, Homo sapiens
atttcacatctatctcagattt

SEQ ID NO: 8532155 - DNA, 22 bp, Homo sapiens
atttcacagctgtcagtgttac

SEQ ID NO: 8532156 - DNA, 22 bp, Homo sapiens
agagtttgtgggcttttcctcc

SEQ ID NO: 8532157 - DNA, 22 bp, Homo sapiens
agagtttgtatttttcagtgaa

SEQ ID NO: 8532158 - DNA, 22 bp, Homo sapiens
agagtttggtgaagcaatttga

SEQ ID NO: 8532159 - DNA, 22 bp, Homo sapiens
agagtttgtagtggtgaatgta

SEQ ID NO: 8532160 - DNA, 22 bp, Homo sapiens
agagtttgtactttaccctgag

SEQ ID NO: 8532161 - DNA, 22 bp, Homo sapiens
agagtttggattttaggacatc

SEQ ID NO: 8532162 - DNA, 22 bp, Homo sapiens
agagtttggggtatgattgttt

SEQ ID NO: 8532163 - DNA, 20 bp, Homo sapiens
agagtttggggtcattttgg

SEQ ID NO: 8532164 - DNA, 22 bp, Homo sapiens
agagtttgggtgggacagcttg

SEQ ID NO: 8532165 - DNA, 22 bp, Homo sapiens
agagtttggaggtgttcctgga

SEQ ID NO: 8532166 - DNA, 22 bp, Homo sapiens
agagtttggagagggtgaggca

SEQ ID NO: 8532167 - DNA, 22 bp, Homo sapiens
agagtttgaattttgaaaagat

SEQ ID NO: 8532168 - DNA, 22 bp, Homo sapiens
agataaaatgattttctggatc

SEQ ID NO: 8532169 - DNA, 17 bp, Homo sapiens
agagttttaagaaattt

SEQ ID NO: 8532170 - DNA, 23 bp, Homo sapiens
agagtttgtttctaatgagtgag

SEQ ID NO: 8532171 - DNA, 22 bp, Homo sapiens
agagtttgttgaatttacttgg

SEQ ID NO: 8532172 - DNA, 22 bp, Homo sapiens
agagtttgtgtcctttatcagg

SEQ ID NO: 8532173 - DNA, 22 bp, Homo sapiens
agataaagtccaaactgtgtag

SEQ ID NO: 8532174 - DNA, 22 bp, Homo sapiens
agataaaatggttcaaaggcta

SEQ ID NO: 8532175 - DNA, 22 bp, Homo sapiens
atttattgaagcttattacgtt

SEQ ID NO: 8532176 - DNA, 22 bp, Homo sapiens
atttcacagctgctgttcaggt

SEQ ID NO: 8532177 - DNA, 22 bp, Homo sapiens
atttcacagctgctgttcaggt

SEQ ID NO: 8532178 - DNA, 22 bp, Homo sapiens
atttcacagcgtggttgactgc

SEQ ID NO: 8532179 - DNA, 22 bp, Homo sapiens
atttcctatacagttgtccata

SEQ ID NO: 8532180 - DNA, 22 bp, Homo sapiens
atttcctaggtgctcgagtgct

SEQ ID NO: 8532181 - DNA, 22 bp, Homo sapiens
atttcctatggatacaggcaga

SEQ ID NO: 8532182 - DNA, 22 bp, Homo sapiens
atttcctatggatacaggcaga

SEQ ID NO: 8532183 - DNA, 22 bp, Homo sapiens
atttcctatttcttgtccccta

SEQ ID NO: 8532184 - DNA, 22 bp, Homo sapiens
atttcctatacagttgtccata

SEQ ID NO: 8532185 - DNA, 22 bp, Homo sapiens
atttcctatagatatggtgagt

SEQ ID NO: 8532186 - DNA, 22 bp, Homo sapiens
atttcctatcctggtcttaaaa

SEQ ID NO: 8532187 - DNA, 22 bp, Homo sapiens
atttcctatagatatggtgagt

SEQ ID NO: 8532188 - DNA, 21 bp, Homo sapiens
agatagttgggcatgcagctg

SEQ ID NO: 8532189 - DNA, 22 bp, Homo sapiens
agatactatggaattttatgag

SEQ ID NO: 8532190 - DNA, 22 bp, Homo sapiens
agatacattgttctaagcattg

SEQ ID NO: 8532191 - DNA, 22 bp, Homo sapiens
agatactaagcatttccagcac

SEQ ID NO: 8532192 - DNA, 22 bp, Homo sapiens
agatacattgttctaagcattg

SEQ ID NO: 8532193 - DNA, 17 bp, Homo sapiens
atttcctcagggctgag

SEQ ID NO: 8532194 - DNA, 22 bp, Homo sapiens
atttccttcagtgtttaatact

SEQ ID NO: 8532195 - DNA, 22 bp, Homo sapiens
atttctcttagcaagacattac

SEQ ID NO: 8532196 - DNA, 22 bp, Homo sapiens
atttctctgcctcagcttctgc

SEQ ID NO: 8532197 - DNA, 18 bp, Homo sapiens
atttctctggggtgattc

SEQ ID NO: 8532198 - DNA, 22 bp, Homo sapiens
atttctctgcagtgttcggaat

SEQ ID NO: 8532199 - DNA, 22 bp, Homo sapiens
atttggatatcactgaatacat

SEQ ID NO: 8532200 - DNA, 22 bp, Homo sapiens
atttggatgcactaaataaaat

SEQ ID NO: 8532201 - DNA, 22 bp, Homo sapiens
atttggatgcactaaataaaat

SEQ ID NO: 8532202 - DNA, 22 bp, Homo sapiens
atttggattcttatttagcact

SEQ ID NO: 8532203 - DNA, 22 bp, Homo sapiens
atttggaggcctctcctgcttg

SEQ ID NO: 8532204 - DNA, 22 bp, Homo sapiens
atttctcattttgcttcaaagg

SEQ ID NO: 8532205 - DNA, 22 bp, Homo sapiens
atttctctaagcatccgtttgc

SEQ ID NO: 8532206 - DNA, 22 bp, Homo sapiens
atttctctcattgttagctagg

SEQ ID NO: 8532207 - DNA, 22 bp, Homo sapiens
atttctctcattgttagctagg

SEQ ID NO: 8532208 - DNA, 22 bp, Homo sapiens
atttctctcattgttagctagg

SEQ ID NO: 8532209 - DNA, 22 bp, Homo sapiens
atttccttcatcagcctatcct

SEQ ID NO: 8532210 - DNA, 22 bp, Homo sapiens
atttctcatgtacaaaaacact

SEQ ID NO: 8532211 - DNA, 22 bp, Homo sapiens
atttctcattttgcttcaaagg

SEQ ID NO: 8532212 - DNA, 22 bp, Homo sapiens
atttctcattaagatcttccaa

SEQ ID NO: 8532213 - DNA, 22 bp, Homo sapiens
atttctcattttgcttcaaagg

SEQ ID NO: 8532214 - DNA, 22 bp, Homo sapiens
atttgtttcagggccttggtat

SEQ ID NO: 8532215 - DNA, 20 bp, Homo sapiens
atttgtttctactctctgac

SEQ ID NO: 8532216 - DNA, 20 bp, Homo sapiens
atttgtttctactctctgac

SEQ ID NO: 8532217 - DNA, 20 bp, Homo sapiens
atttgtttctactctctgac

SEQ ID NO: 8532218 - DNA, 22 bp, Homo sapiens
atttgttgctagcagcactgat

SEQ ID NO: 8532219 - DNA, 22 bp, Homo sapiens
atttgttgctagcagcactgat

SEQ ID NO: 8532220 - DNA, 22 bp, Homo sapiens
atttgtttatcgtcgattgtag

SEQ ID NO: 8532221 - DNA, 22 bp, Homo sapiens
atttgtttatcgtcgattgtag

SEQ ID NO: 8532222 - DNA, 22 bp, Homo sapiens
atttgtttatcgtcgattgtag

SEQ ID NO: 8532223 - DNA, 22 bp, Homo sapiens
attttaaccctcttatatatac

SEQ ID NO: 8532224 - DNA, 22 bp, Homo sapiens
attttttgttaactcaggatag

SEQ ID NO: 8532225 - DNA, 22 bp, Homo sapiens
caaaagcagttctatctgagtt

SEQ ID NO: 8532226 - DNA, 22 bp, Homo sapiens
caaaagggagttctctggaagg

SEQ ID NO: 8532227 - DNA, 22 bp, Homo sapiens
atttgtgaattaagcatgtcaa

SEQ ID NO: 8532228 - DNA, 22 bp, Homo sapiens
atttgtctttggacctgtgaga

SEQ ID NO: 8532229 - DNA, 22 bp, Homo sapiens
atttgtctttggacctgtgaga

SEQ ID NO: 8532230 - DNA, 22 bp, Homo sapiens
atttgtgggactataatgcagg

SEQ ID NO: 8532231 - DNA, 22 bp, Homo sapiens
atttgtgataatttgttacagc

SEQ ID NO: 8532232 - DNA, 22 bp, Homo sapiens
atttgtgatcgtgcgtgatgaa

SEQ ID NO: 8532233 - DNA, 17 bp, Homo sapiens
atttgtgatgtaacgtc

SEQ ID NO: 8532234 - DNA, 22 bp, Homo sapiens
atttgttgaataaattagtatt

SEQ ID NO: 8532235 - DNA, 22 bp, Homo sapiens
atttgtgttgtattaagctgct

SEQ ID NO: 8532236 - DNA, 22 bp, Homo sapiens
atttgtgttgtattaagctgct

SEQ ID NO: 8532237 - DNA, 22 bp, Homo sapiens
atttgttcagcattgaatttgg

SEQ ID NO: 8532238 - DNA, 22 bp, Homo sapiens
atttgttcatgggttgttatgc

SEQ ID NO: 8532239 - DNA, 22 bp, Homo sapiens
cacctgagcaaccctgtgcggg

SEQ ID NO: 8532240 - DNA, 22 bp, Homo sapiens
cactgcacttcagcctgggtga

SEQ ID NO: 8532241 - DNA, 22 bp, Homo sapiens
cacctgagactcctcaccatga

SEQ ID NO: 8532242 - DNA, 22 bp, Homo sapiens
cacctgagcactggggccgccc

SEQ ID NO: 8532243 - DNA, 22 bp, Homo sapiens
cacctgaagatttagagattga

SEQ ID NO: 8532244 - DNA, 22 bp, Homo sapiens
cacctgaagatttagagattga

SEQ ID NO: 8532245 - DNA, 22 bp, Homo sapiens
cacctgaatggaactttgaacc

SEQ ID NO: 8532246 - DNA, 22 bp, Homo sapiens
cactgcagatcagaggctgaga

SEQ ID NO: 8532247 - DNA, 22 bp, Homo sapiens
cactgcagatcagaggctgaga

SEQ ID NO: 8532248 - DNA, 22 bp, Homo sapiens
cactgcctgtgagctgtgtgcc

SEQ ID NO: 8532249 - DNA, 22 bp, Homo sapiens
cactgcctgtgagctgtgtgcc

SEQ ID NO: 8532250 - DNA, 22 bp, Homo sapiens
cacctctttgatttgaggcaag

SEQ ID NO: 8532251 - DNA, 22 bp, Homo sapiens
cacctctgctgtccacaggatg

SEQ ID NO: 8532252 - DNA, 22 bp, Homo sapiens
cacctcaggcagcaaagtctca

SEQ ID NO: 8532253 - DNA, 22 bp, Homo sapiens
cacctctgcctcaagcttccca

SEQ ID NO: 8532254 - DNA, 22 bp, Homo sapiens
cacctctcagctaggagtaagt

SEQ ID NO: 8532255 - DNA, 22 bp, Homo sapiens
cacctctcatttctacagattc

SEQ ID NO: 8532256 - DNA, 22 bp, Homo sapiens
cacccaggctggagtgcattgg

SEQ ID NO: 8532257 - DNA, 22 bp, Homo sapiens
cacccaggctggagtgcagtgg

SEQ ID NO: 8532258 - DNA, 22 bp, Homo sapiens
cacccaggctggagtgcagtgg

SEQ ID NO: 8532259 - DNA, 22 bp, Homo sapiens
cacccaggctggagtgcagtgg

SEQ ID NO: 8532260 - DNA, 22 bp, Homo sapiens
cacccaggctggattgcagtgg

SEQ ID NO: 8532261 - DNA, 22 bp, Homo sapiens
cactgctcgctgcagcatggcc

SEQ ID NO: 8532262 - DNA, 22 bp, Homo sapiens
cactgcttagttggtaaatgtg

SEQ ID NO: 8532263 - DNA, 22 bp, Homo sapiens
cactgctacctctgcctcccgg

SEQ ID NO: 8532264 - DNA, 22 bp, Homo sapiens
cactgctacctctgcctcccgg

SEQ ID NO: 8532265 - DNA, 22 bp, Homo sapiens
cactgctacctctgcctcccgg

SEQ ID NO: 8532266 - DNA, 22 bp, Homo sapiens
cactgctacctctgcctcccgg

SEQ ID NO: 8532267 - DNA, 22 bp, Homo sapiens
cactgctatgatgatgatattt

SEQ ID NO: 8532268 - DNA, 22 bp, Homo sapiens
cactgctattattagacaatgt

SEQ ID NO: 8532269 - DNA, 22 bp, Homo sapiens
cactgctattattagacaatgt

SEQ ID NO: 8532270 - DNA, 22 bp, Homo sapiens
cactgctttaaggctgagtaac

SEQ ID NO: 8532271 - DNA, 22 bp, Homo sapiens
agcatacaccctaaactgctta

SEQ ID NO: 8532272 - DNA, 22 bp, Homo sapiens
agcatacaggtctgaaacagct

SEQ ID NO: 8532273 - DNA, 22 bp, Homo sapiens
cactgcttgattgacatgcacg

SEQ ID NO: 8532274 - DNA, 22 bp, Homo sapiens
cactgcttggttgcaacattgc

SEQ ID NO: 8532275 - DNA, 20 bp, Homo sapiens
agcatacatcataagaaacc

SEQ ID NO: 8532276 - DNA, 20 bp, Homo sapiens
agcatacatcataagaaacc

SEQ ID NO: 8532277 - DNA, 22 bp, Homo sapiens
agcatacaggtctgaaacagct

SEQ ID NO: 8532278 - DNA, 22 bp, Homo sapiens
agcatacaggtctgaaacagct

SEQ ID NO: 8532279 - DNA, 22 bp, Homo sapiens
agcagggggccacagtcacagc

SEQ ID NO: 8532280 - DNA, 22 bp, Homo sapiens
agcagggggccacagtcacagc

SEQ ID NO: 8532281 - DNA, 22 bp, Homo sapiens
agcaggggtaacagaaggaaag

SEQ ID NO: 8532282 - DNA, 22 bp, Homo sapiens
agcaggggtaacagaaggaaag

SEQ ID NO: 8532283 - DNA, 22 bp, Homo sapiens
agcaggggtaacagaaggaaag

SEQ ID NO: 8532284 - DNA, 22 bp, Homo sapiens
agcagggggagttagactagat

SEQ ID NO: 8532285 - DNA, 22 bp, Homo sapiens
agcagggggagttagactagat

SEQ ID NO: 8532286 - DNA, 22 bp, Homo sapiens
agcagggggcatccttgccctt

SEQ ID NO: 8532287 - DNA, 22 bp, Homo sapiens
agcagggggcatccttgccctt

SEQ ID NO: 8532288 - DNA, 22 bp, Homo sapiens
agcaggggcagggttttgtgct

SEQ ID NO: 8532289 - DNA, 22 bp, Homo sapiens
agcaggggcagggttttgtgct

SEQ ID NO: 8532290 - DNA, 22 bp, Homo sapiens
agcaggggctcctccacagcca

SEQ ID NO: 8532291 - DNA, 23 bp, Homo sapiens
agcaggctgcttctccacagctg

SEQ ID NO: 8532292 - DNA, 22 bp, Homo sapiens
agcagggctggggcacgagcca

SEQ ID NO: 8532293 - DNA, 22 bp, Homo sapiens
agcaggggtctctgctaatgaa

SEQ ID NO: 8532294 - DNA, 22 bp, Homo sapiens
agcaggggtctctgctaatgaa

SEQ ID NO: 8532295 - DNA, 22 bp, Homo sapiens
agcaggggtggaaggtagcttt

SEQ ID NO: 8532296 - DNA, 22 bp, Homo sapiens
agcaggggtggaaggtagcttt

SEQ ID NO: 8532297 - DNA, 22 bp, Homo sapiens
agcagggtcctgaggtgagtca

SEQ ID NO: 8532298 - DNA, 22 bp, Homo sapiens
agcagggtatgttagagctgta

SEQ ID NO: 8532299 - DNA, 22 bp, Homo sapiens
agcagggtttggggattggcac

SEQ ID NO: 8532300 - DNA, 22 bp, Homo sapiens
agcagggttccaggagttgcag

SEQ ID NO: 8532301 - DNA, 22 bp, Homo sapiens
agcagggttccaggagttgcag

SEQ ID NO: 8532302 - DNA, 22 bp, Homo sapiens
agcagggttccaggagttgcag

SEQ ID NO: 8532303 - DNA, 22 bp, Homo sapiens
cacccaggctggagagcagtgg

SEQ ID NO: 8532304 - DNA, 22 bp, Homo sapiens
cacccaggctggagagcagtgg

SEQ ID NO: 8532305 - DNA, 22 bp, Homo sapiens
cacccaggctggagagcagtgg

SEQ ID NO: 8532306 - DNA, 22 bp, Homo sapiens
cacccaggctggagagcagtgg

SEQ ID NO: 8532307 - DNA, 22 bp, Homo sapiens
cacccaggctggagagcagtgg

SEQ ID NO: 8532308 - DNA, 22 bp, Homo sapiens
caccaggtggaaatgtcacagc

SEQ ID NO: 8532309 - DNA, 22 bp, Homo sapiens
cacccaggctggagagcagtgg

SEQ ID NO: 8532310 - DNA, 22 bp, Homo sapiens
cacccaggctggaatgcagtgg

SEQ ID NO: 8532311 - DNA, 22 bp, Homo sapiens
agcagggtttggggattggcac

SEQ ID NO: 8532312 - DNA, 22 bp, Homo sapiens
caccaggtggaaatgtcacagc

SEQ ID NO: 8532313 - DNA, 22 bp, Homo sapiens
cacccaggctggagtgcagtga

SEQ ID NO: 8532314 - DNA, 22 bp, Homo sapiens
cacccaggctggagtgcagtga

SEQ ID NO: 8532315 - DNA, 22 bp, Homo sapiens
cacccaggctggagtgcagtga

SEQ ID NO: 8532316 - DNA, 22 bp, Homo sapiens
cacccaggctggagtgcagggg

SEQ ID NO: 8532317 - DNA, 22 bp, Homo sapiens
cacccaggctggagtgcagggg

SEQ ID NO: 8532318 - DNA, 22 bp, Homo sapiens
cacccaggctggagtgcagggg

SEQ ID NO: 8532319 - DNA, 22 bp, Homo sapiens
cacccaggctggagtgcagggg

SEQ ID NO: 8532320 - DNA, 22 bp, Homo sapiens
cacagtcctacagagatcagag

SEQ ID NO: 8532321 - DNA, 22 bp, Homo sapiens
cacagtcccattcgagagtaat

SEQ ID NO: 8532322 - DNA, 22 bp, Homo sapiens
cacagtcccgtgcttaccatgt

SEQ ID NO: 8532323 - DNA, 22 bp, Homo sapiens
agcaggcaggaatggtggaaca

SEQ ID NO: 8532324 - DNA, 22 bp, Homo sapiens
agcaggcaggaaggcagcactg

SEQ ID NO: 8532325 - DNA, 22 bp, Homo sapiens
cacagttatatgttcacaagga

SEQ ID NO: 8532326 - DNA, 22 bp, Homo sapiens
cacagtgttccagagcagtggt

SEQ ID NO: 8532327 - DNA, 22 bp, Homo sapiens
cacagtgtttgatttaggggcc

SEQ ID NO: 8532328 - DNA, 22 bp, Homo sapiens
cacagtcctgccagagggcctt

SEQ ID NO: 8532329 - DNA, 19 bp, Homo sapiens
cacagtcctatgtttatca

SEQ ID NO: 8532330 - DNA, 19 bp, Homo sapiens
cacagtcctatgtttatca

SEQ ID NO: 8532331 - DNA, 22 bp, Homo sapiens
cacagtcctacagagatcagag

SEQ ID NO: 8532332 - DNA, 22 bp, Homo sapiens
agcaggcaggaaggcagcactg

SEQ ID NO: 8532333 - DNA, 22 bp, Homo sapiens
agcaggcaggaaggcagcactg

SEQ ID NO: 8532334 - DNA, 22 bp, Homo sapiens
agcaggcagctgggggagttga

SEQ ID NO: 8532335 - DNA, 22 bp, Homo sapiens
agcaggcactatgccaggatct

SEQ ID NO: 8532336 - DNA, 22 bp, Homo sapiens
agcaggcactatgccaggatct

SEQ ID NO: 8532337 - DNA, 22 bp, Homo sapiens
cacagtttggtatagaagtgat

SEQ ID NO: 8532338 - DNA, 22 bp, Homo sapiens
cacagtttggtatagaagtgat

SEQ ID NO: 8532339 - DNA, 22 bp, Homo sapiens
cacagtttgggtctccggggca

SEQ ID NO: 8532340 - DNA, 22 bp, Homo sapiens
cacagtttctgaacactttgca

SEQ ID NO: 8532341 - DNA, 22 bp, Homo sapiens
cacagtttgcataggaaaaaca

SEQ ID NO: 8532342 - DNA, 22 bp, Homo sapiens
cacagtttgcataggaaaaaca

SEQ ID NO: 8532343 - DNA, 22 bp, Homo sapiens
cacagttatatgttcacaagga

SEQ ID NO: 8532344 - DNA, 22 bp, Homo sapiens
cacagtttatgatctcagtgaa

SEQ ID NO: 8532345 - DNA, 22 bp, Homo sapiens
cacagtttcaataattattctt

SEQ ID NO: 8532346 - DNA, 22 bp, Homo sapiens
cacagtttctataggtcagaat

SEQ ID NO: 8532347 - DNA, 22 bp, Homo sapiens
agcaggctccaggctggccatc

SEQ ID NO: 8532348 - DNA, 22 bp, Homo sapiens
agcaggctccttccttctctgg

SEQ ID NO: 8532349 - DNA, 22 bp, Homo sapiens
agcaggctccttccttctctgg

SEQ ID NO: 8532350 - DNA, 22 bp, Homo sapiens
agcaggcaagcgtgagttctct

SEQ ID NO: 8532351 - DNA, 22 bp, Homo sapiens
agcaggagtttgatgcttttat

SEQ ID NO: 8532352 - DNA, 17 bp, Homo sapiens
agcaggcacgtcagcac

SEQ ID NO: 8532353 - DNA, 22 bp, Homo sapiens
agcaggcacgctccctgcgcga

SEQ ID NO: 8532354 - DNA, 22 bp, Homo sapiens
agcaggcaccagggctcgtcct

SEQ ID NO: 8532355 - DNA, 22 bp, Homo sapiens
agcaggagcccttatcaccagg

SEQ ID NO: 8532356 - DNA, 22 bp, Homo sapiens
agcaggagtgtcccctggctgt

SEQ ID NO: 8532357 - DNA, 22 bp, Homo sapiens
agcaggagcatttccatgattc

SEQ ID NO: 8532358 - DNA, 22 bp, Homo sapiens
agcaggagtttgatgcttttat

SEQ ID NO: 8532359 - DNA, 22 bp, Homo sapiens
agcaggagtgtcccctggctgt

SEQ ID NO: 8532360 - DNA, 22 bp, Homo sapiens
agcaggagtgtcccctggctgt

SEQ ID NO: 8532361 - DNA, 22 bp, Homo sapiens
cacacactggagcaaggagatg

SEQ ID NO: 8532362 - DNA, 22 bp, Homo sapiens
cacacactgttaatgtaggagt

SEQ ID NO: 8532363 - DNA, 22 bp, Homo sapiens
cacacactcttcctggcaccta

SEQ ID NO: 8532364 - DNA, 22 bp, Homo sapiens
cacacactggagcaaggagatg

SEQ ID NO: 8532365 - DNA, 22 bp, Homo sapiens
cacacactgacaccttatcttg

SEQ ID NO: 8532366 - DNA, 22 bp, Homo sapiens
cacacacagttttgtattctgt

SEQ ID NO: 8532367 - DNA, 22 bp, Homo sapiens
cacacacagttttgtattctgt

SEQ ID NO: 8532368 - DNA, 22 bp, Homo sapiens
cacacacagttttgtattctgt

SEQ ID NO: 8532369 - DNA, 22 bp, Homo sapiens
cacacacagttttgtattctgt

SEQ ID NO: 8532370 - DNA, 22 bp, Homo sapiens
agcagctgccactggaatagga

SEQ ID NO: 8532371 - DNA, 21 bp, Homo sapiens
agcagctgcagtttctatctg

SEQ ID NO: 8532372 - DNA, 21 bp, Homo sapiens
agcagctgcagtttctatctg

SEQ ID NO: 8532373 - DNA, 22 bp, Homo sapiens
agcagctgccagagagagttcc

SEQ ID NO: 8532374 - DNA, 22 bp, Homo sapiens
agcagctgccagagagagttcc

SEQ ID NO: 8532375 - DNA, 22 bp, Homo sapiens
agcagctgctccacttgcttaa

SEQ ID NO: 8532376 - DNA, 22 bp, Homo sapiens
cacacaaatattctggaggcaa

SEQ ID NO: 8532377 - DNA, 22 bp, Homo sapiens
cacacaattatgtgtgcacaat

SEQ ID NO: 8532378 - DNA, 22 bp, Homo sapiens
cacacacagttttgtattctgt

SEQ ID NO: 8532379 - DNA, 22 bp, Homo sapiens
agcagctgcagggagggtctgc

SEQ ID NO: 8532380 - DNA, 21 bp, Homo sapiens
agcagctgcagtttctatctg

SEQ ID NO: 8532381 - DNA, 22 bp, Homo sapiens
agcagctgcagagggctccccc

SEQ ID NO: 8532382 - DNA, 22 bp, Homo sapiens
agcagctgatcaaagcacttat

SEQ ID NO: 8532383 - DNA, 22 bp, Homo sapiens
agcagctgatcaaagcacttat

SEQ ID NO: 8532384 - DNA, 22 bp, Homo sapiens
cacaagacttatttgtgtagaa

SEQ ID NO: 8532385 - DNA, 21 bp, Homo sapiens
cacaagacacatagggtgttt

SEQ ID NO: 8532386 - DNA, 21 bp, Homo sapiens
cacaagacacatagggtgttt

SEQ ID NO: 8532387 - DNA, 22 bp, Homo sapiens
cacaagaaataagctgcctttc

SEQ ID NO: 8532388 - DNA, 22 bp, Homo sapiens
cacaagaaataagctgcctttc

SEQ ID NO: 8532389 - DNA, 22 bp, Homo sapiens
cacaagacttatttgtgtagaa

SEQ ID NO: 8532390 - DNA, 22 bp, Homo sapiens
cacaagacttatttgtgtagaa

SEQ ID NO: 8532391 - DNA, 22 bp, Homo sapiens
cacaagagagtgcgcgttgcaa

SEQ ID NO: 8532392 - DNA, 22 bp, Homo sapiens
agcagcagggtgatagtgccca

SEQ ID NO: 8532393 - DNA, 22 bp, Homo sapiens
agcagcagggtgatagtgccca

SEQ ID NO: 8532394 - DNA, 22 bp, Homo sapiens
agcagcagggtcattgctcttt

SEQ ID NO: 8532395 - DNA, 22 bp, Homo sapiens
agcagcagggctctgcccgtgc

SEQ ID NO: 8532396 - DNA, 22 bp, Homo sapiens
agcagcagggctctgcccgtgc

SEQ ID NO: 8532397 - DNA, 22 bp, Homo sapiens
agcagcagggctctgcccgtgc

SEQ ID NO: 8532398 - DNA, 22 bp, Homo sapiens
agcagcagggcatgtcttactc

SEQ ID NO: 8532399 - DNA, 22 bp, Homo sapiens
agcagcagggacaaaggaacag

SEQ ID NO: 8532400 - DNA, 22 bp, Homo sapiens
agcagcagggacaaaggaacag

SEQ ID NO: 8532401 - DNA, 22 bp, Homo sapiens
agcagcagggacaaaggaacag

SEQ ID NO: 8532402 - DNA, 21 bp, Homo sapiens
agcagcagggaagcctcatcc

SEQ ID NO: 8532403 - DNA, 21 bp, Homo sapiens
agcagcagggaagcctcatcc

SEQ ID NO: 8532404 - DNA, 22 bp, Homo sapiens
agcagcaggcttaaggaaaagt

SEQ ID NO: 8532405 - DNA, 22 bp, Homo sapiens
agcagcaggcttaaggaaaagt

SEQ ID NO: 8532406 - DNA, 22 bp, Homo sapiens
agcagccaattggaggatgaag

SEQ ID NO: 8532407 - DNA, 22 bp, Homo sapiens
agcagccacagtctgggacagg

SEQ ID NO: 8532408 - DNA, 22 bp, Homo sapiens
agcagccacagtctgggacagg

SEQ ID NO: 8532409 - DNA, 22 bp, Homo sapiens
agcagctcccctcatgctccac

SEQ ID NO: 8532410 - DNA, 22 bp, Homo sapiens
agcagccagaaatccagaggtg

SEQ ID NO: 8532411 - DNA, 22 bp, Homo sapiens
agcagctccctcctcagccacc

SEQ ID NO: 8532412 - DNA, 22 bp, Homo sapiens
cacaaggacctcagatggatga

SEQ ID NO: 8532413 - DNA, 22 bp, Homo sapiens
cacaagctccttatgtggagaa

SEQ ID NO: 8532414 - DNA, 22 bp, Homo sapiens
cacaaggacatgtatatttatg

SEQ ID NO: 8532415 - DNA, 22 bp, Homo sapiens
cacaaggactggatggagtggg

SEQ ID NO: 8532416 - DNA, 22 bp, Homo sapiens
cacaaggaggtcctgaggaagc

SEQ ID NO: 8532417 - DNA, 22 bp, Homo sapiens
cacaagatggtcacataagtgc

SEQ ID NO: 8532418 - DNA, 22 bp, Homo sapiens
cacaagatggtcacataagtgc

SEQ ID NO: 8532419 - DNA, 22 bp, Homo sapiens
cacaagggagcttagaaaacat

SEQ ID NO: 8532420 - DNA, 22 bp, Homo sapiens
caagagacttatgtggaaacct

SEQ ID NO: 8532421 - DNA, 17 bp, Homo sapiens
caagagagatgactgga

SEQ ID NO: 8532422 - DNA, 22 bp, Homo sapiens
caagagagatgcagctcactca

SEQ ID NO: 8532423 - DNA, 22 bp, Homo sapiens
caagagcctttgggcagaagga

SEQ ID NO: 8532424 - DNA, 22 bp, Homo sapiens
caagagcatttagttagctggt

SEQ ID NO: 8532425 - DNA, 22 bp, Homo sapiens
caagatttatattttcacacaa

SEQ ID NO: 8532426 - DNA, 22 bp, Homo sapiens
caagatttagcctgctgcctgt

SEQ ID NO: 8532427 - DNA, 22 bp, Homo sapiens
caagagctagactttgtcagga

SEQ ID NO: 8532428 - DNA, 19 bp, Homo sapiens
caagatttgttcacacatg

SEQ ID NO: 8532429 - DNA, 22 bp, Homo sapiens
caagatttgacttcgtggtttg

SEQ ID NO: 8532430 - DNA, 22 bp, Homo sapiens
caagatttccaaccctgggtaa

SEQ ID NO: 8532431 - DNA, 22 bp, Homo sapiens
caagatttggcaactttgtcat

SEQ ID NO: 8532432 - DNA, 22 bp, Homo sapiens
caagcagaaatctagaactcca

SEQ ID NO: 8532433 - DNA, 22 bp, Homo sapiens
caagcaatgctatactcattat

SEQ ID NO: 8532434 - DNA, 22 bp, Homo sapiens
caagcaacgactttcaagctgt

SEQ ID NO: 8532435 - DNA, 22 bp, Homo sapiens
caagcagacagtaggcctagaa

SEQ ID NO: 8532436 - DNA, 22 bp, Homo sapiens
agcagcaggctagggaactgct

SEQ ID NO: 8532437 - DNA, 22 bp, Homo sapiens
agcagcaggctagggaactgct

SEQ ID NO: 8532438 - DNA, 22 bp, Homo sapiens
agcagcaggctagggaactgct

SEQ ID NO: 8532439 - DNA, 22 bp, Homo sapiens
agcagcaggctagggaactgct

SEQ ID NO: 8532440 - DNA, 22 bp, Homo sapiens
agcagcaggattttcgttggga

SEQ ID NO: 8532441 - DNA, 22 bp, Homo sapiens
agcagcaggctagggaactgct

SEQ ID NO: 8532442 - DNA, 23 bp, Homo sapiens
agcagcaggaggtattgataagg

SEQ ID NO: 8532443 - DNA, 23 bp, Homo sapiens
agcagcaggaggtattgataagg

SEQ ID NO: 8532444 - DNA, 22 bp, Homo sapiens
agcagcaggctgtgtggactga

SEQ ID NO: 8532445 - DNA, 22 bp, Homo sapiens
agcagcaggctgtgtggactga

SEQ ID NO: 8532446 - DNA, 22 bp, Homo sapiens
agcagcaggctgtgtggactga

SEQ ID NO: 8532447 - DNA, 22 bp, Homo sapiens
agcagcaggctgtgtggactga

SEQ ID NO: 8532448 - DNA, 22 bp, Homo sapiens
agcagcaggctgggatgagtct

SEQ ID NO: 8532449 - DNA, 22 bp, Homo sapiens
agcagcaggctgggatgagtct

SEQ ID NO: 8532450 - DNA, 22 bp, Homo sapiens
caagcagagactagatagctgt

SEQ ID NO: 8532451 - DNA, 22 bp, Homo sapiens
caagcagagactagatagctgt

SEQ ID NO: 8532452 - DNA, 22 bp, Homo sapiens
caagcagagactagatagctgt

SEQ ID NO: 8532453 - DNA, 22 bp, Homo sapiens
agcagcagctctgttgccctac

SEQ ID NO: 8532454 - DNA, 20 bp, Homo sapiens
agcagcagatgttggaggtg

SEQ ID NO: 8532455 - DNA, 22 bp, Homo sapiens
agcagcaggagccgtggggtga

SEQ ID NO: 8532456 - DNA, 22 bp, Homo sapiens
agcagcaggagccgtggggtga

SEQ ID NO: 8532457 - DNA, 22 bp, Homo sapiens
agcagcaggaggccattgtctt

SEQ ID NO: 8532458 - DNA, 22 bp, Homo sapiens
agcagcaggaggctgtccacca

SEQ ID NO: 8532459 - DNA, 22 bp, Homo sapiens
agcagcaggaggctgtccacca

SEQ ID NO: 8532460 - DNA, 22 bp, Homo sapiens
agcagcaggaggctgtccacca

SEQ ID NO: 8532461 - DNA, 22 bp, Homo sapiens
agcacaggtgaaacagtcaggt

SEQ ID NO: 8532462 - DNA, 22 bp, Homo sapiens
agcacaggtgaaacagtcaggt

SEQ ID NO: 8532463 - DNA, 22 bp, Homo sapiens
agcacaggtgaaacagtcaggt

SEQ ID NO: 8532464 - DNA, 22 bp, Homo sapiens
agcacaggtgaaacagtcaggt

SEQ ID NO: 8532465 - DNA, 22 bp, Homo sapiens
agcacaggtgaaacagtcaggt

SEQ ID NO: 8532466 - DNA, 22 bp, Homo sapiens
agcacaggtgaaacagtcaggt

SEQ ID NO: 8532467 - DNA, 22 bp, Homo sapiens
agcacagtaaagcagtgtcaca

SEQ ID NO: 8532468 - DNA, 22 bp, Homo sapiens
agcacagtttcttttccttgtc

SEQ ID NO: 8532469 - DNA, 19 bp, Homo sapiens
agcacagtttccacatgca

SEQ ID NO: 8532470 - DNA, 22 bp, Homo sapiens
agcacagttttcattgcagggt

SEQ ID NO: 8532471 - DNA, 22 bp, Homo sapiens
agcacagtggcttctatgtcta

SEQ ID NO: 8532472 - DNA, 22 bp, Homo sapiens
agcacagtgctctggacagagt

SEQ ID NO: 8532473 - DNA, 22 bp, Homo sapiens
agcacatgacttttagtcgagt

SEQ ID NO: 8532474 - DNA, 22 bp, Homo sapiens
agcacatgcacagtgctacact

SEQ ID NO: 8532475 - DNA, 22 bp, Homo sapiens
agcacatgcacagtgctacact

SEQ ID NO: 8532476 - DNA, 22 bp, Homo sapiens
agcacatgcacagtgctacact

SEQ ID NO: 8532477 - DNA, 22 bp, Homo sapiens
agcacatgtattctccttgaat

SEQ ID NO: 8532478 - DNA, 22 bp, Homo sapiens
agcacatgcacagtgctacact

SEQ ID NO: 8532479 - DNA, 22 bp, Homo sapiens
caaatagattgttcaatcctga

SEQ ID NO: 8532480 - DNA, 22 bp, Homo sapiens
caaatagattgttcaatcctga

SEQ ID NO: 8532481 - DNA, 21 bp, Homo sapiens
agcacagctttaagccatgtg

SEQ ID NO: 8532482 - DNA, 21 bp, Homo sapiens
agcacagctttaagccatgtg

SEQ ID NO: 8532483 - DNA, 21 bp, Homo sapiens
agcacagctttaagccatgtg

SEQ ID NO: 8532484 - DNA, 22 bp, Homo sapiens
agcacaggtacggagatgctac

SEQ ID NO: 8532485 - DNA, 22 bp, Homo sapiens
agcaaagctaccaattattgag

SEQ ID NO: 8532486 - DNA, 18 bp, Homo sapiens
agcaaagcaagagatcac

SEQ ID NO: 8532487 - DNA, 22 bp, Homo sapiens
agcaaagcaccatatggcagtt

SEQ ID NO: 8532488 - DNA, 18 bp, Homo sapiens
agcaaagcaagagatcac

SEQ ID NO: 8532489 - DNA, 22 bp, Homo sapiens
agcaaagcagtggctaagctga

SEQ ID NO: 8532490 - DNA, 22 bp, Homo sapiens
agcaaagcaccatatggcagtt

SEQ ID NO: 8532491 - DNA, 22 bp, Homo sapiens
agcaaagcagtggctaagctga

SEQ ID NO: 8532492 - DNA, 22 bp, Homo sapiens
agcaaagcactttgcatacata

SEQ ID NO: 8532493 - DNA, 22 bp, Homo sapiens
agcaaagccgagacagccagtg

SEQ ID NO: 8532494 - DNA, 22 bp, Homo sapiens
agcaaagcatcactccaatctg

SEQ ID NO: 8532495 - DNA, 22 bp, Homo sapiens
agcaaactaattgcagttctgg

SEQ ID NO: 8532496 - DNA, 22 bp, Homo sapiens
caaaagttctcacccagacatg

SEQ ID NO: 8532497 - DNA, 23 bp, Homo sapiens
caaaagttagcccttcccatctc

SEQ ID NO: 8532498 - DNA, 22 bp, Homo sapiens
caaaagtctgtcctttaacttc

SEQ ID NO: 8532499 - DNA, 22 bp, Homo sapiens
agcaaagaaatggaggctcaga

SEQ ID NO: 8532500 - DNA, 22 bp, Homo sapiens
agcaaagaagacacaggcttca

SEQ ID NO: 8532501 - DNA, 22 bp, Homo sapiens
agcaaagaagacacaggcttca

SEQ ID NO: 8532502 - DNA, 22 bp, Homo sapiens
agcaaagaagggttcttcatta

SEQ ID NO: 8532503 - DNA, 22 bp, Homo sapiens
agcaaagacagggacgaccaag

SEQ ID NO: 8532504 - DNA, 23 bp, Homo sapiens
caacactgccttcaggtgaagaa

SEQ ID NO: 8532505 - DNA, 22 bp, Homo sapiens
caacagaaggaagcagggtcag

SEQ ID NO: 8532506 - DNA, 22 bp, Homo sapiens
caacagaaggaagcagggtcag

SEQ ID NO: 8532507 - DNA, 20 bp, Homo sapiens
caacactgcccattgtttgc

SEQ ID NO: 8532508 - DNA, 22 bp, Homo sapiens
caaattaatgtgtctcaaaata

SEQ ID NO: 8532509 - DNA, 22 bp, Homo sapiens
caaattaccctcaacatctaga

SEQ ID NO: 8532510 - DNA, 22 bp, Homo sapiens
caaatagtgtcacattgtgagg

SEQ ID NO: 8532511 - DNA, 22 bp, Homo sapiens
caaatatctttggcaaagagaa

SEQ ID NO: 8532512 - DNA, 22 bp, Homo sapiens
caaatatctttggcaaagagaa

SEQ ID NO: 8532513 - DNA, 22 bp, Homo sapiens
caaatattccaggtacatccct

SEQ ID NO: 8532514 - DNA, 22 bp, Homo sapiens
caacagacctggattcaaaaac

SEQ ID NO: 8532515 - DNA, 22 bp, Homo sapiens
caacagagagaccagaaacagg

SEQ ID NO: 8532516 - DNA, 22 bp, Homo sapiens
caacagagagaccagaaacagg

SEQ ID NO: 8532517 - DNA, 22 bp, Homo sapiens
caacagaaggtgtactactgaa

SEQ ID NO: 8532518 - DNA, 22 bp, Homo sapiens
caacagagcagttgatcaggaa

SEQ ID NO: 8532519 - DNA, 20 bp, Homo sapiens
caacagaggggtctggagta

SEQ ID NO: 8532520 - DNA, 22 bp, Homo sapiens
caacagagggaatggatctcat

SEQ ID NO: 8532521 - DNA, 22 bp, Homo sapiens
caacagctcagacacgggacct

SEQ ID NO: 8532522 - DNA, 22 bp, Homo sapiens
caacagctgatctttgatgaag

SEQ ID NO: 8532523 - DNA, 22 bp, Homo sapiens
caacagctgatctttgatgaag

SEQ ID NO: 8532524 - DNA, 23 bp, Homo sapiens
caacagctgttagatatgggctt

SEQ ID NO: 8532525 - DNA, 22 bp, Homo sapiens
caacagctggaggcttggcccg

SEQ ID NO: 8532526 - DNA, 22 bp, Homo sapiens
agcacattagtatctaagaaca

SEQ ID NO: 8532527 - DNA, 22 bp, Homo sapiens
agcacattagtatctaagaaca

SEQ ID NO: 8532528 - DNA, 22 bp, Homo sapiens
caacagctttagaaacactttc

SEQ ID NO: 8532529 - DNA, 22 bp, Homo sapiens
caacagctttagaaacactttc

SEQ ID NO: 8532530 - DNA, 22 bp, Homo sapiens
agcaccaggctgttggaagccc

SEQ ID NO: 8532531 - DNA, 22 bp, Homo sapiens
agcaccaggtcgctggcacgct

SEQ ID NO: 8532532 - DNA, 22 bp, Homo sapiens
agcaccaggccatggggtccct

SEQ ID NO: 8532533 - DNA, 22 bp, Homo sapiens
agcaccaggcagtatatcaaag

SEQ ID NO: 8532534 - DNA, 22 bp, Homo sapiens
caacttggctctctggctatcc

SEQ ID NO: 8532535 - DNA, 22 bp, Homo sapiens
caactttaaatggctatgtctg

SEQ ID NO: 8532536 - DNA, 22 bp, Homo sapiens
caagacatgcaattgccacttt

SEQ ID NO: 8532537 - DNA, 21 bp, Homo sapiens
caagacatatgagtactctgg

SEQ ID NO: 8532538 - DNA, 21 bp, Homo sapiens
caagacatatgagtactctgg

SEQ ID NO: 8532539 - DNA, 22 bp, Homo sapiens
caagacattgattttgtacaga

SEQ ID NO: 8532540 - DNA, 22 bp, Homo sapiens
caagacctcaaaatgagagggg

SEQ ID NO: 8532541 - DNA, 22 bp, Homo sapiens
agcacattctgccttgctttgc

SEQ ID NO: 8532542 - DNA, 22 bp, Homo sapiens
agcacatttaagtatgaaatat

SEQ ID NO: 8532543 - DNA, 22 bp, Homo sapiens
agcaccagagctatgggcctgc

SEQ ID NO: 8532544 - DNA, 16 bp, Homo sapiens
agcaccagatcatatc

SEQ ID NO: 8532545 - DNA, 22 bp, Homo sapiens
agcaccagagctatgggcctgc

SEQ ID NO: 8532546 - DNA, 22 bp, Homo sapiens
agcacattttatttaagaaaat

SEQ ID NO: 8532547 - DNA, 22 bp, Homo sapiens
agcacattttatttaagaaaat

SEQ ID NO: 8532548 - DNA, 22 bp, Homo sapiens
agcaccagcgtgggggccgttg

SEQ ID NO: 8532549 - DNA, 22 bp, Homo sapiens
agcaccagcaactatgggctgc

SEQ ID NO: 8532550 - DNA, 22 bp, Homo sapiens
agcaccagcgtgggggccgttg

SEQ ID NO: 8532551 - DNA, 22 bp, Homo sapiens
agcaccagctcaaggtgcacct

SEQ ID NO: 8532552 - DNA, 22 bp, Homo sapiens
agcaccagctcaaggtgcacct

SEQ ID NO: 8532553 - DNA, 22 bp, Homo sapiens
agcaccagcaactatgggctgc

SEQ ID NO: 8532554 - DNA, 22 bp, Homo sapiens
agcaccagcaactatgggctgc

SEQ ID NO: 8532555 - DNA, 22 bp, Homo sapiens
agcaccagcaactatgggctgc

SEQ ID NO: 8532556 - DNA, 22 bp, Homo sapiens
agcaccaggcaccaaagggcct

SEQ ID NO: 8532557 - DNA, 23 bp, Homo sapiens
agcaccaggaacagtgtggtcct

SEQ ID NO: 8532558 - DNA, 22 bp, Homo sapiens
agcaccaggatattgttggaga

SEQ ID NO: 8532559 - DNA, 23 bp, Homo sapiens
agcaccaggaacagtgtggtcct

SEQ ID NO: 8532560 - DNA, 22 bp, Homo sapiens
agcaccaggaaagaaggggcca

SEQ ID NO: 8532561 - DNA, 23 bp, Homo sapiens
cagaggcatcggattcaacatca

SEQ ID NO: 8532562 - DNA, 23 bp, Homo sapiens
cagaggcatcggattcaacatca

SEQ ID NO: 8532563 - DNA, 23 bp, Homo sapiens
cagaggcatcggattcaacatca

SEQ ID NO: 8532564 - DNA, 22 bp, Homo sapiens
cagaggcattactgaaaaggtg

SEQ ID NO: 8532565 - DNA, 22 bp, Homo sapiens
cagaggcattactgaaaaggtg

SEQ ID NO: 8532566 - DNA, 20 bp, Homo sapiens
cagaggcattttcagactct

SEQ ID NO: 8532567 - DNA, 22 bp, Homo sapiens
agcccaggcagagggatgcttg

SEQ ID NO: 8532568 - DNA, 22 bp, Homo sapiens
agcccaggcagagggatgcttg

SEQ ID NO: 8532569 - DNA, 21 bp, Homo sapiens
cagaggcaggtcctgggacgg

SEQ ID NO: 8532570 - DNA, 21 bp, Homo sapiens
cagaggcaggtcctgggacgg

SEQ ID NO: 8532571 - DNA, 22 bp, Homo sapiens
cagaggcagtggggttgctcct

SEQ ID NO: 8532572 - DNA, 22 bp, Homo sapiens
cagaggcagtggggttgctcct

SEQ ID NO: 8532573 - DNA, 22 bp, Homo sapiens
cagaggcagtggggttgctcct

SEQ ID NO: 8532574 - DNA, 22 bp, Homo sapiens
cagaggcatactcccagtcttg

SEQ ID NO: 8532575 - DNA, 22 bp, Homo sapiens
agcccagccggattcccagttc

SEQ ID NO: 8532576 - DNA, 22 bp, Homo sapiens
cagaggagttcagtacacagcc

SEQ ID NO: 8532577 - DNA, 22 bp, Homo sapiens
agcccagccggattcccagttc

SEQ ID NO: 8532578 - DNA, 22 bp, Homo sapiens
cagaggagttcagtacacagcc

SEQ ID NO: 8532579 - DNA, 22 bp, Homo sapiens
cagagggagccctccaggagca

SEQ ID NO: 8532580 - DNA, 22 bp, Homo sapiens
cagagggaccagaacatactgt

SEQ ID NO: 8532581 - DNA, 22 bp, Homo sapiens
cagagggagccctccaggagca

SEQ ID NO: 8532582 - DNA, 22 bp, Homo sapiens
cagagggagccctccaggagca

SEQ ID NO: 8532583 - DNA, 22 bp, Homo sapiens
cagaggctcttcctcactgccc

SEQ ID NO: 8532584 - DNA, 22 bp, Homo sapiens
cagaggctgacaaaatattgct

SEQ ID NO: 8532585 - DNA, 22 bp, Homo sapiens
agcccaggctggagtgcagtgg

SEQ ID NO: 8532586 - DNA, 22 bp, Homo sapiens
agcccaggctggagtgcagtgg

SEQ ID NO: 8532587 - DNA, 22 bp, Homo sapiens
agcccaggctggagtgcagtgg

SEQ ID NO: 8532588 - DNA, 20 bp, Homo sapiens
agcccaggcctgtgtgagtc

SEQ ID NO: 8532589 - DNA, 20 bp, Homo sapiens
agcccaggcctgtgtgagtc

SEQ ID NO: 8532590 - DNA, 23 bp, Homo sapiens
agcccagcagagaacctaggtcc

SEQ ID NO: 8532591 - DNA, 22 bp, Homo sapiens
agcccagcactgggggcccagc

SEQ ID NO: 8532592 - DNA, 22 bp, Homo sapiens
agcccagcagaaagtccagcct

SEQ ID NO: 8532593 - DNA, 23 bp, Homo sapiens
agcccagcagagaacctaggtcc

SEQ ID NO: 8532594 - DNA, 23 bp, Homo sapiens
agcccagcagagaacctaggtcc

SEQ ID NO: 8532595 - DNA, 22 bp, Homo sapiens
agcccagcagtaagattagaga

SEQ ID NO: 8532596 - DNA, 22 bp, Homo sapiens
agcccagcccgggctgcgcttt

SEQ ID NO: 8532597 - DNA, 22 bp, Homo sapiens
agcccagccactattaaatgtt

SEQ ID NO: 8532598 - DNA, 22 bp, Homo sapiens
agcccagcccgggctgcgcttt

SEQ ID NO: 8532599 - DNA, 22 bp, Homo sapiens
agcccagcactgggggcccagc

SEQ ID NO: 8532600 - DNA, 22 bp, Homo sapiens
agcccagcaaagggaggttcag

SEQ ID NO: 8532601 - DNA, 22 bp, Homo sapiens
agcccagcaaaggggtttgaga

SEQ ID NO: 8532602 - DNA, 22 bp, Homo sapiens
agcccagcaaagggaggttcag

SEQ ID NO: 8532603 - DNA, 22 bp, Homo sapiens
agcccagcaaagggaggttcag

SEQ ID NO: 8532604 - DNA, 22 bp, Homo sapiens
agcccagcagaaagtccagcct

SEQ ID NO: 8532605 - DNA, 22 bp, Homo sapiens
agcccagcagaaagtccagcct

SEQ ID NO: 8532606 - DNA, 22 bp, Homo sapiens
agcccagagggtagcagaagaa

SEQ ID NO: 8532607 - DNA, 22 bp, Homo sapiens
agcccagaggctgggcgtgcat

SEQ ID NO: 8532608 - DNA, 22 bp, Homo sapiens
agcccagataaagtacaaccat

SEQ ID NO: 8532609 - DNA, 22 bp, Homo sapiens
agcccagagccccggccatgtt

SEQ ID NO: 8532610 - DNA, 22 bp, Homo sapiens
agcccagagccccggccatgtt

SEQ ID NO: 8532611 - DNA, 22 bp, Homo sapiens
agcccaaggcttccctgctggc

SEQ ID NO: 8532612 - DNA, 23 bp, Homo sapiens
agcccaccttgttagtcctgtgg

SEQ ID NO: 8532613 - DNA, 22 bp, Homo sapiens
cagagaaactcagatagctgat

SEQ ID NO: 8532614 - DNA, 22 bp, Homo sapiens
cagagaaactcagatagctgat

SEQ ID NO: 8532615 - DNA, 22 bp, Homo sapiens
cagagaaactcagatagctgat

SEQ ID NO: 8532616 - DNA, 22 bp, Homo sapiens
cagagaaaaaatcctgctctca

SEQ ID NO: 8532617 - DNA, 22 bp, Homo sapiens
cagagaaaaaatcctgctctca

SEQ ID NO: 8532618 - DNA, 22 bp, Homo sapiens
cagagaaactcagatagctgat

SEQ ID NO: 8532619 - DNA, 22 bp, Homo sapiens
cagagaaactcagatagctgat

SEQ ID NO: 8532620 - DNA, 22 bp, Homo sapiens
cagagaaagaagcccattcatt

SEQ ID NO: 8532621 - DNA, 22 bp, Homo sapiens
cagactttctgactcccttgcc

SEQ ID NO: 8532622 - DNA, 22 bp, Homo sapiens
cagactttcaaggagtgaaggc

SEQ ID NO: 8532623 - DNA, 22 bp, Homo sapiens
cagacatggcgccaagtgctag

SEQ ID NO: 8532624 - DNA, 22 bp, Homo sapiens
cagacatggaaatttagtgtta

SEQ ID NO: 8532625 - DNA, 22 bp, Homo sapiens
cagacttttgacattaatacag

SEQ ID NO: 8532626 - DNA, 22 bp, Homo sapiens
cagagaaagaagcccattcatt

SEQ ID NO: 8532627 - DNA, 22 bp, Homo sapiens
cagagaaagacttgcccttagt

SEQ ID NO: 8532628 - DNA, 22 bp, Homo sapiens
cagagaaagggtgaattccttc

SEQ ID NO: 8532629 - DNA, 22 bp, Homo sapiens
cagagaaagggtgaattccttc

SEQ ID NO: 8532630 - DNA, 22 bp, Homo sapiens
cagagaaagggtgaattccttc

SEQ ID NO: 8532631 - DNA, 22 bp, Homo sapiens
cagagaaagggtgaattccttc

SEQ ID NO: 8532632 - DNA, 22 bp, Homo sapiens
agccatcatttctgtcactggc

SEQ ID NO: 8532633 - DNA, 22 bp, Homo sapiens
agccatcacttgagaatctatt

SEQ ID NO: 8532634 - DNA, 22 bp, Homo sapiens
agccatcctactacctcagcat

SEQ ID NO: 8532635 - DNA, 22 bp, Homo sapiens
agcccaagctatgaggtgacct

SEQ ID NO: 8532636 - DNA, 22 bp, Homo sapiens
agccacaggaaacagagacagc

SEQ ID NO: 8532637 - DNA, 22 bp, Homo sapiens
agccacaggaaacagagacagc

SEQ ID NO: 8532638 - DNA, 22 bp, Homo sapiens
agccacaggaaacagagacagc

SEQ ID NO: 8532639 - DNA, 22 bp, Homo sapiens
agccacaggaaacagagacagc

SEQ ID NO: 8532640 - DNA, 22 bp, Homo sapiens
agcatataggaaatgttgaatc

SEQ ID NO: 8532641 - DNA, 22 bp, Homo sapiens
agccacaggaaacagagacagc

SEQ ID NO: 8532642 - DNA, 22 bp, Homo sapiens
agcatatacaaactcatataca

SEQ ID NO: 8532643 - DNA, 22 bp, Homo sapiens
agccacagtctgtagccagctt

SEQ ID NO: 8532644 - DNA, 22 bp, Homo sapiens
agccacagtctgtagccagctt

SEQ ID NO: 8532645 - DNA, 22 bp, Homo sapiens
agccacagtgcaagagagaaaa

SEQ ID NO: 8532646 - DNA, 22 bp, Homo sapiens
agcatataaatggacatatttg

SEQ ID NO: 8532647 - DNA, 22 bp, Homo sapiens
agcatataaatggacatatttg

SEQ ID NO: 8532648 - DNA, 22 bp, Homo sapiens
agcatagatacattgagccaca

SEQ ID NO: 8532649 - DNA, 22 bp, Homo sapiens
agccacagtgcaagagagaaaa

SEQ ID NO: 8532650 - DNA, 22 bp, Homo sapiens
agccacagtgcaagagagaaaa

SEQ ID NO: 8532651 - DNA, 22 bp, Homo sapiens
agccacagtgggctaccagctc

SEQ ID NO: 8532652 - DNA, 22 bp, Homo sapiens
agccacctctatcttgggctcc

SEQ ID NO: 8532653 - DNA, 22 bp, Homo sapiens
agccacctcctgctctgctcac

SEQ ID NO: 8532654 - DNA, 22 bp, Homo sapiens
agccacctcctgctctgctcac

SEQ ID NO: 8532655 - DNA, 22 bp, Homo sapiens
agccacctctgtgcaggcctcg

SEQ ID NO: 8532656 - DNA, 22 bp, Homo sapiens
cagaaatatttattgagtgaca

SEQ ID NO: 8532657 - DNA, 22 bp, Homo sapiens
cagaaatattccaagtactgca

SEQ ID NO: 8532658 - DNA, 22 bp, Homo sapiens
cagaaatatgtgccatgcctta

SEQ ID NO: 8532659 - DNA, 18 bp, Homo sapiens
cagaaatcacaccagcac

SEQ ID NO: 8532660 - DNA, 18 bp, Homo sapiens
cagaaatcacaccagcac

SEQ ID NO: 8532661 - DNA, 18 bp, Homo sapiens
cagaaatcacaccagcac

SEQ ID NO: 8532662 - DNA, 22 bp, Homo sapiens
cagaaatatttattgagtgaca

SEQ ID NO: 8532663 - DNA, 22 bp, Homo sapiens
cagaataatattggtctcatag

SEQ ID NO: 8532664 - DNA, 22 bp, Homo sapiens
cagaataagctgtgttgtcaag

SEQ ID NO: 8532665 - DNA, 22 bp, Homo sapiens
agccactgtaaggggaattgcc

SEQ ID NO: 8532666 - DNA, 22 bp, Homo sapiens
agccactggcctgggcagctct

SEQ ID NO: 8532667 - DNA, 22 bp, Homo sapiens
cagaaatatcagttgaaagtgc

SEQ ID NO: 8532668 - DNA, 22 bp, Homo sapiens
cagaaatatcacctggactcta

SEQ ID NO: 8532669 - DNA, 22 bp, Homo sapiens
cagaaatatcagttgaaagtgc

SEQ ID NO: 8532670 - DNA, 22 bp, Homo sapiens
cagaatgagataacccagattg

SEQ ID NO: 8532671 - DNA, 22 bp, Homo sapiens
cagaatgcaaattttataatat

SEQ ID NO: 8532672 - DNA, 22 bp, Homo sapiens
cagaatgagtagcatcttcacc

SEQ ID NO: 8532673 - DNA, 22 bp, Homo sapiens
cagaatatgacaagattttcct

SEQ ID NO: 8532674 - DNA, 22 bp, Homo sapiens
agccagaaaggggcattatctg

SEQ ID NO: 8532675 - DNA, 19 bp, Homo sapiens
agccagaactagtgtttct

SEQ ID NO: 8532676 - DNA, 22 bp, Homo sapiens
agccagaaccactggaacggtg

SEQ ID NO: 8532677 - DNA, 22 bp, Homo sapiens
agccactgtgtgaccagctgtc

SEQ ID NO: 8532678 - DNA, 22 bp, Homo sapiens
cagaatgtagatcatcatcaag

SEQ ID NO: 8532679 - DNA, 22 bp, Homo sapiens
cagaatgtatatgatctaaggt

SEQ ID NO: 8532680 - DNA, 22 bp, Homo sapiens
cagaatgtattctcataaagcc

SEQ ID NO: 8532681 - DNA, 22 bp, Homo sapiens
cagacagtggacttgataaagg

SEQ ID NO: 8532682 - DNA, 22 bp, Homo sapiens
cagacagtggacttgataaagg

SEQ ID NO: 8532683 - DNA, 22 bp, Homo sapiens
cagacagtggacttgataaagg

SEQ ID NO: 8532684 - DNA, 22 bp, Homo sapiens
cagacaggtagggacagaacat

SEQ ID NO: 8532685 - DNA, 22 bp, Homo sapiens
cagacaggttgcaaaacttcaa

SEQ ID NO: 8532686 - DNA, 22 bp, Homo sapiens
cagacatctgtacccagcctgt

SEQ ID NO: 8532687 - DNA, 22 bp, Homo sapiens
cagacatcacactcagattgca

SEQ ID NO: 8532688 - DNA, 22 bp, Homo sapiens
cagacatgatgtaagcagaggc

SEQ ID NO: 8532689 - DNA, 22 bp, Homo sapiens
cagacatgatgtaagcagaggc

SEQ ID NO: 8532690 - DNA, 21 bp, Homo sapiens
cagacatgagtctcagctttg

SEQ ID NO: 8532691 - DNA, 22 bp, Homo sapiens
agccagacatggctcctgctcc

SEQ ID NO: 8532692 - DNA, 22 bp, Homo sapiens
agccagacatggctcctgctcc

SEQ ID NO: 8532693 - DNA, 20 bp, Homo sapiens
agccagaagaaggctggaga

SEQ ID NO: 8532694 - DNA, 22 bp, Homo sapiens
agccagagactttacctgtgca

SEQ ID NO: 8532695 - DNA, 22 bp, Homo sapiens
agccagagactttacctgtgca

SEQ ID NO: 8532696 - DNA, 22 bp, Homo sapiens
cagacagggtgggtttctgggc

SEQ ID NO: 8532697 - DNA, 22 bp, Homo sapiens
cagacagggtgggtttctgggc

SEQ ID NO: 8532698 - DNA, 22 bp, Homo sapiens
agccagagagccccaggttcta

SEQ ID NO: 8532699 - DNA, 22 bp, Homo sapiens
agccagagagccccaggttcta

SEQ ID NO: 8532700 - DNA, 22 bp, Homo sapiens
agccagagagccccaggttcta

SEQ ID NO: 8532701 - DNA, 22 bp, Homo sapiens
cagacaggaagttcagaagaaa

SEQ ID NO: 8532702 - DNA, 22 bp, Homo sapiens
agccagagagtgttggagatgt

SEQ ID NO: 8532703 - DNA, 22 bp, Homo sapiens
cagccctgcacgctgcctccgc

SEQ ID NO: 8532704 - DNA, 22 bp, Homo sapiens
cagccctgcacgctgcctccgc

SEQ ID NO: 8532705 - DNA, 22 bp, Homo sapiens
cagccctgcacgctgcctccgc

SEQ ID NO: 8532706 - DNA, 22 bp, Homo sapiens
cagccctgcagagggcgctcct

SEQ ID NO: 8532707 - DNA, 22 bp, Homo sapiens
agctcagagaatagggcttgag

SEQ ID NO: 8532708 - DNA, 22 bp, Homo sapiens
cagccctgcagagggcgctcct

SEQ ID NO: 8532709 - DNA, 22 bp, Homo sapiens
cagccctgagttagcccacgga

SEQ ID NO: 8532710 - DNA, 22 bp, Homo sapiens
cagccctgagttagcccacgga

SEQ ID NO: 8532711 - DNA, 22 bp, Homo sapiens
cagccctgagttagcccacgga

SEQ ID NO: 8532712 - DNA, 22 bp, Homo sapiens
cagccctgagcaaggcttttaa

SEQ ID NO: 8532713 - DNA, 16 bp, Homo sapiens
cagccctgaggaagaa

SEQ ID NO: 8532714 - DNA, 22 bp, Homo sapiens
cagccctgagagaaccatctat

SEQ ID NO: 8532715 - DNA, 22 bp, Homo sapiens
cagccctgagagaaccatctat

SEQ ID NO: 8532716 - DNA, 22 bp, Homo sapiens
cagccctgagagaaccatctat

SEQ ID NO: 8532717 - DNA, 22 bp, Homo sapiens
cagccctgagagaaccatctat

SEQ ID NO: 8532718 - DNA, 22 bp, Homo sapiens
cagccctgagaaggaggatctc

SEQ ID NO: 8532719 - DNA, 23 bp, Homo sapiens
cagccctgaaatcgaggtgacac

SEQ ID NO: 8532720 - DNA, 23 bp, Homo sapiens
cagccctgaaatcgaggtgacac

SEQ ID NO: 8532721 - DNA, 22 bp, Homo sapiens
cagcatattactttaaaaaatc

SEQ ID NO: 8532722 - DNA, 22 bp, Homo sapiens
cagccccagcacttagctgagt

SEQ ID NO: 8532723 - DNA, 22 bp, Homo sapiens
cagccccatggtgtgctccagc

SEQ ID NO: 8532724 - DNA, 22 bp, Homo sapiens
cagcatatctgagttgaaagag

SEQ ID NO: 8532725 - DNA, 22 bp, Homo sapiens
cagcagtgtggaagctgagggg

SEQ ID NO: 8532726 - DNA, 22 bp, Homo sapiens
cagcagtgtggaagctgagggg

SEQ ID NO: 8532727 - DNA, 22 bp, Homo sapiens
cagcagtgtggaagctgagggg

SEQ ID NO: 8532728 - DNA, 22 bp, Homo sapiens
cagcagttatgagtagaatagt

SEQ ID NO: 8532729 - DNA, 22 bp, Homo sapiens
cagcagttcaatccagtgcacg

SEQ ID NO: 8532730 - DNA, 21 bp, Homo sapiens
cagcagtgtgtctgagctaga

SEQ ID NO: 8532731 - DNA, 22 bp, Homo sapiens
cagcagtgtgcaggtgtgctgg

SEQ ID NO: 8532732 - DNA, 22 bp, Homo sapiens
cagcagtgtctccagcatcaca

SEQ ID NO: 8532733 - DNA, 22 bp, Homo sapiens
cagcagtgtctccagcatcaca

SEQ ID NO: 8532734 - DNA, 22 bp, Homo sapiens
cagcagtgtctccagcatcaca

SEQ ID NO: 8532735 - DNA, 22 bp, Homo sapiens
cagcagggtatacagggaattt

SEQ ID NO: 8532736 - DNA, 22 bp, Homo sapiens
cagcagggggcagcgcagatca

SEQ ID NO: 8532737 - DNA, 22 bp, Homo sapiens
cagcaggggaactgtgggccag

SEQ ID NO: 8532738 - DNA, 22 bp, Homo sapiens
cagcagggtaggttgtatcagt

SEQ ID NO: 8532739 - DNA, 22 bp, Homo sapiens
cagcagggtaggttgtatcagt

SEQ ID NO: 8532740 - DNA, 22 bp, Homo sapiens
cagcagggggcagcgcagatca

SEQ ID NO: 8532741 - DNA, 22 bp, Homo sapiens
cagcaggggtgtcattgtagtt

SEQ ID NO: 8532742 - DNA, 23 bp, Homo sapiens
agctcctgaggccagcctctcct

SEQ ID NO: 8532743 - DNA, 20 bp, Homo sapiens
agctcctgagggttactttc

SEQ ID NO: 8532744 - DNA, 22 bp, Homo sapiens
agctcctgagtagctttactca

SEQ ID NO: 8532745 - DNA, 20 bp, Homo sapiens
agctcctgagggttactttc

SEQ ID NO: 8532746 - DNA, 22 bp, Homo sapiens
agctcctgattctcagagatag

SEQ ID NO: 8532747 - DNA, 22 bp, Homo sapiens
cagctctgagactgaggctatg

SEQ ID NO: 8532748 - DNA, 22 bp, Homo sapiens
cagctctgagactgaggctatg

SEQ ID NO: 8532749 - DNA, 22 bp, Homo sapiens
agctcctgatacatgcaggaat

SEQ ID NO: 8532750 - DNA, 22 bp, Homo sapiens
agctcctgatacatgcaggaat

SEQ ID NO: 8532751 - DNA, 19 bp, Homo sapiens
cagctcagtttgattctct

SEQ ID NO: 8532752 - DNA, 22 bp, Homo sapiens
cagctcagtttcaataccaggt

SEQ ID NO: 8532753 - DNA, 22 bp, Homo sapiens
cagctcagtttcaataccaggt

SEQ ID NO: 8532754 - DNA, 22 bp, Homo sapiens
cagctcagtgatgccttcacag

SEQ ID NO: 8532755 - DNA, 22 bp, Homo sapiens
cagctcagtcttgaagcactgg

SEQ ID NO: 8532756 - DNA, 22 bp, Homo sapiens
cagctcagtgatgccttcacag

SEQ ID NO: 8532757 - DNA, 22 bp, Homo sapiens
cagctcagtcttgaagcactgg

SEQ ID NO: 8532758 - DNA, 22 bp, Homo sapiens
cagctcagtctggagagatgca

SEQ ID NO: 8532759 - DNA, 22 bp, Homo sapiens
cagctccaaagccccactgtcc

SEQ ID NO: 8532760 - DNA, 22 bp, Homo sapiens
cagctccaaagccccactgtcc

SEQ ID NO: 8532761 - DNA, 22 bp, Homo sapiens
agctcctgaaaagcgcttgctt

SEQ ID NO: 8532762 - DNA, 18 bp, Homo sapiens
agctcctgaactctgtgg

SEQ ID NO: 8532763 - DNA, 18 bp, Homo sapiens
agctcctgaactctgtgg

SEQ ID NO: 8532764 - DNA, 22 bp, Homo sapiens
agctcctgaaaatccagactgg

SEQ ID NO: 8532765 - DNA, 22 bp, Homo sapiens
agctcctgaaaatccagactgg

SEQ ID NO: 8532766 - DNA, 21 bp, Homo sapiens
agctcagcaagatggaggctc

SEQ ID NO: 8532767 - DNA, 21 bp, Homo sapiens
agctcagcaagatggaggctc

SEQ ID NO: 8532768 - DNA, 22 bp, Homo sapiens
agctcagcactgtcagcactcc

SEQ ID NO: 8532769 - DNA, 22 bp, Homo sapiens
agctcagagataatcaagagac

SEQ ID NO: 8532770 - DNA, 22 bp, Homo sapiens
agctcagagataatcaagagac

SEQ ID NO: 8532771 - DNA, 22 bp, Homo sapiens
agctcagagataatcaagagac

SEQ ID NO: 8532772 - DNA, 22 bp, Homo sapiens
agctcagagataatcaagagac

SEQ ID NO: 8532773 - DNA, 22 bp, Homo sapiens
agctcagagctcgggaggatgg

SEQ ID NO: 8532774 - DNA, 22 bp, Homo sapiens
agctcagagggaggtgaagtgg

SEQ ID NO: 8532775 - DNA, 21 bp, Homo sapiens
agctcagccgggcacagtggc

SEQ ID NO: 8532776 - DNA, 21 bp, Homo sapiens
agctcagccgggcacagtggc

SEQ ID NO: 8532777 - DNA, 22 bp, Homo sapiens
agctcagcttcctctccatgct

SEQ ID NO: 8532778 - DNA, 22 bp, Homo sapiens
agctcagcttcctctccatgct

SEQ ID NO: 8532779 - DNA, 22 bp, Homo sapiens
agctcagcttcctctccatgct

SEQ ID NO: 8532780 - DNA, 19 bp, Homo sapiens
cagctcaggactcagcccc

SEQ ID NO: 8532781 - DNA, 19 bp, Homo sapiens
cagctcaggactcagcccc

SEQ ID NO: 8532782 - DNA, 22 bp, Homo sapiens
cagctcaggcactggcgcggga

SEQ ID NO: 8532783 - DNA, 22 bp, Homo sapiens
cagctcaggctctccatgctcc

SEQ ID NO: 8532784 - DNA, 22 bp, Homo sapiens
cagctcaggctctccatgctcc

SEQ ID NO: 8532785 - DNA, 22 bp, Homo sapiens
cagctcaggctctccatgctcc

SEQ ID NO: 8532786 - DNA, 22 bp, Homo sapiens
cagctcaggaaggaaggccggc

SEQ ID NO: 8532787 - DNA, 22 bp, Homo sapiens
cagctcaggaaggaaggccggc

SEQ ID NO: 8532788 - DNA, 19 bp, Homo sapiens
cagctcaggactcagcccc

SEQ ID NO: 8532789 - DNA, 22 bp, Homo sapiens
agctcaggcaactctgggcccc

SEQ ID NO: 8532790 - DNA, 22 bp, Homo sapiens
agctcaggcaactctgggcccc

SEQ ID NO: 8532791 - DNA, 22 bp, Homo sapiens
cagagggccccctggccacagt

SEQ ID NO: 8532792 - DNA, 22 bp, Homo sapiens
cagaggtattgcaaaagcctag

SEQ ID NO: 8532793 - DNA, 22 bp, Homo sapiens
cagaggtcaagatctgaagtga

SEQ ID NO: 8532794 - DNA, 22 bp, Homo sapiens
cagaggtcaggttggacattat

SEQ ID NO: 8532795 - DNA, 22 bp, Homo sapiens
cagaggtcaagatctgaagtga

SEQ ID NO: 8532796 - DNA, 22 bp, Homo sapiens
cagaggtattgcaaaagcctag

SEQ ID NO: 8532797 - DNA, 22 bp, Homo sapiens
cagaggtattttgataaacgcc

SEQ ID NO: 8532798 - DNA, 22 bp, Homo sapiens
cagagggcactcggagtgacat

SEQ ID NO: 8532799 - DNA, 22 bp, Homo sapiens
cagagggcactcggagtgacat

SEQ ID NO: 8532800 - DNA, 22 bp, Homo sapiens
cagagggagtttctgaggttgc

SEQ ID NO: 8532801 - DNA, 22 bp, Homo sapiens
cagagggatcatcttcctgaag

SEQ ID NO: 8532802 - DNA, 22 bp, Homo sapiens
cagaggtgcatacaggtcatta

SEQ ID NO: 8532803 - DNA, 22 bp, Homo sapiens
cagaggtgcatacaggtcatta

SEQ ID NO: 8532804 - DNA, 22 bp, Homo sapiens
cagaggtgcatacaggtcatta

SEQ ID NO: 8532805 - DNA, 22 bp, Homo sapiens
cagaggtctgatgcgtccctgc

SEQ ID NO: 8532806 - DNA, 22 bp, Homo sapiens
cagaggtgcatacaggtcatta

SEQ ID NO: 8532807 - DNA, 22 bp, Homo sapiens
cagaggtgcatacaggtcatta

SEQ ID NO: 8532808 - DNA, 22 bp, Homo sapiens
agcctcctggagtttctgggat

SEQ ID NO: 8532809 - DNA, 22 bp, Homo sapiens
agcctccctatgcaccttcagg

SEQ ID NO: 8532810 - DNA, 22 bp, Homo sapiens
cagaggtctgacactgaatggt

SEQ ID NO: 8532811 - DNA, 19 bp, Homo sapiens
cagaggtgatatatgccca

SEQ ID NO: 8532812 - DNA, 22 bp, Homo sapiens
cagaggtctccatcaccctcct

SEQ ID NO: 8532813 - DNA, 22 bp, Homo sapiens
cagaggtctccatcaccctcct

SEQ ID NO: 8532814 - DNA, 22 bp, Homo sapiens
cagaggtctgacactgaatggt

SEQ ID NO: 8532815 - DNA, 22 bp, Homo sapiens
cagaggtctgacactgaatggt

SEQ ID NO: 8532816 - DNA, 22 bp, Homo sapiens
cagaggtccctatttctttgtt

SEQ ID NO: 8532817 - DNA, 22 bp, Homo sapiens
cagaggtccctgttcttaagga

SEQ ID NO: 8532818 - DNA, 22 bp, Homo sapiens
cagaggtccctgttcttaagga

SEQ ID NO: 8532819 - DNA, 21 bp, Homo sapiens
cagaggtcatcctgaggacaa

SEQ ID NO: 8532820 - DNA, 21 bp, Homo sapiens
cagaggtcatcctgaggacaa

SEQ ID NO: 8532821 - DNA, 22 bp, Homo sapiens
agcctctgtagaaagcagtgtg

SEQ ID NO: 8532822 - DNA, 22 bp, Homo sapiens
agcctctgtagaaagcagtgtg

SEQ ID NO: 8532823 - DNA, 22 bp, Homo sapiens
agcctctgtagaaagcagtgtg

SEQ ID NO: 8532824 - DNA, 22 bp, Homo sapiens
agcctctgtcaagcttttcaaa

SEQ ID NO: 8532825 - DNA, 22 bp, Homo sapiens
agcctctgtcaagcttttcaaa

SEQ ID NO: 8532826 - DNA, 22 bp, Homo sapiens
agcctctgtcaagcttttcaaa

SEQ ID NO: 8532827 - DNA, 22 bp, Homo sapiens
agcctctgtgactcacaggtca

SEQ ID NO: 8532828 - DNA, 22 bp, Homo sapiens
agcctctgtgactcacaggtca

SEQ ID NO: 8532829 - DNA, 22 bp, Homo sapiens
agcctctgggggagctgggagc

SEQ ID NO: 8532830 - DNA, 22 bp, Homo sapiens
agcctctgggggagctgggagc

SEQ ID NO: 8532831 - DNA, 22 bp, Homo sapiens
agcctctggtcctccctcagct

SEQ ID NO: 8532832 - DNA, 22 bp, Homo sapiens
agcctctggtcctccctcagct

SEQ ID NO: 8532833 - DNA, 22 bp, Homo sapiens
agcctctggtcctccctcagct

SEQ ID NO: 8532834 - DNA, 22 bp, Homo sapiens
agcctctggtcctccctcagct

SEQ ID NO: 8532835 - DNA, 22 bp, Homo sapiens
agcctctggccctagactgctt

SEQ ID NO: 8532836 - DNA, 22 bp, Homo sapiens
agcctctggccctagactgctt

SEQ ID NO: 8532837 - DNA, 22 bp, Homo sapiens
agcctctggccctagactgctt

SEQ ID NO: 8532838 - DNA, 22 bp, Homo sapiens
agcctctgggggagctgggagc

SEQ ID NO: 8532839 - DNA, 22 bp, Homo sapiens
agcctctgggggagctgggagc

SEQ ID NO: 8532840 - DNA, 20 bp, Homo sapiens
agcctctgcccttcccactg

SEQ ID NO: 8532841 - DNA, 20 bp, Homo sapiens
agcctctgcccttcccactg

SEQ ID NO: 8532842 - DNA, 22 bp, Homo sapiens
agcctctgcacttcttacaggt

SEQ ID NO: 8532843 - DNA, 22 bp, Homo sapiens
agcctctgcacttcttacaggt

SEQ ID NO: 8532844 - DNA, 22 bp, Homo sapiens
agcctctgcacttcttacaggt

SEQ ID NO: 8532845 - DNA, 22 bp, Homo sapiens
agcctcctggagtttctgggat

SEQ ID NO: 8532846 - DNA, 22 bp, Homo sapiens
agcctctgatggctcccaagga

SEQ ID NO: 8532847 - DNA, 22 bp, Homo sapiens
agcctctgcacgggcacgggtg

SEQ ID NO: 8532848 - DNA, 22 bp, Homo sapiens
agcctctgcacgggcacgggtg

SEQ ID NO: 8532849 - DNA, 22 bp, Homo sapiens
agcctctgcacgggcacgggtg

SEQ ID NO: 8532850 - DNA, 18 bp, Homo sapiens
agcctctggcagagagaa

SEQ ID NO: 8532851 - DNA, 18 bp, Homo sapiens
agcctctggcagagagaa

SEQ ID NO: 8532852 - DNA, 18 bp, Homo sapiens
agcctctggcagagagaa

SEQ ID NO: 8532853 - DNA, 22 bp, Homo sapiens
agcctctgctggccctggcact

SEQ ID NO: 8532854 - DNA, 22 bp, Homo sapiens
agcctctgctggccctggcact

SEQ ID NO: 8532855 - DNA, 22 bp, Homo sapiens
agcctctgcttatgcaaaggta

SEQ ID NO: 8532856 - DNA, 22 bp, Homo sapiens
agcctctgcttatgcaaaggta

SEQ ID NO: 8532857 - DNA, 22 bp, Homo sapiens
agcctctgctggccctggcact

SEQ ID NO: 8532858 - DNA, 22 bp, Homo sapiens
agcctctgctggccctggcact

SEQ ID NO: 8532859 - DNA, 22 bp, Homo sapiens
agcctggatcctaggctcagct

SEQ ID NO: 8532860 - DNA, 22 bp, Homo sapiens
agcctggattcgtgcatccaca

SEQ ID NO: 8532861 - DNA, 22 bp, Homo sapiens
agcctggatcctaggctcagct

SEQ ID NO: 8532862 - DNA, 22 bp, Homo sapiens
agcctggatcctaggctcagct

SEQ ID NO: 8532863 - DNA, 23 bp, Homo sapiens
agcctggcacctgcagatcggag

SEQ ID NO: 8532864 - DNA, 22 bp, Homo sapiens
agcctggattcgtgcatccaca

SEQ ID NO: 8532865 - DNA, 20 bp, Homo sapiens
agcctggcaaacacccccag

SEQ ID NO: 8532866 - DNA, 22 bp, Homo sapiens
agcctggattcgtgcatccaca

SEQ ID NO: 8532867 - DNA, 22 bp, Homo sapiens
agcctggagttcccaggagaag

SEQ ID NO: 8532868 - DNA, 22 bp, Homo sapiens
agcctggagttcccaggagaag

SEQ ID NO: 8532869 - DNA, 22 bp, Homo sapiens
agcctggatccatgtggctacc

SEQ ID NO: 8532870 - DNA, 22 bp, Homo sapiens
agcctggaggtaatgaggaaac

SEQ ID NO: 8532871 - DNA, 22 bp, Homo sapiens
cagcaggggaactgtgggccag

SEQ ID NO: 8532872 - DNA, 22 bp, Homo sapiens
cagcagggcccccgggtgcgcc

SEQ ID NO: 8532873 - DNA, 22 bp, Homo sapiens
cagcagggcccccgggtgcgcc

SEQ ID NO: 8532874 - DNA, 22 bp, Homo sapiens
cagcaggatatggtggagagag

SEQ ID NO: 8532875 - DNA, 22 bp, Homo sapiens
agcctggcactgaggcagggcg

SEQ ID NO: 8532876 - DNA, 22 bp, Homo sapiens
agcctggcactgaggcagggcg

SEQ ID NO: 8532877 - DNA, 22 bp, Homo sapiens
agcctggcactgccccatccat

SEQ ID NO: 8532878 - DNA, 22 bp, Homo sapiens
agcctggcactgccccatccat

SEQ ID NO: 8532879 - DNA, 22 bp, Homo sapiens
agcctggcactgaggcagggcg

SEQ ID NO: 8532880 - DNA, 22 bp, Homo sapiens
agcctggcactgaggcagggcg

SEQ ID NO: 8532881 - DNA, 22 bp, Homo sapiens
cagcagctcagtctctcagtag

SEQ ID NO: 8532882 - DNA, 22 bp, Homo sapiens
cagcagctcctctgcggctatg

SEQ ID NO: 8532883 - DNA, 22 bp, Homo sapiens
cagcagctcccatccgctgagc

SEQ ID NO: 8532884 - DNA, 22 bp, Homo sapiens
cagcagctcaggctgcttccca

SEQ ID NO: 8532885 - DNA, 22 bp, Homo sapiens
cagcagctcactgaataatgac

SEQ ID NO: 8532886 - DNA, 22 bp, Homo sapiens
cagcagctcactcaggtggctc

SEQ ID NO: 8532887 - DNA, 22 bp, Homo sapiens
agcctgagctgcctgccgcctc

SEQ ID NO: 8532888 - DNA, 22 bp, Homo sapiens
cagcagcattgctctggattcc

SEQ ID NO: 8532889 - DNA, 22 bp, Homo sapiens
agcctgagagccaagctgtgca

SEQ ID NO: 8532890 - DNA, 22 bp, Homo sapiens
agcctgagagccaagctgtgca

SEQ ID NO: 8532891 - DNA, 22 bp, Homo sapiens
agcctgagccccatccagctga

SEQ ID NO: 8532892 - DNA, 22 bp, Homo sapiens
agcctgagccccatccagctga

SEQ ID NO: 8532893 - DNA, 23 bp, Homo sapiens
agcctcttttctcctgccctgca

SEQ ID NO: 8532894 - DNA, 22 bp, Homo sapiens
agtcccagctcagaaccactag

SEQ ID NO: 8532895 - DNA, 22 bp, Homo sapiens
agtcccagctcagaaccactag

SEQ ID NO: 8532896 - DNA, 22 bp, Homo sapiens
agtcccagctctgccacttact

SEQ ID NO: 8532897 - DNA, 22 bp, Homo sapiens
agtcccagctctgccacttact

SEQ ID NO: 8532898 - DNA, 22 bp, Homo sapiens
actcaggctgttttttccttgt

SEQ ID NO: 8532899 - DNA, 22 bp, Homo sapiens
actcaggcttcaggcacagctg

SEQ ID NO: 8532900 - DNA, 22 bp, Homo sapiens
actcaggctacaacgcgtggct

SEQ ID NO: 8532901 - DNA, 22 bp, Homo sapiens
actcaggctagggaaaaagtgg

SEQ ID NO: 8532902 - DNA, 22 bp, Homo sapiens
actcaggctacaggggcagaag

SEQ ID NO: 8532903 - DNA, 22 bp, Homo sapiens
actcaggccccatcgcccatct

SEQ ID NO: 8532904 - DNA, 22 bp, Homo sapiens
actcaggcctccttctgtcctt

SEQ ID NO: 8532905 - DNA, 21 bp, Homo sapiens
actcaggcaccaggggatggc

SEQ ID NO: 8532906 - DNA, 22 bp, Homo sapiens
actcaggcactcagccctcgcc

SEQ ID NO: 8532907 - DNA, 19 bp, Homo sapiens
actcaggcaatgagaaaca

SEQ ID NO: 8532908 - DNA, 22 bp, Homo sapiens
agtcaaataagagagagatgtt

SEQ ID NO: 8532909 - DNA, 22 bp, Homo sapiens
agtcaaagctacaggcatttga

SEQ ID NO: 8532910 - DNA, 22 bp, Homo sapiens
agtcaaatatcttaaaaggcta

SEQ ID NO: 8532911 - DNA, 22 bp, Homo sapiens
agtcaaatgagtaaatatataa

SEQ ID NO: 8532912 - DNA, 15 bp, Homo sapiens
agtcaaatctgtttt

SEQ ID NO: 8532913 - DNA, 22 bp, Homo sapiens
agtcaacacattaaacctaggg

SEQ ID NO: 8532914 - DNA, 22 bp, Homo sapiens
actcaggaatggggctgggact

SEQ ID NO: 8532915 - DNA, 22 bp, Homo sapiens
actcaggaaattgagataatgg

SEQ ID NO: 8532916 - DNA, 23 bp, Homo sapiens
actcagctttgggagatgactca

SEQ ID NO: 8532917 - DNA, 23 bp, Homo sapiens
actcagctttgggagatgactca

SEQ ID NO: 8532918 - DNA, 22 bp, Homo sapiens
agtcaactgcattaggaaatga

SEQ ID NO: 8532919 - DNA, 22 bp, Homo sapiens
actcagcttgcacacatcaatg

SEQ ID NO: 8532920 - DNA, 19 bp, Homo sapiens
agtatagagtattgaggag

SEQ ID NO: 8532921 - DNA, 22 bp, Homo sapiens
agtatacatatattagccttcg

SEQ ID NO: 8532922 - DNA, 22 bp, Homo sapiens
actagtattcttggtcttgtat

SEQ ID NO: 8532923 - DNA, 22 bp, Homo sapiens
actagtattgcctactgtacat

SEQ ID NO: 8532924 - DNA, 22 bp, Homo sapiens
actaggggctcaggcccaggga

SEQ ID NO: 8532925 - DNA, 22 bp, Homo sapiens
actagtattagactaaaagtca

SEQ ID NO: 8532926 - DNA, 22 bp, Homo sapiens
actagtataattgccctaacct

SEQ ID NO: 8532927 - DNA, 22 bp, Homo sapiens
actaggaaggcatatgggcaga

SEQ ID NO: 8532928 - DNA, 22 bp, Homo sapiens
actaggagaaaacttacactga

SEQ ID NO: 8532929 - DNA, 22 bp, Homo sapiens
agtcaaagggtatttggattga

SEQ ID NO: 8532930 - DNA, 22 bp, Homo sapiens
agtcaaataagactgtcataag

SEQ ID NO: 8532931 - DNA, 22 bp, Homo sapiens
agtcaaagctacaggcatttga

SEQ ID NO: 8532932 - DNA, 22 bp, Homo sapiens
agtcaaagatgaccgagttcct

SEQ ID NO: 8532933 - DNA, 22 bp, Homo sapiens
agtcaaagatgaccgagttcct

SEQ ID NO: 8532934 - DNA, 22 bp, Homo sapiens
agtcaaagaagatggttccaaa

SEQ ID NO: 8532935 - DNA, 22 bp, Homo sapiens
agtcaaaacatgtactttcctt

SEQ ID NO: 8532936 - DNA, 22 bp, Homo sapiens
agtcaaaacatgtactttcctt

SEQ ID NO: 8532937 - DNA, 22 bp, Homo sapiens
agtattttcgccatcacaagaa

SEQ ID NO: 8532938 - DNA, 22 bp, Homo sapiens
agtattttcgccatcacaagaa

SEQ ID NO: 8532939 - DNA, 22 bp, Homo sapiens
aggtggctcctcccatggctgg

SEQ ID NO: 8532940 - DNA, 22 bp, Homo sapiens
acgatgatgaaagagaacattc

SEQ ID NO: 8532941 - DNA, 22 bp, Homo sapiens
acgcagaagggcctggcgtgcc

SEQ ID NO: 8532942 - DNA, 20 bp, Homo sapiens
acgcacacgcgggggcgtgc

SEQ ID NO: 8532943 - DNA, 22 bp, Homo sapiens
acgcccagactcccatactttg

SEQ ID NO: 8532944 - DNA, 22 bp, Homo sapiens
acgcccagactcccatactttg

SEQ ID NO: 8532945 - DNA, 22 bp, Homo sapiens
acgcagtttgtggacatttttt

SEQ ID NO: 8532946 - DNA, 22 bp, Homo sapiens
acgcccagactcccatactttg

SEQ ID NO: 8532947 - DNA, 22 bp, Homo sapiens
acgcccggtctccatagttttt

SEQ ID NO: 8532948 - DNA, 22 bp, Homo sapiens
acgcctgtaatcccagcacttt

SEQ ID NO: 8532949 - DNA, 22 bp, Homo sapiens
agtaaaaattgaggtgcaaaat

SEQ ID NO: 8532950 - DNA, 22 bp, Homo sapiens
acggcttcttgactgtgggttg

SEQ ID NO: 8532951 - DNA, 22 bp, Homo sapiens
acgcctgtaatcccagcacttt

SEQ ID NO: 8532952 - DNA, 22 bp, Homo sapiens
acgcctgtaatcccagcacttt

SEQ ID NO: 8532953 - DNA, 22 bp, Homo sapiens
agtaaaatcttaagcacagtgg

SEQ ID NO: 8532954 - DNA, 22 bp, Homo sapiens
agtaaaatcaccatctctttgt

SEQ ID NO: 8532955 - DNA, 22 bp, Homo sapiens
agtaaaatcttaagcacagtgg

SEQ ID NO: 8532956 - DNA, 22 bp, Homo sapiens
agtaaaatcaccatctctttgt

SEQ ID NO: 8532957 - DNA, 22 bp, Homo sapiens
agtaaacactgtctttatatat

SEQ ID NO: 8532958 - DNA, 22 bp, Homo sapiens
agtaaacacgtggggtttcttt

SEQ ID NO: 8532959 - DNA, 22 bp, Homo sapiens
agtaaacacgtggggtttcttt

SEQ ID NO: 8532960 - DNA, 22 bp, Homo sapiens
agtaaacaatgtatgaggacag

SEQ ID NO: 8532961 - DNA, 22 bp, Homo sapiens
agtaaaatttctgctgaggaga

SEQ ID NO: 8532962 - DNA, 22 bp, Homo sapiens
agtaaaattgtattggaaaaca

SEQ ID NO: 8532963 - DNA, 19 bp, Homo sapiens
actagatacaacatgcaga

SEQ ID NO: 8532964 - DNA, 22 bp, Homo sapiens
actagccaagttttacgactaa

SEQ ID NO: 8532965 - DNA, 22 bp, Homo sapiens
actagcagggatattatataag

SEQ ID NO: 8532966 - DNA, 22 bp, Homo sapiens
actagcagggatgttattactt

SEQ ID NO: 8532967 - DNA, 22 bp, Homo sapiens
actagaaattactcagaataaa

SEQ ID NO: 8532968 - DNA, 22 bp, Homo sapiens
actagaaccagaggaggcaggt

SEQ ID NO: 8532969 - DNA, 22 bp, Homo sapiens
agtaaacagaaagcaagatgat

SEQ ID NO: 8532970 - DNA, 22 bp, Homo sapiens
agtaaacactgtctttatatat

SEQ ID NO: 8532971 - DNA, 22 bp, Homo sapiens
agtaaacagaaagcaagatgat

SEQ ID NO: 8532972 - DNA, 21 bp, Homo sapiens
acctgagctccacctcctgcc

SEQ ID NO: 8532973 - DNA, 22 bp, Homo sapiens
acctgagcctagggaggttgag

SEQ ID NO: 8532974 - DNA, 22 bp, Homo sapiens
acctgaggcctccccagcagac

SEQ ID NO: 8532975 - DNA, 22 bp, Homo sapiens
acctgaggactggatggtagaa

SEQ ID NO: 8532976 - DNA, 22 bp, Homo sapiens
acctgagacctaatctgactgt

SEQ ID NO: 8532977 - DNA, 22 bp, Homo sapiens
acctgagacctaatctgactgt

SEQ ID NO: 8532978 - DNA, 22 bp, Homo sapiens
acctgagacctaatctgactgt

SEQ ID NO: 8532979 - DNA, 22 bp, Homo sapiens
acctgagagctataaggtttta

SEQ ID NO: 8532980 - DNA, 22 bp, Homo sapiens
acctgagcatgccaggagagtg

SEQ ID NO: 8532981 - DNA, 22 bp, Homo sapiens
acctgagacttgggatgggaat

SEQ ID NO: 8532982 - DNA, 22 bp, Homo sapiens
acctgagcatgccaggagagtg

SEQ ID NO: 8532983 - DNA, 22 bp, Homo sapiens
acctgaggcctccccagcagac

SEQ ID NO: 8532984 - DNA, 22 bp, Homo sapiens
acctgaggctgttagtctaggt

SEQ ID NO: 8532985 - DNA, 22 bp, Homo sapiens
acctgaggcctccccagcagac

SEQ ID NO: 8532986 - DNA, 22 bp, Homo sapiens
acctgagggagattaggcctga

SEQ ID NO: 8532987 - DNA, 22 bp, Homo sapiens
acctgagggcccaaacttggta

SEQ ID NO: 8532988 - DNA, 22 bp, Homo sapiens
acctgatatgtttgatcaccct

SEQ ID NO: 8532989 - DNA, 22 bp, Homo sapiens
acctgagggcccaaacttggta

SEQ ID NO: 8532990 - DNA, 20 bp, Homo sapiens
acctgaggtccctatggtct

SEQ ID NO: 8532991 - DNA, 22 bp, Homo sapiens
acctgccagaatccaagccaca

SEQ ID NO: 8532992 - DNA, 22 bp, Homo sapiens
aggtccagttgccagaatggcc

SEQ ID NO: 8532993 - DNA, 22 bp, Homo sapiens
aggtccagttgccagaatggcc

SEQ ID NO: 8532994 - DNA, 22 bp, Homo sapiens
acctgcagtggccactcctaat

SEQ ID NO: 8532995 - DNA, 22 bp, Homo sapiens
acctgcagtggccactcctaat

SEQ ID NO: 8532996 - DNA, 22 bp, Homo sapiens
acctgcaggcacaggtgtgcgc

SEQ ID NO: 8532997 - DNA, 22 bp, Homo sapiens
acctgcagctgagaaaatgact

SEQ ID NO: 8532998 - DNA, 22 bp, Homo sapiens
acctgcagccacttctctcctt

SEQ ID NO: 8532999 - DNA, 22 bp, Homo sapiens
acctgcagccacttctctcctt

SEQ ID NO: 8533000 - DNA, 22 bp, Homo sapiens
acctgcagctaaagatgtaggg

SEQ ID NO: 8533001 - DNA, 22 bp, Homo sapiens
acctgcagtggccactcctaat

SEQ ID NO: 8533002 - DNA, 19 bp, Homo sapiens
acctgcagtaataattcct

SEQ ID NO: 8533003 - DNA, 22 bp, Homo sapiens
acctgcaggtgtttccacactt

SEQ ID NO: 8533004 - DNA, 22 bp, Homo sapiens
acctgcaggtgtttccacactt

SEQ ID NO: 8533005 - DNA, 22 bp, Homo sapiens
acctgcaggggtgctctctggg

SEQ ID NO: 8533006 - DNA, 22 bp, Homo sapiens
acctctttgaacctcagtgtga

SEQ ID NO: 8533007 - DNA, 22 bp, Homo sapiens
acctctttgaacctcagtgtga

SEQ ID NO: 8533008 - DNA, 22 bp, Homo sapiens
acctcctgatgagagtaaagga

SEQ ID NO: 8533009 - DNA, 22 bp, Homo sapiens
acctctggccttcaggcatcat

SEQ ID NO: 8533010 - DNA, 22 bp, Homo sapiens
acctgaatttgaaatgtttatt

SEQ ID NO: 8533011 - DNA, 22 bp, Homo sapiens
acctgaattgtcatatcttatt

SEQ ID NO: 8533012 - DNA, 22 bp, Homo sapiens
acctgaaaattattatttccgc

SEQ ID NO: 8533013 - DNA, 22 bp, Homo sapiens
acctgaaaattattatttccgc

SEQ ID NO: 8533014 - DNA, 22 bp, Homo sapiens
acctgaaactcaactttatctc

SEQ ID NO: 8533015 - DNA, 22 bp, Homo sapiens
acctgaaactcaactttatctc

SEQ ID NO: 8533016 - DNA, 22 bp, Homo sapiens
acctgaaaccaacttgtgtact

SEQ ID NO: 8533017 - DNA, 22 bp, Homo sapiens
acctgaaaccaacttgtgtact

SEQ ID NO: 8533018 - DNA, 19 bp, Homo sapiens
accctctctgtagaaagat

SEQ ID NO: 8533019 - DNA, 19 bp, Homo sapiens
accctctcagtgcctgagg

SEQ ID NO: 8533020 - DNA, 19 bp, Homo sapiens
accctctgccacaagcctc

SEQ ID NO: 8533021 - DNA, 22 bp, Homo sapiens
accctctgagaggcacactttg

SEQ ID NO: 8533022 - DNA, 19 bp, Homo sapiens
accctctgccacaagcctc

SEQ ID NO: 8533023 - DNA, 22 bp, Homo sapiens
accctccaggctgcagctcctg

SEQ ID NO: 8533024 - DNA, 22 bp, Homo sapiens
accctcccatttccatgtagca

SEQ ID NO: 8533025 - DNA, 22 bp, Homo sapiens
accctcccatttccatgtagca

SEQ ID NO: 8533026 - DNA, 19 bp, Homo sapiens
accctctcagtgcctgagg

SEQ ID NO: 8533027 - DNA, 22 bp, Homo sapiens
accctccccaagaggtcgtgcc

SEQ ID NO: 8533028 - DNA, 22 bp, Homo sapiens
accctccccaagaggtcgtgcc

SEQ ID NO: 8533029 - DNA, 22 bp, Homo sapiens
acctggcataagggcttgagtc

SEQ ID NO: 8533030 - DNA, 22 bp, Homo sapiens
acctggcactacaggcacctgt

SEQ ID NO: 8533031 - DNA, 22 bp, Homo sapiens
acctggcactacaggcacctgt

SEQ ID NO: 8533032 - DNA, 22 bp, Homo sapiens
acctggcacattctaccacagt

SEQ ID NO: 8533033 - DNA, 22 bp, Homo sapiens
acctggcatgaagcatgcctta

SEQ ID NO: 8533034 - DNA, 22 bp, Homo sapiens
acctggctgagaacgtgcagct

SEQ ID NO: 8533035 - DNA, 20 bp, Homo sapiens
acctggctctcaggagcaac

SEQ ID NO: 8533036 - DNA, 22 bp, Homo sapiens
aggtggctatgaggatgcagtc

SEQ ID NO: 8533037 - DNA, 22 bp, Homo sapiens
aggtggctatgaggatgcagtc

SEQ ID NO: 8533038 - DNA, 22 bp, Homo sapiens
aggtggccggtgccagccgggc

SEQ ID NO: 8533039 - DNA, 18 bp, Homo sapiens
aggtggcctgggagcttt

SEQ ID NO: 8533040 - DNA, 18 bp, Homo sapiens
aggtggcctgggagcttt

SEQ ID NO: 8533041 - DNA, 23 bp, Homo sapiens
aggtggcctttgcctctttctct

SEQ ID NO: 8533042 - DNA, 22 bp, Homo sapiens
aggtggccaagactgtttgaca

SEQ ID NO: 8533043 - DNA, 22 bp, Homo sapiens
aggtggccccaggcctctgcca

SEQ ID NO: 8533044 - DNA, 22 bp, Homo sapiens
aggtggccccaggcctctgcca

SEQ ID NO: 8533045 - DNA, 22 bp, Homo sapiens
aggtggccaataaatgttggag

SEQ ID NO: 8533046 - DNA, 23 bp, Homo sapiens
aggtggccaccagaatgttaagg

SEQ ID NO: 8533047 - DNA, 22 bp, Homo sapiens
aggtctcccaagggccagggag

SEQ ID NO: 8533048 - DNA, 22 bp, Homo sapiens
aggtctctaaaatagtcaaact

SEQ ID NO: 8533049 - DNA, 22 bp, Homo sapiens
acctggaggcagaggttgcagt

SEQ ID NO: 8533050 - DNA, 22 bp, Homo sapiens
acctggaggcagaggttgcagt

SEQ ID NO: 8533051 - DNA, 22 bp, Homo sapiens
acctggaggcagaggttgcagt

SEQ ID NO: 8533052 - DNA, 22 bp, Homo sapiens
acctggagtcatttgaggagta

SEQ ID NO: 8533053 - DNA, 22 bp, Homo sapiens
acctggagtcatttgaggagta

SEQ ID NO: 8533054 - DNA, 22 bp, Homo sapiens
acctggagggaagttctgactt

SEQ ID NO: 8533055 - DNA, 22 bp, Homo sapiens
acctggagggaagttctgactt

SEQ ID NO: 8533056 - DNA, 22 bp, Homo sapiens
acctggattttgcttagacatg

SEQ ID NO: 8533057 - DNA, 22 bp, Homo sapiens
acctggatgctggccttgcctt

SEQ ID NO: 8533058 - DNA, 22 bp, Homo sapiens
acctggatgctggccttgcctt

SEQ ID NO: 8533059 - DNA, 22 bp, Homo sapiens
acctggagtcatttgaggagta

SEQ ID NO: 8533060 - DNA, 22 bp, Homo sapiens
acctggagtcatttgaggagta

SEQ ID NO: 8533061 - DNA, 22 bp, Homo sapiens
acctggagtcatttgaggagta

SEQ ID NO: 8533062 - DNA, 22 bp, Homo sapiens
aggtcctgtcttatctctgtaa

SEQ ID NO: 8533063 - DNA, 22 bp, Homo sapiens
aggtcgagtttcggggctactt

SEQ ID NO: 8533064 - DNA, 22 bp, Homo sapiens
aggtcgagtttcggggctactt

SEQ ID NO: 8533065 - DNA, 19 bp, Homo sapiens
aggtctaatcataagacaa

SEQ ID NO: 8533066 - DNA, 22 bp, Homo sapiens
aggtctaactgatagaattcat

SEQ ID NO: 8533067 - DNA, 22 bp, Homo sapiens
aggtctcaaactggcaccctgt

SEQ ID NO: 8533068 - DNA, 22 bp, Homo sapiens
aggtctcaatctcaggtggtca

SEQ ID NO: 8533069 - DNA, 22 bp, Homo sapiens
aggtctcaattcctgctcctgt

SEQ ID NO: 8533070 - DNA, 22 bp, Homo sapiens
actgcagactctacagttataa

SEQ ID NO: 8533071 - DNA, 22 bp, Homo sapiens
actgcagactctacagttataa

SEQ ID NO: 8533072 - DNA, 22 bp, Homo sapiens
actgcagagcttttcagttgag

SEQ ID NO: 8533073 - DNA, 22 bp, Homo sapiens
actgcagaggtggggtgcagag

SEQ ID NO: 8533074 - DNA, 22 bp, Homo sapiens
actgcagaggtggggtgcagag

SEQ ID NO: 8533075 - DNA, 22 bp, Homo sapiens
actgcagagcttttcagttgag

SEQ ID NO: 8533076 - DNA, 22 bp, Homo sapiens
actgcagcaaagcccgtgtctt

SEQ ID NO: 8533077 - DNA, 22 bp, Homo sapiens
actgcagaggtggggtgcagag

SEQ ID NO: 8533078 - DNA, 22 bp, Homo sapiens
actgcagaggtggggtgcagag

SEQ ID NO: 8533079 - DNA, 21 bp, Homo sapiens
agtggggtctctgtggaggcc

SEQ ID NO: 8533080 - DNA, 21 bp, Homo sapiens
agtggggtctctgtggaggcc

SEQ ID NO: 8533081 - DNA, 22 bp, Homo sapiens
actgcagactctacagttataa

SEQ ID NO: 8533082 - DNA, 22 bp, Homo sapiens
actgcacttcagcctgggtgtc

SEQ ID NO: 8533083 - DNA, 22 bp, Homo sapiens
actgcacttcagcctgggtgtc

SEQ ID NO: 8533084 - DNA, 22 bp, Homo sapiens
actgcacttcagcctgggtgtc

SEQ ID NO: 8533085 - DNA, 22 bp, Homo sapiens
actgcacttcagcctgggtgtc

SEQ ID NO: 8533086 - DNA, 22 bp, Homo sapiens
actgcacttcagcctgggtgtc

SEQ ID NO: 8533087 - DNA, 22 bp, Homo sapiens
actgcacttcagcctgggtgtc

SEQ ID NO: 8533088 - DNA, 22 bp, Homo sapiens
agtgtagacataggtctggtct

SEQ ID NO: 8533089 - DNA, 22 bp, Homo sapiens
agtgtagggtggtcagagcaga

SEQ ID NO: 8533090 - DNA, 22 bp, Homo sapiens
agtgtacatgtttacagcatct

SEQ ID NO: 8533091 - DNA, 22 bp, Homo sapiens
agtgtacattctgtttgaggta

SEQ ID NO: 8533092 - DNA, 22 bp, Homo sapiens
agtgtacatcagaacatatcaa

SEQ ID NO: 8533093 - DNA, 22 bp, Homo sapiens
agtgtacatcagaacatatcaa

SEQ ID NO: 8533094 - DNA, 22 bp, Homo sapiens
agtgtacatgtacacattagta

SEQ ID NO: 8533095 - DNA, 22 bp, Homo sapiens
agtgtacatgtacacattagta

SEQ ID NO: 8533096 - DNA, 22 bp, Homo sapiens
agtgtacatcagaacatatcaa

SEQ ID NO: 8533097 - DNA, 22 bp, Homo sapiens
agtgtacaagaccttattgttg

SEQ ID NO: 8533098 - DNA, 20 bp, Homo sapiens
agtgtacagacactagaaat

SEQ ID NO: 8533099 - DNA, 22 bp, Homo sapiens
agtgtacagttctatgaatttc

SEQ ID NO: 8533100 - DNA, 22 bp, Homo sapiens
agtgtacagttctatgaatttc

SEQ ID NO: 8533101 - DNA, 20 bp, Homo sapiens
agtgtacagacactagaaat

SEQ ID NO: 8533102 - DNA, 22 bp, Homo sapiens
agtggcagagccagggttggga

SEQ ID NO: 8533103 - DNA, 22 bp, Homo sapiens
actgaggggttggagagtgagg

SEQ ID NO: 8533104 - DNA, 21 bp, Homo sapiens
actgagggccagagaggacct

SEQ ID NO: 8533105 - DNA, 22 bp, Homo sapiens
agtggcagagctgggatttggg

SEQ ID NO: 8533106 - DNA, 22 bp, Homo sapiens
agtggcagagctgggatttggg

SEQ ID NO: 8533107 - DNA, 22 bp, Homo sapiens
agtggcaggtgtgtagtatccc

SEQ ID NO: 8533108 - DNA, 22 bp, Homo sapiens
agtggcaggtgtttcgtggtgc

SEQ ID NO: 8533109 - DNA, 22 bp, Homo sapiens
agtggcagtaacattccacaat

SEQ ID NO: 8533110 - DNA, 22 bp, Homo sapiens
agtggcagggctggctgctgca

SEQ ID NO: 8533111 - DNA, 22 bp, Homo sapiens
agtggcaggtgtgtagtatccc

SEQ ID NO: 8533112 - DNA, 22 bp, Homo sapiens
agtggcagtaacattccacaat

SEQ ID NO: 8533113 - DNA, 22 bp, Homo sapiens
agtggcagtagatgagctggtt

SEQ ID NO: 8533114 - DNA, 22 bp, Homo sapiens
agtggcagtagatgagctggtt

SEQ ID NO: 8533115 - DNA, 22 bp, Homo sapiens
agtggcagtggaaagcacacgg

SEQ ID NO: 8533116 - DNA, 22 bp, Homo sapiens
agtggcagtagatgagctggtt

SEQ ID NO: 8533117 - DNA, 22 bp, Homo sapiens
agtggcagtggctgggcagagc

SEQ ID NO: 8533118 - DNA, 22 bp, Homo sapiens
agtggcagtggctgggcagagc

SEQ ID NO: 8533119 - DNA, 22 bp, Homo sapiens
agtggcagtggctgggcagagc

SEQ ID NO: 8533120 - DNA, 22 bp, Homo sapiens
agtggcagtagatgagctggtt

SEQ ID NO: 8533121 - DNA, 22 bp, Homo sapiens
agtggcagtagatgagctggtt

SEQ ID NO: 8533122 - DNA, 22 bp, Homo sapiens
actgcacttcagcctgggtgac

SEQ ID NO: 8533123 - DNA, 22 bp, Homo sapiens
actgcacttcagcctgggtgac

SEQ ID NO: 8533124 - DNA, 22 bp, Homo sapiens
actgcacttcagcctgggtgac

SEQ ID NO: 8533125 - DNA, 22 bp, Homo sapiens
actgcacttcagcctgggtgac

SEQ ID NO: 8533126 - DNA, 22 bp, Homo sapiens
actgcacttcagcctgggtgac

SEQ ID NO: 8533127 - DNA, 20 bp, Homo sapiens
actggacactgaggtgagct

SEQ ID NO: 8533128 - DNA, 22 bp, Homo sapiens
agtgtgtgaccttttaatttaa

SEQ ID NO: 8533129 - DNA, 22 bp, Homo sapiens
agtgtgtgaccttttaatttaa

SEQ ID NO: 8533130 - DNA, 21 bp, Homo sapiens
agtgtgtgataggcaggaaga

SEQ ID NO: 8533131 - DNA, 22 bp, Homo sapiens
actggaagccagttgacaatca

SEQ ID NO: 8533132 - DNA, 21 bp, Homo sapiens
actggaagtgggtcaggaagt

SEQ ID NO: 8533133 - DNA, 22 bp, Homo sapiens
actggaaattgagaggtcactg

SEQ ID NO: 8533134 - DNA, 22 bp, Homo sapiens
actgcttttgatctcttctgta

SEQ ID NO: 8533135 - DNA, 22 bp, Homo sapiens
actggaaaaccactgaaatgag

SEQ ID NO: 8533136 - DNA, 22 bp, Homo sapiens
actggaaaattcaaatggggtc

SEQ ID NO: 8533137 - DNA, 22 bp, Homo sapiens
actgctttatctgagaagtcct

SEQ ID NO: 8533138 - DNA, 22 bp, Homo sapiens
actgctttatctgagaagtcct

SEQ ID NO: 8533139 - DNA, 22 bp, Homo sapiens
actgcttttagaaatctataga

SEQ ID NO: 8533140 - DNA, 22 bp, Homo sapiens
agtgtatgcaggttttcaatgt

SEQ ID NO: 8533141 - DNA, 22 bp, Homo sapiens
agtgtatggaattagctccctt

SEQ ID NO: 8533142 - DNA, 20 bp, Homo sapiens
agtgtatgaatctggatggg

SEQ ID NO: 8533143 - DNA, 22 bp, Homo sapiens
agtgtatgcaggttttcaatgt

SEQ ID NO: 8533144 - DNA, 22 bp, Homo sapiens
agtgtatgtcaagtatatacac

SEQ ID NO: 8533145 - DNA, 22 bp, Homo sapiens
agtgtatgtgaaactttccaaa

SEQ ID NO: 8533146 - DNA, 22 bp, Homo sapiens
agtgtatgtcctgaggggagaa

SEQ ID NO: 8533147 - DNA, 21 bp, Homo sapiens
agtgtaggtcattagctgttg

SEQ ID NO: 8533148 - DNA, 20 bp, Homo sapiens
agtgtatgaatctggatggg

SEQ ID NO: 8533149 - DNA, 20 bp, Homo sapiens
agtgtatgaacagatgcggg

SEQ ID NO: 8533150 - DNA, 22 bp, Homo sapiens
agtgtatgagtttcagttcttc

SEQ ID NO: 8533151 - DNA, 22 bp, Homo sapiens
agtgtatgaacttaagagagag

SEQ ID NO: 8533152 - DNA, 22 bp, Homo sapiens
agtgtatcatggttggcagaca

SEQ ID NO: 8533153 - DNA, 22 bp, Homo sapiens
agtgtttagcatgaagttcatt

SEQ ID NO: 8533154 - DNA, 22 bp, Homo sapiens
agtgtttatattatggaaatat

SEQ ID NO: 8533155 - DNA, 22 bp, Homo sapiens
agtgtttaccccaatcagttta

SEQ ID NO: 8533156 - DNA, 22 bp, Homo sapiens
agtgtttacattgaagcttgta

SEQ ID NO: 8533157 - DNA, 22 bp, Homo sapiens
actggctttgcctctgcctctc

SEQ ID NO: 8533158 - DNA, 22 bp, Homo sapiens
actggctttgagggaatagcta

SEQ ID NO: 8533159 - DNA, 22 bp, Homo sapiens
actgggaaaaactgctttgagg

SEQ ID NO: 8533160 - DNA, 21 bp, Homo sapiens
agtgtgtgataggcaggaaga

SEQ ID NO: 8533161 - DNA, 22 bp, Homo sapiens
agtgttcttcttcaaagctctg

SEQ ID NO: 8533162 - DNA, 22 bp, Homo sapiens
agtgttgcatgaggcagtacca

SEQ ID NO: 8533163 - DNA, 22 bp, Homo sapiens
agtgttggaccgaggtggagcc

SEQ ID NO: 8533164 - DNA, 22 bp, Homo sapiens
agtgtttaaactgaagtgatga

SEQ ID NO: 8533165 - DNA, 22 bp, Homo sapiens
agtgttgtcaaacggctcagca

SEQ ID NO: 8533166 - DNA, 22 bp, Homo sapiens
agtgttgtatgggatgactgct

SEQ ID NO: 8533167 - DNA, 23 bp, Homo sapiens
agtgttggttgggaagccaagca

SEQ ID NO: 8533168 - DNA, 22 bp, Homo sapiens
agtgtttaatgccttttccagc

SEQ ID NO: 8533169 - DNA, 22 bp, Homo sapiens
agtgcaatgtgtacagaaaaat

SEQ ID NO: 8533170 - DNA, 22 bp, Homo sapiens
agtgcaatgtgtacagaaaaat

SEQ ID NO: 8533171 - DNA, 22 bp, Homo sapiens
actcttcaccgctactgaaata

SEQ ID NO: 8533172 - DNA, 22 bp, Homo sapiens
actcttcacttcccctgccagc

SEQ ID NO: 8533173 - DNA, 22 bp, Homo sapiens
actcttcagtacaataatatct

SEQ ID NO: 8533174 - DNA, 22 bp, Homo sapiens
actcttcacacttgtctccagg

SEQ ID NO: 8533175 - DNA, 22 bp, Homo sapiens
actcttcacacatgctgccctc

SEQ ID NO: 8533176 - DNA, 22 bp, Homo sapiens
actcttattttgaagtaataat

SEQ ID NO: 8533177 - DNA, 22 bp, Homo sapiens
agtgcagggggaaagggtgtct

SEQ ID NO: 8533178 - DNA, 22 bp, Homo sapiens
agtgcagtggttaggagccagg

SEQ ID NO: 8533179 - DNA, 22 bp, Homo sapiens
actctgtgctggggacctcatc

SEQ ID NO: 8533180 - DNA, 22 bp, Homo sapiens
actctgtgtgagtagagcctgt

SEQ ID NO: 8533181 - DNA, 22 bp, Homo sapiens
actctgtgttttggtggcagca

SEQ ID NO: 8533182 - DNA, 22 bp, Homo sapiens
actcttactccctcaggcactg

SEQ ID NO: 8533183 - DNA, 19 bp, Homo sapiens
actctgttgtacttgaggg

SEQ ID NO: 8533184 - DNA, 22 bp, Homo sapiens
actctgtttgcaggtagctcag

SEQ ID NO: 8533185 - DNA, 22 bp, Homo sapiens
actcttattccctcagaaatat

SEQ ID NO: 8533186 - DNA, 22 bp, Homo sapiens
actctgtagggacggttctccc

SEQ ID NO: 8533187 - DNA, 22 bp, Homo sapiens
actctgtagcctgtaagagagc

SEQ ID NO: 8533188 - DNA, 22 bp, Homo sapiens
actgagggccaaaggcactgag

SEQ ID NO: 8533189 - DNA, 22 bp, Homo sapiens
actgaggcttacaaaggtaaag

SEQ ID NO: 8533190 - DNA, 22 bp, Homo sapiens
actgaggcttaaagagattagg

SEQ ID NO: 8533191 - DNA, 22 bp, Homo sapiens
actgaggcgcagtccggctgtc

SEQ ID NO: 8533192 - DNA, 22 bp, Homo sapiens
actgaggatggataggtcatat

SEQ ID NO: 8533193 - DNA, 22 bp, Homo sapiens
actgaggattagcccaggctag

SEQ ID NO: 8533194 - DNA, 22 bp, Homo sapiens
actgaggcagaagggtaagtgg

SEQ ID NO: 8533195 - DNA, 22 bp, Homo sapiens
actgaggaacatatataagatg

SEQ ID NO: 8533196 - DNA, 22 bp, Homo sapiens
actgagctgtgacaatgcttaa

SEQ ID NO: 8533197 - DNA, 22 bp, Homo sapiens
actgagctgcttgaagtgaact

SEQ ID NO: 8533198 - DNA, 22 bp, Homo sapiens
agtgcatgccttcctgtggatg

SEQ ID NO: 8533199 - DNA, 22 bp, Homo sapiens
agtgcatgaaagcatacaaggc

SEQ ID NO: 8533200 - DNA, 22 bp, Homo sapiens
agtgcatagggggatgcacagc

SEQ ID NO: 8533201 - DNA, 22 bp, Homo sapiens
agtgcatatatgaagagtatga

SEQ ID NO: 8533202 - DNA, 22 bp, Homo sapiens
actgagctcttgactgggagtt

SEQ ID NO: 8533203 - DNA, 22 bp, Homo sapiens
actgagctgcaagtcagggagg

SEQ ID NO: 8533204 - DNA, 20 bp, Homo sapiens
actgagctgcatggagagga

SEQ ID NO: 8533205 - DNA, 20 bp, Homo sapiens
actgagctgcatggagagga

SEQ ID NO: 8533206 - DNA, 22 bp, Homo sapiens
agtgcatgtccagtagtttatg

SEQ ID NO: 8533207 - DNA, 22 bp, Homo sapiens
actgagctcttgactgggagtt

SEQ ID NO: 8533208 - DNA, 23 bp, Homo sapiens
agtgcatgcttgacttagcaagc

SEQ ID NO: 8533209 - DNA, 22 bp, Homo sapiens
agtcccagtgagatgaaccagg

SEQ ID NO: 8533210 - DNA, 22 bp, Homo sapiens
agtcccagtgagatgaaccagg

SEQ ID NO: 8533211 - DNA, 22 bp, Homo sapiens
agtcccagtgacttggccagaa

SEQ ID NO: 8533212 - DNA, 22 bp, Homo sapiens
agtcccagtgagatgagccacg

SEQ ID NO: 8533213 - DNA, 22 bp, Homo sapiens
agtcccagtgagatgagccacg

SEQ ID NO: 8533214 - DNA, 22 bp, Homo sapiens
agtcccagtgagatgagccacg

SEQ ID NO: 8533215 - DNA, 22 bp, Homo sapiens
agtcccagtgagatgagccacg

SEQ ID NO: 8533216 - DNA, 22 bp, Homo sapiens
agtcccagttcggttcttcctc

SEQ ID NO: 8533217 - DNA, 22 bp, Homo sapiens
agtcccagttcggttcttcctc

SEQ ID NO: 8533218 - DNA, 22 bp, Homo sapiens
agtcccaggcagccgagccggt

SEQ ID NO: 8533219 - DNA, 22 bp, Homo sapiens
agtcccaggcagccgagccggt

SEQ ID NO: 8533220 - DNA, 22 bp, Homo sapiens
agtcccaggcagccgagccggt

SEQ ID NO: 8533221 - DNA, 22 bp, Homo sapiens
agtcccaggcagccgagccggt

SEQ ID NO: 8533222 - DNA, 22 bp, Homo sapiens
agtcccagcttcccccatgcag

SEQ ID NO: 8533223 - DNA, 22 bp, Homo sapiens
agtcccagcttcccccatgcag

SEQ ID NO: 8533224 - DNA, 22 bp, Homo sapiens
agtcccagcttcccccatgcag

SEQ ID NO: 8533225 - DNA, 22 bp, Homo sapiens
agtcccagtgacttggccagaa

SEQ ID NO: 8533226 - DNA, 22 bp, Homo sapiens
agtcccagtgacttggccagaa

SEQ ID NO: 8533227 - DNA, 21 bp, Homo sapiens
agtcccaggggtgagtgatgt

SEQ ID NO: 8533228 - DNA, 21 bp, Homo sapiens
agtcccaggggtgagtgatgt

SEQ ID NO: 8533229 - DNA, 19 bp, Homo sapiens
agtcccaggcccgaaagag

SEQ ID NO: 8533230 - DNA, 22 bp, Homo sapiens
actcctgggttgcagtcctcaa

SEQ ID NO: 8533231 - DNA, 22 bp, Homo sapiens
actcctgtgggcatggcacccc

SEQ ID NO: 8533232 - DNA, 22 bp, Homo sapiens
actcctggtttgtgtcctggct

SEQ ID NO: 8533233 - DNA, 22 bp, Homo sapiens
actcctggtttgtgtcctggct

SEQ ID NO: 8533234 - DNA, 22 bp, Homo sapiens
actcctggtttgtgtcctggct

SEQ ID NO: 8533235 - DNA, 23 bp, Homo sapiens
actcgtggaattctctgcgatcg

SEQ ID NO: 8533236 - DNA, 22 bp, Homo sapiens
agtcttctgggtgtttccagag

SEQ ID NO: 8533237 - DNA, 22 bp, Homo sapiens
agtcttgcattttctgaagatg

SEQ ID NO: 8533238 - DNA, 22 bp, Homo sapiens
agtcttgctcttgcatctgctt

SEQ ID NO: 8533239 - DNA, 22 bp, Homo sapiens
agtcttctttcatttactcagt

SEQ ID NO: 8533240 - DNA, 22 bp, Homo sapiens
agtcttctttgtgttctctcat

SEQ ID NO: 8533241 - DNA, 22 bp, Homo sapiens
agtcttctttgtgttctctcat

SEQ ID NO: 8533242 - DNA, 22 bp, Homo sapiens
agtcttcttgatcttttcagtg

SEQ ID NO: 8533243 - DNA, 22 bp, Homo sapiens
agtcttcttgatcttttcagtg

SEQ ID NO: 8533244 - DNA, 22 bp, Homo sapiens
agtcttctttcatttactcagt

SEQ ID NO: 8533245 - DNA, 22 bp, Homo sapiens
agtcttctttcatttactcagt

SEQ ID NO: 8533246 - DNA, 22 bp, Homo sapiens
agtctttaacatttggagattg

SEQ ID NO: 8533247 - DNA, 18 bp, Homo sapiens
agtcttgttctgttgccc

SEQ ID NO: 8533248 - DNA, 22 bp, Homo sapiens
atactgtatcacttgtgagtga

SEQ ID NO: 8533249 - DNA, 23 bp, Homo sapiens
actttatcctatatctttgttct

SEQ ID NO: 8533250 - DNA, 22 bp, Homo sapiens
actttatcaggaatcacacagc

SEQ ID NO: 8533251 - DNA, 22 bp, Homo sapiens
actttcaaatatcatgattcta

SEQ ID NO: 8533252 - DNA, 22 bp, Homo sapiens
atactgattagttgagaaagca

SEQ ID NO: 8533253 - DNA, 22 bp, Homo sapiens
atactgatgatgtgaagaaaca

SEQ ID NO: 8533254 - DNA, 22 bp, Homo sapiens
atactgtacgtcccagatagga

SEQ ID NO: 8533255 - DNA, 22 bp, Homo sapiens
atactgtaatacctaaatgaac

SEQ ID NO: 8533256 - DNA, 22 bp, Homo sapiens
atactgtaatacctaaatgaac

SEQ ID NO: 8533257 - DNA, 23 bp, Homo sapiens
atactgaaactgttgtttatctg

SEQ ID NO: 8533258 - DNA, 22 bp, Homo sapiens
atactgaattaggtaaagcata

SEQ ID NO: 8533259 - DNA, 22 bp, Homo sapiens
atactgaattaggtaaagcata

SEQ ID NO: 8533260 - DNA, 22 bp, Homo sapiens
atactgaattaggtaaagcata

SEQ ID NO: 8533261 - DNA, 22 bp, Homo sapiens
atactgaattaggtaaagcata

SEQ ID NO: 8533262 - DNA, 22 bp, Homo sapiens
atactgaaggcattcagataac

SEQ ID NO: 8533263 - DNA, 22 bp, Homo sapiens
atacatgttgagaaaatatctg

SEQ ID NO: 8533264 - DNA, 22 bp, Homo sapiens
atacatgttcgtgtacatgttc

SEQ ID NO: 8533265 - DNA, 22 bp, Homo sapiens
atacatgttgagaaaatatctg

SEQ ID NO: 8533266 - DNA, 22 bp, Homo sapiens
atacatgttcgtgtacatgttc

SEQ ID NO: 8533267 - DNA, 22 bp, Homo sapiens
acttcttgggaccctggcaccg

SEQ ID NO: 8533268 - DNA, 22 bp, Homo sapiens
atacatctatgcctttctgaca

SEQ ID NO: 8533269 - DNA, 22 bp, Homo sapiens
acttctggtgtcatactgcatt

SEQ ID NO: 8533270 - DNA, 22 bp, Homo sapiens
acttctgtaaagggaagacagt

SEQ ID NO: 8533271 - DNA, 22 bp, Homo sapiens
acttctgtatgtcctgcattca

SEQ ID NO: 8533272 - DNA, 22 bp, Homo sapiens
acttctgtatgtcctgcattca

SEQ ID NO: 8533273 - DNA, 22 bp, Homo sapiens
acttctgtcctccaagccacgt

SEQ ID NO: 8533274 - DNA, 22 bp, Homo sapiens
acttctgtcctccaagccacgt

SEQ ID NO: 8533275 - DNA, 22 bp, Homo sapiens
acttcttcttcagctgggggat

SEQ ID NO: 8533276 - DNA, 22 bp, Homo sapiens
atacattagctcatatgattaa

SEQ ID NO: 8533277 - DNA, 22 bp, Homo sapiens
atacattagctcatatgattaa

SEQ ID NO: 8533278 - DNA, 22 bp, Homo sapiens
atacattagctcatatgattaa

SEQ ID NO: 8533279 - DNA, 22 bp, Homo sapiens
atacattagtgaacaaaagaga

SEQ ID NO: 8533280 - DNA, 22 bp, Homo sapiens
atacatgttgtaccatatgttt

SEQ ID NO: 8533281 - DNA, 22 bp, Homo sapiens
atacatgttgtaccatatgttt

SEQ ID NO: 8533282 - DNA, 22 bp, Homo sapiens
atacattagaatctggtactca

SEQ ID NO: 8533283 - DNA, 22 bp, Homo sapiens
atacatgttgtaccatatgttt

SEQ ID NO: 8533284 - DNA, 22 bp, Homo sapiens
atacatgttgtaccatatgttt

SEQ ID NO: 8533285 - DNA, 22 bp, Homo sapiens
atacatgtttgctggataaaca

SEQ ID NO: 8533286 - DNA, 22 bp, Homo sapiens
acttaacagacattatttacct

SEQ ID NO: 8533287 - DNA, 21 bp, Homo sapiens
acttaaattccttgatattta

SEQ ID NO: 8533288 - DNA, 21 bp, Homo sapiens
acttaaattccttgatattta

SEQ ID NO: 8533289 - DNA, 21 bp, Homo sapiens
acttaaattccttgatattta

SEQ ID NO: 8533290 - DNA, 23 bp, Homo sapiens
acttaaatggttctttatctcag

SEQ ID NO: 8533291 - DNA, 23 bp, Homo sapiens
acttaaatggttctttatctcag

SEQ ID NO: 8533292 - DNA, 22 bp, Homo sapiens
ataatggccgggggctgaatgc

SEQ ID NO: 8533293 - DNA, 22 bp, Homo sapiens
acttaaagttataatttgctaa

SEQ ID NO: 8533294 - DNA, 22 bp, Homo sapiens
ataatgcatttagaataattca

SEQ ID NO: 8533295 - DNA, 22 bp, Homo sapiens
ataatgcatttagaataattca

SEQ ID NO: 8533296 - DNA, 22 bp, Homo sapiens
ataatgcatttagaataattca

SEQ ID NO: 8533297 - DNA, 22 bp, Homo sapiens
ataatgctgggagaaattgtta

SEQ ID NO: 8533298 - DNA, 22 bp, Homo sapiens
ataatgcgaggagaaaatgaag

SEQ ID NO: 8533299 - DNA, 22 bp, Homo sapiens
ataatgcgcctcagaaaacaga

SEQ ID NO: 8533300 - DNA, 22 bp, Homo sapiens
acttagaaagggattctagatt

SEQ ID NO: 8533301 - DNA, 22 bp, Homo sapiens
acttacaatcaaccaccttgga

SEQ ID NO: 8533302 - DNA, 22 bp, Homo sapiens
acttaacagacattatttacct

SEQ ID NO: 8533303 - DNA, 22 bp, Homo sapiens
acttaacagacattatttacct

SEQ ID NO: 8533304 - DNA, 22 bp, Homo sapiens
acttacaagctagggaagcttg

SEQ ID NO: 8533305 - DNA, 22 bp, Homo sapiens
acttacaagttccctttctcag

SEQ ID NO: 8533306 - DNA, 22 bp, Homo sapiens
acttagaacaggcagaattcca

SEQ ID NO: 8533307 - DNA, 22 bp, Homo sapiens
acttagaagatgcagtaaagca

SEQ ID NO: 8533308 - DNA, 22 bp, Homo sapiens
acttagaagatgcagtaaagca

SEQ ID NO: 8533309 - DNA, 20 bp, Homo sapiens
atacacttgcccagcttgtg

SEQ ID NO: 8533310 - DNA, 22 bp, Homo sapiens
atacacttgtacattttttaat

SEQ ID NO: 8533311 - DNA, 22 bp, Homo sapiens
atacacttgtacattttttaat

SEQ ID NO: 8533312 - DNA, 22 bp, Homo sapiens
atacagcttacagttctaatgc

SEQ ID NO: 8533313 - DNA, 22 bp, Homo sapiens
atacagcttatgcatatatctc

SEQ ID NO: 8533314 - DNA, 22 bp, Homo sapiens
atacagcttatgcatatatctc

SEQ ID NO: 8533315 - DNA, 22 bp, Homo sapiens
atacagctttctttcacatgag

SEQ ID NO: 8533316 - DNA, 22 bp, Homo sapiens
atacagcttacagttctaatgc

SEQ ID NO: 8533317 - DNA, 22 bp, Homo sapiens
atacagcctattcttaccattg

SEQ ID NO: 8533318 - DNA, 22 bp, Homo sapiens
atacagctgccttctaactatg

SEQ ID NO: 8533319 - DNA, 22 bp, Homo sapiens
atacagattgctatacttacaa

SEQ ID NO: 8533320 - DNA, 22 bp, Homo sapiens
acttctgaagcagagatttggg

SEQ ID NO: 8533321 - DNA, 22 bp, Homo sapiens
acttctctttagtactaaatgt

SEQ ID NO: 8533322 - DNA, 19 bp, Homo sapiens
acttctgaggaactgcaca

SEQ ID NO: 8533323 - DNA, 22 bp, Homo sapiens
atacagtaaccacattctatag

SEQ ID NO: 8533324 - DNA, 22 bp, Homo sapiens
acttctctttagtactaaatgt

SEQ ID NO: 8533325 - DNA, 22 bp, Homo sapiens
acttctcttccccggaactcta

SEQ ID NO: 8533326 - DNA, 22 bp, Homo sapiens
acttctcttccccggaactcta

SEQ ID NO: 8533327 - DNA, 22 bp, Homo sapiens
atacagtaaccacattctatag

SEQ ID NO: 8533328 - DNA, 22 bp, Homo sapiens
actgtacatgtaaacattgtca

SEQ ID NO: 8533329 - DNA, 22 bp, Homo sapiens
actgtacatgtaaacattgtca

SEQ ID NO: 8533330 - DNA, 22 bp, Homo sapiens
actgtacatgtaaacattgtca

SEQ ID NO: 8533331 - DNA, 22 bp, Homo sapiens
actgtaaccagtgtggtgagag

SEQ ID NO: 8533332 - DNA, 22 bp, Homo sapiens
actgtaacactcatactgaagt

SEQ ID NO: 8533333 - DNA, 22 bp, Homo sapiens
actgtaacacaatggtatctgt

SEQ ID NO: 8533334 - DNA, 20 bp, Homo sapiens
actgggagctaacggagatt

SEQ ID NO: 8533335 - DNA, 22 bp, Homo sapiens
actgtaaattttggttgcaggt

SEQ ID NO: 8533336 - DNA, 22 bp, Homo sapiens
actgtacttttcttggctagat

SEQ ID NO: 8533337 - DNA, 22 bp, Homo sapiens
actgtagctgccactggatgca

SEQ ID NO: 8533338 - DNA, 19 bp, Homo sapiens
actgtagcactgcagtata

SEQ ID NO: 8533339 - DNA, 22 bp, Homo sapiens
actgtagaggcctggattgagg

SEQ ID NO: 8533340 - DNA, 22 bp, Homo sapiens
actgtactgtgtattgtagaat

SEQ ID NO: 8533341 - DNA, 22 bp, Homo sapiens
actgggactgtatgtgctggac

SEQ ID NO: 8533342 - DNA, 22 bp, Homo sapiens
actgggagaaactgacacctta

SEQ ID NO: 8533343 - DNA, 22 bp, Homo sapiens
actgtataaggcataggtaagc

SEQ ID NO: 8533344 - DNA, 22 bp, Homo sapiens
actgtataaggcataggtaagc

SEQ ID NO: 8533345 - DNA, 22 bp, Homo sapiens
actgtagctgccactggatgca

SEQ ID NO: 8533346 - DNA, 22 bp, Homo sapiens
actgtatacttctgtatacaat

SEQ ID NO: 8533347 - DNA, 22 bp, Homo sapiens
actgtatagatggagttgattt

SEQ ID NO: 8533348 - DNA, 22 bp, Homo sapiens
actgtatagtatttattcttag

SEQ ID NO: 8533349 - DNA, 22 bp, Homo sapiens
actgtattctagtcatgtttgt

SEQ ID NO: 8533350 - DNA, 22 bp, Homo sapiens
actgtattctagtcatgtttgt

SEQ ID NO: 8533351 - DNA, 22 bp, Homo sapiens
actgtatagtatttattcttag

SEQ ID NO: 8533352 - DNA, 22 bp, Homo sapiens
actgtattttgggtgtattttc

SEQ ID NO: 8533353 - DNA, 22 bp, Homo sapiens
actgtatttccaacagacaaat

SEQ ID NO: 8533354 - DNA, 22 bp, Homo sapiens
ataaaaactgacccatcctttg

SEQ ID NO: 8533355 - DNA, 22 bp, Homo sapiens
actgtcatcttgtaagcaatgt

SEQ ID NO: 8533356 - DNA, 22 bp, Homo sapiens
actgtcatctggtagatgatgg

SEQ ID NO: 8533357 - DNA, 22 bp, Homo sapiens
actgtcatcagaagatgaaaat

SEQ ID NO: 8533358 - DNA, 22 bp, Homo sapiens
actgtcactgtgatgttagaga

SEQ ID NO: 8533359 - DNA, 22 bp, Homo sapiens
actgtcacttgcaactgtgagg

SEQ ID NO: 8533360 - DNA, 22 bp, Homo sapiens
actgtcaggatggcagcttgtt

SEQ ID NO: 8533361 - DNA, 22 bp, Homo sapiens
actgtcacttgcaactgtgagg

SEQ ID NO: 8533362 - DNA, 22 bp, Homo sapiens
actgtcacttgcaactgtgagg

SEQ ID NO: 8533363 - DNA, 22 bp, Homo sapiens
actgtcaccatcagagcgggaa

SEQ ID NO: 8533364 - DNA, 22 bp, Homo sapiens
actgtcactaactaagtctagt

SEQ ID NO: 8533365 - DNA, 22 bp, Homo sapiens
actgtcactaactaagtctagt

SEQ ID NO: 8533366 - DNA, 22 bp, Homo sapiens
actgtcactccaactgagtcgt

SEQ ID NO: 8533367 - DNA, 19 bp, Homo sapiens
actgtcacataaaggaagg

SEQ ID NO: 8533368 - DNA, 22 bp, Homo sapiens
ataaaatttgctactgttaaat

SEQ ID NO: 8533369 - DNA, 22 bp, Homo sapiens
ataaaatttgctactgttaaat

SEQ ID NO: 8533370 - DNA, 22 bp, Homo sapiens
ataaaatttgctactgttaaat

SEQ ID NO: 8533371 - DNA, 22 bp, Homo sapiens
ataaaaactgacccatcctttg

SEQ ID NO: 8533372 - DNA, 22 bp, Homo sapiens
ataaaatggtaaacgaagctga

SEQ ID NO: 8533373 - DNA, 22 bp, Homo sapiens
ataaaatttgctactgttaaat

SEQ ID NO: 8533374 - DNA, 22 bp, Homo sapiens
ataaaatttgctactgttaaat

SEQ ID NO: 8533375 - DNA, 22 bp, Homo sapiens
ataaaatttgctactgttaaat

SEQ ID NO: 8533376 - DNA, 22 bp, Homo sapiens
actgtgatgttctctatcttgg

SEQ ID NO: 8533377 - DNA, 22 bp, Homo sapiens
actgtgagtttatttatctgat

SEQ ID NO: 8533378 - DNA, 22 bp, Homo sapiens
actgtgagcagcgacctgagga

SEQ ID NO: 8533379 - DNA, 21 bp, Homo sapiens
actgtgataatgctttttctg

SEQ ID NO: 8533380 - DNA, 22 bp, Homo sapiens
actgtgcacaattctaagtcct

SEQ ID NO: 8533381 - DNA, 22 bp, Homo sapiens
actgtgcaatgagtaataaact

SEQ ID NO: 8533382 - DNA, 22 bp, Homo sapiens
ataaacagtagagaaaggtggt

SEQ ID NO: 8533383 - DNA, 22 bp, Homo sapiens
ataaacagtagagaaaggtggt

SEQ ID NO: 8533384 - DNA, 22 bp, Homo sapiens
ataaacagctccatttagtgcc

SEQ ID NO: 8533385 - DNA, 22 bp, Homo sapiens
actgtgcatgaaccgaaacaaa

SEQ ID NO: 8533386 - DNA, 22 bp, Homo sapiens
actgtgcaggtagatgcctggg

SEQ ID NO: 8533387 - DNA, 22 bp, Homo sapiens
actgtgcacacaaaaatagatt

SEQ ID NO: 8533388 - DNA, 22 bp, Homo sapiens
ataaggtatgaaaagtaaatgg

SEQ ID NO: 8533389 - DNA, 22 bp, Homo sapiens
actgtgccacaattcaccaggg

SEQ ID NO: 8533390 - DNA, 22 bp, Homo sapiens
ataaggttaacatcatcagtga

SEQ ID NO: 8533391 - DNA, 22 bp, Homo sapiens
ataaggttaacatcatcagtga

SEQ ID NO: 8533392 - DNA, 22 bp, Homo sapiens
ataaggttggtcttaactacct

SEQ ID NO: 8533393 - DNA, 22 bp, Homo sapiens
ataaggttaggattatagtgtt

SEQ ID NO: 8533394 - DNA, 22 bp, Homo sapiens
ataaggttggtcttaactacct

SEQ ID NO: 8533395 - DNA, 22 bp, Homo sapiens
ataatccatgtctagagtaaag

SEQ ID NO: 8533396 - DNA, 22 bp, Homo sapiens
actgtgcatgaaccgaaacaaa

SEQ ID NO: 8533397 - DNA, 22 bp, Homo sapiens
actgtgcattccccaacctgtg

SEQ ID NO: 8533398 - DNA, 22 bp, Homo sapiens
ataatcttgtatttcctaaagt

SEQ ID NO: 8533399 - DNA, 22 bp, Homo sapiens
ataatctgtggatggttttgag

SEQ ID NO: 8533400 - DNA, 22 bp, Homo sapiens
ataatctggtctttgtatgagt

SEQ ID NO: 8533401 - DNA, 22 bp, Homo sapiens
ataatctggcttgtttgcttaa

SEQ ID NO: 8533402 - DNA, 22 bp, Homo sapiens
ataatctgagctatttcatgag

SEQ ID NO: 8533403 - DNA, 22 bp, Homo sapiens
ataatcctgctttttcactatt

SEQ ID NO: 8533404 - DNA, 22 bp, Homo sapiens
ataatccattaattaatgacca

SEQ ID NO: 8533405 - DNA, 22 bp, Homo sapiens
ataatctgacaaagacttaagc

SEQ ID NO: 8533406 - DNA, 22 bp, Homo sapiens
ataatccattaattaatgacca

SEQ ID NO: 8533407 - DNA, 22 bp, Homo sapiens
ataatccatgtctagagtaaag

SEQ ID NO: 8533408 - DNA, 22 bp, Homo sapiens
ataatgaatgcagagttatttt

SEQ ID NO: 8533409 - DNA, 22 bp, Homo sapiens
ataatgcacctttgagtatggc

SEQ ID NO: 8533410 - DNA, 23 bp, Homo sapiens
ataatgcaagtggtggtaatctg

SEQ ID NO: 8533411 - DNA, 22 bp, Homo sapiens
ataatgcacctttgagtatggc

SEQ ID NO: 8533412 - DNA, 22 bp, Homo sapiens
ataatgcagcttttcaatggcc

SEQ ID NO: 8533413 - DNA, 23 bp, Homo sapiens
agaaaagttcatacctttttaac

SEQ ID NO: 8533414 - DNA, 22 bp, Homo sapiens
agaaaagtttaaatcttggcac

SEQ ID NO: 8533415 - DNA, 22 bp, Homo sapiens
agaaaagttttctgagactgac

SEQ ID NO: 8533416 - DNA, 22 bp, Homo sapiens
agaaaataaattgatggtggaa

SEQ ID NO: 8533417 - DNA, 21 bp, Homo sapiens
agaaaagtatttgaatcaaga

SEQ ID NO: 8533418 - DNA, 21 bp, Homo sapiens
agaaaagtatttgaatcaaga

SEQ ID NO: 8533419 - DNA, 21 bp, Homo sapiens
agaaaagtatttgaatcaaga

SEQ ID NO: 8533420 - DNA, 21 bp, Homo sapiens
agaaaagtagagttttcagag

SEQ ID NO: 8533421 - DNA, 21 bp, Homo sapiens
agaaaagtatttgaatcaaga

SEQ ID NO: 8533422 - DNA, 21 bp, Homo sapiens
agaaaagtatttgaatcaaga

SEQ ID NO: 8533423 - DNA, 22 bp, Homo sapiens
agaaaataaattgatggtggaa

SEQ ID NO: 8533424 - DNA, 22 bp, Homo sapiens
atattacacacggtatcacggg

SEQ ID NO: 8533425 - DNA, 22 bp, Homo sapiens
atattcatcgtgtagaaatact

SEQ ID NO: 8533426 - DNA, 22 bp, Homo sapiens
atattcattgaacacctactac

SEQ ID NO: 8533427 - DNA, 22 bp, Homo sapiens
atattctctgctgcttttgtgt

SEQ ID NO: 8533428 - DNA, 22 bp, Homo sapiens
atattctgcctcactacagttg

SEQ ID NO: 8533429 - DNA, 22 bp, Homo sapiens
atattcctgtttttaacacttt

SEQ ID NO: 8533430 - DNA, 22 bp, Homo sapiens
atattcttatccttttctctgt

SEQ ID NO: 8533431 - DNA, 22 bp, Homo sapiens
atattcttatccttttctctgt

SEQ ID NO: 8533432 - DNA, 22 bp, Homo sapiens
atattcttccaaaacatcattt

SEQ ID NO: 8533433 - DNA, 22 bp, Homo sapiens
atattcttccaaaacatcattt

SEQ ID NO: 8533434 - DNA, 22 bp, Homo sapiens
atattcttccaaaacatcattt

SEQ ID NO: 8533435 - DNA, 22 bp, Homo sapiens
atatttataagcaagcaggact

SEQ ID NO: 8533436 - DNA, 22 bp, Homo sapiens
atatttataagcaagcaggact

SEQ ID NO: 8533437 - DNA, 22 bp, Homo sapiens
atatttataaggcaggcaagta

SEQ ID NO: 8533438 - DNA, 22 bp, Homo sapiens
atatttataaggcaggcaagta

SEQ ID NO: 8533439 - DNA, 22 bp, Homo sapiens
atatttataagcaagcaggact

SEQ ID NO: 8533440 - DNA, 22 bp, Homo sapiens
atattcttccaaaacatcattt

SEQ ID NO: 8533441 - DNA, 22 bp, Homo sapiens
atattcttccaaaacatcattt

SEQ ID NO: 8533442 - DNA, 22 bp, Homo sapiens
atatttataaggcaggcaagta

SEQ ID NO: 8533443 - DNA, 22 bp, Homo sapiens
agaaagctccccatgagatgat

SEQ ID NO: 8533444 - DNA, 23 bp, Homo sapiens
atatttccaggttagtgaggtaa

SEQ ID NO: 8533445 - DNA, 23 bp, Homo sapiens
atatttccaggttagtgaggtaa

SEQ ID NO: 8533446 - DNA, 22 bp, Homo sapiens
atatttcatggggttccatact

SEQ ID NO: 8533447 - DNA, 23 bp, Homo sapiens
atatttccaggttagtgaggtaa

SEQ ID NO: 8533448 - DNA, 22 bp, Homo sapiens
actttcctggccctgtcctctg

SEQ ID NO: 8533449 - DNA, 22 bp, Homo sapiens
actttcctggccctgtcctctg

SEQ ID NO: 8533450 - DNA, 22 bp, Homo sapiens
actttccttatggatggggaaa

SEQ ID NO: 8533451 - DNA, 22 bp, Homo sapiens
actttctattcccacagagata

SEQ ID NO: 8533452 - DNA, 22 bp, Homo sapiens
actttctattcccacagagata

SEQ ID NO: 8533453 - DNA, 22 bp, Homo sapiens
actttctcaaatcagactttaa

SEQ ID NO: 8533454 - DNA, 22 bp, Homo sapiens
actttctattcccacagagata

SEQ ID NO: 8533455 - DNA, 22 bp, Homo sapiens
actttctattcccacagagata

SEQ ID NO: 8533456 - DNA, 22 bp, Homo sapiens
actttctaggtctcagtccttt

SEQ ID NO: 8533457 - DNA, 22 bp, Homo sapiens
actttctaggtctcagtccttt

SEQ ID NO: 8533458 - DNA, 22 bp, Homo sapiens
actttcaagaacttctttaatg

SEQ ID NO: 8533459 - DNA, 22 bp, Homo sapiens
actttcaagccctctagagaca

SEQ ID NO: 8533460 - DNA, 22 bp, Homo sapiens
actttcaagccctctagagaca

SEQ ID NO: 8533461 - DNA, 22 bp, Homo sapiens
actttcatgttggtgaagggtt

SEQ ID NO: 8533462 - DNA, 22 bp, Homo sapiens
actttcatttgtaataaacttc

SEQ ID NO: 8533463 - DNA, 20 bp, Homo sapiens
actttctcggtttctcacct

SEQ ID NO: 8533464 - DNA, 22 bp, Homo sapiens
actttctcccacccacccgtct

SEQ ID NO: 8533465 - DNA, 19 bp, Homo sapiens
actttctccaggacctgtt

SEQ ID NO: 8533466 - DNA, 22 bp, Homo sapiens
actttctccagaaaaccaagga

SEQ ID NO: 8533467 - DNA, 22 bp, Homo sapiens
actttctcaggaattcacagac

SEQ ID NO: 8533468 - DNA, 22 bp, Homo sapiens
actttctcaggaattcacagac

SEQ ID NO: 8533469 - DNA, 22 bp, Homo sapiens
atatgaaagtaagcatgtgtgt

SEQ ID NO: 8533470 - DNA, 22 bp, Homo sapiens
atatgaaagtaagcatgtgtgt

SEQ ID NO: 8533471 - DNA, 22 bp, Homo sapiens
atatgcttacagcttaaaatcc

SEQ ID NO: 8533472 - DNA, 22 bp, Homo sapiens
atatgcttgactctttcacatc

SEQ ID NO: 8533473 - DNA, 22 bp, Homo sapiens
atatggaactattctgtgtaga

SEQ ID NO: 8533474 - DNA, 22 bp, Homo sapiens
atatggaaatagcaatatggtt

SEQ ID NO: 8533475 - DNA, 22 bp, Homo sapiens
atatggaaatagcaatatggtt

SEQ ID NO: 8533476 - DNA, 22 bp, Homo sapiens
atatggaagagcctgggaattt

SEQ ID NO: 8533477 - DNA, 22 bp, Homo sapiens
atatggaagttacctgacttca

SEQ ID NO: 8533478 - DNA, 22 bp, Homo sapiens
atatggaactattctgtgtaga

SEQ ID NO: 8533479 - DNA, 22 bp, Homo sapiens
atatggaactattctgtgtaga

SEQ ID NO: 8533480 - DNA, 18 bp, Homo sapiens
atatggaatgcctggcta

SEQ ID NO: 8533481 - DNA, 18 bp, Homo sapiens
atatggaatgcctggcta

SEQ ID NO: 8533482 - DNA, 22 bp, Homo sapiens
atatggaagttacctgacttca

SEQ ID NO: 8533483 - DNA, 22 bp, Homo sapiens
atatggaagttacctgacttca

SEQ ID NO: 8533484 - DNA, 22 bp, Homo sapiens
atatggagaactcaaaaagtga

SEQ ID NO: 8533485 - DNA, 22 bp, Homo sapiens
agaaaaggttgaaagtaggatt

SEQ ID NO: 8533486 - DNA, 22 bp, Homo sapiens
agaaaaggttgaaagtaggatt

SEQ ID NO: 8533487 - DNA, 22 bp, Homo sapiens
atatggaatggtaatctacaat

SEQ ID NO: 8533488 - DNA, 22 bp, Homo sapiens
atatggaatggtaatctacaat

SEQ ID NO: 8533489 - DNA, 22 bp, Homo sapiens
atcatcttgaaagtctatgttt

SEQ ID NO: 8533490 - DNA, 22 bp, Homo sapiens
atcatcttgaaagtctatgttt

SEQ ID NO: 8533491 - DNA, 22 bp, Homo sapiens
atcatcttgaaagtctatgttt

SEQ ID NO: 8533492 - DNA, 22 bp, Homo sapiens
atcatcttcgaaaaaagtcaga

SEQ ID NO: 8533493 - DNA, 22 bp, Homo sapiens
atcatcttatctgactcatttt

SEQ ID NO: 8533494 - DNA, 22 bp, Homo sapiens
atcatcttaaatctagaatgtg

SEQ ID NO: 8533495 - DNA, 22 bp, Homo sapiens
atcatcttaaggtatctcaagc

SEQ ID NO: 8533496 - DNA, 18 bp, Homo sapiens
atcctgggagcagacagc

SEQ ID NO: 8533497 - DNA, 22 bp, Homo sapiens
atcatcttgctttctgtttact

SEQ ID NO: 8533498 - DNA, 22 bp, Homo sapiens
atcatcttgctttctgtttact

SEQ ID NO: 8533499 - DNA, 22 bp, Homo sapiens
atcctttatctttcctaggaat

SEQ ID NO: 8533500 - DNA, 22 bp, Homo sapiens
atcgcaatgtttagaattttgt

SEQ ID NO: 8533501 - DNA, 22 bp, Homo sapiens
atcatccatctagcgcgggggg

SEQ ID NO: 8533502 - DNA, 22 bp, Homo sapiens
atcatccactggagccggcagg

SEQ ID NO: 8533503 - DNA, 22 bp, Homo sapiens
atcatccaagcgtagttcttct

SEQ ID NO: 8533504 - DNA, 22 bp, Homo sapiens
agaacaggaggaagccagctcc

SEQ ID NO: 8533505 - DNA, 22 bp, Homo sapiens
agaacaggcagttggttggatt

SEQ ID NO: 8533506 - DNA, 22 bp, Homo sapiens
agaacaggaggaagccagctcc

SEQ ID NO: 8533507 - DNA, 22 bp, Homo sapiens
agaacaggaggaagccagctcc

SEQ ID NO: 8533508 - DNA, 22 bp, Homo sapiens
atcatcctagaaggaagctagg

SEQ ID NO: 8533509 - DNA, 22 bp, Homo sapiens
atcatcctattgtgccccaggt

SEQ ID NO: 8533510 - DNA, 22 bp, Homo sapiens
atcatcctagaaggaagctagg

SEQ ID NO: 8533511 - DNA, 22 bp, Homo sapiens
atcatccatggctgatcataaa

SEQ ID NO: 8533512 - DNA, 22 bp, Homo sapiens
atcatctgggttaatgtgctca

SEQ ID NO: 8533513 - DNA, 22 bp, Homo sapiens
atcatctgcacagatcctattt

SEQ ID NO: 8533514 - DNA, 22 bp, Homo sapiens
atcatctgcctcatcactgcat

SEQ ID NO: 8533515 - DNA, 20 bp, Homo sapiens
atcatctcaaagctgaggtt

SEQ ID NO: 8533516 - DNA, 22 bp, Homo sapiens
atctaaagtgtttcatgaaaga

SEQ ID NO: 8533517 - DNA, 22 bp, Homo sapiens
atctaactgggctattttattg

SEQ ID NO: 8533518 - DNA, 22 bp, Homo sapiens
atctaacttatgttttaccaaa

SEQ ID NO: 8533519 - DNA, 22 bp, Homo sapiens
atctaacagcaacaccagaata

SEQ ID NO: 8533520 - DNA, 22 bp, Homo sapiens
atctaaaaggagctctttatct

SEQ ID NO: 8533521 - DNA, 22 bp, Homo sapiens
atctaaaaggagctctttatct

SEQ ID NO: 8533522 - DNA, 22 bp, Homo sapiens
atcgtttaccctgagtgattgc

SEQ ID NO: 8533523 - DNA, 22 bp, Homo sapiens
atcgtaaagccctatggcttca

SEQ ID NO: 8533524 - DNA, 21 bp, Homo sapiens
atctcacagcccagagaagcc

SEQ ID NO: 8533525 - DNA, 21 bp, Homo sapiens
atctcacagcccagagaagcc

SEQ ID NO: 8533526 - DNA, 22 bp, Homo sapiens
atctcaaagcatggagcagaat

SEQ ID NO: 8533527 - DNA, 22 bp, Homo sapiens
atctcaaagcatggagcagaat

SEQ ID NO: 8533528 - DNA, 22 bp, Homo sapiens
atctcaaatgattacaccaagc

SEQ ID NO: 8533529 - DNA, 22 bp, Homo sapiens
atctaagagttaacatcaagaa

SEQ ID NO: 8533530 - DNA, 22 bp, Homo sapiens
atctaagatgtattgagcactt

SEQ ID NO: 8533531 - DNA, 22 bp, Homo sapiens
atctaagattttgctaagatca

SEQ ID NO: 8533532 - DNA, 22 bp, Homo sapiens
atctattttaaatggcagtaaa

SEQ ID NO: 8533533 - DNA, 22 bp, Homo sapiens
atctcaaacatctttgaccata

SEQ ID NO: 8533534 - DNA, 22 bp, Homo sapiens
agaacagaagggaggaaggcct

SEQ ID NO: 8533535 - DNA, 22 bp, Homo sapiens
agaacagaggccttatgtttca

SEQ ID NO: 8533536 - DNA, 22 bp, Homo sapiens
agaacagaggccttatgtttca

SEQ ID NO: 8533537 - DNA, 22 bp, Homo sapiens
agaacagatgtgggcagacctg

SEQ ID NO: 8533538 - DNA, 22 bp, Homo sapiens
agaacagcagttatggttcatt

SEQ ID NO: 8533539 - DNA, 22 bp, Homo sapiens
agaacagcagcacgtcaagctg

SEQ ID NO: 8533540 - DNA, 22 bp, Homo sapiens
agaacactgctagtataatcac

SEQ ID NO: 8533541 - DNA, 22 bp, Homo sapiens
agaacacatagagaagttttat

SEQ ID NO: 8533542 - DNA, 22 bp, Homo sapiens
agaacacactgggggaaacaag

SEQ ID NO: 8533543 - DNA, 22 bp, Homo sapiens
agaaagttgttggaggaaatga

SEQ ID NO: 8533544 - DNA, 22 bp, Homo sapiens
agaaagtttattcctatctagc

SEQ ID NO: 8533545 - DNA, 22 bp, Homo sapiens
agaaagtttgagaactgtagat

SEQ ID NO: 8533546 - DNA, 22 bp, Homo sapiens
agaaagtttgagaactgtagat

SEQ ID NO: 8533547 - DNA, 22 bp, Homo sapiens
agaaagtttatttcttgatgga

SEQ ID NO: 8533548 - DNA, 22 bp, Homo sapiens
agaaagtttggggctgggcacg

SEQ ID NO: 8533549 - DNA, 22 bp, Homo sapiens
agaaattaggaaagtaacactt

SEQ ID NO: 8533550 - DNA, 23 bp, Homo sapiens
agaaagtttgtgccttgtgacac

SEQ ID NO: 8533551 - DNA, 23 bp, Homo sapiens
agaaagtcatggccaggtttgat

SEQ ID NO: 8533552 - DNA, 22 bp, Homo sapiens
agaaagtacagatgagacactt

SEQ ID NO: 8533553 - DNA, 22 bp, Homo sapiens
agaaaggtggatgctctggaat

SEQ ID NO: 8533554 - DNA, 22 bp, Homo sapiens
agaaaggtcaaaatcgtgacat

SEQ ID NO: 8533555 - DNA, 22 bp, Homo sapiens
agaaaggtcacttagcctcagc

SEQ ID NO: 8533556 - DNA, 22 bp, Homo sapiens
agaaagtgcctcccttgggagc

SEQ ID NO: 8533557 - DNA, 22 bp, Homo sapiens
agaaagtgcctcccttgggagc

SEQ ID NO: 8533558 - DNA, 22 bp, Homo sapiens
agaaagtgaccttgaaaactgg

SEQ ID NO: 8533559 - DNA, 22 bp, Homo sapiens
agaaagtgaccttgaaaactgg

SEQ ID NO: 8533560 - DNA, 22 bp, Homo sapiens
agaaagtgaacgtgttcagttt

SEQ ID NO: 8533561 - DNA, 22 bp, Homo sapiens
agaaagtgcttccctttggact

SEQ ID NO: 8533562 - DNA, 22 bp, Homo sapiens
agaaagtgcttccctttggtga

SEQ ID NO: 8533563 - DNA, 22 bp, Homo sapiens
agaaagtgtgtcatactaagtg

SEQ ID NO: 8533564 - DNA, 22 bp, Homo sapiens
agaaagttaaacagtgataaga

SEQ ID NO: 8533565 - DNA, 22 bp, Homo sapiens
agaaagttaaacagtgataaga

SEQ ID NO: 8533566 - DNA, 22 bp, Homo sapiens
agaaagttaaacagtgataaga

SEQ ID NO: 8533567 - DNA, 22 bp, Homo sapiens
agaaagttaaacagtgataaga

SEQ ID NO: 8533568 - DNA, 22 bp, Homo sapiens
agaaagttagcagactcttggc

SEQ ID NO: 8533569 - DNA, 22 bp, Homo sapiens
agaaagttagcagactcttggc

SEQ ID NO: 8533570 - DNA, 22 bp, Homo sapiens
agaaagttatcacaaaattgag

SEQ ID NO: 8533571 - DNA, 22 bp, Homo sapiens
agaaagttatcacaaaattgag

SEQ ID NO: 8533572 - DNA, 22 bp, Homo sapiens
agaaagttcactggtatatttt

SEQ ID NO: 8533573 - DNA, 22 bp, Homo sapiens
agaaagttctgtgagttgttca

SEQ ID NO: 8533574 - DNA, 22 bp, Homo sapiens
agaaagttctgtgagttgttca

SEQ ID NO: 8533575 - DNA, 22 bp, Homo sapiens
agaaagttcactggtatatttt

SEQ ID NO: 8533576 - DNA, 22 bp, Homo sapiens
agaaagttgttggaggaaatga

SEQ ID NO: 8533577 - DNA, 22 bp, Homo sapiens
agaaagttgttttagccaaacc

SEQ ID NO: 8533578 - DNA, 18 bp, Homo sapiens
acagtaaagaaaggaatt

SEQ ID NO: 8533579 - DNA, 18 bp, Homo sapiens
acagtaaagaaaggaatt

SEQ ID NO: 8533580 - DNA, 18 bp, Homo sapiens
acagtaaagaaaggaatt

SEQ ID NO: 8533581 - DNA, 22 bp, Homo sapiens
acagtaaagccttctggttgac

SEQ ID NO: 8533582 - DNA, 22 bp, Homo sapiens
acagtaaagccttctggttgac

SEQ ID NO: 8533583 - DNA, 22 bp, Homo sapiens
acagtaaataatgcatgttgat

SEQ ID NO: 8533584 - DNA, 22 bp, Homo sapiens
acagtaaataatgcatgttgat

SEQ ID NO: 8533585 - DNA, 22 bp, Homo sapiens
acagtaaataatgcatgttgat

SEQ ID NO: 8533586 - DNA, 22 bp, Homo sapiens
acagtaaaaagccttagaattt

SEQ ID NO: 8533587 - DNA, 22 bp, Homo sapiens
acagtaaacaatgcagcaaatt

SEQ ID NO: 8533588 - DNA, 22 bp, Homo sapiens
acagtaaaacatttttattagg

SEQ ID NO: 8533589 - DNA, 22 bp, Homo sapiens
acaggtgttgactcacaggccc

SEQ ID NO: 8533590 - DNA, 22 bp, Homo sapiens
acaggtgtacaatgcatgacag

SEQ ID NO: 8533591 - DNA, 22 bp, Homo sapiens
aggacacacttctgaggtcttt

SEQ ID NO: 8533592 - DNA, 22 bp, Homo sapiens
aggacacagctcttcagtaaga

SEQ ID NO: 8533593 - DNA, 22 bp, Homo sapiens
aggacacagctgctctgcagag

SEQ ID NO: 8533594 - DNA, 22 bp, Homo sapiens
aggacacaggtaagccagtgga

SEQ ID NO: 8533595 - DNA, 22 bp, Homo sapiens
aggagcaaatgatgagacagca

SEQ ID NO: 8533596 - DNA, 22 bp, Homo sapiens
aggagcaaatgatgagacagca

SEQ ID NO: 8533597 - DNA, 22 bp, Homo sapiens
aggagcaaatgatgagacagca

SEQ ID NO: 8533598 - DNA, 22 bp, Homo sapiens
aggagattgtactgtcatcact

SEQ ID NO: 8533599 - DNA, 22 bp, Homo sapiens
acagtaaatcaacagaatatct

SEQ ID NO: 8533600 - DNA, 22 bp, Homo sapiens
acagtaaatcaacagaatatct

SEQ ID NO: 8533601 - DNA, 19 bp, Homo sapiens
aggagcactgccagcacca

SEQ ID NO: 8533602 - DNA, 22 bp, Homo sapiens
aggagcagaactgattctgact

SEQ ID NO: 8533603 - DNA, 19 bp, Homo sapiens
aggagcactgccagcacca

SEQ ID NO: 8533604 - DNA, 22 bp, Homo sapiens
aggagcactaattcctgcagag

SEQ ID NO: 8533605 - DNA, 22 bp, Homo sapiens
aggagcactgagccagcatggg

SEQ ID NO: 8533606 - DNA, 22 bp, Homo sapiens
aggagcagaatttaatgtgcag

SEQ ID NO: 8533607 - DNA, 22 bp, Homo sapiens
aggagcagaactgttgtggagg

SEQ ID NO: 8533608 - DNA, 22 bp, Homo sapiens
aggagcagaactgttgtggagg

SEQ ID NO: 8533609 - DNA, 22 bp, Homo sapiens
aggagcagaactgattctgact

SEQ ID NO: 8533610 - DNA, 22 bp, Homo sapiens
aggagcagaactgttgtggagg

SEQ ID NO: 8533611 - DNA, 22 bp, Homo sapiens
aggagcagaactgattctgact

SEQ ID NO: 8533612 - DNA, 22 bp, Homo sapiens
acagtatagggcttatattgta

SEQ ID NO: 8533613 - DNA, 22 bp, Homo sapiens
acagtatatatagtctaaaagc

SEQ ID NO: 8533614 - DNA, 22 bp, Homo sapiens
acagtatatatagtctaaaagc

SEQ ID NO: 8533615 - DNA, 21 bp, Homo sapiens
acagtatattagatatttgaa

SEQ ID NO: 8533616 - DNA, 22 bp, Homo sapiens
acagtatatatggttatctgat

SEQ ID NO: 8533617 - DNA, 22 bp, Homo sapiens
acagtatatatggttatctgat

SEQ ID NO: 8533618 - DNA, 22 bp, Homo sapiens
acagtatattttcttgattgtt

SEQ ID NO: 8533619 - DNA, 21 bp, Homo sapiens
acagtatattagatatttgaa

SEQ ID NO: 8533620 - DNA, 22 bp, Homo sapiens
acagtatgaatgcagaatgtag

SEQ ID NO: 8533621 - DNA, 22 bp, Homo sapiens
aggagcagaccgtagtcctgca

SEQ ID NO: 8533622 - DNA, 22 bp, Homo sapiens
aggagcagaccgtagtcctgca

SEQ ID NO: 8533623 - DNA, 22 bp, Homo sapiens
aggagcagaatttaatgtgcag

SEQ ID NO: 8533624 - DNA, 22 bp, Homo sapiens
aggagcagaatttaatgtgcag

SEQ ID NO: 8533625 - DNA, 22 bp, Homo sapiens
acagtcctgtacaggccatatc

SEQ ID NO: 8533626 - DNA, 22 bp, Homo sapiens
acagtcctagctgcaaagaagt

SEQ ID NO: 8533627 - DNA, 22 bp, Homo sapiens
acagtcctgttgtcaaagcaat

SEQ ID NO: 8533628 - DNA, 22 bp, Homo sapiens
acagtcctgtacaggccatatc

SEQ ID NO: 8533629 - DNA, 20 bp, Homo sapiens
acagtcctgcactggtgttt

SEQ ID NO: 8533630 - DNA, 22 bp, Homo sapiens
acagtcctgttgtcaaagcaat

SEQ ID NO: 8533631 - DNA, 22 bp, Homo sapiens
acagtctacaaagtgatgtgtg

SEQ ID NO: 8533632 - DNA, 22 bp, Homo sapiens
acagtctaatcttgtgttctgt

SEQ ID NO: 8533633 - DNA, 23 bp, Homo sapiens
acagtcgtaggtatccttttcct

SEQ ID NO: 8533634 - DNA, 22 bp, Homo sapiens
acagtccttgtttcggtcagat

SEQ ID NO: 8533635 - DNA, 20 bp, Homo sapiens
acagtcgcctatcaaccagg

SEQ ID NO: 8533636 - DNA, 22 bp, Homo sapiens
acagtccttgtgtggaacatta

SEQ ID NO: 8533637 - DNA, 22 bp, Homo sapiens
acagtccttgtgtggaacatta

SEQ ID NO: 8533638 - DNA, 22 bp, Homo sapiens
acagtctctgttgctgctgttt

SEQ ID NO: 8533639 - DNA, 22 bp, Homo sapiens
acagtctctccacactgcaggg

SEQ ID NO: 8533640 - DNA, 21 bp, Homo sapiens
acagtctccccagatctctcc

SEQ ID NO: 8533641 - DNA, 22 bp, Homo sapiens
acagtctaggtgtgtgatttaa

SEQ ID NO: 8533642 - DNA, 22 bp, Homo sapiens
acagtctaggcctaggtcaaaa

SEQ ID NO: 8533643 - DNA, 22 bp, Homo sapiens
acagtccagcctagtatgtata

SEQ ID NO: 8533644 - DNA, 19 bp, Homo sapiens
acagtccagctgtttgtac

SEQ ID NO: 8533645 - DNA, 22 bp, Homo sapiens
acagtcctaagataattgtctc

SEQ ID NO: 8533646 - DNA, 22 bp, Homo sapiens
acagtcatagcagcctttgtta

SEQ ID NO: 8533647 - DNA, 20 bp, Homo sapiens
acagtcagggaatagaaaaa

SEQ ID NO: 8533648 - DNA, 19 bp, Homo sapiens
acagtcagggaataaagac

SEQ ID NO: 8533649 - DNA, 22 bp, Homo sapiens
acagtcaatgagtgagtgaatg

SEQ ID NO: 8533650 - DNA, 22 bp, Homo sapiens
acagtcaatgagtgagtgaatg

SEQ ID NO: 8533651 - DNA, 22 bp, Homo sapiens
acagtcaaatgtctatcttctt

SEQ ID NO: 8533652 - DNA, 22 bp, Homo sapiens
acagtatttgcgatactgatga

SEQ ID NO: 8533653 - DNA, 22 bp, Homo sapiens
acagtcaatcagaacagcatgt

SEQ ID NO: 8533654 - DNA, 22 bp, Homo sapiens
acagtcaatcagaacagcatgt

SEQ ID NO: 8533655 - DNA, 22 bp, Homo sapiens
acagtcaatcagaacagcatgt

SEQ ID NO: 8533656 - DNA, 22 bp, Homo sapiens
acagtcaagaaatggcagagcc

SEQ ID NO: 8533657 - DNA, 23 bp, Homo sapiens
acagtgtctgctgcaagatatct

SEQ ID NO: 8533658 - DNA, 23 bp, Homo sapiens
acagtgtctgctgcaagatatct

SEQ ID NO: 8533659 - DNA, 22 bp, Homo sapiens
acagtgtctgacacgtaggaag

SEQ ID NO: 8533660 - DNA, 22 bp, Homo sapiens
acagtgtctgacacattgtagc

SEQ ID NO: 8533661 - DNA, 22 bp, Homo sapiens
acagtgtctcactgctgaaatc

SEQ ID NO: 8533662 - DNA, 20 bp, Homo sapiens
acagtgggtggggagcactg

SEQ ID NO: 8533663 - DNA, 22 bp, Homo sapiens
acagtgtctcctggtacccagt

SEQ ID NO: 8533664 - DNA, 22 bp, Homo sapiens
acagtggggtcttaatagaaca

SEQ ID NO: 8533665 - DNA, 22 bp, Homo sapiens
acagtctgcctctcagagcagc

SEQ ID NO: 8533666 - DNA, 22 bp, Homo sapiens
acagtctgcagggtgaacatgt

SEQ ID NO: 8533667 - DNA, 17 bp, Homo sapiens
acagtctgcctgacagt

SEQ ID NO: 8533668 - DNA, 22 bp, Homo sapiens
acagtctgcttgtctccatggt

SEQ ID NO: 8533669 - DNA, 22 bp, Homo sapiens
acagtgggacagtgacggggga

SEQ ID NO: 8533670 - DNA, 22 bp, Homo sapiens
acagtctggaagcagggggcaa

SEQ ID NO: 8533671 - DNA, 22 bp, Homo sapiens
acagtctgcttgtctccatggt

SEQ ID NO: 8533672 - DNA, 22 bp, Homo sapiens
acagtgtggaaagtcaacttga

SEQ ID NO: 8533673 - DNA, 22 bp, Homo sapiens
acagtgtgggacattaggaaat

SEQ ID NO: 8533674 - DNA, 22 bp, Homo sapiens
acagtgtggtgatggcacttgc

SEQ ID NO: 8533675 - DNA, 22 bp, Homo sapiens
acagtgtggggtgagatggaac

SEQ ID NO: 8533676 - DNA, 22 bp, Homo sapiens
acagtgtgatgggcctgcctga

SEQ ID NO: 8533677 - DNA, 22 bp, Homo sapiens
acagtgtgcaagaaatggggga

SEQ ID NO: 8533678 - DNA, 21 bp, Homo sapiens
acagtgtgcttctctccctcc

SEQ ID NO: 8533679 - DNA, 16 bp, Homo sapiens
acagtgtgctaagcat

SEQ ID NO: 8533680 - DNA, 19 bp, Homo sapiens
acagtgtctgtatataaat

SEQ ID NO: 8533681 - DNA, 22 bp, Homo sapiens
acagtgtgacaattgtgtcaga

SEQ ID NO: 8533682 - DNA, 22 bp, Homo sapiens
acagtgtgtgggaaatgtgact

SEQ ID NO: 8533683 - DNA, 22 bp, Homo sapiens
acagtgtgtgctttcccttacg

SEQ ID NO: 8533684 - DNA, 22 bp, Homo sapiens
acagtgtggtttgagcactggg

SEQ ID NO: 8533685 - DNA, 22 bp, Homo sapiens
acagtgtggtttgagcactggg

SEQ ID NO: 8533686 - DNA, 22 bp, Homo sapiens
acagtgtgtcctaaaggtctgg

SEQ ID NO: 8533687 - DNA, 22 bp, Homo sapiens
acagtgtggtttgagcactggg

SEQ ID NO: 8533688 - DNA, 23 bp, Homo sapiens
acagtgtggtggacaaggagcag

SEQ ID NO: 8533689 - DNA, 22 bp, Homo sapiens
acagtgtggttgtttctggtta

SEQ ID NO: 8533690 - DNA, 22 bp, Homo sapiens
acagttcccgtcttgcacagct

SEQ ID NO: 8533691 - DNA, 22 bp, Homo sapiens
acagttcccgtcttgcacagct

SEQ ID NO: 8533692 - DNA, 22 bp, Homo sapiens
acagtttagagcatgatgacca

SEQ ID NO: 8533693 - DNA, 22 bp, Homo sapiens
acagtttagaatgccacatagt

SEQ ID NO: 8533694 - DNA, 19 bp, Homo sapiens
aggatggagcaggcggtga

SEQ ID NO: 8533695 - DNA, 22 bp, Homo sapiens
acagtttatcgattcacctacc

SEQ ID NO: 8533696 - DNA, 20 bp, Homo sapiens
acagtttatccagttagcag

SEQ ID NO: 8533697 - DNA, 22 bp, Homo sapiens
acagtttataaaaataatgagg

SEQ ID NO: 8533698 - DNA, 22 bp, Homo sapiens
acagtttaggatgagagaacac

SEQ ID NO: 8533699 - DNA, 22 bp, Homo sapiens
acagtttataaaaataatgagg

SEQ ID NO: 8533700 - DNA, 22 bp, Homo sapiens
aggatgaggctggcaggtcttg

SEQ ID NO: 8533701 - DNA, 22 bp, Homo sapiens
aggatgagccgcgcaagctgac

SEQ ID NO: 8533702 - DNA, 22 bp, Homo sapiens
aggatgagccgcgcaagctgac

SEQ ID NO: 8533703 - DNA, 22 bp, Homo sapiens
aggatgaggctggacacttctt

SEQ ID NO: 8533704 - DNA, 22 bp, Homo sapiens
aggatgccttcattgcatggcc

SEQ ID NO: 8533705 - DNA, 22 bp, Homo sapiens
aggatgaggctggcaggtcttg

SEQ ID NO: 8533706 - DNA, 20 bp, Homo sapiens
aggatgcagggagtctgcag

SEQ ID NO: 8533707 - DNA, 22 bp, Homo sapiens
aggatgagattccagggtcaat

SEQ ID NO: 8533708 - DNA, 22 bp, Homo sapiens
aggatgagattgctgtgttgta

SEQ ID NO: 8533709 - DNA, 22 bp, Homo sapiens
aggatgagagatacatggagca

SEQ ID NO: 8533710 - DNA, 22 bp, Homo sapiens
acagtgtgttctgggacctcca

SEQ ID NO: 8533711 - DNA, 22 bp, Homo sapiens
acagtgttacttgatagtgtat

SEQ ID NO: 8533712 - DNA, 22 bp, Homo sapiens
acagtgtgttggaggagactgt

SEQ ID NO: 8533713 - DNA, 22 bp, Homo sapiens
aggcactgggaatatgctgagg

SEQ ID NO: 8533714 - DNA, 22 bp, Homo sapiens
aggcactgggggatgagcaagg

SEQ ID NO: 8533715 - DNA, 22 bp, Homo sapiens
aggcactgggggatgagcaagg

SEQ ID NO: 8533716 - DNA, 22 bp, Homo sapiens
acagtttctccatttacacctt

SEQ ID NO: 8533717 - DNA, 22 bp, Homo sapiens
acagtttctccatttacacctt

SEQ ID NO: 8533718 - DNA, 22 bp, Homo sapiens
acagtttccccctagggcagca

SEQ ID NO: 8533719 - DNA, 22 bp, Homo sapiens
acagtttattgcacaggtaacc

SEQ ID NO: 8533720 - DNA, 20 bp, Homo sapiens
acagtttattttacttggtt

SEQ ID NO: 8533721 - DNA, 22 bp, Homo sapiens
acagtttatgtaaagctgccaa

SEQ ID NO: 8533722 - DNA, 21 bp, Homo sapiens
acagtttattagagtaagtgc

SEQ ID NO: 8533723 - DNA, 22 bp, Homo sapiens
acagtttatggtgttttatata

SEQ ID NO: 8533724 - DNA, 22 bp, Homo sapiens
acagtttatggtgttttatata

SEQ ID NO: 8533725 - DNA, 22 bp, Homo sapiens
acagtttatggtgttttatata

SEQ ID NO: 8533726 - DNA, 22 bp, Homo sapiens
acagtttatcgattcacctacc

SEQ ID NO: 8533727 - DNA, 22 bp, Homo sapiens
acagtttatgcctctgagcctg

SEQ ID NO: 8533728 - DNA, 22 bp, Homo sapiens
acatatattttcacacatggtt

SEQ ID NO: 8533729 - DNA, 22 bp, Homo sapiens
acatattaactgcactacacta

SEQ ID NO: 8533730 - DNA, 22 bp, Homo sapiens
acatattaactgcactacacta

SEQ ID NO: 8533731 - DNA, 22 bp, Homo sapiens
acatattaactgcactacacta

SEQ ID NO: 8533732 - DNA, 22 bp, Homo sapiens
acatatctgtgaggttttgttg

SEQ ID NO: 8533733 - DNA, 22 bp, Homo sapiens
acatattggcaaactggaggca

SEQ ID NO: 8533734 - DNA, 22 bp, Homo sapiens
acatattggcttagctctgtga

SEQ ID NO: 8533735 - DNA, 22 bp, Homo sapiens
acatattgagctctaaaagtac

SEQ ID NO: 8533736 - DNA, 22 bp, Homo sapiens
acatattgagctctaaaagtac

SEQ ID NO: 8533737 - DNA, 23 bp, Homo sapiens
acatattgaatgctgagaatttt

SEQ ID NO: 8533738 - DNA, 22 bp, Homo sapiens
acatatttccatgcagcatgtc

SEQ ID NO: 8533739 - DNA, 22 bp, Homo sapiens
acatatttccatgcagcatgtc

SEQ ID NO: 8533740 - DNA, 22 bp, Homo sapiens
acatatttccatgcagcatgtc

SEQ ID NO: 8533741 - DNA, 22 bp, Homo sapiens
acatatttccatgcagcatgtc

SEQ ID NO: 8533742 - DNA, 22 bp, Homo sapiens
aggcagctgccctctccttcct

SEQ ID NO: 8533743 - DNA, 22 bp, Homo sapiens
aggcagctggaaaactccaggc

SEQ ID NO: 8533744 - DNA, 22 bp, Homo sapiens
aggcagctgaggtctggcgccc

SEQ ID NO: 8533745 - DNA, 17 bp, Homo sapiens
aggcagctcagaacatc

SEQ ID NO: 8533746 - DNA, 17 bp, Homo sapiens
aggcagctcagaacatc

SEQ ID NO: 8533747 - DNA, 22 bp, Homo sapiens
acatagcttaaatgagaagata

SEQ ID NO: 8533748 - DNA, 19 bp, Homo sapiens
acatagctggctacactgt

SEQ ID NO: 8533749 - DNA, 22 bp, Homo sapiens
acatagctcagcataatcgtgg

SEQ ID NO: 8533750 - DNA, 22 bp, Homo sapiens
acatagcagaggactgagcaga

SEQ ID NO: 8533751 - DNA, 22 bp, Homo sapiens
acatagcagaggactgagcaga

SEQ ID NO: 8533752 - DNA, 22 bp, Homo sapiens
acatagcacgtctcaatttgga

SEQ ID NO: 8533753 - DNA, 22 bp, Homo sapiens
acatagcataaagaatgactct

SEQ ID NO: 8533754 - DNA, 22 bp, Homo sapiens
acatagaaggaagagtagtagg

SEQ ID NO: 8533755 - DNA, 22 bp, Homo sapiens
acatagaaggaagagtagtagg

SEQ ID NO: 8533756 - DNA, 22 bp, Homo sapiens
acatagaacttcgatgtctttt

SEQ ID NO: 8533757 - DNA, 22 bp, Homo sapiens
acatagaacttcgatgtctttt

SEQ ID NO: 8533758 - DNA, 22 bp, Homo sapiens
acatagaacttcccagtgagca

SEQ ID NO: 8533759 - DNA, 22 bp, Homo sapiens
acatagaacttcccagtgagca

SEQ ID NO: 8533760 - DNA, 22 bp, Homo sapiens
acatagaacttcccagtgagca

SEQ ID NO: 8533761 - DNA, 21 bp, Homo sapiens
acatacattatctttttaaaa

SEQ ID NO: 8533762 - DNA, 21 bp, Homo sapiens
acatacattatctttttaaaa

SEQ ID NO: 8533763 - DNA, 21 bp, Homo sapiens
acatacattatctttttaaaa

SEQ ID NO: 8533764 - DNA, 22 bp, Homo sapiens
acatagaagtgatgcttatcca

SEQ ID NO: 8533765 - DNA, 22 bp, Homo sapiens
acatagaagtgatgcttatcca

SEQ ID NO: 8533766 - DNA, 20 bp, Homo sapiens
acatagatcagtgattgaca

SEQ ID NO: 8533767 - DNA, 22 bp, Homo sapiens
acatagagttcaattttcagtc

SEQ ID NO: 8533768 - DNA, 22 bp, Homo sapiens
acatagagttcaattttcagtc

SEQ ID NO: 8533769 - DNA, 22 bp, Homo sapiens
acatagagtatcatactggatg

SEQ ID NO: 8533770 - DNA, 22 bp, Homo sapiens
acatagatctgtgattcattct

SEQ ID NO: 8533771 - DNA, 22 bp, Homo sapiens
acatagatctgtgattcattct

SEQ ID NO: 8533772 - DNA, 22 bp, Homo sapiens
acatagatttaagagcaattag

SEQ ID NO: 8533773 - DNA, 22 bp, Homo sapiens
acatagatttaagagcaattag

SEQ ID NO: 8533774 - DNA, 22 bp, Homo sapiens
acatagcaagtgctcaataaat

SEQ ID NO: 8533775 - DNA, 22 bp, Homo sapiens
acagctgggaatcagctgggga

SEQ ID NO: 8533776 - DNA, 22 bp, Homo sapiens
acagctgggaatcagctgggga

SEQ ID NO: 8533777 - DNA, 22 bp, Homo sapiens
acagctgggaatcagctgggga

SEQ ID NO: 8533778 - DNA, 22 bp, Homo sapiens
acagctgggaatcagctgggga

SEQ ID NO: 8533779 - DNA, 22 bp, Homo sapiens
acagctggccgaggctcaggga

SEQ ID NO: 8533780 - DNA, 22 bp, Homo sapiens
acagctggccgaggctcaggga

SEQ ID NO: 8533781 - DNA, 22 bp, Homo sapiens
acagctggccgaggctcaggga

SEQ ID NO: 8533782 - DNA, 22 bp, Homo sapiens
acagctggccgaggctcaggga

SEQ ID NO: 8533783 - DNA, 22 bp, Homo sapiens
acagctgggaactcacacagca

SEQ ID NO: 8533784 - DNA, 21 bp, Homo sapiens
acagctggccgcgcgggtcgg

SEQ ID NO: 8533785 - DNA, 21 bp, Homo sapiens
acagctggccgcgcgggtcgg

SEQ ID NO: 8533786 - DNA, 22 bp, Homo sapiens
acagctggcaggggggcatgaa

SEQ ID NO: 8533787 - DNA, 22 bp, Homo sapiens
acagctggcaggggggcatgaa

SEQ ID NO: 8533788 - DNA, 22 bp, Homo sapiens
acagctggcaggggggcatgaa

SEQ ID NO: 8533789 - DNA, 22 bp, Homo sapiens
acagctggcaggggggcatgaa

SEQ ID NO: 8533790 - DNA, 22 bp, Homo sapiens
agctgagagctgtgtcaagata

SEQ ID NO: 8533791 - DNA, 22 bp, Homo sapiens
agctgagaggtggcaagctgta

SEQ ID NO: 8533792 - DNA, 21 bp, Homo sapiens
acagctggtgcagggcgggga

SEQ ID NO: 8533793 - DNA, 21 bp, Homo sapiens
acagctggtgcagggcgggga

SEQ ID NO: 8533794 - DNA, 22 bp, Homo sapiens
acagctgtatccccagagctca

SEQ ID NO: 8533795 - DNA, 22 bp, Homo sapiens
acagctgggtgtcccacttctg

SEQ ID NO: 8533796 - DNA, 22 bp, Homo sapiens
acagctgggtgctgctcagagc

SEQ ID NO: 8533797 - DNA, 22 bp, Homo sapiens
acagctgggtgctgctcagagc

SEQ ID NO: 8533798 - DNA, 22 bp, Homo sapiens
acagctgggtgctgctcagagc

SEQ ID NO: 8533799 - DNA, 23 bp, Homo sapiens
agctggaggctgtctactcccaa

SEQ ID NO: 8533800 - DNA, 22 bp, Homo sapiens
agctggaggggccagcaggtgt

SEQ ID NO: 8533801 - DNA, 22 bp, Homo sapiens
agctggaggggccagcaggtgt

SEQ ID NO: 8533802 - DNA, 22 bp, Homo sapiens
agctggaggggccagcaggtgt

SEQ ID NO: 8533803 - DNA, 22 bp, Homo sapiens
agctggaggggccagcaggtgt

SEQ ID NO: 8533804 - DNA, 22 bp, Homo sapiens
agctgaagcaacaacaggatgg

SEQ ID NO: 8533805 - DNA, 22 bp, Homo sapiens
agctgaagcagtcagttcagct

SEQ ID NO: 8533806 - DNA, 22 bp, Homo sapiens
agctgaaggctagaacagctgg

SEQ ID NO: 8533807 - DNA, 22 bp, Homo sapiens
agctctggggtggagcccagga

SEQ ID NO: 8533808 - DNA, 22 bp, Homo sapiens
agctctggtatttctttaatcc

SEQ ID NO: 8533809 - DNA, 22 bp, Homo sapiens
agctctgggtcacggctgccga

SEQ ID NO: 8533810 - DNA, 22 bp, Homo sapiens
agctgagaatcttccccagtgt

SEQ ID NO: 8533811 - DNA, 22 bp, Homo sapiens
agctgacttcttgatccaatga

SEQ ID NO: 8533812 - DNA, 22 bp, Homo sapiens
agctgactgatgaagaggcctt

SEQ ID NO: 8533813 - DNA, 22 bp, Homo sapiens
agctgactctggcctctggtcc

SEQ ID NO: 8533814 - DNA, 22 bp, Homo sapiens
agctgaccaaatgcctacagtt

SEQ ID NO: 8533815 - DNA, 22 bp, Homo sapiens
agctgagacacttgagagacta

SEQ ID NO: 8533816 - DNA, 22 bp, Homo sapiens
agctgagagctgtgtcaagata

SEQ ID NO: 8533817 - DNA, 22 bp, Homo sapiens
agctgagagcccctgccctgtg

SEQ ID NO: 8533818 - DNA, 22 bp, Homo sapiens
agctgagagcccctgccctgtg

SEQ ID NO: 8533819 - DNA, 22 bp, Homo sapiens
agctgaatcttgactaggaaga

SEQ ID NO: 8533820 - DNA, 22 bp, Homo sapiens
agctgaatgttctcagaccaga

SEQ ID NO: 8533821 - DNA, 22 bp, Homo sapiens
agctgaagtcctcgcggtgcta

SEQ ID NO: 8533822 - DNA, 22 bp, Homo sapiens
agctgaagttcagtccagagaa

SEQ ID NO: 8533823 - DNA, 22 bp, Homo sapiens
agctgaagttcagtccagagaa

SEQ ID NO: 8533824 - DNA, 22 bp, Homo sapiens
agctggcaaggcaatttggatt

SEQ ID NO: 8533825 - DNA, 22 bp, Homo sapiens
agctggcaaggcaatttggatt

SEQ ID NO: 8533826 - DNA, 22 bp, Homo sapiens
acaggaggggcatgaaagacgg

SEQ ID NO: 8533827 - DNA, 22 bp, Homo sapiens
acaggagtgaatctggcactta

SEQ ID NO: 8533828 - DNA, 22 bp, Homo sapiens
acaggagtagggctggtggaga

SEQ ID NO: 8533829 - DNA, 22 bp, Homo sapiens
acaggagtgaatctggcactta

SEQ ID NO: 8533830 - DNA, 22 bp, Homo sapiens
acaggagtggctctaccagacc

SEQ ID NO: 8533831 - DNA, 22 bp, Homo sapiens
acaggagtggagaggtgcctct

SEQ ID NO: 8533832 - DNA, 22 bp, Homo sapiens
acaggagtggagaggtgcctct

SEQ ID NO: 8533833 - DNA, 22 bp, Homo sapiens
acaggagggacaccttcctgct

SEQ ID NO: 8533834 - DNA, 22 bp, Homo sapiens
acaggagaattatctggaacaa

SEQ ID NO: 8533835 - DNA, 22 bp, Homo sapiens
acaggagaattatctggaacaa

SEQ ID NO: 8533836 - DNA, 22 bp, Homo sapiens
acaggagaattatctggaacaa

SEQ ID NO: 8533837 - DNA, 22 bp, Homo sapiens
agctggtgtgccagttccagtt

SEQ ID NO: 8533838 - DNA, 22 bp, Homo sapiens
agctggtgtgccactgttgggg

SEQ ID NO: 8533839 - DNA, 22 bp, Homo sapiens
agctggtgtcctcctggagctg

SEQ ID NO: 8533840 - DNA, 22 bp, Homo sapiens
agctggtgtcctcctggagctg

SEQ ID NO: 8533841 - DNA, 22 bp, Homo sapiens
agctggtgtcctcctggagctg

SEQ ID NO: 8533842 - DNA, 21 bp, Homo sapiens
agctggtgtcagagctctggg

SEQ ID NO: 8533843 - DNA, 22 bp, Homo sapiens
agctggtgtcctcctggagctg

SEQ ID NO: 8533844 - DNA, 21 bp, Homo sapiens
agctggtgtcagagctctggg

SEQ ID NO: 8533845 - DNA, 21 bp, Homo sapiens
agctggtgtcagagctctggg

SEQ ID NO: 8533846 - DNA, 21 bp, Homo sapiens
agctggtgtcagagctctggg

SEQ ID NO: 8533847 - DNA, 22 bp, Homo sapiens
agctggtgtgccagttccagtt

SEQ ID NO: 8533848 - DNA, 22 bp, Homo sapiens
agctggtgtgccagttccagtt

SEQ ID NO: 8533849 - DNA, 22 bp, Homo sapiens
agctggtgtgctctggaatcct

SEQ ID NO: 8533850 - DNA, 18 bp, Homo sapiens
agctggtggggagacagc

SEQ ID NO: 8533851 - DNA, 22 bp, Homo sapiens
agctggtggggaagctgcaggt

SEQ ID NO: 8533852 - DNA, 18 bp, Homo sapiens
agctggtggggagacagc

SEQ ID NO: 8533853 - DNA, 22 bp, Homo sapiens
agctggtggattatgctgtaca

SEQ ID NO: 8533854 - DNA, 22 bp, Homo sapiens
agctggtggggaagctgcaggt

SEQ ID NO: 8533855 - DNA, 22 bp, Homo sapiens
agctggtggggaagctgcaggt

SEQ ID NO: 8533856 - DNA, 21 bp, Homo sapiens
acaggataggacagtgttcct

SEQ ID NO: 8533857 - DNA, 22 bp, Homo sapiens
acaggagtttctgacagagaca

SEQ ID NO: 8533858 - DNA, 22 bp, Homo sapiens
acaggatcgccctgttgcccag

SEQ ID NO: 8533859 - DNA, 22 bp, Homo sapiens
acaggagtttaagaaatatttc

SEQ ID NO: 8533860 - DNA, 22 bp, Homo sapiens
acaggagtttctgacagagaca

SEQ ID NO: 8533861 - DNA, 22 bp, Homo sapiens
acaggagtttaagaaatatttc

SEQ ID NO: 8533862 - DNA, 22 bp, Homo sapiens
acaggagttcagaggacacccc

SEQ ID NO: 8533863 - DNA, 22 bp, Homo sapiens
acaggagttaaggctgagttga

SEQ ID NO: 8533864 - DNA, 22 bp, Homo sapiens
acaggagttaaccatgggaagt

SEQ ID NO: 8533865 - DNA, 22 bp, Homo sapiens
aggaagaaactgagctctgaca

SEQ ID NO: 8533866 - DNA, 21 bp, Homo sapiens
aggaagaaaggttggaggttg

SEQ ID NO: 8533867 - DNA, 22 bp, Homo sapiens
acagggagccccagcatttcca

SEQ ID NO: 8533868 - DNA, 22 bp, Homo sapiens
aggaagaacctaagaaagtctc

SEQ ID NO: 8533869 - DNA, 22 bp, Homo sapiens
aggaagaacagataatggacgc

SEQ ID NO: 8533870 - DNA, 22 bp, Homo sapiens
aggaagaacagataatggacgc

SEQ ID NO: 8533871 - DNA, 22 bp, Homo sapiens
aggaagaaatgtgacttcaaac

SEQ ID NO: 8533872 - DNA, 22 bp, Homo sapiens
aggaagaatgtttacatatcaa

SEQ ID NO: 8533873 - DNA, 22 bp, Homo sapiens
aggaagaatgtttacatatcaa

SEQ ID NO: 8533874 - DNA, 22 bp, Homo sapiens
aggaagaatgtttacatatcaa

SEQ ID NO: 8533875 - DNA, 22 bp, Homo sapiens
aggaagaatgtttacatatcaa

SEQ ID NO: 8533876 - DNA, 22 bp, Homo sapiens
aggaagacaatctgtgtgctgt

SEQ ID NO: 8533877 - DNA, 23 bp, Homo sapiens
aggaagagagagtgcctctttct

SEQ ID NO: 8533878 - DNA, 22 bp, Homo sapiens
aggaagagcatctttgggtctg

SEQ ID NO: 8533879 - DNA, 22 bp, Homo sapiens
aggaagagcattcacatggtag

SEQ ID NO: 8533880 - DNA, 22 bp, Homo sapiens
acagggctatattcctcagagt

SEQ ID NO: 8533881 - DNA, 22 bp, Homo sapiens
acagggctatattcctcagagt

SEQ ID NO: 8533882 - DNA, 22 bp, Homo sapiens
acagggctatattcctcagagt

SEQ ID NO: 8533883 - DNA, 19 bp, Homo sapiens
acagggcttggcctgacat

SEQ ID NO: 8533884 - DNA, 19 bp, Homo sapiens
acagggcttggcctgacat

SEQ ID NO: 8533885 - DNA, 21 bp, Homo sapiens
acagggcttcagggagggtta

SEQ ID NO: 8533886 - DNA, 22 bp, Homo sapiens
acagggctatattcctcagagt

SEQ ID NO: 8533887 - DNA, 22 bp, Homo sapiens
acagggcttttaatcagtagtt

SEQ ID NO: 8533888 - DNA, 22 bp, Homo sapiens
acagggcttttaatcagtagtt

SEQ ID NO: 8533889 - DNA, 22 bp, Homo sapiens
acagggcttttaatcagtagtt

SEQ ID NO: 8533890 - DNA, 22 bp, Homo sapiens
acagggcttgtgacaactttaa

SEQ ID NO: 8533891 - DNA, 22 bp, Homo sapiens
acaggggacctaggaccctcgg

SEQ ID NO: 8533892 - DNA, 22 bp, Homo sapiens
acaggggattgattggaagtct

SEQ ID NO: 8533893 - DNA, 22 bp, Homo sapiens
acaggggaatttactgtcatta

SEQ ID NO: 8533894 - DNA, 22 bp, Homo sapiens
acagggcttttaatcagtagtt

SEQ ID NO: 8533895 - DNA, 22 bp, Homo sapiens
acaggggaatttactgtcatta

SEQ ID NO: 8533896 - DNA, 20 bp, Homo sapiens
acaggggcagcacaataatg

SEQ ID NO: 8533897 - DNA, 20 bp, Homo sapiens
acaggggcagcacaataatg

SEQ ID NO: 8533898 - DNA, 22 bp, Homo sapiens
acaggggcaagggctcacggcc

SEQ ID NO: 8533899 - DNA, 22 bp, Homo sapiens
acaggggcaggcaggacccttt

SEQ ID NO: 8533900 - DNA, 22 bp, Homo sapiens
aggacacaccaggtccagctgt

SEQ ID NO: 8533901 - DNA, 22 bp, Homo sapiens
aggacacacccagctcacgggg

SEQ ID NO: 8533902 - DNA, 22 bp, Homo sapiens
aggacacacagaatacaaatcc

SEQ ID NO: 8533903 - DNA, 22 bp, Homo sapiens
aggacacactgcaagagcctgg

SEQ ID NO: 8533904 - DNA, 22 bp, Homo sapiens
aggacacactgcaagagcctgg

SEQ ID NO: 8533905 - DNA, 19 bp, Homo sapiens
acaggggctagcggaagca

SEQ ID NO: 8533906 - DNA, 19 bp, Homo sapiens
acaggggcctttccagggt

SEQ ID NO: 8533907 - DNA, 22 bp, Homo sapiens
acagggaatggagggatcagta

SEQ ID NO: 8533908 - DNA, 22 bp, Homo sapiens
acagggaaggatttagtgggaa

SEQ ID NO: 8533909 - DNA, 22 bp, Homo sapiens
acagggaccttggaagctggaa

SEQ ID NO: 8533910 - DNA, 22 bp, Homo sapiens
acagggacctgtgagctccata

SEQ ID NO: 8533911 - DNA, 22 bp, Homo sapiens
acagggacctgtgagctccata

SEQ ID NO: 8533912 - DNA, 22 bp, Homo sapiens
acaggcagggaccttggctaag

SEQ ID NO: 8533913 - DNA, 22 bp, Homo sapiens
acaggctgttggggtccagggt

SEQ ID NO: 8533914 - DNA, 22 bp, Homo sapiens
acaggcagggacctcttgagtt

SEQ ID NO: 8533915 - DNA, 22 bp, Homo sapiens
acaggcagggacctcttgagtt

SEQ ID NO: 8533916 - DNA, 22 bp, Homo sapiens
acaggcagccctctccctggtt

SEQ ID NO: 8533917 - DNA, 22 bp, Homo sapiens
acaggcagccctctccctggtt

SEQ ID NO: 8533918 - DNA, 22 bp, Homo sapiens
acaggcagcgtcattgctgctc

SEQ ID NO: 8533919 - DNA, 22 bp, Homo sapiens
acaggcaggagctccccattcc

SEQ ID NO: 8533920 - DNA, 22 bp, Homo sapiens
acaggcagcactaatctctggt

SEQ ID NO: 8533921 - DNA, 22 bp, Homo sapiens
acaggcagcactaatctctggt

SEQ ID NO: 8533922 - DNA, 22 bp, Homo sapiens
acaggcagcactaatctctggt

SEQ ID NO: 8533923 - DNA, 22 bp, Homo sapiens
acaggcagcaaaatcagcctca

SEQ ID NO: 8533924 - DNA, 22 bp, Homo sapiens
acaggcagcaaaatcagcctca

SEQ ID NO: 8533925 - DNA, 22 bp, Homo sapiens
acaggcagcaaaatcagcctca

SEQ ID NO: 8533926 - DNA, 17 bp, Homo sapiens
acaggcagatcacctga

SEQ ID NO: 8533927 - DNA, 17 bp, Homo sapiens
acaggcagatcacctga

SEQ ID NO: 8533928 - DNA, 22 bp, Homo sapiens
acatcacagagcccagataaag

SEQ ID NO: 8533929 - DNA, 22 bp, Homo sapiens
acatcacacgccttccaggagg

SEQ ID NO: 8533930 - DNA, 22 bp, Homo sapiens
acatcacagagcccagataaag

SEQ ID NO: 8533931 - DNA, 22 bp, Homo sapiens
acatcacagagcccagataaag

SEQ ID NO: 8533932 - DNA, 22 bp, Homo sapiens
acatcacagagcccagataaag

SEQ ID NO: 8533933 - DNA, 22 bp, Homo sapiens
acatattttgaaagctttctaa

SEQ ID NO: 8533934 - DNA, 22 bp, Homo sapiens
acatattttgaaagctttctaa

SEQ ID NO: 8533935 - DNA, 22 bp, Homo sapiens
acatattttgaaagctttctaa

SEQ ID NO: 8533936 - DNA, 20 bp, Homo sapiens
acatcaactagtcacagaca

SEQ ID NO: 8533937 - DNA, 22 bp, Homo sapiens
acatcacacgccttccaggagg

SEQ ID NO: 8533938 - DNA, 22 bp, Homo sapiens
acatcacagagcccagataaag

SEQ ID NO: 8533939 - DNA, 22 bp, Homo sapiens
acatcacagtagttaagccaga

SEQ ID NO: 8533940 - DNA, 22 bp, Homo sapiens
acatcacagtagttaagccaga

SEQ ID NO: 8533941 - DNA, 22 bp, Homo sapiens
acatcagagggctcacatgatc

SEQ ID NO: 8533942 - DNA, 22 bp, Homo sapiens
acatcagagggctcacatgatc

SEQ ID NO: 8533943 - DNA, 22 bp, Homo sapiens
acatcagagggctcacatgatc

SEQ ID NO: 8533944 - DNA, 23 bp, Homo sapiens
acatcagagttagttcaatcagg

SEQ ID NO: 8533945 - DNA, 21 bp, Homo sapiens
acatcagagttgtgaaggtag

SEQ ID NO: 8533946 - DNA, 22 bp, Homo sapiens
acatcagattatgctttgctta

SEQ ID NO: 8533947 - DNA, 22 bp, Homo sapiens
acatcagtaattaagtctcaag

SEQ ID NO: 8533948 - DNA, 22 bp, Homo sapiens
acatcagtaactgtaaaacagg

SEQ ID NO: 8533949 - DNA, 22 bp, Homo sapiens
acatccaccacatgccaggctc

SEQ ID NO: 8533950 - DNA, 22 bp, Homo sapiens
acatccacatttattcagtcat

SEQ ID NO: 8533951 - DNA, 22 bp, Homo sapiens
acatccagaggcgtggaaggct

SEQ ID NO: 8533952 - DNA, 22 bp, Homo sapiens
acatccagaggcgtggaaggct

SEQ ID NO: 8533953 - DNA, 22 bp, Homo sapiens
acatcatttctagttcctgtca

SEQ ID NO: 8533954 - DNA, 22 bp, Homo sapiens
acatccagatctcagcatggct

SEQ ID NO: 8533955 - DNA, 22 bp, Homo sapiens
acatccactatccttgcttgtt

SEQ ID NO: 8533956 - DNA, 22 bp, Homo sapiens
acatccagatctcagcatggct

SEQ ID NO: 8533957 - DNA, 22 bp, Homo sapiens
acatccagatctcagcatggct

SEQ ID NO: 8533958 - DNA, 22 bp, Homo sapiens
acatccatcttatgagataggt

SEQ ID NO: 8533959 - DNA, 22 bp, Homo sapiens
acatcattcagggcctcgttgg

SEQ ID NO: 8533960 - DNA, 22 bp, Homo sapiens
acatcatgagagacttaaattg

SEQ ID NO: 8533961 - DNA, 22 bp, Homo sapiens
aggccaggcaacattctgaagt

SEQ ID NO: 8533962 - DNA, 22 bp, Homo sapiens
aggccaggcctttctccattcc

SEQ ID NO: 8533963 - DNA, 22 bp, Homo sapiens
aggccaggcaacattctgaagt

SEQ ID NO: 8533964 - DNA, 22 bp, Homo sapiens
acatgctttgcacttacatcat

SEQ ID NO: 8533965 - DNA, 22 bp, Homo sapiens
acatgcttttcccacaattata

SEQ ID NO: 8533966 - DNA, 22 bp, Homo sapiens
acatgctttgcacttacatcat

SEQ ID NO: 8533967 - DNA, 22 bp, Homo sapiens
acatgctttctaggtccttctg

SEQ ID NO: 8533968 - DNA, 22 bp, Homo sapiens
acatgctttgatgtattttgca

SEQ ID NO: 8533969 - DNA, 22 bp, Homo sapiens
acatgctttatcggattgacac

SEQ ID NO: 8533970 - DNA, 22 bp, Homo sapiens
acatgctttaacttattttgat

SEQ ID NO: 8533971 - DNA, 22 bp, Homo sapiens
acatgctctcctaaggccctgt

SEQ ID NO: 8533972 - DNA, 22 bp, Homo sapiens
acatgcttgtttttcacaacct

SEQ ID NO: 8533973 - DNA, 22 bp, Homo sapiens
acatgcttgtttttcacaacct

SEQ ID NO: 8533974 - DNA, 22 bp, Homo sapiens
acatgcctccattgagctgtgg

SEQ ID NO: 8533975 - DNA, 22 bp, Homo sapiens
acatgctaaatctgagatgctt

SEQ ID NO: 8533976 - DNA, 22 bp, Homo sapiens
acatgctaatggagatgccaag

SEQ ID NO: 8533977 - DNA, 22 bp, Homo sapiens
acatgctaatggagatgccaag

SEQ ID NO: 8533978 - DNA, 22 bp, Homo sapiens
acatgctaatggagatgccaag

SEQ ID NO: 8533979 - DNA, 22 bp, Homo sapiens
acatgctaattgcaaagtcttg

SEQ ID NO: 8533980 - DNA, 22 bp, Homo sapiens
acatgctacagtgaaggaggaa

SEQ ID NO: 8533981 - DNA, 22 bp, Homo sapiens
acatgctatgagagattacttc

SEQ ID NO: 8533982 - DNA, 22 bp, Homo sapiens
acatgctaggtacagatctaaa

SEQ ID NO: 8533983 - DNA, 22 bp, Homo sapiens
acatgctatgagagattacttc

SEQ ID NO: 8533984 - DNA, 22 bp, Homo sapiens
acatgcataagcctagccatca

SEQ ID NO: 8533985 - DNA, 22 bp, Homo sapiens
acatgcataagcctagccatca

SEQ ID NO: 8533986 - DNA, 22 bp, Homo sapiens
acatccatcttatgagataggt

SEQ ID NO: 8533987 - DNA, 22 bp, Homo sapiens
acatgcatacaagcacatgtag

SEQ ID NO: 8533988 - DNA, 22 bp, Homo sapiens
acatgccagcccatttaaatgg

SEQ ID NO: 8533989 - DNA, 22 bp, Homo sapiens
acatgttagaaatgcagaatct

SEQ ID NO: 8533990 - DNA, 22 bp, Homo sapiens
acatgttaaacatcatggaatg

SEQ ID NO: 8533991 - DNA, 22 bp, Homo sapiens
acatgttaaacatcatggaatg

SEQ ID NO: 8533992 - DNA, 22 bp, Homo sapiens
acatgtttaagtttaatgaaaa

SEQ ID NO: 8533993 - DNA, 22 bp, Homo sapiens
acatgttcatgcatgcacaggt

SEQ ID NO: 8533994 - DNA, 22 bp, Homo sapiens
aggccaggggtgagcacttctg

SEQ ID NO: 8533995 - DNA, 22 bp, Homo sapiens
aggccagggtcccacactcgca

SEQ ID NO: 8533996 - DNA, 22 bp, Homo sapiens
aggccagggtcccacactcgca

SEQ ID NO: 8533997 - DNA, 22 bp, Homo sapiens
aggccagggtcccacactcgca

SEQ ID NO: 8533998 - DNA, 22 bp, Homo sapiens
aggccagggccagattagccac

SEQ ID NO: 8533999 - DNA, 22 bp, Homo sapiens
aggccaggggtgagcacttctg

SEQ ID NO: 8534000 - DNA, 22 bp, Homo sapiens
aggccaggcgagacacccggct

SEQ ID NO: 8534001 - DNA, 21 bp, Homo sapiens
aggcctcttcatggccatgat

SEQ ID NO: 8534002 - DNA, 22 bp, Homo sapiens
aggcctcttcagggagcatgga

SEQ ID NO: 8534003 - DNA, 22 bp, Homo sapiens
aggcctctgtagggccctgaag

SEQ ID NO: 8534004 - DNA, 22 bp, Homo sapiens
aggcctctgggtctcctctgac

SEQ ID NO: 8534005 - DNA, 22 bp, Homo sapiens
aggcctgaaggaagatgagctg

SEQ ID NO: 8534006 - DNA, 22 bp, Homo sapiens
aggcctgaggaccttctggagg

SEQ ID NO: 8534007 - DNA, 19 bp, Homo sapiens
acatgttttgcagaacagc

SEQ ID NO: 8534008 - DNA, 22 bp, Homo sapiens
acatgtttgataaatatttggg

SEQ ID NO: 8534009 - DNA, 22 bp, Homo sapiens
acatgtttgcctgcaggcttag

SEQ ID NO: 8534010 - DNA, 22 bp, Homo sapiens
acatgtttggctctatgctata

SEQ ID NO: 8534011 - DNA, 22 bp, Homo sapiens
acatgtttaagtttgttatatg

SEQ ID NO: 8534012 - DNA, 22 bp, Homo sapiens
acatgtttaagtttgttatatg

SEQ ID NO: 8534013 - DNA, 22 bp, Homo sapiens
acattgtataatgattatcaca

SEQ ID NO: 8534014 - DNA, 22 bp, Homo sapiens
acattgtagttgttctgcagca

SEQ ID NO: 8534015 - DNA, 22 bp, Homo sapiens
acattgtagacttttcatatgt

SEQ ID NO: 8534016 - DNA, 22 bp, Homo sapiens
acattgtactcttagcgttgtt

SEQ ID NO: 8534017 - DNA, 19 bp, Homo sapiens
acattggacatggatcttg

SEQ ID NO: 8534018 - DNA, 22 bp, Homo sapiens
acattgctgcattctccttccc

SEQ ID NO: 8534019 - DNA, 22 bp, Homo sapiens
acattggtcactgaagaatgag

SEQ ID NO: 8534020 - DNA, 19 bp, Homo sapiens
acattggacatggatcttg

SEQ ID NO: 8534021 - DNA, 22 bp, Homo sapiens
acattgtataatgattatcaca

SEQ ID NO: 8534022 - DNA, 22 bp, Homo sapiens
acatttcagaatcacacagctt

SEQ ID NO: 8534023 - DNA, 22 bp, Homo sapiens
acatttctagttgttcatctcc

SEQ ID NO: 8534024 - DNA, 22 bp, Homo sapiens
acatttctagttgttcatctcc

SEQ ID NO: 8534025 - DNA, 22 bp, Homo sapiens
acatttctagttgttcatctcc

SEQ ID NO: 8534026 - DNA, 22 bp, Homo sapiens
acatttctagttgttcatctcc

SEQ ID NO: 8534027 - DNA, 22 bp, Homo sapiens
acatttctagttgttcatctcc

SEQ ID NO: 8534028 - DNA, 22 bp, Homo sapiens
acatttctatcatcctgtaatg

SEQ ID NO: 8534029 - DNA, 22 bp, Homo sapiens
acatttctatagtgcatctgtt

SEQ ID NO: 8534030 - DNA, 22 bp, Homo sapiens
acatttctatagtgcatctgtt

SEQ ID NO: 8534031 - DNA, 22 bp, Homo sapiens
acatttctatagtgcatctgtt

SEQ ID NO: 8534032 - DNA, 22 bp, Homo sapiens
acatttctatagtgcatctgtt

SEQ ID NO: 8534033 - DNA, 22 bp, Homo sapiens
acatttctaatttaatgtaaca

SEQ ID NO: 8534034 - DNA, 22 bp, Homo sapiens
acatttctaatttaatgtaaca

SEQ ID NO: 8534035 - DNA, 22 bp, Homo sapiens
acatttctaatttaatgtaaca

SEQ ID NO: 8534036 - DNA, 18 bp, Homo sapiens
acatttctaggtgaaagc

SEQ ID NO: 8534037 - DNA, 18 bp, Homo sapiens
acatttctaggtgaaagc

SEQ ID NO: 8534038 - DNA, 22 bp, Homo sapiens
acatttctagttgttcatctcc

SEQ ID NO: 8534039 - DNA, 22 bp, Homo sapiens
acatttctaatttaatgtaaca

SEQ ID NO: 8534040 - DNA, 18 bp, Homo sapiens
aggcctgcccagcactgt

SEQ ID NO: 8534041 - DNA, 22 bp, Homo sapiens
aggcctgcagcaggagcaaacc

SEQ ID NO: 8534042 - DNA, 22 bp, Homo sapiens
aggctctggctactacagagct

SEQ ID NO: 8534043 - DNA, 22 bp, Homo sapiens
aggctctttgagactacctgga

SEQ ID NO: 8534044 - DNA, 22 bp, Homo sapiens
aggctgaaaacgagatggcaat

SEQ ID NO: 8534045 - DNA, 22 bp, Homo sapiens
aggctgagaaagtgggaagatg

SEQ ID NO: 8534046 - DNA, 22 bp, Homo sapiens
aggctgagaaagtgggaagatg

SEQ ID NO: 8534047 - DNA, 22 bp, Homo sapiens
aggctgagaaagtgggaagatg

SEQ ID NO: 8534048 - DNA, 22 bp, Homo sapiens
aggctgagactgtgcattagtg

SEQ ID NO: 8534049 - DNA, 22 bp, Homo sapiens
aggctgagaaagtgggaagatg

SEQ ID NO: 8534050 - DNA, 22 bp, Homo sapiens
acattgatgtgatgcagaagtg

SEQ ID NO: 8534051 - DNA, 20 bp, Homo sapiens
acattgattatgtttgtaga

SEQ ID NO: 8534052 - DNA, 18 bp, Homo sapiens
acattgatggctttaagc

SEQ ID NO: 8534053 - DNA, 18 bp, Homo sapiens
acattgatggctttaagc

SEQ ID NO: 8534054 - DNA, 22 bp, Homo sapiens
acattgatgaaaaggtatcatt

SEQ ID NO: 8534055 - DNA, 22 bp, Homo sapiens
acattgatgatcccacttacag

SEQ ID NO: 8534056 - DNA, 22 bp, Homo sapiens
acattgatgaaaaggtatcatt

SEQ ID NO: 8534057 - DNA, 22 bp, Homo sapiens
acattgatatttcaaatacagg

SEQ ID NO: 8534058 - DNA, 22 bp, Homo sapiens
acattgatcagcctcccatgca

SEQ ID NO: 8534059 - DNA, 22 bp, Homo sapiens
acattgcaataataattctctt

SEQ ID NO: 8534060 - DNA, 22 bp, Homo sapiens
acattgcaattaggtacctatg

SEQ ID NO: 8534061 - DNA, 22 bp, Homo sapiens
acatttctcagggagttttgct

SEQ ID NO: 8534062 - DNA, 22 bp, Homo sapiens
aggctgagctgacctggtttgg

SEQ ID NO: 8534063 - DNA, 22 bp, Homo sapiens
aggctgagctggcccttgaaat

SEQ ID NO: 8534064 - DNA, 22 bp, Homo sapiens
aggctgagctggcccttgaaat

SEQ ID NO: 8534065 - DNA, 18 bp, Homo sapiens
acatttctatgcttctgg

SEQ ID NO: 8534066 - DNA, 18 bp, Homo sapiens
acatttctatgcttctgg

SEQ ID NO: 8534067 - DNA, 18 bp, Homo sapiens
acatttctatgcttctgg

SEQ ID NO: 8534068 - DNA, 18 bp, Homo sapiens
acatttctatgcttctgg

SEQ ID NO: 8534069 - DNA, 18 bp, Homo sapiens
acatttctatgcttctgg

SEQ ID NO: 8534070 - DNA, 22 bp, Homo sapiens
aggctgaggagggatgttgctt

SEQ ID NO: 8534071 - DNA, 22 bp, Homo sapiens
aggctgagctggtagtgagtac

SEQ ID NO: 8534072 - DNA, 22 bp, Homo sapiens
aggctgagctggtagtgagtac

SEQ ID NO: 8534073 - DNA, 22 bp, Homo sapiens
aggctgagctggtagtgagtac

SEQ ID NO: 8534074 - DNA, 22 bp, Homo sapiens
aggctgagctggtagtgagtac

SEQ ID NO: 8534075 - DNA, 22 bp, Homo sapiens
acatttctcttagagttggact

SEQ ID NO: 8534076 - DNA, 22 bp, Homo sapiens
aggctgaggagggatgttgctt

SEQ ID NO: 8534077 - DNA, 22 bp, Homo sapiens
aggctgaggagggatgttgctt

SEQ ID NO: 8534078 - DNA, 22 bp, Homo sapiens
acatttctcttgatgtctctat

SEQ ID NO: 8534079 - DNA, 22 bp, Homo sapiens
acatttctcttagagttggact

SEQ ID NO: 8534080 - DNA, 22 bp, Homo sapiens
acatttcttgatgcctctgtga

SEQ ID NO: 8534081 - DNA, 22 bp, Homo sapiens
acatttctttctattcagtagc

SEQ ID NO: 8534082 - DNA, 22 bp, Homo sapiens
acatttcttgatgcctctgtga

SEQ ID NO: 8534083 - DNA, 22 bp, Homo sapiens
acatttcttcctaattatccct

SEQ ID NO: 8534084 - DNA, 22 bp, Homo sapiens
acatttcttcctaattatccct

SEQ ID NO: 8534085 - DNA, 22 bp, Homo sapiens
acatttcttttcatctctatat

SEQ ID NO: 8534086 - DNA, 22 bp, Homo sapiens
acatttcttttcatctctatat

SEQ ID NO: 8534087 - DNA, 22 bp, Homo sapiens
acatttctttgctagacagcag

SEQ ID NO: 8534088 - DNA, 22 bp, Homo sapiens
acatttcttttcatctctatat

SEQ ID NO: 8534089 - DNA, 22 bp, Homo sapiens
acatttctttgctagacagcag

SEQ ID NO: 8534090 - DNA, 22 bp, Homo sapiens
acatttctttgctagacagcag

SEQ ID NO: 8534091 - DNA, 22 bp, Homo sapiens
acatttctttctattcagtagc

SEQ ID NO: 8534092 - DNA, 22 bp, Homo sapiens
acatttctttctattcagtagc

SEQ ID NO: 8534093 - DNA, 22 bp, Homo sapiens
acatttctttctattcagtagc

SEQ ID NO: 8534094 - DNA, 22 bp, Homo sapiens
acatttcttttcatctctatat

SEQ ID NO: 8534095 - DNA, 22 bp, Homo sapiens
acatttcttttcatctctatat

SEQ ID NO: 8534096 - DNA, 22 bp, Homo sapiens
acatttgacatttagtatcagc

SEQ ID NO: 8534097 - DNA, 22 bp, Homo sapiens
acatttgacatttagtatcagc

SEQ ID NO: 8534098 - DNA, 22 bp, Homo sapiens
acatttgacatttagtatcagc

SEQ ID NO: 8534099 - DNA, 22 bp, Homo sapiens
acatttgacatttagtatcagc

SEQ ID NO: 8534100 - DNA, 22 bp, Homo sapiens
acatttgaaattctgaacagat

SEQ ID NO: 8534101 - DNA, 22 bp, Homo sapiens
acatttgactgtagatacttgc

SEQ ID NO: 8534102 - DNA, 22 bp, Homo sapiens
acatttgagatgccttttaggt

SEQ ID NO: 8534103 - DNA, 22 bp, Homo sapiens
acatttgactctgttcatatta

SEQ ID NO: 8534104 - DNA, 22 bp, Homo sapiens
acatttgacatttagtatcagc

SEQ ID NO: 8534105 - DNA, 22 bp, Homo sapiens
acatttgaggatgttaagaatg

SEQ ID NO: 8534106 - DNA, 20 bp, Homo sapiens
acatttgagtatcatctact

SEQ ID NO: 8534107 - DNA, 22 bp, Homo sapiens
acatttgataattataaagaca

SEQ ID NO: 8534108 - DNA, 22 bp, Homo sapiens
acatttggcaagaaagagaaac

SEQ ID NO: 8534109 - DNA, 22 bp, Homo sapiens
acatttgggaccctctcttcac

SEQ ID NO: 8534110 - DNA, 22 bp, Homo sapiens
acatttggtaacacttgagcat

SEQ ID NO: 8534111 - DNA, 22 bp, Homo sapiens
acatttgggaccctctcttcac

SEQ ID NO: 8534112 - DNA, 22 bp, Homo sapiens
accagcctggccaacatggcaa

SEQ ID NO: 8534113 - DNA, 22 bp, Homo sapiens
accagcctggccaacatggtga

SEQ ID NO: 8534114 - DNA, 22 bp, Homo sapiens
accagcctggccaacatggtga

SEQ ID NO: 8534115 - DNA, 22 bp, Homo sapiens
accagcctgtctgagtcgtggg

SEQ ID NO: 8534116 - DNA, 22 bp, Homo sapiens
accagcctgtctgagtcgtggg

SEQ ID NO: 8534117 - DNA, 22 bp, Homo sapiens
accagctcagaagccagaaaga

SEQ ID NO: 8534118 - DNA, 22 bp, Homo sapiens
accagctcagaagccagaaaga

SEQ ID NO: 8534119 - DNA, 22 bp, Homo sapiens
accagctcagagcaggctcctg

SEQ ID NO: 8534120 - DNA, 22 bp, Homo sapiens
accagctcagagcaggctcctg

SEQ ID NO: 8534121 - DNA, 22 bp, Homo sapiens
accagctcataattttcaaaac

SEQ ID NO: 8534122 - DNA, 22 bp, Homo sapiens
accagctcagaagccagaaaga

SEQ ID NO: 8534123 - DNA, 22 bp, Homo sapiens
accagctcagagcaggctcctg

SEQ ID NO: 8534124 - DNA, 22 bp, Homo sapiens
accagcctcctagctgctcctg

SEQ ID NO: 8534125 - DNA, 17 bp, Homo sapiens
accagcctctcctgggg

SEQ ID NO: 8534126 - DNA, 22 bp, Homo sapiens
accagcctcctagctgctcctg

SEQ ID NO: 8534127 - DNA, 22 bp, Homo sapiens
accagcctggccaacatggcaa

SEQ ID NO: 8534128 - DNA, 22 bp, Homo sapiens
accagcctggccaacatggcaa

SEQ ID NO: 8534129 - DNA, 17 bp, Homo sapiens
accagcctctcctgggg

SEQ ID NO: 8534130 - DNA, 17 bp, Homo sapiens
accagcctctcctgggg

SEQ ID NO: 8534131 - DNA, 22 bp, Homo sapiens
agggagagaagttatacaagat

SEQ ID NO: 8534132 - DNA, 22 bp, Homo sapiens
agggagagacatttccttcttg

SEQ ID NO: 8534133 - DNA, 18 bp, Homo sapiens
agggagagaccgcgggtc

SEQ ID NO: 8534134 - DNA, 22 bp, Homo sapiens
agggagaggagcgtttcacatc

SEQ ID NO: 8534135 - DNA, 22 bp, Homo sapiens
agggagaggagggtcttgttga

SEQ ID NO: 8534136 - DNA, 22 bp, Homo sapiens
agggcagcacaaggcatggact

SEQ ID NO: 8534137 - DNA, 22 bp, Homo sapiens
agggcagcacaaggcatggact

SEQ ID NO: 8534138 - DNA, 22 bp, Homo sapiens
agggcagcacaaggcatggact

SEQ ID NO: 8534139 - DNA, 19 bp, Homo sapiens
accaggcctcagaggccct

SEQ ID NO: 8534140 - DNA, 19 bp, Homo sapiens
accaggcctcagaggccct

SEQ ID NO: 8534141 - DNA, 22 bp, Homo sapiens
agggcagcagcggcccaggcct

SEQ ID NO: 8534142 - DNA, 22 bp, Homo sapiens
agggcagcagcggcccaggcct

SEQ ID NO: 8534143 - DNA, 22 bp, Homo sapiens
agggcagcacagctgtgctcct

SEQ ID NO: 8534144 - DNA, 22 bp, Homo sapiens
accagctcttctgctctagttg

SEQ ID NO: 8534145 - DNA, 22 bp, Homo sapiens
accagctctggacaggcatttc

SEQ ID NO: 8534146 - DNA, 22 bp, Homo sapiens
accagctctggacaggcatttc

SEQ ID NO: 8534147 - DNA, 22 bp, Homo sapiens
accagctccaggcccctgctga

SEQ ID NO: 8534148 - DNA, 22 bp, Homo sapiens
accagctccaggcccctgctgg

SEQ ID NO: 8534149 - DNA, 22 bp, Homo sapiens
accagctccaggcccctgctgg

SEQ ID NO: 8534150 - DNA, 22 bp, Homo sapiens
accagctccaggcccctgctga

SEQ ID NO: 8534151 - DNA, 22 bp, Homo sapiens
accagctccaggcccctgctga

SEQ ID NO: 8534152 - DNA, 22 bp, Homo sapiens
accagctctggacaggcatttc

SEQ ID NO: 8534153 - DNA, 22 bp, Homo sapiens
accagctccaggcccctgctgg

SEQ ID NO: 8534154 - DNA, 22 bp, Homo sapiens
accagctctctagccctggtcc

SEQ ID NO: 8534155 - DNA, 22 bp, Homo sapiens
agggcagatggaacttccccga

SEQ ID NO: 8534156 - DNA, 21 bp, Homo sapiens
agggcagattagctgtaagag

SEQ ID NO: 8534157 - DNA, 22 bp, Homo sapiens
agggcagcaatgcagctgctgc

SEQ ID NO: 8534158 - DNA, 22 bp, Homo sapiens
accagcagagttgaggaggaca

SEQ ID NO: 8534159 - DNA, 22 bp, Homo sapiens
accagcagagttgaggaggaca

SEQ ID NO: 8534160 - DNA, 22 bp, Homo sapiens
accagagctggcagagtatcaa

SEQ ID NO: 8534161 - DNA, 22 bp, Homo sapiens
accagcagctgccagagtggag

SEQ ID NO: 8534162 - DNA, 21 bp, Homo sapiens
accagcaggagatcagaagga

SEQ ID NO: 8534163 - DNA, 22 bp, Homo sapiens
acatttgtctggctagaaagtt

SEQ ID NO: 8534164 - DNA, 22 bp, Homo sapiens
accagagctcttcagcacagga

SEQ ID NO: 8534165 - DNA, 22 bp, Homo sapiens
accagagctggcagagtatcaa

SEQ ID NO: 8534166 - DNA, 22 bp, Homo sapiens
accagagctggcagagtatcaa

SEQ ID NO: 8534167 - DNA, 22 bp, Homo sapiens
acatttgtatgcgtttttactg

SEQ ID NO: 8534168 - DNA, 22 bp, Homo sapiens
acatttgtacattggcatgtct

SEQ ID NO: 8534169 - DNA, 22 bp, Homo sapiens
acatttgtaggacagaggaaga

SEQ ID NO: 8534170 - DNA, 22 bp, Homo sapiens
acatttgtacattggcatgtct

SEQ ID NO: 8534171 - DNA, 22 bp, Homo sapiens
acatttgtatatatgcagcata

SEQ ID NO: 8534172 - DNA, 22 bp, Homo sapiens
accagcagttatgaggccagga

SEQ ID NO: 8534173 - DNA, 22 bp, Homo sapiens
accagcagttatgaggccagga

SEQ ID NO: 8534174 - DNA, 21 bp, Homo sapiens
accagcattccacactgtccc

SEQ ID NO: 8534175 - DNA, 22 bp, Homo sapiens
accagcatccttcctattaaca

SEQ ID NO: 8534176 - DNA, 22 bp, Homo sapiens
accagcatcacctggaggcctg

SEQ ID NO: 8534177 - DNA, 21 bp, Homo sapiens
accagcattccacactgtccc

SEQ ID NO: 8534178 - DNA, 22 bp, Homo sapiens
accagcattgctttgggttata

SEQ ID NO: 8534179 - DNA, 22 bp, Homo sapiens
accagccagccacagtggctcc

SEQ ID NO: 8534180 - DNA, 22 bp, Homo sapiens
aggctttaagtggcctacagct

SEQ ID NO: 8534181 - DNA, 22 bp, Homo sapiens
aggctttaattatctacaggag

SEQ ID NO: 8534182 - DNA, 22 bp, Homo sapiens
agggagacaaaagcagctgcca

SEQ ID NO: 8534183 - DNA, 22 bp, Homo sapiens
agggagacacatgaggaagtca

SEQ ID NO: 8534184 - DNA, 20 bp, Homo sapiens
aggcttggcttggcaggaac

SEQ ID NO: 8534185 - DNA, 22 bp, Homo sapiens
aggcttggctggcagccctggg

SEQ ID NO: 8534186 - DNA, 22 bp, Homo sapiens
accagccccaccgggactgcag

SEQ ID NO: 8534187 - DNA, 22 bp, Homo sapiens
accagccccaccgggactgcag

SEQ ID NO: 8534188 - DNA, 22 bp, Homo sapiens
aggcttgggtcagaaggcttgt

SEQ ID NO: 8534189 - DNA, 22 bp, Homo sapiens
agggggcatcaggtcctggctc

SEQ ID NO: 8534190 - DNA, 22 bp, Homo sapiens
agggggcatcaggtcctggctc

SEQ ID NO: 8534191 - DNA, 22 bp, Homo sapiens
agggggcatcaggtcctggctc

SEQ ID NO: 8534192 - DNA, 22 bp, Homo sapiens
agggggcaggagagacctgctg

SEQ ID NO: 8534193 - DNA, 22 bp, Homo sapiens
agggggcaggagagacctgctg

SEQ ID NO: 8534194 - DNA, 22 bp, Homo sapiens
agggggaggctgtgctgcgtct

SEQ ID NO: 8534195 - DNA, 22 bp, Homo sapiens
agggggaggctgtgctgcgtct

SEQ ID NO: 8534196 - DNA, 22 bp, Homo sapiens
acccaggctggcgtgcagtggc

SEQ ID NO: 8534197 - DNA, 22 bp, Homo sapiens
aggggcctggacatggacgcgc

SEQ ID NO: 8534198 - DNA, 22 bp, Homo sapiens
aggggcctggacatggacgcgc

SEQ ID NO: 8534199 - DNA, 22 bp, Homo sapiens
aggggcctggacatggacgcgc

SEQ ID NO: 8534200 - DNA, 22 bp, Homo sapiens
aggggcctggcactgagctggc

SEQ ID NO: 8534201 - DNA, 22 bp, Homo sapiens
agggggctcctccggtgcttcc

SEQ ID NO: 8534202 - DNA, 22 bp, Homo sapiens
accctcagtaatcgtgcagttt

SEQ ID NO: 8534203 - DNA, 22 bp, Homo sapiens
accctcagtaatcgtgcagttt

SEQ ID NO: 8534204 - DNA, 22 bp, Homo sapiens
agggggctcagtgactgaagtg

SEQ ID NO: 8534205 - DNA, 22 bp, Homo sapiens
agggggctcagcatggatggag

SEQ ID NO: 8534206 - DNA, 22 bp, Homo sapiens
accctcagtaatcgtgcagttt

SEQ ID NO: 8534207 - DNA, 22 bp, Homo sapiens
accctccactttatctgtcttt

SEQ ID NO: 8534208 - DNA, 22 bp, Homo sapiens
agggggctcagcaggctctgga

SEQ ID NO: 8534209 - DNA, 22 bp, Homo sapiens
agggggcccttgcaggtgagcg

SEQ ID NO: 8534210 - DNA, 22 bp, Homo sapiens
agggggcccttgcaggtgagcg

SEQ ID NO: 8534211 - DNA, 22 bp, Homo sapiens
agggggcattatgaggcttttc

SEQ ID NO: 8534212 - DNA, 22 bp, Homo sapiens
agggggctcagcatggatggag

SEQ ID NO: 8534213 - DNA, 22 bp, Homo sapiens
agggggctcagcatggatggag

SEQ ID NO: 8534214 - DNA, 22 bp, Homo sapiens
agggggctcagcaggctctgga

SEQ ID NO: 8534215 - DNA, 22 bp, Homo sapiens
agggctgcctgactccagagcc

SEQ ID NO: 8534216 - DNA, 22 bp, Homo sapiens
agggctgcctgactccagagcc

SEQ ID NO: 8534217 - DNA, 22 bp, Homo sapiens
agggctgctatgttgattcaga

SEQ ID NO: 8534218 - DNA, 22 bp, Homo sapiens
acccaggctggagtgcagtgac

SEQ ID NO: 8534219 - DNA, 22 bp, Homo sapiens
acccaggctggagtgcagtgat

SEQ ID NO: 8534220 - DNA, 22 bp, Homo sapiens
agggctgctcctccttcaggcc

SEQ ID NO: 8534221 - DNA, 22 bp, Homo sapiens
acccaggctggagtgcagtggg

SEQ ID NO: 8534222 - DNA, 22 bp, Homo sapiens
acccaggctggagtgcagtggc

SEQ ID NO: 8534223 - DNA, 22 bp, Homo sapiens
acccaggctggagtgcagtggt

SEQ ID NO: 8534224 - DNA, 22 bp, Homo sapiens
acccaggctggagtgcagtgtc

SEQ ID NO: 8534225 - DNA, 22 bp, Homo sapiens
acccagcccagaatctggggcc

SEQ ID NO: 8534226 - DNA, 19 bp, Homo sapiens
acccagcccaggagtggca

SEQ ID NO: 8534227 - DNA, 22 bp, Homo sapiens
acccagcctacaaagctcacct

SEQ ID NO: 8534228 - DNA, 22 bp, Homo sapiens
acccagcatgacacctgcacat

SEQ ID NO: 8534229 - DNA, 22 bp, Homo sapiens
acccagataaatgacagggctt

SEQ ID NO: 8534230 - DNA, 22 bp, Homo sapiens
acccagagtgtctgtctcagtc

SEQ ID NO: 8534231 - DNA, 22 bp, Homo sapiens
acccagccatgttcagttctct

SEQ ID NO: 8534232 - DNA, 22 bp, Homo sapiens
acccagccacagcattgaggga

SEQ ID NO: 8534233 - DNA, 22 bp, Homo sapiens
accaggctccccttggatcctg

SEQ ID NO: 8534234 - DNA, 22 bp, Homo sapiens
accaggctccccttggatcctg

SEQ ID NO: 8534235 - DNA, 22 bp, Homo sapiens
accaggctctgccagtgtttac

SEQ ID NO: 8534236 - DNA, 22 bp, Homo sapiens
accaggctggagtgcagtggcg

SEQ ID NO: 8534237 - DNA, 22 bp, Homo sapiens
accaggctccccttggatcctg

SEQ ID NO: 8534238 - DNA, 22 bp, Homo sapiens
accaggcctggctgggcagcca

SEQ ID NO: 8534239 - DNA, 22 bp, Homo sapiens
accaggcctggctgggcagcca

SEQ ID NO: 8534240 - DNA, 22 bp, Homo sapiens
accaggctggagtgcagtggcg

SEQ ID NO: 8534241 - DNA, 22 bp, Homo sapiens
accaggctggagtgcagtggcg

SEQ ID NO: 8534242 - DNA, 22 bp, Homo sapiens
acccagagccagggtcaggagc

SEQ ID NO: 8534243 - DNA, 22 bp, Homo sapiens
acccagagcagagcttggcttc

SEQ ID NO: 8534244 - DNA, 22 bp, Homo sapiens
acccagagcagagcttggcttc

SEQ ID NO: 8534245 - DNA, 22 bp, Homo sapiens
accaggctgtgaagtgagacta

SEQ ID NO: 8534246 - DNA, 22 bp, Homo sapiens
accaggctgtgaagtgagacta

SEQ ID NO: 8534247 - DNA, 22 bp, Homo sapiens
acccagctctttgatggtcttg

SEQ ID NO: 8534248 - DNA, 22 bp, Homo sapiens
acccagctctttgatggtcttg

SEQ ID NO: 8534249 - DNA, 22 bp, Homo sapiens
acccagctctttgatggtcttg

SEQ ID NO: 8534250 - DNA, 22 bp, Homo sapiens
acccagctgtttcccgtgtcat

SEQ ID NO: 8534251 - DNA, 22 bp, Homo sapiens
acccagctggatgcatggaggc

SEQ ID NO: 8534252 - DNA, 22 bp, Homo sapiens
acccagctggatgcatggaggc

SEQ ID NO: 8534253 - DNA, 22 bp, Homo sapiens
acccagctggatgcatggaggc

SEQ ID NO: 8534254 - DNA, 22 bp, Homo sapiens
acccagctaaccctaccctgga

SEQ ID NO: 8534255 - DNA, 20 bp, Homo sapiens
acccagctctgtgccctggg

SEQ ID NO: 8534256 - DNA, 20 bp, Homo sapiens
acccagctctgtgccctggg

SEQ ID NO: 8534257 - DNA, 22 bp, Homo sapiens
acccagctaaccctaccctgga

SEQ ID NO: 8534258 - DNA, 22 bp, Homo sapiens
acccagctaaccctaccctgga

SEQ ID NO: 8534259 - DNA, 22 bp, Homo sapiens
acccagctctttgatggtcttg

SEQ ID NO: 8534260 - DNA, 20 bp, Homo sapiens
acccagctctgtgccctggg

SEQ ID NO: 8534261 - DNA, 20 bp, Homo sapiens
acccagctctgtgccctggg

SEQ ID NO: 8534262 - DNA, 22 bp, Homo sapiens
acccaggaaaacatggtgcaga

SEQ ID NO: 8534263 - DNA, 22 bp, Homo sapiens
acccaggacaaaataaccaggt

SEQ ID NO: 8534264 - DNA, 22 bp, Homo sapiens
acccaggaaaacatggtgcaga

SEQ ID NO: 8534265 - DNA, 22 bp, Homo sapiens
acccaggaaaacatggtgcaga

SEQ ID NO: 8534266 - DNA, 22 bp, Homo sapiens
acccaggaaaacatggtgcaga

SEQ ID NO: 8534267 - DNA, 22 bp, Homo sapiens
acccagctgtttcccgtgtcat

SEQ ID NO: 8534268 - DNA, 22 bp, Homo sapiens
acccaggacacagagatgaccc

SEQ ID NO: 8534269 - DNA, 22 bp, Homo sapiens
acccaggacatgggcacccgtg

SEQ ID NO: 8534270 - DNA, 22 bp, Homo sapiens
acccaggacaaaataaccaggt

SEQ ID NO: 8534271 - DNA, 22 bp, Homo sapiens
acccaggacacagagatgaccc

SEQ ID NO: 8534272 - DNA, 22 bp, Homo sapiens
acccaggacacagagatgaccc

SEQ ID NO: 8534273 - DNA, 22 bp, Homo sapiens
agggctgcccagtgtgagagct

SEQ ID NO: 8534274 - DNA, 22 bp, Homo sapiens
agggctgacagtgaggagtcaa

SEQ ID NO: 8534275 - DNA, 22 bp, Homo sapiens
acccaggagagagctataaaat

SEQ ID NO: 8534276 - DNA, 22 bp, Homo sapiens
agggctgacagtgaggagtcaa

SEQ ID NO: 8534277 - DNA, 22 bp, Homo sapiens
agggctgccatttctggcccaa

SEQ ID NO: 8534278 - DNA, 22 bp, Homo sapiens
acccaggagacaggttgcagtg

SEQ ID NO: 8534279 - DNA, 22 bp, Homo sapiens
acccaggagacggaggtgcagt

SEQ ID NO: 8534280 - DNA, 22 bp, Homo sapiens
acccaggagacggaggtgcagt

SEQ ID NO: 8534281 - DNA, 22 bp, Homo sapiens
acccaggagagagctataaaat

SEQ ID NO: 8534282 - DNA, 22 bp, Homo sapiens
acccaggagacggaggtgcagt

SEQ ID NO: 8534283 - DNA, 22 bp, Homo sapiens
acccaggactctcttccagtag

SEQ ID NO: 8534284 - DNA, 22 bp, Homo sapiens
acccaggacttggcaacctcat

SEQ ID NO: 8534285 - DNA, 22 bp, Homo sapiens
acccaggactctcttccagtag

SEQ ID NO: 8534286 - DNA, 22 bp, Homo sapiens
acccaggacatgggcacccgtg

SEQ ID NO: 8534287 - DNA, 22 bp, Homo sapiens
acccaggacttggcaacctcat

SEQ ID NO: 8534288 - DNA, 22 bp, Homo sapiens
acccaggacttggcaacctcat

SEQ ID NO: 8534289 - DNA, 22 bp, Homo sapiens
acccaggagacaggttgcagtg

SEQ ID NO: 8534290 - DNA, 20 bp, Homo sapiens
ataatttaccctgcaccact

SEQ ID NO: 8534291 - DNA, 20 bp, Homo sapiens
ataatttaccctgcaccact

SEQ ID NO: 8534292 - DNA, 22 bp, Homo sapiens
ataatttacaactgcttttaat

SEQ ID NO: 8534293 - DNA, 22 bp, Homo sapiens
ataatttacaactgcttttaat

SEQ ID NO: 8534294 - DNA, 20 bp, Homo sapiens
atacacattcatagaaaaat

SEQ ID NO: 8534295 - DNA, 20 bp, Homo sapiens
atacacattcatagaaaaat

SEQ ID NO: 8534296 - DNA, 22 bp, Homo sapiens
ataatttaattttcacagtggt

SEQ ID NO: 8534297 - DNA, 22 bp, Homo sapiens
ataatttaattttcacagtggt

SEQ ID NO: 8534298 - DNA, 22 bp, Homo sapiens
ataatttaattttcacagtggt

SEQ ID NO: 8534299 - DNA, 22 bp, Homo sapiens
ataatttaaattagtatgtgat

SEQ ID NO: 8534300 - DNA, 22 bp, Homo sapiens
atacagaagaactatagccact

SEQ ID NO: 8534301 - DNA, 22 bp, Homo sapiens
atacagaactctcagttgtata

SEQ ID NO: 8534302 - DNA, 22 bp, Homo sapiens
atacagaactctcagttgtata

SEQ ID NO: 8534303 - DNA, 21 bp, Homo sapiens
atacagaacattgatccaaga

SEQ ID NO: 8534304 - DNA, 21 bp, Homo sapiens
atacagaacattgatccaaga

SEQ ID NO: 8534305 - DNA, 22 bp, Homo sapiens
atacagaaaagtggatagccag

SEQ ID NO: 8534306 - DNA, 22 bp, Homo sapiens
atacagaaaatgatgcagagtt

SEQ ID NO: 8534307 - DNA, 22 bp, Homo sapiens
atacagaacaagcctcacctcc

SEQ ID NO: 8534308 - DNA, 22 bp, Homo sapiens
atacagaaaatgatgcagagtt

SEQ ID NO: 8534309 - DNA, 22 bp, Homo sapiens
atacagaacaagcctcacctcc

SEQ ID NO: 8534310 - DNA, 22 bp, Homo sapiens
ataatttaaattagtatgtgat

SEQ ID NO: 8534311 - DNA, 22 bp, Homo sapiens
ataattgatgaggctttggaca

SEQ ID NO: 8534312 - DNA, 22 bp, Homo sapiens
ataattgtgggcagtgtgatat

SEQ ID NO: 8534313 - DNA, 20 bp, Homo sapiens
ataattatttacttttgtgc

SEQ ID NO: 8534314 - DNA, 22 bp, Homo sapiens
ataattatctcagacacttgtt

SEQ ID NO: 8534315 - DNA, 22 bp, Homo sapiens
ataattatctcagacacttgtt

SEQ ID NO: 8534316 - DNA, 22 bp, Homo sapiens
ataattatctcagacacttgtt

SEQ ID NO: 8534317 - DNA, 22 bp, Homo sapiens
ataattatctcagacacttgtt

SEQ ID NO: 8534318 - DNA, 22 bp, Homo sapiens
ataattacattatactgttaga

SEQ ID NO: 8534319 - DNA, 22 bp, Homo sapiens
ataattatctcagacacttgtt

SEQ ID NO: 8534320 - DNA, 22 bp, Homo sapiens
ataatgtaggtatgtgtattta

SEQ ID NO: 8534321 - DNA, 22 bp, Homo sapiens
ataatgtgatatttcatttaca

SEQ ID NO: 8534322 - DNA, 22 bp, Homo sapiens
ataatgtgttcatcttacaatt

SEQ ID NO: 8534323 - DNA, 22 bp, Homo sapiens
ataatgttgatgattgtctttg

SEQ ID NO: 8534324 - DNA, 21 bp, Homo sapiens
ataatgtacaaaaactgtctt

SEQ ID NO: 8534325 - DNA, 22 bp, Homo sapiens
ctgcctgcttttctgggagccg

SEQ ID NO: 8534326 - DNA, 22 bp, Homo sapiens
ataatcattcacataaggtgct

SEQ ID NO: 8534327 - DNA, 22 bp, Homo sapiens
ataatcattcacataaggtgct

SEQ ID NO: 8534328 - DNA, 22 bp, Homo sapiens
atacagaagaactatagccact

SEQ ID NO: 8534329 - DNA, 22 bp, Homo sapiens
atacagaagcctgtatttctgg

SEQ ID NO: 8534330 - DNA, 22 bp, Homo sapiens
atacagaagcctgtatttctgg

SEQ ID NO: 8534331 - DNA, 22 bp, Homo sapiens
atacagaagcctgtatttctgg

SEQ ID NO: 8534332 - DNA, 22 bp, Homo sapiens
ctggaacaagtggccttgcaag

SEQ ID NO: 8534333 - DNA, 22 bp, Homo sapiens
ctggaaattggagatgatgttt

SEQ ID NO: 8534334 - DNA, 22 bp, Homo sapiens
ctggaaatcactactagtcaat

SEQ ID NO: 8534335 - DNA, 22 bp, Homo sapiens
ctggaacccaggcctggaagcc

SEQ ID NO: 8534336 - DNA, 22 bp, Homo sapiens
ctggaacagtgttggagcttga

SEQ ID NO: 8534337 - DNA, 23 bp, Homo sapiens
ctggaacatagtagatggtcaga

SEQ ID NO: 8534338 - DNA, 22 bp, Homo sapiens
ctggaagaactccagttctgtg

SEQ ID NO: 8534339 - DNA, 22 bp, Homo sapiens
ctggaagaactccagttctgtg

SEQ ID NO: 8534340 - DNA, 21 bp, Homo sapiens
ctggaagaagcagcaggattc

SEQ ID NO: 8534341 - DNA, 22 bp, Homo sapiens
ctggaagaactccagttctgtg

SEQ ID NO: 8534342 - DNA, 21 bp, Homo sapiens
ctggaagaagcagcaggattc

SEQ ID NO: 8534343 - DNA, 22 bp, Homo sapiens
ctggaagacgtttgaagccatg

SEQ ID NO: 8534344 - DNA, 22 bp, Homo sapiens
ctggaagacgtttgaagccatg

SEQ ID NO: 8534345 - DNA, 22 bp, Homo sapiens
ctggaagacgtttgaagccatg

SEQ ID NO: 8534346 - DNA, 22 bp, Homo sapiens
ctggaagaccccccaggactca

SEQ ID NO: 8534347 - DNA, 21 bp, Homo sapiens
ctggaagaagcagcaggattc

SEQ ID NO: 8534348 - DNA, 21 bp, Homo sapiens
ctggaagaagcagcaggattc

SEQ ID NO: 8534349 - DNA, 22 bp, Homo sapiens
atacatatatggtacttcctgg

SEQ ID NO: 8534350 - DNA, 22 bp, Homo sapiens
atacatatatggtacttcctgg

SEQ ID NO: 8534351 - DNA, 22 bp, Homo sapiens
atacatctcatgtaagagataa

SEQ ID NO: 8534352 - DNA, 22 bp, Homo sapiens
ctggagctggcccaggctggcc

SEQ ID NO: 8534353 - DNA, 22 bp, Homo sapiens
ctggagctgctgtccttgggtg

SEQ ID NO: 8534354 - DNA, 22 bp, Homo sapiens
ctggagctgctgtccttgggtg

SEQ ID NO: 8534355 - DNA, 22 bp, Homo sapiens
ctggagctgctgtccttgggtg

SEQ ID NO: 8534356 - DNA, 22 bp, Homo sapiens
atacatgatcactgtattataa

SEQ ID NO: 8534357 - DNA, 22 bp, Homo sapiens
atacatgatcactgtattataa

SEQ ID NO: 8534358 - DNA, 22 bp, Homo sapiens
atacatgatacttagtacgtag

SEQ ID NO: 8534359 - DNA, 22 bp, Homo sapiens
ctggagctgtcttcacaggcct

SEQ ID NO: 8534360 - DNA, 22 bp, Homo sapiens
ctggagctgtcttcacaggcct

SEQ ID NO: 8534361 - DNA, 22 bp, Homo sapiens
ctggagctggtatagggacaaa

SEQ ID NO: 8534362 - DNA, 22 bp, Homo sapiens
ctggagctggcttccttccact

SEQ ID NO: 8534363 - DNA, 22 bp, Homo sapiens
ctggagctggcttccttccact

SEQ ID NO: 8534364 - DNA, 22 bp, Homo sapiens
ctggagctgggctagggtagga

SEQ ID NO: 8534365 - DNA, 22 bp, Homo sapiens
atacatcttccttttaaaatgc

SEQ ID NO: 8534366 - DNA, 22 bp, Homo sapiens
atacatcttccttttaaaatgc

SEQ ID NO: 8534367 - DNA, 22 bp, Homo sapiens
atacatcttccttttaaaatgc

SEQ ID NO: 8534368 - DNA, 22 bp, Homo sapiens
atacatctggatgtatgcattt

SEQ ID NO: 8534369 - DNA, 22 bp, Homo sapiens
atacatctggatgtatgcattt

SEQ ID NO: 8534370 - DNA, 22 bp, Homo sapiens
atacatctcatgtaagagataa

SEQ ID NO: 8534371 - DNA, 22 bp, Homo sapiens
atacatctcatgtaagagataa

SEQ ID NO: 8534372 - DNA, 22 bp, Homo sapiens
atacatgactcacacattctgc

SEQ ID NO: 8534373 - DNA, 22 bp, Homo sapiens
atacatgaggaggctggaaaca

SEQ ID NO: 8534374 - DNA, 22 bp, Homo sapiens
atacatgaggaggctggaaaca

SEQ ID NO: 8534375 - DNA, 22 bp, Homo sapiens
atacatcttgtcagattcatgt

SEQ ID NO: 8534376 - DNA, 22 bp, Homo sapiens
atacatgacactgggctacagg

SEQ ID NO: 8534377 - DNA, 22 bp, Homo sapiens
atacatcttgtcagattcatgt

SEQ ID NO: 8534378 - DNA, 22 bp, Homo sapiens
atacatgactcacacattctgc

SEQ ID NO: 8534379 - DNA, 22 bp, Homo sapiens
ataggcaagggatacaatatac

SEQ ID NO: 8534380 - DNA, 23 bp, Homo sapiens
atagacccaagagtaaaggcatc

SEQ ID NO: 8534381 - DNA, 22 bp, Homo sapiens
atagacgcggccgctgatgcag

SEQ ID NO: 8534382 - DNA, 22 bp, Homo sapiens
atagcatataagttataaaact

SEQ ID NO: 8534383 - DNA, 22 bp, Homo sapiens
ataggcaagcacaaagtcagga

SEQ ID NO: 8534384 - DNA, 22 bp, Homo sapiens
atagggcctaaaaagtattgct

SEQ ID NO: 8534385 - DNA, 22 bp, Homo sapiens
ataggtacagcagatattctta

SEQ ID NO: 8534386 - DNA, 22 bp, Homo sapiens
ataggtctgaaagtgtatcctg

SEQ ID NO: 8534387 - DNA, 22 bp, Homo sapiens
atagtaaattatcgtggagaga

SEQ ID NO: 8534388 - DNA, 22 bp, Homo sapiens
atagtaactggcatgtttatga

SEQ ID NO: 8534389 - DNA, 22 bp, Homo sapiens
atagtaactggcatgtttatga

SEQ ID NO: 8534390 - DNA, 22 bp, Homo sapiens
atagtaactggcatgtttatga

SEQ ID NO: 8534391 - DNA, 22 bp, Homo sapiens
atagtacacatcctacaatgtt

SEQ ID NO: 8534392 - DNA, 22 bp, Homo sapiens
atagtacaatcagttaattagt

SEQ ID NO: 8534393 - DNA, 22 bp, Homo sapiens
atagaatctttgtaaaacactt

SEQ ID NO: 8534394 - DNA, 22 bp, Homo sapiens
atagaatgtattatagtacaga

SEQ ID NO: 8534395 - DNA, 22 bp, Homo sapiens
atagaattacagtgtgtttgga

SEQ ID NO: 8534396 - DNA, 22 bp, Homo sapiens
atagaattctttgaaatttatg

SEQ ID NO: 8534397 - DNA, 22 bp, Homo sapiens
atagacaaacacgaagatgaca

SEQ ID NO: 8534398 - DNA, 22 bp, Homo sapiens
atagaatttgtacttgtagaac

SEQ ID NO: 8534399 - DNA, 22 bp, Homo sapiens
atagaatttgcactaaatctgc

SEQ ID NO: 8534400 - DNA, 22 bp, Homo sapiens
atagaattctttgaaatttatg

SEQ ID NO: 8534401 - DNA, 22 bp, Homo sapiens
atagaattctttgaaatttatg

SEQ ID NO: 8534402 - DNA, 22 bp, Homo sapiens
atagacatatggctttgtttct

SEQ ID NO: 8534403 - DNA, 22 bp, Homo sapiens
atagacattataacacagagct

SEQ ID NO: 8534404 - DNA, 22 bp, Homo sapiens
atagacattataacacagagct

SEQ ID NO: 8534405 - DNA, 22 bp, Homo sapiens
atagacatgcaacactttttac

SEQ ID NO: 8534406 - DNA, 22 bp, Homo sapiens
atagacatggtcttttgtcatt

SEQ ID NO: 8534407 - DNA, 22 bp, Homo sapiens
atagacaatggtttgccaagaa

SEQ ID NO: 8534408 - DNA, 22 bp, Homo sapiens
atagacaatcccccatcctacc

SEQ ID NO: 8534409 - DNA, 20 bp, Homo sapiens
atagacaaagacatgccaga

SEQ ID NO: 8534410 - DNA, 22 bp, Homo sapiens
ctggccaggttttgaacagttg

SEQ ID NO: 8534411 - DNA, 22 bp, Homo sapiens
ctggccagggtgcgatcgtggt

SEQ ID NO: 8534412 - DNA, 22 bp, Homo sapiens
ctggccagggtgcgatcgtggt

SEQ ID NO: 8534413 - DNA, 22 bp, Homo sapiens
ctggccaggcttgggacagaca

SEQ ID NO: 8534414 - DNA, 22 bp, Homo sapiens
ctggccaggcttgggacagaca

SEQ ID NO: 8534415 - DNA, 22 bp, Homo sapiens
ctggccaggcttgggacagaca

SEQ ID NO: 8534416 - DNA, 22 bp, Homo sapiens
ctggccaggcttgggacagaca

SEQ ID NO: 8534417 - DNA, 22 bp, Homo sapiens
ctggccagtgcctgtgggcccc

SEQ ID NO: 8534418 - DNA, 22 bp, Homo sapiens
ctggccagtgactgctcacccg

SEQ ID NO: 8534419 - DNA, 22 bp, Homo sapiens
ctggccagtgactgctcacccg

SEQ ID NO: 8534420 - DNA, 22 bp, Homo sapiens
ctggccaggttttgaacagttg

SEQ ID NO: 8534421 - DNA, 22 bp, Homo sapiens
ctggccaggttttgaacagttg

SEQ ID NO: 8534422 - DNA, 22 bp, Homo sapiens
ctggccaggttttgaacagttg

SEQ ID NO: 8534423 - DNA, 22 bp, Homo sapiens
ctggagctgtcttcacaggcct

SEQ ID NO: 8534424 - DNA, 22 bp, Homo sapiens
ctggagctgttttttcaggaaa

SEQ ID NO: 8534425 - DNA, 17 bp, Homo sapiens
ctggagctgtgtaacct

SEQ ID NO: 8534426 - DNA, 22 bp, Homo sapiens
ctggagcttattgggagcagaa

SEQ ID NO: 8534427 - DNA, 22 bp, Homo sapiens
ctggagcttattgggagcagaa

SEQ ID NO: 8534428 - DNA, 21 bp, Homo sapiens
ctggagcttggtgagaagtgt

SEQ ID NO: 8534429 - DNA, 22 bp, Homo sapiens
ctggccaggctctcacgtggtc

SEQ ID NO: 8534430 - DNA, 22 bp, Homo sapiens
ctggccagaggttcctctgccc

SEQ ID NO: 8534431 - DNA, 22 bp, Homo sapiens
ctggccaggcttgggacagaca

SEQ ID NO: 8534432 - DNA, 22 bp, Homo sapiens
ctggccaggcttgggacagaca

SEQ ID NO: 8534433 - DNA, 22 bp, Homo sapiens
ctggccaggctctcacgtggtc

SEQ ID NO: 8534434 - DNA, 19 bp, Homo sapiens
atagaaagggttaaagaca

SEQ ID NO: 8534435 - DNA, 19 bp, Homo sapiens
atagaaagggttaaagaca

SEQ ID NO: 8534436 - DNA, 22 bp, Homo sapiens
atagaaatggcagctggtgcta

SEQ ID NO: 8534437 - DNA, 22 bp, Homo sapiens
atagaaaggtctttggcagaca

SEQ ID NO: 8534438 - DNA, 22 bp, Homo sapiens
atagaatatgacttttagatcc

SEQ ID NO: 8534439 - DNA, 22 bp, Homo sapiens
atagaatatgacttttagatcc

SEQ ID NO: 8534440 - DNA, 22 bp, Homo sapiens
atagaatatgacttttagatcc

SEQ ID NO: 8534441 - DNA, 22 bp, Homo sapiens
atagaatagcatagaaaattga

SEQ ID NO: 8534442 - DNA, 22 bp, Homo sapiens
atagaatagcatagaaaattga

SEQ ID NO: 8534443 - DNA, 22 bp, Homo sapiens
atagaatagcatagaaaattga

SEQ ID NO: 8534444 - DNA, 22 bp, Homo sapiens
atagaatagcatagaaaattga

SEQ ID NO: 8534445 - DNA, 22 bp, Homo sapiens
atagaatatgacttttagatcc

SEQ ID NO: 8534446 - DNA, 22 bp, Homo sapiens
atagaaaacagatgtccttaaa

SEQ ID NO: 8534447 - DNA, 22 bp, Homo sapiens
atagaaacagggaagcaaagca

SEQ ID NO: 8534448 - DNA, 22 bp, Homo sapiens
atagaaaacagatgtccttaaa

SEQ ID NO: 8534449 - DNA, 22 bp, Homo sapiens
atagaaaacagatgtccttaaa

SEQ ID NO: 8534450 - DNA, 22 bp, Homo sapiens
atactttgggggttagtgtaga

SEQ ID NO: 8534451 - DNA, 22 bp, Homo sapiens
atacttttaattccttctgagt

SEQ ID NO: 8534452 - DNA, 22 bp, Homo sapiens
atacttttaattccttctgagt

SEQ ID NO: 8534453 - DNA, 21 bp, Homo sapiens
atactttgaattacagccttg

SEQ ID NO: 8534454 - DNA, 21 bp, Homo sapiens
atactttgaattacagccttg

SEQ ID NO: 8534455 - DNA, 22 bp, Homo sapiens
agtttctgttaccatatttgac

SEQ ID NO: 8534456 - DNA, 22 bp, Homo sapiens
agtttctctttgacaccaaaat

SEQ ID NO: 8534457 - DNA, 22 bp, Homo sapiens
agtttctcttaatctagtatct

SEQ ID NO: 8534458 - DNA, 22 bp, Homo sapiens
agtttctcttaatctagtatct

SEQ ID NO: 8534459 - DNA, 22 bp, Homo sapiens
agtttcttcatccaaaaaatgg

SEQ ID NO: 8534460 - DNA, 22 bp, Homo sapiens
agtttcttattcttagttatgt

SEQ ID NO: 8534461 - DNA, 22 bp, Homo sapiens
agtttcttgaagactgatgttt

SEQ ID NO: 8534462 - DNA, 22 bp, Homo sapiens
agtttcttgaagactgatgttt

SEQ ID NO: 8534463 - DNA, 22 bp, Homo sapiens
agtttcttgaagactgatgttt

SEQ ID NO: 8534464 - DNA, 22 bp, Homo sapiens
ctgagtctcccggcagtggagg

SEQ ID NO: 8534465 - DNA, 22 bp, Homo sapiens
agtttctttagatagaaagttc

SEQ ID NO: 8534466 - DNA, 22 bp, Homo sapiens
agtttctctagagtctttgaaa

SEQ ID NO: 8534467 - DNA, 22 bp, Homo sapiens
agtttctctagagtctttgaaa

SEQ ID NO: 8534468 - DNA, 22 bp, Homo sapiens
agtttctcttaatctagtatct

SEQ ID NO: 8534469 - DNA, 22 bp, Homo sapiens
agtttctctcagtatagaatag

SEQ ID NO: 8534470 - DNA, 22 bp, Homo sapiens
agtttctagcctcactgtttag

SEQ ID NO: 8534471 - DNA, 22 bp, Homo sapiens
agtttcatgagacagattttca

SEQ ID NO: 8534472 - DNA, 22 bp, Homo sapiens
agtttcagttctgtcatttata

SEQ ID NO: 8534473 - DNA, 18 bp, Homo sapiens
agtttcagggcaggaaac

SEQ ID NO: 8534474 - DNA, 22 bp, Homo sapiens
agtttcatattaccatgtcacc

SEQ ID NO: 8534475 - DNA, 23 bp, Homo sapiens
agtttcacattttacatgtggct

SEQ ID NO: 8534476 - DNA, 22 bp, Homo sapiens
agtttcacatgcatggatgtgt

SEQ ID NO: 8534477 - DNA, 22 bp, Homo sapiens
agtttcacagtctgtcattgtt

SEQ ID NO: 8534478 - DNA, 22 bp, Homo sapiens
agtttcagaatttatgcagaca

SEQ ID NO: 8534479 - DNA, 22 bp, Homo sapiens
agtttcactaaggtctgtgtgt

SEQ ID NO: 8534480 - DNA, 22 bp, Homo sapiens
ctgagtggaacataggatgata

SEQ ID NO: 8534481 - DNA, 22 bp, Homo sapiens
ctgagtgaggggagcttgatgg

SEQ ID NO: 8534482 - DNA, 22 bp, Homo sapiens
ctgataatgtcctgcagtaaat

SEQ ID NO: 8534483 - DNA, 21 bp, Homo sapiens
ctgataattgttaaattattt

SEQ ID NO: 8534484 - DNA, 22 bp, Homo sapiens
ctgagttctgcccaaggtctgg

SEQ ID NO: 8534485 - DNA, 22 bp, Homo sapiens
ctgagttctaggctgccacctt

SEQ ID NO: 8534486 - DNA, 22 bp, Homo sapiens
ctgagtgttttcagccacggcc

SEQ ID NO: 8534487 - DNA, 22 bp, Homo sapiens
ctgatacatagtagcatgtcat

SEQ ID NO: 8534488 - DNA, 22 bp, Homo sapiens
ctgatacatagtagcatgtcat

SEQ ID NO: 8534489 - DNA, 22 bp, Homo sapiens
ctgatacaatgctaataaattt

SEQ ID NO: 8534490 - DNA, 22 bp, Homo sapiens
agttttatgttcacagaaggat

SEQ ID NO: 8534491 - DNA, 22 bp, Homo sapiens
agttttattaaatccacagaag

SEQ ID NO: 8534492 - DNA, 22 bp, Homo sapiens
agtttgtatgccaacagcaaag

SEQ ID NO: 8534493 - DNA, 22 bp, Homo sapiens
agttttattccaatgtgcagca

SEQ ID NO: 8534494 - DNA, 22 bp, Homo sapiens
agttttattccaatgtgcagca

SEQ ID NO: 8534495 - DNA, 22 bp, Homo sapiens
agttttattgtcccagaggtga

SEQ ID NO: 8534496 - DNA, 22 bp, Homo sapiens
agttttattgtcccagaggtga

SEQ ID NO: 8534497 - DNA, 22 bp, Homo sapiens
agttttattccaatgtgcagca

SEQ ID NO: 8534498 - DNA, 22 bp, Homo sapiens
agttttattaaatccacagaag

SEQ ID NO: 8534499 - DNA, 22 bp, Homo sapiens
agttttattccaatgtgcagca

SEQ ID NO: 8534500 - DNA, 22 bp, Homo sapiens
agttttattaaatccacagaag

SEQ ID NO: 8534501 - DNA, 23 bp, Homo sapiens
agtgttcagcatgtagtaaatac

SEQ ID NO: 8534502 - DNA, 22 bp, Homo sapiens
agtgttagtgaaaggtgtttat

SEQ ID NO: 8534503 - DNA, 22 bp, Homo sapiens
agtgttagattcttactcagtt

SEQ ID NO: 8534504 - DNA, 22 bp, Homo sapiens
agtttatgtaaaattagtaatg

SEQ ID NO: 8534505 - DNA, 22 bp, Homo sapiens
agtttatgtaaaattagtaatg

SEQ ID NO: 8534506 - DNA, 22 bp, Homo sapiens
agtttacaacagtagctatgga

SEQ ID NO: 8534507 - DNA, 22 bp, Homo sapiens
agtgttcatttattcattcact

SEQ ID NO: 8534508 - DNA, 22 bp, Homo sapiens
agtgttcatttattcattcact

SEQ ID NO: 8534509 - DNA, 22 bp, Homo sapiens
agtttatgtagaattggcaata

SEQ ID NO: 8534510 - DNA, 22 bp, Homo sapiens
agtttatgtaaaattagtaatg

SEQ ID NO: 8534511 - DNA, 22 bp, Homo sapiens
agtttatgttgtttataagcca

SEQ ID NO: 8534512 - DNA, 19 bp, Homo sapiens
agtttattataggtgattc

SEQ ID NO: 8534513 - DNA, 22 bp, Homo sapiens
agtttcacagaatatgaaggtt

SEQ ID NO: 8534514 - DNA, 22 bp, Homo sapiens
agtttcacagagggttagacgc

SEQ ID NO: 8534515 - DNA, 17 bp, Homo sapiens
agtttatttagccttct

SEQ ID NO: 8534516 - DNA, 17 bp, Homo sapiens
agtttatttagccttct

SEQ ID NO: 8534517 - DNA, 20 bp, Homo sapiens
agtttattccaggagaactg

SEQ ID NO: 8534518 - DNA, 20 bp, Homo sapiens
agtttattccaggagaactg

SEQ ID NO: 8534519 - DNA, 22 bp, Homo sapiens
agtttattctctggtcttagta

SEQ ID NO: 8534520 - DNA, 22 bp, Homo sapiens
agtttattctgcttggccctcc

SEQ ID NO: 8534521 - DNA, 22 bp, Homo sapiens
agtttattgtatatggtagttt

SEQ ID NO: 8534522 - DNA, 22 bp, Homo sapiens
ctgccctcgggccctcccatag

SEQ ID NO: 8534523 - DNA, 22 bp, Homo sapiens
ctgccctcgggccctcccatag

SEQ ID NO: 8534524 - DNA, 22 bp, Homo sapiens
ctgccctcgggccctcccatag

SEQ ID NO: 8534525 - DNA, 21 bp, Homo sapiens
ctgccctagatggctctggaa

SEQ ID NO: 8534526 - DNA, 22 bp, Homo sapiens
ctgcccgtccctttgctctcgc

SEQ ID NO: 8534527 - DNA, 18 bp, Homo sapiens
ctgccccttctctgagat

SEQ ID NO: 8534528 - DNA, 18 bp, Homo sapiens
ctgccccttctctgagat

SEQ ID NO: 8534529 - DNA, 18 bp, Homo sapiens
ctgcccagagcacttgtg

SEQ ID NO: 8534530 - DNA, 22 bp, Homo sapiens
ctgccctgactgaccttttgaa

SEQ ID NO: 8534531 - DNA, 22 bp, Homo sapiens
ctgccctgacctgcctcagagt

SEQ ID NO: 8534532 - DNA, 22 bp, Homo sapiens
ctgccctggtcccatggctgat

SEQ ID NO: 8534533 - DNA, 22 bp, Homo sapiens
ctgccctggtcccatggctgat

SEQ ID NO: 8534534 - DNA, 22 bp, Homo sapiens
ctgccctggtcccatggctgat

SEQ ID NO: 8534535 - DNA, 22 bp, Homo sapiens
ctgccctctagaggaggactga

SEQ ID NO: 8534536 - DNA, 22 bp, Homo sapiens
ctgccctctagggatgcactgg

SEQ ID NO: 8534537 - DNA, 22 bp, Homo sapiens
ctgccctctagaggaggactga

SEQ ID NO: 8534538 - DNA, 22 bp, Homo sapiens
ctgccctctagggatgcactgg

SEQ ID NO: 8534539 - DNA, 22 bp, Homo sapiens
ctgccctgacctgcctcagagt

SEQ ID NO: 8534540 - DNA, 22 bp, Homo sapiens
ctgccctctagggatgcactgg

SEQ ID NO: 8534541 - DNA, 22 bp, Homo sapiens
ctgccctctagggatgcactgg

SEQ ID NO: 8534542 - DNA, 20 bp, Homo sapiens
agttttcagcagaacaccca

SEQ ID NO: 8534543 - DNA, 22 bp, Homo sapiens
agttttcacactcaccaaaagg

SEQ ID NO: 8534544 - DNA, 22 bp, Homo sapiens
agttttcattaccatgctgcaa

SEQ ID NO: 8534545 - DNA, 21 bp, Homo sapiens
agttttccattagggagggag

SEQ ID NO: 8534546 - DNA, 22 bp, Homo sapiens
agttttcctttattgagtacca

SEQ ID NO: 8534547 - DNA, 22 bp, Homo sapiens
agttttctgacccctgctctat

SEQ ID NO: 8534548 - DNA, 22 bp, Homo sapiens
agttttcttcattttgtggcca

SEQ ID NO: 8534549 - DNA, 22 bp, Homo sapiens
agttttctttcatctatcagca

SEQ ID NO: 8534550 - DNA, 22 bp, Homo sapiens
agttttgaaatgaaatgtagtt

SEQ ID NO: 8534551 - DNA, 22 bp, Homo sapiens
agttttctgggatcactggaat

SEQ ID NO: 8534552 - DNA, 22 bp, Homo sapiens
agttttctgcctctggatgcgt

SEQ ID NO: 8534553 - DNA, 22 bp, Homo sapiens
agttttctgctaaaccagctaa

SEQ ID NO: 8534554 - DNA, 22 bp, Homo sapiens
agttttctgatgtgtagtgaga

SEQ ID NO: 8534555 - DNA, 22 bp, Homo sapiens
ctgcctgctgcctgtggagggt

SEQ ID NO: 8534556 - DNA, 22 bp, Homo sapiens
ctgcctgctgcctgtggagggt

SEQ ID NO: 8534557 - DNA, 22 bp, Homo sapiens
ctgcctgctgccctccagagcc

SEQ ID NO: 8534558 - DNA, 22 bp, Homo sapiens
ctgcctgctgccctccagagcc

SEQ ID NO: 8534559 - DNA, 22 bp, Homo sapiens
ctgcctgctgccctccagagcc

SEQ ID NO: 8534560 - DNA, 18 bp, Homo sapiens
ctgcctgctctccagctt

SEQ ID NO: 8534561 - DNA, 18 bp, Homo sapiens
ctgcctgctctccagctt

SEQ ID NO: 8534562 - DNA, 18 bp, Homo sapiens
ctgcctgctctccagctt

SEQ ID NO: 8534563 - DNA, 18 bp, Homo sapiens
ctgcctgctctccagctt

SEQ ID NO: 8534564 - DNA, 18 bp, Homo sapiens
ctgcctgctctccagctt

SEQ ID NO: 8534565 - DNA, 22 bp, Homo sapiens
ctgcctgctgattagtattgtc

SEQ ID NO: 8534566 - DNA, 22 bp, Homo sapiens
ctgcctgctgacattctttata

SEQ ID NO: 8534567 - DNA, 22 bp, Homo sapiens
ctgcctgctgattagtattgtc

SEQ ID NO: 8534568 - DNA, 22 bp, Homo sapiens
ctgcctgctgattagtattgtc

SEQ ID NO: 8534569 - DNA, 22 bp, Homo sapiens
ctgcctgctgacattctttata

SEQ ID NO: 8534570 - DNA, 22 bp, Homo sapiens
ctgcctgctgacattctttata

SEQ ID NO: 8534571 - DNA, 22 bp, Homo sapiens
ctgcctgcttctgagccagagg

SEQ ID NO: 8534572 - DNA, 22 bp, Homo sapiens
ctgcctgcttctgagccagagg

SEQ ID NO: 8534573 - DNA, 22 bp, Homo sapiens
ctgcctgcttctgagccagagg

SEQ ID NO: 8534574 - DNA, 22 bp, Homo sapiens
ctgcctgcttctgagccagagg

SEQ ID NO: 8534575 - DNA, 22 bp, Homo sapiens
ctgcctgcttttctgggagccg

SEQ ID NO: 8534576 - DNA, 22 bp, Homo sapiens
ctgcctgcttttctgggagccg

SEQ ID NO: 8534577 - DNA, 22 bp, Homo sapiens
ctgcctgcttttctgggagccg

SEQ ID NO: 8534578 - DNA, 22 bp, Homo sapiens
ctgcctgcttaccatgcatcag

SEQ ID NO: 8534579 - DNA, 22 bp, Homo sapiens
ctgcctgcttaccatgcatcag

SEQ ID NO: 8534580 - DNA, 22 bp, Homo sapiens
ctgcctgcttaccatgcatcag

SEQ ID NO: 8534581 - DNA, 22 bp, Homo sapiens
ctgcctgctgcctgtggagggt

SEQ ID NO: 8534582 - DNA, 23 bp, Homo sapiens
ctgcctgctggggagacagatct

SEQ ID NO: 8534583 - DNA, 23 bp, Homo sapiens
ctgcctgctggggagacagatct

SEQ ID NO: 8534584 - DNA, 23 bp, Homo sapiens
ctgcctgctggggagacagatct

SEQ ID NO: 8534585 - DNA, 22 bp, Homo sapiens
ataataactcctgttgaagaac

SEQ ID NO: 8534586 - DNA, 22 bp, Homo sapiens
ataataacacctgaataggaaa

SEQ ID NO: 8534587 - DNA, 23 bp, Homo sapiens
ataataacgtctgtcttgtctct

SEQ ID NO: 8534588 - DNA, 22 bp, Homo sapiens
ataataacacctgaataggaaa

SEQ ID NO: 8534589 - DNA, 22 bp, Homo sapiens
ataataacacctgaataggaaa

SEQ ID NO: 8534590 - DNA, 22 bp, Homo sapiens
ataataaaccaggatgggtctg

SEQ ID NO: 8534591 - DNA, 22 bp, Homo sapiens
ataataatgaaagccactgtgt

SEQ ID NO: 8534592 - DNA, 23 bp, Homo sapiens
ataataattatggcagcaaagtg

SEQ ID NO: 8534593 - DNA, 18 bp, Homo sapiens
ctgcctgctctccagctt

SEQ ID NO: 8534594 - DNA, 22 bp, Homo sapiens
ctgccctgtctttttctgatga

SEQ ID NO: 8534595 - DNA, 22 bp, Homo sapiens
ctgccctgtgagggtccttggg

SEQ ID NO: 8534596 - DNA, 22 bp, Homo sapiens
ctgccctgtgagggtccttggg

SEQ ID NO: 8534597 - DNA, 22 bp, Homo sapiens
ctgccctgtggctctgagtcat

SEQ ID NO: 8534598 - DNA, 22 bp, Homo sapiens
ctgccctgtggctctgagtcat

SEQ ID NO: 8534599 - DNA, 22 bp, Homo sapiens
ctgccctgtgcacaggaaactg

SEQ ID NO: 8534600 - DNA, 22 bp, Homo sapiens
ctgccctgtatcttctcccaat

SEQ ID NO: 8534601 - DNA, 22 bp, Homo sapiens
ctgccctgtatcttctcccaat

SEQ ID NO: 8534602 - DNA, 22 bp, Homo sapiens
ctgccctgtatcttctcccaat

SEQ ID NO: 8534603 - DNA, 22 bp, Homo sapiens
ctgccctgtctgcagcctggct

SEQ ID NO: 8534604 - DNA, 22 bp, Homo sapiens
ctgccctgtctgcagcctggct

SEQ ID NO: 8534605 - DNA, 22 bp, Homo sapiens
ctgccctgtctgcagcctggct

SEQ ID NO: 8534606 - DNA, 22 bp, Homo sapiens
ctgccctgtctgcagcctggct

SEQ ID NO: 8534607 - DNA, 22 bp, Homo sapiens
ataagtttgtctttgtaaagat

SEQ ID NO: 8534608 - DNA, 22 bp, Homo sapiens
ataataaaccaggatgggtctg

SEQ ID NO: 8534609 - DNA, 22 bp, Homo sapiens
ataagtttgtctttgtaaagat

SEQ ID NO: 8534610 - DNA, 22 bp, Homo sapiens
ataagtgtgtaaggcattctgt

SEQ ID NO: 8534611 - DNA, 22 bp, Homo sapiens
ataagtgttaggtaaacatctt

SEQ ID NO: 8534612 - DNA, 22 bp, Homo sapiens
ataagttcaggtaaagaaatca

SEQ ID NO: 8534613 - DNA, 22 bp, Homo sapiens
ctgccctgtttggacagcccgg

SEQ ID NO: 8534614 - DNA, 22 bp, Homo sapiens
ataagcatttcacaggtgtgtt

SEQ ID NO: 8534615 - DNA, 22 bp, Homo sapiens
ctgccctgtggttgtgggttct

SEQ ID NO: 8534616 - DNA, 22 bp, Homo sapiens
ataagtgatatttagctataga

SEQ ID NO: 8534617 - DNA, 22 bp, Homo sapiens
ctgtaatcccagctactcggga

SEQ ID NO: 8534618 - DNA, 22 bp, Homo sapiens
ctgtaatcccagctactcggga

SEQ ID NO: 8534619 - DNA, 22 bp, Homo sapiens
atattttgaagttaataatgtg

SEQ ID NO: 8534620 - DNA, 22 bp, Homo sapiens
ctgtatgattccatttctataa

SEQ ID NO: 8534621 - DNA, 22 bp, Homo sapiens
ctgtatgaggatcagactggac

SEQ ID NO: 8534622 - DNA, 22 bp, Homo sapiens
ctgtatatgtgcatacacacac

SEQ ID NO: 8534623 - DNA, 22 bp, Homo sapiens
ctgtatctgtgttggatgagtt

SEQ ID NO: 8534624 - DNA, 22 bp, Homo sapiens
ctgtatctgtcagctggtctcg

SEQ ID NO: 8534625 - DNA, 20 bp, Homo sapiens
ctgtatcaggttacaaagta

SEQ ID NO: 8534626 - DNA, 22 bp, Homo sapiens
atatttgttgagttcttatgat

SEQ ID NO: 8534627 - DNA, 22 bp, Homo sapiens
atatttgttagagtctatgtgt

SEQ ID NO: 8534628 - DNA, 22 bp, Homo sapiens
atatttgttagagtctatgtgt

SEQ ID NO: 8534629 - DNA, 22 bp, Homo sapiens
atatttgttagagtctatgtgt

SEQ ID NO: 8534630 - DNA, 22 bp, Homo sapiens
atattttcacagaacttgcaaa

SEQ ID NO: 8534631 - DNA, 22 bp, Homo sapiens
atattttcacagaacttgcaaa

SEQ ID NO: 8534632 - DNA, 22 bp, Homo sapiens
atattttcacagaacttgcaaa

SEQ ID NO: 8534633 - DNA, 22 bp, Homo sapiens
atatttgtttggcagagttcag

SEQ ID NO: 8534634 - DNA, 22 bp, Homo sapiens
atattttctggaactatgcctg

SEQ ID NO: 8534635 - DNA, 22 bp, Homo sapiens
atattttccgaacttgaggtag

SEQ ID NO: 8534636 - DNA, 22 bp, Homo sapiens
atattttctggaactatgcctg

SEQ ID NO: 8534637 - DNA, 22 bp, Homo sapiens
atattttcactgaaccaaagta

SEQ ID NO: 8534638 - DNA, 22 bp, Homo sapiens
atattttccgaacttgaggtag

SEQ ID NO: 8534639 - DNA, 22 bp, Homo sapiens
atattttcactgaaccaaagta

SEQ ID NO: 8534640 - DNA, 22 bp, Homo sapiens
atattttcactgaaccaaagta

SEQ ID NO: 8534641 - DNA, 22 bp, Homo sapiens
ctgtatttagttaaaatgctaa

SEQ ID NO: 8534642 - DNA, 22 bp, Homo sapiens
ctgtatttagttaaaatgctaa

SEQ ID NO: 8534643 - DNA, 22 bp, Homo sapiens
ctgtatttagttaaaatgctaa

SEQ ID NO: 8534644 - DNA, 22 bp, Homo sapiens
ctgtatttcccacattctctat

SEQ ID NO: 8534645 - DNA, 22 bp, Homo sapiens
ctgtatttcccacattctctat

SEQ ID NO: 8534646 - DNA, 22 bp, Homo sapiens
ctgtatttcttggacagttgct

SEQ ID NO: 8534647 - DNA, 22 bp, Homo sapiens
ctgtcatttaagacattctgga

SEQ ID NO: 8534648 - DNA, 22 bp, Homo sapiens
ctgtcattgtacatgttataca

SEQ ID NO: 8534649 - DNA, 22 bp, Homo sapiens
ctgtcattggcagggagtgtgt

SEQ ID NO: 8534650 - DNA, 22 bp, Homo sapiens
ctgtattcaagcttctgcccaa

SEQ ID NO: 8534651 - DNA, 22 bp, Homo sapiens
ctgtatgtttctatgaatgtga

SEQ ID NO: 8534652 - DNA, 22 bp, Homo sapiens
ctgtattagccaggtgcacaag

SEQ ID NO: 8534653 - DNA, 22 bp, Homo sapiens
ctgtattaaaggcagtgatctt

SEQ ID NO: 8534654 - DNA, 22 bp, Homo sapiens
ctgtatgtttctatgaatgtga

SEQ ID NO: 8534655 - DNA, 22 bp, Homo sapiens
ctgtatgttccgttttgtcact

SEQ ID NO: 8534656 - DNA, 22 bp, Homo sapiens
ctgtatgtcttgtgaattgtag

SEQ ID NO: 8534657 - DNA, 22 bp, Homo sapiens
ctgtatgtgaaaatgtcaagtg

SEQ ID NO: 8534658 - DNA, 22 bp, Homo sapiens
ctgtccagctgaccagagcagc

SEQ ID NO: 8534659 - DNA, 22 bp, Homo sapiens
ctgtccagcttggctcctgggg

SEQ ID NO: 8534660 - DNA, 22 bp, Homo sapiens
ctgtccacctttgataggctct

SEQ ID NO: 8534661 - DNA, 19 bp, Homo sapiens
ctgtccacacactcgcttc

SEQ ID NO: 8534662 - DNA, 22 bp, Homo sapiens
ctgtcatttttttagaacacct

SEQ ID NO: 8534663 - DNA, 22 bp, Homo sapiens
ctgtcatttaagacattctgga

SEQ ID NO: 8534664 - DNA, 22 bp, Homo sapiens
ctgtcatttctttagcaatggg

SEQ ID NO: 8534665 - DNA, 22 bp, Homo sapiens
ctgtcatttgtctgctccctct

SEQ ID NO: 8534666 - DNA, 22 bp, Homo sapiens
ctgtcatttctattatagagga

SEQ ID NO: 8534667 - DNA, 22 bp, Homo sapiens
ctggggaggcagggctgcccct

SEQ ID NO: 8534668 - DNA, 22 bp, Homo sapiens
ctggggaggatgctacgacctg

SEQ ID NO: 8534669 - DNA, 22 bp, Homo sapiens
ctggggaggatgctacgacctg

SEQ ID NO: 8534670 - DNA, 22 bp, Homo sapiens
ctgggctgttctgcccctgggt

SEQ ID NO: 8534671 - DNA, 20 bp, Homo sapiens
ctggggaggaggatgtgttc

SEQ ID NO: 8534672 - DNA, 22 bp, Homo sapiens
ctggggatgggacctggcataa

SEQ ID NO: 8534673 - DNA, 22 bp, Homo sapiens
ctggggatgggacctggcataa

SEQ ID NO: 8534674 - DNA, 22 bp, Homo sapiens
ctggggagtgaaggtaattaca

SEQ ID NO: 8534675 - DNA, 22 bp, Homo sapiens
ctggggagtgaaggtaattaca

SEQ ID NO: 8534676 - DNA, 22 bp, Homo sapiens
ctggggagtgaaggtaattaca

SEQ ID NO: 8534677 - DNA, 22 bp, Homo sapiens
ctggggagtgaaggtaattaca

SEQ ID NO: 8534678 - DNA, 22 bp, Homo sapiens
ctggggaggcagggctgcccct

SEQ ID NO: 8534679 - DNA, 22 bp, Homo sapiens
ctggggaggcagggctgcccct

SEQ ID NO: 8534680 - DNA, 22 bp, Homo sapiens
ctggggagtgaaattcttaaat

SEQ ID NO: 8534681 - DNA, 22 bp, Homo sapiens
ctggggagtgaaattcttaaat

SEQ ID NO: 8534682 - DNA, 22 bp, Homo sapiens
ctggggagtgaaattcttaaat

SEQ ID NO: 8534683 - DNA, 23 bp, Homo sapiens
ctgggctgtcctgaggtcacctc

SEQ ID NO: 8534684 - DNA, 22 bp, Homo sapiens
ctgggctgtcccagggcggcag

SEQ ID NO: 8534685 - DNA, 23 bp, Homo sapiens
ctgggctgtcctgaggtcacctc

SEQ ID NO: 8534686 - DNA, 22 bp, Homo sapiens
ctgggctgtggtgtggcccaaa

SEQ ID NO: 8534687 - DNA, 22 bp, Homo sapiens
ctgggctgtggtgtggcccaaa

SEQ ID NO: 8534688 - DNA, 22 bp, Homo sapiens
ctgggctgtggtgtggcccaaa

SEQ ID NO: 8534689 - DNA, 22 bp, Homo sapiens
ctgggctgtggtgtggcccaaa

SEQ ID NO: 8534690 - DNA, 22 bp, Homo sapiens
ctgggctgtcaatggccctctg

SEQ ID NO: 8534691 - DNA, 22 bp, Homo sapiens
ctgggctgtcaatggccctctg

SEQ ID NO: 8534692 - DNA, 22 bp, Homo sapiens
ctgggctgtcaatggccctctg

SEQ ID NO: 8534693 - DNA, 22 bp, Homo sapiens
ctgggctgtcaatggccctctg

SEQ ID NO: 8534694 - DNA, 22 bp, Homo sapiens
ctgggctgtcccaaccccatcc

SEQ ID NO: 8534695 - DNA, 22 bp, Homo sapiens
ctgggctgtcccaaccccatcc

SEQ ID NO: 8534696 - DNA, 22 bp, Homo sapiens
ctgggctgtcccagggcggcag

SEQ ID NO: 8534697 - DNA, 19 bp, Homo sapiens
ctggtgcttgagtgagtca

SEQ ID NO: 8534698 - DNA, 22 bp, Homo sapiens
ctggtgctggcaacagagtagg

SEQ ID NO: 8534699 - DNA, 22 bp, Homo sapiens
ctggtgctggagcctagtccct

SEQ ID NO: 8534700 - DNA, 22 bp, Homo sapiens
ctggtccttgacgcgtgggagg

SEQ ID NO: 8534701 - DNA, 22 bp, Homo sapiens
ctggtgctttgctcatttgata

SEQ ID NO: 8534702 - DNA, 19 bp, Homo sapiens
ctggtcctgactgaggggt

SEQ ID NO: 8534703 - DNA, 22 bp, Homo sapiens
ctggggcagagcccagcaattt

SEQ ID NO: 8534704 - DNA, 22 bp, Homo sapiens
ctggggcagagcccagcaattt

SEQ ID NO: 8534705 - DNA, 22 bp, Homo sapiens
ctggtgggaggcaaggtggaag

SEQ ID NO: 8534706 - DNA, 22 bp, Homo sapiens
atatttgttagagtctatgtgt

SEQ ID NO: 8534707 - DNA, 22 bp, Homo sapiens
ctggtgggagcagcaggcagct

SEQ ID NO: 8534708 - DNA, 22 bp, Homo sapiens
ctggtgggagcagcaggcagct

SEQ ID NO: 8534709 - DNA, 22 bp, Homo sapiens
ctggtgggagcagcaggcagct

SEQ ID NO: 8534710 - DNA, 22 bp, Homo sapiens
ctgggcctgggaggccaggtct

SEQ ID NO: 8534711 - DNA, 22 bp, Homo sapiens
ctgggcctggggctgttgagag

SEQ ID NO: 8534712 - DNA, 22 bp, Homo sapiens
ctgggcctgggaggccaggtct

SEQ ID NO: 8534713 - DNA, 22 bp, Homo sapiens
ctgggctggcgcatccgacacg

SEQ ID NO: 8534714 - DNA, 22 bp, Homo sapiens
ctgggctgcagcgggagcgacg

SEQ ID NO: 8534715 - DNA, 22 bp, Homo sapiens
ctgggctgatttagtcacgttt

SEQ ID NO: 8534716 - DNA, 22 bp, Homo sapiens
ctgggctgtaatgtggcactga

SEQ ID NO: 8534717 - DNA, 22 bp, Homo sapiens
ctgggctgtaatgtggcactga

SEQ ID NO: 8534718 - DNA, 22 bp, Homo sapiens
ctgggctgtaatgtggcactga

SEQ ID NO: 8534719 - DNA, 22 bp, Homo sapiens
ctgggctgtaatgtggcactga

SEQ ID NO: 8534720 - DNA, 20 bp, Homo sapiens
ctgggctgggctacagggtc

SEQ ID NO: 8534721 - DNA, 20 bp, Homo sapiens
ctgggctgggctacagggtc

SEQ ID NO: 8534722 - DNA, 22 bp, Homo sapiens
ctgggctgggtttaccctcttc

SEQ ID NO: 8534723 - DNA, 22 bp, Homo sapiens
ctgggcctggagcccacgagcc

SEQ ID NO: 8534724 - DNA, 22 bp, Homo sapiens
ctgggcctggcgttccaggctg

SEQ ID NO: 8534725 - DNA, 22 bp, Homo sapiens
ctgggcctgggaggccaggtct

SEQ ID NO: 8534726 - DNA, 22 bp, Homo sapiens
ctgggcctgggaggccaggtct

SEQ ID NO: 8534727 - DNA, 22 bp, Homo sapiens
ctgggcctggacgggcagatct

SEQ ID NO: 8534728 - DNA, 22 bp, Homo sapiens
ctgggccatcagaggggctgga

SEQ ID NO: 8534729 - DNA, 22 bp, Homo sapiens
ctgggccatcagaggggctgga

SEQ ID NO: 8534730 - DNA, 22 bp, Homo sapiens
ctgggccagtctcggccgctct

SEQ ID NO: 8534731 - DNA, 22 bp, Homo sapiens
ctgggccagtctcggccgctct

SEQ ID NO: 8534732 - DNA, 22 bp, Homo sapiens
ctgggccatcagaggggctgga

SEQ ID NO: 8534733 - DNA, 22 bp, Homo sapiens
ctgggccatcagaggggctgga

SEQ ID NO: 8534734 - DNA, 22 bp, Homo sapiens
atatcattctgatgtatatctt

SEQ ID NO: 8534735 - DNA, 22 bp, Homo sapiens
ctgggcagtttacattcctacc

SEQ ID NO: 8534736 - DNA, 22 bp, Homo sapiens
ctgggccagggaggtgtctgta

SEQ ID NO: 8534737 - DNA, 22 bp, Homo sapiens
ctgggccagggaggtgtctgta

SEQ ID NO: 8534738 - DNA, 22 bp, Homo sapiens
ctgggccagggaggtgtctgta

SEQ ID NO: 8534739 - DNA, 22 bp, Homo sapiens
ctgggccagtctcggccgctct

SEQ ID NO: 8534740 - DNA, 22 bp, Homo sapiens
ctgggccagtctcggccgctct

SEQ ID NO: 8534741 - DNA, 22 bp, Homo sapiens
ctgggccagtctcggccgctct

SEQ ID NO: 8534742 - DNA, 22 bp, Homo sapiens
ctgggcctctcagctcccgcgg

SEQ ID NO: 8534743 - DNA, 22 bp, Homo sapiens
ctgggccatgggccagcgaggc

SEQ ID NO: 8534744 - DNA, 22 bp, Homo sapiens
ctgggccatgggccagcgaggc

SEQ ID NO: 8534745 - DNA, 22 bp, Homo sapiens
ctgggccatggaagtctctgcc

SEQ ID NO: 8534746 - DNA, 22 bp, Homo sapiens
ctgggccatgggccagcgaggc

SEQ ID NO: 8534747 - DNA, 22 bp, Homo sapiens
ctgggccatggaagtctctgcc

SEQ ID NO: 8534748 - DNA, 22 bp, Homo sapiens
ctgggccatctctctgcaagtg

SEQ ID NO: 8534749 - DNA, 22 bp, Homo sapiens
ctgggccatctctctgcaagtg

SEQ ID NO: 8534750 - DNA, 22 bp, Homo sapiens
atatcaaagctagtggaaattt

SEQ ID NO: 8534751 - DNA, 22 bp, Homo sapiens
atatcaaagctagtggaaattt

SEQ ID NO: 8534752 - DNA, 22 bp, Homo sapiens
atatcaaagctagtggaaattt

SEQ ID NO: 8534753 - DNA, 22 bp, Homo sapiens
atatcaaagctagtggaaattt

SEQ ID NO: 8534754 - DNA, 23 bp, Homo sapiens
atatcacacccagtacagtctcc

SEQ ID NO: 8534755 - DNA, 22 bp, Homo sapiens
atatcacaaacaagtctgtact

SEQ ID NO: 8534756 - DNA, 23 bp, Homo sapiens
atatcacacccagtacagtctcc

SEQ ID NO: 8534757 - DNA, 22 bp, Homo sapiens
atatcaaacgaagttattttaa

SEQ ID NO: 8534758 - DNA, 22 bp, Homo sapiens
atatcaaacgaagttattttaa

SEQ ID NO: 8534759 - DNA, 22 bp, Homo sapiens
atatcacaggtgtttacctgat

SEQ ID NO: 8534760 - DNA, 22 bp, Homo sapiens
atatcacaggaaaggaagatac

SEQ ID NO: 8534761 - DNA, 22 bp, Homo sapiens
atatcacaggtgtttacctgat

SEQ ID NO: 8534762 - DNA, 22 bp, Homo sapiens
atatcacagtagttgtttagtt

SEQ ID NO: 8534763 - DNA, 22 bp, Homo sapiens
atatcacagtagttgtttagtt

SEQ ID NO: 8534764 - DNA, 22 bp, Homo sapiens
atatcacagctctttcattgct

SEQ ID NO: 8534765 - DNA, 22 bp, Homo sapiens
atatcacaggaaaggaagatac

SEQ ID NO: 8534766 - DNA, 22 bp, Homo sapiens
atatcacagatgcagaaagaga

SEQ ID NO: 8534767 - DNA, 22 bp, Homo sapiens
atatcacagatgcagaaagaga

SEQ ID NO: 8534768 - DNA, 22 bp, Homo sapiens
atatcattatgttatgagcaca

SEQ ID NO: 8534769 - DNA, 22 bp, Homo sapiens
atatcattatgttatgagcaca

SEQ ID NO: 8534770 - DNA, 22 bp, Homo sapiens
atatcattatgttatgagcaca

SEQ ID NO: 8534771 - DNA, 22 bp, Homo sapiens
atatcattatgttatgagcaca

SEQ ID NO: 8534772 - DNA, 22 bp, Homo sapiens
atatcataaatcggtgcatgaa

SEQ ID NO: 8534773 - DNA, 18 bp, Homo sapiens
atatcagctacttcatgg

SEQ ID NO: 8534774 - DNA, 22 bp, Homo sapiens
atatcagaaatagtaagcagag

SEQ ID NO: 8534775 - DNA, 22 bp, Homo sapiens
atatattttttgagacagagtc

SEQ ID NO: 8534776 - DNA, 22 bp, Homo sapiens
atatattttttgagacagagtc

SEQ ID NO: 8534777 - DNA, 22 bp, Homo sapiens
atatattttgcggtcacgtggc

SEQ ID NO: 8534778 - DNA, 22 bp, Homo sapiens
atatattttgcggtcacgtggc

SEQ ID NO: 8534779 - DNA, 22 bp, Homo sapiens
atatattacaaaagaggaagga

SEQ ID NO: 8534780 - DNA, 22 bp, Homo sapiens
atagtcttcagcactttgatca

SEQ ID NO: 8534781 - DNA, 22 bp, Homo sapiens
atagtctttactgctgaattga

SEQ ID NO: 8534782 - DNA, 19 bp, Homo sapiens
atagtctttccaattatac

SEQ ID NO: 8534783 - DNA, 22 bp, Homo sapiens
atagtgaaaatgctgtcagcat

SEQ ID NO: 8534784 - DNA, 22 bp, Homo sapiens
atagtcttagatcagataaagt

SEQ ID NO: 8534785 - DNA, 22 bp, Homo sapiens
atagtcttagatcagataaagt

SEQ ID NO: 8534786 - DNA, 22 bp, Homo sapiens
atagtcttagatcagataaagt

SEQ ID NO: 8534787 - DNA, 22 bp, Homo sapiens
atagtcttcagcactttgatca

SEQ ID NO: 8534788 - DNA, 22 bp, Homo sapiens
atagtcttagtctatagttttg

SEQ ID NO: 8534789 - DNA, 22 bp, Homo sapiens
atagtcttcagcactttgatca

SEQ ID NO: 8534790 - DNA, 22 bp, Homo sapiens
atagtcttagaatcttgagtgt

SEQ ID NO: 8534791 - DNA, 23 bp, Homo sapiens
atagtctgcgcaactgagagagg

SEQ ID NO: 8534792 - DNA, 22 bp, Homo sapiens
atagtatttccagaaatagtct

SEQ ID NO: 8534793 - DNA, 22 bp, Homo sapiens
atagtacatgggtgtcctcaca

SEQ ID NO: 8534794 - DNA, 22 bp, Homo sapiens
atagtatgaattaaatcatgag

SEQ ID NO: 8534795 - DNA, 22 bp, Homo sapiens
atagtatgagctcatacacttg

SEQ ID NO: 8534796 - DNA, 22 bp, Homo sapiens
ctgttatttagaacatggaatc

SEQ ID NO: 8534797 - DNA, 22 bp, Homo sapiens
ctgttatttatgctgctccatt

SEQ ID NO: 8534798 - DNA, 22 bp, Homo sapiens
ctgttatttagaacatggaatc

SEQ ID NO: 8534799 - DNA, 22 bp, Homo sapiens
ctgttatttctgccaggtgagt

SEQ ID NO: 8534800 - DNA, 22 bp, Homo sapiens
ctgttatttctgaatgccatcc

SEQ ID NO: 8534801 - DNA, 22 bp, Homo sapiens
ctgttatttctgaatgccatcc

SEQ ID NO: 8534802 - DNA, 23 bp, Homo sapiens
ctgttattccaggctgatgggtg

SEQ ID NO: 8534803 - DNA, 22 bp, Homo sapiens
ctgttattcaagacaaaggcag

SEQ ID NO: 8534804 - DNA, 22 bp, Homo sapiens
ctgttattccccttgctgtggt

SEQ ID NO: 8534805 - DNA, 19 bp, Homo sapiens
ctgttattgtcagagctcc

SEQ ID NO: 8534806 - DNA, 22 bp, Homo sapiens
ctgttatttagaacatggaatc

SEQ ID NO: 8534807 - DNA, 23 bp, Homo sapiens
ctgttatattctagggagctgca

SEQ ID NO: 8534808 - DNA, 22 bp, Homo sapiens
ctgttattaaaaagctcaggct

SEQ ID NO: 8534809 - DNA, 22 bp, Homo sapiens
ctgttactgctggagccattga

SEQ ID NO: 8534810 - DNA, 22 bp, Homo sapiens
ctgttactgtatttaatcatct

SEQ ID NO: 8534811 - DNA, 22 bp, Homo sapiens
ctgttatttgagagtgttgaat

SEQ ID NO: 8534812 - DNA, 22 bp, Homo sapiens
ctgttatttgctggaagagttt

SEQ ID NO: 8534813 - DNA, 22 bp, Homo sapiens
ctgttatttggaggatgcttgg

SEQ ID NO: 8534814 - DNA, 22 bp, Homo sapiens
ctgttattttataattcaagaa

SEQ ID NO: 8534815 - DNA, 22 bp, Homo sapiens
ctgtttatctctaacctgttta

SEQ ID NO: 8534816 - DNA, 22 bp, Homo sapiens
ctgttattttataattcaagaa

SEQ ID NO: 8534817 - DNA, 22 bp, Homo sapiens
ctgttattttataattcaagaa

SEQ ID NO: 8534818 - DNA, 22 bp, Homo sapiens
ctgtttatccctttggtcagca

SEQ ID NO: 8534819 - DNA, 22 bp, Homo sapiens
ctgtttatctaggagttgcagg

SEQ ID NO: 8534820 - DNA, 22 bp, Homo sapiens
ctgtttatctaggagttgcagg

SEQ ID NO: 8534821 - DNA, 22 bp, Homo sapiens
ctgtttattacactggatagca

SEQ ID NO: 8534822 - DNA, 22 bp, Homo sapiens
ctgtgtcccagtaccttgggta

SEQ ID NO: 8534823 - DNA, 22 bp, Homo sapiens
ctgtgtcccagtaccttgggta

SEQ ID NO: 8534824 - DNA, 22 bp, Homo sapiens
ctgtgtcccttgtcccagagcc

SEQ ID NO: 8534825 - DNA, 22 bp, Homo sapiens
ctgtgtccccctcagccaggtg

SEQ ID NO: 8534826 - DNA, 22 bp, Homo sapiens
atcattagaccaaactagagct

SEQ ID NO: 8534827 - DNA, 23 bp, Homo sapiens
atcattaacagtgcaggggtagg

SEQ ID NO: 8534828 - DNA, 21 bp, Homo sapiens
atcattaattgctgagtgaca

SEQ ID NO: 8534829 - DNA, 22 bp, Homo sapiens
atcattaaatataagcttcaca

SEQ ID NO: 8534830 - DNA, 22 bp, Homo sapiens
atcattaaatataagcttcaca

SEQ ID NO: 8534831 - DNA, 22 bp, Homo sapiens
atcattaaatataagcttcaca

SEQ ID NO: 8534832 - DNA, 22 bp, Homo sapiens
ctgttactaatcttttctgcta

SEQ ID NO: 8534833 - DNA, 22 bp, Homo sapiens
ctgtgtgtcctcggacgagttt

SEQ ID NO: 8534834 - DNA, 22 bp, Homo sapiens
ctgtgtgtgaacacagcccagc

SEQ ID NO: 8534835 - DNA, 22 bp, Homo sapiens
atcattctagctgttgtgttga

SEQ ID NO: 8534836 - DNA, 22 bp, Homo sapiens
ctgtgtgtcctcggacgagttt

SEQ ID NO: 8534837 - DNA, 22 bp, Homo sapiens
atcattccacatgtaccactag

SEQ ID NO: 8534838 - DNA, 22 bp, Homo sapiens
atcattcagtgaccacttccca

SEQ ID NO: 8534839 - DNA, 22 bp, Homo sapiens
atcattcagtctctgggacagt

SEQ ID NO: 8534840 - DNA, 22 bp, Homo sapiens
atcattcagtgaccacttccca

SEQ ID NO: 8534841 - DNA, 22 bp, Homo sapiens
atcattcaagtgctctaaaatg

SEQ ID NO: 8534842 - DNA, 22 bp, Homo sapiens
atcattagcaattttcaataag

SEQ ID NO: 8534843 - DNA, 22 bp, Homo sapiens
atcattcagtctctgggacagt

SEQ ID NO: 8534844 - DNA, 22 bp, Homo sapiens
atcattcagcctaagcaagtac

SEQ ID NO: 8534845 - DNA, 22 bp, Homo sapiens
atcattcagcctaagcaagtac

SEQ ID NO: 8534846 - DNA, 22 bp, Homo sapiens
atcattcagcctaagcaagtac

SEQ ID NO: 8534847 - DNA, 22 bp, Homo sapiens
atcaggctagtgtgtgtgttca

SEQ ID NO: 8534848 - DNA, 22 bp, Homo sapiens
atcaggatgctgtcagttacca

SEQ ID NO: 8534849 - DNA, 22 bp, Homo sapiens
ctgtgtatctctgtgggacaga

SEQ ID NO: 8534850 - DNA, 22 bp, Homo sapiens
ctgtgtatgactccagagggta

SEQ ID NO: 8534851 - DNA, 19 bp, Homo sapiens
ctgtgtcacatttatgaaa

SEQ ID NO: 8534852 - DNA, 22 bp, Homo sapiens
ctgtgtattgaaaaagggttaa

SEQ ID NO: 8534853 - DNA, 22 bp, Homo sapiens
ctgtgtccaatggccttagcag

SEQ ID NO: 8534854 - DNA, 22 bp, Homo sapiens
atcaggaaatacttatttataa

SEQ ID NO: 8534855 - DNA, 19 bp, Homo sapiens
atcaggaacaaggctgatc

SEQ ID NO: 8534856 - DNA, 20 bp, Homo sapiens
atcaggaagagagactgacc

SEQ ID NO: 8534857 - DNA, 22 bp, Homo sapiens
atcaggaagaattggatgctac

SEQ ID NO: 8534858 - DNA, 22 bp, Homo sapiens
atcaggaagaagaatgtgttgg

SEQ ID NO: 8534859 - DNA, 22 bp, Homo sapiens
atcaggaagccagtctaatgga

SEQ ID NO: 8534860 - DNA, 22 bp, Homo sapiens
atcaggaatgaatacttttgga

SEQ ID NO: 8534861 - DNA, 22 bp, Homo sapiens
atcaggaatgaatacttttgga

SEQ ID NO: 8534862 - DNA, 22 bp, Homo sapiens
atcaggatagtctgtaaattgt

SEQ ID NO: 8534863 - DNA, 22 bp, Homo sapiens
atcaggaattaggtgagatgga

SEQ ID NO: 8534864 - DNA, 20 bp, Homo sapiens
ctgtgcctcctgctagtcct

SEQ ID NO: 8534865 - DNA, 22 bp, Homo sapiens
ctgtgcctgcaggccacatcaa

SEQ ID NO: 8534866 - DNA, 22 bp, Homo sapiens
ctgtgcctccagtctcgcttct

SEQ ID NO: 8534867 - DNA, 22 bp, Homo sapiens
ctgtgcctccagtctcgcttct

SEQ ID NO: 8534868 - DNA, 22 bp, Homo sapiens
ctgtgccttagtattctcattt

SEQ ID NO: 8534869 - DNA, 22 bp, Homo sapiens
ctgtgcctggggggcagagctg

SEQ ID NO: 8534870 - DNA, 22 bp, Homo sapiens
ctgtgctccctctggcgccccg

SEQ ID NO: 8534871 - DNA, 22 bp, Homo sapiens
ctgtgcctttgtagctgtgcct

SEQ ID NO: 8534872 - DNA, 22 bp, Homo sapiens
ctgtgcctttgtagctgtgcct

SEQ ID NO: 8534873 - DNA, 22 bp, Homo sapiens
ctgtgcgtaagtagccaaaata

SEQ ID NO: 8534874 - DNA, 22 bp, Homo sapiens
ctgtgcgttgtgaaatgtttag

SEQ ID NO: 8534875 - DNA, 22 bp, Homo sapiens
ctgtgcctttgtagctgtgcct

SEQ ID NO: 8534876 - DNA, 22 bp, Homo sapiens
ctgtgccttggcgctgtgccac

SEQ ID NO: 8534877 - DNA, 22 bp, Homo sapiens
ctgtgccttggcgctgtgccac

SEQ ID NO: 8534878 - DNA, 22 bp, Homo sapiens
ctgtgccttctacttcactcta

SEQ ID NO: 8534879 - DNA, 22 bp, Homo sapiens
ctgtgccttctacttcactcta

SEQ ID NO: 8534880 - DNA, 22 bp, Homo sapiens
ctgtgccttctgcctggaacat

SEQ ID NO: 8534881 - DNA, 22 bp, Homo sapiens
ctgtgccctttcgctgcactgt

SEQ ID NO: 8534882 - DNA, 22 bp, Homo sapiens
ctgtgccctttgtcctcgtctc

SEQ ID NO: 8534883 - DNA, 22 bp, Homo sapiens
ctgtgcctaagatgcatgtctc

SEQ ID NO: 8534884 - DNA, 22 bp, Homo sapiens
ctgtgcctaagatgcatgtctc

SEQ ID NO: 8534885 - DNA, 22 bp, Homo sapiens
ctgtgcctaagatgcatgtctc

SEQ ID NO: 8534886 - DNA, 22 bp, Homo sapiens
ctgtgcctcagtgtcctcgagt

SEQ ID NO: 8534887 - DNA, 19 bp, Homo sapiens
ctgtgcaggccgggctgag

SEQ ID NO: 8534888 - DNA, 23 bp, Homo sapiens
ctgtccaggattcttgagagaac

SEQ ID NO: 8534889 - DNA, 22 bp, Homo sapiens
atctggaagccagatactcagt

SEQ ID NO: 8534890 - DNA, 22 bp, Homo sapiens
atctggaagccagatactcagt

SEQ ID NO: 8534891 - DNA, 17 bp, Homo sapiens
atctggaagctagctga

SEQ ID NO: 8534892 - DNA, 22 bp, Homo sapiens
atctggaagccagatactcagt

SEQ ID NO: 8534893 - DNA, 21 bp, Homo sapiens
atctggaagaactggtaagtg

SEQ ID NO: 8534894 - DNA, 22 bp, Homo sapiens
atctggaacaaagcttaggaat

SEQ ID NO: 8534895 - DNA, 22 bp, Homo sapiens
cttcatgttctgcctgtggaag

SEQ ID NO: 8534896 - DNA, 22 bp, Homo sapiens
atctgcatgtatctctctgcat

SEQ ID NO: 8534897 - DNA, 22 bp, Homo sapiens
cttcattaaccaaaatgcaata

SEQ ID NO: 8534898 - DNA, 22 bp, Homo sapiens
atctgcatgtccccatggatcc

SEQ ID NO: 8534899 - DNA, 22 bp, Homo sapiens
atctgcatgtccccatggatcc

SEQ ID NO: 8534900 - DNA, 17 bp, Homo sapiens
atctgcatttctaatga

SEQ ID NO: 8534901 - DNA, 22 bp, Homo sapiens
atctgcatttacattgcttgta

SEQ ID NO: 8534902 - DNA, 21 bp, Homo sapiens
atctggaaattctgccagaga

SEQ ID NO: 8534903 - DNA, 22 bp, Homo sapiens
cttcataaactcagaaggcagc

SEQ ID NO: 8534904 - DNA, 22 bp, Homo sapiens
cttcatcaactctaacaaatgt

SEQ ID NO: 8534905 - DNA, 21 bp, Homo sapiens
cttcatcccggagattctggt

SEQ ID NO: 8534906 - DNA, 22 bp, Homo sapiens
cttcatgacccataaaaattta

SEQ ID NO: 8534907 - DNA, 23 bp, Homo sapiens
cttcatgagagccctgaggaaaa

SEQ ID NO: 8534908 - DNA, 22 bp, Homo sapiens
cttcatgagactccactgccat

SEQ ID NO: 8534909 - DNA, 22 bp, Homo sapiens
cttcatgatgaccaactgccat

SEQ ID NO: 8534910 - DNA, 22 bp, Homo sapiens
cttcatgaggccggctttatcc

SEQ ID NO: 8534911 - DNA, 22 bp, Homo sapiens
cttcatgaggccggctttatcc

SEQ ID NO: 8534912 - DNA, 22 bp, Homo sapiens
cttcatgagtgtacaacctgtg

SEQ ID NO: 8534913 - DNA, 22 bp, Homo sapiens
atctccaggattttcacactca

SEQ ID NO: 8534914 - DNA, 22 bp, Homo sapiens
atctcattctcccgtgccatgg

SEQ ID NO: 8534915 - DNA, 22 bp, Homo sapiens
atctcattttggtttctactta

SEQ ID NO: 8534916 - DNA, 22 bp, Homo sapiens
atctcattttggtttctactta

SEQ ID NO: 8534917 - DNA, 22 bp, Homo sapiens
atctcataaacacacatatatg

SEQ ID NO: 8534918 - DNA, 22 bp, Homo sapiens
atctccaggattttcacactca

SEQ ID NO: 8534919 - DNA, 22 bp, Homo sapiens
atctccagttagcagtactgat

SEQ ID NO: 8534920 - DNA, 22 bp, Homo sapiens
atctcccagccacagcattctt

SEQ ID NO: 8534921 - DNA, 22 bp, Homo sapiens
atctcccagccacagcattctt

SEQ ID NO: 8534922 - DNA, 22 bp, Homo sapiens
atctcccaaattagcctcttga

SEQ ID NO: 8534923 - DNA, 22 bp, Homo sapiens
atctcccacaggctgctacttc

SEQ ID NO: 8534924 - DNA, 22 bp, Homo sapiens
cttcagttatgtgccaaggaca

SEQ ID NO: 8534925 - DNA, 22 bp, Homo sapiens
cttcagttagtttcatgtgagc

SEQ ID NO: 8534926 - DNA, 22 bp, Homo sapiens
ctgtttccaccttcatggctaa

SEQ ID NO: 8534927 - DNA, 22 bp, Homo sapiens
ctgtttccctccagggggtgga

SEQ ID NO: 8534928 - DNA, 22 bp, Homo sapiens
ctgtttccccatgccctgactc

SEQ ID NO: 8534929 - DNA, 22 bp, Homo sapiens
ctgtttcctaccgtttttcatt

SEQ ID NO: 8534930 - DNA, 22 bp, Homo sapiens
ctgtttcctgtcttctcactat

SEQ ID NO: 8534931 - DNA, 22 bp, Homo sapiens
cttcacacccactaaaatgatg

SEQ ID NO: 8534932 - DNA, 22 bp, Homo sapiens
cttcacaatcaccttttcggaa

SEQ ID NO: 8534933 - DNA, 22 bp, Homo sapiens
ctgtttccatacaggtttttgg

SEQ ID NO: 8534934 - DNA, 22 bp, Homo sapiens
ctgtttcaagtgaagtcagaca

SEQ ID NO: 8534935 - DNA, 21 bp, Homo sapiens
cttcagcaaatacttggcagg

SEQ ID NO: 8534936 - DNA, 22 bp, Homo sapiens
cttcagaggggactcaaagtca

SEQ ID NO: 8534937 - DNA, 22 bp, Homo sapiens
cttcagaggggactcaaagtca

SEQ ID NO: 8534938 - DNA, 22 bp, Homo sapiens
cttcagagaacttgatcgctgc

SEQ ID NO: 8534939 - DNA, 22 bp, Homo sapiens
cttcagaattcctcagcctcag

SEQ ID NO: 8534940 - DNA, 22 bp, Homo sapiens
cttcagaatgggactgtgtttg

SEQ ID NO: 8534941 - DNA, 22 bp, Homo sapiens
cttcagaagcctgcagcctttg

SEQ ID NO: 8534942 - DNA, 22 bp, Homo sapiens
cttcacagaataaactcattat

SEQ ID NO: 8534943 - DNA, 22 bp, Homo sapiens
cttcagcaactttggaatgttt

SEQ ID NO: 8534944 - DNA, 22 bp, Homo sapiens
cttcagcacctcagctggagag

SEQ ID NO: 8534945 - DNA, 22 bp, Homo sapiens
cttcagcagcctcttgcataaa

SEQ ID NO: 8534946 - DNA, 22 bp, Homo sapiens
atccttaatttacttgcatctt

SEQ ID NO: 8534947 - DNA, 22 bp, Homo sapiens
cttcagcatctttttcttgggg

SEQ ID NO: 8534948 - DNA, 22 bp, Homo sapiens
atccttcaaaaggaatagcagg

SEQ ID NO: 8534949 - DNA, 22 bp, Homo sapiens
atccttcagctgccctgttacc

SEQ ID NO: 8534950 - DNA, 22 bp, Homo sapiens
atccttcaattagaaccaattg

SEQ ID NO: 8534951 - DNA, 22 bp, Homo sapiens
atccttcaaggggctgacagct

SEQ ID NO: 8534952 - DNA, 22 bp, Homo sapiens
atccttcaattagaaccaattg

SEQ ID NO: 8534953 - DNA, 22 bp, Homo sapiens
atccttggatcctgtgttcctg

SEQ ID NO: 8534954 - DNA, 22 bp, Homo sapiens
atccttgagccttatcttttgt

SEQ ID NO: 8534955 - DNA, 22 bp, Homo sapiens
atccttgaatgactctgccctc

SEQ ID NO: 8534956 - DNA, 22 bp, Homo sapiens
atccttggcacagtggaattca

SEQ ID NO: 8534957 - DNA, 22 bp, Homo sapiens
atccttggatgtgtctttttgt

SEQ ID NO: 8534958 - DNA, 22 bp, Homo sapiens
atccttggcagctcagacctac

SEQ ID NO: 8534959 - DNA, 22 bp, Homo sapiens
atccttggtaagagagttggat

SEQ ID NO: 8534960 - DNA, 22 bp, Homo sapiens
atctattatgctgagaaactgt

SEQ ID NO: 8534961 - DNA, 22 bp, Homo sapiens
atctatttctgctaataacaat

SEQ ID NO: 8534962 - DNA, 22 bp, Homo sapiens
atctattctctacagtagacag

SEQ ID NO: 8534963 - DNA, 18 bp, Homo sapiens
atccttggggctgctgct

SEQ ID NO: 8534964 - DNA, 22 bp, Homo sapiens
atccttccagagttattctcaa

SEQ ID NO: 8534965 - DNA, 22 bp, Homo sapiens
atccttccagagttattctcaa

SEQ ID NO: 8534966 - DNA, 22 bp, Homo sapiens
atccttcaggaaaccatcctca

SEQ ID NO: 8534967 - DNA, 22 bp, Homo sapiens
atccttcagtggaagacagtag

SEQ ID NO: 8534968 - DNA, 22 bp, Homo sapiens
atccttcagtggaagacagtag

SEQ ID NO: 8534969 - DNA, 22 bp, Homo sapiens
atccttccttcatttgacaggt

SEQ ID NO: 8534970 - DNA, 22 bp, Homo sapiens
atccttcttctgctagtgtcta

SEQ ID NO: 8534971 - DNA, 22 bp, Homo sapiens
ctcaggagttggaggctacagt

SEQ ID NO: 8534972 - DNA, 23 bp, Homo sapiens
agtcttactgtcccagaacaggg

SEQ ID NO: 8534973 - DNA, 22 bp, Homo sapiens
agtcttaatagagaaaaactgt

SEQ ID NO: 8534974 - DNA, 22 bp, Homo sapiens
agtcttacatgagaaagaacct

SEQ ID NO: 8534975 - DNA, 22 bp, Homo sapiens
agtctgtggggtccctggggca

SEQ ID NO: 8534976 - DNA, 22 bp, Homo sapiens
agtctgtgtatattcactgccc

SEQ ID NO: 8534977 - DNA, 22 bp, Homo sapiens
agtctgtgtactgggtttctgt

SEQ ID NO: 8534978 - DNA, 19 bp, Homo sapiens
agtctgtggatttgtgggt

SEQ ID NO: 8534979 - DNA, 22 bp, Homo sapiens
agtctgtggggtccctggggca

SEQ ID NO: 8534980 - DNA, 22 bp, Homo sapiens
agtctgtgtacctttggccttc

SEQ ID NO: 8534981 - DNA, 22 bp, Homo sapiens
agtctgtgtgaatgtgggcttt

SEQ ID NO: 8534982 - DNA, 22 bp, Homo sapiens
agtcttaactatgcaagtacta

SEQ ID NO: 8534983 - DNA, 21 bp, Homo sapiens
agtctgttaggatgactctga

SEQ ID NO: 8534984 - DNA, 18 bp, Homo sapiens
ctcaggcagagaagcttt

SEQ ID NO: 8534985 - DNA, 22 bp, Homo sapiens
ctcaggcaaggcccgcattctc

SEQ ID NO: 8534986 - DNA, 22 bp, Homo sapiens
agtctgtgaaaagataggaagt

SEQ ID NO: 8534987 - DNA, 22 bp, Homo sapiens
agtctgtctctgctaatcacta

SEQ ID NO: 8534988 - DNA, 22 bp, Homo sapiens
agtctgtctgtcacttctgcag

SEQ ID NO: 8534989 - DNA, 22 bp, Homo sapiens
agtctgtctacttaaagtctgt

SEQ ID NO: 8534990 - DNA, 22 bp, Homo sapiens
agtctgtgagtgatgtacctgc

SEQ ID NO: 8534991 - DNA, 23 bp, Homo sapiens
agtctgtgctgaagaagttacaa

SEQ ID NO: 8534992 - DNA, 22 bp, Homo sapiens
agtctgtgaacttggcagggaa

SEQ ID NO: 8534993 - DNA, 22 bp, Homo sapiens
agtctgtgactcattggatctc

SEQ ID NO: 8534994 - DNA, 22 bp, Homo sapiens
agtctgtggatggactggcaga

SEQ ID NO: 8534995 - DNA, 22 bp, Homo sapiens
agtctgtgctgttggtgaggat

SEQ ID NO: 8534996 - DNA, 23 bp, Homo sapiens
agtctgtgcttggtgggagggcc

SEQ ID NO: 8534997 - DNA, 22 bp, Homo sapiens
agtctggacctgctgggtctcc

SEQ ID NO: 8534998 - DNA, 22 bp, Homo sapiens
agtctggagtgattatgtggga

SEQ ID NO: 8534999 - DNA, 22 bp, Homo sapiens
agtctggagtagagcctagaaa

SEQ ID NO: 8535000 - DNA, 22 bp, Homo sapiens
agtctggaaaatgcatgtttca

SEQ ID NO: 8535001 - DNA, 22 bp, Homo sapiens
agtctcttggcattctgaaaca

SEQ ID NO: 8535002 - DNA, 21 bp, Homo sapiens
agtctctctaataaatgcttg

SEQ ID NO: 8535003 - DNA, 22 bp, Homo sapiens
agtctctccacattgttataaa

SEQ ID NO: 8535004 - DNA, 22 bp, Homo sapiens
agtccaaggccatacagttgtg

SEQ ID NO: 8535005 - DNA, 22 bp, Homo sapiens
agtctgaaccagatggcaaggt

SEQ ID NO: 8535006 - DNA, 22 bp, Homo sapiens
agtctgaagactcatgtctgaa

SEQ ID NO: 8535007 - DNA, 22 bp, Homo sapiens
agtctgaaagtatgttgtaatg

SEQ ID NO: 8535008 - DNA, 22 bp, Homo sapiens
agtctgaaataatgtcactaag

SEQ ID NO: 8535009 - DNA, 22 bp, Homo sapiens
agtctctttaatcacagtgtct

SEQ ID NO: 8535010 - DNA, 22 bp, Homo sapiens
agtctctttgtggactctgcct

SEQ ID NO: 8535011 - DNA, 21 bp, Homo sapiens
agtctgaggtggggcctagga

SEQ ID NO: 8535012 - DNA, 23 bp, Homo sapiens
agtctgaattgagatgtgctgtg

SEQ ID NO: 8535013 - DNA, 22 bp, Homo sapiens
agtctgaagactcatgtctgaa

SEQ ID NO: 8535014 - DNA, 22 bp, Homo sapiens
agtctgaagatattcttgcagg

SEQ ID NO: 8535015 - DNA, 22 bp, Homo sapiens
agtctgaagatattcttgcagg

SEQ ID NO: 8535016 - DNA, 22 bp, Homo sapiens
agtctgaaggatggaaggtacc

SEQ ID NO: 8535017 - DNA, 22 bp, Homo sapiens
agtctgaaggcaatctgctgac

SEQ ID NO: 8535018 - DNA, 22 bp, Homo sapiens
agtctgaagtagtctttagtgt

SEQ ID NO: 8535019 - DNA, 22 bp, Homo sapiens
agtctgaaggcaatctgctgac

SEQ ID NO: 8535020 - DNA, 22 bp, Homo sapiens
agtctgagttagtggaaatgta

SEQ ID NO: 8535021 - DNA, 22 bp, Homo sapiens
agtctgcactcaggtggaggtc

SEQ ID NO: 8535022 - DNA, 22 bp, Homo sapiens
agtctgagtatctctgagccag

SEQ ID NO: 8535023 - DNA, 22 bp, Homo sapiens
agtctgcaggctgtgatttttt

SEQ ID NO: 8535024 - DNA, 22 bp, Homo sapiens
agtctgcattcacagcaattat

SEQ ID NO: 8535025 - DNA, 20 bp, Homo sapiens
agtcattgggtgtccttcgg

SEQ ID NO: 8535026 - DNA, 22 bp, Homo sapiens
agtcattacggactagtactac

SEQ ID NO: 8535027 - DNA, 22 bp, Homo sapiens
agtcatgactccattggtcaag

SEQ ID NO: 8535028 - DNA, 22 bp, Homo sapiens
agtcatctcaggtagcatttac

SEQ ID NO: 8535029 - DNA, 22 bp, Homo sapiens
agtcatatgacccttcacaaac

SEQ ID NO: 8535030 - DNA, 22 bp, Homo sapiens
agtcatatctgaggaggaatcc

SEQ ID NO: 8535031 - DNA, 22 bp, Homo sapiens
agtcatatattttgtttgtgca

SEQ ID NO: 8535032 - DNA, 22 bp, Homo sapiens
agtcatatctgaggaggaatcc

SEQ ID NO: 8535033 - DNA, 19 bp, Homo sapiens
agtcatattgttcatcttg

SEQ ID NO: 8535034 - DNA, 22 bp, Homo sapiens
agtcatatttagcttgtggaat

SEQ ID NO: 8535035 - DNA, 22 bp, Homo sapiens
agtcatatggctatttagtggg

SEQ ID NO: 8535036 - DNA, 22 bp, Homo sapiens
agtcatatgtggcattttctaa

SEQ ID NO: 8535037 - DNA, 17 bp, Homo sapiens
agtcatattgtgcagtt

SEQ ID NO: 8535038 - DNA, 19 bp, Homo sapiens
agtcatctcactgtgccca

SEQ ID NO: 8535039 - DNA, 22 bp, Homo sapiens
agtcatttctgtagtcatgttt

SEQ ID NO: 8535040 - DNA, 22 bp, Homo sapiens
agtcattttctgcctgtaatct

SEQ ID NO: 8535041 - DNA, 22 bp, Homo sapiens
agtcattttgccagtcttcagg

SEQ ID NO: 8535042 - DNA, 22 bp, Homo sapiens
agtcattttctgcctgtaatct

SEQ ID NO: 8535043 - DNA, 22 bp, Homo sapiens
agtcattttgccagtcttcagg

SEQ ID NO: 8535044 - DNA, 22 bp, Homo sapiens
agtccaaagcagatgagggcca

SEQ ID NO: 8535045 - DNA, 22 bp, Homo sapiens
ctcctccctgcgattgctctgc

SEQ ID NO: 8535046 - DNA, 22 bp, Homo sapiens
ctcctccctctttgccacacat

SEQ ID NO: 8535047 - DNA, 22 bp, Homo sapiens
ctcctccctgcgattgctctgc

SEQ ID NO: 8535048 - DNA, 22 bp, Homo sapiens
ctcctcccacggtctcaggaag

SEQ ID NO: 8535049 - DNA, 22 bp, Homo sapiens
ctcctcccacggtctcaggaag

SEQ ID NO: 8535050 - DNA, 22 bp, Homo sapiens
ctcctcccacggtctcaggaag

SEQ ID NO: 8535051 - DNA, 22 bp, Homo sapiens
ctcctccctctttgccacacat

SEQ ID NO: 8535052 - DNA, 22 bp, Homo sapiens
ctcctccctctttgccacacat

SEQ ID NO: 8535053 - DNA, 22 bp, Homo sapiens
ctcctccctctttgccacacat

SEQ ID NO: 8535054 - DNA, 22 bp, Homo sapiens
ctcctccctctttgccacacat

SEQ ID NO: 8535055 - DNA, 22 bp, Homo sapiens
ctcctctcaaaagtaggttgac

SEQ ID NO: 8535056 - DNA, 22 bp, Homo sapiens
agtgcaggagcctggccagagc

SEQ ID NO: 8535057 - DNA, 22 bp, Homo sapiens
ctcccaggggaactatcaagta

SEQ ID NO: 8535058 - DNA, 22 bp, Homo sapiens
ctcccaggggaactatcaagta

SEQ ID NO: 8535059 - DNA, 22 bp, Homo sapiens
agtgcagccgagatcaggtgct

SEQ ID NO: 8535060 - DNA, 22 bp, Homo sapiens
agtgcagcatgaagcacatgtg

SEQ ID NO: 8535061 - DNA, 22 bp, Homo sapiens
ctcccagggtctaggctgctgg

SEQ ID NO: 8535062 - DNA, 22 bp, Homo sapiens
ctcccagggtctaggctgctgg

SEQ ID NO: 8535063 - DNA, 22 bp, Homo sapiens
ctcccaggggagtcatctgctt

SEQ ID NO: 8535064 - DNA, 22 bp, Homo sapiens
ctcccaggggagtcatctgctt

SEQ ID NO: 8535065 - DNA, 22 bp, Homo sapiens
ctcccagggtagggagagacta

SEQ ID NO: 8535066 - DNA, 22 bp, Homo sapiens
ctcccagggtagggagagacta

SEQ ID NO: 8535067 - DNA, 22 bp, Homo sapiens
ctcccaggtgtcccttctgcca

SEQ ID NO: 8535068 - DNA, 22 bp, Homo sapiens
ctcccaggttacatctgagcct

SEQ ID NO: 8535069 - DNA, 22 bp, Homo sapiens
ctcccaggttacatctgagcct

SEQ ID NO: 8535070 - DNA, 22 bp, Homo sapiens
ctcccagggtctaggctgctgg

SEQ ID NO: 8535071 - DNA, 22 bp, Homo sapiens
ctcccaggttccgacgcctctt

SEQ ID NO: 8535072 - DNA, 22 bp, Homo sapiens
ctcccaggttccgacgcctctt

SEQ ID NO: 8535073 - DNA, 22 bp, Homo sapiens
ctcccaggttccgacgcctctt

SEQ ID NO: 8535074 - DNA, 22 bp, Homo sapiens
ctcccaggttccgacgcctctt

SEQ ID NO: 8535075 - DNA, 22 bp, Homo sapiens
ctcccaggttccgacgcctctt

SEQ ID NO: 8535076 - DNA, 22 bp, Homo sapiens
ctcctcagctgggaggagtccc

SEQ ID NO: 8535077 - DNA, 22 bp, Homo sapiens
ctcctcccacggtctcaggaag

SEQ ID NO: 8535078 - DNA, 22 bp, Homo sapiens
ctcctcagagagcagcttgggg

SEQ ID NO: 8535079 - DNA, 22 bp, Homo sapiens
agtgcacaccttagtacaaagt

SEQ ID NO: 8535080 - DNA, 22 bp, Homo sapiens
agtgcacaccttagtacaaagt

SEQ ID NO: 8535081 - DNA, 22 bp, Homo sapiens
agtgcacagcgtgatgtattgg

SEQ ID NO: 8535082 - DNA, 22 bp, Homo sapiens
agtgcagactgaaatgaccttc

SEQ ID NO: 8535083 - DNA, 22 bp, Homo sapiens
agtgcagatttttagtcagctt

SEQ ID NO: 8535084 - DNA, 22 bp, Homo sapiens
agtgcagatttttagtcagctt

SEQ ID NO: 8535085 - DNA, 22 bp, Homo sapiens
agtgcagagtacatttgtggca

SEQ ID NO: 8535086 - DNA, 22 bp, Homo sapiens
agtgcagagacctggtcaggca

SEQ ID NO: 8535087 - DNA, 22 bp, Homo sapiens
agtgcagaggctgggaaatgct

SEQ ID NO: 8535088 - DNA, 22 bp, Homo sapiens
agtgcagagagcaatactctac

SEQ ID NO: 8535089 - DNA, 22 bp, Homo sapiens
agtgacatttgcaccagctgct

SEQ ID NO: 8535090 - DNA, 22 bp, Homo sapiens
agtgaccaatcatggttagatt

SEQ ID NO: 8535091 - DNA, 22 bp, Homo sapiens
agtgaccaacaatgctgagaag

SEQ ID NO: 8535092 - DNA, 22 bp, Homo sapiens
agtgaccattttcagctagagg

SEQ ID NO: 8535093 - DNA, 22 bp, Homo sapiens
agtgactgacacctgtaatccc

SEQ ID NO: 8535094 - DNA, 22 bp, Homo sapiens
agtgactgggcagggcagggcc

SEQ ID NO: 8535095 - DNA, 22 bp, Homo sapiens
agtgactgggcagggcagggcc

SEQ ID NO: 8535096 - DNA, 22 bp, Homo sapiens
agtgactggttttgacaggaat

SEQ ID NO: 8535097 - DNA, 22 bp, Homo sapiens
agtgactggtgtgaagttaaat

SEQ ID NO: 8535098 - DNA, 22 bp, Homo sapiens
agtgacatcatgtcagcaaagt

SEQ ID NO: 8535099 - DNA, 22 bp, Homo sapiens
agtgacatgctctcaggcataa

SEQ ID NO: 8535100 - DNA, 22 bp, Homo sapiens
ctccatggaaaaggctgttgtt

SEQ ID NO: 8535101 - DNA, 22 bp, Homo sapiens
ctccatatgttcagttatgcag

SEQ ID NO: 8535102 - DNA, 22 bp, Homo sapiens
ctccatcagctgttggttgagg

SEQ ID NO: 8535103 - DNA, 22 bp, Homo sapiens
ctccagtgggggtgagcctaga

SEQ ID NO: 8535104 - DNA, 22 bp, Homo sapiens
ctccagtgggggtgagcctaga

SEQ ID NO: 8535105 - DNA, 22 bp, Homo sapiens
ctccagggagctgcgggagcca

SEQ ID NO: 8535106 - DNA, 22 bp, Homo sapiens
ctccagggagctgcgggagcca

SEQ ID NO: 8535107 - DNA, 22 bp, Homo sapiens
ctccagggagctgcgggagcca

SEQ ID NO: 8535108 - DNA, 22 bp, Homo sapiens
ctccagtggtgatggggaagaa

SEQ ID NO: 8535109 - DNA, 22 bp, Homo sapiens
ctccagtgtctcagagcagatg

SEQ ID NO: 8535110 - DNA, 22 bp, Homo sapiens
ctccagtgtctcagagcagatg

SEQ ID NO: 8535111 - DNA, 20 bp, Homo sapiens
ctccagtgttcaggggagtg

SEQ ID NO: 8535112 - DNA, 20 bp, Homo sapiens
ctccagtgttcaggggagtg

SEQ ID NO: 8535113 - DNA, 20 bp, Homo sapiens
ctccagtgttcaggggagtg

SEQ ID NO: 8535114 - DNA, 20 bp, Homo sapiens
ctccagtgttcaggggagtg

SEQ ID NO: 8535115 - DNA, 22 bp, Homo sapiens
ctccagttggccccagttggtt

SEQ ID NO: 8535116 - DNA, 20 bp, Homo sapiens
ctccagtgttcaggggagtg

SEQ ID NO: 8535117 - DNA, 22 bp, Homo sapiens
ctccagttggccccagttggtt

SEQ ID NO: 8535118 - DNA, 22 bp, Homo sapiens
ctccagttggccccagttggtt

SEQ ID NO: 8535119 - DNA, 22 bp, Homo sapiens
ctgaagcagatgtggctgagat

SEQ ID NO: 8535120 - DNA, 22 bp, Homo sapiens
ctgaagcagatgtggctgagat

SEQ ID NO: 8535121 - DNA, 22 bp, Homo sapiens
agtgttaagagaaaattctgct

SEQ ID NO: 8535122 - DNA, 21 bp, Homo sapiens
agtgtgttcttggcattacct

SEQ ID NO: 8535123 - DNA, 23 bp, Homo sapiens
agtgttaaatttcgcacctaaat

SEQ ID NO: 8535124 - DNA, 22 bp, Homo sapiens
agtgtgtgtttgggcggtttat

SEQ ID NO: 8535125 - DNA, 22 bp, Homo sapiens
agtgtgtgtttgggcggtttat

SEQ ID NO: 8535126 - DNA, 22 bp, Homo sapiens
agtgtgtgtttgggcggtttat

SEQ ID NO: 8535127 - DNA, 21 bp, Homo sapiens
agtgtgtgtggaatgagaata

SEQ ID NO: 8535128 - DNA, 21 bp, Homo sapiens
agtgtgtgtggaatgagaata

SEQ ID NO: 8535129 - DNA, 22 bp, Homo sapiens
agtgtgtgtttgggcggtttat

SEQ ID NO: 8535130 - DNA, 21 bp, Homo sapiens
agtgtgtgtggaatgagaata

SEQ ID NO: 8535131 - DNA, 22 bp, Homo sapiens
agtgtgtgctgttccccggagg

SEQ ID NO: 8535132 - DNA, 21 bp, Homo sapiens
agtgtgtgtggaatgagaata

SEQ ID NO: 8535133 - DNA, 22 bp, Homo sapiens
agtgtgtgcctttggatacctg

SEQ ID NO: 8535134 - DNA, 22 bp, Homo sapiens
agtgtgtgctgttccccggagg

SEQ ID NO: 8535135 - DNA, 22 bp, Homo sapiens
agtgtgtgcctttggatacctg

SEQ ID NO: 8535136 - DNA, 18 bp, Homo sapiens
agtgtgtgccctttcagg

SEQ ID NO: 8535137 - DNA, 18 bp, Homo sapiens
agtgtgtgccctttcagg

SEQ ID NO: 8535138 - DNA, 22 bp, Homo sapiens
agtgtgtgcctttggatacctg

SEQ ID NO: 8535139 - DNA, 22 bp, Homo sapiens
agtgtgggggctttggtgtcac

SEQ ID NO: 8535140 - DNA, 21 bp, Homo sapiens
agtgtgtgataggcaggaaga

SEQ ID NO: 8535141 - DNA, 21 bp, Homo sapiens
agtgtgtgataggcaggaaga

SEQ ID NO: 8535142 - DNA, 22 bp, Homo sapiens
agtgtgggggctttggtgtcac

SEQ ID NO: 8535143 - DNA, 22 bp, Homo sapiens
agtgtgggggctttggtgtcac

SEQ ID NO: 8535144 - DNA, 22 bp, Homo sapiens
agtgtgtgcatgcattcgtgca

SEQ ID NO: 8535145 - DNA, 22 bp, Homo sapiens
agtgtgtgcatgcattcgtgca

SEQ ID NO: 8535146 - DNA, 22 bp, Homo sapiens
agtgtgtgcatgcattcgtgca

SEQ ID NO: 8535147 - DNA, 18 bp, Homo sapiens
agtgtgtgccctttcagg

SEQ ID NO: 8535148 - DNA, 22 bp, Homo sapiens
agtgtgtgcatgcattcgtgca

SEQ ID NO: 8535149 - DNA, 22 bp, Homo sapiens
ctgagagcatcgctggagatag

SEQ ID NO: 8535150 - DNA, 22 bp, Homo sapiens
ctgagagcctcctgttggctag

SEQ ID NO: 8535151 - DNA, 19 bp, Homo sapiens
ctgagagatgcttcacaca

SEQ ID NO: 8535152 - DNA, 22 bp, Homo sapiens
ctgagagatggtgtgtttataa

SEQ ID NO: 8535153 - DNA, 22 bp, Homo sapiens
ctgagaggcggagcttgcagtg

SEQ ID NO: 8535154 - DNA, 22 bp, Homo sapiens
ctgagaggcggaggttgcagtg

SEQ ID NO: 8535155 - DNA, 22 bp, Homo sapiens
ctgagaggcggagcttgcagtg

SEQ ID NO: 8535156 - DNA, 22 bp, Homo sapiens
ctgagaggcagccagagaaaat

SEQ ID NO: 8535157 - DNA, 22 bp, Homo sapiens
ctgagaggatgctgcagtggag

SEQ ID NO: 8535158 - DNA, 22 bp, Homo sapiens
ctgagaggcagccagagaaaat

SEQ ID NO: 8535159 - DNA, 22 bp, Homo sapiens
ctgaagcaggcctacttcattg

SEQ ID NO: 8535160 - DNA, 22 bp, Homo sapiens
ctgaagcatatcatgccaagtt

SEQ ID NO: 8535161 - DNA, 23 bp, Homo sapiens
ctgaagcagttccctctctgccc

SEQ ID NO: 8535162 - DNA, 22 bp, Homo sapiens
ctgaagccatgtgctcactggt

SEQ ID NO: 8535163 - DNA, 22 bp, Homo sapiens
ctgaagccagtttgctgccctt

SEQ ID NO: 8535164 - DNA, 22 bp, Homo sapiens
ctgagaaaggacctcaaacagg

SEQ ID NO: 8535165 - DNA, 22 bp, Homo sapiens
ctgagaaagtgagggttaaaca

SEQ ID NO: 8535166 - DNA, 22 bp, Homo sapiens
ctgaagcttgataaactataaa

SEQ ID NO: 8535167 - DNA, 22 bp, Homo sapiens
ctgaagcttagtttacgctcca

SEQ ID NO: 8535168 - DNA, 22 bp, Homo sapiens
ctgaagctgaaaacttccagca

SEQ ID NO: 8535169 - DNA, 22 bp, Homo sapiens
ctgaagctctccagtttgtttc

SEQ ID NO: 8535170 - DNA, 22 bp, Homo sapiens
agtggggacaatgagagcaggt

SEQ ID NO: 8535171 - DNA, 22 bp, Homo sapiens
agtggggacaatgagagcaggt

SEQ ID NO: 8535172 - DNA, 22 bp, Homo sapiens
agtggggacttatgccagcatt

SEQ ID NO: 8535173 - DNA, 22 bp, Homo sapiens
agtggggacaatgagagcaggt

SEQ ID NO: 8535174 - DNA, 22 bp, Homo sapiens
agtggggaagagcatgggccct

SEQ ID NO: 8535175 - DNA, 22 bp, Homo sapiens
agtggggaagattttgcagtca

SEQ ID NO: 8535176 - DNA, 23 bp, Homo sapiens
agtggggaatcaacagattcttt

SEQ ID NO: 8535177 - DNA, 20 bp, Homo sapiens
agtggggagtcaggagtgcc

SEQ ID NO: 8535178 - DNA, 20 bp, Homo sapiens
agtggggagtcaggagtgcc

SEQ ID NO: 8535179 - DNA, 20 bp, Homo sapiens
agtggggagtcaggagtgcc

SEQ ID NO: 8535180 - DNA, 20 bp, Homo sapiens
agtggggagtcaggagtgcc

SEQ ID NO: 8535181 - DNA, 22 bp, Homo sapiens
agtggggaggtccaggccaccc

SEQ ID NO: 8535182 - DNA, 22 bp, Homo sapiens
agtggggaggtccaggccaccc

SEQ ID NO: 8535183 - DNA, 22 bp, Homo sapiens
agtggggaagattttgcagtca

SEQ ID NO: 8535184 - DNA, 22 bp, Homo sapiens
agtggggacttatgccagcatt

SEQ ID NO: 8535185 - DNA, 22 bp, Homo sapiens
agtgtctgagctatcattaggg

SEQ ID NO: 8535186 - DNA, 22 bp, Homo sapiens
agtgtctgagtaaatttctcat

SEQ ID NO: 8535187 - DNA, 23 bp, Homo sapiens
agtgtctgagtgcaggctgtgca

SEQ ID NO: 8535188 - DNA, 22 bp, Homo sapiens
agtgtctgcaaaatgaaagagc

SEQ ID NO: 8535189 - DNA, 22 bp, Homo sapiens
agtgtctgatgcacagttgtcc

SEQ ID NO: 8535190 - DNA, 22 bp, Homo sapiens
agtgtctgatcagttgactaga

SEQ ID NO: 8535191 - DNA, 22 bp, Homo sapiens
agtgtctgatcagttgactaga

SEQ ID NO: 8535192 - DNA, 22 bp, Homo sapiens
agtgtctgagccagaattagaa

SEQ ID NO: 8535193 - DNA, 21 bp, Homo sapiens
agtgtctgagcgctgcttctg

SEQ ID NO: 8535194 - DNA, 22 bp, Homo sapiens
agtgtctgagccagaattagaa

SEQ ID NO: 8535195 - DNA, 22 bp, Homo sapiens
agtgtctgaactgggtgctgac

SEQ ID NO: 8535196 - DNA, 22 bp, Homo sapiens
agtgtctgaagcctcagcccga

SEQ ID NO: 8535197 - DNA, 22 bp, Homo sapiens
agtgtctgaaggatttggcttc

SEQ ID NO: 8535198 - DNA, 22 bp, Homo sapiens
agtgtctgaactgggtgctgac

SEQ ID NO: 8535199 - DNA, 22 bp, Homo sapiens
agtgtcctctattatgacttta

SEQ ID NO: 8535200 - DNA, 22 bp, Homo sapiens
ctcttagaaactatagagatta

SEQ ID NO: 8535201 - DNA, 22 bp, Homo sapiens
ctcttagaaactatagagatta

SEQ ID NO: 8535202 - DNA, 22 bp, Homo sapiens
ctcttacattcttttactagca

SEQ ID NO: 8535203 - DNA, 22 bp, Homo sapiens
ctcttagaaactatagagatta

SEQ ID NO: 8535204 - DNA, 19 bp, Homo sapiens
ctcttacagaatagacaca

SEQ ID NO: 8535205 - DNA, 19 bp, Homo sapiens
ctcttacagaatagacaca

SEQ ID NO: 8535206 - DNA, 22 bp, Homo sapiens
ctcttaattaagctgagatctg

SEQ ID NO: 8535207 - DNA, 22 bp, Homo sapiens
ctcttacaagctcccgatataa

SEQ ID NO: 8535208 - DNA, 20 bp, Homo sapiens
ctcttaattgctcacattag

SEQ ID NO: 8535209 - DNA, 22 bp, Homo sapiens
ctcttaaagcttccagtttcaa

SEQ ID NO: 8535210 - DNA, 20 bp, Homo sapiens
ctcttaaatgtaaagtaggc

SEQ ID NO: 8535211 - DNA, 19 bp, Homo sapiens
ctcttaaattgtctcttgc

SEQ ID NO: 8535212 - DNA, 22 bp, Homo sapiens
ctcttaatgaccttaattcaag

SEQ ID NO: 8535213 - DNA, 22 bp, Homo sapiens
ctcttaatgaccttaattcaag

SEQ ID NO: 8535214 - DNA, 22 bp, Homo sapiens
ctcttaatgttttatagattga

SEQ ID NO: 8535215 - DNA, 20 bp, Homo sapiens
ctcttaaatgtaaagtaggc

SEQ ID NO: 8535216 - DNA, 20 bp, Homo sapiens
ctcttaaatgtaaagtaggc

SEQ ID NO: 8535217 - DNA, 23 bp, Homo sapiens
agtgtctgagtgcaggctgtgca

SEQ ID NO: 8535218 - DNA, 22 bp, Homo sapiens
agtgtctgccagctgccaggtg

SEQ ID NO: 8535219 - DNA, 22 bp, Homo sapiens
agtgtctgcctatttttcaagc

SEQ ID NO: 8535220 - DNA, 22 bp, Homo sapiens
agtgtctgccaactgcatggtc

SEQ ID NO: 8535221 - DNA, 22 bp, Homo sapiens
agtgtctgccagctgccaggtg

SEQ ID NO: 8535222 - DNA, 22 bp, Homo sapiens
agtgtctgcaaaatgaaagagc

SEQ ID NO: 8535223 - DNA, 22 bp, Homo sapiens
agtgtctgcagtgatgtctctt

SEQ ID NO: 8535224 - DNA, 22 bp, Homo sapiens
agtgtctgccaactgcatggtc

SEQ ID NO: 8535225 - DNA, 22 bp, Homo sapiens
agtgtctgcagtgatgtctctt

SEQ ID NO: 8535226 - DNA, 22 bp, Homo sapiens
ctcttaaaattacctttgcaaa

SEQ ID NO: 8535227 - DNA, 22 bp, Homo sapiens
ctcttaaaaacttgatatattt

SEQ ID NO: 8535228 - DNA, 22 bp, Homo sapiens
agtgtctgcctatttttcaagc

SEQ ID NO: 8535229 - DNA, 22 bp, Homo sapiens
ctctgtttttcaatagttcttg

SEQ ID NO: 8535230 - DNA, 19 bp, Homo sapiens
agtggctgggcagaagcaa

SEQ ID NO: 8535231 - DNA, 22 bp, Homo sapiens
agtggctggcataggaacagac

SEQ ID NO: 8535232 - DNA, 22 bp, Homo sapiens
agtggctggcataggaacagac

SEQ ID NO: 8535233 - DNA, 22 bp, Homo sapiens
agtggctggcataggaacagac

SEQ ID NO: 8535234 - DNA, 22 bp, Homo sapiens
agtggctggagccccaggctgg

SEQ ID NO: 8535235 - DNA, 22 bp, Homo sapiens
agtggctgacaactgggttaac

SEQ ID NO: 8535236 - DNA, 22 bp, Homo sapiens
agtggctggacgacaagggtga

SEQ ID NO: 8535237 - DNA, 22 bp, Homo sapiens
agtggctgaatatattttacta

SEQ ID NO: 8535238 - DNA, 20 bp, Homo sapiens
agtggcaggcgatcattact

SEQ ID NO: 8535239 - DNA, 20 bp, Homo sapiens
agtggcaggcgatcattact

SEQ ID NO: 8535240 - DNA, 17 bp, Homo sapiens
agtggcaggcagatggg

SEQ ID NO: 8535241 - DNA, 22 bp, Homo sapiens
agtggcagctgtcatgccctag

SEQ ID NO: 8535242 - DNA, 22 bp, Homo sapiens
agtggcaggaaagtggaagaga

SEQ ID NO: 8535243 - DNA, 22 bp, Homo sapiens
agtggcaggatctcggttcact

SEQ ID NO: 8535244 - DNA, 22 bp, Homo sapiens
agtggcaggaaagtggaagaga

SEQ ID NO: 8535245 - DNA, 17 bp, Homo sapiens
agtggcaggcagatggg

SEQ ID NO: 8535246 - DNA, 22 bp, Homo sapiens
agtggcaggcagaagcttctca

SEQ ID NO: 8535247 - DNA, 22 bp, Homo sapiens
agtggcaggcagaagcttctca

SEQ ID NO: 8535248 - DNA, 22 bp, Homo sapiens
ctctctggtacatagagtttgg

SEQ ID NO: 8535249 - DNA, 22 bp, Homo sapiens
ctctctggtacatagagtttgg

SEQ ID NO: 8535250 - DNA, 22 bp, Homo sapiens
agtggcagccgagcaggagatg

SEQ ID NO: 8535251 - DNA, 22 bp, Homo sapiens
agtggcagccgagcaggagatg

SEQ ID NO: 8535252 - DNA, 22 bp, Homo sapiens
agtggcagctgtcatgccctag

SEQ ID NO: 8535253 - DNA, 22 bp, Homo sapiens
agtggcagccttgttcattatg

SEQ ID NO: 8535254 - DNA, 22 bp, Homo sapiens
agtggcagccgagcaggagatg

SEQ ID NO: 8535255 - DNA, 18 bp, Homo sapiens
ctctctgggtgaggacaa

SEQ ID NO: 8535256 - DNA, 18 bp, Homo sapiens
ctctctgggtgaggacaa

SEQ ID NO: 8535257 - DNA, 18 bp, Homo sapiens
ctctctgggtgaggacaa

SEQ ID NO: 8535258 - DNA, 22 bp, Homo sapiens
ctctctggggttccagacgtgg

SEQ ID NO: 8535259 - DNA, 22 bp, Homo sapiens
ctctctggggttccagacgtgg

SEQ ID NO: 8535260 - DNA, 22 bp, Homo sapiens
ctctctgggcccagttggcacc

SEQ ID NO: 8535261 - DNA, 22 bp, Homo sapiens
ctctctgggcccagttggcacc

SEQ ID NO: 8535262 - DNA, 22 bp, Homo sapiens
ctctctgggggccatgccaaga

SEQ ID NO: 8535263 - DNA, 22 bp, Homo sapiens
ctctctgggcccagttggcacc

SEQ ID NO: 8535264 - DNA, 22 bp, Homo sapiens
ctctctggcttggcacggagat

SEQ ID NO: 8535265 - DNA, 22 bp, Homo sapiens
ctctctggcttggcacggagat

SEQ ID NO: 8535266 - DNA, 22 bp, Homo sapiens
ctctctggcttggcacggagat

SEQ ID NO: 8535267 - DNA, 23 bp, Homo sapiens
ctctctctaccatgtgaggacac

SEQ ID NO: 8535268 - DNA, 22 bp, Homo sapiens
ctctctccttagctgcagacca

SEQ ID NO: 8535269 - DNA, 22 bp, Homo sapiens
agtgcaggccccaggccaggcc

SEQ ID NO: 8535270 - DNA, 22 bp, Homo sapiens
agtgggccggacagcccaggcc

SEQ ID NO: 8535271 - DNA, 22 bp, Homo sapiens
agtgggcatgatctggtgtctg

SEQ ID NO: 8535272 - DNA, 22 bp, Homo sapiens
agtgggccaaatggaggcaagt

SEQ ID NO: 8535273 - DNA, 22 bp, Homo sapiens
agtgggctggtggcagggagaa

SEQ ID NO: 8535274 - DNA, 22 bp, Homo sapiens
agtgggctggtggcagggagaa

SEQ ID NO: 8535275 - DNA, 22 bp, Homo sapiens
agtgggctggtggcagggagaa

SEQ ID NO: 8535276 - DNA, 22 bp, Homo sapiens
agtgggctgagcttgctgggtg

SEQ ID NO: 8535277 - DNA, 22 bp, Homo sapiens
agtggggaagagcatgggccct

SEQ ID NO: 8535278 - DNA, 22 bp, Homo sapiens
agtggggaagagcatgggccct

SEQ ID NO: 8535279 - DNA, 22 bp, Homo sapiens
agtgggcttactgagggagtgt

SEQ ID NO: 8535280 - DNA, 22 bp, Homo sapiens
agtgggagggccatatggtgaa

SEQ ID NO: 8535281 - DNA, 22 bp, Homo sapiens
agtgggagggccatatggtgaa

SEQ ID NO: 8535282 - DNA, 22 bp, Homo sapiens
agtgggagggccatatggtgaa

SEQ ID NO: 8535283 - DNA, 22 bp, Homo sapiens
ctctgagatgataccttctgga

SEQ ID NO: 8535284 - DNA, 22 bp, Homo sapiens
ctctgagatgcttgaagaggat

SEQ ID NO: 8535285 - DNA, 22 bp, Homo sapiens
ctctgagcagaggccgtggcta

SEQ ID NO: 8535286 - DNA, 22 bp, Homo sapiens
ctctgagcagaggccgtggcta

SEQ ID NO: 8535287 - DNA, 22 bp, Homo sapiens
agtgggagagaagcaagtagta

SEQ ID NO: 8535288 - DNA, 22 bp, Homo sapiens
agtgggagagaagcaagtagta

SEQ ID NO: 8535289 - DNA, 22 bp, Homo sapiens
agtgggcagcccaggaggtctt

SEQ ID NO: 8535290 - DNA, 22 bp, Homo sapiens
agtgggcagtgcgctcggatgc

SEQ ID NO: 8535291 - DNA, 22 bp, Homo sapiens
agtgggcagcccaggaggtctt

SEQ ID NO: 8535292 - DNA, 22 bp, Homo sapiens
agtgggcaaaacagctcagagc

SEQ ID NO: 8535293 - DNA, 22 bp, Homo sapiens
ctctgagaggtgagaagcagca

SEQ ID NO: 8535294 - DNA, 22 bp, Homo sapiens
ctctgagagtgctcagagggta

SEQ ID NO: 8535295 - DNA, 22 bp, Homo sapiens
ctctgagagagctggtgagcac

SEQ ID NO: 8535296 - DNA, 22 bp, Homo sapiens
ctctgagagagctggtgagcac

SEQ ID NO: 8535297 - DNA, 22 bp, Homo sapiens
ctctgagaggatcctgcccggg

SEQ ID NO: 8535298 - DNA, 22 bp, Homo sapiens
ctctgagaagccttgatgggga

SEQ ID NO: 8535299 - DNA, 22 bp, Homo sapiens
ctctgagaatataagactattt

SEQ ID NO: 8535300 - DNA, 22 bp, Homo sapiens
ctctgagaaagctgtgagctaa

SEQ ID NO: 8535301 - DNA, 22 bp, Homo sapiens
ctctgagaagagttcaagtaaa

SEQ ID NO: 8535302 - DNA, 22 bp, Homo sapiens
ctctgagactcaagtgagtggg

SEQ ID NO: 8535303 - DNA, 22 bp, Homo sapiens
ctctgagaatatgagctctttg

SEQ ID NO: 8535304 - DNA, 22 bp, Homo sapiens
ctctgagaagccttgatgggga

SEQ ID NO: 8535305 - DNA, 22 bp, Homo sapiens
agtggctgtaggctatgagaga

SEQ ID NO: 8535306 - DNA, 21 bp, Homo sapiens
agtggctgtcaagggggcctt

SEQ ID NO: 8535307 - DNA, 22 bp, Homo sapiens
agtggctgtatcagtcaaccct

SEQ ID NO: 8535308 - DNA, 22 bp, Homo sapiens
agtggctggtctaaggtcacag

SEQ ID NO: 8535309 - DNA, 22 bp, Homo sapiens
agtggctgtaggctatgagaga

SEQ ID NO: 8535310 - DNA, 22 bp, Homo sapiens
agtggctgtactattttttcat

SEQ ID NO: 8535311 - DNA, 22 bp, Homo sapiens
agtggctggtctaaggtcacag

SEQ ID NO: 8535312 - DNA, 22 bp, Homo sapiens
agtggctggtagttactgagca

SEQ ID NO: 8535313 - DNA, 19 bp, Homo sapiens
agtggctgggcagaagcaa

SEQ ID NO: 8535314 - DNA, 22 bp, Homo sapiens
agtggctgtcctggctctaact

SEQ ID NO: 8535315 - DNA, 22 bp, Homo sapiens
agtggctgtcttccaaaatctg

SEQ ID NO: 8535316 - DNA, 22 bp, Homo sapiens
ctctgactttaaatacaggatg

SEQ ID NO: 8535317 - DNA, 22 bp, Homo sapiens
ctctgagaaagctgtgagctaa

SEQ ID NO: 8535318 - DNA, 22 bp, Homo sapiens
ctacagaaaatcagccacaggc

SEQ ID NO: 8535319 - DNA, 22 bp, Homo sapiens
ctacagaaaatcagccacaggc

SEQ ID NO: 8535320 - DNA, 22 bp, Homo sapiens
ctacactttggttgactttgtg

SEQ ID NO: 8535321 - DNA, 22 bp, Homo sapiens
ctacacttgttcgactgcagga

SEQ ID NO: 8535322 - DNA, 22 bp, Homo sapiens
ctacagaaacactggacatgtg

SEQ ID NO: 8535323 - DNA, 22 bp, Homo sapiens
ctacagaaacctttttcataca

SEQ ID NO: 8535324 - DNA, 22 bp, Homo sapiens
ctacagaagaaactatcactat

SEQ ID NO: 8535325 - DNA, 22 bp, Homo sapiens
ctacagaagaaactatcactat

SEQ ID NO: 8535326 - DNA, 22 bp, Homo sapiens
ctacagaagtttcccttgctta

SEQ ID NO: 8535327 - DNA, 22 bp, Homo sapiens
ctacagaagtttcccttgctta

SEQ ID NO: 8535328 - DNA, 21 bp, Homo sapiens
ctacagaatcgagcattctgg

SEQ ID NO: 8535329 - DNA, 21 bp, Homo sapiens
ctacagaatcgagcattctgg

SEQ ID NO: 8535330 - DNA, 21 bp, Homo sapiens
ctacagaatcgagcattctgg

SEQ ID NO: 8535331 - DNA, 22 bp, Homo sapiens
ctacagaaggagaaatgggtaa

SEQ ID NO: 8535332 - DNA, 22 bp, Homo sapiens
ctacagaaggagaaatgggtaa

SEQ ID NO: 8535333 - DNA, 22 bp, Homo sapiens
ctacagaagccgtggtcaggaa

SEQ ID NO: 8535334 - DNA, 21 bp, Homo sapiens
ctacagaagctctcctatcca

SEQ ID NO: 8535335 - DNA, 22 bp, Homo sapiens
ctacagaagaaactatcactat

SEQ ID NO: 8535336 - DNA, 20 bp, Homo sapiens
ctacacagggttcgctgggc

SEQ ID NO: 8535337 - DNA, 22 bp, Homo sapiens
ctacacagttctgcctaatggc

SEQ ID NO: 8535338 - DNA, 22 bp, Homo sapiens
ctacacttgcatgagtcttgaa

SEQ ID NO: 8535339 - DNA, 22 bp, Homo sapiens
ctacacttgttcgactgcagga

SEQ ID NO: 8535340 - DNA, 22 bp, Homo sapiens
ctacactgagagctcttcaggg

SEQ ID NO: 8535341 - DNA, 22 bp, Homo sapiens
agtcaggattttggattattcg

SEQ ID NO: 8535342 - DNA, 22 bp, Homo sapiens
agtcagtgttctgggttgtaat

SEQ ID NO: 8535343 - DNA, 22 bp, Homo sapiens
agtcagttaaactttgtaaagt

SEQ ID NO: 8535344 - DNA, 22 bp, Homo sapiens
agtcagtgttctccggagaggc

SEQ ID NO: 8535345 - DNA, 22 bp, Homo sapiens
agtcagttgtggagatttaact

SEQ ID NO: 8535346 - DNA, 19 bp, Homo sapiens
agtcagttctgaggaggaa

SEQ ID NO: 8535347 - DNA, 22 bp, Homo sapiens
agtcataattataaacatcagt

SEQ ID NO: 8535348 - DNA, 22 bp, Homo sapiens
agtcataaagccagtgggaggc

SEQ ID NO: 8535349 - DNA, 23 bp, Homo sapiens
ctacaagagcaagcatggacaag

SEQ ID NO: 8535350 - DNA, 22 bp, Homo sapiens
ctacaacattatgctttctgtc

SEQ ID NO: 8535351 - DNA, 22 bp, Homo sapiens
agtcagatgatgtgaggagtgg

SEQ ID NO: 8535352 - DNA, 22 bp, Homo sapiens
agtcagatttagatgtagcaag

SEQ ID NO: 8535353 - DNA, 22 bp, Homo sapiens
ctacaagatttttaaaactgta

SEQ ID NO: 8535354 - DNA, 22 bp, Homo sapiens
ctacaatgacagaattgagtag

SEQ ID NO: 8535355 - DNA, 22 bp, Homo sapiens
agtcagagttttgaggtgtgac

SEQ ID NO: 8535356 - DNA, 17 bp, Homo sapiens
agtcagaggagtatctg

SEQ ID NO: 8535357 - DNA, 17 bp, Homo sapiens
agtcagaggagtatctg

SEQ ID NO: 8535358 - DNA, 17 bp, Homo sapiens
agtcagaggagtatctg

SEQ ID NO: 8535359 - DNA, 22 bp, Homo sapiens
agtcagacataattctaacatt

SEQ ID NO: 8535360 - DNA, 22 bp, Homo sapiens
agtcagagaatgttttcatgga

SEQ ID NO: 8535361 - DNA, 22 bp, Homo sapiens
agtcagagaataaagaatgcat

SEQ ID NO: 8535362 - DNA, 23 bp, Homo sapiens
agtcagagagtgtgagacaactg

SEQ ID NO: 8535363 - DNA, 22 bp, Homo sapiens
agtcagagctatgttgttatat

SEQ ID NO: 8535364 - DNA, 22 bp, Homo sapiens
agtcagagaccctagatctaat

SEQ ID NO: 8535365 - DNA, 23 bp, Homo sapiens
agtcagagagtgtgagacaactg

SEQ ID NO: 8535366 - DNA, 22 bp, Homo sapiens
agtcagagagctctcagcatag

SEQ ID NO: 8535367 - DNA, 20 bp, Homo sapiens
cgtgctgtgaccttgagcat

SEQ ID NO: 8535368 - DNA, 22 bp, Homo sapiens
cgtggccacccagtggtgcgtg

SEQ ID NO: 8535369 - DNA, 17 bp, Homo sapiens
cgtggctgagccataga

SEQ ID NO: 8535370 - DNA, 22 bp, Homo sapiens
cgtggcctttgagtgagctccc

SEQ ID NO: 8535371 - DNA, 22 bp, Homo sapiens
cgtggctggggaggtcagccag

SEQ ID NO: 8535372 - DNA, 22 bp, Homo sapiens
cgtggctggggcgactccacgg

SEQ ID NO: 8535373 - DNA, 22 bp, Homo sapiens
ctaaaattatcaagataattcc

SEQ ID NO: 8535374 - DNA, 22 bp, Homo sapiens
ctaaaattatcaagataattcc

SEQ ID NO: 8535375 - DNA, 22 bp, Homo sapiens
ctaaaattatcaagataattcc

SEQ ID NO: 8535376 - DNA, 22 bp, Homo sapiens
ctaaaattatcaagataattcc

SEQ ID NO: 8535377 - DNA, 22 bp, Homo sapiens
ctaaacatcttgcaatgcacag

SEQ ID NO: 8535378 - DNA, 22 bp, Homo sapiens
ctaaacatcttgcaatgcacag

SEQ ID NO: 8535379 - DNA, 22 bp, Homo sapiens
agtcacatttgggggtgtcaaa

SEQ ID NO: 8535380 - DNA, 22 bp, Homo sapiens
ctaaacatgttggtgctttaaa

SEQ ID NO: 8535381 - DNA, 22 bp, Homo sapiens
ctaaacatgttggtgctttaaa

SEQ ID NO: 8535382 - DNA, 22 bp, Homo sapiens
ctaaacatgtagcttttgtggt

SEQ ID NO: 8535383 - DNA, 22 bp, Homo sapiens
ctaaacatgaactacatttagg

SEQ ID NO: 8535384 - DNA, 22 bp, Homo sapiens
ctaaacatgaactacatttagg

SEQ ID NO: 8535385 - DNA, 22 bp, Homo sapiens
ctaaacatggcttagaacactc

SEQ ID NO: 8535386 - DNA, 22 bp, Homo sapiens
ctaaacatggcttagaacactc

SEQ ID NO: 8535387 - DNA, 22 bp, Homo sapiens
ctaaacatgcaagagcttctgg

SEQ ID NO: 8535388 - DNA, 22 bp, Homo sapiens
ctaaacatgcaagagcttctgg

SEQ ID NO: 8535389 - DNA, 18 bp, Homo sapiens
cgtgagtggaggctgcgg

SEQ ID NO: 8535390 - DNA, 18 bp, Homo sapiens
cgtgagtggaggctgcgg

SEQ ID NO: 8535391 - DNA, 22 bp, Homo sapiens
cgtgagtgggtagcttattctt

SEQ ID NO: 8535392 - DNA, 22 bp, Homo sapiens
cggtcaggtgcagcgttggcac

SEQ ID NO: 8535393 - DNA, 22 bp, Homo sapiens
cgtgcaaatatatgtgtgatga

SEQ ID NO: 8535394 - DNA, 22 bp, Homo sapiens
cgtgccactgcactctagcctg

SEQ ID NO: 8535395 - DNA, 22 bp, Homo sapiens
cgtgccactgcactctagcctg

SEQ ID NO: 8535396 - DNA, 22 bp, Homo sapiens
cgtgcatgatatatgagttgtt

SEQ ID NO: 8535397 - DNA, 22 bp, Homo sapiens
cgcctgggagtccacacctgct

SEQ ID NO: 8535398 - DNA, 19 bp, Homo sapiens
cgcctggcaggccctgcgc

SEQ ID NO: 8535399 - DNA, 22 bp, Homo sapiens
cgcgaggtggaggttgcagtga

SEQ ID NO: 8535400 - DNA, 22 bp, Homo sapiens
cgcgcggctctcgcgagatgtg

SEQ ID NO: 8535401 - DNA, 22 bp, Homo sapiens
cgcgctctccttctggcaccca

SEQ ID NO: 8535402 - DNA, 22 bp, Homo sapiens
cgcgctcatttccgcctccttc

SEQ ID NO: 8535403 - DNA, 22 bp, Homo sapiens
cgcggtggcggcctccagcgcc

SEQ ID NO: 8535404 - DNA, 22 bp, Homo sapiens
cgcggtggcggcctccagcgcc

SEQ ID NO: 8535405 - DNA, 22 bp, Homo sapiens
cgcgctgcagacagcggaggcc

SEQ ID NO: 8535406 - DNA, 22 bp, Homo sapiens
cgcggagctccgcccggtgccc

SEQ ID NO: 8535407 - DNA, 22 bp, Homo sapiens
cgcggcgcgcccccgggtgtgt

SEQ ID NO: 8535408 - DNA, 17 bp, Homo sapiens
aggtgtggtcaagggag

SEQ ID NO: 8535409 - DNA, 17 bp, Homo sapiens
aggtgtggtcaagggag

SEQ ID NO: 8535410 - DNA, 22 bp, Homo sapiens
aggtgtgggaaacgggtgacct

SEQ ID NO: 8535411 - DNA, 22 bp, Homo sapiens
aggtgtgggaaacgggtgacct

SEQ ID NO: 8535412 - DNA, 22 bp, Homo sapiens
aggtgtggcttgaagtctctat

SEQ ID NO: 8535413 - DNA, 22 bp, Homo sapiens
aggtgtggctggggcagaggcc

SEQ ID NO: 8535414 - DNA, 22 bp, Homo sapiens
aggtgtggctggggcagaggcc

SEQ ID NO: 8535415 - DNA, 22 bp, Homo sapiens
aggtgtggctggggcagaggcc

SEQ ID NO: 8535416 - DNA, 22 bp, Homo sapiens
cctggtgccactagagaatgtc

SEQ ID NO: 8535417 - DNA, 22 bp, Homo sapiens
aggttcattcccaaatttggag

SEQ ID NO: 8535418 - DNA, 22 bp, Homo sapiens
aggttggccaagctgctggccc

SEQ ID NO: 8535419 - DNA, 22 bp, Homo sapiens
aggttggcctcagggaggctct

SEQ ID NO: 8535420 - DNA, 22 bp, Homo sapiens
aggttggctgctcttttcctaa

SEQ ID NO: 8535421 - DNA, 22 bp, Homo sapiens
aggtttactgagggtgctggtt

SEQ ID NO: 8535422 - DNA, 22 bp, Homo sapiens
aggttcaaatgcaagagatgct

SEQ ID NO: 8535423 - DNA, 22 bp, Homo sapiens
aggttcaaattgttgcagtttc

SEQ ID NO: 8535424 - DNA, 22 bp, Homo sapiens
aggttcagtgcctggaacaggg

SEQ ID NO: 8535425 - DNA, 23 bp, Homo sapiens
aggttcaggagatggaggaacaa

SEQ ID NO: 8535426 - DNA, 22 bp, Homo sapiens
aggttcaggctgcacacctgag

SEQ ID NO: 8535427 - DNA, 22 bp, Homo sapiens
aggttaaaaaggattcagttaa

SEQ ID NO: 8535428 - DNA, 22 bp, Homo sapiens
aggttaaaaaggattcagttaa

SEQ ID NO: 8535429 - DNA, 22 bp, Homo sapiens
aggttaggaagatacagaatgt

SEQ ID NO: 8535430 - DNA, 23 bp, Homo sapiens
aggttatgattatagagcgagga

SEQ ID NO: 8535431 - DNA, 22 bp, Homo sapiens
aggttatatgtcatactgaagt

SEQ ID NO: 8535432 - DNA, 22 bp, Homo sapiens
aggttagtgctgaaatgacatg

SEQ ID NO: 8535433 - DNA, 22 bp, Homo sapiens
aggttagtgctgaaatgacatg

SEQ ID NO: 8535434 - DNA, 22 bp, Homo sapiens
aggttagtatgacacggttata

SEQ ID NO: 8535435 - DNA, 22 bp, Homo sapiens
agtacaaaatgcagcatcatca

SEQ ID NO: 8535436 - DNA, 21 bp, Homo sapiens
agtacaaaaattcctttctca

SEQ ID NO: 8535437 - DNA, 22 bp, Homo sapiens
agtacaaaatgcagcatcatca

SEQ ID NO: 8535438 - DNA, 22 bp, Homo sapiens
agtacaaactgtttcaaagtag

SEQ ID NO: 8535439 - DNA, 22 bp, Homo sapiens
agtacaaaggcccttgattact

SEQ ID NO: 8535440 - DNA, 22 bp, Homo sapiens
agtacaaaggcccttgattact

SEQ ID NO: 8535441 - DNA, 22 bp, Homo sapiens
agtacaaaggcccttgattact

SEQ ID NO: 8535442 - DNA, 22 bp, Homo sapiens
agtacaaactgtttcaaagtag

SEQ ID NO: 8535443 - DNA, 22 bp, Homo sapiens
agtacaaattatagcgcttgga

SEQ ID NO: 8535444 - DNA, 22 bp, Homo sapiens
cgcctggaacctctaggaccag

SEQ ID NO: 8535445 - DNA, 22 bp, Homo sapiens
cgcctggagaggaggcgacgcg

SEQ ID NO: 8535446 - DNA, 22 bp, Homo sapiens
agtacaaagtgctcctggttct

SEQ ID NO: 8535447 - DNA, 22 bp, Homo sapiens
agtacaaagtgctcctggttct

SEQ ID NO: 8535448 - DNA, 22 bp, Homo sapiens
agtacaaagtgctcctggttct

SEQ ID NO: 8535449 - DNA, 22 bp, Homo sapiens
agtacaaatgcagccagagtag

SEQ ID NO: 8535450 - DNA, 22 bp, Homo sapiens
agtacaaatgcagccagagtag

SEQ ID NO: 8535451 - DNA, 22 bp, Homo sapiens
agtaatctgattttatagctat

SEQ ID NO: 8535452 - DNA, 22 bp, Homo sapiens
agtaatgtgcctgaaatacttg

SEQ ID NO: 8535453 - DNA, 22 bp, Homo sapiens
agtaatgtcccttaaatgtggt

SEQ ID NO: 8535454 - DNA, 21 bp, Homo sapiens
agtacaaaaattcctttctca

SEQ ID NO: 8535455 - DNA, 22 bp, Homo sapiens
agtaataatttatattagggag

SEQ ID NO: 8535456 - DNA, 22 bp, Homo sapiens
agtaatcaatttttcggtggat

SEQ ID NO: 8535457 - DNA, 22 bp, Homo sapiens
agtaacagggtatttgtgtggg

SEQ ID NO: 8535458 - DNA, 22 bp, Homo sapiens
agtaataatttatattagggag

SEQ ID NO: 8535459 - DNA, 22 bp, Homo sapiens
aggtttctatgctgtttatctt

SEQ ID NO: 8535460 - DNA, 19 bp, Homo sapiens
aggtttctaactattcaag

SEQ ID NO: 8535461 - DNA, 21 bp, Homo sapiens
aggtttctcttttatggaggg

SEQ ID NO: 8535462 - DNA, 17 bp, Homo sapiens
aggtttatggtatttga

SEQ ID NO: 8535463 - DNA, 21 bp, Homo sapiens
aggtttatttcaacttcagga

SEQ ID NO: 8535464 - DNA, 20 bp, Homo sapiens
cctttattatttgtatgatg

SEQ ID NO: 8535465 - DNA, 20 bp, Homo sapiens
cctttattatttgtatgatg

SEQ ID NO: 8535466 - DNA, 22 bp, Homo sapiens
agggtggctgagtagatggaag

SEQ ID NO: 8535467 - DNA, 21 bp, Homo sapiens
agggtggctctgggtcagaac

SEQ ID NO: 8535468 - DNA, 21 bp, Homo sapiens
agggtggctctgggtcagaac

SEQ ID NO: 8535469 - DNA, 22 bp, Homo sapiens
agggtggctgagtagatggaag

SEQ ID NO: 8535470 - DNA, 22 bp, Homo sapiens
agggtggctgagtagatggaag

SEQ ID NO: 8535471 - DNA, 22 bp, Homo sapiens
agggtggctggaggaatcagaa

SEQ ID NO: 8535472 - DNA, 22 bp, Homo sapiens
agggtggctggaggaatcagaa

SEQ ID NO: 8535473 - DNA, 22 bp, Homo sapiens
cctggccagccagggctggggt

SEQ ID NO: 8535474 - DNA, 22 bp, Homo sapiens
cctggccttaagggcagggagc

SEQ ID NO: 8535475 - DNA, 22 bp, Homo sapiens
cctggccttaagggcagggagc

SEQ ID NO: 8535476 - DNA, 22 bp, Homo sapiens
agggtggctgtgaagtgcttgg

SEQ ID NO: 8535477 - DNA, 22 bp, Homo sapiens
cctggagcccctctggccagcc

SEQ ID NO: 8535478 - DNA, 22 bp, Homo sapiens
cctggagcccctctggccagcc

SEQ ID NO: 8535479 - DNA, 22 bp, Homo sapiens
cctggagcccctctggccagcc

SEQ ID NO: 8535480 - DNA, 22 bp, Homo sapiens
cctggagcccctctggccagcc

SEQ ID NO: 8535481 - DNA, 22 bp, Homo sapiens
cctggagcccctctggccagcc

SEQ ID NO: 8535482 - DNA, 22 bp, Homo sapiens
cctggagcgcgggtcaagctgg

SEQ ID NO: 8535483 - DNA, 22 bp, Homo sapiens
cctggagcgcgggtcaagctgg

SEQ ID NO: 8535484 - DNA, 20 bp, Homo sapiens
cctggagcctggaaggagtc

SEQ ID NO: 8535485 - DNA, 22 bp, Homo sapiens
cctggagcccctctggccagcc

SEQ ID NO: 8535486 - DNA, 20 bp, Homo sapiens
cctggagcctggaaggagtc

SEQ ID NO: 8535487 - DNA, 20 bp, Homo sapiens
cctggagcctggaaggagtc

SEQ ID NO: 8535488 - DNA, 22 bp, Homo sapiens
agggtggccatgagggagagat

SEQ ID NO: 8535489 - DNA, 22 bp, Homo sapiens
agggtggccaccaagtatgtca

SEQ ID NO: 8535490 - DNA, 22 bp, Homo sapiens
agggtggccatgagggagagat

SEQ ID NO: 8535491 - DNA, 22 bp, Homo sapiens
agggtggccatgagggagagat

SEQ ID NO: 8535492 - DNA, 22 bp, Homo sapiens
agggtggccaccaagtatgtca

SEQ ID NO: 8535493 - DNA, 22 bp, Homo sapiens
agggtggcagttactggagcaa

SEQ ID NO: 8535494 - DNA, 22 bp, Homo sapiens
cctggagctcactgggagccgg

SEQ ID NO: 8535495 - DNA, 22 bp, Homo sapiens
cctggagctcactgggagccgg

SEQ ID NO: 8535496 - DNA, 22 bp, Homo sapiens
cctggagctcactgggagccgg

SEQ ID NO: 8535497 - DNA, 22 bp, Homo sapiens
cctggctcaaggcgaggactcc

SEQ ID NO: 8535498 - DNA, 22 bp, Homo sapiens
cctggctcaaggcgaggactcc

SEQ ID NO: 8535499 - DNA, 23 bp, Homo sapiens
cctggctcaccccttatgtccag

SEQ ID NO: 8535500 - DNA, 22 bp, Homo sapiens
cctggccttaagggcagggagc

SEQ ID NO: 8535501 - DNA, 22 bp, Homo sapiens
cctggctcagcagctctttctc

SEQ ID NO: 8535502 - DNA, 22 bp, Homo sapiens
cctggctcagagtatgtcatcg

SEQ ID NO: 8535503 - DNA, 22 bp, Homo sapiens
cctggctcagtgttgaaggggt

SEQ ID NO: 8535504 - DNA, 17 bp, Homo sapiens
aggtataaaatggtagc

SEQ ID NO: 8535505 - DNA, 22 bp, Homo sapiens
aggtagttttgacttcatggct

SEQ ID NO: 8535506 - DNA, 22 bp, Homo sapiens
aggtatagaattgaaagggttt

SEQ ID NO: 8535507 - DNA, 22 bp, Homo sapiens
aggtataagtctcatttctgtt

SEQ ID NO: 8535508 - DNA, 22 bp, Homo sapiens
aggtataagtctcatttctgtt

SEQ ID NO: 8535509 - DNA, 22 bp, Homo sapiens
aggtatatgctattacttctgc

SEQ ID NO: 8535510 - DNA, 22 bp, Homo sapiens
aggtatatgttcatgtatgtgt

SEQ ID NO: 8535511 - DNA, 22 bp, Homo sapiens
aggtatatgttcatgtatgtgt

SEQ ID NO: 8535512 - DNA, 22 bp, Homo sapiens
aggtatattgaatgcttactta

SEQ ID NO: 8535513 - DNA, 22 bp, Homo sapiens
aggtatcaacagcagagtctga

SEQ ID NO: 8535514 - DNA, 22 bp, Homo sapiens
aggtatctggtaagaggcagac

SEQ ID NO: 8535515 - DNA, 19 bp, Homo sapiens
agggtggcaaaggagggtg

SEQ ID NO: 8535516 - DNA, 19 bp, Homo sapiens
agggtggcaaaggagggtg

SEQ ID NO: 8535517 - DNA, 22 bp, Homo sapiens
agggtggcacctggaagggatg

SEQ ID NO: 8535518 - DNA, 22 bp, Homo sapiens
agggtggcacctggaagggatg

SEQ ID NO: 8535519 - DNA, 20 bp, Homo sapiens
agggtggcaagttagtgaca

SEQ ID NO: 8535520 - DNA, 20 bp, Homo sapiens
agggtggcaagttagtgaca

SEQ ID NO: 8535521 - DNA, 22 bp, Homo sapiens
agggtggcaccacatatcatag

SEQ ID NO: 8535522 - DNA, 22 bp, Homo sapiens
cctgcctgcggcccgcggggag

SEQ ID NO: 8535523 - DNA, 22 bp, Homo sapiens
agggtggcagttactggagcaa

SEQ ID NO: 8535524 - DNA, 22 bp, Homo sapiens
cctgcctgcgtcctctgagggc

SEQ ID NO: 8535525 - DNA, 22 bp, Homo sapiens
cctgcctgcgtcctctgagggc

SEQ ID NO: 8535526 - DNA, 22 bp, Homo sapiens
agggtggcagttactggagcaa

SEQ ID NO: 8535527 - DNA, 22 bp, Homo sapiens
agggtggcagttactggagcaa

SEQ ID NO: 8535528 - DNA, 22 bp, Homo sapiens
agggtggcagttactggagcaa

SEQ ID NO: 8535529 - DNA, 23 bp, Homo sapiens
agggtgagcaagctatggagacc

SEQ ID NO: 8535530 - DNA, 23 bp, Homo sapiens
agggtgagcaagctatggagacc

SEQ ID NO: 8535531 - DNA, 22 bp, Homo sapiens
aggggcttgtggagttgctggt

SEQ ID NO: 8535532 - DNA, 22 bp, Homo sapiens
aggggctgtggaaaccaactct

SEQ ID NO: 8535533 - DNA, 22 bp, Homo sapiens
agggtggagggagtccctgagc

SEQ ID NO: 8535534 - DNA, 22 bp, Homo sapiens
agggtggaagatggcactatct

SEQ ID NO: 8535535 - DNA, 21 bp, Homo sapiens
cctggactaaaaccaggccac

SEQ ID NO: 8535536 - DNA, 18 bp, Homo sapiens
cctggacctgtctccttt

SEQ ID NO: 8535537 - DNA, 22 bp, Homo sapiens
cctggagcaggagctgcagagg

SEQ ID NO: 8535538 - DNA, 22 bp, Homo sapiens
cctggactcagaggtgctggtg

SEQ ID NO: 8535539 - DNA, 22 bp, Homo sapiens
cctggactaaaatcttttctta

SEQ ID NO: 8535540 - DNA, 22 bp, Homo sapiens
cctggagcactctccctggctg

SEQ ID NO: 8535541 - DNA, 22 bp, Homo sapiens
cctggagcaggagctgcagagg

SEQ ID NO: 8535542 - DNA, 22 bp, Homo sapiens
cctggagcaggagctgcagagg

SEQ ID NO: 8535543 - DNA, 22 bp, Homo sapiens
cctggagcaggagctgcagagg

SEQ ID NO: 8535544 - DNA, 22 bp, Homo sapiens
cctggagcatcaggaggaaggg

SEQ ID NO: 8535545 - DNA, 22 bp, Homo sapiens
cctggagcccaaggcagtgaga

SEQ ID NO: 8535546 - DNA, 22 bp, Homo sapiens
cctggagcccaaggcagtgaga

SEQ ID NO: 8535547 - DNA, 22 bp, Homo sapiens
cctgcctggctgtcagcagagc

SEQ ID NO: 8535548 - DNA, 22 bp, Homo sapiens
cctgcctggctgtcagcagagc

SEQ ID NO: 8535549 - DNA, 22 bp, Homo sapiens
cctgcctggcccaccttgccac

SEQ ID NO: 8535550 - DNA, 22 bp, Homo sapiens
cctgcctggcccaccttgccac

SEQ ID NO: 8535551 - DNA, 22 bp, Homo sapiens
cctgcctggcacatagtactct

SEQ ID NO: 8535552 - DNA, 22 bp, Homo sapiens
cctgcctggatcagccatcctg

SEQ ID NO: 8535553 - DNA, 22 bp, Homo sapiens
cctgcctggcccaccttgccac

SEQ ID NO: 8535554 - DNA, 22 bp, Homo sapiens
cctgcctggatcagccatcctg

SEQ ID NO: 8535555 - DNA, 22 bp, Homo sapiens
cctgcctggcacatagtactct

SEQ ID NO: 8535556 - DNA, 22 bp, Homo sapiens
cctgcctggagctgagtgtgga

SEQ ID NO: 8535557 - DNA, 22 bp, Homo sapiens
cctgcctggagctgagtgtgga

SEQ ID NO: 8535558 - DNA, 22 bp, Homo sapiens
cctgcctggagctgagtgtgga

SEQ ID NO: 8535559 - DNA, 22 bp, Homo sapiens
cctgcctggatcagccatcctg

SEQ ID NO: 8535560 - DNA, 22 bp, Homo sapiens
cctgcctggatcagccatcctg

SEQ ID NO: 8535561 - DNA, 22 bp, Homo sapiens
cctgcctggatcagccatcctg

SEQ ID NO: 8535562 - DNA, 22 bp, Homo sapiens
cctgcctgctttctgctttgca

SEQ ID NO: 8535563 - DNA, 22 bp, Homo sapiens
cctgcctgcgtcctctgagggc

SEQ ID NO: 8535564 - DNA, 22 bp, Homo sapiens
cctgcctgctttctgctttgca

SEQ ID NO: 8535565 - DNA, 22 bp, Homo sapiens
cctgcctgctttctgctttgca

SEQ ID NO: 8535566 - DNA, 22 bp, Homo sapiens
cctgcctgctttctgctttgca

SEQ ID NO: 8535567 - DNA, 22 bp, Homo sapiens
cctggtcagagcagtcaggatc

SEQ ID NO: 8535568 - DNA, 22 bp, Homo sapiens
cctggtcaggtaactgggctga

SEQ ID NO: 8535569 - DNA, 22 bp, Homo sapiens
cctggtcaggtaactgggctga

SEQ ID NO: 8535570 - DNA, 22 bp, Homo sapiens
cctggtcccattgcggctgcct

SEQ ID NO: 8535571 - DNA, 22 bp, Homo sapiens
cctggtcacccctctctctgca

SEQ ID NO: 8535572 - DNA, 22 bp, Homo sapiens
cctgggtgtcatgggcagctgg

SEQ ID NO: 8535573 - DNA, 22 bp, Homo sapiens
cctgggtgtcatgggcagctgg

SEQ ID NO: 8535574 - DNA, 22 bp, Homo sapiens
aggtggagttggctgtagttca

SEQ ID NO: 8535575 - DNA, 22 bp, Homo sapiens
aggtggagttggctgtagttca

SEQ ID NO: 8535576 - DNA, 22 bp, Homo sapiens
aggtggagttaagtgtgaactg

SEQ ID NO: 8535577 - DNA, 22 bp, Homo sapiens
aggtgcttggctcgtgcacaca

SEQ ID NO: 8535578 - DNA, 22 bp, Homo sapiens
aggtgcttggctcgtgcacaca

SEQ ID NO: 8535579 - DNA, 23 bp, Homo sapiens
aggtggagctgtgcagccggggc

SEQ ID NO: 8535580 - DNA, 23 bp, Homo sapiens
aggtggagctgtgcagccggggc

SEQ ID NO: 8535581 - DNA, 22 bp, Homo sapiens
aggtggagtgaaggaaaggcag

SEQ ID NO: 8535582 - DNA, 22 bp, Homo sapiens
aggtggagtgaaggaaaggcag

SEQ ID NO: 8535583 - DNA, 21 bp, Homo sapiens
aggtggagtgcttagcatcca

SEQ ID NO: 8535584 - DNA, 22 bp, Homo sapiens
aggtggagtgtgcagggagagc

SEQ ID NO: 8535585 - DNA, 22 bp, Homo sapiens
aggtggagtgtgcagggagagc

SEQ ID NO: 8535586 - DNA, 22 bp, Homo sapiens
aggtggagtgtgcagggagagc

SEQ ID NO: 8535587 - DNA, 22 bp, Homo sapiens
aggtggagtgtgcagggagagc

SEQ ID NO: 8535588 - DNA, 22 bp, Homo sapiens
cctgggcaggtgtggcttcccc

SEQ ID NO: 8535589 - DNA, 22 bp, Homo sapiens
cctgggcaggtgtggcttcccc

SEQ ID NO: 8535590 - DNA, 22 bp, Homo sapiens
cctgggcaggtgtggcttcccc

SEQ ID NO: 8535591 - DNA, 22 bp, Homo sapiens
cctgggcagggctggactctca

SEQ ID NO: 8535592 - DNA, 22 bp, Homo sapiens
cctgggcagggctggactctca

SEQ ID NO: 8535593 - DNA, 22 bp, Homo sapiens
cctgggcaggtgtggcttcccc

SEQ ID NO: 8535594 - DNA, 22 bp, Homo sapiens
cctgggcaggtgtggcttcccc

SEQ ID NO: 8535595 - DNA, 22 bp, Homo sapiens
cctgggcagtgctggagttgaa

SEQ ID NO: 8535596 - DNA, 22 bp, Homo sapiens
cctgggcagtgctggagttgaa

SEQ ID NO: 8535597 - DNA, 22 bp, Homo sapiens
cctgggcagggagaccaggctc

SEQ ID NO: 8535598 - DNA, 22 bp, Homo sapiens
cctgggcaggccggacgctggg

SEQ ID NO: 8535599 - DNA, 22 bp, Homo sapiens
cctgggcaggccggacgctggg

SEQ ID NO: 8535600 - DNA, 22 bp, Homo sapiens
cctgggcaggatgggcccggtg

SEQ ID NO: 8535601 - DNA, 22 bp, Homo sapiens
cctgggcaggccggacgctggg

SEQ ID NO: 8535602 - DNA, 22 bp, Homo sapiens
cctgggcagggctggactctca

SEQ ID NO: 8535603 - DNA, 22 bp, Homo sapiens
cctgggcagggctggactctca

SEQ ID NO: 8535604 - DNA, 22 bp, Homo sapiens
cctgggcagggagaccaggctc

SEQ ID NO: 8535605 - DNA, 22 bp, Homo sapiens
cctgggcagggagaccaggctc

SEQ ID NO: 8535606 - DNA, 19 bp, Homo sapiens
aggtgatgtgactctagaa

SEQ ID NO: 8535607 - DNA, 22 bp, Homo sapiens
aggtgatgtccacagcttgcag

SEQ ID NO: 8535608 - DNA, 22 bp, Homo sapiens
aggtgataagtgttaaataaag

SEQ ID NO: 8535609 - DNA, 22 bp, Homo sapiens
aggtgagttacaggaggaggtc

SEQ ID NO: 8535610 - DNA, 22 bp, Homo sapiens
aggtgagtcctgggcacaggta

SEQ ID NO: 8535611 - DNA, 22 bp, Homo sapiens
aggtgagtcctgggcacaggta

SEQ ID NO: 8535612 - DNA, 22 bp, Homo sapiens
aggtgagtcctgggcacaggta

SEQ ID NO: 8535613 - DNA, 22 bp, Homo sapiens
aggtgagtgtgactgcaagaga

SEQ ID NO: 8535614 - DNA, 22 bp, Homo sapiens
aggtgcacctgagggtgtcatc

SEQ ID NO: 8535615 - DNA, 22 bp, Homo sapiens
aggtgcagaaaaaagtccttta

SEQ ID NO: 8535616 - DNA, 22 bp, Homo sapiens
aggtgcactgtctaattaggtc

SEQ ID NO: 8535617 - DNA, 22 bp, Homo sapiens
aggtgcagaaaaaagtccttta

SEQ ID NO: 8535618 - DNA, 22 bp, Homo sapiens
cctgggcaggatgggcccggtg

SEQ ID NO: 8535619 - DNA, 22 bp, Homo sapiens
cctgggcagcctgctcaaggac

SEQ ID NO: 8535620 - DNA, 21 bp, Homo sapiens
aggtgcagagccagggaccag

SEQ ID NO: 8535621 - DNA, 22 bp, Homo sapiens
aggtctggtgagagcaggtgct

SEQ ID NO: 8535622 - DNA, 22 bp, Homo sapiens
aggtctggtgagagcaggtgct

SEQ ID NO: 8535623 - DNA, 22 bp, Homo sapiens
aggtctgggcaccactggctgc

SEQ ID NO: 8535624 - DNA, 22 bp, Homo sapiens
aggtctgggagttcattccctg

SEQ ID NO: 8535625 - DNA, 22 bp, Homo sapiens
aggtctgggattgaagacatca

SEQ ID NO: 8535626 - DNA, 23 bp, Homo sapiens
aggtctggacccttggcccctgc

SEQ ID NO: 8535627 - DNA, 23 bp, Homo sapiens
aggtctggacccttggcccctgc

SEQ ID NO: 8535628 - DNA, 22 bp, Homo sapiens
aggtctggctcttctccacaga

SEQ ID NO: 8535629 - DNA, 22 bp, Homo sapiens
aggtctggctcttctccacaga

SEQ ID NO: 8535630 - DNA, 22 bp, Homo sapiens
aggtctggagtgggatctgaga

SEQ ID NO: 8535631 - DNA, 18 bp, Homo sapiens
aggtctgtggtcaccagg

SEQ ID NO: 8535632 - DNA, 19 bp, Homo sapiens
aggtgaggggcaccatgtc

SEQ ID NO: 8535633 - DNA, 22 bp, Homo sapiens
aggtctggtgggctttagattg

SEQ ID NO: 8535634 - DNA, 22 bp, Homo sapiens
aggtctggtgttgggcctgaaa

SEQ ID NO: 8535635 - DNA, 19 bp, Homo sapiens
aggtgaggggcaccatgtc

SEQ ID NO: 8535636 - DNA, 22 bp, Homo sapiens
aggtgaggtttgggaggtgtca

SEQ ID NO: 8535637 - DNA, 22 bp, Homo sapiens
aggtgaggtttgggaggtgtca

SEQ ID NO: 8535638 - DNA, 22 bp, Homo sapiens
aggtgagggtgccagtgcatgg

SEQ ID NO: 8535639 - DNA, 22 bp, Homo sapiens
aggtgagggtgccagtgcatgg

SEQ ID NO: 8535640 - DNA, 22 bp, Homo sapiens
aggtgagggtgccagtgcatgg

SEQ ID NO: 8535641 - DNA, 20 bp, Homo sapiens
aggtctgaatgtcagggctg

SEQ ID NO: 8535642 - DNA, 22 bp, Homo sapiens
aggtctgactctttgccacata

SEQ ID NO: 8535643 - DNA, 20 bp, Homo sapiens
aggtctgaatgtcagggctg

SEQ ID NO: 8535644 - DNA, 22 bp, Homo sapiens
aggtctgacttcaagcctgtgg

SEQ ID NO: 8535645 - DNA, 22 bp, Homo sapiens
aggtctgagagccgctttcccc

SEQ ID NO: 8535646 - DNA, 22 bp, Homo sapiens
aggtctcttgctgtctctgggc

SEQ ID NO: 8535647 - DNA, 22 bp, Homo sapiens
aggtctgaaagcctcagtcaca

SEQ ID NO: 8535648 - DNA, 22 bp, Homo sapiens
aggtcctgtccttggtctctga

SEQ ID NO: 8535649 - DNA, 22 bp, Homo sapiens
aggtattattagcatctctatt

SEQ ID NO: 8535650 - DNA, 22 bp, Homo sapiens
aggtattattagcatctctatt

SEQ ID NO: 8535651 - DNA, 22 bp, Homo sapiens
aggtattattagcatctctatt

SEQ ID NO: 8535652 - DNA, 22 bp, Homo sapiens
aggtatgccaattaggtcaagt

SEQ ID NO: 8535653 - DNA, 22 bp, Homo sapiens
aggtatggcataaatcacaggg

SEQ ID NO: 8535654 - DNA, 22 bp, Homo sapiens
aggtatgtgctattgttatatt

SEQ ID NO: 8535655 - DNA, 22 bp, Homo sapiens
aggtctgagctcagggcctggc

SEQ ID NO: 8535656 - DNA, 22 bp, Homo sapiens
aggtctgagctccttcctctga

SEQ ID NO: 8535657 - DNA, 18 bp, Homo sapiens
aggtctgaggaagagcct

SEQ ID NO: 8535658 - DNA, 22 bp, Homo sapiens
aggtctgagctccttcctctga

SEQ ID NO: 8535659 - DNA, 22 bp, Homo sapiens
aggtctgagctcagggcctggc

SEQ ID NO: 8535660 - DNA, 22 bp, Homo sapiens
aggtctgagcaggggagaacag

SEQ ID NO: 8535661 - DNA, 22 bp, Homo sapiens
aggtctgagaactacctatagg

SEQ ID NO: 8535662 - DNA, 17 bp, Homo sapiens
aggtctgagagtatctg

SEQ ID NO: 8535663 - DNA, 22 bp, Homo sapiens
aggtctgagtagagaaaaggca

SEQ ID NO: 8535664 - DNA, 22 bp, Homo sapiens
aggtctgagtatggcctgagaa

SEQ ID NO: 8535665 - DNA, 22 bp, Homo sapiens
aggtctgagtagagaaaaggca

SEQ ID NO: 8535666 - DNA, 22 bp, Homo sapiens
aggtctggaaacagcagggaga

SEQ ID NO: 8535667 - DNA, 22 bp, Homo sapiens
aggtctgcctcactcacttctg

SEQ ID NO: 8535668 - DNA, 22 bp, Homo sapiens
aggtctgattttttattcccag

SEQ ID NO: 8535669 - DNA, 22 bp, Homo sapiens
aggtctgatcatgggcccactt

SEQ ID NO: 8535670 - DNA, 20 bp, Homo sapiens
aggtctgattccagaatcag

SEQ ID NO: 8535671 - DNA, 22 bp, Homo sapiens
aggtctgatatttgttgtatga

SEQ ID NO: 8535672 - DNA, 22 bp, Homo sapiens
aggtctgagtttgttgttggct

SEQ ID NO: 8535673 - DNA, 22 bp, Homo sapiens
aggtctgagtctatatacattg

SEQ ID NO: 8535674 - DNA, 22 bp, Homo sapiens
aggtctgagtatggcctgagaa

SEQ ID NO: 8535675 - DNA, 22 bp, Homo sapiens
aggtctgagtcccaggggtacc

SEQ ID NO: 8535676 - DNA, 22 bp, Homo sapiens
aggtctgagtatggcctgagaa

SEQ ID NO: 8535677 - DNA, 22 bp, Homo sapiens
cagctgagaagtgatagctgca

SEQ ID NO: 8535678 - DNA, 22 bp, Homo sapiens
cagctgagaccagaatgcaggt

SEQ ID NO: 8535679 - DNA, 22 bp, Homo sapiens
cagctgagaccagaatgcaggt

SEQ ID NO: 8535680 - DNA, 22 bp, Homo sapiens
cagctgagaagtgatagctgca

SEQ ID NO: 8535681 - DNA, 22 bp, Homo sapiens
cagctgagaaaggcaggctcac

SEQ ID NO: 8535682 - DNA, 22 bp, Homo sapiens
cagctgagaaaggcaggctcac

SEQ ID NO: 8535683 - DNA, 22 bp, Homo sapiens
cagctgagagtagaaatggagg

SEQ ID NO: 8535684 - DNA, 23 bp, Homo sapiens
agctgaggctgtgggtgtcagag

SEQ ID NO: 8535685 - DNA, 22 bp, Homo sapiens
cagctgagaccagaatgcaggt

SEQ ID NO: 8535686 - DNA, 22 bp, Homo sapiens
agctgattccactttttcccca

SEQ ID NO: 8535687 - DNA, 22 bp, Homo sapiens
agctgattccactttttcccca

SEQ ID NO: 8535688 - DNA, 22 bp, Homo sapiens
agctgattccactttttcccca

SEQ ID NO: 8535689 - DNA, 22 bp, Homo sapiens
agctgagggcaggatggggtga

SEQ ID NO: 8535690 - DNA, 22 bp, Homo sapiens
agctgcactgtgaagttcatag

SEQ ID NO: 8535691 - DNA, 22 bp, Homo sapiens
cagctctggttcctgggcccag

SEQ ID NO: 8535692 - DNA, 22 bp, Homo sapiens
cagctctgggtgacaggagggc

SEQ ID NO: 8535693 - DNA, 22 bp, Homo sapiens
cagctctgggtgacaggagggc

SEQ ID NO: 8535694 - DNA, 22 bp, Homo sapiens
cagctctgggtgacaggagggc

SEQ ID NO: 8535695 - DNA, 22 bp, Homo sapiens
cagctctggggcagagtgacta

SEQ ID NO: 8535696 - DNA, 20 bp, Homo sapiens
cagctctgggcaggtcgagg

SEQ ID NO: 8535697 - DNA, 22 bp, Homo sapiens
cagctctggttcctgggcccag

SEQ ID NO: 8535698 - DNA, 22 bp, Homo sapiens
cagctctgtaaattccttcatc

SEQ ID NO: 8535699 - DNA, 22 bp, Homo sapiens
cagctctgtaaattccttcatc

SEQ ID NO: 8535700 - DNA, 22 bp, Homo sapiens
cagctgaaggtaggaaccagga

SEQ ID NO: 8535701 - DNA, 22 bp, Homo sapiens
cagctgaattcttcagactcca

SEQ ID NO: 8535702 - DNA, 22 bp, Homo sapiens
cagctgaatggctccctgctaa

SEQ ID NO: 8535703 - DNA, 19 bp, Homo sapiens
agctgcagaccagaagtgc

SEQ ID NO: 8535704 - DNA, 20 bp, Homo sapiens
agctgcagaacccactggac

SEQ ID NO: 8535705 - DNA, 18 bp, Homo sapiens
agctgcagaccaggaggt

SEQ ID NO: 8535706 - DNA, 18 bp, Homo sapiens
agctgcagaccaggaggt

SEQ ID NO: 8535707 - DNA, 19 bp, Homo sapiens
agctgcagaccagaagtgc

SEQ ID NO: 8535708 - DNA, 22 bp, Homo sapiens
agctgcagataggatgttattt

SEQ ID NO: 8535709 - DNA, 22 bp, Homo sapiens
agctgcagaggtttgtgcaaca

SEQ ID NO: 8535710 - DNA, 22 bp, Homo sapiens
agctgcagaggtttgtgcaaca

SEQ ID NO: 8535711 - DNA, 18 bp, Homo sapiens
agctgcagaccaggaggt

SEQ ID NO: 8535712 - DNA, 22 bp, Homo sapiens
agctgcagcactccagtagccg

SEQ ID NO: 8535713 - DNA, 22 bp, Homo sapiens
agctgcagcactccagtagccg

SEQ ID NO: 8535714 - DNA, 22 bp, Homo sapiens
agctgcagattctatctagaag

SEQ ID NO: 8535715 - DNA, 22 bp, Homo sapiens
agctgcagattctatctagaag

SEQ ID NO: 8535716 - DNA, 22 bp, Homo sapiens
caggaagagaacatggaggctg

SEQ ID NO: 8535717 - DNA, 22 bp, Homo sapiens
agctgcagcactccagtagccg

SEQ ID NO: 8535718 - DNA, 22 bp, Homo sapiens
agctgcagcactccagtagccg

SEQ ID NO: 8535719 - DNA, 22 bp, Homo sapiens
caggaaggaccgtccagatcag

SEQ ID NO: 8535720 - DNA, 22 bp, Homo sapiens
caggaaggaccgtccagatcag

SEQ ID NO: 8535721 - DNA, 22 bp, Homo sapiens
agctgcagttagccccagatga

SEQ ID NO: 8535722 - DNA, 22 bp, Homo sapiens
caggaaggggctcactctggcc

SEQ ID NO: 8535723 - DNA, 22 bp, Homo sapiens
agctgcagtcaagctgggccac

SEQ ID NO: 8535724 - DNA, 22 bp, Homo sapiens
agctgccacagagcctggccag

SEQ ID NO: 8535725 - DNA, 22 bp, Homo sapiens
agctgccacatgcccaagggca

SEQ ID NO: 8535726 - DNA, 22 bp, Homo sapiens
agctgccaagtttctcagttta

SEQ ID NO: 8535727 - DNA, 22 bp, Homo sapiens
agctgccacagagcctggccag

SEQ ID NO: 8535728 - DNA, 22 bp, Homo sapiens
agctgccaagttggagtagcaa

SEQ ID NO: 8535729 - DNA, 22 bp, Homo sapiens
agctgccaagttggagtagcaa

SEQ ID NO: 8535730 - DNA, 22 bp, Homo sapiens
caggaaggcccacctgtcctgt

SEQ ID NO: 8535731 - DNA, 22 bp, Homo sapiens
caggaaggcccacctgtcctgt

SEQ ID NO: 8535732 - DNA, 22 bp, Homo sapiens
caggaaggcccacctgtcctgt

SEQ ID NO: 8535733 - DNA, 22 bp, Homo sapiens
caggaaggggctcactctggcc

SEQ ID NO: 8535734 - DNA, 19 bp, Homo sapiens
caggaaggggcgaatctgg

SEQ ID NO: 8535735 - DNA, 22 bp, Homo sapiens
caggaaggcgcggctgtgcctg

SEQ ID NO: 8535736 - DNA, 22 bp, Homo sapiens
caggaggaggtgaggtagaact

SEQ ID NO: 8535737 - DNA, 22 bp, Homo sapiens
caggaggagcattagcgtctca

SEQ ID NO: 8535738 - DNA, 22 bp, Homo sapiens
agctgctgagccatgtcctgct

SEQ ID NO: 8535739 - DNA, 22 bp, Homo sapiens
agctgctgagccatgtcctgct

SEQ ID NO: 8535740 - DNA, 22 bp, Homo sapiens
caggaggattgcttgaggccag

SEQ ID NO: 8535741 - DNA, 22 bp, Homo sapiens
caggaggattgcttgaggccag

SEQ ID NO: 8535742 - DNA, 22 bp, Homo sapiens
caggaggattgcttgaggccag

SEQ ID NO: 8535743 - DNA, 22 bp, Homo sapiens
caggaggattgcttgaggccag

SEQ ID NO: 8535744 - DNA, 22 bp, Homo sapiens
caggagccccaggctgacaata

SEQ ID NO: 8535745 - DNA, 22 bp, Homo sapiens
caggagccccaggctgacaata

SEQ ID NO: 8535746 - DNA, 22 bp, Homo sapiens
agctgccactgagggtgcacag

SEQ ID NO: 8535747 - DNA, 22 bp, Homo sapiens
agctgccacatggtgtcactgt

SEQ ID NO: 8535748 - DNA, 21 bp, Homo sapiens
agctgccaccctagcttctga

SEQ ID NO: 8535749 - DNA, 22 bp, Homo sapiens
agctgccacctctgcctttggg

SEQ ID NO: 8535750 - DNA, 21 bp, Homo sapiens
agctgccaccctagcttctga

SEQ ID NO: 8535751 - DNA, 22 bp, Homo sapiens
caggaggagcattagcgtctca

SEQ ID NO: 8535752 - DNA, 22 bp, Homo sapiens
caggaggagcattagcgtctca

SEQ ID NO: 8535753 - DNA, 22 bp, Homo sapiens
caggaggacatactggctcaca

SEQ ID NO: 8535754 - DNA, 22 bp, Homo sapiens
caggaggacatactggctcaca

SEQ ID NO: 8535755 - DNA, 19 bp, Homo sapiens
agctgctggcccagggacc

SEQ ID NO: 8535756 - DNA, 22 bp, Homo sapiens
agctgctgcggaaagatgccac

SEQ ID NO: 8535757 - DNA, 22 bp, Homo sapiens
caggcactggccagtcagcaca

SEQ ID NO: 8535758 - DNA, 22 bp, Homo sapiens
caggcactgcactaccactttt

SEQ ID NO: 8535759 - DNA, 22 bp, Homo sapiens
caggcacactgtctacactgag

SEQ ID NO: 8535760 - DNA, 22 bp, Homo sapiens
caggcacactgtctacactgag

SEQ ID NO: 8535761 - DNA, 22 bp, Homo sapiens
caggcactgtgctagatccttg

SEQ ID NO: 8535762 - DNA, 22 bp, Homo sapiens
caggccaggctgcatttgcccc

SEQ ID NO: 8535763 - DNA, 22 bp, Homo sapiens
caggccaggctgcatttgcccc

SEQ ID NO: 8535764 - DNA, 22 bp, Homo sapiens
caggccagggagaatatgaagc

SEQ ID NO: 8535765 - DNA, 22 bp, Homo sapiens
agctgggctggagctccaagcg

SEQ ID NO: 8535766 - DNA, 22 bp, Homo sapiens
agctgggctggagctccaagcg

SEQ ID NO: 8535767 - DNA, 22 bp, Homo sapiens
agctgggctgggctgagctgag

SEQ ID NO: 8535768 - DNA, 22 bp, Homo sapiens
agctgggcttggccaggtcgct

SEQ ID NO: 8535769 - DNA, 22 bp, Homo sapiens
agctgggcttggccaggtcgct

SEQ ID NO: 8535770 - DNA, 19 bp, Homo sapiens
agctgggcttactcactcg

SEQ ID NO: 8535771 - DNA, 19 bp, Homo sapiens
agctgggctgtcacagtga

SEQ ID NO: 8535772 - DNA, 19 bp, Homo sapiens
agctgggctgtcacagtga

SEQ ID NO: 8535773 - DNA, 22 bp, Homo sapiens
agctgggctgggctgagctgag

SEQ ID NO: 8535774 - DNA, 22 bp, Homo sapiens
caggccagagtccaactccaga

SEQ ID NO: 8535775 - DNA, 22 bp, Homo sapiens
caggccagagtccaactccaga

SEQ ID NO: 8535776 - DNA, 22 bp, Homo sapiens
caggccagcagggcctccgtgg

SEQ ID NO: 8535777 - DNA, 22 bp, Homo sapiens
caggccagcggcccgcgcgttc

SEQ ID NO: 8535778 - DNA, 22 bp, Homo sapiens
caggccagcagggcctccgtgg

SEQ ID NO: 8535779 - DNA, 22 bp, Homo sapiens
caggccagcagggcctccgtgg

SEQ ID NO: 8535780 - DNA, 22 bp, Homo sapiens
caggccagcagggcctccgtgg

SEQ ID NO: 8535781 - DNA, 22 bp, Homo sapiens
caggccagcagggcctccgtgg

SEQ ID NO: 8535782 - DNA, 22 bp, Homo sapiens
caggccaggctgcatttgcccc

SEQ ID NO: 8535783 - DNA, 22 bp, Homo sapiens
caggccagcttcctgacatcct

SEQ ID NO: 8535784 - DNA, 22 bp, Homo sapiens
caggccaggctgcatttgcccc

SEQ ID NO: 8535785 - DNA, 22 bp, Homo sapiens
caggccagcttcctgacatcct

SEQ ID NO: 8535786 - DNA, 22 bp, Homo sapiens
caggccagcttcctgacatcct

SEQ ID NO: 8535787 - DNA, 22 bp, Homo sapiens
caggccagcttcctgacatcct

SEQ ID NO: 8535788 - DNA, 22 bp, Homo sapiens
caggccagcgtccagaacaagc

SEQ ID NO: 8535789 - DNA, 22 bp, Homo sapiens
caggccagcgtccagaacaagc

SEQ ID NO: 8535790 - DNA, 22 bp, Homo sapiens
caggccagcttcctgacatcct

SEQ ID NO: 8535791 - DNA, 22 bp, Homo sapiens
caggcactgtgctgagctctgc

SEQ ID NO: 8535792 - DNA, 22 bp, Homo sapiens
caggcactgtgctgagctctgc

SEQ ID NO: 8535793 - DNA, 22 bp, Homo sapiens
agctggccattgtgagtggcct

SEQ ID NO: 8535794 - DNA, 22 bp, Homo sapiens
agctggccattgtgagtggcct

SEQ ID NO: 8535795 - DNA, 22 bp, Homo sapiens
agctggccattgtgagtggcct

SEQ ID NO: 8535796 - DNA, 20 bp, Homo sapiens
agctggcccacaggtgtggg

SEQ ID NO: 8535797 - DNA, 20 bp, Homo sapiens
agctggcccacaggtgtggg

SEQ ID NO: 8535798 - DNA, 22 bp, Homo sapiens
agctggcccactgtgtggtcca

SEQ ID NO: 8535799 - DNA, 22 bp, Homo sapiens
agctggcccactgtgtggtcca

SEQ ID NO: 8535800 - DNA, 22 bp, Homo sapiens
agctggccctcgagagccaatt

SEQ ID NO: 8535801 - DNA, 20 bp, Homo sapiens
agctggcccccggtggcctg

SEQ ID NO: 8535802 - DNA, 22 bp, Homo sapiens
agctggccggcctccaggtgga

SEQ ID NO: 8535803 - DNA, 22 bp, Homo sapiens
agctggccggcctccaggtgga

SEQ ID NO: 8535804 - DNA, 18 bp, Homo sapiens
agctggccctggctgccg

SEQ ID NO: 8535805 - DNA, 18 bp, Homo sapiens
agctggccctggctgccg

SEQ ID NO: 8535806 - DNA, 18 bp, Homo sapiens
agctggccctggctgccg

SEQ ID NO: 8535807 - DNA, 18 bp, Homo sapiens
agctggccctggctgccg

SEQ ID NO: 8535808 - DNA, 18 bp, Homo sapiens
agctggccctggctgccg

SEQ ID NO: 8535809 - DNA, 22 bp, Homo sapiens
agctggccctcgagagccaatt

SEQ ID NO: 8535810 - DNA, 18 bp, Homo sapiens
agctggccctggctgccg

SEQ ID NO: 8535811 - DNA, 20 bp, Homo sapiens
caggcagtttgtggttaggg

SEQ ID NO: 8535812 - DNA, 22 bp, Homo sapiens
agctggcctccgggtgcctggg

SEQ ID NO: 8535813 - DNA, 22 bp, Homo sapiens
agctggcctcactgcagaatgc

SEQ ID NO: 8535814 - DNA, 22 bp, Homo sapiens
agctggcctccgggtgcctggg

SEQ ID NO: 8535815 - DNA, 20 bp, Homo sapiens
caggccagaggtttgatggc

SEQ ID NO: 8535816 - DNA, 22 bp, Homo sapiens
caggtgaggctgaacagatgaa

SEQ ID NO: 8535817 - DNA, 22 bp, Homo sapiens
caggtgaggctgaacagatgaa

SEQ ID NO: 8535818 - DNA, 22 bp, Homo sapiens
caggtgaggctgaacagatgaa

SEQ ID NO: 8535819 - DNA, 22 bp, Homo sapiens
caggtgagtttgctattgtaca

SEQ ID NO: 8535820 - DNA, 22 bp, Homo sapiens
caggtgaggctgaacagatgaa

SEQ ID NO: 8535821 - DNA, 22 bp, Homo sapiens
caggtgagctctatctagggag

SEQ ID NO: 8535822 - DNA, 22 bp, Homo sapiens
caggtgagctctatctagggag

SEQ ID NO: 8535823 - DNA, 20 bp, Homo sapiens
caggtgagcagatctgggtg

SEQ ID NO: 8535824 - DNA, 22 bp, Homo sapiens
caggtgagaggcggtcctgcat

SEQ ID NO: 8535825 - DNA, 22 bp, Homo sapiens
caggtcctttagtgtccagaac

SEQ ID NO: 8535826 - DNA, 22 bp, Homo sapiens
caggtgaccctctcacctgctt

SEQ ID NO: 8535827 - DNA, 22 bp, Homo sapiens
caggtgaccctctcacctgctt

SEQ ID NO: 8535828 - DNA, 22 bp, Homo sapiens
caggtcctggcatcaggcaggt

SEQ ID NO: 8535829 - DNA, 22 bp, Homo sapiens
cagggtgcgccactcagatgta

SEQ ID NO: 8535830 - DNA, 22 bp, Homo sapiens
cagggtgcgccactcagatgta

SEQ ID NO: 8535831 - DNA, 22 bp, Homo sapiens
cagggtgcgccactcagatgta

SEQ ID NO: 8535832 - DNA, 22 bp, Homo sapiens
cagggtgcctcccgctcgccgg

SEQ ID NO: 8535833 - DNA, 22 bp, Homo sapiens
cagggtgccaaagaacaaatat

SEQ ID NO: 8535834 - DNA, 22 bp, Homo sapiens
cagggtgcctcccgctcgccgg

SEQ ID NO: 8535835 - DNA, 22 bp, Homo sapiens
cagggtgcctctgctcccacca

SEQ ID NO: 8535836 - DNA, 22 bp, Homo sapiens
cagggtgcctgtcctcagcaaa

SEQ ID NO: 8535837 - DNA, 22 bp, Homo sapiens
cagggtgcctgtcctcagcaaa

SEQ ID NO: 8535838 - DNA, 22 bp, Homo sapiens
caggggctgtggcacatggtgt

SEQ ID NO: 8535839 - DNA, 22 bp, Homo sapiens
caggggctgagaaggaacgtcc

SEQ ID NO: 8535840 - DNA, 22 bp, Homo sapiens
caggggctgtggcacatggtgt

SEQ ID NO: 8535841 - DNA, 22 bp, Homo sapiens
caggggctgtggcacatggtgt

SEQ ID NO: 8535842 - DNA, 22 bp, Homo sapiens
caggggctgaaatgttggggtt

SEQ ID NO: 8535843 - DNA, 22 bp, Homo sapiens
caggggctgaaatgttggggtt

SEQ ID NO: 8535844 - DNA, 22 bp, Homo sapiens
caggggctccctgggtgccagt

SEQ ID NO: 8535845 - DNA, 22 bp, Homo sapiens
caggggctccctgggtgccagt

SEQ ID NO: 8535846 - DNA, 22 bp, Homo sapiens
caggggctctaatgcatgatca

SEQ ID NO: 8535847 - DNA, 22 bp, Homo sapiens
caggggctctgggtgatgtgag

SEQ ID NO: 8535848 - DNA, 22 bp, Homo sapiens
caggggctctgagattgtctaa

SEQ ID NO: 8535849 - DNA, 22 bp, Homo sapiens
caggggctctaatgcatgatca

SEQ ID NO: 8535850 - DNA, 22 bp, Homo sapiens
cagggtgactgccctggccact

SEQ ID NO: 8535851 - DNA, 22 bp, Homo sapiens
cagggtgactgccctggccact

SEQ ID NO: 8535852 - DNA, 22 bp, Homo sapiens
cagggtgagcctctggagccct

SEQ ID NO: 8535853 - DNA, 22 bp, Homo sapiens
cagggtgagtgggaagcagcgt

SEQ ID NO: 8535854 - DNA, 22 bp, Homo sapiens
cagggtgcatacccatgcatac

SEQ ID NO: 8535855 - DNA, 22 bp, Homo sapiens
cagggtgcatacccatgcatac

SEQ ID NO: 8535856 - DNA, 22 bp, Homo sapiens
cagggtgcagtgtcgctgctag

SEQ ID NO: 8535857 - DNA, 22 bp, Homo sapiens
cagggtgagtgggaagcagcgt

SEQ ID NO: 8535858 - DNA, 22 bp, Homo sapiens
cagggtcttggcgccatcaccc

SEQ ID NO: 8535859 - DNA, 22 bp, Homo sapiens
caggggctgtttgcctcaggcc

SEQ ID NO: 8535860 - DNA, 22 bp, Homo sapiens
caggggctgtgggcggagcctc

SEQ ID NO: 8535861 - DNA, 22 bp, Homo sapiens
caggggctgtgggcggagcctc

SEQ ID NO: 8535862 - DNA, 22 bp, Homo sapiens
caggggctgtgggcggagcctc

SEQ ID NO: 8535863 - DNA, 22 bp, Homo sapiens
caggggctgtttgcctcaggcc

SEQ ID NO: 8535864 - DNA, 22 bp, Homo sapiens
cagggcctctcatcccacgggc

SEQ ID NO: 8535865 - DNA, 22 bp, Homo sapiens
cagggcctctcctccaggaact

SEQ ID NO: 8535866 - DNA, 22 bp, Homo sapiens
cagggcctcgaagcctctgggc

SEQ ID NO: 8535867 - DNA, 22 bp, Homo sapiens
cagggcctcgaagcctctgggc

SEQ ID NO: 8535868 - DNA, 22 bp, Homo sapiens
cagggcctgcaagagacctggg

SEQ ID NO: 8535869 - DNA, 22 bp, Homo sapiens
cagggcctgagggctgctctgc

SEQ ID NO: 8535870 - DNA, 22 bp, Homo sapiens
cagggatgtctctggaagggag

SEQ ID NO: 8535871 - DNA, 22 bp, Homo sapiens
cagggatgtctctggaagggag

SEQ ID NO: 8535872 - DNA, 22 bp, Homo sapiens
cagggatgtctctggaagggag

SEQ ID NO: 8535873 - DNA, 22 bp, Homo sapiens
cagggatgtctctggaagggag

SEQ ID NO: 8535874 - DNA, 22 bp, Homo sapiens
cagggcctcctaaggcatctaa

SEQ ID NO: 8535875 - DNA, 22 bp, Homo sapiens
cagggcctcctaaggcatctaa

SEQ ID NO: 8535876 - DNA, 22 bp, Homo sapiens
cagggcctccccggcagtcttt

SEQ ID NO: 8535877 - DNA, 23 bp, Homo sapiens
cagggccaggcagcagctgtcac

SEQ ID NO: 8535878 - DNA, 22 bp, Homo sapiens
cagggctcgctcgctcgctcgc

SEQ ID NO: 8535879 - DNA, 22 bp, Homo sapiens
cagggctcgctcgctcgctcgc

SEQ ID NO: 8535880 - DNA, 22 bp, Homo sapiens
cagggctcccttgcaaggaggg

SEQ ID NO: 8535881 - DNA, 22 bp, Homo sapiens
cagggctcgctgccagcttcag

SEQ ID NO: 8535882 - DNA, 22 bp, Homo sapiens
cagggctcgctgccagcttcag

SEQ ID NO: 8535883 - DNA, 22 bp, Homo sapiens
cagggctctgccttgagggatg

SEQ ID NO: 8535884 - DNA, 22 bp, Homo sapiens
cagggcttgccttgccccggcg

SEQ ID NO: 8535885 - DNA, 22 bp, Homo sapiens
caggggcggtggctcacgcctg

SEQ ID NO: 8535886 - DNA, 22 bp, Homo sapiens
caggggctagcacttaatgttt

SEQ ID NO: 8535887 - DNA, 22 bp, Homo sapiens
caggggctccctgggtgccagt

SEQ ID NO: 8535888 - DNA, 22 bp, Homo sapiens
caggggctccctgggtgccagt

SEQ ID NO: 8535889 - DNA, 22 bp, Homo sapiens
caggggctccctgggtgccagt

SEQ ID NO: 8535890 - DNA, 22 bp, Homo sapiens
cagggctccccagagagcctct

SEQ ID NO: 8535891 - DNA, 22 bp, Homo sapiens
cagggctccccagagagcctct

SEQ ID NO: 8535892 - DNA, 22 bp, Homo sapiens
cagggctccccgcaccgcagcc

SEQ ID NO: 8535893 - DNA, 22 bp, Homo sapiens
cagggctccccgcaccgcagcc

SEQ ID NO: 8535894 - DNA, 22 bp, Homo sapiens
cagggcctgcaagagacctggg

SEQ ID NO: 8535895 - DNA, 22 bp, Homo sapiens
cagggcctgcctggttcctgga

SEQ ID NO: 8535896 - DNA, 22 bp, Homo sapiens
cagggctccctgcagcctctgt

SEQ ID NO: 8535897 - DNA, 22 bp, Homo sapiens
cagggctcccttgcaaggaggg

SEQ ID NO: 8535898 - DNA, 22 bp, Homo sapiens
cagggctccctctggctcccag

SEQ ID NO: 8535899 - DNA, 22 bp, Homo sapiens
cagggctccctctggctcccag

SEQ ID NO: 8535900 - DNA, 22 bp, Homo sapiens
cagggagaaatctccaggaggt

SEQ ID NO: 8535901 - DNA, 22 bp, Homo sapiens
cagggagcggagtcccatgcct

SEQ ID NO: 8535902 - DNA, 22 bp, Homo sapiens
caggctggagttacctttaggg

SEQ ID NO: 8535903 - DNA, 22 bp, Homo sapiens
caggctggagttacctttaggg

SEQ ID NO: 8535904 - DNA, 22 bp, Homo sapiens
caggctggagtgcagttgtgca

SEQ ID NO: 8535905 - DNA, 22 bp, Homo sapiens
caggctggagtgcagtgtcgcc

SEQ ID NO: 8535906 - DNA, 22 bp, Homo sapiens
caggctggagtgcagttgtgca

SEQ ID NO: 8535907 - DNA, 22 bp, Homo sapiens
caggctggagtgcagttgtgca

SEQ ID NO: 8535908 - DNA, 22 bp, Homo sapiens
caggctggagtgcagttgtgca

SEQ ID NO: 8535909 - DNA, 22 bp, Homo sapiens
caggctggagttacctttaggg

SEQ ID NO: 8535910 - DNA, 22 bp, Homo sapiens
caggctggagtacaattgtgtg

SEQ ID NO: 8535911 - DNA, 22 bp, Homo sapiens
caggctggacattagatacata

SEQ ID NO: 8535912 - DNA, 22 bp, Homo sapiens
caggctggagtgcagtgtcgcc

SEQ ID NO: 8535913 - DNA, 22 bp, Homo sapiens
caggctggagtgcagtgtcgcc

SEQ ID NO: 8535914 - DNA, 22 bp, Homo sapiens
caggctggagtgcagtggtgcc

SEQ ID NO: 8535915 - DNA, 22 bp, Homo sapiens
caggctggagtgcagtggtgcc

SEQ ID NO: 8535916 - DNA, 22 bp, Homo sapiens
caggctggagtgcagtggtgcc

SEQ ID NO: 8535917 - DNA, 22 bp, Homo sapiens
cagggagctgacaaccaaggag

SEQ ID NO: 8535918 - DNA, 22 bp, Homo sapiens
cagggagctctgggccggactc

SEQ ID NO: 8535919 - DNA, 22 bp, Homo sapiens
cagggagctggctggcgtgagt

SEQ ID NO: 8535920 - DNA, 22 bp, Homo sapiens
cagggagctggctggcgtgagt

SEQ ID NO: 8535921 - DNA, 22 bp, Homo sapiens
cagggagctggctggcgtgagt

SEQ ID NO: 8535922 - DNA, 22 bp, Homo sapiens
cagggagctggctggctgtgcc

SEQ ID NO: 8535923 - DNA, 19 bp, Homo sapiens
cagggatgggtagggactc

SEQ ID NO: 8535924 - DNA, 19 bp, Homo sapiens
cagggatgggtagggactc

SEQ ID NO: 8535925 - DNA, 22 bp, Homo sapiens
cagggatgggatggagtcagtt

SEQ ID NO: 8535926 - DNA, 22 bp, Homo sapiens
cagggatgggatggagtcagtt

SEQ ID NO: 8535927 - DNA, 22 bp, Homo sapiens
cagggatgggatggagtcagtt

SEQ ID NO: 8535928 - DNA, 22 bp, Homo sapiens
cagggatggcgctggctgcccg

SEQ ID NO: 8535929 - DNA, 22 bp, Homo sapiens
cagggatgggatggagtcagtt

SEQ ID NO: 8535930 - DNA, 22 bp, Homo sapiens
agctgtgctgccaagttgctga

SEQ ID NO: 8535931 - DNA, 22 bp, Homo sapiens
agctgtggaaatcaggcaatga

SEQ ID NO: 8535932 - DNA, 22 bp, Homo sapiens
agctgtggaagactgtcagggt

SEQ ID NO: 8535933 - DNA, 22 bp, Homo sapiens
agctgtggcagcactttggagt

SEQ ID NO: 8535934 - DNA, 22 bp, Homo sapiens
caggctgagctctggcctgggc

SEQ ID NO: 8535935 - DNA, 22 bp, Homo sapiens
agctgtggaagactgtcagggt

SEQ ID NO: 8535936 - DNA, 22 bp, Homo sapiens
agctgtggaagactgtcagggt

SEQ ID NO: 8535937 - DNA, 19 bp, Homo sapiens
agctgtggatgtgggattt

SEQ ID NO: 8535938 - DNA, 22 bp, Homo sapiens
agctgtggagtagggggttgga

SEQ ID NO: 8535939 - DNA, 22 bp, Homo sapiens
caggctgcggccgtgtgagcat

SEQ ID NO: 8535940 - DNA, 22 bp, Homo sapiens
caggctgcggccgtgtgagcat

SEQ ID NO: 8535941 - DNA, 22 bp, Homo sapiens
caggctgcggccgtgtgagcat

SEQ ID NO: 8535942 - DNA, 22 bp, Homo sapiens
caggctgagctctggcctgggc

SEQ ID NO: 8535943 - DNA, 22 bp, Homo sapiens
caggctgaggcagtagggtttg

SEQ ID NO: 8535944 - DNA, 22 bp, Homo sapiens
caggctgagctctggcctgggc

SEQ ID NO: 8535945 - DNA, 22 bp, Homo sapiens
caggctgcggtcggctctggtc

SEQ ID NO: 8535946 - DNA, 22 bp, Homo sapiens
caggctgcggtcggctctggtc

SEQ ID NO: 8535947 - DNA, 22 bp, Homo sapiens
caggctgcggtcggctctggtc

SEQ ID NO: 8535948 - DNA, 22 bp, Homo sapiens
caggctgcggtcggctctggtc

SEQ ID NO: 8535949 - DNA, 22 bp, Homo sapiens
caggctgctccagggtaggaaa

SEQ ID NO: 8535950 - DNA, 22 bp, Homo sapiens
caggctcactgtaaggtcagct

SEQ ID NO: 8535951 - DNA, 22 bp, Homo sapiens
caggctcactttctcagtcaca

SEQ ID NO: 8535952 - DNA, 22 bp, Homo sapiens
caggctcactgtaaggtcagct

SEQ ID NO: 8535953 - DNA, 22 bp, Homo sapiens
caggctcactgtaaggtcagct

SEQ ID NO: 8535954 - DNA, 22 bp, Homo sapiens
caggctcactgtaaggtcagct

SEQ ID NO: 8535955 - DNA, 18 bp, Homo sapiens
agctggggcctctggtcc

SEQ ID NO: 8535956 - DNA, 22 bp, Homo sapiens
caggctcagctctggccagtgc

SEQ ID NO: 8535957 - DNA, 22 bp, Homo sapiens
agctgtgaccttcaagagctac

SEQ ID NO: 8535958 - DNA, 22 bp, Homo sapiens
agctgtgattatccactggaat

SEQ ID NO: 8535959 - DNA, 22 bp, Homo sapiens
aggacctgagagttggaaatcc

SEQ ID NO: 8535960 - DNA, 22 bp, Homo sapiens
aggacctgactggctcctgctt

SEQ ID NO: 8535961 - DNA, 22 bp, Homo sapiens
aggacctgactggctcctgctt

SEQ ID NO: 8535962 - DNA, 22 bp, Homo sapiens
aggacctggatcacagagatct

SEQ ID NO: 8535963 - DNA, 22 bp, Homo sapiens
aggacctttggcaaggctgctc

SEQ ID NO: 8535964 - DNA, 22 bp, Homo sapiens
aggacctgtacctcagcatcta

SEQ ID NO: 8535965 - DNA, 22 bp, Homo sapiens
aggacctgtagggcctgcatcc

SEQ ID NO: 8535966 - DNA, 22 bp, Homo sapiens
aggaccttggaataacaaattc

SEQ ID NO: 8535967 - DNA, 22 bp, Homo sapiens
aggacccacgcacaggaacccc

SEQ ID NO: 8535968 - DNA, 22 bp, Homo sapiens
aggacccacgcacaggaacccc

SEQ ID NO: 8535969 - DNA, 22 bp, Homo sapiens
aggacccagaggcagaggacgt

SEQ ID NO: 8535970 - DNA, 22 bp, Homo sapiens
aggaccctgagcgggcatgccg

SEQ ID NO: 8535971 - DNA, 22 bp, Homo sapiens
aggaccagtatgagagcatctg

SEQ ID NO: 8535972 - DNA, 22 bp, Homo sapiens
aggaccagtgagtctggcaagt

SEQ ID NO: 8535973 - DNA, 22 bp, Homo sapiens
aggacccaagcacagttcctgg

SEQ ID NO: 8535974 - DNA, 22 bp, Homo sapiens
aggaccagaggccagagtcagc

SEQ ID NO: 8535975 - DNA, 22 bp, Homo sapiens
aggaccagaccgaactagctaa

SEQ ID NO: 8535976 - DNA, 22 bp, Homo sapiens
aggaccagcctccaggtctctt

SEQ ID NO: 8535977 - DNA, 22 bp, Homo sapiens
aggaccagcctccaggtctctt

SEQ ID NO: 8535978 - DNA, 22 bp, Homo sapiens
aggacaggattgagctgaactg

SEQ ID NO: 8535979 - DNA, 22 bp, Homo sapiens
aggacaggattgagctgaactg

SEQ ID NO: 8535980 - DNA, 22 bp, Homo sapiens
aggacaggattgagctgaactg

SEQ ID NO: 8535981 - DNA, 22 bp, Homo sapiens
aggacatgtaaatggagaggga

SEQ ID NO: 8535982 - DNA, 22 bp, Homo sapiens
aggacatgtgcctccagggcag

SEQ ID NO: 8535983 - DNA, 22 bp, Homo sapiens
aggaccaacatagcagcagtgg

SEQ ID NO: 8535984 - DNA, 22 bp, Homo sapiens
caggtgggagcggagactgatt

SEQ ID NO: 8535985 - DNA, 22 bp, Homo sapiens
caggtgggagcggagactgatt

SEQ ID NO: 8535986 - DNA, 22 bp, Homo sapiens
caggtgggagcgaggagctact

SEQ ID NO: 8535987 - DNA, 22 bp, Homo sapiens
caggtgggagcgaggagctact

SEQ ID NO: 8535988 - DNA, 22 bp, Homo sapiens
caggtgggaccatgatagggca

SEQ ID NO: 8535989 - DNA, 22 bp, Homo sapiens
caggtgggaccatgatagggca

SEQ ID NO: 8535990 - DNA, 22 bp, Homo sapiens
caggtgggagccacagcgtaca

SEQ ID NO: 8535991 - DNA, 22 bp, Homo sapiens
caggtggcttctccctaggcca

SEQ ID NO: 8535992 - DNA, 22 bp, Homo sapiens
caggtggcttctccctaggcca

SEQ ID NO: 8535993 - DNA, 22 bp, Homo sapiens
caggtggcttctccctaggcca

SEQ ID NO: 8535994 - DNA, 22 bp, Homo sapiens
caggtgccatagacgggcctgg

SEQ ID NO: 8535995 - DNA, 22 bp, Homo sapiens
caggtgcagctggatggaagcc

SEQ ID NO: 8535996 - DNA, 22 bp, Homo sapiens
cagtgcctcaggccagcctgca

SEQ ID NO: 8535997 - DNA, 22 bp, Homo sapiens
cagtgcccttccaggactgcag

SEQ ID NO: 8535998 - DNA, 19 bp, Homo sapiens
cagtgcccgacgcaggtct

SEQ ID NO: 8535999 - DNA, 22 bp, Homo sapiens
cagtgcccgccgccgttcctgg

SEQ ID NO: 8536000 - DNA, 19 bp, Homo sapiens
cagtgcccgacgcaggtct

SEQ ID NO: 8536001 - DNA, 20 bp, Homo sapiens
cagtgcccgtggaaaagatg

SEQ ID NO: 8536002 - DNA, 22 bp, Homo sapiens
cagtgccctcatctatgaaatc

SEQ ID NO: 8536003 - DNA, 19 bp, Homo sapiens
aggactctggaggcatgag

SEQ ID NO: 8536004 - DNA, 22 bp, Homo sapiens
aggactccatgtgtcctggaga

SEQ ID NO: 8536005 - DNA, 22 bp, Homo sapiens
aggactaatttcaggggatata

SEQ ID NO: 8536006 - DNA, 22 bp, Homo sapiens
cagtgcctcttaagtgtcaccc

SEQ ID NO: 8536007 - DNA, 22 bp, Homo sapiens
cagtgcctcaggccagcctgca

SEQ ID NO: 8536008 - DNA, 22 bp, Homo sapiens
cagtgcctgtgggcttcttcca

SEQ ID NO: 8536009 - DNA, 22 bp, Homo sapiens
cagtgcctgggacccggctgtg

SEQ ID NO: 8536010 - DNA, 22 bp, Homo sapiens
cagtgcctggccggcttccatt

SEQ ID NO: 8536011 - DNA, 22 bp, Homo sapiens
cagtgctcctgatgtacccttg

SEQ ID NO: 8536012 - DNA, 21 bp, Homo sapiens
cagtgctcaatctgacagtgg

SEQ ID NO: 8536013 - DNA, 22 bp, Homo sapiens
cagtgctataatccagtgtcgt

SEQ ID NO: 8536014 - DNA, 22 bp, Homo sapiens
aggagaagtaaggctagatgat

SEQ ID NO: 8536015 - DNA, 22 bp, Homo sapiens
aggagaagtaaggctagatgat

SEQ ID NO: 8536016 - DNA, 22 bp, Homo sapiens
aggagaagtaaggctagatgat

SEQ ID NO: 8536017 - DNA, 22 bp, Homo sapiens
aggagaaggaggcccctcacac

SEQ ID NO: 8536018 - DNA, 22 bp, Homo sapiens
aggagaagtaaggctagatgat

SEQ ID NO: 8536019 - DNA, 22 bp, Homo sapiens
aggagaaggaagtgcatcacta

SEQ ID NO: 8536020 - DNA, 22 bp, Homo sapiens
aggagaaggaagtgcatcacta

SEQ ID NO: 8536021 - DNA, 22 bp, Homo sapiens
aggagaaggaagtgcatcacta

SEQ ID NO: 8536022 - DNA, 22 bp, Homo sapiens
aggagaaggaagtgcatcacta

SEQ ID NO: 8536023 - DNA, 22 bp, Homo sapiens
aggagaaggaagtgcatcacta

SEQ ID NO: 8536024 - DNA, 22 bp, Homo sapiens
aggagaagtaaggctagatgat

SEQ ID NO: 8536025 - DNA, 19 bp, Homo sapiens
aggagaagtagcagaaatt

SEQ ID NO: 8536026 - DNA, 19 bp, Homo sapiens
aggagaagtagcagaaatt

SEQ ID NO: 8536027 - DNA, 19 bp, Homo sapiens
aggagaagtagcagaaatt

SEQ ID NO: 8536028 - DNA, 22 bp, Homo sapiens
cagtggccatggtggcaggggt

SEQ ID NO: 8536029 - DNA, 22 bp, Homo sapiens
cagtggccatggtggcaggggt

SEQ ID NO: 8536030 - DNA, 22 bp, Homo sapiens
cagtggcctctggctttgctgt

SEQ ID NO: 8536031 - DNA, 17 bp, Homo sapiens
cagtggcctatggcttt

SEQ ID NO: 8536032 - DNA, 22 bp, Homo sapiens
cagtggcctgagccaggcttcc

SEQ ID NO: 8536033 - DNA, 22 bp, Homo sapiens
cagtggcctgagccaggcttcc

SEQ ID NO: 8536034 - DNA, 19 bp, Homo sapiens
cagtggcctggaggtctct

SEQ ID NO: 8536035 - DNA, 22 bp, Homo sapiens
cagtggccttgatgcctcattc

SEQ ID NO: 8536036 - DNA, 18 bp, Homo sapiens
cagtggcatagttgagta

SEQ ID NO: 8536037 - DNA, 22 bp, Homo sapiens
cagtggagaggcatgcttggca

SEQ ID NO: 8536038 - DNA, 22 bp, Homo sapiens
cagtggcatggttgactgcagt

SEQ ID NO: 8536039 - DNA, 22 bp, Homo sapiens
cagtggccaacttcctgcctct

SEQ ID NO: 8536040 - DNA, 22 bp, Homo sapiens
aggagggagcttaagccaggca

SEQ ID NO: 8536041 - DNA, 22 bp, Homo sapiens
catatttattcttctgccagtg

SEQ ID NO: 8536042 - DNA, 22 bp, Homo sapiens
catatttattcttctgccagtg

SEQ ID NO: 8536043 - DNA, 22 bp, Homo sapiens
catatttcagtctaagatgtgt

SEQ ID NO: 8536044 - DNA, 22 bp, Homo sapiens
catatttcagtctaagatgtgt

SEQ ID NO: 8536045 - DNA, 21 bp, Homo sapiens
aggaggctgtctctttcagct

SEQ ID NO: 8536046 - DNA, 22 bp, Homo sapiens
catatttatagatctggcattt

SEQ ID NO: 8536047 - DNA, 22 bp, Homo sapiens
catatttagtgtttggagatcg

SEQ ID NO: 8536048 - DNA, 22 bp, Homo sapiens
catatttagtgtttggagatcg

SEQ ID NO: 8536049 - DNA, 22 bp, Homo sapiens
catattgtaaaaggttgaatcc

SEQ ID NO: 8536050 - DNA, 22 bp, Homo sapiens
catattagcctccactgggaca

SEQ ID NO: 8536051 - DNA, 22 bp, Homo sapiens
catattagacacttatgtccac

SEQ ID NO: 8536052 - DNA, 22 bp, Homo sapiens
catattaaggtctgtaaggggt

SEQ ID NO: 8536053 - DNA, 22 bp, Homo sapiens
catattgtaaaaggttgaatcc

SEQ ID NO: 8536054 - DNA, 22 bp, Homo sapiens
catattctgttggtcacataga

SEQ ID NO: 8536055 - DNA, 22 bp, Homo sapiens
catattcaaggggtaaggcaaa

SEQ ID NO: 8536056 - DNA, 22 bp, Homo sapiens
catacattacctaacttaatgc

SEQ ID NO: 8536057 - DNA, 22 bp, Homo sapiens
cagttttatacactgcagctcc

SEQ ID NO: 8536058 - DNA, 22 bp, Homo sapiens
cagttttatacactgcagctcc

SEQ ID NO: 8536059 - DNA, 22 bp, Homo sapiens
cagttttatcatctgtgaaatg

SEQ ID NO: 8536060 - DNA, 22 bp, Homo sapiens
cagttttatcatctgtgaaatg

SEQ ID NO: 8536061 - DNA, 22 bp, Homo sapiens
catagacattcagcactcacta

SEQ ID NO: 8536062 - DNA, 22 bp, Homo sapiens
catagagtgatgtaaggtatgt

SEQ ID NO: 8536063 - DNA, 22 bp, Homo sapiens
catagagtgatgtaaggtatgt

SEQ ID NO: 8536064 - DNA, 22 bp, Homo sapiens
catagaggctaaaattatttgg

SEQ ID NO: 8536065 - DNA, 22 bp, Homo sapiens
catagcaaggtgctttccacat

SEQ ID NO: 8536066 - DNA, 22 bp, Homo sapiens
catagcaacagcatcaagtcaa

SEQ ID NO: 8536067 - DNA, 22 bp, Homo sapiens
catagcaagatcacattctgta

SEQ ID NO: 8536068 - DNA, 22 bp, Homo sapiens
catagcaacagcatcaagtcaa

SEQ ID NO: 8536069 - DNA, 22 bp, Homo sapiens
catataaatacaacatgtgtta

SEQ ID NO: 8536070 - DNA, 22 bp, Homo sapiens
catagtgtctggtaacatagta

SEQ ID NO: 8536071 - DNA, 22 bp, Homo sapiens
catagttataaggcaacactgt

SEQ ID NO: 8536072 - DNA, 22 bp, Homo sapiens
catagttataaggcaacactgt

SEQ ID NO: 8536073 - DNA, 22 bp, Homo sapiens
catataaatacaacatgtgtta

SEQ ID NO: 8536074 - DNA, 22 bp, Homo sapiens
catataaatacaacatgtgtta

SEQ ID NO: 8536075 - DNA, 22 bp, Homo sapiens
cataggtcactgtacaggttaa

SEQ ID NO: 8536076 - DNA, 22 bp, Homo sapiens
catagtaaataatgcagatgat

SEQ ID NO: 8536077 - DNA, 22 bp, Homo sapiens
cataggaagccatctcagtcac

SEQ ID NO: 8536078 - DNA, 22 bp, Homo sapiens
cataggaaaagcattcttcttg

SEQ ID NO: 8536079 - DNA, 22 bp, Homo sapiens
catagcggtattccacgtggtt

SEQ ID NO: 8536080 - DNA, 22 bp, Homo sapiens
catagcggtattccacgtggtt

SEQ ID NO: 8536081 - DNA, 22 bp, Homo sapiens
catagcggtattccacgtggtt

SEQ ID NO: 8536082 - DNA, 22 bp, Homo sapiens
cagttttagggcaatgtgaaga

SEQ ID NO: 8536083 - DNA, 22 bp, Homo sapiens
cagttttagggcaatgtgaaga

SEQ ID NO: 8536084 - DNA, 22 bp, Homo sapiens
cagttttagctagagcaaacca

SEQ ID NO: 8536085 - DNA, 22 bp, Homo sapiens
cagttttagctagagcaaacca

SEQ ID NO: 8536086 - DNA, 22 bp, Homo sapiens
cagtttctctcaataagcatcg

SEQ ID NO: 8536087 - DNA, 22 bp, Homo sapiens
cagtttctctcaataagcatcg

SEQ ID NO: 8536088 - DNA, 22 bp, Homo sapiens
cagttttaaattttgaatgtct

SEQ ID NO: 8536089 - DNA, 22 bp, Homo sapiens
cagtttctacgaaggtcaaccc

SEQ ID NO: 8536090 - DNA, 22 bp, Homo sapiens
cagtttctacgacttaagcaca

SEQ ID NO: 8536091 - DNA, 22 bp, Homo sapiens
cagtttctacgacttaagcaca

SEQ ID NO: 8536092 - DNA, 22 bp, Homo sapiens
cagtttctatggctgggctctg

SEQ ID NO: 8536093 - DNA, 22 bp, Homo sapiens
cagtttatttccaagatgacaa

SEQ ID NO: 8536094 - DNA, 19 bp, Homo sapiens
cagtttatgctttggggac

SEQ ID NO: 8536095 - DNA, 22 bp, Homo sapiens
cagtttcagaatcaaaacatca

SEQ ID NO: 8536096 - DNA, 22 bp, Homo sapiens
cagtttccctgcttgaaaacgt

SEQ ID NO: 8536097 - DNA, 22 bp, Homo sapiens
cagtgggtgccatcgtgccctt

SEQ ID NO: 8536098 - DNA, 22 bp, Homo sapiens
cagtgggtgccatcgtgccctt

SEQ ID NO: 8536099 - DNA, 22 bp, Homo sapiens
cagtggcgtgatctctgctcac

SEQ ID NO: 8536100 - DNA, 22 bp, Homo sapiens
cagtggcgtgatctctgctcac

SEQ ID NO: 8536101 - DNA, 22 bp, Homo sapiens
cagtggcgtgatctctgctcac

SEQ ID NO: 8536102 - DNA, 22 bp, Homo sapiens
cagtggcctttcctgctgctca

SEQ ID NO: 8536103 - DNA, 22 bp, Homo sapiens
cagtggctcatgcctataatcc

SEQ ID NO: 8536104 - DNA, 22 bp, Homo sapiens
cagtgggtggctaagtggctga

SEQ ID NO: 8536105 - DNA, 22 bp, Homo sapiens
cagtttatattctagtgctgtt

SEQ ID NO: 8536106 - DNA, 22 bp, Homo sapiens
cagttctggaggatagaagtct

SEQ ID NO: 8536107 - DNA, 22 bp, Homo sapiens
cagttctggaggatagaagtct

SEQ ID NO: 8536108 - DNA, 22 bp, Homo sapiens
cagttctggaggatagaagtct

SEQ ID NO: 8536109 - DNA, 22 bp, Homo sapiens
cagtttatattctagtgctgtt

SEQ ID NO: 8536110 - DNA, 20 bp, Homo sapiens
cagtttatctttccggagct

SEQ ID NO: 8536111 - DNA, 22 bp, Homo sapiens
cagtggttatacttactgtttc

SEQ ID NO: 8536112 - DNA, 22 bp, Homo sapiens
cagtggttatacttactgtttc

SEQ ID NO: 8536113 - DNA, 18 bp, Homo sapiens
cagtggtgctgggatgtg

SEQ ID NO: 8536114 - DNA, 22 bp, Homo sapiens
cagtggtggaatgaggaattgt

SEQ ID NO: 8536115 - DNA, 18 bp, Homo sapiens
cagtggtgctgggatgtg

SEQ ID NO: 8536116 - DNA, 22 bp, Homo sapiens
cagtggtgaagagcaggggctc

SEQ ID NO: 8536117 - DNA, 22 bp, Homo sapiens
cagtggtctgtgcttctgtaca

SEQ ID NO: 8536118 - DNA, 22 bp, Homo sapiens
catgtacattctgtagatggag

SEQ ID NO: 8536119 - DNA, 22 bp, Homo sapiens
catgtacattctgtagatggag

SEQ ID NO: 8536120 - DNA, 22 bp, Homo sapiens
catgtatagacactcatacagt

SEQ ID NO: 8536121 - DNA, 22 bp, Homo sapiens
catgtagtcctaatgctggtga

SEQ ID NO: 8536122 - DNA, 22 bp, Homo sapiens
catgtataggtccatagtgaat

SEQ ID NO: 8536123 - DNA, 22 bp, Homo sapiens
catgtatagttggaactacatc

SEQ ID NO: 8536124 - DNA, 22 bp, Homo sapiens
catgtatagttggaactacatc

SEQ ID NO: 8536125 - DNA, 22 bp, Homo sapiens
catgtatagcaaatatttgttc

SEQ ID NO: 8536126 - DNA, 22 bp, Homo sapiens
catgtatagacactcatacagt

SEQ ID NO: 8536127 - DNA, 18 bp, Homo sapiens
catgggtgacaggtggat

SEQ ID NO: 8536128 - DNA, 21 bp, Homo sapiens
catggggttgctatagcaaaa

SEQ ID NO: 8536129 - DNA, 22 bp, Homo sapiens
catggggtggtgggcaacctca

SEQ ID NO: 8536130 - DNA, 22 bp, Homo sapiens
catgtcacaattcttaatggga

SEQ ID NO: 8536131 - DNA, 22 bp, Homo sapiens
catgtcagggaagagagtcagt

SEQ ID NO: 8536132 - DNA, 22 bp, Homo sapiens
catgtccacagttctgagaggc

SEQ ID NO: 8536133 - DNA, 22 bp, Homo sapiens
catgtattgaagtgtgcatctg

SEQ ID NO: 8536134 - DNA, 22 bp, Homo sapiens
catgtatcttaattgctttgga

SEQ ID NO: 8536135 - DNA, 22 bp, Homo sapiens
catgtatattttatgtggagag

SEQ ID NO: 8536136 - DNA, 22 bp, Homo sapiens
catgtatagttggaactacatc

SEQ ID NO: 8536137 - DNA, 22 bp, Homo sapiens
catgtatatttctgtatgtgca

SEQ ID NO: 8536138 - DNA, 22 bp, Homo sapiens
catggggagacacctagggaaa

SEQ ID NO: 8536139 - DNA, 22 bp, Homo sapiens
catgggcttgctctctgagctc

SEQ ID NO: 8536140 - DNA, 22 bp, Homo sapiens
catgggggtctggacaacaggc

SEQ ID NO: 8536141 - DNA, 22 bp, Homo sapiens
catgggggtctggacaacaggc

SEQ ID NO: 8536142 - DNA, 22 bp, Homo sapiens
catggggatgaggctgagactt

SEQ ID NO: 8536143 - DNA, 23 bp, Homo sapiens
catggggagcagtgctcctgacc

SEQ ID NO: 8536144 - DNA, 22 bp, Homo sapiens
aggatttacaatgattctaggt

SEQ ID NO: 8536145 - DNA, 22 bp, Homo sapiens
aggatttacaatgattctaggt

SEQ ID NO: 8536146 - DNA, 22 bp, Homo sapiens
aggattgtgcctccagtcagaa

SEQ ID NO: 8536147 - DNA, 22 bp, Homo sapiens
catggctgaacactcagtgact

SEQ ID NO: 8536148 - DNA, 22 bp, Homo sapiens
catggctgaacactcagtgact

SEQ ID NO: 8536149 - DNA, 22 bp, Homo sapiens
catggctgaaattcttcgcttg

SEQ ID NO: 8536150 - DNA, 22 bp, Homo sapiens
aggatttgaaatatttagtaaa

SEQ ID NO: 8536151 - DNA, 21 bp, Homo sapiens
aggatttctgtcatttcagat

SEQ ID NO: 8536152 - DNA, 20 bp, Homo sapiens
aggaggggatagaatcaaag

SEQ ID NO: 8536153 - DNA, 20 bp, Homo sapiens
aggaggggatagaatcaaag

SEQ ID NO: 8536154 - DNA, 20 bp, Homo sapiens
aggaggggatagaatcaaag

SEQ ID NO: 8536155 - DNA, 16 bp, Homo sapiens
aggaggggaattagga

SEQ ID NO: 8536156 - DNA, 16 bp, Homo sapiens
aggaggggaattagga

SEQ ID NO: 8536157 - DNA, 16 bp, Homo sapiens
aggaggggaattagga

SEQ ID NO: 8536158 - DNA, 22 bp, Homo sapiens
catgctaaaatatctgaagatt

SEQ ID NO: 8536159 - DNA, 22 bp, Homo sapiens
catgctaaaatatctgaagatt

SEQ ID NO: 8536160 - DNA, 22 bp, Homo sapiens
catgctaaaccagaacatagga

SEQ ID NO: 8536161 - DNA, 20 bp, Homo sapiens
aggaggggatagaatcaaag

SEQ ID NO: 8536162 - DNA, 20 bp, Homo sapiens
aggaggggatagaatcaaag

SEQ ID NO: 8536163 - DNA, 22 bp, Homo sapiens
aggaggggcaatgatagtctgg

SEQ ID NO: 8536164 - DNA, 21 bp, Homo sapiens
aggagggcacaaggccaggaa

SEQ ID NO: 8536165 - DNA, 21 bp, Homo sapiens
aggagggcacaaggccaggaa

SEQ ID NO: 8536166 - DNA, 21 bp, Homo sapiens
aggagggcacaaggccaggaa

SEQ ID NO: 8536167 - DNA, 21 bp, Homo sapiens
aggagggcacaaggccaggaa

SEQ ID NO: 8536168 - DNA, 22 bp, Homo sapiens
aggagggcaggctggctgccta

SEQ ID NO: 8536169 - DNA, 22 bp, Homo sapiens
aggagggcaggctggctgccta

SEQ ID NO: 8536170 - DNA, 22 bp, Homo sapiens
aggagggcaggctggctgccta

SEQ ID NO: 8536171 - DNA, 21 bp, Homo sapiens
aggagggcacaaggccaggaa

SEQ ID NO: 8536172 - DNA, 22 bp, Homo sapiens
aggagggcaggctggctgccta

SEQ ID NO: 8536173 - DNA, 22 bp, Homo sapiens
aggagggctaggaaaaccagga

SEQ ID NO: 8536174 - DNA, 22 bp, Homo sapiens
aggagggctaggaaaaccagga

SEQ ID NO: 8536175 - DNA, 22 bp, Homo sapiens
aggagggcaggctggctgccta

SEQ ID NO: 8536176 - DNA, 22 bp, Homo sapiens
aggagggcaggctggctgccta

SEQ ID NO: 8536177 - DNA, 22 bp, Homo sapiens
catggacagtgggacagtgtgt

SEQ ID NO: 8536178 - DNA, 22 bp, Homo sapiens
catgctaaccagagacataaag

SEQ ID NO: 8536179 - DNA, 22 bp, Homo sapiens
catgctaaccagagacataaag

SEQ ID NO: 8536180 - DNA, 22 bp, Homo sapiens
catggaatgtgagttgtttagt

SEQ ID NO: 8536181 - DNA, 22 bp, Homo sapiens
catggaatggttgaatgacgaa

SEQ ID NO: 8536182 - DNA, 22 bp, Homo sapiens
catggaatggttgaatgacgaa

SEQ ID NO: 8536183 - DNA, 22 bp, Homo sapiens
catggaattttctaggcataaa

SEQ ID NO: 8536184 - DNA, 22 bp, Homo sapiens
catggaattttctaggcataaa

SEQ ID NO: 8536185 - DNA, 22 bp, Homo sapiens
catggaatgtgagttgtttagt

SEQ ID NO: 8536186 - DNA, 22 bp, Homo sapiens
catggatatattgtacagtagc

SEQ ID NO: 8536187 - DNA, 22 bp, Homo sapiens
catggaggccaggaaacagcct

SEQ ID NO: 8536188 - DNA, 22 bp, Homo sapiens
catggatagatgaatgcttaaa

SEQ ID NO: 8536189 - DNA, 22 bp, Homo sapiens
catggaggagttaggtgtgagt

SEQ ID NO: 8536190 - DNA, 22 bp, Homo sapiens
catggcagaaacctgagctgct

SEQ ID NO: 8536191 - DNA, 22 bp, Homo sapiens
catggcagaaacctgagctgct

SEQ ID NO: 8536192 - DNA, 22 bp, Homo sapiens
catggcagaaacctgagctgct

SEQ ID NO: 8536193 - DNA, 22 bp, Homo sapiens
catggcactgagcaggtatgca

SEQ ID NO: 8536194 - DNA, 22 bp, Homo sapiens
catggcactgagcaggtatgca

SEQ ID NO: 8536195 - DNA, 22 bp, Homo sapiens
catggcagaaacctgagctgct

SEQ ID NO: 8536196 - DNA, 22 bp, Homo sapiens
aggatgtgttcatagctgacgc

SEQ ID NO: 8536197 - DNA, 22 bp, Homo sapiens
aggatgtgttttgagctgacta

SEQ ID NO: 8536198 - DNA, 22 bp, Homo sapiens
aggattcatggtgcagacaaag

SEQ ID NO: 8536199 - DNA, 22 bp, Homo sapiens
ccaagctacttaggagtctgag

SEQ ID NO: 8536200 - DNA, 22 bp, Homo sapiens
ccaagctacttaggagtctgag

SEQ ID NO: 8536201 - DNA, 22 bp, Homo sapiens
ccaagctacttaggagtctgag

SEQ ID NO: 8536202 - DNA, 22 bp, Homo sapiens
ccaagctacttaggagtctgag

SEQ ID NO: 8536203 - DNA, 22 bp, Homo sapiens
ccaagcatggggttcagtagga

SEQ ID NO: 8536204 - DNA, 22 bp, Homo sapiens
ccaagcatttctagccagtcac

SEQ ID NO: 8536205 - DNA, 22 bp, Homo sapiens
ccaagatgagctggctccatgg

SEQ ID NO: 8536206 - DNA, 23 bp, Homo sapiens
aggcagcaggttgtccagggtga

SEQ ID NO: 8536207 - DNA, 22 bp, Homo sapiens
aggcagcagggccactggctga

SEQ ID NO: 8536208 - DNA, 22 bp, Homo sapiens
aggcagcagggccactggctga

SEQ ID NO: 8536209 - DNA, 19 bp, Homo sapiens
aggcagcaggccagggatg

SEQ ID NO: 8536210 - DNA, 23 bp, Homo sapiens
aggcagcaggttgtccagggtga

SEQ ID NO: 8536211 - DNA, 22 bp, Homo sapiens
ccaaggtgggcagatcacgagg

SEQ ID NO: 8536212 - DNA, 22 bp, Homo sapiens
ccaagggctgctgaggtgtcca

SEQ ID NO: 8536213 - DNA, 22 bp, Homo sapiens
ccaagggctgctgaggtgtcca

SEQ ID NO: 8536214 - DNA, 22 bp, Homo sapiens
ccaagggctctggacagagtgg

SEQ ID NO: 8536215 - DNA, 22 bp, Homo sapiens
ccaagggctctggacagagtgg

SEQ ID NO: 8536216 - DNA, 22 bp, Homo sapiens
ccaagctggatttagctgcaca

SEQ ID NO: 8536217 - DNA, 23 bp, Homo sapiens
ccaagcttctaatgctgctgagc

SEQ ID NO: 8536218 - DNA, 22 bp, Homo sapiens
ccaagcttctttcctactacag

SEQ ID NO: 8536219 - DNA, 23 bp, Homo sapiens
ccaagcttgtccctgcctgcttt

SEQ ID NO: 8536220 - DNA, 20 bp, Homo sapiens
ccaaggacactggctcctgg

SEQ ID NO: 8536221 - DNA, 22 bp, Homo sapiens
ccaaggactggacacacaggtt

SEQ ID NO: 8536222 - DNA, 22 bp, Homo sapiens
ccaagggctctgacttgcctgc

SEQ ID NO: 8536223 - DNA, 22 bp, Homo sapiens
ccaagggctatttacagaacag

SEQ ID NO: 8536224 - DNA, 22 bp, Homo sapiens
ccaatcctcatgttcaacaacc

SEQ ID NO: 8536225 - DNA, 22 bp, Homo sapiens
ccaatacactttatagaagaaa

SEQ ID NO: 8536226 - DNA, 22 bp, Homo sapiens
ccaagtgatacacccgcctcgg

SEQ ID NO: 8536227 - DNA, 22 bp, Homo sapiens
catttgaaattcttagaacaaa

SEQ ID NO: 8536228 - DNA, 22 bp, Homo sapiens
catttgaaattcttagaacaaa

SEQ ID NO: 8536229 - DNA, 22 bp, Homo sapiens
catttgttaaccagtgtggatt

SEQ ID NO: 8536230 - DNA, 22 bp, Homo sapiens
catttgttaatgctgcttttaa

SEQ ID NO: 8536231 - DNA, 22 bp, Homo sapiens
cattaacaattgtttatgctgt

SEQ ID NO: 8536232 - DNA, 22 bp, Homo sapiens
catttgaaatagttcattcttg

SEQ ID NO: 8536233 - DNA, 22 bp, Homo sapiens
cattaacaatgactgcttgact

SEQ ID NO: 8536234 - DNA, 22 bp, Homo sapiens
cattaacaattgtttatgctgt

SEQ ID NO: 8536235 - DNA, 22 bp, Homo sapiens
cattaacaatgactgcttgact

SEQ ID NO: 8536236 - DNA, 20 bp, Homo sapiens
catttgttagctttctactg

SEQ ID NO: 8536237 - DNA, 22 bp, Homo sapiens
catttgttctgatttcaaaagg

SEQ ID NO: 8536238 - DNA, 22 bp, Homo sapiens
catttgttctgatttcaaaagg

SEQ ID NO: 8536239 - DNA, 20 bp, Homo sapiens
catttgttagctttctactg

SEQ ID NO: 8536240 - DNA, 22 bp, Homo sapiens
catttgttaattactattatct

SEQ ID NO: 8536241 - DNA, 22 bp, Homo sapiens
catttgttaattactattatct

SEQ ID NO: 8536242 - DNA, 17 bp, Homo sapiens
catttgttgatcagttg

SEQ ID NO: 8536243 - DNA, 22 bp, Homo sapiens
catttgttggtcagattgtagt

SEQ ID NO: 8536244 - DNA, 22 bp, Homo sapiens
catttgtttagaagtctttata

SEQ ID NO: 8536245 - DNA, 21 bp, Homo sapiens
aggcagcaggatccagggaca

SEQ ID NO: 8536246 - DNA, 21 bp, Homo sapiens
aggcagcaggatccagggaca

SEQ ID NO: 8536247 - DNA, 21 bp, Homo sapiens
aggcagcaggatccagggaca

SEQ ID NO: 8536248 - DNA, 21 bp, Homo sapiens
aggcagcaggatccagggaca

SEQ ID NO: 8536249 - DNA, 19 bp, Homo sapiens
aggcagcaggccagggatg

SEQ ID NO: 8536250 - DNA, 19 bp, Homo sapiens
aggcagcaggccagggatg

SEQ ID NO: 8536251 - DNA, 19 bp, Homo sapiens
aggcagcaggccagggatg

SEQ ID NO: 8536252 - DNA, 19 bp, Homo sapiens
aggcagcaggccagggatg

SEQ ID NO: 8536253 - DNA, 22 bp, Homo sapiens
aggcactgtgctgatgtcttat

SEQ ID NO: 8536254 - DNA, 22 bp, Homo sapiens
cattaaaatatctcatggtgtt

SEQ ID NO: 8536255 - DNA, 22 bp, Homo sapiens
cattaaaatatctcatggtgtt

SEQ ID NO: 8536256 - DNA, 23 bp, Homo sapiens
catgtttttctatctcagcgtgt

SEQ ID NO: 8536257 - DNA, 22 bp, Homo sapiens
cattaaaatatctcatggtgtt

SEQ ID NO: 8536258 - DNA, 22 bp, Homo sapiens
catgttttgtgtacagaatatt

SEQ ID NO: 8536259 - DNA, 22 bp, Homo sapiens
cattaaatcttccagacctcac

SEQ ID NO: 8536260 - DNA, 22 bp, Homo sapiens
cattaaatatcaacctagacta

SEQ ID NO: 8536261 - DNA, 22 bp, Homo sapiens
cattaaatcttccagacctcac

SEQ ID NO: 8536262 - DNA, 22 bp, Homo sapiens
cattaaacaaccttgaatcaat

SEQ ID NO: 8536263 - DNA, 22 bp, Homo sapiens
cattaaattccttgttctcaaa

SEQ ID NO: 8536264 - DNA, 22 bp, Homo sapiens
cattaaattccttgttctcaaa

SEQ ID NO: 8536265 - DNA, 22 bp, Homo sapiens
cattaacaaatggaagcatgaa

SEQ ID NO: 8536266 - DNA, 22 bp, Homo sapiens
cattaacaatgactgcttgact

SEQ ID NO: 8536267 - DNA, 22 bp, Homo sapiens
agggaaatggagagtgtagttt

SEQ ID NO: 8536268 - DNA, 22 bp, Homo sapiens
agggaaatctttcaacacttca

SEQ ID NO: 8536269 - DNA, 22 bp, Homo sapiens
agggaaataatctattctgagg

SEQ ID NO: 8536270 - DNA, 23 bp, Homo sapiens
agggaaatactgcaatttttgga

SEQ ID NO: 8536271 - DNA, 22 bp, Homo sapiens
agggaaatctcagctctaaaat

SEQ ID NO: 8536272 - DNA, 21 bp, Homo sapiens
agggaaatccagtcacttttc

SEQ ID NO: 8536273 - DNA, 22 bp, Homo sapiens
agggaacagtgaaaggcatcag

SEQ ID NO: 8536274 - DNA, 23 bp, Homo sapiens
agggaacaagcaagctgctagtc

SEQ ID NO: 8536275 - DNA, 20 bp, Homo sapiens
agggaacaatggacgctgtc

SEQ ID NO: 8536276 - DNA, 23 bp, Homo sapiens
agggaacaagcaagctgctagtc

SEQ ID NO: 8536277 - DNA, 22 bp, Homo sapiens
agggaaattaatgtgagcaatg

SEQ ID NO: 8536278 - DNA, 22 bp, Homo sapiens
cccaggagttggaggctgcagt

SEQ ID NO: 8536279 - DNA, 22 bp, Homo sapiens
cccaggagttggaggctgcagt

SEQ ID NO: 8536280 - DNA, 22 bp, Homo sapiens
cccaggagttggaggctgcagt

SEQ ID NO: 8536281 - DNA, 22 bp, Homo sapiens
cccaggagttggaggctgcagt

SEQ ID NO: 8536282 - DNA, 23 bp, Homo sapiens
cccaggagtttcactgcaaaggt

SEQ ID NO: 8536283 - DNA, 22 bp, Homo sapiens
cccaggagtttgagttcagcat

SEQ ID NO: 8536284 - DNA, 22 bp, Homo sapiens
cccaggagtttgagttcagcat

SEQ ID NO: 8536285 - DNA, 22 bp, Homo sapiens
cccaggatgatcgagagtggga

SEQ ID NO: 8536286 - DNA, 22 bp, Homo sapiens
cccaggatcacctggtcaaggg

SEQ ID NO: 8536287 - DNA, 22 bp, Homo sapiens
cccaggagtttgagttcagcat

SEQ ID NO: 8536288 - DNA, 22 bp, Homo sapiens
cccaggagtttgagttcagcat

SEQ ID NO: 8536289 - DNA, 20 bp, Homo sapiens
cccaggagtttgctcttact

SEQ ID NO: 8536290 - DNA, 22 bp, Homo sapiens
cccagggcttttctcactagac

SEQ ID NO: 8536291 - DNA, 22 bp, Homo sapiens
cccagggcttttctcactagac

SEQ ID NO: 8536292 - DNA, 22 bp, Homo sapiens
cccagggcttttctcactagac

SEQ ID NO: 8536293 - DNA, 22 bp, Homo sapiens
cccagggcttgagtcatccatg

SEQ ID NO: 8536294 - DNA, 22 bp, Homo sapiens
cccagggctgcagatggaggct

SEQ ID NO: 8536295 - DNA, 22 bp, Homo sapiens
cccagggctgtagaatgtccaa

SEQ ID NO: 8536296 - DNA, 22 bp, Homo sapiens
cccagggctgtagaatgtccaa

SEQ ID NO: 8536297 - DNA, 22 bp, Homo sapiens
cccaggggaggtcctcagggaa

SEQ ID NO: 8536298 - DNA, 22 bp, Homo sapiens
cccaggggaggtcctcagggaa

SEQ ID NO: 8536299 - DNA, 22 bp, Homo sapiens
cccaggggaggtcctcagggaa

SEQ ID NO: 8536300 - DNA, 22 bp, Homo sapiens
cccaggggaggtcctcagggaa

SEQ ID NO: 8536301 - DNA, 19 bp, Homo sapiens
cccaggggacccagcccta

SEQ ID NO: 8536302 - DNA, 19 bp, Homo sapiens
cccaggggacccagcccta

SEQ ID NO: 8536303 - DNA, 22 bp, Homo sapiens
cccaggggtatccatggagaag

SEQ ID NO: 8536304 - DNA, 22 bp, Homo sapiens
cccaggggtaaggcgcagcgtg

SEQ ID NO: 8536305 - DNA, 22 bp, Homo sapiens
cccaggggtaaggcgcagcgtg

SEQ ID NO: 8536306 - DNA, 22 bp, Homo sapiens
cccaggggtaaggcgcagcgtg

SEQ ID NO: 8536307 - DNA, 22 bp, Homo sapiens
cccaggggaggtcctcagggaa

SEQ ID NO: 8536308 - DNA, 22 bp, Homo sapiens
cccagggctgcagatggaggct

SEQ ID NO: 8536309 - DNA, 22 bp, Homo sapiens
cccagggctgcagatggaggct

SEQ ID NO: 8536310 - DNA, 22 bp, Homo sapiens
cccagggctgcagatggaggct

SEQ ID NO: 8536311 - DNA, 22 bp, Homo sapiens
cccagggccctggacagctaca

SEQ ID NO: 8536312 - DNA, 22 bp, Homo sapiens
cccagggccctggacagctaca

SEQ ID NO: 8536313 - DNA, 22 bp, Homo sapiens
cccagggccctggacagctaca

SEQ ID NO: 8536314 - DNA, 22 bp, Homo sapiens
agggaagaagctggtagtaggt

SEQ ID NO: 8536315 - DNA, 23 bp, Homo sapiens
agggaagaaacatgaagggctgt

SEQ ID NO: 8536316 - DNA, 22 bp, Homo sapiens
cccagggaagccatttctgact

SEQ ID NO: 8536317 - DNA, 23 bp, Homo sapiens
agggaagaaacatgaagggctgt

SEQ ID NO: 8536318 - DNA, 22 bp, Homo sapiens
agggaagaaaatccatcgctgc

SEQ ID NO: 8536319 - DNA, 22 bp, Homo sapiens
aggcttctaggaaactttctgg

SEQ ID NO: 8536320 - DNA, 19 bp, Homo sapiens
aggcttctaccctgtccag

SEQ ID NO: 8536321 - DNA, 22 bp, Homo sapiens
aggcttctaggaaactttctgg

SEQ ID NO: 8536322 - DNA, 22 bp, Homo sapiens
aggctggctggcaggggacaca

SEQ ID NO: 8536323 - DNA, 22 bp, Homo sapiens
aggctggctgagctgcagcctg

SEQ ID NO: 8536324 - DNA, 22 bp, Homo sapiens
aggctggctgagctgcagcctg

SEQ ID NO: 8536325 - DNA, 22 bp, Homo sapiens
aggctggctgacttctgaagca

SEQ ID NO: 8536326 - DNA, 22 bp, Homo sapiens
aggctggctgacttctgaagca

SEQ ID NO: 8536327 - DNA, 22 bp, Homo sapiens
aggcttcctggaggaagaggta

SEQ ID NO: 8536328 - DNA, 22 bp, Homo sapiens
aggcttcctggaggaagaggta

SEQ ID NO: 8536329 - DNA, 22 bp, Homo sapiens
aggcttcctcgtgccttagata

SEQ ID NO: 8536330 - DNA, 21 bp, Homo sapiens
aggcttggatctagacaggcc

SEQ ID NO: 8536331 - DNA, 22 bp, Homo sapiens
cccaggaggtggagcttgcagt

SEQ ID NO: 8536332 - DNA, 22 bp, Homo sapiens
cccaggaggtggagcttgcagt

SEQ ID NO: 8536333 - DNA, 22 bp, Homo sapiens
cccaggaggtggagcttgcagt

SEQ ID NO: 8536334 - DNA, 22 bp, Homo sapiens
cccaggagttggaggctacggt

SEQ ID NO: 8536335 - DNA, 22 bp, Homo sapiens
aggcttctgtgagctcatacaa

SEQ ID NO: 8536336 - DNA, 22 bp, Homo sapiens
aggcttcttctctatgtacaag

SEQ ID NO: 8536337 - DNA, 22 bp, Homo sapiens
aggcttcttctctatgtacaag

SEQ ID NO: 8536338 - DNA, 22 bp, Homo sapiens
aggcttcttgagccccacaggc

SEQ ID NO: 8536339 - DNA, 22 bp, Homo sapiens
aggcttgaaatgaaatctgtaa

SEQ ID NO: 8536340 - DNA, 22 bp, Homo sapiens
aggcttgactgctgattttgcc

SEQ ID NO: 8536341 - DNA, 19 bp, Homo sapiens
aggcttggaacagccttat

SEQ ID NO: 8536342 - DNA, 20 bp, Homo sapiens
agggcagagggattacaggc

SEQ ID NO: 8536343 - DNA, 20 bp, Homo sapiens
agggcagagggattacaggc

SEQ ID NO: 8536344 - DNA, 22 bp, Homo sapiens
ccctggaaggttctctggctca

SEQ ID NO: 8536345 - DNA, 22 bp, Homo sapiens
agggcagaggcggacacggaag

SEQ ID NO: 8536346 - DNA, 22 bp, Homo sapiens
agggcagagctgtctaaatggc

SEQ ID NO: 8536347 - DNA, 22 bp, Homo sapiens
agggcagaggcggacacggaag

SEQ ID NO: 8536348 - DNA, 22 bp, Homo sapiens
ccctggaggaccccaatgtggc

SEQ ID NO: 8536349 - DNA, 22 bp, Homo sapiens
ccctggaggaccccaatgtggc

SEQ ID NO: 8536350 - DNA, 22 bp, Homo sapiens
ccctggaggagcttagagcttg

SEQ ID NO: 8536351 - DNA, 22 bp, Homo sapiens
ccctggaggagcttagagcttg

SEQ ID NO: 8536352 - DNA, 22 bp, Homo sapiens
ccctggaggagcttagagcttg

SEQ ID NO: 8536353 - DNA, 19 bp, Homo sapiens
ccctggaggagtgttggct

SEQ ID NO: 8536354 - DNA, 22 bp, Homo sapiens
ccctggaggagcttagagcttg

SEQ ID NO: 8536355 - DNA, 19 bp, Homo sapiens
ccctggaggagtgttggct

SEQ ID NO: 8536356 - DNA, 22 bp, Homo sapiens
agggcagagatctgagtgggca

SEQ ID NO: 8536357 - DNA, 22 bp, Homo sapiens
agggcagagattaattaagaca

SEQ ID NO: 8536358 - DNA, 22 bp, Homo sapiens
agggcagagatctgagtgggca

SEQ ID NO: 8536359 - DNA, 22 bp, Homo sapiens
agggcagagcactgaattggga

SEQ ID NO: 8536360 - DNA, 22 bp, Homo sapiens
agggcagagattaattaagaca

SEQ ID NO: 8536361 - DNA, 22 bp, Homo sapiens
agggcagagattaattaagaca

SEQ ID NO: 8536362 - DNA, 22 bp, Homo sapiens
agggcagagcactgaattggga

SEQ ID NO: 8536363 - DNA, 22 bp, Homo sapiens
agggcagagagatgaatgggat

SEQ ID NO: 8536364 - DNA, 22 bp, Homo sapiens
agggcagagagatgaatgggat

SEQ ID NO: 8536365 - DNA, 22 bp, Homo sapiens
agggcagagacatgcttcctga

SEQ ID NO: 8536366 - DNA, 22 bp, Homo sapiens
ccctctgcctgcgccctggtgt

SEQ ID NO: 8536367 - DNA, 22 bp, Homo sapiens
ccctctggctcttctcaggccg

SEQ ID NO: 8536368 - DNA, 22 bp, Homo sapiens
ccctctggctcttctcaggccg

SEQ ID NO: 8536369 - DNA, 18 bp, Homo sapiens
ccctcttgcacaaagcaa

SEQ ID NO: 8536370 - DNA, 22 bp, Homo sapiens
ccctctggtttgcccttgggtg

SEQ ID NO: 8536371 - DNA, 22 bp, Homo sapiens
ccctctctgctgcatagaggaa

SEQ ID NO: 8536372 - DNA, 22 bp, Homo sapiens
ccctctgacctcctgccacagt

SEQ ID NO: 8536373 - DNA, 22 bp, Homo sapiens
ccctctgaacctggtagcagaa

SEQ ID NO: 8536374 - DNA, 22 bp, Homo sapiens
ccctctgagacaggtagctcac

SEQ ID NO: 8536375 - DNA, 22 bp, Homo sapiens
ccctctgacctcctgccacagt

SEQ ID NO: 8536376 - DNA, 22 bp, Homo sapiens
ccctctgactgggccagttctg

SEQ ID NO: 8536377 - DNA, 22 bp, Homo sapiens
ccctctctgacttctgaacttg

SEQ ID NO: 8536378 - DNA, 22 bp, Homo sapiens
ccctcccaggagtggccagaga

SEQ ID NO: 8536379 - DNA, 22 bp, Homo sapiens
ccctcccaggagtggccagaga

SEQ ID NO: 8536380 - DNA, 22 bp, Homo sapiens
agggatgggtctaacccagaac

SEQ ID NO: 8536381 - DNA, 22 bp, Homo sapiens
ccctcccaggagtggccagaga

SEQ ID NO: 8536382 - DNA, 22 bp, Homo sapiens
agggatgggtctaacccagaac

SEQ ID NO: 8536383 - DNA, 22 bp, Homo sapiens
agggatgggaactcctccagca

SEQ ID NO: 8536384 - DNA, 22 bp, Homo sapiens
agggagaaggtccatgcctgtc

SEQ ID NO: 8536385 - DNA, 22 bp, Homo sapiens
agggaggagtcctcaaagtcat

SEQ ID NO: 8536386 - DNA, 22 bp, Homo sapiens
agggaggagtcctcaaagtcat

SEQ ID NO: 8536387 - DNA, 22 bp, Homo sapiens
agggaggagtcctcaaagtcat

SEQ ID NO: 8536388 - DNA, 22 bp, Homo sapiens
agggactggctctctgagcagg

SEQ ID NO: 8536389 - DNA, 22 bp, Homo sapiens
agggactcggttgagtgcccct

SEQ ID NO: 8536390 - DNA, 22 bp, Homo sapiens
agggactgagctaggatctagt

SEQ ID NO: 8536391 - DNA, 22 bp, Homo sapiens
agggagaacagttgcagcagac

SEQ ID NO: 8536392 - DNA, 22 bp, Homo sapiens
agggatgatggaaagaagcagg

SEQ ID NO: 8536393 - DNA, 22 bp, Homo sapiens
agggatgatttcagtgtctgcc

SEQ ID NO: 8536394 - DNA, 22 bp, Homo sapiens
agggatggaagacttgaagacc

SEQ ID NO: 8536395 - DNA, 22 bp, Homo sapiens
agggatgctttgctgacagatt

SEQ ID NO: 8536396 - DNA, 22 bp, Homo sapiens
agggatggaagacttgaagacc

SEQ ID NO: 8536397 - DNA, 22 bp, Homo sapiens
agggatggaagacttgaagacc

SEQ ID NO: 8536398 - DNA, 22 bp, Homo sapiens
agggatggagtgcggcccggac

SEQ ID NO: 8536399 - DNA, 22 bp, Homo sapiens
agggatggatcttggccctgga

SEQ ID NO: 8536400 - DNA, 22 bp, Homo sapiens
agggatggagtgcggcccggac

SEQ ID NO: 8536401 - DNA, 22 bp, Homo sapiens
agggatggagtgcggcccggac

SEQ ID NO: 8536402 - DNA, 22 bp, Homo sapiens
agggatggaagctcgtctgcaa

SEQ ID NO: 8536403 - DNA, 22 bp, Homo sapiens
agggatgactcttggctgattc

SEQ ID NO: 8536404 - DNA, 22 bp, Homo sapiens
agggatgatcagggtagaggct

SEQ ID NO: 8536405 - DNA, 19 bp, Homo sapiens
agggatatttaaaaagctc

SEQ ID NO: 8536406 - DNA, 22 bp, Homo sapiens
agggagtgtaaatggtgctcag

SEQ ID NO: 8536407 - DNA, 22 bp, Homo sapiens
agggagtgtaaatggtgctcag

SEQ ID NO: 8536408 - DNA, 22 bp, Homo sapiens
agggagtgtaaatggtgctcag

SEQ ID NO: 8536409 - DNA, 22 bp, Homo sapiens
cctcctggaaaaattccctggc

SEQ ID NO: 8536410 - DNA, 22 bp, Homo sapiens
cctcctggaaaaattccctggc

SEQ ID NO: 8536411 - DNA, 22 bp, Homo sapiens
cctcctggaggctctaagggag

SEQ ID NO: 8536412 - DNA, 22 bp, Homo sapiens
cctcctggagcattggtgagga

SEQ ID NO: 8536413 - DNA, 22 bp, Homo sapiens
cctcctggaaaaattccctggc

SEQ ID NO: 8536414 - DNA, 22 bp, Homo sapiens
cctcctggaggctctagggaaa

SEQ ID NO: 8536415 - DNA, 22 bp, Homo sapiens
agggctgagtgggagagagttg

SEQ ID NO: 8536416 - DNA, 23 bp, Homo sapiens
agggctgatgccattgcagctct

SEQ ID NO: 8536417 - DNA, 23 bp, Homo sapiens
agggctgatgccattgcagctct

SEQ ID NO: 8536418 - DNA, 18 bp, Homo sapiens
agggctgatgagtttggg

SEQ ID NO: 8536419 - DNA, 22 bp, Homo sapiens
cctcctggccctgggcctggaa

SEQ ID NO: 8536420 - DNA, 22 bp, Homo sapiens
agggctgatgcaccatgtagcc

SEQ ID NO: 8536421 - DNA, 22 bp, Homo sapiens
cctctgggcggagatctgctgc

SEQ ID NO: 8536422 - DNA, 16 bp, Homo sapiens
cctctgggcctgcaag

SEQ ID NO: 8536423 - DNA, 22 bp, Homo sapiens
cctctgggcaggtagcagcagc

SEQ ID NO: 8536424 - DNA, 22 bp, Homo sapiens
cctctgggagactgctactgag

SEQ ID NO: 8536425 - DNA, 21 bp, Homo sapiens
cctctggcttgtgctgtgccc

SEQ ID NO: 8536426 - DNA, 22 bp, Homo sapiens
cctctgggaagccagtcctgct

SEQ ID NO: 8536427 - DNA, 22 bp, Homo sapiens
cctctgggaagccagtcctgct

SEQ ID NO: 8536428 - DNA, 18 bp, Homo sapiens
cctctgccatagccagca

SEQ ID NO: 8536429 - DNA, 22 bp, Homo sapiens
cctctggcttactgttgggttt

SEQ ID NO: 8536430 - DNA, 18 bp, Homo sapiens
cctctgccatagccagca

SEQ ID NO: 8536431 - DNA, 19 bp, Homo sapiens
cctctgccagcccgcctct

SEQ ID NO: 8536432 - DNA, 22 bp, Homo sapiens
agggctgcaggcaagatatggc

SEQ ID NO: 8536433 - DNA, 22 bp, Homo sapiens
cctgaggcccctgaggatagca

SEQ ID NO: 8536434 - DNA, 22 bp, Homo sapiens
aggggctgcctggcttggcact

SEQ ID NO: 8536435 - DNA, 22 bp, Homo sapiens
cctgaggcaaggacttggtggc

SEQ ID NO: 8536436 - DNA, 22 bp, Homo sapiens
cctgaggcaaggacttggtggc

SEQ ID NO: 8536437 - DNA, 22 bp, Homo sapiens
cctgaggagattgtggctgggg

SEQ ID NO: 8536438 - DNA, 22 bp, Homo sapiens
cctgaggatgccagcatgggtg

SEQ ID NO: 8536439 - DNA, 22 bp, Homo sapiens
aggggctgggacagagccaagc

SEQ ID NO: 8536440 - DNA, 22 bp, Homo sapiens
aggggctgggacagagccaagc

SEQ ID NO: 8536441 - DNA, 22 bp, Homo sapiens
aggggctgggacagagccaagc

SEQ ID NO: 8536442 - DNA, 22 bp, Homo sapiens
aggggctggcttatctgagagt

SEQ ID NO: 8536443 - DNA, 22 bp, Homo sapiens
aggggctggcttatctgagagt

SEQ ID NO: 8536444 - DNA, 22 bp, Homo sapiens
aggggctggcttatctgagagt

SEQ ID NO: 8536445 - DNA, 22 bp, Homo sapiens
aggggctggcttatctgagagt

SEQ ID NO: 8536446 - DNA, 22 bp, Homo sapiens
aggggctgcctggcttggcact

SEQ ID NO: 8536447 - DNA, 22 bp, Homo sapiens
aggggctgctgggtccgcccct

SEQ ID NO: 8536448 - DNA, 22 bp, Homo sapiens
aggggctgctgggtccgcccct

SEQ ID NO: 8536449 - DNA, 22 bp, Homo sapiens
aggggctgctgggtccgcccct

SEQ ID NO: 8536450 - DNA, 22 bp, Homo sapiens
aggggctggagttcgaggttac

SEQ ID NO: 8536451 - DNA, 22 bp, Homo sapiens
aggggctggagttcgaggttac

SEQ ID NO: 8536452 - DNA, 22 bp, Homo sapiens
cctgaggacacacgctgcagga

SEQ ID NO: 8536453 - DNA, 22 bp, Homo sapiens
cctgaggacacacgctgcagga

SEQ ID NO: 8536454 - DNA, 17 bp, Homo sapiens
aggggagagtgggaaga

SEQ ID NO: 8536455 - DNA, 22 bp, Homo sapiens
aggggagagttaatgtgaatgt

SEQ ID NO: 8536456 - DNA, 17 bp, Homo sapiens
aggggagagtgggaaga

SEQ ID NO: 8536457 - DNA, 22 bp, Homo sapiens
aggggagaggtgagcaacttct

SEQ ID NO: 8536458 - DNA, 22 bp, Homo sapiens
cctgagagtgcgtgcctcctta

SEQ ID NO: 8536459 - DNA, 22 bp, Homo sapiens
aggggagagaacataaggaagt

SEQ ID NO: 8536460 - DNA, 22 bp, Homo sapiens
aggggagactggaatctaacat

SEQ ID NO: 8536461 - DNA, 22 bp, Homo sapiens
aggggagaaaaatgccttctgt

SEQ ID NO: 8536462 - DNA, 22 bp, Homo sapiens
aggggagaaaaatgccttctgt

SEQ ID NO: 8536463 - DNA, 22 bp, Homo sapiens
aggggagaatttcaactcaggt

SEQ ID NO: 8536464 - DNA, 22 bp, Homo sapiens
aggggacacggcttctccaggg

SEQ ID NO: 8536465 - DNA, 21 bp, Homo sapiens
aggggacagagtagctccagg

SEQ ID NO: 8536466 - DNA, 22 bp, Homo sapiens
aggggacatttagcaatgacta

SEQ ID NO: 8536467 - DNA, 22 bp, Homo sapiens
agggccagaggcaccttgcagc

SEQ ID NO: 8536468 - DNA, 22 bp, Homo sapiens
agggccagaatccctcagtcta

SEQ ID NO: 8536469 - DNA, 22 bp, Homo sapiens
agggccagaatccctcagtcta

SEQ ID NO: 8536470 - DNA, 22 bp, Homo sapiens
agggccagaatccctcagtcta

SEQ ID NO: 8536471 - DNA, 22 bp, Homo sapiens
agggccagagtctgtgtagata

SEQ ID NO: 8536472 - DNA, 22 bp, Homo sapiens
agggccagagtctgtgtagata

SEQ ID NO: 8536473 - DNA, 22 bp, Homo sapiens
agggccagagtacatcagggct

SEQ ID NO: 8536474 - DNA, 22 bp, Homo sapiens
agggccagagtacatcagggct

SEQ ID NO: 8536475 - DNA, 22 bp, Homo sapiens
agggccagagtacatcagggct

SEQ ID NO: 8536476 - DNA, 22 bp, Homo sapiens
agggccagaggcaccttgcagc

SEQ ID NO: 8536477 - DNA, 16 bp, Homo sapiens
agggccagaagcatca

SEQ ID NO: 8536478 - DNA, 22 bp, Homo sapiens
ccctggagggacagctgctcta

SEQ ID NO: 8536479 - DNA, 22 bp, Homo sapiens
ccctggagggacagctgctcta

SEQ ID NO: 8536480 - DNA, 23 bp, Homo sapiens
agggccactgggaaggattactg

SEQ ID NO: 8536481 - DNA, 22 bp, Homo sapiens
ccctggagggacagctgctcta

SEQ ID NO: 8536482 - DNA, 22 bp, Homo sapiens
ccctggagggacagctgctcta

SEQ ID NO: 8536483 - DNA, 22 bp, Homo sapiens
ccctggagggacagctgctcta

SEQ ID NO: 8536484 - DNA, 22 bp, Homo sapiens
ccctggaggctggaggcagtag

SEQ ID NO: 8536485 - DNA, 22 bp, Homo sapiens
ccctggaggcggatgttgcagt

SEQ ID NO: 8536486 - DNA, 22 bp, Homo sapiens
ccctggaggcggatgttgcagt

SEQ ID NO: 8536487 - DNA, 22 bp, Homo sapiens
ccctggaggctggaggcagtag

SEQ ID NO: 8536488 - DNA, 22 bp, Homo sapiens
ccctggaggctggaggcagtag

SEQ ID NO: 8536489 - DNA, 22 bp, Homo sapiens
ccctggaggcaaaggttgcagt

SEQ ID NO: 8536490 - DNA, 22 bp, Homo sapiens
ccctggaggcaaaggttgcagt

SEQ ID NO: 8536491 - DNA, 22 bp, Homo sapiens
ccctggaggcaaaggttgcagt

SEQ ID NO: 8536492 - DNA, 19 bp, Homo sapiens
ccctggaggagtgttggct

SEQ ID NO: 8536493 - DNA, 22 bp, Homo sapiens
ccctggaggcaaaggttgcagt

SEQ ID NO: 8536494 - DNA, 22 bp, Homo sapiens
ccctggaggcaaaggttgcagt

SEQ ID NO: 8536495 - DNA, 22 bp, Homo sapiens
ccctggaggcggagcttgcagt

SEQ ID NO: 8536496 - DNA, 22 bp, Homo sapiens
ccctggaggcggagcttgcagt

SEQ ID NO: 8536497 - DNA, 22 bp, Homo sapiens
ccctggaggcggatgttgcagt

SEQ ID NO: 8536498 - DNA, 22 bp, Homo sapiens
ccctggaggcggagcttgcagt

SEQ ID NO: 8536499 - DNA, 22 bp, Homo sapiens
ccctggaggcggagcttgcagt

SEQ ID NO: 8536500 - DNA, 22 bp, Homo sapiens
ccgaggtcctggacttggccct

SEQ ID NO: 8536501 - DNA, 22 bp, Homo sapiens
ccgaggtcctggacttggccct

SEQ ID NO: 8536502 - DNA, 22 bp, Homo sapiens
ccgaggtcctggacttggccct

SEQ ID NO: 8536503 - DNA, 22 bp, Homo sapiens
ccgcccacactaaatatgagcg

SEQ ID NO: 8536504 - DNA, 22 bp, Homo sapiens
ccgcaaggcagaggttgcagtg

SEQ ID NO: 8536505 - DNA, 22 bp, Homo sapiens
ccgcccacactaaatatgagcg

SEQ ID NO: 8536506 - DNA, 22 bp, Homo sapiens
agggccctaaggaaggcacaca

SEQ ID NO: 8536507 - DNA, 22 bp, Homo sapiens
ccctttcccttctggctcaggg

SEQ ID NO: 8536508 - DNA, 22 bp, Homo sapiens
cccttcagtgctaggctgcctg

SEQ ID NO: 8536509 - DNA, 22 bp, Homo sapiens
cccttcagtgctaggctgcctg

SEQ ID NO: 8536510 - DNA, 22 bp, Homo sapiens
agggccagagtctgtgtagata

SEQ ID NO: 8536511 - DNA, 22 bp, Homo sapiens
cccttcagtgctaggctgcctg

SEQ ID NO: 8536512 - DNA, 22 bp, Homo sapiens
ccctttcttcttgactgaaaac

SEQ ID NO: 8536513 - DNA, 22 bp, Homo sapiens
agggctccaggggaccatcagt

SEQ ID NO: 8536514 - DNA, 22 bp, Homo sapiens
agggctccaggggaccatcagt

SEQ ID NO: 8536515 - DNA, 22 bp, Homo sapiens
agggctccaggggctgggtgac

SEQ ID NO: 8536516 - DNA, 22 bp, Homo sapiens
agggctccaaggaagtgtagct

SEQ ID NO: 8536517 - DNA, 22 bp, Homo sapiens
agggctccaaggaagtgtagct

SEQ ID NO: 8536518 - DNA, 22 bp, Homo sapiens
agggctcccgtgaggtgactgc

SEQ ID NO: 8536519 - DNA, 22 bp, Homo sapiens
agggctcccgtgaggtgactgc

SEQ ID NO: 8536520 - DNA, 22 bp, Homo sapiens
agggctccaggggctgggtgac

SEQ ID NO: 8536521 - DNA, 22 bp, Homo sapiens
agggctccaggggctgggtgac

SEQ ID NO: 8536522 - DNA, 22 bp, Homo sapiens
agggctcccgcggtgtccggga

SEQ ID NO: 8536523 - DNA, 22 bp, Homo sapiens
agggctccaaggaagtgtagct

SEQ ID NO: 8536524 - DNA, 22 bp, Homo sapiens
agggctccaaggaagtgtagct

SEQ ID NO: 8536525 - DNA, 22 bp, Homo sapiens
agggctcattgacatggaaaag

SEQ ID NO: 8536526 - DNA, 22 bp, Homo sapiens
agggctcatctgagactgacat

SEQ ID NO: 8536527 - DNA, 22 bp, Homo sapiens
agggctcataattcctgacttc

SEQ ID NO: 8536528 - DNA, 22 bp, Homo sapiens
agggctcataattcctgacttc

SEQ ID NO: 8536529 - DNA, 22 bp, Homo sapiens
agggctcataattcctgacttc

SEQ ID NO: 8536530 - DNA, 23 bp, Homo sapiens
agggcctcaggagggctgcatgg

SEQ ID NO: 8536531 - DNA, 19 bp, Homo sapiens
agggctaggcacatagggc

SEQ ID NO: 8536532 - DNA, 22 bp, Homo sapiens
agggctaggaatggaactggag

SEQ ID NO: 8536533 - DNA, 22 bp, Homo sapiens
agggctaggaatggaactggag

SEQ ID NO: 8536534 - DNA, 22 bp, Homo sapiens
agggcccttacgcaggcccttc

SEQ ID NO: 8536535 - DNA, 22 bp, Homo sapiens
agggccctctggcaggccaggc

SEQ ID NO: 8536536 - DNA, 22 bp, Homo sapiens
agggccctctggcaggccaggc

SEQ ID NO: 8536537 - DNA, 22 bp, Homo sapiens
agggccctctgggcactgtggc

SEQ ID NO: 8536538 - DNA, 22 bp, Homo sapiens
agggccctccccgctcagggca

SEQ ID NO: 8536539 - DNA, 22 bp, Homo sapiens
agggccctccccgctcagggca

SEQ ID NO: 8536540 - DNA, 22 bp, Homo sapiens
agggctctggggtggcagagat

SEQ ID NO: 8536541 - DNA, 22 bp, Homo sapiens
agggctctgagtgggaaagagg

SEQ ID NO: 8536542 - DNA, 22 bp, Homo sapiens
agggctctgtccccagaggccc

SEQ ID NO: 8536543 - DNA, 22 bp, Homo sapiens
agggctctggggtggcagagat

SEQ ID NO: 8536544 - DNA, 22 bp, Homo sapiens
agggctctgtccccagaggccc

SEQ ID NO: 8536545 - DNA, 22 bp, Homo sapiens
agggctctgtccccagaggccc

SEQ ID NO: 8536546 - DNA, 22 bp, Homo sapiens
agggctctgtgactatcactgc

SEQ ID NO: 8536547 - DNA, 22 bp, Homo sapiens
agggctctgtccccagaggccc

SEQ ID NO: 8536548 - DNA, 22 bp, Homo sapiens
cctcctctgtgcagctgtgggt

SEQ ID NO: 8536549 - DNA, 22 bp, Homo sapiens
cctccccacgggcagccggcgc

SEQ ID NO: 8536550 - DNA, 22 bp, Homo sapiens
agggctctgttggggtcagcac

SEQ ID NO: 8536551 - DNA, 22 bp, Homo sapiens
agggctccgggccaccggcctg

SEQ ID NO: 8536552 - DNA, 22 bp, Homo sapiens
agggctccgggccaccggcctg

SEQ ID NO: 8536553 - DNA, 22 bp, Homo sapiens
agggctccgggccaccggcctg

SEQ ID NO: 8536554 - DNA, 22 bp, Homo sapiens
agggctccgggcaggcgatgga

SEQ ID NO: 8536555 - DNA, 22 bp, Homo sapiens
agggctccgggcaggcgatgga

SEQ ID NO: 8536556 - DNA, 22 bp, Homo sapiens
agggctcctatgatgctctgcc

SEQ ID NO: 8536557 - DNA, 22 bp, Homo sapiens
agggctcctatgccccatggac

SEQ ID NO: 8536558 - DNA, 22 bp, Homo sapiens
agggctcctatgccccatggac

SEQ ID NO: 8536559 - DNA, 22 bp, Homo sapiens
agggctcctatgccccatggac

SEQ ID NO: 8536560 - DNA, 22 bp, Homo sapiens
agggctcctatgccccatggac

SEQ ID NO: 8536561 - DNA, 22 bp, Homo sapiens
agggctcctccccggcctccac

SEQ ID NO: 8536562 - DNA, 22 bp, Homo sapiens
agggctcctccccggcctccac

SEQ ID NO: 8536563 - DNA, 22 bp, Homo sapiens
agggctcctccccggcctccac

SEQ ID NO: 8536564 - DNA, 23 bp, Homo sapiens
agggctccttgttgattagcatt

SEQ ID NO: 8536565 - DNA, 18 bp, Homo sapiens
agggctctctgctgggtt

SEQ ID NO: 8536566 - DNA, 22 bp, Homo sapiens
agggctcctgaggcccttctgg

SEQ ID NO: 8536567 - DNA, 22 bp, Homo sapiens
ccagcttttcttatcattataa

SEQ ID NO: 8536568 - DNA, 22 bp, Homo sapiens
ccagcttttcttatcattataa

SEQ ID NO: 8536569 - DNA, 22 bp, Homo sapiens
aggccctggcactgcctgggag

SEQ ID NO: 8536570 - DNA, 22 bp, Homo sapiens
aggccctggcactgcctgggag

SEQ ID NO: 8536571 - DNA, 22 bp, Homo sapiens
aggccctggcccccagagattc

SEQ ID NO: 8536572 - DNA, 18 bp, Homo sapiens
aggccctggcctcgaaca

SEQ ID NO: 8536573 - DNA, 22 bp, Homo sapiens
aggccctggcctgactcaatgt

SEQ ID NO: 8536574 - DNA, 18 bp, Homo sapiens
aggccctggcctcgaaca

SEQ ID NO: 8536575 - DNA, 18 bp, Homo sapiens
aggccctggcctcgaaca

SEQ ID NO: 8536576 - DNA, 22 bp, Homo sapiens
aggccctgggagcagagatgca

SEQ ID NO: 8536577 - DNA, 22 bp, Homo sapiens
aggccctggctgggtttcttta

SEQ ID NO: 8536578 - DNA, 22 bp, Homo sapiens
ccaggacaagtgtggccatggc

SEQ ID NO: 8536579 - DNA, 22 bp, Homo sapiens
ccaggacaagtgtggccatggc

SEQ ID NO: 8536580 - DNA, 22 bp, Homo sapiens
ccaggacaagtgtggccatggc

SEQ ID NO: 8536581 - DNA, 22 bp, Homo sapiens
ccaggacaagtgtggccatggc

SEQ ID NO: 8536582 - DNA, 22 bp, Homo sapiens
aggccctggggtctgttaaatt

SEQ ID NO: 8536583 - DNA, 22 bp, Homo sapiens
aggccctgggcagttctgtagc

SEQ ID NO: 8536584 - DNA, 22 bp, Homo sapiens
aggccctgggcagttctgtagc

SEQ ID NO: 8536585 - DNA, 22 bp, Homo sapiens
ccaggagagcagaagcccaggc

SEQ ID NO: 8536586 - DNA, 22 bp, Homo sapiens
ccaggagagcagaagcccaggc

SEQ ID NO: 8536587 - DNA, 22 bp, Homo sapiens
ccaggagagcagaagcccaggc

SEQ ID NO: 8536588 - DNA, 22 bp, Homo sapiens
ccaggagagcaggcgtgcagct

SEQ ID NO: 8536589 - DNA, 22 bp, Homo sapiens
ccaggagagcattgcacagagg

SEQ ID NO: 8536590 - DNA, 22 bp, Homo sapiens
ccaggagagcattgcacagagg

SEQ ID NO: 8536591 - DNA, 22 bp, Homo sapiens
ccaggagagcattgcacagagg

SEQ ID NO: 8536592 - DNA, 22 bp, Homo sapiens
ccaggagagctctaaatggctg

SEQ ID NO: 8536593 - DNA, 22 bp, Homo sapiens
ccaggagatgggaaagtagcag

SEQ ID NO: 8536594 - DNA, 22 bp, Homo sapiens
ccaggagatttttccatagcac

SEQ ID NO: 8536595 - DNA, 22 bp, Homo sapiens
ccaggagcgggaaaaggaagaa

SEQ ID NO: 8536596 - DNA, 22 bp, Homo sapiens
ccaggagcgcgtgaacaggctg

SEQ ID NO: 8536597 - DNA, 22 bp, Homo sapiens
ccaggagcaaagatcactggga

SEQ ID NO: 8536598 - DNA, 22 bp, Homo sapiens
ccaggagcgcgtgaacaggctg

SEQ ID NO: 8536599 - DNA, 22 bp, Homo sapiens
ccagcctggactgggtcttgtg

SEQ ID NO: 8536600 - DNA, 22 bp, Homo sapiens
ccagcctggactgggtcttgtg

SEQ ID NO: 8536601 - DNA, 22 bp, Homo sapiens
ccagcctggactgggtcttgtg

SEQ ID NO: 8536602 - DNA, 22 bp, Homo sapiens
aggcccagagcaggaaagggtt

SEQ ID NO: 8536603 - DNA, 22 bp, Homo sapiens
aggcccagcccgtcctcgtgct

SEQ ID NO: 8536604 - DNA, 19 bp, Homo sapiens
aggcccagcgctgggggct

SEQ ID NO: 8536605 - DNA, 22 bp, Homo sapiens
ccagctggcccagctgtgctcc

SEQ ID NO: 8536606 - DNA, 19 bp, Homo sapiens
ccagctggcctgggacctc

SEQ ID NO: 8536607 - DNA, 19 bp, Homo sapiens
ccagctggcctgggacctc

SEQ ID NO: 8536608 - DNA, 22 bp, Homo sapiens
ccagctggcccagctgtgctcc

SEQ ID NO: 8536609 - DNA, 22 bp, Homo sapiens
aggcccagctggacaaactgct

SEQ ID NO: 8536610 - DNA, 19 bp, Homo sapiens
ccagctggcctgggacctc

SEQ ID NO: 8536611 - DNA, 22 bp, Homo sapiens
ccagcttctctctgatgcagct

SEQ ID NO: 8536612 - DNA, 22 bp, Homo sapiens
ccagcttctctctgatgcagct

SEQ ID NO: 8536613 - DNA, 22 bp, Homo sapiens
ccagcttgaagatgtgctggtt

SEQ ID NO: 8536614 - DNA, 22 bp, Homo sapiens
ccagcttgtttgaagctcgtca

SEQ ID NO: 8536615 - DNA, 22 bp, Homo sapiens
ccagcctcatcgcctgcctgtc

SEQ ID NO: 8536616 - DNA, 22 bp, Homo sapiens
ccagcctcatcgcctgcctgtc

SEQ ID NO: 8536617 - DNA, 22 bp, Homo sapiens
ccagcctcatcatattcctgct

SEQ ID NO: 8536618 - DNA, 22 bp, Homo sapiens
ccagccctgccagagagagctg

SEQ ID NO: 8536619 - DNA, 22 bp, Homo sapiens
aggccagagttaaggagaacag

SEQ ID NO: 8536620 - DNA, 17 bp, Homo sapiens
aggccagatgaggcaag

SEQ ID NO: 8536621 - DNA, 17 bp, Homo sapiens
aggccagatgaggcaag

SEQ ID NO: 8536622 - DNA, 22 bp, Homo sapiens
ccagcctgaaatgcctcatcct

SEQ ID NO: 8536623 - DNA, 22 bp, Homo sapiens
ccagcctgaaatgcctcatcct

SEQ ID NO: 8536624 - DNA, 22 bp, Homo sapiens
ccagcctgaaatgcctcatcct

SEQ ID NO: 8536625 - DNA, 22 bp, Homo sapiens
ccagcctgaaatgcctcatcct

SEQ ID NO: 8536626 - DNA, 22 bp, Homo sapiens
ccagcctgaaatgcctcatcct

SEQ ID NO: 8536627 - DNA, 22 bp, Homo sapiens
ccagcctgaaatgcctcatcct

SEQ ID NO: 8536628 - DNA, 22 bp, Homo sapiens
ccagcctgaaatgcctcatcct

SEQ ID NO: 8536629 - DNA, 22 bp, Homo sapiens
ccagcctgaaatgcctcatcct

SEQ ID NO: 8536630 - DNA, 23 bp, Homo sapiens
ccagcctctgggtcttcatccag

SEQ ID NO: 8536631 - DNA, 19 bp, Homo sapiens
ccagcctctcttccacccc

SEQ ID NO: 8536632 - DNA, 23 bp, Homo sapiens
ccagcctctgggtcttcatccag

SEQ ID NO: 8536633 - DNA, 23 bp, Homo sapiens
ccagcctctgggtcttcatccag

SEQ ID NO: 8536634 - DNA, 22 bp, Homo sapiens
ccagcctcatcgcctgcctgtc

SEQ ID NO: 8536635 - DNA, 22 bp, Homo sapiens
ccagcctccatgtagatagctg

SEQ ID NO: 8536636 - DNA, 19 bp, Homo sapiens
ccagcctctcttccacccc

SEQ ID NO: 8536637 - DNA, 22 bp, Homo sapiens
ccagcctccatgtagatagctg

SEQ ID NO: 8536638 - DNA, 22 bp, Homo sapiens
ccagcctccatgtagatagctg

SEQ ID NO: 8536639 - DNA, 22 bp, Homo sapiens
ccagcctccatgtagatagctg

SEQ ID NO: 8536640 - DNA, 22 bp, Homo sapiens
aggcatggcactgagcagcttc

SEQ ID NO: 8536641 - DNA, 22 bp, Homo sapiens
aggcatggcactgagcagcttc

SEQ ID NO: 8536642 - DNA, 22 bp, Homo sapiens
ccagagtgacgtgaagtgtgaa

SEQ ID NO: 8536643 - DNA, 22 bp, Homo sapiens
ccagagtctttatattcctgaa

SEQ ID NO: 8536644 - DNA, 22 bp, Homo sapiens
ccagagtctttatattcctgaa

SEQ ID NO: 8536645 - DNA, 22 bp, Homo sapiens
aggcatggatgtagcagtgacc

SEQ ID NO: 8536646 - DNA, 22 bp, Homo sapiens
ccagagcaattctcacagaact

SEQ ID NO: 8536647 - DNA, 22 bp, Homo sapiens
ccagagcagatgtggccttggt

SEQ ID NO: 8536648 - DNA, 22 bp, Homo sapiens
ccagagcagatgtggccttggt

SEQ ID NO: 8536649 - DNA, 22 bp, Homo sapiens
ccagagcaattctcacagaact

SEQ ID NO: 8536650 - DNA, 17 bp, Homo sapiens
ccagagatgcctcaggc

SEQ ID NO: 8536651 - DNA, 19 bp, Homo sapiens
ccagcagacacagctgccc

SEQ ID NO: 8536652 - DNA, 19 bp, Homo sapiens
ccagcagacacagctgccc

SEQ ID NO: 8536653 - DNA, 22 bp, Homo sapiens
ccagcagagcatggggaggaag

SEQ ID NO: 8536654 - DNA, 19 bp, Homo sapiens
ccagcagacacagctgccc

SEQ ID NO: 8536655 - DNA, 19 bp, Homo sapiens
ccagcagacacagctgccc

SEQ ID NO: 8536656 - DNA, 22 bp, Homo sapiens
ccagcagagctcaaacttcctg

SEQ ID NO: 8536657 - DNA, 22 bp, Homo sapiens
ccagcagagctggaagtgtgct

SEQ ID NO: 8536658 - DNA, 22 bp, Homo sapiens
ccagcagagcatggggaggaag

SEQ ID NO: 8536659 - DNA, 22 bp, Homo sapiens
ccagcagacacacaggcgtggg

SEQ ID NO: 8536660 - DNA, 19 bp, Homo sapiens
ccagcagaagccactcctg

SEQ ID NO: 8536661 - DNA, 22 bp, Homo sapiens
ccagcagaagctcccgctgggt

SEQ ID NO: 8536662 - DNA, 19 bp, Homo sapiens
ccagcagaagccactcctg

SEQ ID NO: 8536663 - DNA, 22 bp, Homo sapiens
ccagcagagggcgcttcacacc

SEQ ID NO: 8536664 - DNA, 22 bp, Homo sapiens
ccagcagaggggcggagtgcag

SEQ ID NO: 8536665 - DNA, 22 bp, Homo sapiens
aggccagaaatttggagtatgt

SEQ ID NO: 8536666 - DNA, 22 bp, Homo sapiens
aggccagaaatttggagtatgt

SEQ ID NO: 8536667 - DNA, 22 bp, Homo sapiens
aggccagacagctagaaacagg

SEQ ID NO: 8536668 - DNA, 22 bp, Homo sapiens
aggccagactttggccaaatcc

SEQ ID NO: 8536669 - DNA, 22 bp, Homo sapiens
aggccagagaggggaccagcct

SEQ ID NO: 8536670 - DNA, 22 bp, Homo sapiens
ccacaggacacaactgctgacc

SEQ ID NO: 8536671 - DNA, 22 bp, Homo sapiens
ccacaggaagttatgagtacta

SEQ ID NO: 8536672 - DNA, 22 bp, Homo sapiens
ccacagctgaccgcaggtgagc

SEQ ID NO: 8536673 - DNA, 22 bp, Homo sapiens
ccacagctgaccgcaggtgagc

SEQ ID NO: 8536674 - DNA, 22 bp, Homo sapiens
aggcagggtgatgataatgatt

SEQ ID NO: 8536675 - DNA, 22 bp, Homo sapiens
aggcagggtcttgctatgttgc

SEQ ID NO: 8536676 - DNA, 22 bp, Homo sapiens
aggcagggtcttgctatgttgc

SEQ ID NO: 8536677 - DNA, 22 bp, Homo sapiens
aggcaggggagctggaagggta

SEQ ID NO: 8536678 - DNA, 22 bp, Homo sapiens
aggcaggggagctggaagggta

SEQ ID NO: 8536679 - DNA, 18 bp, Homo sapiens
aggcaggctggagtgact

SEQ ID NO: 8536680 - DNA, 22 bp, Homo sapiens
aggcaggggagctggaagggta

SEQ ID NO: 8536681 - DNA, 22 bp, Homo sapiens
aggcaggggagctggaagggta

SEQ ID NO: 8536682 - DNA, 22 bp, Homo sapiens
aggcaggggagctggaagggta

SEQ ID NO: 8536683 - DNA, 22 bp, Homo sapiens
aggcaggggagctggaagggta

SEQ ID NO: 8536684 - DNA, 20 bp, Homo sapiens
ccacaggagtccagtcgacc

SEQ ID NO: 8536685 - DNA, 22 bp, Homo sapiens
ccacaggaggaacaattagatg

SEQ ID NO: 8536686 - DNA, 22 bp, Homo sapiens
ccacaggaggaacaattagatg

SEQ ID NO: 8536687 - DNA, 22 bp, Homo sapiens
ccacaggacggaggtctggccg

SEQ ID NO: 8536688 - DNA, 22 bp, Homo sapiens
ccacaggaccagaggagatcac

SEQ ID NO: 8536689 - DNA, 22 bp, Homo sapiens
ccacaggaccagaggagatcac

SEQ ID NO: 8536690 - DNA, 22 bp, Homo sapiens
ccacaggaagttatgagtacta

SEQ ID NO: 8536691 - DNA, 22 bp, Homo sapiens
ccacaggacggaggtctggccg

SEQ ID NO: 8536692 - DNA, 20 bp, Homo sapiens
ccacaggagtccagtcgacc

SEQ ID NO: 8536693 - DNA, 22 bp, Homo sapiens
ccagagagggcgccacctggag

SEQ ID NO: 8536694 - DNA, 22 bp, Homo sapiens
ccagagagggcgccacctggag

SEQ ID NO: 8536695 - DNA, 22 bp, Homo sapiens
ccagagaaagtgaagcaaatgt

SEQ ID NO: 8536696 - DNA, 22 bp, Homo sapiens
ccagagagtatcatggagagta

SEQ ID NO: 8536697 - DNA, 22 bp, Homo sapiens
ccagagagtatcatggagagta

SEQ ID NO: 8536698 - DNA, 22 bp, Homo sapiens
ccagagagtatcatggagagta

SEQ ID NO: 8536699 - DNA, 22 bp, Homo sapiens
ccagagagtatcatggagagta

SEQ ID NO: 8536700 - DNA, 22 bp, Homo sapiens
ccagagagtatcatggagagta

SEQ ID NO: 8536701 - DNA, 22 bp, Homo sapiens
ccagagagtcgatgggggacac

SEQ ID NO: 8536702 - DNA, 22 bp, Homo sapiens
ccagagagtcgatgggggacac

SEQ ID NO: 8536703 - DNA, 22 bp, Homo sapiens
ccagagagtcgatgggggacac

SEQ ID NO: 8536704 - DNA, 20 bp, Homo sapiens
ccagagagtaggttagtgat

SEQ ID NO: 8536705 - DNA, 17 bp, Homo sapiens
ccagagagtagttagga

SEQ ID NO: 8536706 - DNA, 22 bp, Homo sapiens
ccagagaggggaagggcttgcc

SEQ ID NO: 8536707 - DNA, 22 bp, Homo sapiens
ccagagaggggaagggcttgcc

SEQ ID NO: 8536708 - DNA, 22 bp, Homo sapiens
ccagagaggggaagggcttgcc

SEQ ID NO: 8536709 - DNA, 22 bp, Homo sapiens
aggctgaggcgggtagatcacc

SEQ ID NO: 8536710 - DNA, 22 bp, Homo sapiens
aggctgaggggcgagggaccct

SEQ ID NO: 8536711 - DNA, 22 bp, Homo sapiens
aggctctgtgcatcctccccaa

SEQ ID NO: 8536712 - DNA, 22 bp, Homo sapiens
aggctctgtgcatcctccccaa

SEQ ID NO: 8536713 - DNA, 22 bp, Homo sapiens
aggctgaggtaggaggatcgct

SEQ ID NO: 8536714 - DNA, 20 bp, Homo sapiens
aggctgagggtgattgtgtc

SEQ ID NO: 8536715 - DNA, 20 bp, Homo sapiens
aggctgagggtgattgtgtc

SEQ ID NO: 8536716 - DNA, 20 bp, Homo sapiens
aggctgagggtgattgtgtc

SEQ ID NO: 8536717 - DNA, 22 bp, Homo sapiens
aggctgaggggcgagggaccct

SEQ ID NO: 8536718 - DNA, 22 bp, Homo sapiens
aggctgaggggcgagggaccct

SEQ ID NO: 8536719 - DNA, 22 bp, Homo sapiens
aggctctgtgatgtgccaggca

SEQ ID NO: 8536720 - DNA, 22 bp, Homo sapiens
aggctctgtgcagcctgcatct

SEQ ID NO: 8536721 - DNA, 22 bp, Homo sapiens
ccagggtggaggctggatggag

SEQ ID NO: 8536722 - DNA, 22 bp, Homo sapiens
ccagggtggaggctggatggag

SEQ ID NO: 8536723 - DNA, 22 bp, Homo sapiens
aggctctgtgacaatcaagctg

SEQ ID NO: 8536724 - DNA, 22 bp, Homo sapiens
aggctgagtcaagttagggtga

SEQ ID NO: 8536725 - DNA, 22 bp, Homo sapiens
aggctgagtcaagttagggtga

SEQ ID NO: 8536726 - DNA, 22 bp, Homo sapiens
aggctgaggtgtgctgtgatcg

SEQ ID NO: 8536727 - DNA, 22 bp, Homo sapiens
aggctgaggtgtgctgtgatcg

SEQ ID NO: 8536728 - DNA, 22 bp, Homo sapiens
aggctgagtcaagttagggtga

SEQ ID NO: 8536729 - DNA, 22 bp, Homo sapiens
aggctgagtcgggaggatcact

SEQ ID NO: 8536730 - DNA, 22 bp, Homo sapiens
aggctgaggtgtgctgtgatcg

SEQ ID NO: 8536731 - DNA, 22 bp, Homo sapiens
aggctgaggtaggaggatcgct

SEQ ID NO: 8536732 - DNA, 22 bp, Homo sapiens
aggctgaggtaggaggatcgct

SEQ ID NO: 8536733 - DNA, 22 bp, Homo sapiens
aggctgaggtaggaggatcgct

SEQ ID NO: 8536734 - DNA, 22 bp, Homo sapiens
ccatggctttctttcattgtaa

SEQ ID NO: 8536735 - DNA, 22 bp, Homo sapiens
ccatggcttttgagtctcaaga

SEQ ID NO: 8536736 - DNA, 22 bp, Homo sapiens
ccatggcttttgagtctcaaga

SEQ ID NO: 8536737 - DNA, 22 bp, Homo sapiens
ccatggcttacagatggagcat

SEQ ID NO: 8536738 - DNA, 22 bp, Homo sapiens
ccatggcttacagatggagcat

SEQ ID NO: 8536739 - DNA, 22 bp, Homo sapiens
ccatggctcttaccttgttata

SEQ ID NO: 8536740 - DNA, 22 bp, Homo sapiens
ccatggcttacagatggagcat

SEQ ID NO: 8536741 - DNA, 22 bp, Homo sapiens
ccatgcacaccagcaggcagac

SEQ ID NO: 8536742 - DNA, 22 bp, Homo sapiens
ccatggctaagtatctgtagaa

SEQ ID NO: 8536743 - DNA, 22 bp, Homo sapiens
ccatgggcactgggtggaggta

SEQ ID NO: 8536744 - DNA, 22 bp, Homo sapiens
ccatggcttttgagtctcaaga

SEQ ID NO: 8536745 - DNA, 22 bp, Homo sapiens
ccatgggacctacctcctgtgc

SEQ ID NO: 8536746 - DNA, 22 bp, Homo sapiens
ccatgggaattgggaggtccca

SEQ ID NO: 8536747 - DNA, 22 bp, Homo sapiens
ccatgggagatgatggggagtg

SEQ ID NO: 8536748 - DNA, 22 bp, Homo sapiens
ccatgggagatgatggggagtg

SEQ ID NO: 8536749 - DNA, 22 bp, Homo sapiens
aggctgcctaggttcaacacct

SEQ ID NO: 8536750 - DNA, 21 bp, Homo sapiens
ccatgtcagatgtgggctgtg

SEQ ID NO: 8536751 - DNA, 22 bp, Homo sapiens
ccatgtgcttgctctggcacct

SEQ ID NO: 8536752 - DNA, 22 bp, Homo sapiens
aggctgcctgttccaatctcct

SEQ ID NO: 8536753 - DNA, 22 bp, Homo sapiens
aggctgcctgttccaatctcct

SEQ ID NO: 8536754 - DNA, 18 bp, Homo sapiens
cccactgtccccacaggc

SEQ ID NO: 8536755 - DNA, 22 bp, Homo sapiens
aggctgcctcttttgagagggt

SEQ ID NO: 8536756 - DNA, 22 bp, Homo sapiens
aggctgcctggctgtgagtgaa

SEQ ID NO: 8536757 - DNA, 22 bp, Homo sapiens
aggctgcctctgcaggatccct

SEQ ID NO: 8536758 - DNA, 22 bp, Homo sapiens
aggctgcctcgtgagctcgctg

SEQ ID NO: 8536759 - DNA, 17 bp, Homo sapiens
aggctggctcacaggga

SEQ ID NO: 8536760 - DNA, 17 bp, Homo sapiens
aggctggctcacaggga

SEQ ID NO: 8536761 - DNA, 17 bp, Homo sapiens
aggctggctcacaggga

SEQ ID NO: 8536762 - DNA, 17 bp, Homo sapiens
aggctggctcacaggga

SEQ ID NO: 8536763 - DNA, 17 bp, Homo sapiens
aggctggctcacaggga

SEQ ID NO: 8536764 - DNA, 22 bp, Homo sapiens
aggctggcgtcaggggctgtac

SEQ ID NO: 8536765 - DNA, 21 bp, Homo sapiens
cccagagcctagggagggcac

SEQ ID NO: 8536766 - DNA, 21 bp, Homo sapiens
cccagagcctagggagggcac

SEQ ID NO: 8536767 - DNA, 22 bp, Homo sapiens
aggctggcgtcaggggctgtac

SEQ ID NO: 8536768 - DNA, 22 bp, Homo sapiens
aggctggcgtcaggggctgtac

SEQ ID NO: 8536769 - DNA, 21 bp, Homo sapiens
cccagagcctagggagggcac

SEQ ID NO: 8536770 - DNA, 22 bp, Homo sapiens
cccagagccggtggtgctcaca

SEQ ID NO: 8536771 - DNA, 22 bp, Homo sapiens
cccagagccggtggtgctcaca

SEQ ID NO: 8536772 - DNA, 22 bp, Homo sapiens
cccagagccggtggtgctcaca

SEQ ID NO: 8536773 - DNA, 23 bp, Homo sapiens
cccagagcacagcctccagatgc

SEQ ID NO: 8536774 - DNA, 23 bp, Homo sapiens
cccagagcacagcctccagatgc

SEQ ID NO: 8536775 - DNA, 23 bp, Homo sapiens
cccagagcacagcctccagatgc

SEQ ID NO: 8536776 - DNA, 23 bp, Homo sapiens
cccagagcacagcctccagatgc

SEQ ID NO: 8536777 - DNA, 22 bp, Homo sapiens
cccagagatgtcctgagtgata

SEQ ID NO: 8536778 - DNA, 19 bp, Homo sapiens
cccagagcatcctgaactt

SEQ ID NO: 8536779 - DNA, 19 bp, Homo sapiens
cccagagcatcctgaactt

SEQ ID NO: 8536780 - DNA, 19 bp, Homo sapiens
cccagagcatcctgaactt

SEQ ID NO: 8536781 - DNA, 19 bp, Homo sapiens
cccagagcatcctgaactt

SEQ ID NO: 8536782 - DNA, 19 bp, Homo sapiens
cccagagcatcctgaactt

SEQ ID NO: 8536783 - DNA, 22 bp, Homo sapiens
cccagagcataacgtatcttga

SEQ ID NO: 8536784 - DNA, 22 bp, Homo sapiens
cccagagcataacgtatcttga

SEQ ID NO: 8536785 - DNA, 20 bp, Homo sapiens
cccagagcactttttcatgt

SEQ ID NO: 8536786 - DNA, 20 bp, Homo sapiens
cccagagcactttttcatgt

SEQ ID NO: 8536787 - DNA, 22 bp, Homo sapiens
cccagagcatgtgctgcctttg

SEQ ID NO: 8536788 - DNA, 20 bp, Homo sapiens
cccagagccatagccagaca

SEQ ID NO: 8536789 - DNA, 20 bp, Homo sapiens
cccagagccatagccagaca

SEQ ID NO: 8536790 - DNA, 22 bp, Homo sapiens
cccagagccgctcccctacttc

SEQ ID NO: 8536791 - DNA, 22 bp, Homo sapiens
cccagagccggtggtgctcaca

SEQ ID NO: 8536792 - DNA, 20 bp, Homo sapiens
cccagagccatagccagaca

SEQ ID NO: 8536793 - DNA, 22 bp, Homo sapiens
cccagagccgctcccctacttc

SEQ ID NO: 8536794 - DNA, 22 bp, Homo sapiens
ccagggtgagtgtcatgggtta

SEQ ID NO: 8536795 - DNA, 22 bp, Homo sapiens
ccagggtgagtgtcatgggtta

SEQ ID NO: 8536796 - DNA, 22 bp, Homo sapiens
ccagggtgctctgtggcgtcgc

SEQ ID NO: 8536797 - DNA, 22 bp, Homo sapiens
ccagggtgctctgtggcgtcgc

SEQ ID NO: 8536798 - DNA, 22 bp, Homo sapiens
ccagggtgaggaggctcccacg

SEQ ID NO: 8536799 - DNA, 22 bp, Homo sapiens
ccagggtgagtgtcatgggtta

SEQ ID NO: 8536800 - DNA, 22 bp, Homo sapiens
ccagggtgagaaaaggctggat

SEQ ID NO: 8536801 - DNA, 22 bp, Homo sapiens
ccagggtgaggaggctcccacg

SEQ ID NO: 8536802 - DNA, 22 bp, Homo sapiens
ccagggtgaggaggctcccacg

SEQ ID NO: 8536803 - DNA, 22 bp, Homo sapiens
ccagggtgagaaaaggctggat

SEQ ID NO: 8536804 - DNA, 22 bp, Homo sapiens
ccagggtgagaaaaggctggat

SEQ ID NO: 8536805 - DNA, 22 bp, Homo sapiens
ccagggtgagaaaaggctggat

SEQ ID NO: 8536806 - DNA, 22 bp, Homo sapiens
ccagggtgaccagctggcctag

SEQ ID NO: 8536807 - DNA, 22 bp, Homo sapiens
ccagggtgaccagctggcctag

SEQ ID NO: 8536808 - DNA, 22 bp, Homo sapiens
ccagggtgaccagctggcctag

SEQ ID NO: 8536809 - DNA, 22 bp, Homo sapiens
aggctcctgagaggcagaggct

SEQ ID NO: 8536810 - DNA, 22 bp, Homo sapiens
aggctcctgagaggcagaggct

SEQ ID NO: 8536811 - DNA, 22 bp, Homo sapiens
aggctccttgctcacaggctca

SEQ ID NO: 8536812 - DNA, 22 bp, Homo sapiens
ccagggtcttggagaggagtgc

SEQ ID NO: 8536813 - DNA, 22 bp, Homo sapiens
aggctccctgaatcgcccgttc

SEQ ID NO: 8536814 - DNA, 22 bp, Homo sapiens
ccagggagcggggctgggtctc

SEQ ID NO: 8536815 - DNA, 18 bp, Homo sapiens
ccagggagcttattagga

SEQ ID NO: 8536816 - DNA, 22 bp, Homo sapiens
ccagggagcggggctgggtctc

SEQ ID NO: 8536817 - DNA, 17 bp, Homo sapiens
aggctcctcctaaggtc

SEQ ID NO: 8536818 - DNA, 22 bp, Homo sapiens
aggctcctatcgctttcagcaa

SEQ ID NO: 8536819 - DNA, 22 bp, Homo sapiens
ccagggagcccacaggacaatg

SEQ ID NO: 8536820 - DNA, 22 bp, Homo sapiens
ccagggagcccacaggacaatg

SEQ ID NO: 8536821 - DNA, 22 bp, Homo sapiens
ccagggagcccacaggacaatg

SEQ ID NO: 8536822 - DNA, 22 bp, Homo sapiens
ccagggagcctggtgtgtcagc

SEQ ID NO: 8536823 - DNA, 22 bp, Homo sapiens
ccagggagcctggtgtgtcagc

SEQ ID NO: 8536824 - DNA, 22 bp, Homo sapiens
ccagggaaggctgctggctgtg

SEQ ID NO: 8536825 - DNA, 22 bp, Homo sapiens
ccagggaagtcacattgtctag

SEQ ID NO: 8536826 - DNA, 22 bp, Homo sapiens
ccagggaatctctgagtgtgtt

SEQ ID NO: 8536827 - DNA, 22 bp, Homo sapiens
ccagggaatctctgagtgtgtt

SEQ ID NO: 8536828 - DNA, 22 bp, Homo sapiens
aggctccaccagtcaggtgcat

SEQ ID NO: 8536829 - DNA, 23 bp, Homo sapiens
aggctccacatgggcactttgca

SEQ ID NO: 8536830 - DNA, 22 bp, Homo sapiens
aggctccaccccgccagacctt

SEQ ID NO: 8536831 - DNA, 22 bp, Homo sapiens
aggctccaccagtcaggtgcat

SEQ ID NO: 8536832 - DNA, 22 bp, Homo sapiens
aggctccaccagtcaggtgcat

SEQ ID NO: 8536833 - DNA, 22 bp, Homo sapiens
aggctccaccctacagagctcc

SEQ ID NO: 8536834 - DNA, 22 bp, Homo sapiens
aggctccaccctacagagctcc

SEQ ID NO: 8536835 - DNA, 22 bp, Homo sapiens
aggctccaccctacagagctcc

SEQ ID NO: 8536836 - DNA, 22 bp, Homo sapiens
aggctccaccccgccagacctt

SEQ ID NO: 8536837 - DNA, 22 bp, Homo sapiens
aggctccaccctacagagctcc

SEQ ID NO: 8536838 - DNA, 22 bp, Homo sapiens
ccaggctgtaaacaccttcaaa

SEQ ID NO: 8536839 - DNA, 22 bp, Homo sapiens
ccaggctgtaaacaccttcaaa

SEQ ID NO: 8536840 - DNA, 22 bp, Homo sapiens
aggctcagttctgtggtgagcc

SEQ ID NO: 8536841 - DNA, 22 bp, Homo sapiens
aggctcagttcacgtcaacttt

SEQ ID NO: 8536842 - DNA, 22 bp, Homo sapiens
aggctcagtgcaaatcattctg

SEQ ID NO: 8536843 - DNA, 22 bp, Homo sapiens
aggctccaaattaccaagctct

SEQ ID NO: 8536844 - DNA, 22 bp, Homo sapiens
aggctccaaattaccaagctct

SEQ ID NO: 8536845 - DNA, 22 bp, Homo sapiens
aggctccaagaggttaagtcac

SEQ ID NO: 8536846 - DNA, 22 bp, Homo sapiens
aggctcattcttgcctctgagc

SEQ ID NO: 8536847 - DNA, 22 bp, Homo sapiens
aggctcagcctgggcctagagc

SEQ ID NO: 8536848 - DNA, 22 bp, Homo sapiens
ccaggaggatcatcctgttttc

SEQ ID NO: 8536849 - DNA, 22 bp, Homo sapiens
aggctcagcctgggcctagagc

SEQ ID NO: 8536850 - DNA, 22 bp, Homo sapiens
aggctcagtatagctggcaagt

SEQ ID NO: 8536851 - DNA, 22 bp, Homo sapiens
aggctcagtcccggcccgcgcc

SEQ ID NO: 8536852 - DNA, 22 bp, Homo sapiens
aggctcagtatagctggcaagt

SEQ ID NO: 8536853 - DNA, 22 bp, Homo sapiens
aggctcagtctgttcatgcact

SEQ ID NO: 8536854 - DNA, 22 bp, Homo sapiens
aggctcagtctgttcatgcact

SEQ ID NO: 8536855 - DNA, 22 bp, Homo sapiens
ccaggagctggcatgtggagag

SEQ ID NO: 8536856 - DNA, 22 bp, Homo sapiens
ccaggagctggcatgtggagag

SEQ ID NO: 8536857 - DNA, 22 bp, Homo sapiens
ccaggagctggcatgtggagag

SEQ ID NO: 8536858 - DNA, 22 bp, Homo sapiens
ccaggagctggagggtgcagtg

SEQ ID NO: 8536859 - DNA, 22 bp, Homo sapiens
ccaggaggaaagaccagcccat

SEQ ID NO: 8536860 - DNA, 22 bp, Homo sapiens
ccaggaggaaattctaaaggta

SEQ ID NO: 8536861 - DNA, 22 bp, Homo sapiens
ccaggagctggagggtgcagtg

SEQ ID NO: 8536862 - DNA, 22 bp, Homo sapiens
ccaggagctggagggtgcagtg

SEQ ID NO: 8536863 - DNA, 22 bp, Homo sapiens
ccaggagctatgtacacactat

SEQ ID NO: 8536864 - DNA, 22 bp, Homo sapiens
ccaggagctggagggtgcagtg

SEQ ID NO: 8536865 - DNA, 22 bp, Homo sapiens
ccaggagctggagggtgcagtg

SEQ ID NO: 8536866 - DNA, 17 bp, Homo sapiens
ccaggagcgtgggtctc

SEQ ID NO: 8536867 - DNA, 17 bp, Homo sapiens
ccaggagcgtgggtctc

SEQ ID NO: 8536868 - DNA, 17 bp, Homo sapiens
ccaggagcgtgggtctc

SEQ ID NO: 8536869 - DNA, 22 bp, Homo sapiens
attttcagcccccactcgtggc

SEQ ID NO: 8536870 - DNA, 22 bp, Homo sapiens
attttcagtgatcatagcacac

SEQ ID NO: 8536871 - DNA, 22 bp, Homo sapiens
atttgtctctgcactttactca

SEQ ID NO: 8536872 - DNA, 22 bp, Homo sapiens
atttgtctctctgggtttactt

SEQ ID NO: 8536873 - DNA, 22 bp, Homo sapiens
attttagagctccaagtacagc

SEQ ID NO: 8536874 - DNA, 22 bp, Homo sapiens
atttgtctagtggtattcacgt

SEQ ID NO: 8536875 - DNA, 22 bp, Homo sapiens
atttgtctaatgagtgtgtact

SEQ ID NO: 8536876 - DNA, 22 bp, Homo sapiens
atttgtcatatataatactctt

SEQ ID NO: 8536877 - DNA, 22 bp, Homo sapiens
atttgtcatgtatgtaaagttg

SEQ ID NO: 8536878 - DNA, 22 bp, Homo sapiens
atttgtcaataagatgaacata

SEQ ID NO: 8536879 - DNA, 22 bp, Homo sapiens
atttgtcagtggaagtgattca

SEQ ID NO: 8536880 - DNA, 22 bp, Homo sapiens
atttgtcactgagagagttaga

SEQ ID NO: 8536881 - DNA, 22 bp, Homo sapiens
atttgtactcaggaattctgct

SEQ ID NO: 8536882 - DNA, 22 bp, Homo sapiens
atttgtaccatactgtttatta

SEQ ID NO: 8536883 - DNA, 22 bp, Homo sapiens
atttgtagtgaagtgaaaataa

SEQ ID NO: 8536884 - DNA, 22 bp, Homo sapiens
atttgtagtgaagtgaaaataa

SEQ ID NO: 8536885 - DNA, 22 bp, Homo sapiens
atttgtagtgaagtgaaaataa

SEQ ID NO: 8536886 - DNA, 22 bp, Homo sapiens
atttgtatatttaagagggtag

SEQ ID NO: 8536887 - DNA, 22 bp, Homo sapiens
atttgtatcaatctcaatatat

SEQ ID NO: 8536888 - DNA, 22 bp, Homo sapiens
atttgtatcaatctcaatatat

SEQ ID NO: 8536889 - DNA, 22 bp, Homo sapiens
atttgtatcaatctcaatatat

SEQ ID NO: 8536890 - DNA, 22 bp, Homo sapiens
atttgtatcttctaatattatc

SEQ ID NO: 8536891 - DNA, 22 bp, Homo sapiens
atttgtatcttctaatattatc

SEQ ID NO: 8536892 - DNA, 22 bp, Homo sapiens
atttgtatcttctaatattatc

SEQ ID NO: 8536893 - DNA, 22 bp, Homo sapiens
atttgtatcttctaatattatc

SEQ ID NO: 8536894 - DNA, 22 bp, Homo sapiens
atttgtatcttctaatattatc

SEQ ID NO: 8536895 - DNA, 22 bp, Homo sapiens
atttgtcaaaacacagagaaca

SEQ ID NO: 8536896 - DNA, 22 bp, Homo sapiens
atttgtcaaaacacagagaaca

SEQ ID NO: 8536897 - DNA, 22 bp, Homo sapiens
atttgtcaataagatgaacata

SEQ ID NO: 8536898 - DNA, 22 bp, Homo sapiens
atttggttactcagttgtctga

SEQ ID NO: 8536899 - DNA, 22 bp, Homo sapiens
atttggtttcaggattctcagg

SEQ ID NO: 8536900 - DNA, 22 bp, Homo sapiens
atttgtaacacgtgacaggttg

SEQ ID NO: 8536901 - DNA, 22 bp, Homo sapiens
atttgtaagctagagccatgat

SEQ ID NO: 8536902 - DNA, 22 bp, Homo sapiens
atttgtacaaatttatgttagt

SEQ ID NO: 8536903 - DNA, 22 bp, Homo sapiens
atttgtacaaatttatgttagt

SEQ ID NO: 8536904 - DNA, 22 bp, Homo sapiens
atttgtaatttcttatctgtgt

SEQ ID NO: 8536905 - DNA, 22 bp, Homo sapiens
atttcttcctctgtcagtaact

SEQ ID NO: 8536906 - DNA, 22 bp, Homo sapiens
atttggggctcaccagggctga

SEQ ID NO: 8536907 - DNA, 22 bp, Homo sapiens
atttggtctccatactggttag

SEQ ID NO: 8536908 - DNA, 22 bp, Homo sapiens
atttggtcatgttcagtgtaga

SEQ ID NO: 8536909 - DNA, 22 bp, Homo sapiens
gccttccttacacctgctcagc

SEQ ID NO: 8536910 - DNA, 17 bp, Homo sapiens
gccttccttcctccaca

SEQ ID NO: 8536911 - DNA, 22 bp, Homo sapiens
gccttccttacacctgctcagc

SEQ ID NO: 8536912 - DNA, 22 bp, Homo sapiens
gccttccctggctaggcaagca

SEQ ID NO: 8536913 - DNA, 22 bp, Homo sapiens
gccttcctgcagctctgagcgt

SEQ ID NO: 8536914 - DNA, 22 bp, Homo sapiens
gccttcctgcagctctgagcgt

SEQ ID NO: 8536915 - DNA, 22 bp, Homo sapiens
gccttcccaccctgcgaggctg

SEQ ID NO: 8536916 - DNA, 22 bp, Homo sapiens
gccttcccaccctgcgaggctg

SEQ ID NO: 8536917 - DNA, 19 bp, Homo sapiens
gccttcccaccacccgtcc

SEQ ID NO: 8536918 - DNA, 22 bp, Homo sapiens
gccttccaggcagggggagcag

SEQ ID NO: 8536919 - DNA, 22 bp, Homo sapiens
attttcctagtcatgtgcttct

SEQ ID NO: 8536920 - DNA, 22 bp, Homo sapiens
attttcctccatgtgagcagtt

SEQ ID NO: 8536921 - DNA, 22 bp, Homo sapiens
gcctgtgcttaactgacgtgag

SEQ ID NO: 8536922 - DNA, 17 bp, Homo sapiens
gccttccagcatgtggg

SEQ ID NO: 8536923 - DNA, 22 bp, Homo sapiens
attttcattttgcagggtgaga

SEQ ID NO: 8536924 - DNA, 22 bp, Homo sapiens
attttcattttgcagggtgaga

SEQ ID NO: 8536925 - DNA, 21 bp, Homo sapiens
attttcatttccaggggagga

SEQ ID NO: 8536926 - DNA, 21 bp, Homo sapiens
attttcattaattcagtgtgg

SEQ ID NO: 8536927 - DNA, 21 bp, Homo sapiens
attttcattaattcagtgtgg

SEQ ID NO: 8536928 - DNA, 22 bp, Homo sapiens
attttccaaaataattgttact

SEQ ID NO: 8536929 - DNA, 22 bp, Homo sapiens
attttccaaaataattgttact

SEQ ID NO: 8536930 - DNA, 22 bp, Homo sapiens
attttccagcctttctagaact

SEQ ID NO: 8536931 - DNA, 22 bp, Homo sapiens
attttccagcctttctagaact

SEQ ID NO: 8536932 - DNA, 22 bp, Homo sapiens
attttcatcatgggtttaacat

SEQ ID NO: 8536933 - DNA, 22 bp, Homo sapiens
attttcatcatgggtttaacat

SEQ ID NO: 8536934 - DNA, 22 bp, Homo sapiens
attttcatcatgggtttaacat

SEQ ID NO: 8536935 - DNA, 22 bp, Homo sapiens
attttcatcatgggtttaacat

SEQ ID NO: 8536936 - DNA, 22 bp, Homo sapiens
attttcatcgctaggttggcct

SEQ ID NO: 8536937 - DNA, 22 bp, Homo sapiens
attttcagttgaaaaagttggt

SEQ ID NO: 8536938 - DNA, 22 bp, Homo sapiens
attttcatcatgggtttaacat

SEQ ID NO: 8536939 - DNA, 22 bp, Homo sapiens
attttcagtgtaaatgttttat

SEQ ID NO: 8536940 - DNA, 22 bp, Homo sapiens
attttcagttgaaaaagttggt

SEQ ID NO: 8536941 - DNA, 22 bp, Homo sapiens
attttcagttgaaaaagttggt

SEQ ID NO: 8536942 - DNA, 22 bp, Homo sapiens
attttcatgactaccttaaata

SEQ ID NO: 8536943 - DNA, 22 bp, Homo sapiens
attttcatggcttctgctcagt

SEQ ID NO: 8536944 - DNA, 22 bp, Homo sapiens
attttcatgactaccttaaata

SEQ ID NO: 8536945 - DNA, 22 bp, Homo sapiens
attttcatcgctaggttggcct

SEQ ID NO: 8536946 - DNA, 22 bp, Homo sapiens
attttcatggcttctgctcagt

SEQ ID NO: 8536947 - DNA, 22 bp, Homo sapiens
attttcatggcttctgctcagt

SEQ ID NO: 8536948 - DNA, 21 bp, Homo sapiens
attttcattaattcagtgtgg

SEQ ID NO: 8536949 - DNA, 22 bp, Homo sapiens
caaaagaagctcttggggctag

SEQ ID NO: 8536950 - DNA, 22 bp, Homo sapiens
caaaagaagctcttggggctag

SEQ ID NO: 8536951 - DNA, 22 bp, Homo sapiens
gctcagagagtttcacaagttt

SEQ ID NO: 8536952 - DNA, 19 bp, Homo sapiens
gctcagagacacctgttgc

SEQ ID NO: 8536953 - DNA, 19 bp, Homo sapiens
gctcagagacacctgttgc

SEQ ID NO: 8536954 - DNA, 22 bp, Homo sapiens
gctcagagaatcagcagacacc

SEQ ID NO: 8536955 - DNA, 22 bp, Homo sapiens
gctcagagaagttgtgcctggc

SEQ ID NO: 8536956 - DNA, 22 bp, Homo sapiens
gctcagagaatttactgctgcc

SEQ ID NO: 8536957 - DNA, 22 bp, Homo sapiens
gctcagagaagttaaggaattt

SEQ ID NO: 8536958 - DNA, 22 bp, Homo sapiens
gctcagagaagttaaggaattt

SEQ ID NO: 8536959 - DNA, 20 bp, Homo sapiens
caaaagcaatgaagttatga

SEQ ID NO: 8536960 - DNA, 20 bp, Homo sapiens
caaaagcaatgaagttatga

SEQ ID NO: 8536961 - DNA, 20 bp, Homo sapiens
caaaagcaatgaagttatga

SEQ ID NO: 8536962 - DNA, 20 bp, Homo sapiens
caaaagcaatgaagttatga

SEQ ID NO: 8536963 - DNA, 21 bp, Homo sapiens
caaaagagactgattcttgga

SEQ ID NO: 8536964 - DNA, 22 bp, Homo sapiens
caaaagaagctcttggggctag

SEQ ID NO: 8536965 - DNA, 22 bp, Homo sapiens
caaaagaagctcttggggctag

SEQ ID NO: 8536966 - DNA, 22 bp, Homo sapiens
caaaagatacttgcatctaact

SEQ ID NO: 8536967 - DNA, 22 bp, Homo sapiens
caaaagatacttgcatctaact

SEQ ID NO: 8536968 - DNA, 22 bp, Homo sapiens
caaaagatacttgcatctaact

SEQ ID NO: 8536969 - DNA, 22 bp, Homo sapiens
caaaagatacttgcatctaact

SEQ ID NO: 8536970 - DNA, 22 bp, Homo sapiens
gctcagagaaattataggaatt

SEQ ID NO: 8536971 - DNA, 22 bp, Homo sapiens
gctcagagaaagattagtccct

SEQ ID NO: 8536972 - DNA, 22 bp, Homo sapiens
gctcagagaaattataggaatt

SEQ ID NO: 8536973 - DNA, 22 bp, Homo sapiens
gctcagagaaaactggggcttg

SEQ ID NO: 8536974 - DNA, 22 bp, Homo sapiens
attttgcacactatgcagcttt

SEQ ID NO: 8536975 - DNA, 22 bp, Homo sapiens
attttgcacactatgcagcttt

SEQ ID NO: 8536976 - DNA, 22 bp, Homo sapiens
attttgctgtggtacattagga

SEQ ID NO: 8536977 - DNA, 22 bp, Homo sapiens
attttgctggtctgaattactt

SEQ ID NO: 8536978 - DNA, 22 bp, Homo sapiens
attttgctgctatgccttgcaa

SEQ ID NO: 8536979 - DNA, 22 bp, Homo sapiens
attttgctacagttggtggaaa

SEQ ID NO: 8536980 - DNA, 17 bp, Homo sapiens
gccttccttcctccaca

SEQ ID NO: 8536981 - DNA, 17 bp, Homo sapiens
gccttccttcctccaca

SEQ ID NO: 8536982 - DNA, 17 bp, Homo sapiens
gccttccttcctccaca

SEQ ID NO: 8536983 - DNA, 22 bp, Homo sapiens
gccttccttttaccaccagcca

SEQ ID NO: 8536984 - DNA, 22 bp, Homo sapiens
attttgaatcaccttggaagaa

SEQ ID NO: 8536985 - DNA, 22 bp, Homo sapiens
attttgaatcaccttggaagaa

SEQ ID NO: 8536986 - DNA, 22 bp, Homo sapiens
attttgataatcatgttagaga

SEQ ID NO: 8536987 - DNA, 22 bp, Homo sapiens
attttgataatcatgttagaga

SEQ ID NO: 8536988 - DNA, 22 bp, Homo sapiens
attttgactgcattacagaaca

SEQ ID NO: 8536989 - DNA, 22 bp, Homo sapiens
attttgactgcattacagaaca

SEQ ID NO: 8536990 - DNA, 22 bp, Homo sapiens
attttgataatcatgttagaga

SEQ ID NO: 8536991 - DNA, 22 bp, Homo sapiens
attttgataatcatgttagaga

SEQ ID NO: 8536992 - DNA, 22 bp, Homo sapiens
attttgatgctatctaatgaat

SEQ ID NO: 8536993 - DNA, 22 bp, Homo sapiens
attttgatgctatctaatgaat

SEQ ID NO: 8536994 - DNA, 22 bp, Homo sapiens
caaagactgcataacacatgaa

SEQ ID NO: 8536995 - DNA, 22 bp, Homo sapiens
caaagactgcataacacatgaa

SEQ ID NO: 8536996 - DNA, 22 bp, Homo sapiens
caaagagctgttcagtgtcgct

SEQ ID NO: 8536997 - DNA, 22 bp, Homo sapiens
gctctgagagtgggtgattctg

SEQ ID NO: 8536998 - DNA, 22 bp, Homo sapiens
caaagaccatgtggcctgaaaa

SEQ ID NO: 8536999 - DNA, 22 bp, Homo sapiens
gctctgctgggtgggcagttat

SEQ ID NO: 8537000 - DNA, 22 bp, Homo sapiens
gctctgctgtgtttgttcagca

SEQ ID NO: 8537001 - DNA, 22 bp, Homo sapiens
caaagaatgagtgagtacataa

SEQ ID NO: 8537002 - DNA, 22 bp, Homo sapiens
caaagaatcactcatctttagc

SEQ ID NO: 8537003 - DNA, 22 bp, Homo sapiens
caaagaaggaactataatccca

SEQ ID NO: 8537004 - DNA, 22 bp, Homo sapiens
caaagaagagatttacagagct

SEQ ID NO: 8537005 - DNA, 22 bp, Homo sapiens
caaagaagagatttacagagct

SEQ ID NO: 8537006 - DNA, 22 bp, Homo sapiens
caaagaatcactcatctttagc

SEQ ID NO: 8537007 - DNA, 22 bp, Homo sapiens
caaagaatagtgagaagatgta

SEQ ID NO: 8537008 - DNA, 22 bp, Homo sapiens
caaagaaggaactataatccca

SEQ ID NO: 8537009 - DNA, 22 bp, Homo sapiens
caaagaaggaactataatccca

SEQ ID NO: 8537010 - DNA, 22 bp, Homo sapiens
caaagaatagcatggcatttgt

SEQ ID NO: 8537011 - DNA, 22 bp, Homo sapiens
gctcccagggcagcgcagaaga

SEQ ID NO: 8537012 - DNA, 22 bp, Homo sapiens
gctcccagggcagcgcagaaga

SEQ ID NO: 8537013 - DNA, 22 bp, Homo sapiens
gctcccagggcagcgcagaaga

SEQ ID NO: 8537014 - DNA, 22 bp, Homo sapiens
gctcccagggcagcgcagaaga

SEQ ID NO: 8537015 - DNA, 22 bp, Homo sapiens
gctcccagggcagcgcagaaga

SEQ ID NO: 8537016 - DNA, 22 bp, Homo sapiens
gctcccaggttcttgggccttg

SEQ ID NO: 8537017 - DNA, 22 bp, Homo sapiens
gctcccagttcccaaagtgacc

SEQ ID NO: 8537018 - DNA, 22 bp, Homo sapiens
gctcccagtctgatggaggaga

SEQ ID NO: 8537019 - DNA, 22 bp, Homo sapiens
gctcccagtctgatggaggaga

SEQ ID NO: 8537020 - DNA, 22 bp, Homo sapiens
gctcccaggatgaggagccagg

SEQ ID NO: 8537021 - DNA, 22 bp, Homo sapiens
gctccagggacccaagagaaaa

SEQ ID NO: 8537022 - DNA, 22 bp, Homo sapiens
gctccagggaacagaatgtact

SEQ ID NO: 8537023 - DNA, 22 bp, Homo sapiens
gctccagggaacagaatgtact

SEQ ID NO: 8537024 - DNA, 22 bp, Homo sapiens
gctcccaggatgaggagccagg

SEQ ID NO: 8537025 - DNA, 22 bp, Homo sapiens
gctccagggaacagaatgtact

SEQ ID NO: 8537026 - DNA, 22 bp, Homo sapiens
gctcccagggacactggccact

SEQ ID NO: 8537027 - DNA, 22 bp, Homo sapiens
gctcccaggcatggaggtaatt

SEQ ID NO: 8537028 - DNA, 22 bp, Homo sapiens
gctcccaggcatggaggtaatt

SEQ ID NO: 8537029 - DNA, 22 bp, Homo sapiens
gctcccaggcatggaggtaatt

SEQ ID NO: 8537030 - DNA, 22 bp, Homo sapiens
gctcccagggacactggccact

SEQ ID NO: 8537031 - DNA, 22 bp, Homo sapiens
gctcccagggaccgcagggcag

SEQ ID NO: 8537032 - DNA, 22 bp, Homo sapiens
gctcccagggaccgcagggcag

SEQ ID NO: 8537033 - DNA, 22 bp, Homo sapiens
gctcccagggaccgcagggcag

SEQ ID NO: 8537034 - DNA, 22 bp, Homo sapiens
gctcccagggaccgcagggcag

SEQ ID NO: 8537035 - DNA, 22 bp, Homo sapiens
attgtacagatgaggtaagtga

SEQ ID NO: 8537036 - DNA, 22 bp, Homo sapiens
attgtacagatgaggtaagtga

SEQ ID NO: 8537037 - DNA, 22 bp, Homo sapiens
attgtacagacatgggaaacaa

SEQ ID NO: 8537038 - DNA, 22 bp, Homo sapiens
attgtacactagtggcagcagt

SEQ ID NO: 8537039 - DNA, 22 bp, Homo sapiens
gcatggcatttgaaggtagaag

SEQ ID NO: 8537040 - DNA, 22 bp, Homo sapiens
gcatggcattaacaagatggaa

SEQ ID NO: 8537041 - DNA, 22 bp, Homo sapiens
attgtacatgcagtgagtcatc

SEQ ID NO: 8537042 - DNA, 22 bp, Homo sapiens
attgtacatgcagtgagtcatc

SEQ ID NO: 8537043 - DNA, 22 bp, Homo sapiens
attgtacaggttggaggaagtg

SEQ ID NO: 8537044 - DNA, 22 bp, Homo sapiens
attgtacagctctgagaggggg

SEQ ID NO: 8537045 - DNA, 22 bp, Homo sapiens
gccagccacaagggaggcttgt

SEQ ID NO: 8537046 - DNA, 22 bp, Homo sapiens
gccagccacgttagactggccc

SEQ ID NO: 8537047 - DNA, 22 bp, Homo sapiens
gccagccaagattgagaaggta

SEQ ID NO: 8537048 - DNA, 22 bp, Homo sapiens
gccagccacaagggaggcttgt

SEQ ID NO: 8537049 - DNA, 19 bp, Homo sapiens
attgtacattgagtttggc

SEQ ID NO: 8537050 - DNA, 22 bp, Homo sapiens
attgtacatgcagtgagtcatc

SEQ ID NO: 8537051 - DNA, 22 bp, Homo sapiens
attgtactacaccatagtactg

SEQ ID NO: 8537052 - DNA, 20 bp, Homo sapiens
attgtacttctgttgatggt

SEQ ID NO: 8537053 - DNA, 22 bp, Homo sapiens
attgtactccctctcctgcccg

SEQ ID NO: 8537054 - DNA, 22 bp, Homo sapiens
gccagccacttcagctatggct

SEQ ID NO: 8537055 - DNA, 22 bp, Homo sapiens
gccagccacttcagctatggct

SEQ ID NO: 8537056 - DNA, 22 bp, Homo sapiens
gccagccagaaacgtcacactg

SEQ ID NO: 8537057 - DNA, 22 bp, Homo sapiens
gccagccacttcccagactggc

SEQ ID NO: 8537058 - DNA, 22 bp, Homo sapiens
gccagccacttcccagactggc

SEQ ID NO: 8537059 - DNA, 22 bp, Homo sapiens
gccagccagaaacgtcacactg

SEQ ID NO: 8537060 - DNA, 23 bp, Homo sapiens
gccagccagaatttctccactgt

SEQ ID NO: 8537061 - DNA, 22 bp, Homo sapiens
gccagccagggaagggagagac

SEQ ID NO: 8537062 - DNA, 22 bp, Homo sapiens
gccagccagagtggctgtgtgt

SEQ ID NO: 8537063 - DNA, 22 bp, Homo sapiens
gccagccagagaggcatggtta

SEQ ID NO: 8537064 - DNA, 23 bp, Homo sapiens
gccagccagaatttctccactgt

SEQ ID NO: 8537065 - DNA, 22 bp, Homo sapiens
gccagccagagtccatctgaga

SEQ ID NO: 8537066 - DNA, 22 bp, Homo sapiens
gccagccagagaggcatggtta

SEQ ID NO: 8537067 - DNA, 22 bp, Homo sapiens
gccagccagtttgctgatggct

SEQ ID NO: 8537068 - DNA, 18 bp, Homo sapiens
gccagctgcacggccctc

SEQ ID NO: 8537069 - DNA, 22 bp, Homo sapiens
gccagctgcatctcctgggctg

SEQ ID NO: 8537070 - DNA, 21 bp, Homo sapiens
gccagctgcagggcttccttg

SEQ ID NO: 8537071 - DNA, 21 bp, Homo sapiens
gccagctgcagggcttccttg

SEQ ID NO: 8537072 - DNA, 20 bp, Homo sapiens
gccagctgcccttccaccct

SEQ ID NO: 8537073 - DNA, 20 bp, Homo sapiens
gccagctgcccttccaccct

SEQ ID NO: 8537074 - DNA, 22 bp, Homo sapiens
gccagctgctcgcgtagggtag

SEQ ID NO: 8537075 - DNA, 22 bp, Homo sapiens
gccagctgctggaacagcgcga

SEQ ID NO: 8537076 - DNA, 22 bp, Homo sapiens
gccagctgccaagttgtgagat

SEQ ID NO: 8537077 - DNA, 22 bp, Homo sapiens
gccagctgcatctcctgggctg

SEQ ID NO: 8537078 - DNA, 22 bp, Homo sapiens
gccagctgccctctgctggtcc

SEQ ID NO: 8537079 - DNA, 22 bp, Homo sapiens
gccagctgccctctgctggtcc

SEQ ID NO: 8537080 - DNA, 22 bp, Homo sapiens
gccaggtggctgagcagctgca

SEQ ID NO: 8537081 - DNA, 22 bp, Homo sapiens
gccatcatatcccctgtgacct

SEQ ID NO: 8537082 - DNA, 22 bp, Homo sapiens
gccatcatatcccctgtgacct

SEQ ID NO: 8537083 - DNA, 22 bp, Homo sapiens
gccatcatatcccctgtgacct

SEQ ID NO: 8537084 - DNA, 22 bp, Homo sapiens
atttattatgggatttggcaca

SEQ ID NO: 8537085 - DNA, 22 bp, Homo sapiens
atttattatgggatttggcaca

SEQ ID NO: 8537086 - DNA, 22 bp, Homo sapiens
atttattacctcggagtttctg

SEQ ID NO: 8537087 - DNA, 22 bp, Homo sapiens
atttattacctcggagtttctg

SEQ ID NO: 8537088 - DNA, 22 bp, Homo sapiens
atttatgactggtgaatagaac

SEQ ID NO: 8537089 - DNA, 22 bp, Homo sapiens
atttatgactggtgaatagaac

SEQ ID NO: 8537090 - DNA, 22 bp, Homo sapiens
atttatgagctgaaccatgaaa

SEQ ID NO: 8537091 - DNA, 22 bp, Homo sapiens
atttatgagctgaaccatgaaa

SEQ ID NO: 8537092 - DNA, 22 bp, Homo sapiens
atttatgattagcctattgttg

SEQ ID NO: 8537093 - DNA, 18 bp, Homo sapiens
atttatgctaatgggata

SEQ ID NO: 8537094 - DNA, 22 bp, Homo sapiens
atttatgcatcccagcatgtga

SEQ ID NO: 8537095 - DNA, 22 bp, Homo sapiens
atttatgattagcctattgttg

SEQ ID NO: 8537096 - DNA, 22 bp, Homo sapiens
atttatgatagctgcattaaag

SEQ ID NO: 8537097 - DNA, 22 bp, Homo sapiens
atttattaagcatctgctatgt

SEQ ID NO: 8537098 - DNA, 22 bp, Homo sapiens
atttattaagcatctgctatgt

SEQ ID NO: 8537099 - DNA, 22 bp, Homo sapiens
atttatgtatctgtgtagatca

SEQ ID NO: 8537100 - DNA, 22 bp, Homo sapiens
atttatattttgggagctcctg

SEQ ID NO: 8537101 - DNA, 22 bp, Homo sapiens
atttatcaccagttagctgact

SEQ ID NO: 8537102 - DNA, 22 bp, Homo sapiens
atttatcaccagttagctgact

SEQ ID NO: 8537103 - DNA, 22 bp, Homo sapiens
atttatgacaaccaaagagtga

SEQ ID NO: 8537104 - DNA, 22 bp, Homo sapiens
atttatgacaaccaaagagtga

SEQ ID NO: 8537105 - DNA, 22 bp, Homo sapiens
atttatgacagaagatatgctg

SEQ ID NO: 8537106 - DNA, 22 bp, Homo sapiens
atttatgacgtgttcggtcaat

SEQ ID NO: 8537107 - DNA, 22 bp, Homo sapiens
atttatgacagaagatatgctg

SEQ ID NO: 8537108 - DNA, 22 bp, Homo sapiens
gccagctggagactggcagggg

SEQ ID NO: 8537109 - DNA, 22 bp, Homo sapiens
gccagctggagactggcagggg

SEQ ID NO: 8537110 - DNA, 22 bp, Homo sapiens
gccagctgctggaacagcgcga

SEQ ID NO: 8537111 - DNA, 22 bp, Homo sapiens
gccagctgcttctccagaattt

SEQ ID NO: 8537112 - DNA, 22 bp, Homo sapiens
gccagctggaaatctgcttgaa

SEQ ID NO: 8537113 - DNA, 21 bp, Homo sapiens
atttagaaggaaattttgcaa

SEQ ID NO: 8537114 - DNA, 22 bp, Homo sapiens
gccagctggagtgagagtgggc

SEQ ID NO: 8537115 - DNA, 21 bp, Homo sapiens
atttagaaggaaattttgcaa

SEQ ID NO: 8537116 - DNA, 22 bp, Homo sapiens
gccagctggagtgagagtgggc

SEQ ID NO: 8537117 - DNA, 22 bp, Homo sapiens
atttagtttaggaaaagtaggt

SEQ ID NO: 8537118 - DNA, 22 bp, Homo sapiens
atttagtttaggaaaagtaggt

SEQ ID NO: 8537119 - DNA, 22 bp, Homo sapiens
gccatgcttggtatgctgtgag

SEQ ID NO: 8537120 - DNA, 22 bp, Homo sapiens
gccatgcagcttattaaagtgg

SEQ ID NO: 8537121 - DNA, 22 bp, Homo sapiens
gccatgcaatggaataaaatca

SEQ ID NO: 8537122 - DNA, 23 bp, Homo sapiens
gccatgagttccctttcacttgt

SEQ ID NO: 8537123 - DNA, 22 bp, Homo sapiens
gccatggcccataccaggtgca

SEQ ID NO: 8537124 - DNA, 22 bp, Homo sapiens
atttattggtttgcatggtgaa

SEQ ID NO: 8537125 - DNA, 22 bp, Homo sapiens
atttattggtttgcatggtgaa

SEQ ID NO: 8537126 - DNA, 22 bp, Homo sapiens
atttcaacagagtttgaaggca

SEQ ID NO: 8537127 - DNA, 19 bp, Homo sapiens
atttattgtatgattccat

SEQ ID NO: 8537128 - DNA, 19 bp, Homo sapiens
atttattgtatgattccat

SEQ ID NO: 8537129 - DNA, 19 bp, Homo sapiens
atttattgtatgattccat

SEQ ID NO: 8537130 - DNA, 20 bp, Homo sapiens
gccatgaggggaggtgactg

SEQ ID NO: 8537131 - DNA, 22 bp, Homo sapiens
gccatgaggctccgagaagtca

SEQ ID NO: 8537132 - DNA, 23 bp, Homo sapiens
gccatctggtatttcctgacttc

SEQ ID NO: 8537133 - DNA, 22 bp, Homo sapiens
gccatcctctgagcactaggca

SEQ ID NO: 8537134 - DNA, 22 bp, Homo sapiens
gccatcctctgagcactaggca

SEQ ID NO: 8537135 - DNA, 22 bp, Homo sapiens
gccatctgcgcggtgtccagct

SEQ ID NO: 8537136 - DNA, 22 bp, Homo sapiens
atttcaaggctacagaaacctt

SEQ ID NO: 8537137 - DNA, 19 bp, Homo sapiens
atttcaagaggtttattgg

SEQ ID NO: 8537138 - DNA, 22 bp, Homo sapiens
atttcaacgttagatgtaatag

SEQ ID NO: 8537139 - DNA, 22 bp, Homo sapiens
atttcaacgttagatgtaatag

SEQ ID NO: 8537140 - DNA, 22 bp, Homo sapiens
atttcaagtgttgagctcataa

SEQ ID NO: 8537141 - DNA, 19 bp, Homo sapiens
gcccaggggcccgatgctg

SEQ ID NO: 8537142 - DNA, 22 bp, Homo sapiens
gcccagggtctacaaaaatatt

SEQ ID NO: 8537143 - DNA, 19 bp, Homo sapiens
gcccaggggcccgatgctg

SEQ ID NO: 8537144 - DNA, 22 bp, Homo sapiens
gcccaggagttgaatgcagcag

SEQ ID NO: 8537145 - DNA, 22 bp, Homo sapiens
gcccaggagttgaatgcagcag

SEQ ID NO: 8537146 - DNA, 22 bp, Homo sapiens
gcccaggagttgaatgcagcag

SEQ ID NO: 8537147 - DNA, 22 bp, Homo sapiens
gcccagggtctacaaaaatatt

SEQ ID NO: 8537148 - DNA, 22 bp, Homo sapiens
gcccagggtgaagtgcagttgt

SEQ ID NO: 8537149 - DNA, 22 bp, Homo sapiens
gcccagggtgcttagaacccat

SEQ ID NO: 8537150 - DNA, 22 bp, Homo sapiens
gcccagggtgcttagaacccat

SEQ ID NO: 8537151 - DNA, 22 bp, Homo sapiens
gcccaggttggagagcagtggc

SEQ ID NO: 8537152 - DNA, 22 bp, Homo sapiens
gcccagtctcttctggccctgt

SEQ ID NO: 8537153 - DNA, 22 bp, Homo sapiens
gcccagtctcttctggccctgt

SEQ ID NO: 8537154 - DNA, 21 bp, Homo sapiens
gcccagtgatttcttcacagt

SEQ ID NO: 8537155 - DNA, 22 bp, Homo sapiens
gcccagtgccctagaatgcact

SEQ ID NO: 8537156 - DNA, 22 bp, Homo sapiens
gcccagtgctgagggtgctgct

SEQ ID NO: 8537157 - DNA, 22 bp, Homo sapiens
gcccagtagttcaaggttgcag

SEQ ID NO: 8537158 - DNA, 22 bp, Homo sapiens
atttcttcaggtcagaaataga

SEQ ID NO: 8537159 - DNA, 22 bp, Homo sapiens
atttcttatgaatattgactgt

SEQ ID NO: 8537160 - DNA, 22 bp, Homo sapiens
atttcttcaggtcagaaataga

SEQ ID NO: 8537161 - DNA, 22 bp, Homo sapiens
atttcttacataacaaattgtt

SEQ ID NO: 8537162 - DNA, 22 bp, Homo sapiens
atttcttacataacaaattgtt

SEQ ID NO: 8537163 - DNA, 22 bp, Homo sapiens
atttcttatctgaggtctacat

SEQ ID NO: 8537164 - DNA, 22 bp, Homo sapiens
atttcttatctgaggtctacat

SEQ ID NO: 8537165 - DNA, 22 bp, Homo sapiens
atttctgtttgctactataagt

SEQ ID NO: 8537166 - DNA, 22 bp, Homo sapiens
atttctgtttgctactataagt

SEQ ID NO: 8537167 - DNA, 22 bp, Homo sapiens
atttcttaaaacttcagggaga

SEQ ID NO: 8537168 - DNA, 18 bp, Homo sapiens
gccctggtggagctggtg

SEQ ID NO: 8537169 - DNA, 22 bp, Homo sapiens
gccctggttttagaggagcagg

SEQ ID NO: 8537170 - DNA, 22 bp, Homo sapiens
gccctgtcctcctgactgagtg

SEQ ID NO: 8537171 - DNA, 22 bp, Homo sapiens
gccctgtcccttggcttctagg

SEQ ID NO: 8537172 - DNA, 22 bp, Homo sapiens
gccctgtcggaactgcgacctc

SEQ ID NO: 8537173 - DNA, 22 bp, Homo sapiens
gccctgtgagattagaacagca

SEQ ID NO: 8537174 - DNA, 20 bp, Homo sapiens
gccctgtgatgtcttgacct

SEQ ID NO: 8537175 - DNA, 20 bp, Homo sapiens
gccctgtgatgtcttgacct

SEQ ID NO: 8537176 - DNA, 22 bp, Homo sapiens
gccctgtgatggagactagagg

SEQ ID NO: 8537177 - DNA, 22 bp, Homo sapiens
atttcccactcaggccgcggcg

SEQ ID NO: 8537178 - DNA, 22 bp, Homo sapiens
atttcccactctactacatgct

SEQ ID NO: 8537179 - DNA, 22 bp, Homo sapiens
atttcccactctactacatgct

SEQ ID NO: 8537180 - DNA, 22 bp, Homo sapiens
atttcccactctactacatgct

SEQ ID NO: 8537181 - DNA, 22 bp, Homo sapiens
atttcccagataaacagctgga

SEQ ID NO: 8537182 - DNA, 22 bp, Homo sapiens
atttcccaatacgctaagtgga

SEQ ID NO: 8537183 - DNA, 22 bp, Homo sapiens
gcccagtgctgagggtgctgct

SEQ ID NO: 8537184 - DNA, 22 bp, Homo sapiens
gcccagtgctgagggtgctgct

SEQ ID NO: 8537185 - DNA, 22 bp, Homo sapiens
gcccagtgctgagggtgctgct

SEQ ID NO: 8537186 - DNA, 22 bp, Homo sapiens
atttcccaggactagaaatata

SEQ ID NO: 8537187 - DNA, 22 bp, Homo sapiens
atttcccagctttgatcagttt

SEQ ID NO: 8537188 - DNA, 22 bp, Homo sapiens
atttcccaggactagaaatata

SEQ ID NO: 8537189 - DNA, 17 bp, Homo sapiens
atttcccagcagtgcta

SEQ ID NO: 8537190 - DNA, 22 bp, Homo sapiens
atttcccagataaacagctgga

SEQ ID NO: 8537191 - DNA, 22 bp, Homo sapiens
atttcccagggccctcatagtt

SEQ ID NO: 8537192 - DNA, 22 bp, Homo sapiens
atttcccagggcctgggatttg

SEQ ID NO: 8537193 - DNA, 22 bp, Homo sapiens
atttcccagggccctcatagtt

SEQ ID NO: 8537194 - DNA, 22 bp, Homo sapiens
atttcccaggactagaaatata

SEQ ID NO: 8537195 - DNA, 22 bp, Homo sapiens
gccctggggaaggtgtctccaa

SEQ ID NO: 8537196 - DNA, 22 bp, Homo sapiens
gccctggggaaggtgtctccaa

SEQ ID NO: 8537197 - DNA, 22 bp, Homo sapiens
gccctgggctccctgctccaca

SEQ ID NO: 8537198 - DNA, 22 bp, Homo sapiens
gccctgggctccctgctccaca

SEQ ID NO: 8537199 - DNA, 17 bp, Homo sapiens
gccctgcctgctgccct

SEQ ID NO: 8537200 - DNA, 22 bp, Homo sapiens
gccctgggctccctgctccaca

SEQ ID NO: 8537201 - DNA, 22 bp, Homo sapiens
atttcctaatttatgcaggagt

SEQ ID NO: 8537202 - DNA, 22 bp, Homo sapiens
atttcctaacagaggcaacagt

SEQ ID NO: 8537203 - DNA, 22 bp, Homo sapiens
atttcctaatttagggatagac

SEQ ID NO: 8537204 - DNA, 23 bp, Homo sapiens
atttcctactataaaagaggtaa

SEQ ID NO: 8537205 - DNA, 22 bp, Homo sapiens
atttcctaatttatgcaggagt

SEQ ID NO: 8537206 - DNA, 23 bp, Homo sapiens
atttcctaaaagataatcattac

SEQ ID NO: 8537207 - DNA, 23 bp, Homo sapiens
atttcctaaaagataatcattac

SEQ ID NO: 8537208 - DNA, 23 bp, Homo sapiens
atttcctaaaagataatcattac

SEQ ID NO: 8537209 - DNA, 22 bp, Homo sapiens
atttcccatgtgaatcaattgg

SEQ ID NO: 8537210 - DNA, 23 bp, Homo sapiens
atttcccattgtgtcagcagagc

SEQ ID NO: 8537211 - DNA, 22 bp, Homo sapiens
attaacttttgatcagtgtggt

SEQ ID NO: 8537212 - DNA, 21 bp, Homo sapiens
attaacttgttaacctaaagt

SEQ ID NO: 8537213 - DNA, 22 bp, Homo sapiens
attaagatcattgtagaagatt

SEQ ID NO: 8537214 - DNA, 22 bp, Homo sapiens
attagttggggtggagaaggat

SEQ ID NO: 8537215 - DNA, 22 bp, Homo sapiens
attataggcttgagccaccgtg

SEQ ID NO: 8537216 - DNA, 22 bp, Homo sapiens
attataggcttgagccaccgtg

SEQ ID NO: 8537217 - DNA, 22 bp, Homo sapiens
attataggcttgagccaccgtg

SEQ ID NO: 8537218 - DNA, 22 bp, Homo sapiens
attatagggaattctagaagtc

SEQ ID NO: 8537219 - DNA, 22 bp, Homo sapiens
attataggcttgagccaccgtg

SEQ ID NO: 8537220 - DNA, 22 bp, Homo sapiens
attataggcttgagccaccgtg

SEQ ID NO: 8537221 - DNA, 22 bp, Homo sapiens
attataggcttgagccaccgtg

SEQ ID NO: 8537222 - DNA, 22 bp, Homo sapiens
attataggcttgagccaccgtg

SEQ ID NO: 8537223 - DNA, 22 bp, Homo sapiens
attataggcttgagccaccgtg

SEQ ID NO: 8537224 - DNA, 22 bp, Homo sapiens
attatcaagtttactgtgtgga

SEQ ID NO: 8537225 - DNA, 22 bp, Homo sapiens
attatcacatggactttgcttt

SEQ ID NO: 8537226 - DNA, 22 bp, Homo sapiens
attatccaacacccagttacat

SEQ ID NO: 8537227 - DNA, 22 bp, Homo sapiens
attatccagcaccaatgtcaga

SEQ ID NO: 8537228 - DNA, 22 bp, Homo sapiens
gcacacagaattgattcactgt

SEQ ID NO: 8537229 - DNA, 22 bp, Homo sapiens
gcacacagaattgattcactgt

SEQ ID NO: 8537230 - DNA, 22 bp, Homo sapiens
attatattgagtataaccagag

SEQ ID NO: 8537231 - DNA, 22 bp, Homo sapiens
attatatttgaaaggttggaag

SEQ ID NO: 8537232 - DNA, 22 bp, Homo sapiens
attatattgagtataaccagag

SEQ ID NO: 8537233 - DNA, 22 bp, Homo sapiens
attatattgagtataaccagag

SEQ ID NO: 8537234 - DNA, 22 bp, Homo sapiens
attatatgtgggatagaattta

SEQ ID NO: 8537235 - DNA, 22 bp, Homo sapiens
attatatgtgggatagaattta

SEQ ID NO: 8537236 - DNA, 22 bp, Homo sapiens
attatataggacttgcccttcc

SEQ ID NO: 8537237 - DNA, 22 bp, Homo sapiens
attatataggacttgcccttcc

SEQ ID NO: 8537238 - DNA, 22 bp, Homo sapiens
attatataggacttgcccttcc

SEQ ID NO: 8537239 - DNA, 22 bp, Homo sapiens
attatataggacttgcccttcc

SEQ ID NO: 8537240 - DNA, 22 bp, Homo sapiens
gcaccaggcagctgagcaggcc

SEQ ID NO: 8537241 - DNA, 22 bp, Homo sapiens
gcaccaggcagctgagcaggcc

SEQ ID NO: 8537242 - DNA, 22 bp, Homo sapiens
gcaccaggcagctgagcaggcc

SEQ ID NO: 8537243 - DNA, 22 bp, Homo sapiens
gcaccaggcagctgagcaggcc

SEQ ID NO: 8537244 - DNA, 22 bp, Homo sapiens
gcacacaggcagtttccagcca

SEQ ID NO: 8537245 - DNA, 22 bp, Homo sapiens
gcacagggcctggcacataaga

SEQ ID NO: 8537246 - DNA, 22 bp, Homo sapiens
gcacagggcctggcacataaga

SEQ ID NO: 8537247 - DNA, 22 bp, Homo sapiens
gcaccaggaggcccttctcatc

SEQ ID NO: 8537248 - DNA, 22 bp, Homo sapiens
gcaccaggtgcagccgggcccc

SEQ ID NO: 8537249 - DNA, 22 bp, Homo sapiens
gcaccaggtgcagccgggcccc

SEQ ID NO: 8537250 - DNA, 22 bp, Homo sapiens
gcaccagggagggtgtgcttca

SEQ ID NO: 8537251 - DNA, 22 bp, Homo sapiens
gcaccagggagggtgtgcttca

SEQ ID NO: 8537252 - DNA, 22 bp, Homo sapiens
gcaccaggcttagagccccagg

SEQ ID NO: 8537253 - DNA, 22 bp, Homo sapiens
gcaccaggcttagagccccagg

SEQ ID NO: 8537254 - DNA, 22 bp, Homo sapiens
gcaccaggcagctgagcaggcc

SEQ ID NO: 8537255 - DNA, 22 bp, Homo sapiens
gcacacagctagattaccattc

SEQ ID NO: 8537256 - DNA, 22 bp, Homo sapiens
gcacacagctagattaccattc

SEQ ID NO: 8537257 - DNA, 22 bp, Homo sapiens
gcacacaggcagtttccagcca

SEQ ID NO: 8537258 - DNA, 22 bp, Homo sapiens
gcacacaggcagtttccagcca

SEQ ID NO: 8537259 - DNA, 22 bp, Homo sapiens
gcacacaggcagtttccagcca

SEQ ID NO: 8537260 - DNA, 22 bp, Homo sapiens
gcacacaggcagtttccagcca

SEQ ID NO: 8537261 - DNA, 22 bp, Homo sapiens
gcacacaggcagtttccagcca

SEQ ID NO: 8537262 - DNA, 22 bp, Homo sapiens
gcacacagccagctgagggcta

SEQ ID NO: 8537263 - DNA, 22 bp, Homo sapiens
gcacacagccagctgagggcta

SEQ ID NO: 8537264 - DNA, 22 bp, Homo sapiens
gcacacagctagattaccattc

SEQ ID NO: 8537265 - DNA, 22 bp, Homo sapiens
gcacacagccagctgagggcta

SEQ ID NO: 8537266 - DNA, 22 bp, Homo sapiens
gcacacagattaggaaacagaa

SEQ ID NO: 8537267 - DNA, 22 bp, Homo sapiens
gcacacagattaggaaacagaa

SEQ ID NO: 8537268 - DNA, 22 bp, Homo sapiens
gcacacagagaggtggtatgtc

SEQ ID NO: 8537269 - DNA, 22 bp, Homo sapiens
gcacacagaattgattcactgt

SEQ ID NO: 8537270 - DNA, 22 bp, Homo sapiens
gcacacagactaaccatatttc

SEQ ID NO: 8537271 - DNA, 22 bp, Homo sapiens
gcacccacttaggccagtcaat

SEQ ID NO: 8537272 - DNA, 22 bp, Homo sapiens
gcaccatgacagtgaggagaac

SEQ ID NO: 8537273 - DNA, 22 bp, Homo sapiens
gcacccagaataaggacaggac

SEQ ID NO: 8537274 - DNA, 22 bp, Homo sapiens
gcacccagaataaggacaggac

SEQ ID NO: 8537275 - DNA, 22 bp, Homo sapiens
gcacccagaataaggacaggac

SEQ ID NO: 8537276 - DNA, 22 bp, Homo sapiens
attatgctggtttacacatttt

SEQ ID NO: 8537277 - DNA, 22 bp, Homo sapiens
attatctatgtagaatgatttt

SEQ ID NO: 8537278 - DNA, 22 bp, Homo sapiens
attatctcaagggatagcagat

SEQ ID NO: 8537279 - DNA, 22 bp, Homo sapiens
attatcttgataaaatggcagt

SEQ ID NO: 8537280 - DNA, 22 bp, Homo sapiens
attatgaagttgagggaccctg

SEQ ID NO: 8537281 - DNA, 22 bp, Homo sapiens
attatgtatttggtatagtttg

SEQ ID NO: 8537282 - DNA, 22 bp, Homo sapiens
gcagagaaggattgaaaccaga

SEQ ID NO: 8537283 - DNA, 22 bp, Homo sapiens
attatgtaggttaggtggttgt

SEQ ID NO: 8537284 - DNA, 22 bp, Homo sapiens
attatgtagctaaaaattgtgt

SEQ ID NO: 8537285 - DNA, 22 bp, Homo sapiens
attatgtagctaaaaattgtgt

SEQ ID NO: 8537286 - DNA, 22 bp, Homo sapiens
attatgtaactgtggttcagca

SEQ ID NO: 8537287 - DNA, 22 bp, Homo sapiens
attatgggtataacacagttat

SEQ ID NO: 8537288 - DNA, 22 bp, Homo sapiens
attatggagaaatatgtacagg

SEQ ID NO: 8537289 - DNA, 22 bp, Homo sapiens
attatggatggaggcattagtc

SEQ ID NO: 8537290 - DNA, 22 bp, Homo sapiens
attatggacgttaattttggaa

SEQ ID NO: 8537291 - DNA, 22 bp, Homo sapiens
attatggacatcaaataactct

SEQ ID NO: 8537292 - DNA, 22 bp, Homo sapiens
attatgcttaggaaaatatgaa

SEQ ID NO: 8537293 - DNA, 22 bp, Homo sapiens
gcagagaggatattattgtcca

SEQ ID NO: 8537294 - DNA, 22 bp, Homo sapiens
gcagagaggaatgaagccatcc

SEQ ID NO: 8537295 - DNA, 22 bp, Homo sapiens
gcagagagttgggctgcgccag

SEQ ID NO: 8537296 - DNA, 21 bp, Homo sapiens
gcagagaatgaactttggctt

SEQ ID NO: 8537297 - DNA, 22 bp, Homo sapiens
gcagagactccactgtcttgtg

SEQ ID NO: 8537298 - DNA, 22 bp, Homo sapiens
gcagagactagtagtgcagact

SEQ ID NO: 8537299 - DNA, 22 bp, Homo sapiens
gcagagatgagctatcaggaca

SEQ ID NO: 8537300 - DNA, 22 bp, Homo sapiens
gcagagattatgccatggaaag

SEQ ID NO: 8537301 - DNA, 22 bp, Homo sapiens
gcagagattatgccatggaaag

SEQ ID NO: 8537302 - DNA, 22 bp, Homo sapiens
attcaagtccagcttctctaca

SEQ ID NO: 8537303 - DNA, 22 bp, Homo sapiens
attcaagtggctgctatgttaa

SEQ ID NO: 8537304 - DNA, 22 bp, Homo sapiens
attcaagtggctgctatgttaa

SEQ ID NO: 8537305 - DNA, 22 bp, Homo sapiens
attcaataaatatgctacatgg

SEQ ID NO: 8537306 - DNA, 22 bp, Homo sapiens
attcaagttcttctgtctttgc

SEQ ID NO: 8537307 - DNA, 22 bp, Homo sapiens
attcaagttcttctgtctttgc

SEQ ID NO: 8537308 - DNA, 22 bp, Homo sapiens
gagtggggcccactgctgggtg

SEQ ID NO: 8537309 - DNA, 22 bp, Homo sapiens
gagtggggcccactgctgggtg

SEQ ID NO: 8537310 - DNA, 22 bp, Homo sapiens
gagtggggcccactgctgggtg

SEQ ID NO: 8537311 - DNA, 23 bp, Homo sapiens
gagtggggagaaattggttaaac

SEQ ID NO: 8537312 - DNA, 23 bp, Homo sapiens
gagtggggagaaattggttaaac

SEQ ID NO: 8537313 - DNA, 23 bp, Homo sapiens
gagtggggagaaattggttaaac

SEQ ID NO: 8537314 - DNA, 22 bp, Homo sapiens
gagtggggaaagccaggacaga

SEQ ID NO: 8537315 - DNA, 22 bp, Homo sapiens
gagtggggaaagccaggacaga

SEQ ID NO: 8537316 - DNA, 22 bp, Homo sapiens
gagtggggaaagccaggacaga

SEQ ID NO: 8537317 - DNA, 22 bp, Homo sapiens
gagtgggcttggggagagtttg

SEQ ID NO: 8537318 - DNA, 22 bp, Homo sapiens
atgttatgtgcaagatacataa

SEQ ID NO: 8537319 - DNA, 22 bp, Homo sapiens
atgttatgtgcaagatacataa

SEQ ID NO: 8537320 - DNA, 22 bp, Homo sapiens
atgttattaaagtacagattct

SEQ ID NO: 8537321 - DNA, 22 bp, Homo sapiens
atgttattaaagtacagattct

SEQ ID NO: 8537322 - DNA, 23 bp, Homo sapiens
atgttattattagcagtcttgcc

SEQ ID NO: 8537323 - DNA, 22 bp, Homo sapiens
atgttattcaatttgaatccaa

SEQ ID NO: 8537324 - DNA, 21 bp, Homo sapiens
atgttattctgttcctccagc

SEQ ID NO: 8537325 - DNA, 22 bp, Homo sapiens
gagtggggcgtggatccagcgt

SEQ ID NO: 8537326 - DNA, 22 bp, Homo sapiens
gagtggggcccactgctgggtg

SEQ ID NO: 8537327 - DNA, 22 bp, Homo sapiens
gagtggggcgtggatccagcgt

SEQ ID NO: 8537328 - DNA, 22 bp, Homo sapiens
gagtggggcgtggatccagcgt

SEQ ID NO: 8537329 - DNA, 22 bp, Homo sapiens
gagtggggcgtggatccagcgt

SEQ ID NO: 8537330 - DNA, 22 bp, Homo sapiens
gagtggggcgtggatccagcgt

SEQ ID NO: 8537331 - DNA, 22 bp, Homo sapiens
atgttatgtctgggaaggggta

SEQ ID NO: 8537332 - DNA, 22 bp, Homo sapiens
gatggcaggtagtggtctcatc

SEQ ID NO: 8537333 - DNA, 22 bp, Homo sapiens
gatggcaggtagtggtctcatc

SEQ ID NO: 8537334 - DNA, 22 bp, Homo sapiens
gatggcaggcaggtgagtagag

SEQ ID NO: 8537335 - DNA, 22 bp, Homo sapiens
gatggcagcagcagccagggat

SEQ ID NO: 8537336 - DNA, 22 bp, Homo sapiens
gatggcagcagcagccagggat

SEQ ID NO: 8537337 - DNA, 22 bp, Homo sapiens
gatggcagcagcagccagggat

SEQ ID NO: 8537338 - DNA, 22 bp, Homo sapiens
gatggcagtcaaccaggtgagg

SEQ ID NO: 8537339 - DNA, 22 bp, Homo sapiens
gatggcagtcaaccaggtgagg

SEQ ID NO: 8537340 - DNA, 22 bp, Homo sapiens
gatggcaggtgatagccgagtc

SEQ ID NO: 8537341 - DNA, 22 bp, Homo sapiens
gatggcaggtagtggtctcatc

SEQ ID NO: 8537342 - DNA, 22 bp, Homo sapiens
gatggcaggtgatagccgagtc

SEQ ID NO: 8537343 - DNA, 22 bp, Homo sapiens
gatggcacacagacatccccgc

SEQ ID NO: 8537344 - DNA, 22 bp, Homo sapiens
gatggagtgccagggtggaact

SEQ ID NO: 8537345 - DNA, 22 bp, Homo sapiens
gatggcacacagacatccccgc

SEQ ID NO: 8537346 - DNA, 22 bp, Homo sapiens
gatggcacacagacatccccgc

SEQ ID NO: 8537347 - DNA, 21 bp, Homo sapiens
gatgatggcaggcagcactgg

SEQ ID NO: 8537348 - DNA, 22 bp, Homo sapiens
gatgatgggatccagcaatgta

SEQ ID NO: 8537349 - DNA, 22 bp, Homo sapiens
gatggagtctgaagctgggaac

SEQ ID NO: 8537350 - DNA, 22 bp, Homo sapiens
atgttatttattgaaacacttt

SEQ ID NO: 8537351 - DNA, 22 bp, Homo sapiens
atgttatttctgaaagatcatt

SEQ ID NO: 8537352 - DNA, 22 bp, Homo sapiens
atgttatttcaaaattcccttg

SEQ ID NO: 8537353 - DNA, 22 bp, Homo sapiens
atgttatttattgaaacacttt

SEQ ID NO: 8537354 - DNA, 22 bp, Homo sapiens
atgttatttattgaaacacttt

SEQ ID NO: 8537355 - DNA, 22 bp, Homo sapiens
atgttattgatgcctgaggctt

SEQ ID NO: 8537356 - DNA, 22 bp, Homo sapiens
atgttatttattatcctcggtt

SEQ ID NO: 8537357 - DNA, 20 bp, Homo sapiens
gatgtcttggtcacagtggc

SEQ ID NO: 8537358 - DNA, 22 bp, Homo sapiens
gatgtcttggtcaacttgggct

SEQ ID NO: 8537359 - DNA, 20 bp, Homo sapiens
gatgtcttggtcacagtggc

SEQ ID NO: 8537360 - DNA, 22 bp, Homo sapiens
gatgtcttcccatgttcatgtg

SEQ ID NO: 8537361 - DNA, 22 bp, Homo sapiens
gatgtcttggcttgctctctgt

SEQ ID NO: 8537362 - DNA, 22 bp, Homo sapiens
gatgtcttctcaactgtagacc

SEQ ID NO: 8537363 - DNA, 22 bp, Homo sapiens
gatgtcttctcaactgtagacc

SEQ ID NO: 8537364 - DNA, 22 bp, Homo sapiens
gatgtctttgccatgcatgtgt

SEQ ID NO: 8537365 - DNA, 22 bp, Homo sapiens
gatgtctttgctgttatccact

SEQ ID NO: 8537366 - DNA, 22 bp, Homo sapiens
gatgtctttttccaggctcttt

SEQ ID NO: 8537367 - DNA, 22 bp, Homo sapiens
gatgtctttctaatactggctt

SEQ ID NO: 8537368 - DNA, 22 bp, Homo sapiens
gatgtctttctgtgtgcctaga

SEQ ID NO: 8537369 - DNA, 22 bp, Homo sapiens
gatgtctttctgtgtgcctaga

SEQ ID NO: 8537370 - DNA, 22 bp, Homo sapiens
gatgtctttgaggctcactgct

SEQ ID NO: 8537371 - DNA, 22 bp, Homo sapiens
gatgtctttgaggctcactgct

SEQ ID NO: 8537372 - DNA, 22 bp, Homo sapiens
gatgtctttctgtgtgcctaga

SEQ ID NO: 8537373 - DNA, 22 bp, Homo sapiens
gatgtgagtggtagctgggatt

SEQ ID NO: 8537374 - DNA, 22 bp, Homo sapiens
gattcactcatattttacgttt

SEQ ID NO: 8537375 - DNA, 22 bp, Homo sapiens
gattccacagcttcgaggtctt

SEQ ID NO: 8537376 - DNA, 22 bp, Homo sapiens
gattcatgttatagagagtcag

SEQ ID NO: 8537377 - DNA, 22 bp, Homo sapiens
gattcataccgtttcttctcca

SEQ ID NO: 8537378 - DNA, 22 bp, Homo sapiens
gattcagtgggctttgggacag

SEQ ID NO: 8537379 - DNA, 22 bp, Homo sapiens
gattcagtgggctttgggacag

SEQ ID NO: 8537380 - DNA, 22 bp, Homo sapiens
gattcagtgagggtgagaagaa

SEQ ID NO: 8537381 - DNA, 22 bp, Homo sapiens
gattcagtgagggtgagaagaa

SEQ ID NO: 8537382 - DNA, 22 bp, Homo sapiens
gattcaggcctgcatctcagca

SEQ ID NO: 8537383 - DNA, 22 bp, Homo sapiens
gattcagtgagggtgagaagaa

SEQ ID NO: 8537384 - DNA, 22 bp, Homo sapiens
gatgtgtaacatgctgtgacat

SEQ ID NO: 8537385 - DNA, 22 bp, Homo sapiens
gatgtgggtgtcttcagctggt

SEQ ID NO: 8537386 - DNA, 22 bp, Homo sapiens
gatgtggggttgagggaccagc

SEQ ID NO: 8537387 - DNA, 22 bp, Homo sapiens
gattctgagctggtgttttacg

SEQ ID NO: 8537388 - DNA, 22 bp, Homo sapiens
gattctggattgtctgcttgaa

SEQ ID NO: 8537389 - DNA, 22 bp, Homo sapiens
gattcctgctattcacagggct

SEQ ID NO: 8537390 - DNA, 22 bp, Homo sapiens
gattccacggctcagcctcaac

SEQ ID NO: 8537391 - DNA, 22 bp, Homo sapiens
gattcccatgtctgaggaggtg

SEQ ID NO: 8537392 - DNA, 22 bp, Homo sapiens
gattcccatcctcagcagcagc

SEQ ID NO: 8537393 - DNA, 22 bp, Homo sapiens
gattcttacttctaagcaagct

SEQ ID NO: 8537394 - DNA, 22 bp, Homo sapiens
gattctgggtcctgtgtcttgc

SEQ ID NO: 8537395 - DNA, 22 bp, Homo sapiens
gattctggcaaaatcctggctt

SEQ ID NO: 8537396 - DNA, 20 bp, Homo sapiens
gattctgggcagtcagtgtc

SEQ ID NO: 8537397 - DNA, 22 bp, Homo sapiens
gattcttgggccttctgaagtt

SEQ ID NO: 8537398 - DNA, 22 bp, Homo sapiens
gattctggagttaaggatgcct

SEQ ID NO: 8537399 - DNA, 22 bp, Homo sapiens
attaaattggatctgcatagtt

SEQ ID NO: 8537400 - DNA, 22 bp, Homo sapiens
attaacagaattttacatgctt

SEQ ID NO: 8537401 - DNA, 20 bp, Homo sapiens
attaacactgagctatgggt

SEQ ID NO: 8537402 - DNA, 22 bp, Homo sapiens
attaacactttggagtctgctc

SEQ ID NO: 8537403 - DNA, 22 bp, Homo sapiens
attaacatgcagccagacacac

SEQ ID NO: 8537404 - DNA, 22 bp, Homo sapiens
attaacatgagttggagatagg

SEQ ID NO: 8537405 - DNA, 22 bp, Homo sapiens
attaacatgagttggagatagg

SEQ ID NO: 8537406 - DNA, 19 bp, Homo sapiens
attaacatcagtgttggcc

SEQ ID NO: 8537407 - DNA, 22 bp, Homo sapiens
gcagcttggatttctgtagttt

SEQ ID NO: 8537408 - DNA, 19 bp, Homo sapiens
gcaggcagctggggtatcc

SEQ ID NO: 8537409 - DNA, 22 bp, Homo sapiens
gcaggattgggctgaaggagtg

SEQ ID NO: 8537410 - DNA, 22 bp, Homo sapiens
gcagcttggtgaaaggtgatgg

SEQ ID NO: 8537411 - DNA, 22 bp, Homo sapiens
gcaggcaggaaggactaagtaa

SEQ ID NO: 8537412 - DNA, 22 bp, Homo sapiens
gcaggcaggaaggactaagtaa

SEQ ID NO: 8537413 - DNA, 22 bp, Homo sapiens
gcaggcaggagcccaactgcct

SEQ ID NO: 8537414 - DNA, 22 bp, Homo sapiens
gcaggcaggagcccaactgcct

SEQ ID NO: 8537415 - DNA, 22 bp, Homo sapiens
gcaggcaggagcccaactgcct

SEQ ID NO: 8537416 - DNA, 22 bp, Homo sapiens
gcaggcaggagcccaactgcct

SEQ ID NO: 8537417 - DNA, 22 bp, Homo sapiens
gcaggcaggcttccttgaactg

SEQ ID NO: 8537418 - DNA, 22 bp, Homo sapiens
gcaggcaggcttccttgaactg

SEQ ID NO: 8537419 - DNA, 22 bp, Homo sapiens
gcaggcaggcttccttgaactg

SEQ ID NO: 8537420 - DNA, 22 bp, Homo sapiens
gcaggcaggcttccttgaactg

SEQ ID NO: 8537421 - DNA, 22 bp, Homo sapiens
attctgagaaatgcattgtcag

SEQ ID NO: 8537422 - DNA, 22 bp, Homo sapiens
attctgaattctgagcctttca

SEQ ID NO: 8537423 - DNA, 22 bp, Homo sapiens
attctgaggacagagtctagca

SEQ ID NO: 8537424 - DNA, 22 bp, Homo sapiens
attctctgtttccaagatgaaa

SEQ ID NO: 8537425 - DNA, 22 bp, Homo sapiens
attctctttgtataacatcttg

SEQ ID NO: 8537426 - DNA, 22 bp, Homo sapiens
attctcataggagcgtgaacct

SEQ ID NO: 8537427 - DNA, 22 bp, Homo sapiens
attctcatttgctggctatatg

SEQ ID NO: 8537428 - DNA, 22 bp, Homo sapiens
attctcatttttatagatgaga

SEQ ID NO: 8537429 - DNA, 22 bp, Homo sapiens
gcagctgtgggcctcggagagc

SEQ ID NO: 8537430 - DNA, 22 bp, Homo sapiens
gcagctgtgggttccaagtcta

SEQ ID NO: 8537431 - DNA, 22 bp, Homo sapiens
gcagctgtgtaatgagcccaca

SEQ ID NO: 8537432 - DNA, 21 bp, Homo sapiens
attctgagttgtcagtcttca

SEQ ID NO: 8537433 - DNA, 22 bp, Homo sapiens
attccaaacttaccccagagga

SEQ ID NO: 8537434 - DNA, 22 bp, Homo sapiens
attcatgaatctacattgtggt

SEQ ID NO: 8537435 - DNA, 22 bp, Homo sapiens
attcacaagttgatggatattt

SEQ ID NO: 8537436 - DNA, 22 bp, Homo sapiens
attcacaagttgatggatattt

SEQ ID NO: 8537437 - DNA, 19 bp, Homo sapiens
attcatttttgccttctaa

SEQ ID NO: 8537438 - DNA, 22 bp, Homo sapiens
attcacaaagaagggaagtaca

SEQ ID NO: 8537439 - DNA, 20 bp, Homo sapiens
attcacaaagccagtgttgc

SEQ ID NO: 8537440 - DNA, 22 bp, Homo sapiens
attcaataagtcactgtggaat

SEQ ID NO: 8537441 - DNA, 22 bp, Homo sapiens
attcacaaaatgatatagatac

SEQ ID NO: 8537442 - DNA, 22 bp, Homo sapiens
attcacaaatgctgccccattc

SEQ ID NO: 8537443 - DNA, 22 bp, Homo sapiens
attcacaaagtcacccttacac

SEQ ID NO: 8537444 - DNA, 22 bp, Homo sapiens
attcacaagttctagggattag

SEQ ID NO: 8537445 - DNA, 22 bp, Homo sapiens
attcacaactgatccttgctca

SEQ ID NO: 8537446 - DNA, 16 bp, Homo sapiens
attcacaaggcatcgg

SEQ ID NO: 8537447 - DNA, 22 bp, Homo sapiens
attccacttatatgaagtaacg

SEQ ID NO: 8537448 - DNA, 22 bp, Homo sapiens
attccactgttataaaatgtcc

SEQ ID NO: 8537449 - DNA, 22 bp, Homo sapiens
attccactgccgaatgatacat

SEQ ID NO: 8537450 - DNA, 22 bp, Homo sapiens
attccactgccgaatgatacat

SEQ ID NO: 8537451 - DNA, 22 bp, Homo sapiens
attccacatgaaaggagctgaa

SEQ ID NO: 8537452 - DNA, 22 bp, Homo sapiens
attccacatgaaaggagctgaa

SEQ ID NO: 8537453 - DNA, 22 bp, Homo sapiens
attccacagtgccttccgtgaa

SEQ ID NO: 8537454 - DNA, 22 bp, Homo sapiens
attccacagtgtgtggtgagga

SEQ ID NO: 8537455 - DNA, 22 bp, Homo sapiens
attccacataggccttcatgac

SEQ ID NO: 8537456 - DNA, 22 bp, Homo sapiens
attccacaggactaccaatgtg

SEQ ID NO: 8537457 - DNA, 22 bp, Homo sapiens
attccacagctacgttttgagc

SEQ ID NO: 8537458 - DNA, 22 bp, Homo sapiens
attccacagctcagcctctctt

SEQ ID NO: 8537459 - DNA, 22 bp, Homo sapiens
attccacagctacgttttgagc

SEQ ID NO: 8537460 - DNA, 22 bp, Homo sapiens
attccacaggagctggttttct

SEQ ID NO: 8537461 - DNA, 17 bp, Homo sapiens
attccacagggaatctg

SEQ ID NO: 8537462 - DNA, 22 bp, Homo sapiens
attccacaggagctggttttct

SEQ ID NO: 8537463 - DNA, 17 bp, Homo sapiens
attccacagggaatctg

SEQ ID NO: 8537464 - DNA, 22 bp, Homo sapiens
attccacagctacatcaatcta

SEQ ID NO: 8537465 - DNA, 22 bp, Homo sapiens
attccacagctacatcaatcta

SEQ ID NO: 8537466 - DNA, 22 bp, Homo sapiens
attccacagctacatcaatcta

SEQ ID NO: 8537467 - DNA, 22 bp, Homo sapiens
attccacagccgataccatgac

SEQ ID NO: 8537468 - DNA, 22 bp, Homo sapiens
attccacagaggactccgattg

SEQ ID NO: 8537469 - DNA, 22 bp, Homo sapiens
attccacagccgataccatgac

SEQ ID NO: 8537470 - DNA, 22 bp, Homo sapiens
attccacagctacatcaatcta

SEQ ID NO: 8537471 - DNA, 22 bp, Homo sapiens
attccacacagtaatactcaat

SEQ ID NO: 8537472 - DNA, 22 bp, Homo sapiens
attccacacagtaatactcaat

SEQ ID NO: 8537473 - DNA, 22 bp, Homo sapiens
attccacacagtaatactcaat

SEQ ID NO: 8537474 - DNA, 22 bp, Homo sapiens
attccacacagtaatactcaat

SEQ ID NO: 8537475 - DNA, 22 bp, Homo sapiens
attccacaagaccataaattag

SEQ ID NO: 8537476 - DNA, 22 bp, Homo sapiens
attccaattgtacttgctttta

SEQ ID NO: 8537477 - DNA, 22 bp, Homo sapiens
attccaattgtacttgctttta

SEQ ID NO: 8537478 - DNA, 22 bp, Homo sapiens
attccaattgtacttgctttta

SEQ ID NO: 8537479 - DNA, 22 bp, Homo sapiens
gcatggcagtgaggatggtgct

SEQ ID NO: 8537480 - DNA, 22 bp, Homo sapiens
gcatggcagtgaggatggtgct

SEQ ID NO: 8537481 - DNA, 22 bp, Homo sapiens
gcatggcaagatcaggagacca

SEQ ID NO: 8537482 - DNA, 22 bp, Homo sapiens
gcatggaattcccttatgggcc

SEQ ID NO: 8537483 - DNA, 22 bp, Homo sapiens
gcatggaattcccttatgggcc

SEQ ID NO: 8537484 - DNA, 22 bp, Homo sapiens
gcatggatctaagaggtcaagg

SEQ ID NO: 8537485 - DNA, 22 bp, Homo sapiens
gcatggatgggagtggacagat

SEQ ID NO: 8537486 - DNA, 22 bp, Homo sapiens
gcatggcaaatatcgagggcag

SEQ ID NO: 8537487 - DNA, 18 bp, Homo sapiens
attgcacaccagcctggg

SEQ ID NO: 8537488 - DNA, 22 bp, Homo sapiens
attgcacaaacacagtcagact

SEQ ID NO: 8537489 - DNA, 22 bp, Homo sapiens
attgcacaaagagggaaactga

SEQ ID NO: 8537490 - DNA, 22 bp, Homo sapiens
attgcaatctggtgaaaacagt

SEQ ID NO: 8537491 - DNA, 22 bp, Homo sapiens
attgcaagtgctagctaaaata

SEQ ID NO: 8537492 - DNA, 22 bp, Homo sapiens
attgcaatctggtgaaaacagt

SEQ ID NO: 8537493 - DNA, 22 bp, Homo sapiens
attgcactccagcctgggtgac

SEQ ID NO: 8537494 - DNA, 22 bp, Homo sapiens
attgcactccagcctgggggac

SEQ ID NO: 8537495 - DNA, 22 bp, Homo sapiens
attgcactccagccctgctgac

SEQ ID NO: 8537496 - DNA, 22 bp, Homo sapiens
attgcactccagcctgggggac

SEQ ID NO: 8537497 - DNA, 19 bp, Homo sapiens
gcatgcttggtggcttctg

SEQ ID NO: 8537498 - DNA, 22 bp, Homo sapiens
gcatcattttcttcttcctgca

SEQ ID NO: 8537499 - DNA, 22 bp, Homo sapiens
gcatcattctggctctttccat

SEQ ID NO: 8537500 - DNA, 19 bp, Homo sapiens
gcatcatttgtctcttctt

SEQ ID NO: 8537501 - DNA, 22 bp, Homo sapiens
attgcactccagcctgggtgac

SEQ ID NO: 8537502 - DNA, 22 bp, Homo sapiens
attgcactccggcctgggtgac

SEQ ID NO: 8537503 - DNA, 22 bp, Homo sapiens
attgcactccggcctgggtgac

SEQ ID NO: 8537504 - DNA, 22 bp, Homo sapiens
gcagtaaaaaaggatatgtgca

SEQ ID NO: 8537505 - DNA, 22 bp, Homo sapiens
attcttttttaaggaatagaac

SEQ ID NO: 8537506 - DNA, 22 bp, Homo sapiens
attgaaaaatgactattgctta

SEQ ID NO: 8537507 - DNA, 22 bp, Homo sapiens
gcaggtgtggagtggggtgagc

SEQ ID NO: 8537508 - DNA, 22 bp, Homo sapiens
attgcaaatgagtcttaatata

SEQ ID NO: 8537509 - DNA, 22 bp, Homo sapiens
attgcaaaggtcccattcaaga

SEQ ID NO: 8537510 - DNA, 22 bp, Homo sapiens
attgcaaaggtcccattcaaga

SEQ ID NO: 8537511 - DNA, 22 bp, Homo sapiens
attgcaaaggtcccattcaaga

SEQ ID NO: 8537512 - DNA, 22 bp, Homo sapiens
attgcaaataactgtactgaat

SEQ ID NO: 8537513 - DNA, 22 bp, Homo sapiens
attgcaaagcattgtgagcgca

SEQ ID NO: 8537514 - DNA, 22 bp, Homo sapiens
attgcaaagcgtagactctaaa

SEQ ID NO: 8537515 - DNA, 22 bp, Homo sapiens
attgcaaaggtcccattcaaga

SEQ ID NO: 8537516 - DNA, 20 bp, Homo sapiens
gcaggcagggaatgggggtg

SEQ ID NO: 8537517 - DNA, 20 bp, Homo sapiens
gcaggcagggaatgggggtg

SEQ ID NO: 8537518 - DNA, 20 bp, Homo sapiens
gcaggcagggaatgggggtg

SEQ ID NO: 8537519 - DNA, 20 bp, Homo sapiens
attctgctttgaaaataagg

SEQ ID NO: 8537520 - DNA, 22 bp, Homo sapiens
attctggaaagctattctctct

SEQ ID NO: 8537521 - DNA, 22 bp, Homo sapiens
attctggaaagctattctctct

SEQ ID NO: 8537522 - DNA, 22 bp, Homo sapiens
attctgctggtaactctataaa

SEQ ID NO: 8537523 - DNA, 16 bp, Homo sapiens
attctgctgcctgctc

SEQ ID NO: 8537524 - DNA, 22 bp, Homo sapiens
attctgctcattttatttccag

SEQ ID NO: 8537525 - DNA, 22 bp, Homo sapiens
gcagggcagtaagagctagagt

SEQ ID NO: 8537526 - DNA, 22 bp, Homo sapiens
gcagggcagtgtgtctgtgggg

SEQ ID NO: 8537527 - DNA, 22 bp, Homo sapiens
gcagggcagtaagagctagagt

SEQ ID NO: 8537528 - DNA, 22 bp, Homo sapiens
gcagggcagtgtgtctgtgggg

SEQ ID NO: 8537529 - DNA, 22 bp, Homo sapiens
gcagggcagtgtgtctgtgggg

SEQ ID NO: 8537530 - DNA, 22 bp, Homo sapiens
gcagggcatagaggcacggagg

SEQ ID NO: 8537531 - DNA, 22 bp, Homo sapiens
gcagggcatccctgagcgggtg

SEQ ID NO: 8537532 - DNA, 22 bp, Homo sapiens
gcagggcatccctgagcgggtg

SEQ ID NO: 8537533 - DNA, 22 bp, Homo sapiens
gcagggcatccctgagcgggtg

SEQ ID NO: 8537534 - DNA, 22 bp, Homo sapiens
attctttccagacactgattgc

SEQ ID NO: 8537535 - DNA, 22 bp, Homo sapiens
attctttccagacactgattgc

SEQ ID NO: 8537536 - DNA, 20 bp, Homo sapiens
gcagggcatcttggccccca

SEQ ID NO: 8537537 - DNA, 22 bp, Homo sapiens
attcttttcccaactgctttaa

SEQ ID NO: 8537538 - DNA, 22 bp, Homo sapiens
attcttttcccaactgctttaa

SEQ ID NO: 8537539 - DNA, 22 bp, Homo sapiens
attcttttaagccccagggatt

SEQ ID NO: 8537540 - DNA, 22 bp, Homo sapiens
attcttttgtcctagcttgata

SEQ ID NO: 8537541 - DNA, 22 bp, Homo sapiens
attcttttaagccccagggatt

SEQ ID NO: 8537542 - DNA, 22 bp, Homo sapiens
attcttttaaatggcagtagta

SEQ ID NO: 8537543 - DNA, 22 bp, Homo sapiens
attcttttaaatggcagtagta

SEQ ID NO: 8537544 - DNA, 22 bp, Homo sapiens
attctttggacaataagtggtg

SEQ ID NO: 8537545 - DNA, 19 bp, Homo sapiens
attctttggtgtccatttc

SEQ ID NO: 8537546 - DNA, 22 bp, Homo sapiens
attctttgaacagttttcctgt

SEQ ID NO: 8537547 - DNA, 17 bp, Homo sapiens
attctttgatgtctctg

SEQ ID NO: 8537548 - DNA, 21 bp, Homo sapiens
attctttgatgtgcaataagt

SEQ ID NO: 8537549 - DNA, 22 bp, Homo sapiens
attctttggacaataagtggtg

SEQ ID NO: 8537550 - DNA, 22 bp, Homo sapiens
attctttgcatctctgggtggc

SEQ ID NO: 8537551 - DNA, 22 bp, Homo sapiens
atctggaatccttgtggacaat

SEQ ID NO: 8537552 - DNA, 22 bp, Homo sapiens
atctggaatccttgtggacaat

SEQ ID NO: 8537553 - DNA, 22 bp, Homo sapiens
atctggaattaagagaaagtga

SEQ ID NO: 8537554 - DNA, 22 bp, Homo sapiens
atctggactagagcagaatggg

SEQ ID NO: 8537555 - DNA, 22 bp, Homo sapiens
cttctccagccacgcccactcc

SEQ ID NO: 8537556 - DNA, 22 bp, Homo sapiens
atctggagaataaatgtccaag

SEQ ID NO: 8537557 - DNA, 22 bp, Homo sapiens
atctggagaataaatgtccaag

SEQ ID NO: 8537558 - DNA, 22 bp, Homo sapiens
cttctccctggcttctgcacac

SEQ ID NO: 8537559 - DNA, 19 bp, Homo sapiens
cttctccagcttctagaag

SEQ ID NO: 8537560 - DNA, 22 bp, Homo sapiens
cttctcctaaggtcagaattgc

SEQ ID NO: 8537561 - DNA, 22 bp, Homo sapiens
cttctcctctgagtcctgggag

SEQ ID NO: 8537562 - DNA, 22 bp, Homo sapiens
cttctcctctgagtcctgggag

SEQ ID NO: 8537563 - DNA, 22 bp, Homo sapiens
cttctcctctgagtcctgggag

SEQ ID NO: 8537564 - DNA, 22 bp, Homo sapiens
atcttgggaattttccaggagt

SEQ ID NO: 8537565 - DNA, 20 bp, Homo sapiens
atcttgggacagggcacatg

SEQ ID NO: 8537566 - DNA, 19 bp, Homo sapiens
atcttgggaaatggtaact

SEQ ID NO: 8537567 - DNA, 21 bp, Homo sapiens
atctttattacgcagagaaga

SEQ ID NO: 8537568 - DNA, 22 bp, Homo sapiens
atctttcaggcctagtgtttaa

SEQ ID NO: 8537569 - DNA, 22 bp, Homo sapiens
atctttcagggccatttgtatt

SEQ ID NO: 8537570 - DNA, 22 bp, Homo sapiens
atctttcagagctccatcaggg

SEQ ID NO: 8537571 - DNA, 22 bp, Homo sapiens
atctttcactttttgtggatga

SEQ ID NO: 8537572 - DNA, 22 bp, Homo sapiens
atctttcaatcaggaaaaatct

SEQ ID NO: 8537573 - DNA, 22 bp, Homo sapiens
atctttcagggccatttgtatt

SEQ ID NO: 8537574 - DNA, 22 bp, Homo sapiens
atctttcagggccatttgtatt

SEQ ID NO: 8537575 - DNA, 22 bp, Homo sapiens
atctttcagtttcataccaatt

SEQ ID NO: 8537576 - DNA, 22 bp, Homo sapiens
atctttcagtttcataccaatt

SEQ ID NO: 8537577 - DNA, 22 bp, Homo sapiens
atctttcatctctattatttga

SEQ ID NO: 8537578 - DNA, 18 bp, Homo sapiens
atctttccatagcatgtt

SEQ ID NO: 8537579 - DNA, 22 bp, Homo sapiens
atctttctatttctaaaaacta

SEQ ID NO: 8537580 - DNA, 22 bp, Homo sapiens
atctttctatggtactttctcc

SEQ ID NO: 8537581 - DNA, 22 bp, Homo sapiens
atctttctccatatacatcttt

SEQ ID NO: 8537582 - DNA, 22 bp, Homo sapiens
atctttctctgcactatacaat

SEQ ID NO: 8537583 - DNA, 22 bp, Homo sapiens
atctttctctgcactatacaat

SEQ ID NO: 8537584 - DNA, 22 bp, Homo sapiens
atctttctccatatacatcttt

SEQ ID NO: 8537585 - DNA, 22 bp, Homo sapiens
atctttctctgcactatacaat

SEQ ID NO: 8537586 - DNA, 22 bp, Homo sapiens
atctttctctgcactatacaat

SEQ ID NO: 8537587 - DNA, 22 bp, Homo sapiens
ctttatgttggggtgtcttagt

SEQ ID NO: 8537588 - DNA, 22 bp, Homo sapiens
ctttatgttcagtacaatgctt

SEQ ID NO: 8537589 - DNA, 22 bp, Homo sapiens
ctttatgttggggtgtcttagt

SEQ ID NO: 8537590 - DNA, 22 bp, Homo sapiens
ctttactgttcttctgtgggaa

SEQ ID NO: 8537591 - DNA, 22 bp, Homo sapiens
ctttactgccatgcatttataa

SEQ ID NO: 8537592 - DNA, 22 bp, Homo sapiens
ctttaccacaaggacagaactt

SEQ ID NO: 8537593 - DNA, 22 bp, Homo sapiens
ctttacattaatttctactgat

SEQ ID NO: 8537594 - DNA, 22 bp, Homo sapiens
ctttacattaatttctactgat

SEQ ID NO: 8537595 - DNA, 22 bp, Homo sapiens
ctttaccagattccattgcaag

SEQ ID NO: 8537596 - DNA, 22 bp, Homo sapiens
ctttactatcaggaataaacaa

SEQ ID NO: 8537597 - DNA, 22 bp, Homo sapiens
ctttattctgcaaattgccttg

SEQ ID NO: 8537598 - DNA, 22 bp, Homo sapiens
ctttattctgcaaattgccttg

SEQ ID NO: 8537599 - DNA, 22 bp, Homo sapiens
ctttattgtccttcttaggtgg

SEQ ID NO: 8537600 - DNA, 22 bp, Homo sapiens
ctttattctgcaaattgccttg

SEQ ID NO: 8537601 - DNA, 22 bp, Homo sapiens
ctttattcctacaagattttct

SEQ ID NO: 8537602 - DNA, 22 bp, Homo sapiens
ctttattcctacaagattttct

SEQ ID NO: 8537603 - DNA, 22 bp, Homo sapiens
ctttattcctacaagattttct

SEQ ID NO: 8537604 - DNA, 22 bp, Homo sapiens
atctttgatgactaatgctttg

SEQ ID NO: 8537605 - DNA, 22 bp, Homo sapiens
atctttgatgactaatgctttg

SEQ ID NO: 8537606 - DNA, 22 bp, Homo sapiens
atctttgaagaggacttgaagt

SEQ ID NO: 8537607 - DNA, 22 bp, Homo sapiens
atctttgactgccattcttgac

SEQ ID NO: 8537608 - DNA, 22 bp, Homo sapiens
atctttgaatcaatgaatcagt

SEQ ID NO: 8537609 - DNA, 22 bp, Homo sapiens
cttgttttctaaaacatcattt

SEQ ID NO: 8537610 - DNA, 22 bp, Homo sapiens
ctttacacatcctaaccagtgt

SEQ ID NO: 8537611 - DNA, 22 bp, Homo sapiens
ctttacacaatgattttcttta

SEQ ID NO: 8537612 - DNA, 22 bp, Homo sapiens
ctttacagaataagaatactgg

SEQ ID NO: 8537613 - DNA, 22 bp, Homo sapiens
ctttacagaataagaatactgg

SEQ ID NO: 8537614 - DNA, 22 bp, Homo sapiens
ctttacacttggacccacactt

SEQ ID NO: 8537615 - DNA, 22 bp, Homo sapiens
ctttacagaaagagaactctgg

SEQ ID NO: 8537616 - DNA, 22 bp, Homo sapiens
ctttacacatgagacctgcaat

SEQ ID NO: 8537617 - DNA, 22 bp, Homo sapiens
ctttacaccaagcagatctttc

SEQ ID NO: 8537618 - DNA, 22 bp, Homo sapiens
ctttacaccaagcagatctttc

SEQ ID NO: 8537619 - DNA, 22 bp, Homo sapiens
ctttacatcctgtttcccgttt

SEQ ID NO: 8537620 - DNA, 22 bp, Homo sapiens
ctttacataaggataaacctgg

SEQ ID NO: 8537621 - DNA, 22 bp, Homo sapiens
ctttacagtgctgctaatggct

SEQ ID NO: 8537622 - DNA, 22 bp, Homo sapiens
ctttacataaggataaacctgg

SEQ ID NO: 8537623 - DNA, 22 bp, Homo sapiens
ctttacataaggataaacctgg

SEQ ID NO: 8537624 - DNA, 22 bp, Homo sapiens
ctttacagtgaacttgcttgtc

SEQ ID NO: 8537625 - DNA, 22 bp, Homo sapiens
ctttacagcttagtggtatgga

SEQ ID NO: 8537626 - DNA, 22 bp, Homo sapiens
ctttacaggaaaaggtggctgt

SEQ ID NO: 8537627 - DNA, 22 bp, Homo sapiens
ctttacagccccacttccgggc

SEQ ID NO: 8537628 - DNA, 22 bp, Homo sapiens
ctttacagcctccagaaggaac

SEQ ID NO: 8537629 - DNA, 22 bp, Homo sapiens
ctttacagcttagtggtatgga

SEQ ID NO: 8537630 - DNA, 22 bp, Homo sapiens
ctttacagatggataattgttt

SEQ ID NO: 8537631 - DNA, 22 bp, Homo sapiens
ctttacagatggataattgttt

SEQ ID NO: 8537632 - DNA, 22 bp, Homo sapiens
ctttacagataggaactactca

SEQ ID NO: 8537633 - DNA, 22 bp, Homo sapiens
ctttacagataggaactactca

SEQ ID NO: 8537634 - DNA, 22 bp, Homo sapiens
ctttgcttgacactgtgattgt

SEQ ID NO: 8537635 - DNA, 22 bp, Homo sapiens
ctttgcttgacactgtgattgt

SEQ ID NO: 8537636 - DNA, 22 bp, Homo sapiens
ctttgcttctccaacctgctca

SEQ ID NO: 8537637 - DNA, 22 bp, Homo sapiens
ctttgcttctccaacctgctca

SEQ ID NO: 8537638 - DNA, 22 bp, Homo sapiens
ctttggctgacaggtttctggt

SEQ ID NO: 8537639 - DNA, 22 bp, Homo sapiens
ctttggcatggtcctcactata

SEQ ID NO: 8537640 - DNA, 20 bp, Homo sapiens
ctttgcctattctctgcctg

SEQ ID NO: 8537641 - DNA, 20 bp, Homo sapiens
ctttgcctattctctgcctg

SEQ ID NO: 8537642 - DNA, 22 bp, Homo sapiens
ctttgcctcctagagcacgttc

SEQ ID NO: 8537643 - DNA, 22 bp, Homo sapiens
ctttctttgcagtgagccagag

SEQ ID NO: 8537644 - DNA, 19 bp, Homo sapiens
ctttgccactgataggagt

SEQ ID NO: 8537645 - DNA, 23 bp, Homo sapiens
ctttgccacccagagcctgacag

SEQ ID NO: 8537646 - DNA, 22 bp, Homo sapiens
ctttgggcaaagggccaattcg

SEQ ID NO: 8537647 - DNA, 22 bp, Homo sapiens
atgaattgtccgatgttgtgca

SEQ ID NO: 8537648 - DNA, 22 bp, Homo sapiens
atgaattgtaaattccttgaaa

SEQ ID NO: 8537649 - DNA, 22 bp, Homo sapiens
ctttggcttgccctggcagtac

SEQ ID NO: 8537650 - DNA, 22 bp, Homo sapiens
ctttggcttgccctggcagtac

SEQ ID NO: 8537651 - DNA, 22 bp, Homo sapiens
ctttggctgggcaaagggaggt

SEQ ID NO: 8537652 - DNA, 22 bp, Homo sapiens
ctttggctgacgaggaggaggc

SEQ ID NO: 8537653 - DNA, 23 bp, Homo sapiens
atgacactcctgtgcgcaccctg

SEQ ID NO: 8537654 - DNA, 22 bp, Homo sapiens
atgacactgtcctagtaaggaa

SEQ ID NO: 8537655 - DNA, 22 bp, Homo sapiens
atgacacccccacagcattgtt

SEQ ID NO: 8537656 - DNA, 22 bp, Homo sapiens
atgacactgtcctagtaaggaa

SEQ ID NO: 8537657 - DNA, 22 bp, Homo sapiens
atgacagaccctctaaagacaa

SEQ ID NO: 8537658 - DNA, 22 bp, Homo sapiens
atgacagaaggcctccctgaca

SEQ ID NO: 8537659 - DNA, 22 bp, Homo sapiens
atgacaccatattagcctagag

SEQ ID NO: 8537660 - DNA, 22 bp, Homo sapiens
atgacacatttgtgctgttgaa

SEQ ID NO: 8537661 - DNA, 22 bp, Homo sapiens
atgacaatggacatagttaaaa

SEQ ID NO: 8537662 - DNA, 22 bp, Homo sapiens
ctttttatagctatgtcctatg

SEQ ID NO: 8537663 - DNA, 22 bp, Homo sapiens
ctttttatagctatgtcctatg

SEQ ID NO: 8537664 - DNA, 22 bp, Homo sapiens
ctttttatctcttaatgatgtt

SEQ ID NO: 8537665 - DNA, 22 bp, Homo sapiens
ctttttatctcttaatgatgtt

SEQ ID NO: 8537666 - DNA, 22 bp, Homo sapiens
ctttttatctcttaatgatgtt

SEQ ID NO: 8537667 - DNA, 22 bp, Homo sapiens
ctttttatctcttaatgatgtt

SEQ ID NO: 8537668 - DNA, 22 bp, Homo sapiens
ctttttatctcttaatgatgtt

SEQ ID NO: 8537669 - DNA, 22 bp, Homo sapiens
ctttttcattggctttaggaca

SEQ ID NO: 8537670 - DNA, 19 bp, Homo sapiens
ctttttcaccttctagaag

SEQ ID NO: 8537671 - DNA, 22 bp, Homo sapiens
ctttttcaagtcaaagagggta

SEQ ID NO: 8537672 - DNA, 22 bp, Homo sapiens
ctttttcactgtgtcctcacac

SEQ ID NO: 8537673 - DNA, 22 bp, Homo sapiens
cttttgttgcccttgtcgcagg

SEQ ID NO: 8537674 - DNA, 22 bp, Homo sapiens
ctttttactctgttgtctcagc

SEQ ID NO: 8537675 - DNA, 22 bp, Homo sapiens
ctttttacaaagcctgtcttct

SEQ ID NO: 8537676 - DNA, 22 bp, Homo sapiens
ctttttacaaagcctgtcttct

SEQ ID NO: 8537677 - DNA, 22 bp, Homo sapiens
ctttttataccgtgccagttga

SEQ ID NO: 8537678 - DNA, 22 bp, Homo sapiens
ctttttataccgtgccagttga

SEQ ID NO: 8537679 - DNA, 22 bp, Homo sapiens
atgacagaccctctaaagacaa

SEQ ID NO: 8537680 - DNA, 22 bp, Homo sapiens
atgacagaggagtgcaggtgat

SEQ ID NO: 8537681 - DNA, 22 bp, Homo sapiens
atgacagatagtcttcatttgc

SEQ ID NO: 8537682 - DNA, 22 bp, Homo sapiens
atgacagaggattgtaaagagg

SEQ ID NO: 8537683 - DNA, 19 bp, Homo sapiens
atgacagagttgataagtg

SEQ ID NO: 8537684 - DNA, 22 bp, Homo sapiens
atgagaaagagttgtatctaga

SEQ ID NO: 8537685 - DNA, 22 bp, Homo sapiens
atgacattgaatatgttaacta

SEQ ID NO: 8537686 - DNA, 22 bp, Homo sapiens
atgagaaagttaatcatcatga

SEQ ID NO: 8537687 - DNA, 22 bp, Homo sapiens
atgagaaagttaatcatcatga

SEQ ID NO: 8537688 - DNA, 22 bp, Homo sapiens
atgagaaagttaatcatcatga

SEQ ID NO: 8537689 - DNA, 22 bp, Homo sapiens
atgagaaatttattacaagcta

SEQ ID NO: 8537690 - DNA, 22 bp, Homo sapiens
atgagactacctgtaatgtggc

SEQ ID NO: 8537691 - DNA, 22 bp, Homo sapiens
atgagaatgcattcatgttttg

SEQ ID NO: 8537692 - DNA, 22 bp, Homo sapiens
atgagatgtgtctaatggaacc

SEQ ID NO: 8537693 - DNA, 22 bp, Homo sapiens
atgagcaagagctatgtacaga

SEQ ID NO: 8537694 - DNA, 22 bp, Homo sapiens
atgagagctctatgatctgttt

SEQ ID NO: 8537695 - DNA, 22 bp, Homo sapiens
atgagaggtttcgtcagaggaa

SEQ ID NO: 8537696 - DNA, 18 bp, Homo sapiens
atgagaggtgtcagaaga

SEQ ID NO: 8537697 - DNA, 22 bp, Homo sapiens
atgagaggtttcgtcagaggaa

SEQ ID NO: 8537698 - DNA, 22 bp, Homo sapiens
atgagagtctcagagtctcttc

SEQ ID NO: 8537699 - DNA, 22 bp, Homo sapiens
atgagatagactatgtcataca

SEQ ID NO: 8537700 - DNA, 22 bp, Homo sapiens
atgagataggaacaaacttaca

SEQ ID NO: 8537701 - DNA, 22 bp, Homo sapiens
atgcagtaaatgttaagaaaaa

SEQ ID NO: 8537702 - DNA, 22 bp, Homo sapiens
atgcagtaaatgttaagaaaaa

SEQ ID NO: 8537703 - DNA, 22 bp, Homo sapiens
atgcagtaaaataggaggtaat

SEQ ID NO: 8537704 - DNA, 22 bp, Homo sapiens
atgcagtacatacaaacactga

SEQ ID NO: 8537705 - DNA, 22 bp, Homo sapiens
atgcagtacagataattctaca

SEQ ID NO: 8537706 - DNA, 22 bp, Homo sapiens
atgcagtaaatgttctagtttg

SEQ ID NO: 8537707 - DNA, 22 bp, Homo sapiens
atgcagtacagataattctaca

SEQ ID NO: 8537708 - DNA, 23 bp, Homo sapiens
atgcagtatatgtcagtagttta

SEQ ID NO: 8537709 - DNA, 22 bp, Homo sapiens
atgcagtataaatcatttctgg

SEQ ID NO: 8537710 - DNA, 22 bp, Homo sapiens
atgcagtataaatcatttctgg

SEQ ID NO: 8537711 - DNA, 22 bp, Homo sapiens
atgcagtagataggcactttta

SEQ ID NO: 8537712 - DNA, 22 bp, Homo sapiens
atgcagtactgatacatgccac

SEQ ID NO: 8537713 - DNA, 22 bp, Homo sapiens
atgcagtggcagctcctggtgt

SEQ ID NO: 8537714 - DNA, 22 bp, Homo sapiens
atgcagtggcttcagtgtcagt

SEQ ID NO: 8537715 - DNA, 22 bp, Homo sapiens
atgcagtggcttcagtgtcagt

SEQ ID NO: 8537716 - DNA, 22 bp, Homo sapiens
atgcagtggcagctcctggtgt

SEQ ID NO: 8537717 - DNA, 22 bp, Homo sapiens
gaaggagggagcggcgcggatt

SEQ ID NO: 8537718 - DNA, 22 bp, Homo sapiens
gaaggagggtgcggatctgagc

SEQ ID NO: 8537719 - DNA, 22 bp, Homo sapiens
gaaggagggtgcggatctgagc

SEQ ID NO: 8537720 - DNA, 22 bp, Homo sapiens
gaaggaggctccccaaagtctg

SEQ ID NO: 8537721 - DNA, 22 bp, Homo sapiens
gaaggaggtctgcattctacag

SEQ ID NO: 8537722 - DNA, 22 bp, Homo sapiens
gaaggaggtctgatacaatatg

SEQ ID NO: 8537723 - DNA, 22 bp, Homo sapiens
gaaggatttgagattatcctag

SEQ ID NO: 8537724 - DNA, 22 bp, Homo sapiens
gaaggaggtgtcagttggactg

SEQ ID NO: 8537725 - DNA, 22 bp, Homo sapiens
gaaggaggtgtcagttggactg

SEQ ID NO: 8537726 - DNA, 22 bp, Homo sapiens
atgcaggagagcatgtttaaga

SEQ ID NO: 8537727 - DNA, 22 bp, Homo sapiens
gaagcctggtccagagctccca

SEQ ID NO: 8537728 - DNA, 22 bp, Homo sapiens
gaagcctggtccagagctccca

SEQ ID NO: 8537729 - DNA, 22 bp, Homo sapiens
gaagcctggttcgctggccacc

SEQ ID NO: 8537730 - DNA, 22 bp, Homo sapiens
gaagcagcaagtataggacagg

SEQ ID NO: 8537731 - DNA, 22 bp, Homo sapiens
gaagccttgaactgcaaacccc

SEQ ID NO: 8537732 - DNA, 22 bp, Homo sapiens
gaagctccgtactatgactttt

SEQ ID NO: 8537733 - DNA, 22 bp, Homo sapiens
gaagctgacccaggagcgtgtg

SEQ ID NO: 8537734 - DNA, 22 bp, Homo sapiens
gaagctgacccaggagcgtgtg

SEQ ID NO: 8537735 - DNA, 22 bp, Homo sapiens
gaagctgcgtgtagccatactt

SEQ ID NO: 8537736 - DNA, 22 bp, Homo sapiens
gaagctgatgaggaccagattg

SEQ ID NO: 8537737 - DNA, 22 bp, Homo sapiens
gaagctgagtggactctggcca

SEQ ID NO: 8537738 - DNA, 22 bp, Homo sapiens
gaagctgaggtcaggtgggtgg

SEQ ID NO: 8537739 - DNA, 22 bp, Homo sapiens
gaagctgagctgaggcatgttg

SEQ ID NO: 8537740 - DNA, 22 bp, Homo sapiens
gaagctgagctgaggcatgttg

SEQ ID NO: 8537741 - DNA, 22 bp, Homo sapiens
gaagctgaggtcaggtgggtgg

SEQ ID NO: 8537742 - DNA, 22 bp, Homo sapiens
gaagctgggtcgctgggatcct

SEQ ID NO: 8537743 - DNA, 22 bp, Homo sapiens
gaagctgtgctgggggatctgt

SEQ ID NO: 8537744 - DNA, 22 bp, Homo sapiens
gaaggaggcgttagccctagga

SEQ ID NO: 8537745 - DNA, 22 bp, Homo sapiens
gaaggaggcgttagccctagga

SEQ ID NO: 8537746 - DNA, 22 bp, Homo sapiens
gaagaaatgtgttcaaggtagg

SEQ ID NO: 8537747 - DNA, 22 bp, Homo sapiens
gaagagagagccctggggtccg

SEQ ID NO: 8537748 - DNA, 22 bp, Homo sapiens
gaagagagccgcgggacatcag

SEQ ID NO: 8537749 - DNA, 22 bp, Homo sapiens
gaagagagccgcgggacatcag

SEQ ID NO: 8537750 - DNA, 22 bp, Homo sapiens
atgagctgggccatccagtgat

SEQ ID NO: 8537751 - DNA, 22 bp, Homo sapiens
atgagctgggccatccagtgat

SEQ ID NO: 8537752 - DNA, 22 bp, Homo sapiens
atgagctgtgggattccagagg

SEQ ID NO: 8537753 - DNA, 22 bp, Homo sapiens
atgagctcatccgagtcacact

SEQ ID NO: 8537754 - DNA, 22 bp, Homo sapiens
atgagcatccagaacagtgcct

SEQ ID NO: 8537755 - DNA, 22 bp, Homo sapiens
atgagcagtaggttcatggctg

SEQ ID NO: 8537756 - DNA, 22 bp, Homo sapiens
atgatggaggccgtgatggacg

SEQ ID NO: 8537757 - DNA, 22 bp, Homo sapiens
atgatggaggtgtcctggattt

SEQ ID NO: 8537758 - DNA, 22 bp, Homo sapiens
atgatggaggtgtcctggattt

SEQ ID NO: 8537759 - DNA, 22 bp, Homo sapiens
atgatggatgtcacagtctgta

SEQ ID NO: 8537760 - DNA, 22 bp, Homo sapiens
atgatggctaggctggttttga

SEQ ID NO: 8537761 - DNA, 22 bp, Homo sapiens
gaagagcatttgcccaggctgt

SEQ ID NO: 8537762 - DNA, 22 bp, Homo sapiens
gaagagcatttgcccaggctgt

SEQ ID NO: 8537763 - DNA, 22 bp, Homo sapiens
gaagagcatatgaagagcatat

SEQ ID NO: 8537764 - DNA, 22 bp, Homo sapiens
gaagagcatatgaagagcatat

SEQ ID NO: 8537765 - DNA, 22 bp, Homo sapiens
gaagagatgacaaaggagcatg

SEQ ID NO: 8537766 - DNA, 21 bp, Homo sapiens
gaagagagtcctcatcctgag

SEQ ID NO: 8537767 - DNA, 22 bp, Homo sapiens
gaagagatgacaaaggagcatg

SEQ ID NO: 8537768 - DNA, 22 bp, Homo sapiens
gaagagatgacaaaggagcatg

SEQ ID NO: 8537769 - DNA, 22 bp, Homo sapiens
atgatgtgtgctgatcaagctt

SEQ ID NO: 8537770 - DNA, 22 bp, Homo sapiens
atgatgtgtgctgatcaagctt

SEQ ID NO: 8537771 - DNA, 23 bp, Homo sapiens
gaagcagatgtctgagtaggcag

SEQ ID NO: 8537772 - DNA, 23 bp, Homo sapiens
gaagcagatgtctgagtaggcag

SEQ ID NO: 8537773 - DNA, 22 bp, Homo sapiens
atgatgttggtttaatttgagt

SEQ ID NO: 8537774 - DNA, 22 bp, Homo sapiens
atgctgcctcctcttcagccgc

SEQ ID NO: 8537775 - DNA, 16 bp, Homo sapiens
atgctgctattagagg

SEQ ID NO: 8537776 - DNA, 22 bp, Homo sapiens
atgctctgggcaggagccctgg

SEQ ID NO: 8537777 - DNA, 22 bp, Homo sapiens
atgctctgggcaggagccctgg

SEQ ID NO: 8537778 - DNA, 23 bp, Homo sapiens
atgctctgggctgtgggacctgc

SEQ ID NO: 8537779 - DNA, 23 bp, Homo sapiens
atgctctgggctgtgggacctgc

SEQ ID NO: 8537780 - DNA, 22 bp, Homo sapiens
atgctctgggcttttgaagtgg

SEQ ID NO: 8537781 - DNA, 20 bp, Homo sapiens
gacagcttggggtgtcacct

SEQ ID NO: 8537782 - DNA, 22 bp, Homo sapiens
gacagcttctagaaatggtcac

SEQ ID NO: 8537783 - DNA, 22 bp, Homo sapiens
gacagcttctagaggaattggt

SEQ ID NO: 8537784 - DNA, 22 bp, Homo sapiens
gacagcttctatgtgacgagca

SEQ ID NO: 8537785 - DNA, 22 bp, Homo sapiens
gacagcttcttgggccgggcct

SEQ ID NO: 8537786 - DNA, 22 bp, Homo sapiens
gacagcttctatgtgacgagca

SEQ ID NO: 8537787 - DNA, 22 bp, Homo sapiens
gacagcttgcctggtactgcaa

SEQ ID NO: 8537788 - DNA, 22 bp, Homo sapiens
atgctataaactctaggtcatt

SEQ ID NO: 8537789 - DNA, 22 bp, Homo sapiens
atgctacattttggtttataaa

SEQ ID NO: 8537790 - DNA, 22 bp, Homo sapiens
atgctacgaatgagagcatata

SEQ ID NO: 8537791 - DNA, 22 bp, Homo sapiens
atgctacaggaagacgtcaggc

SEQ ID NO: 8537792 - DNA, 22 bp, Homo sapiens
gacagcttaggaagtttctatt

SEQ ID NO: 8537793 - DNA, 22 bp, Homo sapiens
gacagcttagtgaaaatgtaaa

SEQ ID NO: 8537794 - DNA, 22 bp, Homo sapiens
gacagcttcgaggaggtgagct

SEQ ID NO: 8537795 - DNA, 22 bp, Homo sapiens
atgctatactcaaagaaattca

SEQ ID NO: 8537796 - DNA, 22 bp, Homo sapiens
atgctatgtaactggcagatag

SEQ ID NO: 8537797 - DNA, 22 bp, Homo sapiens
atgctaaatgctgggggtacat

SEQ ID NO: 8537798 - DNA, 22 bp, Homo sapiens
atgctaaatggccagtaccaaa

SEQ ID NO: 8537799 - DNA, 22 bp, Homo sapiens
atgctaaatggccagtaccaaa

SEQ ID NO: 8537800 - DNA, 22 bp, Homo sapiens
atgctaaagctttgctttcatt

SEQ ID NO: 8537801 - DNA, 22 bp, Homo sapiens
atgctaaaggggtaggcctcct

SEQ ID NO: 8537802 - DNA, 22 bp, Homo sapiens
atgctaaataactggtttgact

SEQ ID NO: 8537803 - DNA, 22 bp, Homo sapiens
atgctaaatccagaagcagtca

SEQ ID NO: 8537804 - DNA, 22 bp, Homo sapiens
atgcctggatttgggactcaaa

SEQ ID NO: 8537805 - DNA, 22 bp, Homo sapiens
atgcctggatttgggactcaaa

SEQ ID NO: 8537806 - DNA, 22 bp, Homo sapiens
atgctaaactatgatcattttc

SEQ ID NO: 8537807 - DNA, 22 bp, Homo sapiens
atgctaaggcccaggagaaaat

SEQ ID NO: 8537808 - DNA, 22 bp, Homo sapiens
atgctaaattcagacagggtta

SEQ ID NO: 8537809 - DNA, 22 bp, Homo sapiens
atgctaaatgttaatgttacct

SEQ ID NO: 8537810 - DNA, 22 bp, Homo sapiens
atgctaaggcccaggagaaaat

SEQ ID NO: 8537811 - DNA, 22 bp, Homo sapiens
gaatttcctctaaacccctgag

SEQ ID NO: 8537812 - DNA, 22 bp, Homo sapiens
atgcctggactgtatcccagat

SEQ ID NO: 8537813 - DNA, 19 bp, Homo sapiens
gaattttaggacttcagca

SEQ ID NO: 8537814 - DNA, 22 bp, Homo sapiens
gaattttaagtgttcgcctctt

SEQ ID NO: 8537815 - DNA, 22 bp, Homo sapiens
gaatttcaaagaggttaagagg

SEQ ID NO: 8537816 - DNA, 22 bp, Homo sapiens
gaatttcagaggtaacatcatc

SEQ ID NO: 8537817 - DNA, 22 bp, Homo sapiens
atgccactgcacttcagcctgg

SEQ ID NO: 8537818 - DNA, 22 bp, Homo sapiens
gaatttatctacgttaagtatg

SEQ ID NO: 8537819 - DNA, 22 bp, Homo sapiens
atgccactgcacttcagcttgg

SEQ ID NO: 8537820 - DNA, 22 bp, Homo sapiens
atgccactgcacttcagcctgg

SEQ ID NO: 8537821 - DNA, 22 bp, Homo sapiens
atgccactgcactccagcctgg

SEQ ID NO: 8537822 - DNA, 22 bp, Homo sapiens
atgccactgcactccagcctgg

SEQ ID NO: 8537823 - DNA, 22 bp, Homo sapiens
atgccactgcactccagcctgg

SEQ ID NO: 8537824 - DNA, 22 bp, Homo sapiens
atgccactgcactccagcctgg

SEQ ID NO: 8537825 - DNA, 22 bp, Homo sapiens
atgccactgcactccagcctgg

SEQ ID NO: 8537826 - DNA, 22 bp, Homo sapiens
atgccactgcactccagcctgg

SEQ ID NO: 8537827 - DNA, 22 bp, Homo sapiens
atgccactgcactccagcctgg

SEQ ID NO: 8537828 - DNA, 22 bp, Homo sapiens
atgccactgcactccagcctgg

SEQ ID NO: 8537829 - DNA, 22 bp, Homo sapiens
atgccactgcactccagcctag

SEQ ID NO: 8537830 - DNA, 22 bp, Homo sapiens
atgccactgcactccagcctag

SEQ ID NO: 8537831 - DNA, 22 bp, Homo sapiens
atgccactgcactccagcctag

SEQ ID NO: 8537832 - DNA, 22 bp, Homo sapiens
atgccactgcactccagcctag

SEQ ID NO: 8537833 - DNA, 22 bp, Homo sapiens
atgccactgcactccagcctag

SEQ ID NO: 8537834 - DNA, 22 bp, Homo sapiens
atgccactgcactccagcctag

SEQ ID NO: 8537835 - DNA, 22 bp, Homo sapiens
atgccactgcactccagcctag

SEQ ID NO: 8537836 - DNA, 22 bp, Homo sapiens
gaagtctgagtgggggccaggc

SEQ ID NO: 8537837 - DNA, 22 bp, Homo sapiens
gaagtcagtcatctcctgtctc

SEQ ID NO: 8537838 - DNA, 22 bp, Homo sapiens
gaagtcagtcatctcctgtctc

SEQ ID NO: 8537839 - DNA, 22 bp, Homo sapiens
gaagtccagaatactgctctga

SEQ ID NO: 8537840 - DNA, 22 bp, Homo sapiens
gaagtataggagacaaacaaga

SEQ ID NO: 8537841 - DNA, 22 bp, Homo sapiens
gaagtatttctgagttgcccag

SEQ ID NO: 8537842 - DNA, 22 bp, Homo sapiens
gaagtattatagcatattagcc

SEQ ID NO: 8537843 - DNA, 22 bp, Homo sapiens
gaagtagattcgttgcatcttg

SEQ ID NO: 8537844 - DNA, 22 bp, Homo sapiens
gaagtacagttttatctagcca

SEQ ID NO: 8537845 - DNA, 22 bp, Homo sapiens
atgcataaagaaagctatctgg

SEQ ID NO: 8537846 - DNA, 22 bp, Homo sapiens
atggcagaattaggatttcaag

SEQ ID NO: 8537847 - DNA, 22 bp, Homo sapiens
atggcagaatccatagtaggtg

SEQ ID NO: 8537848 - DNA, 22 bp, Homo sapiens
atggcagacacaggcaggcaga

SEQ ID NO: 8537849 - DNA, 22 bp, Homo sapiens
atggcagacacaggcaggcaga

SEQ ID NO: 8537850 - DNA, 22 bp, Homo sapiens
atggcagacctcctggccacaa

SEQ ID NO: 8537851 - DNA, 22 bp, Homo sapiens
atggcagaaaggcatgtgggcc

SEQ ID NO: 8537852 - DNA, 22 bp, Homo sapiens
atggcagaagtcaagatgagtt

SEQ ID NO: 8537853 - DNA, 22 bp, Homo sapiens
atggcagaaagaatagaggcta

SEQ ID NO: 8537854 - DNA, 22 bp, Homo sapiens
atggattggatttttatggacc

SEQ ID NO: 8537855 - DNA, 22 bp, Homo sapiens
atggatgggatattgcttgcca

SEQ ID NO: 8537856 - DNA, 22 bp, Homo sapiens
atggatgagtccttgagacaca

SEQ ID NO: 8537857 - DNA, 22 bp, Homo sapiens
atggatggcctgagcacagctg

SEQ ID NO: 8537858 - DNA, 22 bp, Homo sapiens
atggatggaactctgctgtggt

SEQ ID NO: 8537859 - DNA, 22 bp, Homo sapiens
atggatgaaggcgaggatgagg

SEQ ID NO: 8537860 - DNA, 22 bp, Homo sapiens
atggatcttccctcatttctga

SEQ ID NO: 8537861 - DNA, 22 bp, Homo sapiens
atggatgagtccttgagacaca

SEQ ID NO: 8537862 - DNA, 22 bp, Homo sapiens
atggatgaaggcgaggatgagg

SEQ ID NO: 8537863 - DNA, 22 bp, Homo sapiens
atggcaaaaattaacagatcaa

SEQ ID NO: 8537864 - DNA, 22 bp, Homo sapiens
atggcaaaaactgcagttacct

SEQ ID NO: 8537865 - DNA, 22 bp, Homo sapiens
atggcaagcaagctgaagagat

SEQ ID NO: 8537866 - DNA, 22 bp, Homo sapiens
atggcaagcaagctgaagagat

SEQ ID NO: 8537867 - DNA, 22 bp, Homo sapiens
gagacaggatttaaccaaagct

SEQ ID NO: 8537868 - DNA, 22 bp, Homo sapiens
gagacagcctactccagtctca

SEQ ID NO: 8537869 - DNA, 21 bp, Homo sapiens
gagacagcccagtgccagggc

SEQ ID NO: 8537870 - DNA, 22 bp, Homo sapiens
gagacagcagggccagggcctg

SEQ ID NO: 8537871 - DNA, 21 bp, Homo sapiens
gagaatcaggaaggattgatg

SEQ ID NO: 8537872 - DNA, 21 bp, Homo sapiens
gagaatcaggaaggattgatg

SEQ ID NO: 8537873 - DNA, 22 bp, Homo sapiens
atggagggtgtcagagagcgaa

SEQ ID NO: 8537874 - DNA, 22 bp, Homo sapiens
gagacaggccaggtggtactta

SEQ ID NO: 8537875 - DNA, 22 bp, Homo sapiens
atggataatggtgatagttgca

SEQ ID NO: 8537876 - DNA, 22 bp, Homo sapiens
atggataatgtctctgtttccc

SEQ ID NO: 8537877 - DNA, 22 bp, Homo sapiens
gagacaggccaggtggtactta

SEQ ID NO: 8537878 - DNA, 22 bp, Homo sapiens
gagacaggcagctagtgggtca

SEQ ID NO: 8537879 - DNA, 22 bp, Homo sapiens
gagacaggcagctagtgggtca

SEQ ID NO: 8537880 - DNA, 22 bp, Homo sapiens
gagacaggcagctagtgggtca

SEQ ID NO: 8537881 - DNA, 22 bp, Homo sapiens
gagacaggccaggtggtactta

SEQ ID NO: 8537882 - DNA, 22 bp, Homo sapiens
gagacaggcagctagtgggtca

SEQ ID NO: 8537883 - DNA, 22 bp, Homo sapiens
gagacaggcagctagtgggtca

SEQ ID NO: 8537884 - DNA, 22 bp, Homo sapiens
gagacaggcagctagtgggtca

SEQ ID NO: 8537885 - DNA, 22 bp, Homo sapiens
atgctggttgctaagcagcgat

SEQ ID NO: 8537886 - DNA, 22 bp, Homo sapiens
atgctgtagatcttagcctcta

SEQ ID NO: 8537887 - DNA, 22 bp, Homo sapiens
atgctgtcagtattatgtgcag

SEQ ID NO: 8537888 - DNA, 22 bp, Homo sapiens
atgctgtccactcttggtgttt

SEQ ID NO: 8537889 - DNA, 22 bp, Homo sapiens
atgctgggaaactgaaaggaat

SEQ ID NO: 8537890 - DNA, 22 bp, Homo sapiens
atgctgggaagacaaggtggag

SEQ ID NO: 8537891 - DNA, 22 bp, Homo sapiens
atgctgtggggagtgagggtag

SEQ ID NO: 8537892 - DNA, 22 bp, Homo sapiens
atgctgtggccagagttcaact

SEQ ID NO: 8537893 - DNA, 22 bp, Homo sapiens
atgctgtggatgccttgcccca

SEQ ID NO: 8537894 - DNA, 22 bp, Homo sapiens
atgctgtgtcaccttaggattt

SEQ ID NO: 8537895 - DNA, 22 bp, Homo sapiens
atgctgtgtcaggaatttgata

SEQ ID NO: 8537896 - DNA, 22 bp, Homo sapiens
atgctgtggtagacagcattcc

SEQ ID NO: 8537897 - DNA, 22 bp, Homo sapiens
atgctgtgtattttactctttc

SEQ ID NO: 8537898 - DNA, 22 bp, Homo sapiens
atgctgtggggagtgagggtag

SEQ ID NO: 8537899 - DNA, 22 bp, Homo sapiens
atgctgtgcctggaaagcggct

SEQ ID NO: 8537900 - DNA, 22 bp, Homo sapiens
atgctgtgccttctctgtgcca

SEQ ID NO: 8537901 - DNA, 22 bp, Homo sapiens
atgctgtgccttctctgtgcca

SEQ ID NO: 8537902 - DNA, 22 bp, Homo sapiens
atgctgtggaagttcctgaagc

SEQ ID NO: 8537903 - DNA, 22 bp, Homo sapiens
atgctgtgctggctaaccatgg

SEQ ID NO: 8537904 - DNA, 22 bp, Homo sapiens
atgctgtgaaaaagaaggctga

SEQ ID NO: 8537905 - DNA, 22 bp, Homo sapiens
atgctgtgattgtagaaatatt

SEQ ID NO: 8537906 - DNA, 22 bp, Homo sapiens
atgctgtgagtgtgccgcagag

SEQ ID NO: 8537907 - DNA, 22 bp, Homo sapiens
gagaaggtggacctgaaggagc

SEQ ID NO: 8537908 - DNA, 22 bp, Homo sapiens
gagaaggtggacctgaaggagc

SEQ ID NO: 8537909 - DNA, 22 bp, Homo sapiens
gagaaggggtgatgtgggtaat

SEQ ID NO: 8537910 - DNA, 22 bp, Homo sapiens
gagaaggggtgatgtgggtaat

SEQ ID NO: 8537911 - DNA, 22 bp, Homo sapiens
gagaacaggctctggagtcaga

SEQ ID NO: 8537912 - DNA, 22 bp, Homo sapiens
gagaaggggtgatgtgggtaat

SEQ ID NO: 8537913 - DNA, 22 bp, Homo sapiens
gagaaggggtgatgtgggtaat

SEQ ID NO: 8537914 - DNA, 22 bp, Homo sapiens
gagaataaatctaaagtttctt

SEQ ID NO: 8537915 - DNA, 22 bp, Homo sapiens
gagaagtttggagtgaaggttt

SEQ ID NO: 8537916 - DNA, 22 bp, Homo sapiens
gagaagtttggagtgaaggttt

SEQ ID NO: 8537917 - DNA, 22 bp, Homo sapiens
gagaagtttctggtttgcatag

SEQ ID NO: 8537918 - DNA, 22 bp, Homo sapiens
gagaagttgtgtggatttaaag

SEQ ID NO: 8537919 - DNA, 22 bp, Homo sapiens
gagaagttgtaggagaattttg

SEQ ID NO: 8537920 - DNA, 22 bp, Homo sapiens
gagaagttgtaggagaattttg

SEQ ID NO: 8537921 - DNA, 22 bp, Homo sapiens
atgctgtgtcctagtgaaagaa

SEQ ID NO: 8537922 - DNA, 22 bp, Homo sapiens
atgctgtgtctagcaggaacac

SEQ ID NO: 8537923 - DNA, 22 bp, Homo sapiens
atgctgtgtggccacctccatg

SEQ ID NO: 8537924 - DNA, 22 bp, Homo sapiens
atgctgtgttttaaatggaaat

SEQ ID NO: 8537925 - DNA, 22 bp, Homo sapiens
atgctgttaagaatctcttcct

SEQ ID NO: 8537926 - DNA, 22 bp, Homo sapiens
atgctgttaagataatgggttc

SEQ ID NO: 8537927 - DNA, 22 bp, Homo sapiens
atgctgtgtggtcaagttaatt

SEQ ID NO: 8537928 - DNA, 22 bp, Homo sapiens
atgctgtgtttgagaacctagg

SEQ ID NO: 8537929 - DNA, 22 bp, Homo sapiens
atgctgttattctaatgtgtga

SEQ ID NO: 8537930 - DNA, 22 bp, Homo sapiens
atgcttaactctgtacatagtt

SEQ ID NO: 8537931 - DNA, 22 bp, Homo sapiens
atgcttaactctgtacatagtt

SEQ ID NO: 8537932 - DNA, 22 bp, Homo sapiens
gagctgccagtgtatgaattct

SEQ ID NO: 8537933 - DNA, 22 bp, Homo sapiens
gagctgccagacatgggaatga

SEQ ID NO: 8537934 - DNA, 22 bp, Homo sapiens
gagctgccaagattacaatcag

SEQ ID NO: 8537935 - DNA, 22 bp, Homo sapiens
gagctgccaagattacaatcag

SEQ ID NO: 8537936 - DNA, 22 bp, Homo sapiens
gagctgccggcccacagtacta

SEQ ID NO: 8537937 - DNA, 22 bp, Homo sapiens
gagctgccctgagctttgcatg

SEQ ID NO: 8537938 - DNA, 22 bp, Homo sapiens
gagctgccctgagctttgcatg

SEQ ID NO: 8537939 - DNA, 18 bp, Homo sapiens
gagctgccatatttagtt

SEQ ID NO: 8537940 - DNA, 21 bp, Homo sapiens
atgggcagaggcagagaggct

SEQ ID NO: 8537941 - DNA, 21 bp, Homo sapiens
atgggcagaggcagagaggct

SEQ ID NO: 8537942 - DNA, 21 bp, Homo sapiens
atgggcagaggcagagaggct

SEQ ID NO: 8537943 - DNA, 21 bp, Homo sapiens
atgggcagaggcagagaggct

SEQ ID NO: 8537944 - DNA, 21 bp, Homo sapiens
atgggcagaggcagagaggct

SEQ ID NO: 8537945 - DNA, 22 bp, Homo sapiens
atgggcagagtggggacaggaa

SEQ ID NO: 8537946 - DNA, 22 bp, Homo sapiens
atgggcagagtggggacaggaa

SEQ ID NO: 8537947 - DNA, 22 bp, Homo sapiens
gagctgagttacctccagatca

SEQ ID NO: 8537948 - DNA, 22 bp, Homo sapiens
gagctgcagacttgatacagga

SEQ ID NO: 8537949 - DNA, 17 bp, Homo sapiens
gagctctgtggcacaag

SEQ ID NO: 8537950 - DNA, 22 bp, Homo sapiens
gagctgagttacctccagatca

SEQ ID NO: 8537951 - DNA, 20 bp, Homo sapiens
gagctgagtgtggtcatggg

SEQ ID NO: 8537952 - DNA, 22 bp, Homo sapiens
gagctgagtgtcctaggcatgg

SEQ ID NO: 8537953 - DNA, 22 bp, Homo sapiens
gagccccaccctagacattctg

SEQ ID NO: 8537954 - DNA, 21 bp, Homo sapiens
atgggcagaggcagagaggct

SEQ ID NO: 8537955 - DNA, 22 bp, Homo sapiens
atgggcagagctggtgggaggc

SEQ ID NO: 8537956 - DNA, 22 bp, Homo sapiens
atgggcagagctggtgggaggc

SEQ ID NO: 8537957 - DNA, 22 bp, Homo sapiens
atgggcagacagggagctcacg

SEQ ID NO: 8537958 - DNA, 22 bp, Homo sapiens
atgggcaacagcagtcacaatg

SEQ ID NO: 8537959 - DNA, 22 bp, Homo sapiens
atgggcagacagggagctcacg

SEQ ID NO: 8537960 - DNA, 22 bp, Homo sapiens
atgggatgaacttgatctgctt

SEQ ID NO: 8537961 - DNA, 22 bp, Homo sapiens
atgggatcttgccctgagggct

SEQ ID NO: 8537962 - DNA, 22 bp, Homo sapiens
atgggatgcatggctgtggcca

SEQ ID NO: 8537963 - DNA, 22 bp, Homo sapiens
atgggatgcatggctgtggcca

SEQ ID NO: 8537964 - DNA, 22 bp, Homo sapiens
atgggatgatcacctgagctca

SEQ ID NO: 8537965 - DNA, 22 bp, Homo sapiens
gagcccgagcgcgtacccggcg

SEQ ID NO: 8537966 - DNA, 22 bp, Homo sapiens
gagccctccatggagccaggca

SEQ ID NO: 8537967 - DNA, 19 bp, Homo sapiens
gagccctctccatggccac

SEQ ID NO: 8537968 - DNA, 22 bp, Homo sapiens
gagccctctctgtaggcaagta

SEQ ID NO: 8537969 - DNA, 22 bp, Homo sapiens
gagccccaggacagctctagtt

SEQ ID NO: 8537970 - DNA, 22 bp, Homo sapiens
gagccccagccctgcttctata

SEQ ID NO: 8537971 - DNA, 22 bp, Homo sapiens
gagcacaggctgctgtgaactg

SEQ ID NO: 8537972 - DNA, 22 bp, Homo sapiens
gagcacaggctgctgtgaactg

SEQ ID NO: 8537973 - DNA, 22 bp, Homo sapiens
gagcacagctgtcttgcaagct

SEQ ID NO: 8537974 - DNA, 22 bp, Homo sapiens
gagcacagctggaggtagcatt

SEQ ID NO: 8537975 - DNA, 22 bp, Homo sapiens
gagcacagctggaggtagcatt

SEQ ID NO: 8537976 - DNA, 22 bp, Homo sapiens
gagcacagctggaggtagcatt

SEQ ID NO: 8537977 - DNA, 22 bp, Homo sapiens
gagcacagctggaggtagcatt

SEQ ID NO: 8537978 - DNA, 22 bp, Homo sapiens
gagcacagcagggctctgggtg

SEQ ID NO: 8537979 - DNA, 22 bp, Homo sapiens
gagcacagcagggctctgggtg

SEQ ID NO: 8537980 - DNA, 22 bp, Homo sapiens
gagcacagattgatttaaaata

SEQ ID NO: 8537981 - DNA, 22 bp, Homo sapiens
gagcacagcagggctctgggtg

SEQ ID NO: 8537982 - DNA, 22 bp, Homo sapiens
gagcacagccaaagtaagaagg

SEQ ID NO: 8537983 - DNA, 22 bp, Homo sapiens
gagcacagccaaagtaagaagg

SEQ ID NO: 8537984 - DNA, 22 bp, Homo sapiens
gagcacagcgcagtttgtaatt

SEQ ID NO: 8537985 - DNA, 19 bp, Homo sapiens
gagcacagcggcatttggt

SEQ ID NO: 8537986 - DNA, 19 bp, Homo sapiens
gagcacagcggcatttggt

SEQ ID NO: 8537987 - DNA, 19 bp, Homo sapiens
gagcacagcggcatttggt

SEQ ID NO: 8537988 - DNA, 22 bp, Homo sapiens
atgggagtgacagggccactgg

SEQ ID NO: 8537989 - DNA, 22 bp, Homo sapiens
atgggagttttctctgatgctc

SEQ ID NO: 8537990 - DNA, 22 bp, Homo sapiens
atgggagggtggaaaggctctg

SEQ ID NO: 8537991 - DNA, 22 bp, Homo sapiens
atgggagggtggaaaggctctg

SEQ ID NO: 8537992 - DNA, 18 bp, Homo sapiens
atgggaggggccaagaga

SEQ ID NO: 8537993 - DNA, 22 bp, Homo sapiens
atgggaggaagagaagatgtct

SEQ ID NO: 8537994 - DNA, 22 bp, Homo sapiens
atgggagggtggaaaggctctg

SEQ ID NO: 8537995 - DNA, 22 bp, Homo sapiens
atgggagggtggaaaggctctg

SEQ ID NO: 8537996 - DNA, 22 bp, Homo sapiens
atgggagggtggaaaggctctg

SEQ ID NO: 8537997 - DNA, 22 bp, Homo sapiens
gagcacagggaatagacagata

SEQ ID NO: 8537998 - DNA, 22 bp, Homo sapiens
atgggaggaagagaagatgtct

SEQ ID NO: 8537999 - DNA, 22 bp, Homo sapiens
atgggaggaagagaagatgtct

SEQ ID NO: 8538000 - DNA, 22 bp, Homo sapiens
atgggaggaagagaagatgtct

SEQ ID NO: 8538001 - DNA, 22 bp, Homo sapiens
gagcacaggctttggtggacac

SEQ ID NO: 8538002 - DNA, 22 bp, Homo sapiens
gagcacaggctttggtggacac

SEQ ID NO: 8538003 - DNA, 22 bp, Homo sapiens
gagcacaggctttggtggacac

SEQ ID NO: 8538004 - DNA, 22 bp, Homo sapiens
gagcacaggctttggtggacac

SEQ ID NO: 8538005 - DNA, 22 bp, Homo sapiens
gagcacagggaatagacagata

SEQ ID NO: 8538006 - DNA, 22 bp, Homo sapiens
gagcacaggctttggtggacac

SEQ ID NO: 8538007 - DNA, 21 bp, Homo sapiens
atggctcaggccatcaatgga

SEQ ID NO: 8538008 - DNA, 22 bp, Homo sapiens
atggctcatttatcttgcagcc

SEQ ID NO: 8538009 - DNA, 22 bp, Homo sapiens
atggctccaagatggagagcca

SEQ ID NO: 8538010 - DNA, 22 bp, Homo sapiens
atggctccaagatggagagcca

SEQ ID NO: 8538011 - DNA, 18 bp, Homo sapiens
atggctccagtgtcttcc

SEQ ID NO: 8538012 - DNA, 22 bp, Homo sapiens
atggctccatcctgttgctagt

SEQ ID NO: 8538013 - DNA, 22 bp, Homo sapiens
atggctccttctgtgcagtttt

SEQ ID NO: 8538014 - DNA, 22 bp, Homo sapiens
atggctccagcttggcttcacc

SEQ ID NO: 8538015 - DNA, 22 bp, Homo sapiens
atggctccagctggtagagatt

SEQ ID NO: 8538016 - DNA, 22 bp, Homo sapiens
atggctctagaatacccctcag

SEQ ID NO: 8538017 - DNA, 22 bp, Homo sapiens
atggccctgtttatggtaaggc

SEQ ID NO: 8538018 - DNA, 22 bp, Homo sapiens
atggccctttattccttcttcc

SEQ ID NO: 8538019 - DNA, 22 bp, Homo sapiens
atggcagagggattgaacagct

SEQ ID NO: 8538020 - DNA, 22 bp, Homo sapiens
atggcagacgaggcagcagggg

SEQ ID NO: 8538021 - DNA, 22 bp, Homo sapiens
atggcagagaaagcgagccaca

SEQ ID NO: 8538022 - DNA, 22 bp, Homo sapiens
atggcagacgaggcagcagggg

SEQ ID NO: 8538023 - DNA, 22 bp, Homo sapiens
atggcagacgaggcagcagggg

SEQ ID NO: 8538024 - DNA, 22 bp, Homo sapiens
atggcagacctgggctggagaa

SEQ ID NO: 8538025 - DNA, 22 bp, Homo sapiens
atggcagacctgggctggagaa

SEQ ID NO: 8538026 - DNA, 22 bp, Homo sapiens
atggcagacctgggctggagaa

SEQ ID NO: 8538027 - DNA, 22 bp, Homo sapiens
atggctgcatcatcctggttga

SEQ ID NO: 8538028 - DNA, 22 bp, Homo sapiens
atggctgcagccggccctgcgc

SEQ ID NO: 8538029 - DNA, 22 bp, Homo sapiens
atggctgcagagacctgaagaa

SEQ ID NO: 8538030 - DNA, 22 bp, Homo sapiens
atggctcttgaattgatactct

SEQ ID NO: 8538031 - DNA, 22 bp, Homo sapiens
atggctgagatgggctccaggc

SEQ ID NO: 8538032 - DNA, 22 bp, Homo sapiens
atggctgagatgggctccaggc

SEQ ID NO: 8538033 - DNA, 22 bp, Homo sapiens
atggctgagatgggctccaggc

SEQ ID NO: 8538034 - DNA, 21 bp, Homo sapiens
atggctgatgatattgaacat

SEQ ID NO: 8538035 - DNA, 22 bp, Homo sapiens
atggctctctagggcccaggtt

SEQ ID NO: 8538036 - DNA, 22 bp, Homo sapiens
atggctctcttgacctaggcac

SEQ ID NO: 8538037 - DNA, 22 bp, Homo sapiens
atggctctctccttactgctgc

SEQ ID NO: 8538038 - DNA, 22 bp, Homo sapiens
atggctctgagaacctgagcta

SEQ ID NO: 8538039 - DNA, 22 bp, Homo sapiens
atggctctgagaacctgagcta

SEQ ID NO: 8538040 - DNA, 22 bp, Homo sapiens
atggctctcttgacctaggcac

SEQ ID NO: 8538041 - DNA, 22 bp, Homo sapiens
atggctctgctgggcaaagcaa

SEQ ID NO: 8538042 - DNA, 22 bp, Homo sapiens
atggctctgctgggcaaagcaa

SEQ ID NO: 8538043 - DNA, 20 bp, Homo sapiens
atggctctgtttggcagtga

SEQ ID NO: 8538044 - DNA, 19 bp, Homo sapiens
atggctctgggatcactgc

SEQ ID NO: 8538045 - DNA, 22 bp, Homo sapiens
gaggctccagcgacacctaggc

SEQ ID NO: 8538046 - DNA, 22 bp, Homo sapiens
gaggctccagcgacacctaggc

SEQ ID NO: 8538047 - DNA, 22 bp, Homo sapiens
atgtatttactgagaaggaaac

SEQ ID NO: 8538048 - DNA, 22 bp, Homo sapiens
atgtatttctatgtagtgaaga

SEQ ID NO: 8538049 - DNA, 23 bp, Homo sapiens
atgtatttaaatttcagtgatga

SEQ ID NO: 8538050 - DNA, 23 bp, Homo sapiens
atgtatttaaatttcagtgatga

SEQ ID NO: 8538051 - DNA, 22 bp, Homo sapiens
atgtattgtctcttttccttaa

SEQ ID NO: 8538052 - DNA, 22 bp, Homo sapiens
gaggctctggagtaggtacaca

SEQ ID NO: 8538053 - DNA, 22 bp, Homo sapiens
gaggctccttgaaagggggact

SEQ ID NO: 8538054 - DNA, 22 bp, Homo sapiens
gaggctcctcattcagtatgct

SEQ ID NO: 8538055 - DNA, 22 bp, Homo sapiens
gaggctcctcattcagtatgct

SEQ ID NO: 8538056 - DNA, 22 bp, Homo sapiens
gaggctcttcaataggtcaatg

SEQ ID NO: 8538057 - DNA, 22 bp, Homo sapiens
gaggctccgtgctgctgccctg

SEQ ID NO: 8538058 - DNA, 22 bp, Homo sapiens
gaggctccctcaactctgggtg

SEQ ID NO: 8538059 - DNA, 22 bp, Homo sapiens
atgtatcacagcaatgtagtca

SEQ ID NO: 8538060 - DNA, 22 bp, Homo sapiens
atgtatcaattatctgtctgca

SEQ ID NO: 8538061 - DNA, 22 bp, Homo sapiens
atgtatcagaaatagcattggc

SEQ ID NO: 8538062 - DNA, 22 bp, Homo sapiens
atgtatcagaaatagcattggc

SEQ ID NO: 8538063 - DNA, 22 bp, Homo sapiens
atgtatcagataaagcatgtgg

SEQ ID NO: 8538064 - DNA, 22 bp, Homo sapiens
atgtatcatgcagggtccatga

SEQ ID NO: 8538065 - DNA, 22 bp, Homo sapiens
atgtatgtatgctgtgcttgca

SEQ ID NO: 8538066 - DNA, 22 bp, Homo sapiens
atgtatgctttgattttagatg

SEQ ID NO: 8538067 - DNA, 22 bp, Homo sapiens
atgtatgcatgtatgtatcgct

SEQ ID NO: 8538068 - DNA, 22 bp, Homo sapiens
atgtatgcatgctacagttttc

SEQ ID NO: 8538069 - DNA, 22 bp, Homo sapiens
atgtatgcatagtgagtaaatg

SEQ ID NO: 8538070 - DNA, 20 bp, Homo sapiens
atgtatgcaaatgtcttcca

SEQ ID NO: 8538071 - DNA, 22 bp, Homo sapiens
atgtatgttttcagttgtatta

SEQ ID NO: 8538072 - DNA, 22 bp, Homo sapiens
atgtatgttagtgtattatcta

SEQ ID NO: 8538073 - DNA, 22 bp, Homo sapiens
atgggcaggcaaggtggcgagt

SEQ ID NO: 8538074 - DNA, 22 bp, Homo sapiens
atgggcaggcaaggtggcgagt

SEQ ID NO: 8538075 - DNA, 22 bp, Homo sapiens
atgggcagctgcagcagtggtg

SEQ ID NO: 8538076 - DNA, 22 bp, Homo sapiens
atgggcaggcctctcatttctg

SEQ ID NO: 8538077 - DNA, 22 bp, Homo sapiens
atgggcaggcactggctctcag

SEQ ID NO: 8538078 - DNA, 22 bp, Homo sapiens
atgggcagcagctgccattcat

SEQ ID NO: 8538079 - DNA, 22 bp, Homo sapiens
atgggcagagtggggacaggaa

SEQ ID NO: 8538080 - DNA, 22 bp, Homo sapiens
atgggcagagtggggacaggaa

SEQ ID NO: 8538081 - DNA, 22 bp, Homo sapiens
atgggcagctgcagcagtggtg

SEQ ID NO: 8538082 - DNA, 22 bp, Homo sapiens
atgggcagctgcagcagtggtg

SEQ ID NO: 8538083 - DNA, 22 bp, Homo sapiens
gaggagggcctggtgtcccttc

SEQ ID NO: 8538084 - DNA, 22 bp, Homo sapiens
gaggagggcctggtgtcccttc

SEQ ID NO: 8538085 - DNA, 22 bp, Homo sapiens
gaggagggcagttcctctttta

SEQ ID NO: 8538086 - DNA, 22 bp, Homo sapiens
gaggagggctttgttgatgtta

SEQ ID NO: 8538087 - DNA, 22 bp, Homo sapiens
gaggagggcctggtgtcccttc

SEQ ID NO: 8538088 - DNA, 22 bp, Homo sapiens
gaggagggctttgttgatgtta

SEQ ID NO: 8538089 - DNA, 22 bp, Homo sapiens
gaggagggagctggaagctctt

SEQ ID NO: 8538090 - DNA, 22 bp, Homo sapiens
gaggagggagctggaagctctt

SEQ ID NO: 8538091 - DNA, 22 bp, Homo sapiens
gaggagggagctggaagctctt

SEQ ID NO: 8538092 - DNA, 22 bp, Homo sapiens
gaggcacagtgtttggtcagtg

SEQ ID NO: 8538093 - DNA, 22 bp, Homo sapiens
gaggcacagtcccgaggcaagg

SEQ ID NO: 8538094 - DNA, 22 bp, Homo sapiens
gaggcacagtcccgaggcaagg

SEQ ID NO: 8538095 - DNA, 22 bp, Homo sapiens
gaggcacagtgtttggtcagtg

SEQ ID NO: 8538096 - DNA, 22 bp, Homo sapiens
gaggcacagtgtttggtcagtg

SEQ ID NO: 8538097 - DNA, 22 bp, Homo sapiens
gaggcacagttcttcctccaga

SEQ ID NO: 8538098 - DNA, 18 bp, Homo sapiens
gaggcacatagttggggc

SEQ ID NO: 8538099 - DNA, 22 bp, Homo sapiens
gaggcacatatatacagagccc

SEQ ID NO: 8538100 - DNA, 22 bp, Homo sapiens
gaggcacatatatacagagccc

SEQ ID NO: 8538101 - DNA, 22 bp, Homo sapiens
gaggcacatatatacagagccc

SEQ ID NO: 8538102 - DNA, 22 bp, Homo sapiens
atgtagctgcagatgataatgc

SEQ ID NO: 8538103 - DNA, 22 bp, Homo sapiens
atgtagcttgtcccacatcata

SEQ ID NO: 8538104 - DNA, 22 bp, Homo sapiens
atgtaggattgagtgatagagg

SEQ ID NO: 8538105 - DNA, 20 bp, Homo sapiens
atgtatattactggctgtga

SEQ ID NO: 8538106 - DNA, 22 bp, Homo sapiens
atgtatcaacaaattgtacagt

SEQ ID NO: 8538107 - DNA, 22 bp, Homo sapiens
gaggcacaatacatgtctcaag

SEQ ID NO: 8538108 - DNA, 22 bp, Homo sapiens
gaggcacaccagggagtcttgt

SEQ ID NO: 8538109 - DNA, 22 bp, Homo sapiens
gaggcacagagccctaggagct

SEQ ID NO: 8538110 - DNA, 22 bp, Homo sapiens
gaggcacagagccctaggagct

SEQ ID NO: 8538111 - DNA, 22 bp, Homo sapiens
gaggcacagagccctaggagct

SEQ ID NO: 8538112 - DNA, 22 bp, Homo sapiens
gaggcacagagtaggtgcacac

SEQ ID NO: 8538113 - DNA, 22 bp, Homo sapiens
gaggaggggacagtacttgtgc

SEQ ID NO: 8538114 - DNA, 23 bp, Homo sapiens
gaggagggtcgtgctgtgttcct

SEQ ID NO: 8538115 - DNA, 23 bp, Homo sapiens
gaggagggtcgtgctgtgttcct

SEQ ID NO: 8538116 - DNA, 22 bp, Homo sapiens
gaggcacaatacatgtctcaag

SEQ ID NO: 8538117 - DNA, 22 bp, Homo sapiens
gaggaggggcacttgtctccta

SEQ ID NO: 8538118 - DNA, 21 bp, Homo sapiens
atgtgcttagctgctggtagt

SEQ ID NO: 8538119 - DNA, 22 bp, Homo sapiens
atgtgcttatggtctctggttg

SEQ ID NO: 8538120 - DNA, 22 bp, Homo sapiens
atgtgcttcattctacatgaca

SEQ ID NO: 8538121 - DNA, 22 bp, Homo sapiens
atgtgcttcaggatgtcagtgt

SEQ ID NO: 8538122 - DNA, 22 bp, Homo sapiens
atgtgcttgcagatgagcctca

SEQ ID NO: 8538123 - DNA, 22 bp, Homo sapiens
atgtgcttggaaaagcagtggt

SEQ ID NO: 8538124 - DNA, 22 bp, Homo sapiens
atgtgcttgaagcctcagagaa

SEQ ID NO: 8538125 - DNA, 22 bp, Homo sapiens
atgtgcttgagggaaatcagtt

SEQ ID NO: 8538126 - DNA, 22 bp, Homo sapiens
atgtgcttgactactctctatt

SEQ ID NO: 8538127 - DNA, 19 bp, Homo sapiens
atgtgcttgggccatgcta

SEQ ID NO: 8538128 - DNA, 22 bp, Homo sapiens
atgtgcttggacattctaggaa

SEQ ID NO: 8538129 - DNA, 22 bp, Homo sapiens
atgtgctttattaagtaaaaat

SEQ ID NO: 8538130 - DNA, 22 bp, Homo sapiens
atgtgctttaggtttgtttaca

SEQ ID NO: 8538131 - DNA, 22 bp, Homo sapiens
atgtgctttaaagaagccagct

SEQ ID NO: 8538132 - DNA, 22 bp, Homo sapiens
atgtggagaggaagtgcaaact

SEQ ID NO: 8538133 - DNA, 22 bp, Homo sapiens
atgtggatttgggagtgatcag

SEQ ID NO: 8538134 - DNA, 22 bp, Homo sapiens
atgtggatggaagtcagatagc

SEQ ID NO: 8538135 - DNA, 22 bp, Homo sapiens
atgtgcttttactccccagagt

SEQ ID NO: 8538136 - DNA, 22 bp, Homo sapiens
atgtgctttctttccaaggggc

SEQ ID NO: 8538137 - DNA, 22 bp, Homo sapiens
atgtgctttccaatgctgtagg

SEQ ID NO: 8538138 - DNA, 22 bp, Homo sapiens
atgtggcaatggttagcactgt

SEQ ID NO: 8538139 - DNA, 22 bp, Homo sapiens
atgtggccagtcatgtagtaac

SEQ ID NO: 8538140 - DNA, 21 bp, Homo sapiens
atgtggccattgtagtccacg

SEQ ID NO: 8538141 - DNA, 22 bp, Homo sapiens
atgtggccagtcatgtagtaac

SEQ ID NO: 8538142 - DNA, 22 bp, Homo sapiens
atgtggcccagcggtcaggctg

SEQ ID NO: 8538143 - DNA, 22 bp, Homo sapiens
atgtggcctagtatagaaatga

SEQ ID NO: 8538144 - DNA, 22 bp, Homo sapiens
atgtggcctagtatagaaatga

SEQ ID NO: 8538145 - DNA, 22 bp, Homo sapiens
atgtcagaatctacattctact

SEQ ID NO: 8538146 - DNA, 22 bp, Homo sapiens
atgtcacttttgagactaggtt

SEQ ID NO: 8538147 - DNA, 22 bp, Homo sapiens
atgtcactgtgaggcagctgtc

SEQ ID NO: 8538148 - DNA, 22 bp, Homo sapiens
gaggctgaacaggttctcatga

SEQ ID NO: 8538149 - DNA, 22 bp, Homo sapiens
atgtcagtctttctgtctcaga

SEQ ID NO: 8538150 - DNA, 22 bp, Homo sapiens
atgtgaggtagataggatgcag

SEQ ID NO: 8538151 - DNA, 22 bp, Homo sapiens
atgtgcgtgtgtacatatatat

SEQ ID NO: 8538152 - DNA, 22 bp, Homo sapiens
atgtggctagtgcaactgagaa

SEQ ID NO: 8538153 - DNA, 22 bp, Homo sapiens
atgtggctagtgcagatgaata

SEQ ID NO: 8538154 - DNA, 23 bp, Homo sapiens
atgtggctagtgagaccaagaaa

SEQ ID NO: 8538155 - DNA, 18 bp, Homo sapiens
atgtggctagtgcaactg

SEQ ID NO: 8538156 - DNA, 17 bp, Homo sapiens
atgtggctaagctgctg

SEQ ID NO: 8538157 - DNA, 22 bp, Homo sapiens
atgtggctagggaataaaatat

SEQ ID NO: 8538158 - DNA, 22 bp, Homo sapiens
atgtggctagtccaattaatga

SEQ ID NO: 8538159 - DNA, 22 bp, Homo sapiens
atgtggctagtcctctgcggca

SEQ ID NO: 8538160 - DNA, 22 bp, Homo sapiens
atgtggccttaatgacagcagc

SEQ ID NO: 8538161 - DNA, 22 bp, Homo sapiens
atgtggccttaggttctagtgg

SEQ ID NO: 8538162 - DNA, 18 bp, Homo sapiens
atgtggctagtgctactg

SEQ ID NO: 8538163 - DNA, 22 bp, Homo sapiens
atgtggctagtggacacagtat

SEQ ID NO: 8538164 - DNA, 22 bp, Homo sapiens
atgtggctagtggctatgatct

SEQ ID NO: 8538165 - DNA, 22 bp, Homo sapiens
atgtggctattttaatgttaat

SEQ ID NO: 8538166 - DNA, 22 bp, Homo sapiens
atgtggctagtggctatgatct

SEQ ID NO: 8538167 - DNA, 22 bp, Homo sapiens
atgtggctcacatagctggaaa

SEQ ID NO: 8538168 - DNA, 22 bp, Homo sapiens
atgtggctcacatagctggaaa

SEQ ID NO: 8538169 - DNA, 21 bp, Homo sapiens
atgtggctcccttcctcagga

SEQ ID NO: 8538170 - DNA, 22 bp, Homo sapiens
atgtggctcattgtttgcttac

SEQ ID NO: 8538171 - DNA, 22 bp, Homo sapiens
atgtggctcagcaggctcccgt

SEQ ID NO: 8538172 - DNA, 22 bp, Homo sapiens
atgtggctgccacctgcctgaa

SEQ ID NO: 8538173 - DNA, 22 bp, Homo sapiens
atgtggctgccacctgcctgaa

SEQ ID NO: 8538174 - DNA, 22 bp, Homo sapiens
atgtggctgatcgcagagctct

SEQ ID NO: 8538175 - DNA, 22 bp, Homo sapiens
atgtggctccttactcatcagc

SEQ ID NO: 8538176 - DNA, 22 bp, Homo sapiens
atgtggctgatcgcagagctct

SEQ ID NO: 8538177 - DNA, 22 bp, Homo sapiens
atgtggctcattgtttgcttac

SEQ ID NO: 8538178 - DNA, 21 bp, Homo sapiens
atgtggctcccttcctcagga

SEQ ID NO: 8538179 - DNA, 23 bp, Homo sapiens
atgttaaacataactgaagagcc

SEQ ID NO: 8538180 - DNA, 22 bp, Homo sapiens
atgtggctggtagttgacaact

SEQ ID NO: 8538181 - DNA, 22 bp, Homo sapiens
atgtggctggtgactgccgtac

SEQ ID NO: 8538182 - DNA, 22 bp, Homo sapiens
atgttacttagaataattctgg

SEQ ID NO: 8538183 - DNA, 22 bp, Homo sapiens
atgttaccttgttctccaaaaa

SEQ ID NO: 8538184 - DNA, 22 bp, Homo sapiens
atgttaccatcttttatctaca

SEQ ID NO: 8538185 - DNA, 22 bp, Homo sapiens
atgttacctctattagaatatt

SEQ ID NO: 8538186 - DNA, 22 bp, Homo sapiens
atgttacctctattagaatatt

SEQ ID NO: 8538187 - DNA, 22 bp, Homo sapiens
atgttactgtgatcatgatact

SEQ ID NO: 8538188 - DNA, 22 bp, Homo sapiens
atgttactgtgatcatgatact

SEQ ID NO: 8538189 - DNA, 22 bp, Homo sapiens
atgttacatagtccttatttgt

SEQ ID NO: 8538190 - DNA, 22 bp, Homo sapiens
atgttacagttgagtaaattaa

SEQ ID NO: 8538191 - DNA, 23 bp, Homo sapiens
atgttaccaatggaggaaattgg

SEQ ID NO: 8538192 - DNA, 22 bp, Homo sapiens
gaggttggcgccctgcctggcc

SEQ ID NO: 8538193 - DNA, 22 bp, Homo sapiens
gaggttgggaagtccaagctgg

SEQ ID NO: 8538194 - DNA, 22 bp, Homo sapiens
gaggttgggaagtccaagctgg

SEQ ID NO: 8538195 - DNA, 22 bp, Homo sapiens
gaggttggagggctggcctgca

SEQ ID NO: 8538196 - DNA, 22 bp, Homo sapiens
gagtgcagtatcttctgtgtcc

SEQ ID NO: 8538197 - DNA, 22 bp, Homo sapiens
gagtgcagtatcttctgtgtcc

SEQ ID NO: 8538198 - DNA, 22 bp, Homo sapiens
gagtgcagtatgagaggctgct

SEQ ID NO: 8538199 - DNA, 22 bp, Homo sapiens
gaggttcgatacagcgtattta

SEQ ID NO: 8538200 - DNA, 22 bp, Homo sapiens
gaggttcagtaaggaatactga

SEQ ID NO: 8538201 - DNA, 22 bp, Homo sapiens
gaggttcacaggctatcacagt

SEQ ID NO: 8538202 - DNA, 22 bp, Homo sapiens
gaggttagaggtcagtgcagtc

SEQ ID NO: 8538203 - DNA, 22 bp, Homo sapiens
atgttatgacaagcatgacaga

SEQ ID NO: 8538204 - DNA, 22 bp, Homo sapiens
atgttatggctcaaacatttgg

SEQ ID NO: 8538205 - DNA, 22 bp, Homo sapiens
atgttataaatagagacactgg

SEQ ID NO: 8538206 - DNA, 22 bp, Homo sapiens
atgttataaatagagacactgg

SEQ ID NO: 8538207 - DNA, 22 bp, Homo sapiens
caatagtaaattacggaggaga

SEQ ID NO: 8538208 - DNA, 22 bp, Homo sapiens
caatagcaggtctacagagaga

SEQ ID NO: 8538209 - DNA, 22 bp, Homo sapiens
caatagctatgtaacctgaaga

SEQ ID NO: 8538210 - DNA, 22 bp, Homo sapiens
caatatagagagaaaattatgt

SEQ ID NO: 8538211 - DNA, 22 bp, Homo sapiens
caatagtgtctgcttgtttcta

SEQ ID NO: 8538212 - DNA, 19 bp, Homo sapiens
caatatatagtgagtggat

SEQ ID NO: 8538213 - DNA, 19 bp, Homo sapiens
caatatatagtgagtggat

SEQ ID NO: 8538214 - DNA, 22 bp, Homo sapiens
caatatataggaacaacttagg

SEQ ID NO: 8538215 - DNA, 22 bp, Homo sapiens
caatatataatgagtactttcc

SEQ ID NO: 8538216 - DNA, 22 bp, Homo sapiens
caatatataggaacaacttagg

SEQ ID NO: 8538217 - DNA, 20 bp, Homo sapiens
caatagaatgtggagataag

SEQ ID NO: 8538218 - DNA, 20 bp, Homo sapiens
caatagaatgtggagataag

SEQ ID NO: 8538219 - DNA, 22 bp, Homo sapiens
caatagaaggcacagataggta

SEQ ID NO: 8538220 - DNA, 22 bp, Homo sapiens
caatagcagcttctgaatgcaa

SEQ ID NO: 8538221 - DNA, 22 bp, Homo sapiens
caatagcagcttctgaatgcaa

SEQ ID NO: 8538222 - DNA, 22 bp, Homo sapiens
caatagcagcttctgaatgcaa

SEQ ID NO: 8538223 - DNA, 22 bp, Homo sapiens
caatagcaggtctacagagaga

SEQ ID NO: 8538224 - DNA, 22 bp, Homo sapiens
caatagcagacctagaaagcaa

SEQ ID NO: 8538225 - DNA, 22 bp, Homo sapiens
caatagcagacctagaaagcaa

SEQ ID NO: 8538226 - DNA, 22 bp, Homo sapiens
caatagcagacctagaaagcaa

SEQ ID NO: 8538227 - DNA, 18 bp, Homo sapiens
caatagaaacagtaggaa

SEQ ID NO: 8538228 - DNA, 18 bp, Homo sapiens
caatagaaacagtaggaa

SEQ ID NO: 8538229 - DNA, 22 bp, Homo sapiens
caatagaaggcacagataggta

SEQ ID NO: 8538230 - DNA, 22 bp, Homo sapiens
caatagaaaactcaatacttaa

SEQ ID NO: 8538231 - DNA, 18 bp, Homo sapiens
caatagaaacagtaggaa

SEQ ID NO: 8538232 - DNA, 22 bp, Homo sapiens
caatagaaaactcaatacttaa

SEQ ID NO: 8538233 - DNA, 22 bp, Homo sapiens
caaggctataatgttgctggaa

SEQ ID NO: 8538234 - DNA, 22 bp, Homo sapiens
caaggctgcaaaactacatggg

SEQ ID NO: 8538235 - DNA, 22 bp, Homo sapiens
caaggctgctgcgggtcgcacc

SEQ ID NO: 8538236 - DNA, 22 bp, Homo sapiens
caaggctgctgcgggtcgcacc

SEQ ID NO: 8538237 - DNA, 22 bp, Homo sapiens
caaggctgctgcgggtcgcacc

SEQ ID NO: 8538238 - DNA, 22 bp, Homo sapiens
caaggctgctgcgggtcgcacc

SEQ ID NO: 8538239 - DNA, 22 bp, Homo sapiens
gctggggaggcagcagagaaca

SEQ ID NO: 8538240 - DNA, 22 bp, Homo sapiens
caaggctaagctttggctttct

SEQ ID NO: 8538241 - DNA, 22 bp, Homo sapiens
gctggggagctagacctcagca

SEQ ID NO: 8538242 - DNA, 22 bp, Homo sapiens
gctggggagctagacctcagca

SEQ ID NO: 8538243 - DNA, 22 bp, Homo sapiens
gctggggagcaagagtagtgag

SEQ ID NO: 8538244 - DNA, 22 bp, Homo sapiens
gctggggagctagacctcagca

SEQ ID NO: 8538245 - DNA, 22 bp, Homo sapiens
gctggggagctagacctcagca

SEQ ID NO: 8538246 - DNA, 22 bp, Homo sapiens
caaggctgtctccagcttccaa

SEQ ID NO: 8538247 - DNA, 22 bp, Homo sapiens
caaggctgtctccagcttccaa

SEQ ID NO: 8538248 - DNA, 22 bp, Homo sapiens
caaggctgtgcagggtccatat

SEQ ID NO: 8538249 - DNA, 22 bp, Homo sapiens
caaggctgtgcagggtccatat

SEQ ID NO: 8538250 - DNA, 22 bp, Homo sapiens
caaggctgctggcttctgagct

SEQ ID NO: 8538251 - DNA, 22 bp, Homo sapiens
caataagtaataggcatctaat

SEQ ID NO: 8538252 - DNA, 22 bp, Homo sapiens
caatactgagtttacattcatc

SEQ ID NO: 8538253 - DNA, 22 bp, Homo sapiens
caaggcttagtcagagggtgct

SEQ ID NO: 8538254 - DNA, 22 bp, Homo sapiens
caataactttgatattttgcgg

SEQ ID NO: 8538255 - DNA, 22 bp, Homo sapiens
caataagatgtattgagcagag

SEQ ID NO: 8538256 - DNA, 22 bp, Homo sapiens
caatttcaatacaaaatacatt

SEQ ID NO: 8538257 - DNA, 22 bp, Homo sapiens
caatttcaatacaaaatacatt

SEQ ID NO: 8538258 - DNA, 22 bp, Homo sapiens
caatttcaatacaaaatacatt

SEQ ID NO: 8538259 - DNA, 22 bp, Homo sapiens
caatttcaggtggataggtttt

SEQ ID NO: 8538260 - DNA, 17 bp, Homo sapiens
caatttcataggttttg

SEQ ID NO: 8538261 - DNA, 22 bp, Homo sapiens
caatttcatcttgtgcttcaat

SEQ ID NO: 8538262 - DNA, 22 bp, Homo sapiens
caatttcatgccatgtattgct

SEQ ID NO: 8538263 - DNA, 22 bp, Homo sapiens
caatttcatgccatgtattgct

SEQ ID NO: 8538264 - DNA, 22 bp, Homo sapiens
caatttcatgccatgtattgct

SEQ ID NO: 8538265 - DNA, 22 bp, Homo sapiens
caatttcattaatagatataga

SEQ ID NO: 8538266 - DNA, 22 bp, Homo sapiens
caatttcatggataaaagatgt

SEQ ID NO: 8538267 - DNA, 22 bp, Homo sapiens
caatttctaacattccatggat

SEQ ID NO: 8538268 - DNA, 22 bp, Homo sapiens
ggaagagcctggggtgtcaggc

SEQ ID NO: 8538269 - DNA, 22 bp, Homo sapiens
ggaagagcctggggtgtcaggc

SEQ ID NO: 8538270 - DNA, 22 bp, Homo sapiens
ggaagagcctggggtgtcaggc

SEQ ID NO: 8538271 - DNA, 22 bp, Homo sapiens
caattgtcagtgctgtttaaat

SEQ ID NO: 8538272 - DNA, 23 bp, Homo sapiens
caattgtataaagcaaatggttt

SEQ ID NO: 8538273 - DNA, 22 bp, Homo sapiens
caattgtcgttgacatccttca

SEQ ID NO: 8538274 - DNA, 22 bp, Homo sapiens
caattgaacagatgagttaaat

SEQ ID NO: 8538275 - DNA, 22 bp, Homo sapiens
caatccatcaattacacaggct

SEQ ID NO: 8538276 - DNA, 22 bp, Homo sapiens
caatcccatcaccatctgctct

SEQ ID NO: 8538277 - DNA, 22 bp, Homo sapiens
caatcacaaagagacaagtgtc

SEQ ID NO: 8538278 - DNA, 22 bp, Homo sapiens
caatcacaaagagacaagtgtc

SEQ ID NO: 8538279 - DNA, 22 bp, Homo sapiens
caatcacaaagagacaagtgtc

SEQ ID NO: 8538280 - DNA, 22 bp, Homo sapiens
caatcacaaagagacaagtgtc

SEQ ID NO: 8538281 - DNA, 19 bp, Homo sapiens
caatatatagtgagtggat

SEQ ID NO: 8538282 - DNA, 22 bp, Homo sapiens
caatatgcaagctattaagtat

SEQ ID NO: 8538283 - DNA, 22 bp, Homo sapiens
caatcagatatgtgacatattt

SEQ ID NO: 8538284 - DNA, 22 bp, Homo sapiens
caatcagatatgtgacatattt

SEQ ID NO: 8538285 - DNA, 21 bp, Homo sapiens
caatcacttttgcaccaagct

SEQ ID NO: 8538286 - DNA, 22 bp, Homo sapiens
caatcactgacctgcagatgca

SEQ ID NO: 8538287 - DNA, 22 bp, Homo sapiens
caatcactgggatattggtgtg

SEQ ID NO: 8538288 - DNA, 22 bp, Homo sapiens
caatcacaaagagacaagtgtc

SEQ ID NO: 8538289 - DNA, 22 bp, Homo sapiens
caatcactccacaatatggttc

SEQ ID NO: 8538290 - DNA, 22 bp, Homo sapiens
caatcactctgcaacattcctg

SEQ ID NO: 8538291 - DNA, 22 bp, Homo sapiens
cacacaggatgaagcagcagaa

SEQ ID NO: 8538292 - DNA, 22 bp, Homo sapiens
cacacaggatgaagcagcagaa

SEQ ID NO: 8538293 - DNA, 22 bp, Homo sapiens
cacacaggatgaagcagcagaa

SEQ ID NO: 8538294 - DNA, 22 bp, Homo sapiens
ggaccagagctcgggcttctca

SEQ ID NO: 8538295 - DNA, 22 bp, Homo sapiens
ggaccagagctcgggcttctca

SEQ ID NO: 8538296 - DNA, 22 bp, Homo sapiens
ggaccagagaagtgagcacctg

SEQ ID NO: 8538297 - DNA, 22 bp, Homo sapiens
cacacaggtatatatatgtaca

SEQ ID NO: 8538298 - DNA, 22 bp, Homo sapiens
cacacaggtaagcctctttcaa

SEQ ID NO: 8538299 - DNA, 22 bp, Homo sapiens
cacacagggagaaagaaagcct

SEQ ID NO: 8538300 - DNA, 22 bp, Homo sapiens
cacacagggagaaagaaagcct

SEQ ID NO: 8538301 - DNA, 22 bp, Homo sapiens
cacacaggatgaagcagcagaa

SEQ ID NO: 8538302 - DNA, 22 bp, Homo sapiens
cacacaggatgaagcagcagaa

SEQ ID NO: 8538303 - DNA, 22 bp, Homo sapiens
cacacaggatgaagcagcagaa

SEQ ID NO: 8538304 - DNA, 22 bp, Homo sapiens
cacacaggatgaagcagcagaa

SEQ ID NO: 8538305 - DNA, 22 bp, Homo sapiens
cacacagtggagtattactcag

SEQ ID NO: 8538306 - DNA, 22 bp, Homo sapiens
cacacagtggagtattactcag

SEQ ID NO: 8538307 - DNA, 22 bp, Homo sapiens
cacacagtggagtattactcag

SEQ ID NO: 8538308 - DNA, 22 bp, Homo sapiens
cacacagtagtatgaggcaaaa

SEQ ID NO: 8538309 - DNA, 21 bp, Homo sapiens
cacacagtgatctatccacat

SEQ ID NO: 8538310 - DNA, 21 bp, Homo sapiens
cacacagtgatctatccacat

SEQ ID NO: 8538311 - DNA, 21 bp, Homo sapiens
cacacagtgatctatccacat

SEQ ID NO: 8538312 - DNA, 22 bp, Homo sapiens
cacacagtaggcactcattaat

SEQ ID NO: 8538313 - DNA, 22 bp, Homo sapiens
cacacagtaggcactcattaat

SEQ ID NO: 8538314 - DNA, 22 bp, Homo sapiens
cacacagtaggcactcattaat

SEQ ID NO: 8538315 - DNA, 22 bp, Homo sapiens
cacacagtagtatgaggcaaaa

SEQ ID NO: 8538316 - DNA, 22 bp, Homo sapiens
cacacagtaggcactcattaat

SEQ ID NO: 8538317 - DNA, 22 bp, Homo sapiens
ggactgggtaggagcccagggc

SEQ ID NO: 8538318 - DNA, 22 bp, Homo sapiens
ggactgggtaggagcccagggc

SEQ ID NO: 8538319 - DNA, 21 bp, Homo sapiens
cacacagtggagtgcccttgc

SEQ ID NO: 8538320 - DNA, 22 bp, Homo sapiens
ggagaaggcacacccacctctg

SEQ ID NO: 8538321 - DNA, 22 bp, Homo sapiens
ggagaaggcgaagtcattcttt

SEQ ID NO: 8538322 - DNA, 22 bp, Homo sapiens
ggagaagggacagactcagctt

SEQ ID NO: 8538323 - DNA, 22 bp, Homo sapiens
ggagaagggccaattccatgta

SEQ ID NO: 8538324 - DNA, 22 bp, Homo sapiens
ggagaagggccaattccatgta

SEQ ID NO: 8538325 - DNA, 22 bp, Homo sapiens
ggagaagggcatggtagtttta

SEQ ID NO: 8538326 - DNA, 22 bp, Homo sapiens
ggagaagggacagactcagctt

SEQ ID NO: 8538327 - DNA, 22 bp, Homo sapiens
ggagaagggacagactcagctt

SEQ ID NO: 8538328 - DNA, 22 bp, Homo sapiens
ggagaagggtatgtgtggcgga

SEQ ID NO: 8538329 - DNA, 22 bp, Homo sapiens
ggagaagggtatgtgtggcgga

SEQ ID NO: 8538330 - DNA, 22 bp, Homo sapiens
ggagaagggtatgtgtggcgga

SEQ ID NO: 8538331 - DNA, 22 bp, Homo sapiens
ggagaagggccaattccatgta

SEQ ID NO: 8538332 - DNA, 22 bp, Homo sapiens
ggagaaggtgctggtcactgtg

SEQ ID NO: 8538333 - DNA, 22 bp, Homo sapiens
ggagaaggtgctggtcactgtg

SEQ ID NO: 8538334 - DNA, 22 bp, Homo sapiens
ggagaagggtatgtgtggcgga

SEQ ID NO: 8538335 - DNA, 22 bp, Homo sapiens
ggagaaggtgctggtcactgtg

SEQ ID NO: 8538336 - DNA, 22 bp, Homo sapiens
ggagaaggtgctggtcactgtg

SEQ ID NO: 8538337 - DNA, 22 bp, Homo sapiens
ggagagcattcttagtctgttt

SEQ ID NO: 8538338 - DNA, 22 bp, Homo sapiens
ggagagcagggtcctgagatac

SEQ ID NO: 8538339 - DNA, 22 bp, Homo sapiens
ggagagcagggtcctgagatac

SEQ ID NO: 8538340 - DNA, 22 bp, Homo sapiens
ggagagcagggtcctgagatac

SEQ ID NO: 8538341 - DNA, 22 bp, Homo sapiens
ggagagcagggaggctgctctg

SEQ ID NO: 8538342 - DNA, 22 bp, Homo sapiens
ggagagcagggaggctgctctg

SEQ ID NO: 8538343 - DNA, 22 bp, Homo sapiens
ggagagcagggaggctgctctg

SEQ ID NO: 8538344 - DNA, 22 bp, Homo sapiens
ggagagcagggaggctgctctg

SEQ ID NO: 8538345 - DNA, 22 bp, Homo sapiens
ggagagaggctggccgtgatga

SEQ ID NO: 8538346 - DNA, 20 bp, Homo sapiens
ggagagcagggaagacagta

SEQ ID NO: 8538347 - DNA, 22 bp, Homo sapiens
ggagagataggagtcctggact

SEQ ID NO: 8538348 - DNA, 22 bp, Homo sapiens
ggagagatggaaaacctcccag

SEQ ID NO: 8538349 - DNA, 22 bp, Homo sapiens
ggagaaggtggctcagcaaagg

SEQ ID NO: 8538350 - DNA, 22 bp, Homo sapiens
ggagagaggagcccactgctgt

SEQ ID NO: 8538351 - DNA, 22 bp, Homo sapiens
ggacatttttcttcctacaatg

SEQ ID NO: 8538352 - DNA, 22 bp, Homo sapiens
ggaccagagaagtgagcacctg

SEQ ID NO: 8538353 - DNA, 19 bp, Homo sapiens
ggacatttgagttgtttat

SEQ ID NO: 8538354 - DNA, 22 bp, Homo sapiens
ggacatttagtttcattgggca

SEQ ID NO: 8538355 - DNA, 22 bp, Homo sapiens
ggacatttcataagaccattct

SEQ ID NO: 8538356 - DNA, 22 bp, Homo sapiens
ggacatggagcatgtagagaaa

SEQ ID NO: 8538357 - DNA, 22 bp, Homo sapiens
ggacatggagctccatggaggc

SEQ ID NO: 8538358 - DNA, 22 bp, Homo sapiens
ggacatttagaacagagtattt

SEQ ID NO: 8538359 - DNA, 19 bp, Homo sapiens
cacaaatgatgaggacctg

SEQ ID NO: 8538360 - DNA, 22 bp, Homo sapiens
cacaaatggccgtgttcaaaga

SEQ ID NO: 8538361 - DNA, 22 bp, Homo sapiens
cacaaatggccgtgttcaaaga

SEQ ID NO: 8538362 - DNA, 23 bp, Homo sapiens
cacaactaatcagaatctctagg

SEQ ID NO: 8538363 - DNA, 17 bp, Homo sapiens
cacaactggctgattga

SEQ ID NO: 8538364 - DNA, 20 bp, Homo sapiens
cacaactgtccacatgctcc

SEQ ID NO: 8538365 - DNA, 18 bp, Homo sapiens
ggacaggagacatgggtg

SEQ ID NO: 8538366 - DNA, 18 bp, Homo sapiens
ggacaggagacatgggtg

SEQ ID NO: 8538367 - DNA, 22 bp, Homo sapiens
ggaagctgaacttagcaaggaa

SEQ ID NO: 8538368 - DNA, 22 bp, Homo sapiens
ggaagctgaacttagcaaggaa

SEQ ID NO: 8538369 - DNA, 23 bp, Homo sapiens
ggaagctcacgtagtcctgcact

SEQ ID NO: 8538370 - DNA, 22 bp, Homo sapiens
ggaagaggaggagccaggcttt

SEQ ID NO: 8538371 - DNA, 22 bp, Homo sapiens
ggaagcctaaagcccaggtctc

SEQ ID NO: 8538372 - DNA, 22 bp, Homo sapiens
ggaagctgaggcccagtgaagg

SEQ ID NO: 8538373 - DNA, 22 bp, Homo sapiens
ggaagctgaggcccagtgaagg

SEQ ID NO: 8538374 - DNA, 22 bp, Homo sapiens
ggaagctgaatccagagacagg

SEQ ID NO: 8538375 - DNA, 22 bp, Homo sapiens
ggaagctgccagtccaccagct

SEQ ID NO: 8538376 - DNA, 22 bp, Homo sapiens
ggaagctggacaggctttgagt

SEQ ID NO: 8538377 - DNA, 22 bp, Homo sapiens
ggaagctggacaggctttgagt

SEQ ID NO: 8538378 - DNA, 22 bp, Homo sapiens
ggaagctggcatatgtaatcct

SEQ ID NO: 8538379 - DNA, 22 bp, Homo sapiens
ggaagctgggatctctctcccg

SEQ ID NO: 8538380 - DNA, 22 bp, Homo sapiens
ggaagctgtgctctcaggcctc

SEQ ID NO: 8538381 - DNA, 22 bp, Homo sapiens
ggaagctggtaattgttgggac

SEQ ID NO: 8538382 - DNA, 22 bp, Homo sapiens
cacaaataccagtttcctaaca

SEQ ID NO: 8538383 - DNA, 22 bp, Homo sapiens
cacaaataccagtttcctaaca

SEQ ID NO: 8538384 - DNA, 22 bp, Homo sapiens
cacaaataccagtttcctaaca

SEQ ID NO: 8538385 - DNA, 22 bp, Homo sapiens
cacaaataccagtttcctaaca

SEQ ID NO: 8538386 - DNA, 22 bp, Homo sapiens
cacaaatgactgaaacgactgt

SEQ ID NO: 8538387 - DNA, 22 bp, Homo sapiens
cacaaatgactgaaacgactgt

SEQ ID NO: 8538388 - DNA, 22 bp, Homo sapiens
gctggcccagggtcacctagga

SEQ ID NO: 8538389 - DNA, 20 bp, Homo sapiens
gctggctgaactgaaagcaa

SEQ ID NO: 8538390 - DNA, 22 bp, Homo sapiens
gctggctgagcactggtttata

SEQ ID NO: 8538391 - DNA, 22 bp, Homo sapiens
gctggctgacagatttggggtg

SEQ ID NO: 8538392 - DNA, 22 bp, Homo sapiens
gctggctgaggtctagctcttt

SEQ ID NO: 8538393 - DNA, 22 bp, Homo sapiens
gctggctgagttctgtcgtctg

SEQ ID NO: 8538394 - DNA, 22 bp, Homo sapiens
gctggctgagttctgtcgtctg

SEQ ID NO: 8538395 - DNA, 22 bp, Homo sapiens
gctggctgaggtctagctcttt

SEQ ID NO: 8538396 - DNA, 22 bp, Homo sapiens
caagcccactgctcagagccaa

SEQ ID NO: 8538397 - DNA, 22 bp, Homo sapiens
caagcccaggattccccagtta

SEQ ID NO: 8538398 - DNA, 22 bp, Homo sapiens
caagcccaggattccccagtta

SEQ ID NO: 8538399 - DNA, 20 bp, Homo sapiens
caagccctctttagcctgcc

SEQ ID NO: 8538400 - DNA, 22 bp, Homo sapiens
gctgggcttgtggccagctggg

SEQ ID NO: 8538401 - DNA, 22 bp, Homo sapiens
gctgggcttgtggccagctggg

SEQ ID NO: 8538402 - DNA, 19 bp, Homo sapiens
gctggggaatggatattga

SEQ ID NO: 8538403 - DNA, 22 bp, Homo sapiens
gctggggagaattgggttatct

SEQ ID NO: 8538404 - DNA, 22 bp, Homo sapiens
gctggggactccccaccatagc

SEQ ID NO: 8538405 - DNA, 22 bp, Homo sapiens
gctggggagcaagagtagtgag

SEQ ID NO: 8538406 - DNA, 22 bp, Homo sapiens
gctggggagcaagagtagtgag

SEQ ID NO: 8538407 - DNA, 22 bp, Homo sapiens
gctgggcttgtggccagctggg

SEQ ID NO: 8538408 - DNA, 22 bp, Homo sapiens
gctgggcttggtttccctgctt

SEQ ID NO: 8538409 - DNA, 22 bp, Homo sapiens
gctgggctcaccaggccactag

SEQ ID NO: 8538410 - DNA, 22 bp, Homo sapiens
gctgggctcagacctagtgaac

SEQ ID NO: 8538411 - DNA, 22 bp, Homo sapiens
caagcctgtctcaccagtgcta

SEQ ID NO: 8538412 - DNA, 22 bp, Homo sapiens
caagctctgcgggctccaagat

SEQ ID NO: 8538413 - DNA, 22 bp, Homo sapiens
caagctccttacatccacaggg

SEQ ID NO: 8538414 - DNA, 22 bp, Homo sapiens
caagctccttacatccacaggg

SEQ ID NO: 8538415 - DNA, 22 bp, Homo sapiens
caagctacttagaaagcacagt

SEQ ID NO: 8538416 - DNA, 22 bp, Homo sapiens
gctgcctgccctgggtcatctg

SEQ ID NO: 8538417 - DNA, 22 bp, Homo sapiens
gctgcctgcctagttccacagt

SEQ ID NO: 8538418 - DNA, 22 bp, Homo sapiens
gctgcctgcctagttccacagt

SEQ ID NO: 8538419 - DNA, 22 bp, Homo sapiens
gctgcctgcctagttccacagt

SEQ ID NO: 8538420 - DNA, 22 bp, Homo sapiens
gctgcctgcctagttccacagt

SEQ ID NO: 8538421 - DNA, 22 bp, Homo sapiens
gctgcctgcctgcatttaatcc

SEQ ID NO: 8538422 - DNA, 22 bp, Homo sapiens
gctgctggccccacatgctcca

SEQ ID NO: 8538423 - DNA, 22 bp, Homo sapiens
gctgcctgccctgggtcatctg

SEQ ID NO: 8538424 - DNA, 21 bp, Homo sapiens
gctgcctgcccctcgggggct

SEQ ID NO: 8538425 - DNA, 18 bp, Homo sapiens
gctgcctgcattcctcac

SEQ ID NO: 8538426 - DNA, 18 bp, Homo sapiens
gctgcctgcattcctcac

SEQ ID NO: 8538427 - DNA, 18 bp, Homo sapiens
gctgcctgcattcctcac

SEQ ID NO: 8538428 - DNA, 22 bp, Homo sapiens
gctgcctgcagtgttttcccag

SEQ ID NO: 8538429 - DNA, 18 bp, Homo sapiens
gctgcctgcattcctcac

SEQ ID NO: 8538430 - DNA, 22 bp, Homo sapiens
gctgcctgcacagagctgcttt

SEQ ID NO: 8538431 - DNA, 22 bp, Homo sapiens
gctgcctgcacagagctgcttt

SEQ ID NO: 8538432 - DNA, 22 bp, Homo sapiens
gctgcctgcacagagctgcttt

SEQ ID NO: 8538433 - DNA, 22 bp, Homo sapiens
gctggaaggctaggctcagttg

SEQ ID NO: 8538434 - DNA, 22 bp, Homo sapiens
gctggaaggctaggctcagttg

SEQ ID NO: 8538435 - DNA, 22 bp, Homo sapiens
gctggaagggaggcccagccgg

SEQ ID NO: 8538436 - DNA, 22 bp, Homo sapiens
gctggaagaatgagtgcctcgt

SEQ ID NO: 8538437 - DNA, 22 bp, Homo sapiens
gctggaaatcatattttgttgt

SEQ ID NO: 8538438 - DNA, 22 bp, Homo sapiens
gctggaaaaggaggcaaaatat

SEQ ID NO: 8538439 - DNA, 22 bp, Homo sapiens
gctgctttttggatttggcaca

SEQ ID NO: 8538440 - DNA, 22 bp, Homo sapiens
gctgctttctgttaggaattgg

SEQ ID NO: 8538441 - DNA, 22 bp, Homo sapiens
gctgctttgacagtgggaacag

SEQ ID NO: 8538442 - DNA, 22 bp, Homo sapiens
gctgctttgacagtgggaacag

SEQ ID NO: 8538443 - DNA, 22 bp, Homo sapiens
gctgctttgtctgtaaaatgga

SEQ ID NO: 8538444 - DNA, 22 bp, Homo sapiens
caagaatataaatactttcaaa

SEQ ID NO: 8538445 - DNA, 19 bp, Homo sapiens
caagacaaagcccatcttc

SEQ ID NO: 8538446 - DNA, 22 bp, Homo sapiens
caagaattaagaattttgatgt

SEQ ID NO: 8538447 - DNA, 22 bp, Homo sapiens
caagaattgtacaaactgggtg

SEQ ID NO: 8538448 - DNA, 19 bp, Homo sapiens
caagacaaagcccatcttc

SEQ ID NO: 8538449 - DNA, 22 bp, Homo sapiens
caagaattaagaattttgatgt

SEQ ID NO: 8538450 - DNA, 22 bp, Homo sapiens
gctggacccggcccctcacctc

SEQ ID NO: 8538451 - DNA, 22 bp, Homo sapiens
gctggactcaggggactcaggg

SEQ ID NO: 8538452 - DNA, 22 bp, Homo sapiens
gctggaccaggtgtgcacaggc

SEQ ID NO: 8538453 - DNA, 22 bp, Homo sapiens
gctggacaggccacatggagga

SEQ ID NO: 8538454 - DNA, 20 bp, Homo sapiens
gctggaagggctagagggct

SEQ ID NO: 8538455 - DNA, 22 bp, Homo sapiens
gctggaattggacccagggctc

SEQ ID NO: 8538456 - DNA, 22 bp, Homo sapiens
caagaaggctatatgggccagg

SEQ ID NO: 8538457 - DNA, 22 bp, Homo sapiens
caaagtgctaggattacaggcc

SEQ ID NO: 8538458 - DNA, 22 bp, Homo sapiens
caaagtgctaggattacaggcg

SEQ ID NO: 8538459 - DNA, 22 bp, Homo sapiens
caaagtgctaggattacaggcg

SEQ ID NO: 8538460 - DNA, 22 bp, Homo sapiens
caaagtgctaggattacaggcc

SEQ ID NO: 8538461 - DNA, 22 bp, Homo sapiens
caaagtgctaggattacaggcc

SEQ ID NO: 8538462 - DNA, 22 bp, Homo sapiens
caaagtgcctgtaccactttgc

SEQ ID NO: 8538463 - DNA, 22 bp, Homo sapiens
caaagtgagagaatggcagaaa

SEQ ID NO: 8538464 - DNA, 22 bp, Homo sapiens
caaagtgagagaatggcagaaa

SEQ ID NO: 8538465 - DNA, 22 bp, Homo sapiens
caaagtgcagaaggaactgggt

SEQ ID NO: 8538466 - DNA, 22 bp, Homo sapiens
gctgccctcccagggcaagctt

SEQ ID NO: 8538467 - DNA, 22 bp, Homo sapiens
gctgccacgatctctgctgtag

SEQ ID NO: 8538468 - DNA, 17 bp, Homo sapiens
gctgccacctttggagc

SEQ ID NO: 8538469 - DNA, 22 bp, Homo sapiens
caaagtgctaggattacaggcg

SEQ ID NO: 8538470 - DNA, 22 bp, Homo sapiens
caaagtgctaggattataggtg

SEQ ID NO: 8538471 - DNA, 22 bp, Homo sapiens
gctgccctgactccagcagcct

SEQ ID NO: 8538472 - DNA, 22 bp, Homo sapiens
gctgccctgactccagcagcct

SEQ ID NO: 8538473 - DNA, 22 bp, Homo sapiens
gctgccctgcctcagactcctc

SEQ ID NO: 8538474 - DNA, 22 bp, Homo sapiens
gctgccctgcctcagactcctc

SEQ ID NO: 8538475 - DNA, 22 bp, Homo sapiens
gctgccctctgtgacccggccc

SEQ ID NO: 8538476 - DNA, 22 bp, Homo sapiens
gctgccctgacaagctactccc

SEQ ID NO: 8538477 - DNA, 22 bp, Homo sapiens
gctgccctgacaagctactccc

SEQ ID NO: 8538478 - DNA, 22 bp, Homo sapiens
gctctggaagcatctgagagga

SEQ ID NO: 8538479 - DNA, 22 bp, Homo sapiens
gctctggaagcatctgagagga

SEQ ID NO: 8538480 - DNA, 22 bp, Homo sapiens
gctctgcttgcatcatgactgc

SEQ ID NO: 8538481 - DNA, 22 bp, Homo sapiens
gctctgcttgcatcatgactgc

SEQ ID NO: 8538482 - DNA, 22 bp, Homo sapiens
gctctggagatggagccttgag

SEQ ID NO: 8538483 - DNA, 22 bp, Homo sapiens
gctctggagagccataggccct

SEQ ID NO: 8538484 - DNA, 22 bp, Homo sapiens
gctctggactggggcctgagaa

SEQ ID NO: 8538485 - DNA, 22 bp, Homo sapiens
caaagtcagggaagagtggctg

SEQ ID NO: 8538486 - DNA, 22 bp, Homo sapiens
caaagtcataaaacttgtaagt

SEQ ID NO: 8538487 - DNA, 22 bp, Homo sapiens
caaagtcatggggatgcaggtc

SEQ ID NO: 8538488 - DNA, 22 bp, Homo sapiens
caaagtcctagaacagtgcttg

SEQ ID NO: 8538489 - DNA, 22 bp, Homo sapiens
caaagtcctagaacagtgcttg

SEQ ID NO: 8538490 - DNA, 22 bp, Homo sapiens
caaagtcccagctgcttagaga

SEQ ID NO: 8538491 - DNA, 22 bp, Homo sapiens
caaagtccatagtttacaatag

SEQ ID NO: 8538492 - DNA, 22 bp, Homo sapiens
caaagtcctagaacagtgcttg

SEQ ID NO: 8538493 - DNA, 17 bp, Homo sapiens
gctctggcacaggattg

SEQ ID NO: 8538494 - DNA, 22 bp, Homo sapiens
gctctggatccggctgggtctg

SEQ ID NO: 8538495 - DNA, 17 bp, Homo sapiens
gctctggcacaggattg

SEQ ID NO: 8538496 - DNA, 22 bp, Homo sapiens
caaagtcagctgccagtcccaa

SEQ ID NO: 8538497 - DNA, 23 bp, Homo sapiens
gctctggagctgggcctggcagg

SEQ ID NO: 8538498 - DNA, 22 bp, Homo sapiens
caagaaatttcttaagaactaa

SEQ ID NO: 8538499 - DNA, 22 bp, Homo sapiens
caagaacagtttgccaaattgg

SEQ ID NO: 8538500 - DNA, 22 bp, Homo sapiens
caagaacattgtgatcacttca

SEQ ID NO: 8538501 - DNA, 22 bp, Homo sapiens
gctgcctgatttacatagtgaa

SEQ ID NO: 8538502 - DNA, 22 bp, Homo sapiens
gctgcctgatgtccagcaggac

SEQ ID NO: 8538503 - DNA, 22 bp, Homo sapiens
gctgcctgatgtccagcaggac

SEQ ID NO: 8538504 - DNA, 22 bp, Homo sapiens
gctgcctgatgtccagcaggac

SEQ ID NO: 8538505 - DNA, 17 bp, Homo sapiens
gctgcctgcaactgact

SEQ ID NO: 8538506 - DNA, 22 bp, Homo sapiens
gctgcctgatttacatagtgaa

SEQ ID NO: 8538507 - DNA, 22 bp, Homo sapiens
gctgcctgcacagagctgcttt

SEQ ID NO: 8538508 - DNA, 22 bp, Homo sapiens
caagaaactttattctgccata

SEQ ID NO: 8538509 - DNA, 22 bp, Homo sapiens
caagaaatgggatttgactgcc

SEQ ID NO: 8538510 - DNA, 22 bp, Homo sapiens
caagaaatgggatttgactgcc

SEQ ID NO: 8538511 - DNA, 22 bp, Homo sapiens
caagaaatgtttactgagcatc

SEQ ID NO: 8538512 - DNA, 22 bp, Homo sapiens
caacttttgacacgtgtgctaa

SEQ ID NO: 8538513 - DNA, 22 bp, Homo sapiens
caacttttctgtgaatttaagt

SEQ ID NO: 8538514 - DNA, 22 bp, Homo sapiens
caacttttctgtgaatttaagt

SEQ ID NO: 8538515 - DNA, 23 bp, Homo sapiens
caacttttggctacatgcttagc

SEQ ID NO: 8538516 - DNA, 22 bp, Homo sapiens
caagaaacaccaatgactgctg

SEQ ID NO: 8538517 - DNA, 22 bp, Homo sapiens
caacttttctgtgaatttaagt

SEQ ID NO: 8538518 - DNA, 22 bp, Homo sapiens
gctgccctgtccggctctcctg

SEQ ID NO: 8538519 - DNA, 22 bp, Homo sapiens
gctgccctgtctgcagcaggac

SEQ ID NO: 8538520 - DNA, 22 bp, Homo sapiens
caaattttgtgtgttctctagt

SEQ ID NO: 8538521 - DNA, 22 bp, Homo sapiens
caaatttaggtaacagtctgta

SEQ ID NO: 8538522 - DNA, 22 bp, Homo sapiens
gctgccctgtctgcagcaggac

SEQ ID NO: 8538523 - DNA, 22 bp, Homo sapiens
gctgccctgtctgcagcaggac

SEQ ID NO: 8538524 - DNA, 22 bp, Homo sapiens
caaattttgtgtgttctctagt

SEQ ID NO: 8538525 - DNA, 22 bp, Homo sapiens
caaattttgtgtgttctctagt

SEQ ID NO: 8538526 - DNA, 22 bp, Homo sapiens
caacaatatgctgagtttttca

SEQ ID NO: 8538527 - DNA, 22 bp, Homo sapiens
caacaatatgccagactcaatt

SEQ ID NO: 8538528 - DNA, 22 bp, Homo sapiens
caacacattgaagctatgatga

SEQ ID NO: 8538529 - DNA, 22 bp, Homo sapiens
caacacaggttctgcaaaggaa

SEQ ID NO: 8538530 - DNA, 22 bp, Homo sapiens
caacacaggttctgcaaaggaa

SEQ ID NO: 8538531 - DNA, 22 bp, Homo sapiens
caacacaggggttatgccatgg

SEQ ID NO: 8538532 - DNA, 22 bp, Homo sapiens
caacacaggggttatgccatgg

SEQ ID NO: 8538533 - DNA, 22 bp, Homo sapiens
caacacagccattcccctagaa

SEQ ID NO: 8538534 - DNA, 22 bp, Homo sapiens
caacaccttgatcttggacttc

SEQ ID NO: 8538535 - DNA, 22 bp, Homo sapiens
caactacatccacactttgtta

SEQ ID NO: 8538536 - DNA, 22 bp, Homo sapiens
caactacatccacactttgtta

SEQ ID NO: 8538537 - DNA, 22 bp, Homo sapiens
caactttagaccccaagtagct

SEQ ID NO: 8538538 - DNA, 22 bp, Homo sapiens
caactatatagaaattgattgt

SEQ ID NO: 8538539 - DNA, 22 bp, Homo sapiens
cactgtacagcattaacaaggc

SEQ ID NO: 8538540 - DNA, 22 bp, Homo sapiens
cactgtaatggaattttcttta

SEQ ID NO: 8538541 - DNA, 22 bp, Homo sapiens
cactgtaatagcattataagtg

SEQ ID NO: 8538542 - DNA, 22 bp, Homo sapiens
cactgtacccatttaaataaat

SEQ ID NO: 8538543 - DNA, 22 bp, Homo sapiens
cactgtaagatgagctttttta

SEQ ID NO: 8538544 - DNA, 22 bp, Homo sapiens
cactgtaaagcgtcacagggac

SEQ ID NO: 8538545 - DNA, 22 bp, Homo sapiens
cactgggagtcgtaagacacgg

SEQ ID NO: 8538546 - DNA, 22 bp, Homo sapiens
cactgggcaattctgagcctaa

SEQ ID NO: 8538547 - DNA, 22 bp, Homo sapiens
cactggtgccagagaacagaat

SEQ ID NO: 8538548 - DNA, 22 bp, Homo sapiens
cactggtgtacaggaggtaaaa

SEQ ID NO: 8538549 - DNA, 22 bp, Homo sapiens
cactggtgccagagaacagaat

SEQ ID NO: 8538550 - DNA, 22 bp, Homo sapiens
cactggtgtctgagcagggtga

SEQ ID NO: 8538551 - DNA, 22 bp, Homo sapiens
cactgtactgtgaataaggagg

SEQ ID NO: 8538552 - DNA, 22 bp, Homo sapiens
cactgtactgtgaataaggagg

SEQ ID NO: 8538553 - DNA, 22 bp, Homo sapiens
cactgtactgggttgaaggacg

SEQ ID NO: 8538554 - DNA, 21 bp, Homo sapiens
cactgtatagcaggagaaaac

SEQ ID NO: 8538555 - DNA, 22 bp, Homo sapiens
cactgtactgtgaataaggagg

SEQ ID NO: 8538556 - DNA, 22 bp, Homo sapiens
cactgtactgtgaataaggagg

SEQ ID NO: 8538557 - DNA, 22 bp, Homo sapiens
ggctctgctggattgaggccag

SEQ ID NO: 8538558 - DNA, 22 bp, Homo sapiens
cactgtcacgttctgaaactgt

SEQ ID NO: 8538559 - DNA, 22 bp, Homo sapiens
cactgtccaatagatacataat

SEQ ID NO: 8538560 - DNA, 22 bp, Homo sapiens
cactgtattattaggaatgaca

SEQ ID NO: 8538561 - DNA, 22 bp, Homo sapiens
cactgtatcttttccaaagtct

SEQ ID NO: 8538562 - DNA, 22 bp, Homo sapiens
cactgtcacgttctgaaactgt

SEQ ID NO: 8538563 - DNA, 22 bp, Homo sapiens
ggctctgctggtaagatgcctc

SEQ ID NO: 8538564 - DNA, 22 bp, Homo sapiens
ggctctgcttcagaaggctcat

SEQ ID NO: 8538565 - DNA, 22 bp, Homo sapiens
ggctctgcttctcacctgttcc

SEQ ID NO: 8538566 - DNA, 22 bp, Homo sapiens
cactgcactccagcctgggtca

SEQ ID NO: 8538567 - DNA, 22 bp, Homo sapiens
cactgcactccagcctgggtca

SEQ ID NO: 8538568 - DNA, 22 bp, Homo sapiens
cactgcactccagcctgggtca

SEQ ID NO: 8538569 - DNA, 22 bp, Homo sapiens
cactgcactccagcctgggtca

SEQ ID NO: 8538570 - DNA, 22 bp, Homo sapiens
cactgcactccagcctgggtca

SEQ ID NO: 8538571 - DNA, 22 bp, Homo sapiens
cactgcactccagcctgggtca

SEQ ID NO: 8538572 - DNA, 22 bp, Homo sapiens
cactgcactccagcctgggtca

SEQ ID NO: 8538573 - DNA, 22 bp, Homo sapiens
cactgcactccagcctgggtca

SEQ ID NO: 8538574 - DNA, 22 bp, Homo sapiens
cactgcactccagcctgggtga

SEQ ID NO: 8538575 - DNA, 22 bp, Homo sapiens
cactgcactccagcctgggtga

SEQ ID NO: 8538576 - DNA, 22 bp, Homo sapiens
cactgcactccagcctgggtga

SEQ ID NO: 8538577 - DNA, 22 bp, Homo sapiens
cactgcactccagcctgggtga

SEQ ID NO: 8538578 - DNA, 22 bp, Homo sapiens
cactgcactccagcctgggtga

SEQ ID NO: 8538579 - DNA, 22 bp, Homo sapiens
cactgcactccagcctgggtga

SEQ ID NO: 8538580 - DNA, 22 bp, Homo sapiens
cactgcactccagcctgggtga

SEQ ID NO: 8538581 - DNA, 22 bp, Homo sapiens
cactgcactccagcctgggtga

SEQ ID NO: 8538582 - DNA, 22 bp, Homo sapiens
cactgcactccagcttgggtga

SEQ ID NO: 8538583 - DNA, 22 bp, Homo sapiens
cactgcactccagcttgggtga

SEQ ID NO: 8538584 - DNA, 22 bp, Homo sapiens
cactgcactccagcttgggtga

SEQ ID NO: 8538585 - DNA, 22 bp, Homo sapiens
cactgcactccagcttgggtga

SEQ ID NO: 8538586 - DNA, 22 bp, Homo sapiens
cactgcactccagcttgggcaa

SEQ ID NO: 8538587 - DNA, 22 bp, Homo sapiens
cacttggaggccccctgtgccc

SEQ ID NO: 8538588 - DNA, 17 bp, Homo sapiens
cacttgctggtctacct

SEQ ID NO: 8538589 - DNA, 22 bp, Homo sapiens
cacttggaggaaggcctattca

SEQ ID NO: 8538590 - DNA, 22 bp, Homo sapiens
cacttgcagactttgcctggtt

SEQ ID NO: 8538591 - DNA, 22 bp, Homo sapiens
cacttgatggaagagcagaaga

SEQ ID NO: 8538592 - DNA, 22 bp, Homo sapiens
cacttgctggatggtggctcag

SEQ ID NO: 8538593 - DNA, 22 bp, Homo sapiens
cacttgaatgaaagagactcct

SEQ ID NO: 8538594 - DNA, 22 bp, Homo sapiens
cacttgaatgagaatttcctgg

SEQ ID NO: 8538595 - DNA, 22 bp, Homo sapiens
cacttgaatggcattgttcctt

SEQ ID NO: 8538596 - DNA, 21 bp, Homo sapiens
cacttgaatggtgttttacaa

SEQ ID NO: 8538597 - DNA, 21 bp, Homo sapiens
cacttgaatggtgttttacaa

SEQ ID NO: 8538598 - DNA, 22 bp, Homo sapiens
cacttgaaaatcagaggaaatt

SEQ ID NO: 8538599 - DNA, 22 bp, Homo sapiens
cacttgaaagtaatggttgtgc

SEQ ID NO: 8538600 - DNA, 22 bp, Homo sapiens
cacttctgttgccttgtgcaat

SEQ ID NO: 8538601 - DNA, 22 bp, Homo sapiens
cacttgaacccgggaggctgag

SEQ ID NO: 8538602 - DNA, 22 bp, Homo sapiens
cacttgaacccgggaggctgag

SEQ ID NO: 8538603 - DNA, 22 bp, Homo sapiens
cacttgaacccgggaggctgag

SEQ ID NO: 8538604 - DNA, 22 bp, Homo sapiens
cacttgaaatattaggggtgat

SEQ ID NO: 8538605 - DNA, 22 bp, Homo sapiens
cacttgaaaatcagaggaaatt

SEQ ID NO: 8538606 - DNA, 22 bp, Homo sapiens
cacttgaagtgaattgctcacc

SEQ ID NO: 8538607 - DNA, 22 bp, Homo sapiens
cacttgaagtttgggggactct

SEQ ID NO: 8538608 - DNA, 22 bp, Homo sapiens
cacttgaactgtttgaatgaga

SEQ ID NO: 8538609 - DNA, 22 bp, Homo sapiens
cacttgggagcattgcacatgt

SEQ ID NO: 8538610 - DNA, 22 bp, Homo sapiens
cacttgttggtggtgaaatcac

SEQ ID NO: 8538611 - DNA, 17 bp, Homo sapiens
ggctgctgtgctggtgc

SEQ ID NO: 8538612 - DNA, 17 bp, Homo sapiens
ggctgctgtgctggtgc

SEQ ID NO: 8538613 - DNA, 22 bp, Homo sapiens
ggctctggaaagtgtccttgat

SEQ ID NO: 8538614 - DNA, 22 bp, Homo sapiens
ggctctggaaagtgtccttgat

SEQ ID NO: 8538615 - DNA, 22 bp, Homo sapiens
ggctctggaaagtgtccttgat

SEQ ID NO: 8538616 - DNA, 20 bp, Homo sapiens
ggctctgcttgtgagcagcc

SEQ ID NO: 8538617 - DNA, 20 bp, Homo sapiens
ggctctggaatctggtgggc

SEQ ID NO: 8538618 - DNA, 20 bp, Homo sapiens
ggctctggaatctggtgggc

SEQ ID NO: 8538619 - DNA, 22 bp, Homo sapiens
cactgtggatacagaaattagt

SEQ ID NO: 8538620 - DNA, 22 bp, Homo sapiens
cacttaaagtcttagcttacag

SEQ ID NO: 8538621 - DNA, 22 bp, Homo sapiens
cacttaaatctgttgagaaaaa

SEQ ID NO: 8538622 - DNA, 22 bp, Homo sapiens
cacttaaatgttcctacagcag

SEQ ID NO: 8538623 - DNA, 22 bp, Homo sapiens
cacttacacttctgaaagccta

SEQ ID NO: 8538624 - DNA, 22 bp, Homo sapiens
cacttaagcagttaatttatct

SEQ ID NO: 8538625 - DNA, 22 bp, Homo sapiens
cacttcaaggaatatctagaaa

SEQ ID NO: 8538626 - DNA, 19 bp, Homo sapiens
cacttcacatggtgaaagc

SEQ ID NO: 8538627 - DNA, 22 bp, Homo sapiens
cacttcattgggaccagggctg

SEQ ID NO: 8538628 - DNA, 22 bp, Homo sapiens
cacttcaggttctggcagggcg

SEQ ID NO: 8538629 - DNA, 22 bp, Homo sapiens
cacttcacttggatgccttttc

SEQ ID NO: 8538630 - DNA, 22 bp, Homo sapiens
cacttcaccactaggctatact

SEQ ID NO: 8538631 - DNA, 22 bp, Homo sapiens
caccctgtacaaatggacatct

SEQ ID NO: 8538632 - DNA, 22 bp, Homo sapiens
caccctgtacaaatggacatct

SEQ ID NO: 8538633 - DNA, 22 bp, Homo sapiens
cacctgcccagcacctgggatc

SEQ ID NO: 8538634 - DNA, 22 bp, Homo sapiens
caccctgggctgggcctgttaa

SEQ ID NO: 8538635 - DNA, 22 bp, Homo sapiens
caccctgggctgggcctgttaa

SEQ ID NO: 8538636 - DNA, 22 bp, Homo sapiens
caccaggctggagtgcagaggt

SEQ ID NO: 8538637 - DNA, 22 bp, Homo sapiens
caccaggctggagtgcagaggt

SEQ ID NO: 8538638 - DNA, 22 bp, Homo sapiens
caccaggctggagtgcagaggt

SEQ ID NO: 8538639 - DNA, 22 bp, Homo sapiens
cacctgcctgcaggggctccac

SEQ ID NO: 8538640 - DNA, 22 bp, Homo sapiens
cacctgcctgcaggggctccac

SEQ ID NO: 8538641 - DNA, 22 bp, Homo sapiens
cacctgcctgcaggggctccac

SEQ ID NO: 8538642 - DNA, 22 bp, Homo sapiens
cacctgcctgcaggggctccac

SEQ ID NO: 8538643 - DNA, 22 bp, Homo sapiens
caccaggctgcccaggacaggg

SEQ ID NO: 8538644 - DNA, 22 bp, Homo sapiens
caccaggctgcccaggacaggg

SEQ ID NO: 8538645 - DNA, 22 bp, Homo sapiens
caccaggctgaaccagagggga

SEQ ID NO: 8538646 - DNA, 20 bp, Homo sapiens
caccaggcgctctgagaaca

SEQ ID NO: 8538647 - DNA, 22 bp, Homo sapiens
caccaggatgggcaggtaggtc

SEQ ID NO: 8538648 - DNA, 22 bp, Homo sapiens
caccaggatgggcaggtaggtc

SEQ ID NO: 8538649 - DNA, 22 bp, Homo sapiens
ggccagggaggagaggcccctg

SEQ ID NO: 8538650 - DNA, 22 bp, Homo sapiens
ggccaggctggtctcagacttc

SEQ ID NO: 8538651 - DNA, 22 bp, Homo sapiens
cacctggagtagcaaggtaatt

SEQ ID NO: 8538652 - DNA, 20 bp, Homo sapiens
cacctggatatgacccagct

SEQ ID NO: 8538653 - DNA, 20 bp, Homo sapiens
cacctggatatgacccagct

SEQ ID NO: 8538654 - DNA, 22 bp, Homo sapiens
cacctggatgccacaaagccac

SEQ ID NO: 8538655 - DNA, 22 bp, Homo sapiens
cacctggatatgtttcagcttg

SEQ ID NO: 8538656 - DNA, 22 bp, Homo sapiens
cacctggcccagctccagtgct

SEQ ID NO: 8538657 - DNA, 22 bp, Homo sapiens
cacctggcccagctccagtgct

SEQ ID NO: 8538658 - DNA, 22 bp, Homo sapiens
cacctggcagctgttggccacg

SEQ ID NO: 8538659 - DNA, 22 bp, Homo sapiens
cacctgctccctcagttccagc

SEQ ID NO: 8538660 - DNA, 22 bp, Homo sapiens
cacctggagtagcaaggtaatt

SEQ ID NO: 8538661 - DNA, 22 bp, Homo sapiens
cacctggaccctgggaggaggg

SEQ ID NO: 8538662 - DNA, 22 bp, Homo sapiens
cacctggaccctgggaggaggg

SEQ ID NO: 8538663 - DNA, 22 bp, Homo sapiens
cacctgcctggtccttagggct

SEQ ID NO: 8538664 - DNA, 22 bp, Homo sapiens
cacctgggctaaactatgcagg

SEQ ID NO: 8538665 - DNA, 20 bp, Homo sapiens
cacctggctgactgtctcca

SEQ ID NO: 8538666 - DNA, 20 bp, Homo sapiens
cacctggctgactgtctcca

SEQ ID NO: 8538667 - DNA, 22 bp, Homo sapiens
cacctggctggaagtgctccgg

SEQ ID NO: 8538668 - DNA, 22 bp, Homo sapiens
ggccagggaggagaggcccctg

SEQ ID NO: 8538669 - DNA, 22 bp, Homo sapiens
cactagtcctggtttcatgcta

SEQ ID NO: 8538670 - DNA, 22 bp, Homo sapiens
cactataatcctgttttagaac

SEQ ID NO: 8538671 - DNA, 22 bp, Homo sapiens
cactagtggccccatgtggttg

SEQ ID NO: 8538672 - DNA, 22 bp, Homo sapiens
cactatatctgttcttgtttat

SEQ ID NO: 8538673 - DNA, 21 bp, Homo sapiens
cactatttatatatgccagct

SEQ ID NO: 8538674 - DNA, 22 bp, Homo sapiens
cactatttcctggattttgacg

SEQ ID NO: 8538675 - DNA, 21 bp, Homo sapiens
cactatttatatatgccagct

SEQ ID NO: 8538676 - DNA, 21 bp, Homo sapiens
cactcagggtatgtgccaggc

SEQ ID NO: 8538677 - DNA, 21 bp, Homo sapiens
cactccacttagaacagggtt

SEQ ID NO: 8538678 - DNA, 21 bp, Homo sapiens
cactccacttagaacagggtt

SEQ ID NO: 8538679 - DNA, 22 bp, Homo sapiens
cactattttctcttcagatggc

SEQ ID NO: 8538680 - DNA, 22 bp, Homo sapiens
cactcaggctgtgtcaggagga

SEQ ID NO: 8538681 - DNA, 22 bp, Homo sapiens
cactccctctagttgcattctg

SEQ ID NO: 8538682 - DNA, 22 bp, Homo sapiens
cactccctctagttgcattctg

SEQ ID NO: 8538683 - DNA, 22 bp, Homo sapiens
cactccctctagttgcattctg

SEQ ID NO: 8538684 - DNA, 22 bp, Homo sapiens
cactcctataattaaagatgca

SEQ ID NO: 8538685 - DNA, 22 bp, Homo sapiens
cactcccttcaggagcctagga

SEQ ID NO: 8538686 - DNA, 22 bp, Homo sapiens
cactccagcctcagtgacagag

SEQ ID NO: 8538687 - DNA, 22 bp, Homo sapiens
cactccagcctcagtgacagag

SEQ ID NO: 8538688 - DNA, 22 bp, Homo sapiens
cactccaggtcccagttcctgg

SEQ ID NO: 8538689 - DNA, 22 bp, Homo sapiens
cactcccttcaggagcctagga

SEQ ID NO: 8538690 - DNA, 22 bp, Homo sapiens
cactcccttcaggagcctagga

SEQ ID NO: 8538691 - DNA, 22 bp, Homo sapiens
cactcctgttccactaaatgag

SEQ ID NO: 8538692 - DNA, 23 bp, Homo sapiens
cactcctgtttctaagccagcat

SEQ ID NO: 8538693 - DNA, 22 bp, Homo sapiens
cactctcacatgccctgtcagt

SEQ ID NO: 8538694 - DNA, 22 bp, Homo sapiens
cactctaagaacacaaaggccc

SEQ ID NO: 8538695 - DNA, 22 bp, Homo sapiens
cactctcagcataatgaatgtg

SEQ ID NO: 8538696 - DNA, 22 bp, Homo sapiens
cactctccagcacaccccattt

SEQ ID NO: 8538697 - DNA, 22 bp, Homo sapiens
cactgcactccagcctgggaga

SEQ ID NO: 8538698 - DNA, 22 bp, Homo sapiens
cactgcactccagcctgggaga

SEQ ID NO: 8538699 - DNA, 22 bp, Homo sapiens
cactgcactccagcctgggaga

SEQ ID NO: 8538700 - DNA, 22 bp, Homo sapiens
cactgcactccagcctgggaga

SEQ ID NO: 8538701 - DNA, 22 bp, Homo sapiens
cactgcactccagcctgggaga

SEQ ID NO: 8538702 - DNA, 22 bp, Homo sapiens
cactgcactccagcctgggaga

SEQ ID NO: 8538703 - DNA, 22 bp, Homo sapiens
cactgcactccagcctgggaga

SEQ ID NO: 8538704 - DNA, 22 bp, Homo sapiens
cactgcactccagcctgcgcaa

SEQ ID NO: 8538705 - DNA, 22 bp, Homo sapiens
cactgcaacctccacctcctgg

SEQ ID NO: 8538706 - DNA, 22 bp, Homo sapiens
cactgcaacctccacctcctgg

SEQ ID NO: 8538707 - DNA, 22 bp, Homo sapiens
cactgcaacctccacctcctgg

SEQ ID NO: 8538708 - DNA, 22 bp, Homo sapiens
cactgcactccagcctgggaga

SEQ ID NO: 8538709 - DNA, 22 bp, Homo sapiens
cactctgacacatgaacttgat

SEQ ID NO: 8538710 - DNA, 22 bp, Homo sapiens
cactctgactggccctgcagga

SEQ ID NO: 8538711 - DNA, 22 bp, Homo sapiens
cactgcaacctccacctcctgg

SEQ ID NO: 8538712 - DNA, 22 bp, Homo sapiens
ggcagaggtgacagtgtctttt

SEQ ID NO: 8538713 - DNA, 22 bp, Homo sapiens
ggcagagtgctctgggcagggg

SEQ ID NO: 8538714 - DNA, 22 bp, Homo sapiens
ggcagagtcagaggtggttctg

SEQ ID NO: 8538715 - DNA, 22 bp, Homo sapiens
cacatgcaccagaaatcaacat

SEQ ID NO: 8538716 - DNA, 22 bp, Homo sapiens
ggcagaggtgacagtgtctttt

SEQ ID NO: 8538717 - DNA, 22 bp, Homo sapiens
cacatgcaggagccaatgtaca

SEQ ID NO: 8538718 - DNA, 22 bp, Homo sapiens
cacatgcaggagccaatgtaca

SEQ ID NO: 8538719 - DNA, 22 bp, Homo sapiens
cacatgatcacttcttgaaaat

SEQ ID NO: 8538720 - DNA, 22 bp, Homo sapiens
cacatgatcgtcatgtgaaagt

SEQ ID NO: 8538721 - DNA, 22 bp, Homo sapiens
cacatgagtgagaacatgcagt

SEQ ID NO: 8538722 - DNA, 22 bp, Homo sapiens
cacatgcaccagaaatcaacat

SEQ ID NO: 8538723 - DNA, 22 bp, Homo sapiens
cacatgcaccagaaatcaacat

SEQ ID NO: 8538724 - DNA, 22 bp, Homo sapiens
ggcagagtgctctgggcagggg

SEQ ID NO: 8538725 - DNA, 22 bp, Homo sapiens
ggcagagtggagtgcggcctcc

SEQ ID NO: 8538726 - DNA, 22 bp, Homo sapiens
ggcagagttggtggagtcagtt

SEQ ID NO: 8538727 - DNA, 20 bp, Homo sapiens
cacatgctgtgtgtttctct

SEQ ID NO: 8538728 - DNA, 22 bp, Homo sapiens
cacatgctccatacagaatggg

SEQ ID NO: 8538729 - DNA, 22 bp, Homo sapiens
cacatgctccatacagaatggg

SEQ ID NO: 8538730 - DNA, 18 bp, Homo sapiens
ggcagatgacaggagaga

SEQ ID NO: 8538731 - DNA, 18 bp, Homo sapiens
ggcagatgacaggagaga

SEQ ID NO: 8538732 - DNA, 22 bp, Homo sapiens
cacatgaattcacatgtatttt

SEQ ID NO: 8538733 - DNA, 22 bp, Homo sapiens
cacatgaattcacatgtatttt

SEQ ID NO: 8538734 - DNA, 22 bp, Homo sapiens
cacatgaagattcaactggatg

SEQ ID NO: 8538735 - DNA, 22 bp, Homo sapiens
cacatgaagattcaactggatg

SEQ ID NO: 8538736 - DNA, 22 bp, Homo sapiens
cacatgaaggctggggtcgtga

SEQ ID NO: 8538737 - DNA, 19 bp, Homo sapiens
cacatgagggctgagggac

SEQ ID NO: 8538738 - DNA, 22 bp, Homo sapiens
cacatgaggtggagatgaatga

SEQ ID NO: 8538739 - DNA, 19 bp, Homo sapiens
cacatgagggctgagggac

SEQ ID NO: 8538740 - DNA, 22 bp, Homo sapiens
cacatgagagcccccaagagca

SEQ ID NO: 8538741 - DNA, 22 bp, Homo sapiens
cacatgagacaattaaagactt

SEQ ID NO: 8538742 - DNA, 23 bp, Homo sapiens
cacatgacctgacctaggctagg

SEQ ID NO: 8538743 - DNA, 22 bp, Homo sapiens
ggcaatatggtgaaaccccatc

SEQ ID NO: 8538744 - DNA, 22 bp, Homo sapiens
cacatatatgggcccctgaggg

SEQ ID NO: 8538745 - DNA, 16 bp, Homo sapiens
cacatatatttatatg

SEQ ID NO: 8538746 - DNA, 22 bp, Homo sapiens
caccaggaccccacggtgggtt

SEQ ID NO: 8538747 - DNA, 22 bp, Homo sapiens
caccagcttgggctgtggaaat

SEQ ID NO: 8538748 - DNA, 22 bp, Homo sapiens
caccagctttgcccactgccca

SEQ ID NO: 8538749 - DNA, 22 bp, Homo sapiens
caccagctttgcccactgccca

SEQ ID NO: 8538750 - DNA, 22 bp, Homo sapiens
caccaggagccatcaggagtcc

SEQ ID NO: 8538751 - DNA, 22 bp, Homo sapiens
caccaggagcatctaggaggcg

SEQ ID NO: 8538752 - DNA, 22 bp, Homo sapiens
caccaggagcatctaggaggcg

SEQ ID NO: 8538753 - DNA, 22 bp, Homo sapiens
caccaggagccatcaggagtcc

SEQ ID NO: 8538754 - DNA, 22 bp, Homo sapiens
caccaggagccatcaggagtcc

SEQ ID NO: 8538755 - DNA, 22 bp, Homo sapiens
caccagcttacagtctcacccc

SEQ ID NO: 8538756 - DNA, 22 bp, Homo sapiens
caccagctgcaacaccatctcc

SEQ ID NO: 8538757 - DNA, 22 bp, Homo sapiens
caccagctctccaccaggtttc

SEQ ID NO: 8538758 - DNA, 22 bp, Homo sapiens
caccagctccaccagggcaggt

SEQ ID NO: 8538759 - DNA, 22 bp, Homo sapiens
caccagctctccaccaggtttc

SEQ ID NO: 8538760 - DNA, 22 bp, Homo sapiens
caccagctccaccagggcaggt

SEQ ID NO: 8538761 - DNA, 22 bp, Homo sapiens
caccagcttcccatcgcgggtc

SEQ ID NO: 8538762 - DNA, 22 bp, Homo sapiens
caccagcttacagtctcacccc

SEQ ID NO: 8538763 - DNA, 22 bp, Homo sapiens
caccagcttctcattgcgggtc

SEQ ID NO: 8538764 - DNA, 22 bp, Homo sapiens
caccagcttgggctgtggaaat

SEQ ID NO: 8538765 - DNA, 22 bp, Homo sapiens
caccagcttgcagtcttaaccc

SEQ ID NO: 8538766 - DNA, 22 bp, Homo sapiens
caccagcttgcagtcttaaccc

SEQ ID NO: 8538767 - DNA, 22 bp, Homo sapiens
cacattcatcagtgttgtactg

SEQ ID NO: 8538768 - DNA, 22 bp, Homo sapiens
cacattcatcagtgttgtactg

SEQ ID NO: 8538769 - DNA, 22 bp, Homo sapiens
cacattcatggagtttgcctgt

SEQ ID NO: 8538770 - DNA, 22 bp, Homo sapiens
cacattcatggagtttgcctgt

SEQ ID NO: 8538771 - DNA, 22 bp, Homo sapiens
cacattcctgagcttcgacctg

SEQ ID NO: 8538772 - DNA, 22 bp, Homo sapiens
cacattcaggtggcatgttaga

SEQ ID NO: 8538773 - DNA, 22 bp, Homo sapiens
cacattcaggtggcatgttaga

SEQ ID NO: 8538774 - DNA, 22 bp, Homo sapiens
caccagctactcgggtttcctg

SEQ ID NO: 8538775 - DNA, 22 bp, Homo sapiens
caccagctactccagggccgtg

SEQ ID NO: 8538776 - DNA, 22 bp, Homo sapiens
caccagctccaccagggcaggt

SEQ ID NO: 8538777 - DNA, 22 bp, Homo sapiens
caccactggaggtcttggcttt

SEQ ID NO: 8538778 - DNA, 22 bp, Homo sapiens
caccactggaggtcttggcttt

SEQ ID NO: 8538779 - DNA, 22 bp, Homo sapiens
cacattcctggtgctcagcagc

SEQ ID NO: 8538780 - DNA, 22 bp, Homo sapiens
cacatgtgcagttacatgaatt

SEQ ID NO: 8538781 - DNA, 22 bp, Homo sapiens
cacatgtgtatatgtgaggggg

SEQ ID NO: 8538782 - DNA, 22 bp, Homo sapiens
cacatgtgggaaatggtgctta

SEQ ID NO: 8538783 - DNA, 22 bp, Homo sapiens
cacatgtgcaaatactgaggct

SEQ ID NO: 8538784 - DNA, 22 bp, Homo sapiens
cacatgcttagatttcagtgga

SEQ ID NO: 8538785 - DNA, 22 bp, Homo sapiens
cacatgcttagatttcagtgga

SEQ ID NO: 8538786 - DNA, 21 bp, Homo sapiens
cacatgtgaattactgaactg

SEQ ID NO: 8538787 - DNA, 22 bp, Homo sapiens
cacatgttcttgaagccaactc

SEQ ID NO: 8538788 - DNA, 22 bp, Homo sapiens
cacatgtgtgctgaggactgtg

SEQ ID NO: 8538789 - DNA, 22 bp, Homo sapiens
cacattcagctcattaatggtc

SEQ ID NO: 8538790 - DNA, 22 bp, Homo sapiens
cacattcaggattttccatgtc

SEQ ID NO: 8538791 - DNA, 22 bp, Homo sapiens
cacattcacttctctgtccacc

SEQ ID NO: 8538792 - DNA, 22 bp, Homo sapiens
cacattattctaaagaggtact

SEQ ID NO: 8538793 - DNA, 22 bp, Homo sapiens
cacattcaattacacagatagg

SEQ ID NO: 8538794 - DNA, 22 bp, Homo sapiens
cacattcacatttttccctcta

SEQ ID NO: 8538795 - DNA, 22 bp, Homo sapiens
cacatgtttggcatgtcaccaa

SEQ ID NO: 8538796 - DNA, 22 bp, Homo sapiens
cacatgtttggcatgtcaccaa

SEQ ID NO: 8538797 - DNA, 22 bp, Homo sapiens
cacattaaaatcctaacttcca

SEQ ID NO: 8538798 - DNA, 20 bp, Homo sapiens
cacattaaggaaaacaactg

SEQ ID NO: 8538799 - DNA, 22 bp, Homo sapiens
cacattaagaataatgagacta

SEQ ID NO: 8538800 - DNA, 22 bp, Homo sapiens
cacaggcagccttgtagaagaa

SEQ ID NO: 8538801 - DNA, 22 bp, Homo sapiens
cacaggcagccttgtagaagaa

SEQ ID NO: 8538802 - DNA, 18 bp, Homo sapiens
cacaggcaggtgataggt

SEQ ID NO: 8538803 - DNA, 18 bp, Homo sapiens
cacaggcaggtgataggt

SEQ ID NO: 8538804 - DNA, 22 bp, Homo sapiens
cacaggcaggaggttctccagt

SEQ ID NO: 8538805 - DNA, 22 bp, Homo sapiens
cacaggcacgcctctggccagg

SEQ ID NO: 8538806 - DNA, 23 bp, Homo sapiens
cacaggcagaaatcaagacggta

SEQ ID NO: 8538807 - DNA, 23 bp, Homo sapiens
cacaggcagaaatcaagacggta

SEQ ID NO: 8538808 - DNA, 22 bp, Homo sapiens
cacaggcacgcctctggccagg

SEQ ID NO: 8538809 - DNA, 22 bp, Homo sapiens
ggagagcctgtgcagccgggtt

SEQ ID NO: 8538810 - DNA, 22 bp, Homo sapiens
ggagagctagtgcctgccagta

SEQ ID NO: 8538811 - DNA, 23 bp, Homo sapiens
ggagagctcctcgtgactcactg

SEQ ID NO: 8538812 - DNA, 22 bp, Homo sapiens
cacaggagattgatctattggt

SEQ ID NO: 8538813 - DNA, 22 bp, Homo sapiens
ggagagctgaagcatggacagg

SEQ ID NO: 8538814 - DNA, 22 bp, Homo sapiens
ggagagctgaagcatggacagg

SEQ ID NO: 8538815 - DNA, 22 bp, Homo sapiens
cacaggagtgctgctattgttg

SEQ ID NO: 8538816 - DNA, 22 bp, Homo sapiens
cacaggagttaacataattaag

SEQ ID NO: 8538817 - DNA, 22 bp, Homo sapiens
cacaggagtgctgctattgttg

SEQ ID NO: 8538818 - DNA, 22 bp, Homo sapiens
cacaggagtgctgctattgttg

SEQ ID NO: 8538819 - DNA, 22 bp, Homo sapiens
cacaggaggttaggaagtggtc

SEQ ID NO: 8538820 - DNA, 18 bp, Homo sapiens
cacaggagccacactcac

SEQ ID NO: 8538821 - DNA, 22 bp, Homo sapiens
cacaggaggttaggaagtggtc

SEQ ID NO: 8538822 - DNA, 22 bp, Homo sapiens
cacaggaggttaggaagtggtc

SEQ ID NO: 8538823 - DNA, 22 bp, Homo sapiens
cacagggttgttctgaggattc

SEQ ID NO: 8538824 - DNA, 22 bp, Homo sapiens
cacagggttgttctgaggattc

SEQ ID NO: 8538825 - DNA, 22 bp, Homo sapiens
cacaggggcaaactgtagggga

SEQ ID NO: 8538826 - DNA, 22 bp, Homo sapiens
cacaggggcaaactgtagggga

SEQ ID NO: 8538827 - DNA, 22 bp, Homo sapiens
cacaggggcaaactgtagggga

SEQ ID NO: 8538828 - DNA, 22 bp, Homo sapiens
cacaggggcaaactgtagggga

SEQ ID NO: 8538829 - DNA, 22 bp, Homo sapiens
cacagggctttgatggctgagt

SEQ ID NO: 8538830 - DNA, 22 bp, Homo sapiens
cacagggcaggtactctcagag

SEQ ID NO: 8538831 - DNA, 22 bp, Homo sapiens
cacagggctttgatggctgagt

SEQ ID NO: 8538832 - DNA, 22 bp, Homo sapiens
cacaggtatatgtgtatatact

SEQ ID NO: 8538833 - DNA, 22 bp, Homo sapiens
cacaggtccttcctgccctggg

SEQ ID NO: 8538834 - DNA, 22 bp, Homo sapiens
cacaggtgcaagaagttgcagt

SEQ ID NO: 8538835 - DNA, 22 bp, Homo sapiens
cacaggtgctcctcggggagct

SEQ ID NO: 8538836 - DNA, 20 bp, Homo sapiens
cacaggccccaagacctgta

SEQ ID NO: 8538837 - DNA, 22 bp, Homo sapiens
cacaggccagtaagactgtgtt

SEQ ID NO: 8538838 - DNA, 22 bp, Homo sapiens
cacaggccagtaagactgtgtt

SEQ ID NO: 8538839 - DNA, 22 bp, Homo sapiens
cacaggccaataccctctctct

SEQ ID NO: 8538840 - DNA, 22 bp, Homo sapiens
cacaggccagtaagactgtgtt

SEQ ID NO: 8538841 - DNA, 20 bp, Homo sapiens
cacaggccttgtgagcagac

SEQ ID NO: 8538842 - DNA, 20 bp, Homo sapiens
cacaggccttgtgagcagac

SEQ ID NO: 8538843 - DNA, 20 bp, Homo sapiens
cacaggccttgtgagcagac

SEQ ID NO: 8538844 - DNA, 22 bp, Homo sapiens
cacaggcctggggttgagcggg

SEQ ID NO: 8538845 - DNA, 22 bp, Homo sapiens
cacaggttaggtattatactat

SEQ ID NO: 8538846 - DNA, 22 bp, Homo sapiens
cacaggttcacctcaggtaggt

SEQ ID NO: 8538847 - DNA, 22 bp, Homo sapiens
cacagtaagaaatgaagaggta

SEQ ID NO: 8538848 - DNA, 22 bp, Homo sapiens
cacagtaaccccaggactggga

SEQ ID NO: 8538849 - DNA, 22 bp, Homo sapiens
cacaggtttgacaaggataaaa

SEQ ID NO: 8538850 - DNA, 22 bp, Homo sapiens
cacagtcctgccagagggcctt

SEQ ID NO: 8538851 - DNA, 22 bp, Homo sapiens
cacagtcctgccagagggcctt

SEQ ID NO: 8538852 - DNA, 22 bp, Homo sapiens
cacagtctctgttgctgggacc

SEQ ID NO: 8538853 - DNA, 22 bp, Homo sapiens
cacagtgaattacatagacgtg

SEQ ID NO: 8538854 - DNA, 22 bp, Homo sapiens
cacagtgaagcatgcagacatc

SEQ ID NO: 8538855 - DNA, 22 bp, Homo sapiens
cacagtgaagcatgcagacatc

SEQ ID NO: 8538856 - DNA, 22 bp, Homo sapiens
cacaggtgttcttgcagtgaaa

SEQ ID NO: 8538857 - DNA, 22 bp, Homo sapiens
cacaggtgtttgttatactcag

SEQ ID NO: 8538858 - DNA, 22 bp, Homo sapiens
cacaggtgttcttgcagtgaaa

SEQ ID NO: 8538859 - DNA, 22 bp, Homo sapiens
cacaggtgtatgaatatgtcca

SEQ ID NO: 8538860 - DNA, 22 bp, Homo sapiens
cacaggtggctccaagttagag

SEQ ID NO: 8538861 - DNA, 17 bp, Homo sapiens
cacaggtgtggtttgag

SEQ ID NO: 8538862 - DNA, 22 bp, Homo sapiens
cacaggtgtatgaatatgtcca

SEQ ID NO: 8538863 - DNA, 22 bp, Homo sapiens
cacaggtgtccaatacctgctt

SEQ ID NO: 8538864 - DNA, 22 bp, Homo sapiens
ggcaagtgatcctggagcaccg

SEQ ID NO: 8538865 - DNA, 22 bp, Homo sapiens
ggcaagtggtagaacatctgag

SEQ ID NO: 8538866 - DNA, 22 bp, Homo sapiens
ggcaagggttgaagataaggta

SEQ ID NO: 8538867 - DNA, 22 bp, Homo sapiens
ggcaagggttgaagataaggta

SEQ ID NO: 8538868 - DNA, 22 bp, Homo sapiens
ggcaagggacggccgtgagaca

SEQ ID NO: 8538869 - DNA, 22 bp, Homo sapiens
ggcaagggacggccgtgagaca

SEQ ID NO: 8538870 - DNA, 22 bp, Homo sapiens
cacagtgcatgatgggcagaag

SEQ ID NO: 8538871 - DNA, 22 bp, Homo sapiens
cacagtgcatgatgggcagaag

SEQ ID NO: 8538872 - DNA, 22 bp, Homo sapiens
ggcaaggggtcaggctgagaca

SEQ ID NO: 8538873 - DNA, 22 bp, Homo sapiens
cacagtgcactaagctccgggg

SEQ ID NO: 8538874 - DNA, 22 bp, Homo sapiens
ggcaaggggtcaggctgagaca

SEQ ID NO: 8538875 - DNA, 22 bp, Homo sapiens
ggcaaggggtcaggctgagaca

SEQ ID NO: 8538876 - DNA, 19 bp, Homo sapiens
cacagtgcagccatttctc

SEQ ID NO: 8538877 - DNA, 22 bp, Homo sapiens
cacagtgattgatttttacttt

SEQ ID NO: 8538878 - DNA, 22 bp, Homo sapiens
cacagtgagctgggcatcagtt

SEQ ID NO: 8538879 - DNA, 22 bp, Homo sapiens
cacagtgacctctttaaaaggg

SEQ ID NO: 8538880 - DNA, 22 bp, Homo sapiens
cacagtgactggcacatagtaa

SEQ ID NO: 8538881 - DNA, 22 bp, Homo sapiens
cacagtgactggcacatagtaa

SEQ ID NO: 8538882 - DNA, 22 bp, Homo sapiens
cacagtgaatttcaagtgttgt

SEQ ID NO: 8538883 - DNA, 22 bp, Homo sapiens
cacagtgacattagtgagaaaa

SEQ ID NO: 8538884 - DNA, 22 bp, Homo sapiens
cacagtgacagctatacagaga

SEQ ID NO: 8538885 - DNA, 22 bp, Homo sapiens
cagaatgttaccagttagtctg

SEQ ID NO: 8538886 - DNA, 22 bp, Homo sapiens
cagaataaaggtacaattgagt

SEQ ID NO: 8538887 - DNA, 22 bp, Homo sapiens
cagaatttaagtggattattct

SEQ ID NO: 8538888 - DNA, 22 bp, Homo sapiens
cagaattatagttgctttttaa

SEQ ID NO: 8538889 - DNA, 22 bp, Homo sapiens
cagaattcgaatgagcagaatc

SEQ ID NO: 8538890 - DNA, 22 bp, Homo sapiens
cagaattcgaatgagcagaatc

SEQ ID NO: 8538891 - DNA, 22 bp, Homo sapiens
cagaattgagagaggctgttct

SEQ ID NO: 8538892 - DNA, 22 bp, Homo sapiens
cagaatttaagtggattattct

SEQ ID NO: 8538893 - DNA, 22 bp, Homo sapiens
cagaaacagacatgacgcagta

SEQ ID NO: 8538894 - DNA, 22 bp, Homo sapiens
cagaaacagacatgacgcagta

SEQ ID NO: 8538895 - DNA, 22 bp, Homo sapiens
cagaaacagacatgacgcagta

SEQ ID NO: 8538896 - DNA, 22 bp, Homo sapiens
cagaaacagagaaatattggct

SEQ ID NO: 8538897 - DNA, 22 bp, Homo sapiens
cagaaacagacatgacgcagta

SEQ ID NO: 8538898 - DNA, 22 bp, Homo sapiens
cagaaacagagaaatattggct

SEQ ID NO: 8538899 - DNA, 22 bp, Homo sapiens
cagaaacaggcaacgtgtgcac

SEQ ID NO: 8538900 - DNA, 22 bp, Homo sapiens
cagaatttgaagtaatattcca

SEQ ID NO: 8538901 - DNA, 22 bp, Homo sapiens
cagaatttgaagtaatattcca

SEQ ID NO: 8538902 - DNA, 22 bp, Homo sapiens
cagaatttagaaaacaacataa

SEQ ID NO: 8538903 - DNA, 22 bp, Homo sapiens
cagaatttagcacaatgtatgg

SEQ ID NO: 8538904 - DNA, 22 bp, Homo sapiens
cagaatttagcacaatgtatgg

SEQ ID NO: 8538905 - DNA, 22 bp, Homo sapiens
cagaatttcagtgatgttttct

SEQ ID NO: 8538906 - DNA, 22 bp, Homo sapiens
cagacaactggactaagatcac

SEQ ID NO: 8538907 - DNA, 22 bp, Homo sapiens
cagaatttttcgaatgtactgt

SEQ ID NO: 8538908 - DNA, 22 bp, Homo sapiens
cagacaaagcggaaactgttta

SEQ ID NO: 8538909 - DNA, 22 bp, Homo sapiens
ggctggcaagtgtctgctcatg

SEQ ID NO: 8538910 - DNA, 19 bp, Homo sapiens
ggctggcaagtgacagtgt

SEQ ID NO: 8538911 - DNA, 22 bp, Homo sapiens
ggctggcactctgtccagtgtc

SEQ ID NO: 8538912 - DNA, 22 bp, Homo sapiens
cagaaacacttgtagagaagtt

SEQ ID NO: 8538913 - DNA, 22 bp, Homo sapiens
cagaaacacttgtagagaagtt

SEQ ID NO: 8538914 - DNA, 22 bp, Homo sapiens
cagaaaatagagtttctctgag

SEQ ID NO: 8538915 - DNA, 22 bp, Homo sapiens
cagaaacactgtatttagggaa

SEQ ID NO: 8538916 - DNA, 22 bp, Homo sapiens
cagaaacacttgtagagaagtt

SEQ ID NO: 8538917 - DNA, 22 bp, Homo sapiens
ggctggcactgaggagagctct

SEQ ID NO: 8538918 - DNA, 22 bp, Homo sapiens
cagaaaatagagtttctctgag

SEQ ID NO: 8538919 - DNA, 22 bp, Homo sapiens
cagaaaatagagtttctctgag

SEQ ID NO: 8538920 - DNA, 22 bp, Homo sapiens
gggagctgatgatgtaagtccc

SEQ ID NO: 8538921 - DNA, 22 bp, Homo sapiens
gggagccaaggagagaggcctt

SEQ ID NO: 8538922 - DNA, 22 bp, Homo sapiens
gggagccaaggagagaggcctt

SEQ ID NO: 8538923 - DNA, 22 bp, Homo sapiens
cagacagaaggaaggccaacat

SEQ ID NO: 8538924 - DNA, 22 bp, Homo sapiens
cagacactgcagcagtctccca

SEQ ID NO: 8538925 - DNA, 22 bp, Homo sapiens
cagacactgcagcagtctccca

SEQ ID NO: 8538926 - DNA, 22 bp, Homo sapiens
cagacacttattgagcaagtac

SEQ ID NO: 8538927 - DNA, 22 bp, Homo sapiens
cagacagaaggaaggccaacat

SEQ ID NO: 8538928 - DNA, 22 bp, Homo sapiens
cagacacacaagcaatctaagt

SEQ ID NO: 8538929 - DNA, 22 bp, Homo sapiens
cagacacagatatgcatatggc

SEQ ID NO: 8538930 - DNA, 22 bp, Homo sapiens
cagacacagatatgcatatggc

SEQ ID NO: 8538931 - DNA, 22 bp, Homo sapiens
cagacacaccaggcccattctg

SEQ ID NO: 8538932 - DNA, 22 bp, Homo sapiens
cagacacaccaggcccattctg

SEQ ID NO: 8538933 - DNA, 22 bp, Homo sapiens
cagacacagatatgcatatggc

SEQ ID NO: 8538934 - DNA, 22 bp, Homo sapiens
cagacacagcaattctgtgttg

SEQ ID NO: 8538935 - DNA, 22 bp, Homo sapiens
cagacactaggtgacagagtgc

SEQ ID NO: 8538936 - DNA, 22 bp, Homo sapiens
cagacactattgtgtataaatc

SEQ ID NO: 8538937 - DNA, 22 bp, Homo sapiens
cagacactatgctaaggtacta

SEQ ID NO: 8538938 - DNA, 18 bp, Homo sapiens
cagacactctgctctgca

SEQ ID NO: 8538939 - DNA, 18 bp, Homo sapiens
cagacactctgctctgca

SEQ ID NO: 8538940 - DNA, 22 bp, Homo sapiens
gggaggcagtgctggaggctgg

SEQ ID NO: 8538941 - DNA, 22 bp, Homo sapiens
gggaggcagtgctggaggctgg

SEQ ID NO: 8538942 - DNA, 22 bp, Homo sapiens
gggaggagggtgctggctaaac

SEQ ID NO: 8538943 - DNA, 22 bp, Homo sapiens
gggagctgccaccacccctggg

SEQ ID NO: 8538944 - DNA, 22 bp, Homo sapiens
gggagctgccaccacccctggg

SEQ ID NO: 8538945 - DNA, 22 bp, Homo sapiens
gggagctgccttagaccggagg

SEQ ID NO: 8538946 - DNA, 22 bp, Homo sapiens
gggagctgctgaacacaagggt

SEQ ID NO: 8538947 - DNA, 22 bp, Homo sapiens
gggaggagggtgctggctaaac

SEQ ID NO: 8538948 - DNA, 21 bp, Homo sapiens
gggagctggaaactgggtgac

SEQ ID NO: 8538949 - DNA, 21 bp, Homo sapiens
gggagctggaaactgggtgac

SEQ ID NO: 8538950 - DNA, 22 bp, Homo sapiens
cagagcagaaggtccaagcctg

SEQ ID NO: 8538951 - DNA, 22 bp, Homo sapiens
cagagcagacgttgagattaag

SEQ ID NO: 8538952 - DNA, 22 bp, Homo sapiens
cagagcagacgttgagattaag

SEQ ID NO: 8538953 - DNA, 18 bp, Homo sapiens
cagagcagaggtggagcg

SEQ ID NO: 8538954 - DNA, 22 bp, Homo sapiens
gggcaggggtagcattccaagt

SEQ ID NO: 8538955 - DNA, 18 bp, Homo sapiens
cagagcagaggtggagcg

SEQ ID NO: 8538956 - DNA, 22 bp, Homo sapiens
gggcaggggtagcattccaagt

SEQ ID NO: 8538957 - DNA, 18 bp, Homo sapiens
cagagcagaggtggagcg

SEQ ID NO: 8538958 - DNA, 22 bp, Homo sapiens
gggcaggggtcagtggccccaa

SEQ ID NO: 8538959 - DNA, 22 bp, Homo sapiens
gggcaggggtcagtggccccaa

SEQ ID NO: 8538960 - DNA, 22 bp, Homo sapiens
gggcaggtacaagatgcttctt

SEQ ID NO: 8538961 - DNA, 22 bp, Homo sapiens
gggcaggtacaagatgcttctt

SEQ ID NO: 8538962 - DNA, 22 bp, Homo sapiens
cagagcaggcccactgccctcc

SEQ ID NO: 8538963 - DNA, 22 bp, Homo sapiens
cagagcaggggtttcccaggtt

SEQ ID NO: 8538964 - DNA, 22 bp, Homo sapiens
gggcaggtactgggtggtgagc

SEQ ID NO: 8538965 - DNA, 22 bp, Homo sapiens
cagagcagtgaggagttgtgta

SEQ ID NO: 8538966 - DNA, 22 bp, Homo sapiens
cagagcaggggtttcccaggtt

SEQ ID NO: 8538967 - DNA, 22 bp, Homo sapiens
cagagcagtggagagtaggtct

SEQ ID NO: 8538968 - DNA, 20 bp, Homo sapiens
cagagcagtgcccaggcggc

SEQ ID NO: 8538969 - DNA, 20 bp, Homo sapiens
cagagcagtgcccaggcggc

SEQ ID NO: 8538970 - DNA, 19 bp, Homo sapiens
cagagcagtggttcctgaa

SEQ ID NO: 8538971 - DNA, 22 bp, Homo sapiens
cagagcagtggggttggtcaga

SEQ ID NO: 8538972 - DNA, 22 bp, Homo sapiens
cagagcatgaataaaagttaca

SEQ ID NO: 8538973 - DNA, 22 bp, Homo sapiens
cagagcataattgacatgaggt

SEQ ID NO: 8538974 - DNA, 22 bp, Homo sapiens
cagagccactgcattttacagc

SEQ ID NO: 8538975 - DNA, 20 bp, Homo sapiens
cagagccaagagcagcatct

SEQ ID NO: 8538976 - DNA, 20 bp, Homo sapiens
cagagccaagagcagcatct

SEQ ID NO: 8538977 - DNA, 20 bp, Homo sapiens
cagagccaagagcagcatct

SEQ ID NO: 8538978 - DNA, 22 bp, Homo sapiens
cagagccaacgccacctgccca

SEQ ID NO: 8538979 - DNA, 22 bp, Homo sapiens
cagagccaaatgctgtggttat

SEQ ID NO: 8538980 - DNA, 22 bp, Homo sapiens
cagagccaaaaccgtaacagcc

SEQ ID NO: 8538981 - DNA, 22 bp, Homo sapiens
cagagccaaatgctgtggttat

SEQ ID NO: 8538982 - DNA, 22 bp, Homo sapiens
cagagccaaatgctgtggttat

SEQ ID NO: 8538983 - DNA, 22 bp, Homo sapiens
cagagccaaacctcagggcccg

SEQ ID NO: 8538984 - DNA, 22 bp, Homo sapiens
cagagccaaacctcagggcccg

SEQ ID NO: 8538985 - DNA, 22 bp, Homo sapiens
cagagcattgagggtctgccaa

SEQ ID NO: 8538986 - DNA, 22 bp, Homo sapiens
cagagccaaacctcagggcccg

SEQ ID NO: 8538987 - DNA, 22 bp, Homo sapiens
cagagcacccaaggagcatttg

SEQ ID NO: 8538988 - DNA, 22 bp, Homo sapiens
cagagaggatggattccatagc

SEQ ID NO: 8538989 - DNA, 22 bp, Homo sapiens
cagagcactgcttggaggattt

SEQ ID NO: 8538990 - DNA, 22 bp, Homo sapiens
cagagcactgcttggaggattt

SEQ ID NO: 8538991 - DNA, 22 bp, Homo sapiens
cagagcactgcttggaggattt

SEQ ID NO: 8538992 - DNA, 22 bp, Homo sapiens
cagagcacctgctcattgccag

SEQ ID NO: 8538993 - DNA, 22 bp, Homo sapiens
cagagcagaagcggtcctcaca

SEQ ID NO: 8538994 - DNA, 22 bp, Homo sapiens
cagagcagaagcggtcctcaca

SEQ ID NO: 8538995 - DNA, 22 bp, Homo sapiens
cagagcagaaacctgggtgatt

SEQ ID NO: 8538996 - DNA, 22 bp, Homo sapiens
cagagcagaaacctgggtgatt

SEQ ID NO: 8538997 - DNA, 22 bp, Homo sapiens
cagagcagaaacctgggtgatt

SEQ ID NO: 8538998 - DNA, 22 bp, Homo sapiens
cagagcagaaacctgggtgatt

SEQ ID NO: 8538999 - DNA, 22 bp, Homo sapiens
gggatgagagctgggacagaag

SEQ ID NO: 8539000 - DNA, 22 bp, Homo sapiens
gggatgagagctgggacagaag

SEQ ID NO: 8539001 - DNA, 22 bp, Homo sapiens
gggatgacaaagtgtctgtccc

SEQ ID NO: 8539002 - DNA, 22 bp, Homo sapiens
gggatgaattgagtcagaaggg

SEQ ID NO: 8539003 - DNA, 22 bp, Homo sapiens
cagagaagaaagtgactataat

SEQ ID NO: 8539004 - DNA, 22 bp, Homo sapiens
cagagaagagtctggcctctct

SEQ ID NO: 8539005 - DNA, 22 bp, Homo sapiens
cagacttgacggcagctgcttt

SEQ ID NO: 8539006 - DNA, 22 bp, Homo sapiens
cagacttgacggcagctgcttt

SEQ ID NO: 8539007 - DNA, 22 bp, Homo sapiens
cagagaactccagtggctggcg

SEQ ID NO: 8539008 - DNA, 22 bp, Homo sapiens
cagacttgaaagagactcagtt

SEQ ID NO: 8539009 - DNA, 22 bp, Homo sapiens
cagactgtggcttcttggaggg

SEQ ID NO: 8539010 - DNA, 20 bp, Homo sapiens
gggaggcattggtccctcac

SEQ ID NO: 8539011 - DNA, 20 bp, Homo sapiens
gggaggcattggtccctcac

SEQ ID NO: 8539012 - DNA, 20 bp, Homo sapiens
gggaggcattggtccctcac

SEQ ID NO: 8539013 - DNA, 22 bp, Homo sapiens
cagactgtagagtttgagaagt

SEQ ID NO: 8539014 - DNA, 22 bp, Homo sapiens
cagactgtgagctccttgaggg

SEQ ID NO: 8539015 - DNA, 22 bp, Homo sapiens
cagagacagaaaatggatctag

SEQ ID NO: 8539016 - DNA, 22 bp, Homo sapiens
cagagacacttaacaggaatgg

SEQ ID NO: 8539017 - DNA, 22 bp, Homo sapiens
cagagacacttaacaggaatgg

SEQ ID NO: 8539018 - DNA, 22 bp, Homo sapiens
cagagacacttaacaggaatgg

SEQ ID NO: 8539019 - DNA, 22 bp, Homo sapiens
cagagacaacctggtagagaaa

SEQ ID NO: 8539020 - DNA, 22 bp, Homo sapiens
cagagacaacctggtagagaaa

SEQ ID NO: 8539021 - DNA, 22 bp, Homo sapiens
cagagacaacctggtagagaaa

SEQ ID NO: 8539022 - DNA, 22 bp, Homo sapiens
cagagacaacctggtagagaaa

SEQ ID NO: 8539023 - DNA, 22 bp, Homo sapiens
cagagacaacctggtagagaaa

SEQ ID NO: 8539024 - DNA, 22 bp, Homo sapiens
gggtgggatctgtggagcctca

SEQ ID NO: 8539025 - DNA, 22 bp, Homo sapiens
gggtgggatctgtggagcctca

SEQ ID NO: 8539026 - DNA, 20 bp, Homo sapiens
gggtcctgacttggtctcct

SEQ ID NO: 8539027 - DNA, 22 bp, Homo sapiens
gggtccctggaattacttgaca

SEQ ID NO: 8539028 - DNA, 22 bp, Homo sapiens
gggtcccaggaaggagcagtgt

SEQ ID NO: 8539029 - DNA, 22 bp, Homo sapiens
gggtcccaggaaggagcagtgt

SEQ ID NO: 8539030 - DNA, 22 bp, Homo sapiens
gggtcccaggtctggaaaagca

SEQ ID NO: 8539031 - DNA, 22 bp, Homo sapiens
gggtccaggtcttcaggcagag

SEQ ID NO: 8539032 - DNA, 22 bp, Homo sapiens
gggtccaggtttagtcatttgt

SEQ ID NO: 8539033 - DNA, 22 bp, Homo sapiens
gggtaggaaatccagaggtggc

SEQ ID NO: 8539034 - DNA, 22 bp, Homo sapiens
gggtaggaaatccagaggtggc

SEQ ID NO: 8539035 - DNA, 22 bp, Homo sapiens
gggtaggaaatccagaggtggc

SEQ ID NO: 8539036 - DNA, 22 bp, Homo sapiens
gggtagcatgtgtcagagtttg

SEQ ID NO: 8539037 - DNA, 22 bp, Homo sapiens
gggtacttaatatttacggggt

SEQ ID NO: 8539038 - DNA, 20 bp, Homo sapiens
gggtgtgggcccggccaggc

SEQ ID NO: 8539039 - DNA, 22 bp, Homo sapiens
gggtgtgtcttttgctcctgga

SEQ ID NO: 8539040 - DNA, 20 bp, Homo sapiens
gggtgtgtgcagggcctggt

SEQ ID NO: 8539041 - DNA, 22 bp, Homo sapiens
gggttaaaacaggaagatcagc

SEQ ID NO: 8539042 - DNA, 22 bp, Homo sapiens
gggttaaagagcccaatgtatg

SEQ ID NO: 8539043 - DNA, 22 bp, Homo sapiens
gggttaaacatgctatatgagt

SEQ ID NO: 8539044 - DNA, 22 bp, Homo sapiens
gggttaaaacaggaagatcagc

SEQ ID NO: 8539045 - DNA, 22 bp, Homo sapiens
gggttaaaacaggaagatcagc

SEQ ID NO: 8539046 - DNA, 22 bp, Homo sapiens
gggttaaagcaggaagcatctt

SEQ ID NO: 8539047 - DNA, 22 bp, Homo sapiens
gggttaaagcaggaagcatctt

SEQ ID NO: 8539048 - DNA, 22 bp, Homo sapiens
gggttaggtccctcccttctgg

SEQ ID NO: 8539049 - DNA, 22 bp, Homo sapiens
gggttagttggtagttaattga

SEQ ID NO: 8539050 - DNA, 22 bp, Homo sapiens
gggttcagactaaagctatgca

SEQ ID NO: 8539051 - DNA, 22 bp, Homo sapiens
gggtgtgttcctaaggaaacca

SEQ ID NO: 8539052 - DNA, 22 bp, Homo sapiens
gggtgttgattttacactaaaa

SEQ ID NO: 8539053 - DNA, 22 bp, Homo sapiens
gggtgtgtcttttgctcctgga

SEQ ID NO: 8539054 - DNA, 22 bp, Homo sapiens
gggtgtgttcctaaggaaacca

SEQ ID NO: 8539055 - DNA, 22 bp, Homo sapiens
gggttcagtccctcttgctact

SEQ ID NO: 8539056 - DNA, 22 bp, Homo sapiens
gggttcagtccctcttgctact

SEQ ID NO: 8539057 - DNA, 22 bp, Homo sapiens
gggttcagtccctcttgctact

SEQ ID NO: 8539058 - DNA, 22 bp, Homo sapiens
gggttccctgcctggccactct

SEQ ID NO: 8539059 - DNA, 19 bp, Homo sapiens
ggtatatgggcctcacttg

SEQ ID NO: 8539060 - DNA, 22 bp, Homo sapiens
ggtagttcttcatgggtttcat

SEQ ID NO: 8539061 - DNA, 22 bp, Homo sapiens
ggtatgaaatgattccatgtta

SEQ ID NO: 8539062 - DNA, 22 bp, Homo sapiens
ggtatgaattcactacttccaa

SEQ ID NO: 8539063 - DNA, 22 bp, Homo sapiens
ggtatgaattcactacttccaa

SEQ ID NO: 8539064 - DNA, 22 bp, Homo sapiens
ggtcaaagtgaggagtcaggtt

SEQ ID NO: 8539065 - DNA, 22 bp, Homo sapiens
ggtcaaagggtgagatggcagg

SEQ ID NO: 8539066 - DNA, 22 bp, Homo sapiens
ggtcaaagttgaagaagggcat

SEQ ID NO: 8539067 - DNA, 22 bp, Homo sapiens
ggtatttatatgtctgaagctg

SEQ ID NO: 8539068 - DNA, 22 bp, Homo sapiens
ggtatttatagtggtgcttagt

SEQ ID NO: 8539069 - DNA, 22 bp, Homo sapiens
ggtatttactgagagccactct

SEQ ID NO: 8539070 - DNA, 22 bp, Homo sapiens
ggtcacaaggcagataataagg

SEQ ID NO: 8539071 - DNA, 19 bp, Homo sapiens
ggtcacaaggagttgtgaa

SEQ ID NO: 8539072 - DNA, 22 bp, Homo sapiens
ggtcacaaggtactgtaagaaa

SEQ ID NO: 8539073 - DNA, 22 bp, Homo sapiens
ggtcacaaggtactgtaagaaa

SEQ ID NO: 8539074 - DNA, 22 bp, Homo sapiens
cagatatgataggattagcaca

SEQ ID NO: 8539075 - DNA, 22 bp, Homo sapiens
cagatgaggggcatataacaat

SEQ ID NO: 8539076 - DNA, 23 bp, Homo sapiens
cagatgaggttggcagcatggtc

SEQ ID NO: 8539077 - DNA, 23 bp, Homo sapiens
cagatgaggttggcagcatggtc

SEQ ID NO: 8539078 - DNA, 22 bp, Homo sapiens
cagatgagcatgggcacaagca

SEQ ID NO: 8539079 - DNA, 22 bp, Homo sapiens
cagatgagcatgggcacaagca

SEQ ID NO: 8539080 - DNA, 22 bp, Homo sapiens
cagatgaggacagatgactggg

SEQ ID NO: 8539081 - DNA, 22 bp, Homo sapiens
cagatgaggcaacctcattgct

SEQ ID NO: 8539082 - DNA, 22 bp, Homo sapiens
cagatgaggacagatgactggg

SEQ ID NO: 8539083 - DNA, 18 bp, Homo sapiens
cagatgagatgcaatctc

SEQ ID NO: 8539084 - DNA, 22 bp, Homo sapiens
cagatgaagtttgcctagagct

SEQ ID NO: 8539085 - DNA, 22 bp, Homo sapiens
ggtcctggaaattgacggaaag

SEQ ID NO: 8539086 - DNA, 22 bp, Homo sapiens
ggtcctggaaattgacggaaag

SEQ ID NO: 8539087 - DNA, 22 bp, Homo sapiens
ggtcctggaaattgacggaaag

SEQ ID NO: 8539088 - DNA, 22 bp, Homo sapiens
ggtcctggcagctctgtgtcca

SEQ ID NO: 8539089 - DNA, 22 bp, Homo sapiens
ggtcctggatgagacaggtagt

SEQ ID NO: 8539090 - DNA, 22 bp, Homo sapiens
ggtcctggatgagacaggtagt

SEQ ID NO: 8539091 - DNA, 22 bp, Homo sapiens
ggtcctggaagtgtaagtggca

SEQ ID NO: 8539092 - DNA, 19 bp, Homo sapiens
cagatgttttcagttcatt

SEQ ID NO: 8539093 - DNA, 22 bp, Homo sapiens
cagatggcacagatttagagtg

SEQ ID NO: 8539094 - DNA, 20 bp, Homo sapiens
cagatggcacgtcagggcat

SEQ ID NO: 8539095 - DNA, 22 bp, Homo sapiens
cagatggcaacagctctgtgac

SEQ ID NO: 8539096 - DNA, 22 bp, Homo sapiens
ggtcctggcagtctttggttgt

SEQ ID NO: 8539097 - DNA, 18 bp, Homo sapiens
cagatgctaggcctccag

SEQ ID NO: 8539098 - DNA, 18 bp, Homo sapiens
cagatgctaggcctccag

SEQ ID NO: 8539099 - DNA, 22 bp, Homo sapiens
cagatgctaagttatcagcagg

SEQ ID NO: 8539100 - DNA, 22 bp, Homo sapiens
cagatgcagcaaaatgacaggc

SEQ ID NO: 8539101 - DNA, 22 bp, Homo sapiens
cagatgcagcaaaatgacaggc

SEQ ID NO: 8539102 - DNA, 22 bp, Homo sapiens
ggtcctgagtacctatgtttat

SEQ ID NO: 8539103 - DNA, 22 bp, Homo sapiens
ggtcctctccagcgccacagtg

SEQ ID NO: 8539104 - DNA, 19 bp, Homo sapiens
ggtcctcagcagagcatgc

SEQ ID NO: 8539105 - DNA, 22 bp, Homo sapiens
ggtcctctcccaagagcgcatc

SEQ ID NO: 8539106 - DNA, 22 bp, Homo sapiens
ggtcctcaatcccaacaaggca

SEQ ID NO: 8539107 - DNA, 22 bp, Homo sapiens
cagagccagaactagaccttgt

SEQ ID NO: 8539108 - DNA, 22 bp, Homo sapiens
cagagccactgtctgccaggca

SEQ ID NO: 8539109 - DNA, 22 bp, Homo sapiens
cagagccactgtctgccaggca

SEQ ID NO: 8539110 - DNA, 22 bp, Homo sapiens
cagagccactgtctgccaggca

SEQ ID NO: 8539111 - DNA, 22 bp, Homo sapiens
cagagccacttggagatgagaa

SEQ ID NO: 8539112 - DNA, 22 bp, Homo sapiens
gggctggaggaccggcctcgga

SEQ ID NO: 8539113 - DNA, 22 bp, Homo sapiens
gggctggaggaccggcctcgga

SEQ ID NO: 8539114 - DNA, 22 bp, Homo sapiens
gggctgagtgggcctcttactt

SEQ ID NO: 8539115 - DNA, 22 bp, Homo sapiens
cagagccagcagtggggacagg

SEQ ID NO: 8539116 - DNA, 22 bp, Homo sapiens
cagagccagcagtggggacagg

SEQ ID NO: 8539117 - DNA, 22 bp, Homo sapiens
cagagccagcagtggggacagg

SEQ ID NO: 8539118 - DNA, 22 bp, Homo sapiens
cagagccagcccactgttcccg

SEQ ID NO: 8539119 - DNA, 21 bp, Homo sapiens
gggctggaggatgggaagccc

SEQ ID NO: 8539120 - DNA, 21 bp, Homo sapiens
gggctggaggatgggaagccc

SEQ ID NO: 8539121 - DNA, 22 bp, Homo sapiens
gggctggaggcctgcctggtta

SEQ ID NO: 8539122 - DNA, 22 bp, Homo sapiens
gggctggaggcctgcctggtta

SEQ ID NO: 8539123 - DNA, 22 bp, Homo sapiens
gggctggaggaccggcctcgga

SEQ ID NO: 8539124 - DNA, 22 bp, Homo sapiens
gggctggaggagatccagaggc

SEQ ID NO: 8539125 - DNA, 22 bp, Homo sapiens
gggctggaggagatccagaggc

SEQ ID NO: 8539126 - DNA, 22 bp, Homo sapiens
gggctggaggagatccagaggc

SEQ ID NO: 8539127 - DNA, 22 bp, Homo sapiens
gggctggaggagatccagaggc

SEQ ID NO: 8539128 - DNA, 22 bp, Homo sapiens
gggctggagtcttctgaaagcc

SEQ ID NO: 8539129 - DNA, 22 bp, Homo sapiens
gggctggaggtgagcaggacag

SEQ ID NO: 8539130 - DNA, 22 bp, Homo sapiens
gggctggaggtgagcaggacag

SEQ ID NO: 8539131 - DNA, 22 bp, Homo sapiens
gggctggaggtgagcaggacag

SEQ ID NO: 8539132 - DNA, 19 bp, Homo sapiens
gggctggagggatagagcc

SEQ ID NO: 8539133 - DNA, 19 bp, Homo sapiens
gggctggagggatagagcc

SEQ ID NO: 8539134 - DNA, 22 bp, Homo sapiens
gggctgtgtaatgtgctctttt

SEQ ID NO: 8539135 - DNA, 22 bp, Homo sapiens
gggctgtgggacccggcacttt

SEQ ID NO: 8539136 - DNA, 22 bp, Homo sapiens
gggctgtgggacccggcacttt

SEQ ID NO: 8539137 - DNA, 22 bp, Homo sapiens
gggctgtggagccgcgagggct

SEQ ID NO: 8539138 - DNA, 22 bp, Homo sapiens
gggctgtggagccgcgagggct

SEQ ID NO: 8539139 - DNA, 22 bp, Homo sapiens
gggctgtgaggtgagaacttac

SEQ ID NO: 8539140 - DNA, 18 bp, Homo sapiens
gggctgtgagatgggaag

SEQ ID NO: 8539141 - DNA, 22 bp, Homo sapiens
gggctgtgcctcaggtggggtc

SEQ ID NO: 8539142 - DNA, 22 bp, Homo sapiens
gggctgtgaggtgagaacttac

SEQ ID NO: 8539143 - DNA, 22 bp, Homo sapiens
gggctgtgctgagtaggaggtg

SEQ ID NO: 8539144 - DNA, 22 bp, Homo sapiens
gggctgtgctgagtaggaggtg

SEQ ID NO: 8539145 - DNA, 20 bp, Homo sapiens
gggctgtgcctcctcgtggt

SEQ ID NO: 8539146 - DNA, 22 bp, Homo sapiens
gggctgtgagagtggggctgct

SEQ ID NO: 8539147 - DNA, 22 bp, Homo sapiens
gggctgtgagagtggggctgct

SEQ ID NO: 8539148 - DNA, 22 bp, Homo sapiens
gggctgtaggagctggaatggg

SEQ ID NO: 8539149 - DNA, 22 bp, Homo sapiens
gggctgtaggagctggaatggg

SEQ ID NO: 8539150 - DNA, 22 bp, Homo sapiens
gggctgtaggagctggaatggg

SEQ ID NO: 8539151 - DNA, 22 bp, Homo sapiens
gggctgtcatgtgtcagtgacc

SEQ ID NO: 8539152 - DNA, 22 bp, Homo sapiens
gggctgtcatgtgtcagtgacc

SEQ ID NO: 8539153 - DNA, 22 bp, Homo sapiens
gggctggatctcacgtgagacc

SEQ ID NO: 8539154 - DNA, 21 bp, Homo sapiens
gggctggatattggaaagagg

SEQ ID NO: 8539155 - DNA, 22 bp, Homo sapiens
gggctggagttgggaagacaaa

SEQ ID NO: 8539156 - DNA, 21 bp, Homo sapiens
gggctggatattggaaagagg

SEQ ID NO: 8539157 - DNA, 22 bp, Homo sapiens
gggctggagttgggaagacaaa

SEQ ID NO: 8539158 - DNA, 20 bp, Homo sapiens
gggctggataattctttgct

SEQ ID NO: 8539159 - DNA, 21 bp, Homo sapiens
ggggcctctccacacagccgg

SEQ ID NO: 8539160 - DNA, 23 bp, Homo sapiens
ggggcctgcaccggtctgcgcgg

SEQ ID NO: 8539161 - DNA, 23 bp, Homo sapiens
ggggcctgcaccggtctgcgcgg

SEQ ID NO: 8539162 - DNA, 22 bp, Homo sapiens
ggggcagatggaacagagcaca

SEQ ID NO: 8539163 - DNA, 22 bp, Homo sapiens
ggggcagagtctggactgttgt

SEQ ID NO: 8539164 - DNA, 22 bp, Homo sapiens
ggggcagatggaacagagcaca

SEQ ID NO: 8539165 - DNA, 22 bp, Homo sapiens
ggggcagagtagctggggtgtg

SEQ ID NO: 8539166 - DNA, 22 bp, Homo sapiens
ggggcagagtagctggggtgtg

SEQ ID NO: 8539167 - DNA, 22 bp, Homo sapiens
ggggcagagtagctggggtgtg

SEQ ID NO: 8539168 - DNA, 22 bp, Homo sapiens
ggggcagagtagctggggtgtg

SEQ ID NO: 8539169 - DNA, 21 bp, Homo sapiens
ggggcagagctaggccctgca

SEQ ID NO: 8539170 - DNA, 22 bp, Homo sapiens
ggggcagagcatagctccaatt

SEQ ID NO: 8539171 - DNA, 22 bp, Homo sapiens
ggggcagagcatagctccaatt

SEQ ID NO: 8539172 - DNA, 22 bp, Homo sapiens
ggggcagaagtagtgcccctga

SEQ ID NO: 8539173 - DNA, 22 bp, Homo sapiens
ggggcagaagtagtgcccctga

SEQ ID NO: 8539174 - DNA, 22 bp, Homo sapiens
ggggcagagaataaaaacctaa

SEQ ID NO: 8539175 - DNA, 22 bp, Homo sapiens
ggggcagagagaaggaagcttg

SEQ ID NO: 8539176 - DNA, 22 bp, Homo sapiens
ggggcagagagaaggaagcttg

SEQ ID NO: 8539177 - DNA, 22 bp, Homo sapiens
ggggcagagagaaggaagcttg

SEQ ID NO: 8539178 - DNA, 19 bp, Homo sapiens
ggggcctgtgatggtcaca

SEQ ID NO: 8539179 - DNA, 19 bp, Homo sapiens
ggggcctgtgatggtcaca

SEQ ID NO: 8539180 - DNA, 22 bp, Homo sapiens
ggggcctgtagagcttcaggga

SEQ ID NO: 8539181 - DNA, 22 bp, Homo sapiens
ggggcctgtagagcttcaggga

SEQ ID NO: 8539182 - DNA, 22 bp, Homo sapiens
ggggcctgtagagcttcaggga

SEQ ID NO: 8539183 - DNA, 22 bp, Homo sapiens
ggggcctgcgaggttcaacttc

SEQ ID NO: 8539184 - DNA, 22 bp, Homo sapiens
ggggccttttctgaatgtggaa

SEQ ID NO: 8539185 - DNA, 22 bp, Homo sapiens
ggggccttggatctgtgccccg

SEQ ID NO: 8539186 - DNA, 22 bp, Homo sapiens
ggggtgagtgctcagccccgga

SEQ ID NO: 8539187 - DNA, 20 bp, Homo sapiens
ggggttggctggcacaggga

SEQ ID NO: 8539188 - DNA, 20 bp, Homo sapiens
ggggttggctggcacaggga

SEQ ID NO: 8539189 - DNA, 20 bp, Homo sapiens
ggggttggctggcacaggga

SEQ ID NO: 8539190 - DNA, 21 bp, Homo sapiens
ggggttggcaagagcagagac

SEQ ID NO: 8539191 - DNA, 22 bp, Homo sapiens
ggggttggtttaaatgcttgag

SEQ ID NO: 8539192 - DNA, 22 bp, Homo sapiens
ggggttggtttaaatgcttgag

SEQ ID NO: 8539193 - DNA, 20 bp, Homo sapiens
ggggttggctggcacaggga

SEQ ID NO: 8539194 - DNA, 22 bp, Homo sapiens
gggtaaaggtcgccctcaaggt

SEQ ID NO: 8539195 - DNA, 22 bp, Homo sapiens
gggtaaatctcttttcatggct

SEQ ID NO: 8539196 - DNA, 20 bp, Homo sapiens
gggtaaaaggcagtgttgca

SEQ ID NO: 8539197 - DNA, 22 bp, Homo sapiens
gggtacaaagatttcataagat

SEQ ID NO: 8539198 - DNA, 22 bp, Homo sapiens
cagccctgtccctgagggacct

SEQ ID NO: 8539199 - DNA, 22 bp, Homo sapiens
cagccctgtccctgagggacct

SEQ ID NO: 8539200 - DNA, 22 bp, Homo sapiens
cagccctgtccctgagggacct

SEQ ID NO: 8539201 - DNA, 22 bp, Homo sapiens
cagccctgtccctgagggacct

SEQ ID NO: 8539202 - DNA, 22 bp, Homo sapiens
cagccctgtctatgactgatga

SEQ ID NO: 8539203 - DNA, 22 bp, Homo sapiens
cagccctgaaacaacctcctct

SEQ ID NO: 8539204 - DNA, 22 bp, Homo sapiens
cagccctgaaacaacctcctct

SEQ ID NO: 8539205 - DNA, 22 bp, Homo sapiens
cagccctggcccaggtgcctta

SEQ ID NO: 8539206 - DNA, 22 bp, Homo sapiens
cagccctggtgccaaggttccc

SEQ ID NO: 8539207 - DNA, 22 bp, Homo sapiens
cagccctggtgccaaggttccc

SEQ ID NO: 8539208 - DNA, 22 bp, Homo sapiens
cagccctgtccaatgtctgctc

SEQ ID NO: 8539209 - DNA, 22 bp, Homo sapiens
cagccctgtccaatgtctgctc

SEQ ID NO: 8539210 - DNA, 22 bp, Homo sapiens
cagccctgtccaatgtctgctc

SEQ ID NO: 8539211 - DNA, 22 bp, Homo sapiens
cagccctgtccagcagagggtg

SEQ ID NO: 8539212 - DNA, 22 bp, Homo sapiens
cagccctgtccagcagagggtg

SEQ ID NO: 8539213 - DNA, 22 bp, Homo sapiens
cagccctgtccagcagagggtg

SEQ ID NO: 8539214 - DNA, 22 bp, Homo sapiens
cagccctgtccagcagagggtg

SEQ ID NO: 8539215 - DNA, 22 bp, Homo sapiens
cagccctgtccagcagagggtg

SEQ ID NO: 8539216 - DNA, 22 bp, Homo sapiens
cagccctgtccagcagagggtg

SEQ ID NO: 8539217 - DNA, 22 bp, Homo sapiens
gtgagcagaacaggtggcttct

SEQ ID NO: 8539218 - DNA, 18 bp, Homo sapiens
gtgagcagagagcatcac

SEQ ID NO: 8539219 - DNA, 22 bp, Homo sapiens
gtgagcagagatcgcgtgattg

SEQ ID NO: 8539220 - DNA, 23 bp, Homo sapiens
gtgagcagcaccatgaggctaga

SEQ ID NO: 8539221 - DNA, 22 bp, Homo sapiens
cagccctcatcccgcctgcgtt

SEQ ID NO: 8539222 - DNA, 22 bp, Homo sapiens
cagccctcatcccgcctgcgtt

SEQ ID NO: 8539223 - DNA, 20 bp, Homo sapiens
cagccctccagtggaggcag

SEQ ID NO: 8539224 - DNA, 20 bp, Homo sapiens
cagccctccagtggaggcag

SEQ ID NO: 8539225 - DNA, 22 bp, Homo sapiens
cagccctcctaccctgccaggc

SEQ ID NO: 8539226 - DNA, 22 bp, Homo sapiens
cagccctcctaccctgccaggc

SEQ ID NO: 8539227 - DNA, 19 bp, Homo sapiens
cagccctcttaccactgtg

SEQ ID NO: 8539228 - DNA, 22 bp, Homo sapiens
cagccctctctgggccccaagg

SEQ ID NO: 8539229 - DNA, 22 bp, Homo sapiens
cagccctctgaagaggcgcttg

SEQ ID NO: 8539230 - DNA, 22 bp, Homo sapiens
gtcctgtcccccaaggctgtgg

SEQ ID NO: 8539231 - DNA, 22 bp, Homo sapiens
gtcctgtgatgagtaccaggtg

SEQ ID NO: 8539232 - DNA, 22 bp, Homo sapiens
gtcctgtgacctgcatcctgag

SEQ ID NO: 8539233 - DNA, 22 bp, Homo sapiens
gtcctgtgacctgcatcctgag

SEQ ID NO: 8539234 - DNA, 22 bp, Homo sapiens
gtcctggtataattgtttaaaa

SEQ ID NO: 8539235 - DNA, 22 bp, Homo sapiens
gtcctggtataattgtttaaaa

SEQ ID NO: 8539236 - DNA, 22 bp, Homo sapiens
gtcctggtgaggtagtgggagg

SEQ ID NO: 8539237 - DNA, 22 bp, Homo sapiens
gtcctggtcctgcctccccatg

SEQ ID NO: 8539238 - DNA, 22 bp, Homo sapiens
gtcctggtgccacctgcgggat

SEQ ID NO: 8539239 - DNA, 22 bp, Homo sapiens
gtcctggtgctggtcattgtcg

SEQ ID NO: 8539240 - DNA, 17 bp, Homo sapiens
gtcctggtgtgtgagga

SEQ ID NO: 8539241 - DNA, 22 bp, Homo sapiens
gtgaattaggacaaaagggctt

SEQ ID NO: 8539242 - DNA, 22 bp, Homo sapiens
gtcctgtgccgaggtgggaagc

SEQ ID NO: 8539243 - DNA, 22 bp, Homo sapiens
gtcctgtgccctgggtggcgct

SEQ ID NO: 8539244 - DNA, 22 bp, Homo sapiens
gtcctgtgccctgggtggcgct

SEQ ID NO: 8539245 - DNA, 22 bp, Homo sapiens
gtcctgtgcccagaccctctgt

SEQ ID NO: 8539246 - DNA, 22 bp, Homo sapiens
gtcctgtgcaccgtgggatgtt

SEQ ID NO: 8539247 - DNA, 22 bp, Homo sapiens
gtgagagggctgggctcatgat

SEQ ID NO: 8539248 - DNA, 22 bp, Homo sapiens
gtgagagtaccacctcaacatc

SEQ ID NO: 8539249 - DNA, 22 bp, Homo sapiens
gtgagagattgattgtagcggc

SEQ ID NO: 8539250 - DNA, 22 bp, Homo sapiens
gtgagagcctgtctggatgtcg

SEQ ID NO: 8539251 - DNA, 22 bp, Homo sapiens
gtgagagctcagctgccctggg

SEQ ID NO: 8539252 - DNA, 22 bp, Homo sapiens
gtgagagctgctagactgttat

SEQ ID NO: 8539253 - DNA, 22 bp, Homo sapiens
cagccaggagctccccctgctc

SEQ ID NO: 8539254 - DNA, 22 bp, Homo sapiens
cagccaggagcctctgcaacta

SEQ ID NO: 8539255 - DNA, 22 bp, Homo sapiens
cagccaggagcctctgcaacta

SEQ ID NO: 8539256 - DNA, 22 bp, Homo sapiens
cagccaggcccagatcatgctg

SEQ ID NO: 8539257 - DNA, 22 bp, Homo sapiens
cagccaggcccagatcatgctg

SEQ ID NO: 8539258 - DNA, 22 bp, Homo sapiens
cagccaggcccccgagtcgttg

SEQ ID NO: 8539259 - DNA, 22 bp, Homo sapiens
cagccaggatggagaactgttg

SEQ ID NO: 8539260 - DNA, 22 bp, Homo sapiens
cagccaggcccagatcatgctg

SEQ ID NO: 8539261 - DNA, 22 bp, Homo sapiens
gtccagagtagtcgagtattct

SEQ ID NO: 8539262 - DNA, 22 bp, Homo sapiens
gtccagagtattcaagtaactt

SEQ ID NO: 8539263 - DNA, 22 bp, Homo sapiens
gtccagcaggatgcaagtgcca

SEQ ID NO: 8539264 - DNA, 22 bp, Homo sapiens
cagccagaacctaggatgagct

SEQ ID NO: 8539265 - DNA, 22 bp, Homo sapiens
cagccagaacctaggatgagct

SEQ ID NO: 8539266 - DNA, 22 bp, Homo sapiens
cagccagcttcagatccaagcc

SEQ ID NO: 8539267 - DNA, 22 bp, Homo sapiens
cagccagcttcagatccaagcc

SEQ ID NO: 8539268 - DNA, 22 bp, Homo sapiens
cagccagcttcagatccaagcc

SEQ ID NO: 8539269 - DNA, 22 bp, Homo sapiens
cagccaggacagggaaactagt

SEQ ID NO: 8539270 - DNA, 22 bp, Homo sapiens
cagccagctgtcccaagtgcct

SEQ ID NO: 8539271 - DNA, 22 bp, Homo sapiens
cagccagctgtcccaagtgcct

SEQ ID NO: 8539272 - DNA, 22 bp, Homo sapiens
cagcatctggatttcctccact

SEQ ID NO: 8539273 - DNA, 22 bp, Homo sapiens
cagcatctggatttcctccact

SEQ ID NO: 8539274 - DNA, 19 bp, Homo sapiens
cagcatctgagccgtgtcc

SEQ ID NO: 8539275 - DNA, 22 bp, Homo sapiens
cagcatctgtaggactcctctt

SEQ ID NO: 8539276 - DNA, 22 bp, Homo sapiens
cagcatctggggaacattcaag

SEQ ID NO: 8539277 - DNA, 22 bp, Homo sapiens
cagcatctggggaacattcaag

SEQ ID NO: 8539278 - DNA, 22 bp, Homo sapiens
cagcatctgtatcctaggctga

SEQ ID NO: 8539279 - DNA, 22 bp, Homo sapiens
cagcatctgtaggactcctctt

SEQ ID NO: 8539280 - DNA, 22 bp, Homo sapiens
cagcatctgttcccaacgagat

SEQ ID NO: 8539281 - DNA, 22 bp, Homo sapiens
cagcatctgtatcctaggctga

SEQ ID NO: 8539282 - DNA, 22 bp, Homo sapiens
cagcatctgttggatggataag

SEQ ID NO: 8539283 - DNA, 22 bp, Homo sapiens
cagcatctgttcccaacgagat

SEQ ID NO: 8539284 - DNA, 22 bp, Homo sapiens
cagcatctgttggatggataag

SEQ ID NO: 8539285 - DNA, 22 bp, Homo sapiens
cagcatctgtttttctgaccca

SEQ ID NO: 8539286 - DNA, 22 bp, Homo sapiens
cagcatctctgcaccctccccc

SEQ ID NO: 8539287 - DNA, 22 bp, Homo sapiens
cagcatctctgcctgcctgcaa

SEQ ID NO: 8539288 - DNA, 22 bp, Homo sapiens
cagcatctctgcctgcctgcaa

SEQ ID NO: 8539289 - DNA, 22 bp, Homo sapiens
cagcatctctgcctgcctgcaa

SEQ ID NO: 8539290 - DNA, 22 bp, Homo sapiens
cagcatctcctgtgcagaggga

SEQ ID NO: 8539291 - DNA, 22 bp, Homo sapiens
cagcatctcctgtgcagaggga

SEQ ID NO: 8539292 - DNA, 22 bp, Homo sapiens
cagcatctctgcaccctccccc

SEQ ID NO: 8539293 - DNA, 22 bp, Homo sapiens
cagcatctcgtggctggataga

SEQ ID NO: 8539294 - DNA, 22 bp, Homo sapiens
cagcatctcgtggctggataga

SEQ ID NO: 8539295 - DNA, 22 bp, Homo sapiens
cagcatctctgggagaagcatc

SEQ ID NO: 8539296 - DNA, 22 bp, Homo sapiens
cagcatctctgggagaagcatc

SEQ ID NO: 8539297 - DNA, 22 bp, Homo sapiens
cagcatctctgggagaagcatc

SEQ ID NO: 8539298 - DNA, 22 bp, Homo sapiens
cagcatctctttttgcattcct

SEQ ID NO: 8539299 - DNA, 22 bp, Homo sapiens
cagcatctctttttgcattcct

SEQ ID NO: 8539300 - DNA, 22 bp, Homo sapiens
cagcatctgaccaatatctaca

SEQ ID NO: 8539301 - DNA, 19 bp, Homo sapiens
cagcatctgagccgtgtcc

SEQ ID NO: 8539302 - DNA, 22 bp, Homo sapiens
cagcatctgaccaatatctaca

SEQ ID NO: 8539303 - DNA, 22 bp, Homo sapiens
gtccagaggtccaggatcaagg

SEQ ID NO: 8539304 - DNA, 22 bp, Homo sapiens
gtccagaggtccaggatcaagg

SEQ ID NO: 8539305 - DNA, 22 bp, Homo sapiens
gtccagagggtcaagtttcttg

SEQ ID NO: 8539306 - DNA, 20 bp, Homo sapiens
gtccagagtaatgtgctgac

SEQ ID NO: 8539307 - DNA, 22 bp, Homo sapiens
gtccagagggctgcaggatgct

SEQ ID NO: 8539308 - DNA, 22 bp, Homo sapiens
gtccagagggctgcaggatgct

SEQ ID NO: 8539309 - DNA, 22 bp, Homo sapiens
gtccagagggctgcaggatgct

SEQ ID NO: 8539310 - DNA, 22 bp, Homo sapiens
gtccagagctggcacactgtca

SEQ ID NO: 8539311 - DNA, 22 bp, Homo sapiens
gtccagagagtaaagggggtaa

SEQ ID NO: 8539312 - DNA, 22 bp, Homo sapiens
gtccagagaggcaggaggctac

SEQ ID NO: 8539313 - DNA, 22 bp, Homo sapiens
gtccagagaggcaggaggctac

SEQ ID NO: 8539314 - DNA, 22 bp, Homo sapiens
cagcatctgtttttctgaccca

SEQ ID NO: 8539315 - DNA, 22 bp, Homo sapiens
gtccagagaggcaggaggctac

SEQ ID NO: 8539316 - DNA, 22 bp, Homo sapiens
gtccagagccggaagagtgaca

SEQ ID NO: 8539317 - DNA, 22 bp, Homo sapiens
gtccagagatggacgagcagat

SEQ ID NO: 8539318 - DNA, 22 bp, Homo sapiens
gtccagagccggaagagtgaca

SEQ ID NO: 8539319 - DNA, 22 bp, Homo sapiens
gtcagcaaaaaatttatgtgag

SEQ ID NO: 8539320 - DNA, 22 bp, Homo sapiens
gtcagcagaaacgccacatgca

SEQ ID NO: 8539321 - DNA, 21 bp, Homo sapiens
gtcagcagatccagcacttgt

SEQ ID NO: 8539322 - DNA, 22 bp, Homo sapiens
gtcagcagaaacgccacatgca

SEQ ID NO: 8539323 - DNA, 21 bp, Homo sapiens
gtcagcagatccagcacttgt

SEQ ID NO: 8539324 - DNA, 22 bp, Homo sapiens
gtcagcagggtccccttgagtg

SEQ ID NO: 8539325 - DNA, 22 bp, Homo sapiens
gtcagcagtgtcagctctgggg

SEQ ID NO: 8539326 - DNA, 22 bp, Homo sapiens
gtcagcagtgtcagctctgggg

SEQ ID NO: 8539327 - DNA, 22 bp, Homo sapiens
cagcatctaatcttcatgccgg

SEQ ID NO: 8539328 - DNA, 22 bp, Homo sapiens
cagcatcgtgtggaaagtggta

SEQ ID NO: 8539329 - DNA, 22 bp, Homo sapiens
cagcatctaatcttcatgccgg

SEQ ID NO: 8539330 - DNA, 22 bp, Homo sapiens
cagcatctcctgtgcagaggga

SEQ ID NO: 8539331 - DNA, 22 bp, Homo sapiens
cagcatctcccaggcatttgcc

SEQ ID NO: 8539332 - DNA, 22 bp, Homo sapiens
cagcatctcatttgacttctgc

SEQ ID NO: 8539333 - DNA, 22 bp, Homo sapiens
cagcatctcatttgacttctgc

SEQ ID NO: 8539334 - DNA, 22 bp, Homo sapiens
cagcatctccatggctttggag

SEQ ID NO: 8539335 - DNA, 22 bp, Homo sapiens
cagcatctccatggctttggag

SEQ ID NO: 8539336 - DNA, 22 bp, Homo sapiens
cagcatctcccaggcatttgcc

SEQ ID NO: 8539337 - DNA, 22 bp, Homo sapiens
cagcatctcattcattcatgtt

SEQ ID NO: 8539338 - DNA, 22 bp, Homo sapiens
cagcatctcattcattcatgtt

SEQ ID NO: 8539339 - DNA, 22 bp, Homo sapiens
cagcatctcatttgacttctgc

SEQ ID NO: 8539340 - DNA, 22 bp, Homo sapiens
cagcatctcattcattcatgtt

SEQ ID NO: 8539341 - DNA, 20 bp, Homo sapiens
cagcatctagtgagatttgc

SEQ ID NO: 8539342 - DNA, 20 bp, Homo sapiens
cagcatctagtgagatttgc

SEQ ID NO: 8539343 - DNA, 22 bp, Homo sapiens
cagcatctcacttcccagaagg

SEQ ID NO: 8539344 - DNA, 22 bp, Homo sapiens
cagcatctcacttcccagaagg

SEQ ID NO: 8539345 - DNA, 22 bp, Homo sapiens
cagcatctcacttcccagaagg

SEQ ID NO: 8539346 - DNA, 22 bp, Homo sapiens
gtcacaggcctggatgaggggc

SEQ ID NO: 8539347 - DNA, 22 bp, Homo sapiens
gtcacaggcctggatgaggggc

SEQ ID NO: 8539348 - DNA, 22 bp, Homo sapiens
gtcacagatctcttgagtcaag

SEQ ID NO: 8539349 - DNA, 18 bp, Homo sapiens
gtcacagcagagaactgc

SEQ ID NO: 8539350 - DNA, 22 bp, Homo sapiens
gtcacactagggccaagtggag

SEQ ID NO: 8539351 - DNA, 22 bp, Homo sapiens
gtaggctgtgtgaggctagaga

SEQ ID NO: 8539352 - DNA, 22 bp, Homo sapiens
gtattttacttacgcatgactt

SEQ ID NO: 8539353 - DNA, 22 bp, Homo sapiens
gtattttatggcatgcagtggc

SEQ ID NO: 8539354 - DNA, 22 bp, Homo sapiens
gtattttacttacgcatgactt

SEQ ID NO: 8539355 - DNA, 22 bp, Homo sapiens
gtcacacaggttgaaatgcagt

SEQ ID NO: 8539356 - DNA, 22 bp, Homo sapiens
gtcacacagggcctccaaatca

SEQ ID NO: 8539357 - DNA, 22 bp, Homo sapiens
gtcacacagggcctccaaatca

SEQ ID NO: 8539358 - DNA, 22 bp, Homo sapiens
gtcacacagagccctgtgctca

SEQ ID NO: 8539359 - DNA, 22 bp, Homo sapiens
gtcacacacatttctttggtgc

SEQ ID NO: 8539360 - DNA, 22 bp, Homo sapiens
gtcacacaatagtaagtggtcc

SEQ ID NO: 8539361 - DNA, 22 bp, Homo sapiens
gtcacacagagccctgtgctca

SEQ ID NO: 8539362 - DNA, 21 bp, Homo sapiens
gtcacacaggcctggagctga

SEQ ID NO: 8539363 - DNA, 21 bp, Homo sapiens
gtcacacaggcctggagctga

SEQ ID NO: 8539364 - DNA, 22 bp, Homo sapiens
cagcagccactagagggctcac

SEQ ID NO: 8539365 - DNA, 22 bp, Homo sapiens
cagcagcagccccaggaaggtt

SEQ ID NO: 8539366 - DNA, 22 bp, Homo sapiens
cagcagcagccccaggaaggtt

SEQ ID NO: 8539367 - DNA, 22 bp, Homo sapiens
cagcaaaggtagaagcacagga

SEQ ID NO: 8539368 - DNA, 22 bp, Homo sapiens
cagcaaaatttgaggattgcct

SEQ ID NO: 8539369 - DNA, 20 bp, Homo sapiens
cagcaaaatgaaaatggatt

SEQ ID NO: 8539370 - DNA, 22 bp, Homo sapiens
cagcagcctacaatgcacagaa

SEQ ID NO: 8539371 - DNA, 22 bp, Homo sapiens
cagcagcctacaatgcacagaa

SEQ ID NO: 8539372 - DNA, 22 bp, Homo sapiens
cagcagcctacaatgcacagaa

SEQ ID NO: 8539373 - DNA, 22 bp, Homo sapiens
cagcagcctacaatgcacagaa

SEQ ID NO: 8539374 - DNA, 22 bp, Homo sapiens
cagcagccctttggctgaactg

SEQ ID NO: 8539375 - DNA, 22 bp, Homo sapiens
cagcagcccacgcgtgctgtcc

SEQ ID NO: 8539376 - DNA, 22 bp, Homo sapiens
cagcagcccacgcgtgctgtcc

SEQ ID NO: 8539377 - DNA, 20 bp, Homo sapiens
cagcagccattctagtagta

SEQ ID NO: 8539378 - DNA, 22 bp, Homo sapiens
cagcagccatgtaccacactca

SEQ ID NO: 8539379 - DNA, 22 bp, Homo sapiens
cagcagccagacaagatacatc

SEQ ID NO: 8539380 - DNA, 22 bp, Homo sapiens
cagcagccactagagggctcac

SEQ ID NO: 8539381 - DNA, 22 bp, Homo sapiens
cagcaaaagccagcataagctc

SEQ ID NO: 8539382 - DNA, 22 bp, Homo sapiens
cagatttctttagcaagctaag

SEQ ID NO: 8539383 - DNA, 22 bp, Homo sapiens
cagatttaagatatttgtattg

SEQ ID NO: 8539384 - DNA, 22 bp, Homo sapiens
cagatttcagctcatatattat

SEQ ID NO: 8539385 - DNA, 22 bp, Homo sapiens
cagatttcagctcatatattat

SEQ ID NO: 8539386 - DNA, 22 bp, Homo sapiens
cagatttcaaggaggcactcca

SEQ ID NO: 8539387 - DNA, 22 bp, Homo sapiens
cagatttaagagataaacagtg

SEQ ID NO: 8539388 - DNA, 22 bp, Homo sapiens
cagattcttcattgccccattc

SEQ ID NO: 8539389 - DNA, 22 bp, Homo sapiens
cagattgagtctgggaaaaggc

SEQ ID NO: 8539390 - DNA, 22 bp, Homo sapiens
cagattccggtcatctctcctt

SEQ ID NO: 8539391 - DNA, 22 bp, Homo sapiens
cagattctcactgtattcaggt

SEQ ID NO: 8539392 - DNA, 22 bp, Homo sapiens
cagattccggtcatctctcctt

SEQ ID NO: 8539393 - DNA, 22 bp, Homo sapiens
cagattctccaggggctgcaga

SEQ ID NO: 8539394 - DNA, 20 bp, Homo sapiens
cagattctccactaacatat

SEQ ID NO: 8539395 - DNA, 22 bp, Homo sapiens
cagattccagtttgtggctccc

SEQ ID NO: 8539396 - DNA, 22 bp, Homo sapiens
gtagaaatatttatctctgaga

SEQ ID NO: 8539397 - DNA, 22 bp, Homo sapiens
gtaggcagggctgtggggagaa

SEQ ID NO: 8539398 - DNA, 22 bp, Homo sapiens
gtaggcagtctctcaggtgatc

SEQ ID NO: 8539399 - DNA, 22 bp, Homo sapiens
gtaggccatggtggttgtctct

SEQ ID NO: 8539400 - DNA, 22 bp, Homo sapiens
gtaggcagtggttggaagagaa

SEQ ID NO: 8539401 - DNA, 20 bp, Homo sapiens
gtaggcatatgaccaattac

SEQ ID NO: 8539402 - DNA, 22 bp, Homo sapiens
gtaggccagtgtgaaacctggt

SEQ ID NO: 8539403 - DNA, 22 bp, Homo sapiens
gtagaaaaagcagtaagtctca

SEQ ID NO: 8539404 - DNA, 22 bp, Homo sapiens
gtagaaaaagcagtaagtctca

SEQ ID NO: 8539405 - DNA, 22 bp, Homo sapiens
gtacttctggccaggctggcca

SEQ ID NO: 8539406 - DNA, 22 bp, Homo sapiens
gtacttcttaaattaggatcaa

SEQ ID NO: 8539407 - DNA, 22 bp, Homo sapiens
gtactttaaatcaatgtagatt

SEQ ID NO: 8539408 - DNA, 22 bp, Homo sapiens
gtactttaagactccagtagca

SEQ ID NO: 8539409 - DNA, 22 bp, Homo sapiens
gtactttagagtaaaatagacc

SEQ ID NO: 8539410 - DNA, 22 bp, Homo sapiens
gtactttagagtaaaatagacc

SEQ ID NO: 8539411 - DNA, 21 bp, Homo sapiens
gtacacagtggttctgaggga

SEQ ID NO: 8539412 - DNA, 22 bp, Homo sapiens
gtacacaggcagcccagtgctg

SEQ ID NO: 8539413 - DNA, 22 bp, Homo sapiens
gtacacaggcagcccagtgctg

SEQ ID NO: 8539414 - DNA, 22 bp, Homo sapiens
gtacacataggttactgattaa

SEQ ID NO: 8539415 - DNA, 22 bp, Homo sapiens
gtacacagatgcttgagaatct

SEQ ID NO: 8539416 - DNA, 22 bp, Homo sapiens
gtacacagatgcttgagaatct

SEQ ID NO: 8539417 - DNA, 22 bp, Homo sapiens
gtacacactgtttgatcatttc

SEQ ID NO: 8539418 - DNA, 22 bp, Homo sapiens
gtacacagagtggtggaagaaa

SEQ ID NO: 8539419 - DNA, 22 bp, Homo sapiens
gtacacagatgcttgagaatct

SEQ ID NO: 8539420 - DNA, 22 bp, Homo sapiens
gtacacagagtggtggaagaaa

SEQ ID NO: 8539421 - DNA, 22 bp, Homo sapiens
cagcagcctagaagctctacca

SEQ ID NO: 8539422 - DNA, 22 bp, Homo sapiens
cagcagcctagggttccatcat

SEQ ID NO: 8539423 - DNA, 22 bp, Homo sapiens
gtacacactatttaaagtgttt

SEQ ID NO: 8539424 - DNA, 22 bp, Homo sapiens
gtacacactgtttgatcatttc

SEQ ID NO: 8539425 - DNA, 22 bp, Homo sapiens
gtacacactatgtattgtacac

SEQ ID NO: 8539426 - DNA, 22 bp, Homo sapiens
gtactgaacttaaaaatcccct

SEQ ID NO: 8539427 - DNA, 22 bp, Homo sapiens
gtactgaataacaaagtctgtc

SEQ ID NO: 8539428 - DNA, 22 bp, Homo sapiens
gtacacatatttccaagggtaa

SEQ ID NO: 8539429 - DNA, 22 bp, Homo sapiens
gtacacatatttccaagggtaa

SEQ ID NO: 8539430 - DNA, 23 bp, Homo sapiens
gtacacatagtgtagttatattt

SEQ ID NO: 8539431 - DNA, 20 bp, Homo sapiens
gtacacatatatgtatgtgt

SEQ ID NO: 8539432 - DNA, 20 bp, Homo sapiens
gtacacatatatgtatgtgt

SEQ ID NO: 8539433 - DNA, 22 bp, Homo sapiens
gtacactattaaacctgctcat

SEQ ID NO: 8539434 - DNA, 22 bp, Homo sapiens
gtacactccccctgtgaagttg

SEQ ID NO: 8539435 - DNA, 22 bp, Homo sapiens
gtacacattgtctgtttacttc

SEQ ID NO: 8539436 - DNA, 22 bp, Homo sapiens
tctccagaggtcccttgtctct

SEQ ID NO: 8539437 - DNA, 20 bp, Homo sapiens
tctccagatgcagatgacat

SEQ ID NO: 8539438 - DNA, 22 bp, Homo sapiens
tctccagagtaaccttggagca

SEQ ID NO: 8539439 - DNA, 22 bp, Homo sapiens
tctccaggaaccatcatggtaa

SEQ ID NO: 8539440 - DNA, 22 bp, Homo sapiens
tctccaggaagccctccctgac

SEQ ID NO: 8539441 - DNA, 21 bp, Homo sapiens
ccagagagagggaagtgggtt

SEQ ID NO: 8539442 - DNA, 21 bp, Homo sapiens
ccagagagagggaagtgggtt

SEQ ID NO: 8539443 - DNA, 22 bp, Homo sapiens
tctccaggaaagacactggact

SEQ ID NO: 8539444 - DNA, 20 bp, Homo sapiens
tctccagatgcagatgacat

SEQ ID NO: 8539445 - DNA, 19 bp, Homo sapiens
tctccagctttgggctttt

SEQ ID NO: 8539446 - DNA, 22 bp, Homo sapiens
ccagagagagtactgggctctg

SEQ ID NO: 8539447 - DNA, 22 bp, Homo sapiens
ccagagagagtactgggctctg

SEQ ID NO: 8539448 - DNA, 21 bp, Homo sapiens
ccagagagagggaagtgggtt

SEQ ID NO: 8539449 - DNA, 22 bp, Homo sapiens
ccagagagagtactgggctctg

SEQ ID NO: 8539450 - DNA, 22 bp, Homo sapiens
ccagagagagtactgggctctg

SEQ ID NO: 8539451 - DNA, 22 bp, Homo sapiens
ccagagagctacaaggcataaa

SEQ ID NO: 8539452 - DNA, 22 bp, Homo sapiens
ccagagagctacaaggcataaa

SEQ ID NO: 8539453 - DNA, 19 bp, Homo sapiens
ccagagagctaggtacaga

SEQ ID NO: 8539454 - DNA, 19 bp, Homo sapiens
ccagagagctaggtacaga

SEQ ID NO: 8539455 - DNA, 19 bp, Homo sapiens
ccagagagctaggtacaga

SEQ ID NO: 8539456 - DNA, 22 bp, Homo sapiens
tctcccacggtacaggataaac

SEQ ID NO: 8539457 - DNA, 22 bp, Homo sapiens
tctcccacggtacaggataaac

SEQ ID NO: 8539458 - DNA, 22 bp, Homo sapiens
tctccctcattcctgcttccat

SEQ ID NO: 8539459 - DNA, 22 bp, Homo sapiens
tctccctctcagatttattcac

SEQ ID NO: 8539460 - DNA, 22 bp, Homo sapiens
tctccctctgtaagatcagggg

SEQ ID NO: 8539461 - DNA, 22 bp, Homo sapiens
tctccctctttgtctgctttgg

SEQ ID NO: 8539462 - DNA, 22 bp, Homo sapiens
tctccctctgtaagatcagggg

SEQ ID NO: 8539463 - DNA, 22 bp, Homo sapiens
tctcccacagtctcccatggct

SEQ ID NO: 8539464 - DNA, 22 bp, Homo sapiens
tctcccacagtctcccatggct

SEQ ID NO: 8539465 - DNA, 22 bp, Homo sapiens
ccagagaggccaaggtcgtggt

SEQ ID NO: 8539466 - DNA, 22 bp, Homo sapiens
ccagagaggccaaggtcgtggt

SEQ ID NO: 8539467 - DNA, 22 bp, Homo sapiens
ccagagaggccaaggtcgtggt

SEQ ID NO: 8539468 - DNA, 19 bp, Homo sapiens
ccagagagctaggtacaga

SEQ ID NO: 8539469 - DNA, 22 bp, Homo sapiens
tctccctctttgtctgctttgg

SEQ ID NO: 8539470 - DNA, 23 bp, Homo sapiens
tctccctgaggttgttagcatta

SEQ ID NO: 8539471 - DNA, 22 bp, Homo sapiens
tctccctggagccctgaagcat

SEQ ID NO: 8539472 - DNA, 22 bp, Homo sapiens
tctcccttggtcacagattcct

SEQ ID NO: 8539473 - DNA, 22 bp, Homo sapiens
tctcccttctctggattccgtt

SEQ ID NO: 8539474 - DNA, 16 bp, Homo sapiens
tctccctgttctccaa

SEQ ID NO: 8539475 - DNA, 22 bp, Homo sapiens
tctccgatcacaggttttcaat

SEQ ID NO: 8539476 - DNA, 16 bp, Homo sapiens
tctcccttgtcacctg

SEQ ID NO: 8539477 - DNA, 22 bp, Homo sapiens
ccacctctgagcccaaaccctg

SEQ ID NO: 8539478 - DNA, 22 bp, Homo sapiens
ccacctcctcggccatgtgacg

SEQ ID NO: 8539479 - DNA, 22 bp, Homo sapiens
ccacctcctcggccatgtgacg

SEQ ID NO: 8539480 - DNA, 22 bp, Homo sapiens
ccacctcctaggcctggagaag

SEQ ID NO: 8539481 - DNA, 22 bp, Homo sapiens
ccacctcctaggcctggagaag

SEQ ID NO: 8539482 - DNA, 22 bp, Homo sapiens
ccacctcctaggcctggagaag

SEQ ID NO: 8539483 - DNA, 22 bp, Homo sapiens
ccacctccacctattgccagcc

SEQ ID NO: 8539484 - DNA, 22 bp, Homo sapiens
ccacctccacctattgccagcc

SEQ ID NO: 8539485 - DNA, 22 bp, Homo sapiens
ccacctccacctattgccagcc

SEQ ID NO: 8539486 - DNA, 22 bp, Homo sapiens
ccacctccacctattgccagcc

SEQ ID NO: 8539487 - DNA, 16 bp, Homo sapiens
ccacctgcagctctca

SEQ ID NO: 8539488 - DNA, 22 bp, Homo sapiens
ccacctgagataagagagctca

SEQ ID NO: 8539489 - DNA, 22 bp, Homo sapiens
ccacctcctcggccatgtgacg

SEQ ID NO: 8539490 - DNA, 22 bp, Homo sapiens
tctcaagcttgttggtatgttt

SEQ ID NO: 8539491 - DNA, 22 bp, Homo sapiens
tctcaagcttgttggtatgttt

SEQ ID NO: 8539492 - DNA, 22 bp, Homo sapiens
tctcaagagggaggcaatcatg

SEQ ID NO: 8539493 - DNA, 22 bp, Homo sapiens
tctcaacaccacttgctgaaga

SEQ ID NO: 8539494 - DNA, 22 bp, Homo sapiens
tctcaaatttgttagataaaat

SEQ ID NO: 8539495 - DNA, 22 bp, Homo sapiens
tctcaaatttatacagagttca

SEQ ID NO: 8539496 - DNA, 22 bp, Homo sapiens
tctcagtttcctcatatgtaaa

SEQ ID NO: 8539497 - DNA, 22 bp, Homo sapiens
ccagaaaaatcctcccttgtcc

SEQ ID NO: 8539498 - DNA, 20 bp, Homo sapiens
tctcagtttctagagtcagg

SEQ ID NO: 8539499 - DNA, 20 bp, Homo sapiens
tctcagtttctagagtcagg

SEQ ID NO: 8539500 - DNA, 22 bp, Homo sapiens
tctccacactttctctcccagg

SEQ ID NO: 8539501 - DNA, 22 bp, Homo sapiens
tctccactattttctagctctt

SEQ ID NO: 8539502 - DNA, 22 bp, Homo sapiens
tctccacaccagaaggagctga

SEQ ID NO: 8539503 - DNA, 22 bp, Homo sapiens
tctccacaccagaaggagctga

SEQ ID NO: 8539504 - DNA, 22 bp, Homo sapiens
tctccacaccagaaggagctga

SEQ ID NO: 8539505 - DNA, 22 bp, Homo sapiens
ccacttgacattttcattaaga

SEQ ID NO: 8539506 - DNA, 22 bp, Homo sapiens
ccacttgacaataaactgagct

SEQ ID NO: 8539507 - DNA, 22 bp, Homo sapiens
ccacttgaaatatctttgttct

SEQ ID NO: 8539508 - DNA, 22 bp, Homo sapiens
ccacttgaaacttagtggcata

SEQ ID NO: 8539509 - DNA, 22 bp, Homo sapiens
ccacttgaaacttagtggcata

SEQ ID NO: 8539510 - DNA, 22 bp, Homo sapiens
ccacttgaatcaaattcttagg

SEQ ID NO: 8539511 - DNA, 22 bp, Homo sapiens
ccacttgaatcaaattcttagg

SEQ ID NO: 8539512 - DNA, 22 bp, Homo sapiens
ccacttgaattttagtggtttt

SEQ ID NO: 8539513 - DNA, 22 bp, Homo sapiens
ccactttctgagggaacagcag

SEQ ID NO: 8539514 - DNA, 22 bp, Homo sapiens
ccacttttgggaacagtgagta

SEQ ID NO: 8539515 - DNA, 22 bp, Homo sapiens
tcctgaatttcccagcatgaac

SEQ ID NO: 8539516 - DNA, 22 bp, Homo sapiens
tcctgaattgttgagaagcagc

SEQ ID NO: 8539517 - DNA, 22 bp, Homo sapiens
tcctgaattgaactcagttaat

SEQ ID NO: 8539518 - DNA, 22 bp, Homo sapiens
tcctgaatccaggagagtaggg

SEQ ID NO: 8539519 - DNA, 22 bp, Homo sapiens
tcctgaatgagttgatcacaat

SEQ ID NO: 8539520 - DNA, 22 bp, Homo sapiens
tcctgaattcctctttgcatcc

SEQ ID NO: 8539521 - DNA, 22 bp, Homo sapiens
tcctgaataaattagctgtcac

SEQ ID NO: 8539522 - DNA, 22 bp, Homo sapiens
tcctgaagtcacaggctctgag

SEQ ID NO: 8539523 - DNA, 22 bp, Homo sapiens
tcctgaagtatgggtatggagt

SEQ ID NO: 8539524 - DNA, 22 bp, Homo sapiens
tcctgaaggcctgagttccacc

SEQ ID NO: 8539525 - DNA, 22 bp, Homo sapiens
tcctctgccaaagggagttgcc

SEQ ID NO: 8539526 - DNA, 21 bp, Homo sapiens
tcctctgcagtgaggtggcct

SEQ ID NO: 8539527 - DNA, 21 bp, Homo sapiens
tcctctgcagtgaggtggcct

SEQ ID NO: 8539528 - DNA, 22 bp, Homo sapiens
tcctctgaatgtacttcataat

SEQ ID NO: 8539529 - DNA, 22 bp, Homo sapiens
tcctctgactcacagcctgggg

SEQ ID NO: 8539530 - DNA, 22 bp, Homo sapiens
tcctctgacttctggttgagtt

SEQ ID NO: 8539531 - DNA, 22 bp, Homo sapiens
tcctctgaaatctagattgtga

SEQ ID NO: 8539532 - DNA, 22 bp, Homo sapiens
tcctctccatgtctcacgccac

SEQ ID NO: 8539533 - DNA, 22 bp, Homo sapiens
tcctctctgcactggccctgcc

SEQ ID NO: 8539534 - DNA, 20 bp, Homo sapiens
tcctgaatttcctttctgct

SEQ ID NO: 8539535 - DNA, 22 bp, Homo sapiens
tcctgactaggagggctaaggt

SEQ ID NO: 8539536 - DNA, 22 bp, Homo sapiens
ccacagtgagttctgtactctg

SEQ ID NO: 8539537 - DNA, 22 bp, Homo sapiens
ccacatgctcaccaagtccctg

SEQ ID NO: 8539538 - DNA, 22 bp, Homo sapiens
ccacatgctctctctccaggtt

SEQ ID NO: 8539539 - DNA, 22 bp, Homo sapiens
ccacatgctctctctccaggtt

SEQ ID NO: 8539540 - DNA, 22 bp, Homo sapiens
ccacatgaatcttggaagcagg

SEQ ID NO: 8539541 - DNA, 22 bp, Homo sapiens
ccacatgaaattgcttatattt

SEQ ID NO: 8539542 - DNA, 22 bp, Homo sapiens
ccacatgatgaggaagctgaac

SEQ ID NO: 8539543 - DNA, 20 bp, Homo sapiens
ccacatgagctctttctgac

SEQ ID NO: 8539544 - DNA, 22 bp, Homo sapiens
ccacatgagctggcaatgccct

SEQ ID NO: 8539545 - DNA, 22 bp, Homo sapiens
ccacatctgttcttagttctga

SEQ ID NO: 8539546 - DNA, 22 bp, Homo sapiens
ccacatctcggtcccctctttg

SEQ ID NO: 8539547 - DNA, 22 bp, Homo sapiens
ccacatttactggatgctcagg

SEQ ID NO: 8539548 - DNA, 22 bp, Homo sapiens
ccacatttggagaagatacttt

SEQ ID NO: 8539549 - DNA, 22 bp, Homo sapiens
ccacatggagcaggaggtgggg

SEQ ID NO: 8539550 - DNA, 22 bp, Homo sapiens
ccacatggagcaggaggtgggg

SEQ ID NO: 8539551 - DNA, 23 bp, Homo sapiens
ccacatggcaagatgatgcattc

SEQ ID NO: 8539552 - DNA, 19 bp, Homo sapiens
ccacatggctggatgacag

SEQ ID NO: 8539553 - DNA, 22 bp, Homo sapiens
ccacatgtgcactgctgtatgg

SEQ ID NO: 8539554 - DNA, 22 bp, Homo sapiens
ccacatgtgcactgctgtatgg

SEQ ID NO: 8539555 - DNA, 22 bp, Homo sapiens
ccaccctgggttctgatgtgga

SEQ ID NO: 8539556 - DNA, 22 bp, Homo sapiens
ccaccctgggttctgatgtgga

SEQ ID NO: 8539557 - DNA, 22 bp, Homo sapiens
ccaccctggacaggcctctgag

SEQ ID NO: 8539558 - DNA, 23 bp, Homo sapiens
tcggtgggcgtggaggccgaggc

SEQ ID NO: 8539559 - DNA, 23 bp, Homo sapiens
tcggtgggcgtggaggccgaggc

SEQ ID NO: 8539560 - DNA, 22 bp, Homo sapiens
ccaccctggacaggcctctgag

SEQ ID NO: 8539561 - DNA, 22 bp, Homo sapiens
ccaccctggactcgaggcccga

SEQ ID NO: 8539562 - DNA, 22 bp, Homo sapiens
ccacccttgggttcggaggccg

SEQ ID NO: 8539563 - DNA, 22 bp, Homo sapiens
ccacccttgggttcggaggccg

SEQ ID NO: 8539564 - DNA, 22 bp, Homo sapiens
ccacccttgggttcggaggccg

SEQ ID NO: 8539565 - DNA, 22 bp, Homo sapiens
ccacccttccattcttcctctt

SEQ ID NO: 8539566 - DNA, 22 bp, Homo sapiens
ccaccctgtgcaggcgtgggta

SEQ ID NO: 8539567 - DNA, 22 bp, Homo sapiens
ccaccctgtgtttttgccattg

SEQ ID NO: 8539568 - DNA, 22 bp, Homo sapiens
ccaccctgtgtttttgccattg

SEQ ID NO: 8539569 - DNA, 22 bp, Homo sapiens
ccaccctgtgcaggcgtgggta

SEQ ID NO: 8539570 - DNA, 22 bp, Homo sapiens
tcgggctcgctctcctagcgga

SEQ ID NO: 8539571 - DNA, 22 bp, Homo sapiens
tcggccacggggtttcctccaa

SEQ ID NO: 8539572 - DNA, 22 bp, Homo sapiens
tcggggtctttgacacgctctg

SEQ ID NO: 8539573 - DNA, 22 bp, Homo sapiens
tcggggtctttgacacgctctg

SEQ ID NO: 8539574 - DNA, 22 bp, Homo sapiens
tcggagctgtagatgaaaccct

SEQ ID NO: 8539575 - DNA, 22 bp, Homo sapiens
tcggagagttggaagtagcaga

SEQ ID NO: 8539576 - DNA, 22 bp, Homo sapiens
tcggagagttcatgaagacccg

SEQ ID NO: 8539577 - DNA, 22 bp, Homo sapiens
tcggagagttggaagtagcaga

SEQ ID NO: 8539578 - DNA, 22 bp, Homo sapiens
tcggagagctcacagctgtggc

SEQ ID NO: 8539579 - DNA, 22 bp, Homo sapiens
tcgctgtggtttctgtacatgg

SEQ ID NO: 8539580 - DNA, 22 bp, Homo sapiens
tcgctgtggtttctgtacatgg

SEQ ID NO: 8539581 - DNA, 22 bp, Homo sapiens
tcgctttaatggtcttcacagc

SEQ ID NO: 8539582 - DNA, 22 bp, Homo sapiens
tcgcgggttgcacatggccatc

SEQ ID NO: 8539583 - DNA, 22 bp, Homo sapiens
tcgctgaggctgcacggctgcc

SEQ ID NO: 8539584 - DNA, 22 bp, Homo sapiens
tcgctgaggctgcacggctgcc

SEQ ID NO: 8539585 - DNA, 22 bp, Homo sapiens
tcgctgaggctgcacggctgcc

SEQ ID NO: 8539586 - DNA, 22 bp, Homo sapiens
ccaccagctttggcggtgacag

SEQ ID NO: 8539587 - DNA, 22 bp, Homo sapiens
ccaccagctttgccaccctgct

SEQ ID NO: 8539588 - DNA, 22 bp, Homo sapiens
ccaccagctttgccaccctgct

SEQ ID NO: 8539589 - DNA, 22 bp, Homo sapiens
ccaccagctttgccaccctgct

SEQ ID NO: 8539590 - DNA, 18 bp, Homo sapiens
tcctttcaccccttctct

SEQ ID NO: 8539591 - DNA, 22 bp, Homo sapiens
tcctttccagcctcacctcagc

SEQ ID NO: 8539592 - DNA, 22 bp, Homo sapiens
ccaccaagtcccactataattt

SEQ ID NO: 8539593 - DNA, 22 bp, Homo sapiens
ccaccacttctggcttctggtg

SEQ ID NO: 8539594 - DNA, 22 bp, Homo sapiens
ccaccagcttcagcagccgcgg

SEQ ID NO: 8539595 - DNA, 22 bp, Homo sapiens
ccaccagctgcatatgcacgta

SEQ ID NO: 8539596 - DNA, 22 bp, Homo sapiens
ccaccagctgcatatgcacgta

SEQ ID NO: 8539597 - DNA, 22 bp, Homo sapiens
ccaccagcttcagcagccgcgg

SEQ ID NO: 8539598 - DNA, 22 bp, Homo sapiens
ccaccagcttcagcagccgcgg

SEQ ID NO: 8539599 - DNA, 22 bp, Homo sapiens
ccaccagcttcagcagccgcgg

SEQ ID NO: 8539600 - DNA, 22 bp, Homo sapiens
ccaccagcagtgtgcaaggatt

SEQ ID NO: 8539601 - DNA, 21 bp, Homo sapiens
tctctgggaggacttgtgaga

SEQ ID NO: 8539602 - DNA, 21 bp, Homo sapiens
tctctgggaggacttgtgaga

SEQ ID NO: 8539603 - DNA, 21 bp, Homo sapiens
tctctgggaggacttgtgaga

SEQ ID NO: 8539604 - DNA, 22 bp, Homo sapiens
ccagcactctgtcccagcttcc

SEQ ID NO: 8539605 - DNA, 22 bp, Homo sapiens
tctctgggagttgagcagcagc

SEQ ID NO: 8539606 - DNA, 22 bp, Homo sapiens
tctctgggagttgagcagcagc

SEQ ID NO: 8539607 - DNA, 22 bp, Homo sapiens
tctctgggacactgggtcagtt

SEQ ID NO: 8539608 - DNA, 22 bp, Homo sapiens
tctctgggaattttttggacat

SEQ ID NO: 8539609 - DNA, 22 bp, Homo sapiens
tctctgggaatgggcctgggta

SEQ ID NO: 8539610 - DNA, 22 bp, Homo sapiens
tctctgggaatgggcctgggta

SEQ ID NO: 8539611 - DNA, 22 bp, Homo sapiens
tctctgcccatcctcagtccac

SEQ ID NO: 8539612 - DNA, 22 bp, Homo sapiens
tctctgcccatcctcagtccac

SEQ ID NO: 8539613 - DNA, 22 bp, Homo sapiens
tctctgcccatcctcagtccac

SEQ ID NO: 8539614 - DNA, 22 bp, Homo sapiens
tctctgcccaagtttctcaagt

SEQ ID NO: 8539615 - DNA, 22 bp, Homo sapiens
tctctgccaccatgagatgggc

SEQ ID NO: 8539616 - DNA, 22 bp, Homo sapiens
tctctgccacagcttctgcctt

SEQ ID NO: 8539617 - DNA, 22 bp, Homo sapiens
tctctgccacagcttctgcctt

SEQ ID NO: 8539618 - DNA, 22 bp, Homo sapiens
tctctgatgtatatcagagaac

SEQ ID NO: 8539619 - DNA, 20 bp, Homo sapiens
tctctgagtttcctaatttg

SEQ ID NO: 8539620 - DNA, 22 bp, Homo sapiens
tctctcttgtcaccccatctgc

SEQ ID NO: 8539621 - DNA, 22 bp, Homo sapiens
tctctcttgtcaccccatctgc

SEQ ID NO: 8539622 - DNA, 22 bp, Homo sapiens
tctctcttgtcaccccatctgc

SEQ ID NO: 8539623 - DNA, 22 bp, Homo sapiens
tctctcttgtcaccccatctgc

SEQ ID NO: 8539624 - DNA, 23 bp, Homo sapiens
tctcctggctgcactgtggccac

SEQ ID NO: 8539625 - DNA, 22 bp, Homo sapiens
tctcctggctcaccaggctgga

SEQ ID NO: 8539626 - DNA, 22 bp, Homo sapiens
tctcctggctcaccaggctgga

SEQ ID NO: 8539627 - DNA, 22 bp, Homo sapiens
tctcctggccgggctgtcccct

SEQ ID NO: 8539628 - DNA, 22 bp, Homo sapiens
tctcctggctctaaaaggctgt

SEQ ID NO: 8539629 - DNA, 23 bp, Homo sapiens
tctcctggctgcactgtggccac

SEQ ID NO: 8539630 - DNA, 23 bp, Homo sapiens
tctcctggctgcactgtggccac

SEQ ID NO: 8539631 - DNA, 22 bp, Homo sapiens
ccagcagctgcaaagcctgggt

SEQ ID NO: 8539632 - DNA, 22 bp, Homo sapiens
ccagcagctgcaaagcctgggt

SEQ ID NO: 8539633 - DNA, 22 bp, Homo sapiens
ccagcagctgacaccagtccca

SEQ ID NO: 8539634 - DNA, 22 bp, Homo sapiens
ccagcagctccctcagggtccg

SEQ ID NO: 8539635 - DNA, 21 bp, Homo sapiens
ccagcagctcaaggatctctt

SEQ ID NO: 8539636 - DNA, 22 bp, Homo sapiens
ccagcagggcagtgccctggac

SEQ ID NO: 8539637 - DNA, 22 bp, Homo sapiens
ccagcagggcagtgccctggac

SEQ ID NO: 8539638 - DNA, 22 bp, Homo sapiens
ccagcagggcagtgccctggac

SEQ ID NO: 8539639 - DNA, 22 bp, Homo sapiens
ccagcagggaaaaacccaccaa

SEQ ID NO: 8539640 - DNA, 22 bp, Homo sapiens
ccagcagggcagtgccctggac

SEQ ID NO: 8539641 - DNA, 22 bp, Homo sapiens
ccagcagctttattggctctcc

SEQ ID NO: 8539642 - DNA, 22 bp, Homo sapiens
ccagcagctttattggctctcc

SEQ ID NO: 8539643 - DNA, 22 bp, Homo sapiens
ccagcagctttattggctctcc

SEQ ID NO: 8539644 - DNA, 22 bp, Homo sapiens
ccagcagctttattggctctcc

SEQ ID NO: 8539645 - DNA, 19 bp, Homo sapiens
ccagcagctttgattctct

SEQ ID NO: 8539646 - DNA, 22 bp, Homo sapiens
ccagcagctgtggctttgcctc

SEQ ID NO: 8539647 - DNA, 22 bp, Homo sapiens
ccagcagctgctatgtggtttt

SEQ ID NO: 8539648 - DNA, 22 bp, Homo sapiens
ccagcagctgtggctttgcctc

SEQ ID NO: 8539649 - DNA, 22 bp, Homo sapiens
ccagcagagggtcttggccatt

SEQ ID NO: 8539650 - DNA, 22 bp, Homo sapiens
ccagcagagggtcttggccatt

SEQ ID NO: 8539651 - DNA, 22 bp, Homo sapiens
ccagcactgctctcagactgag

SEQ ID NO: 8539652 - DNA, 22 bp, Homo sapiens
ccagcagagtctaggaaggagg

SEQ ID NO: 8539653 - DNA, 22 bp, Homo sapiens
ccagcagagtctaggaaggagg

SEQ ID NO: 8539654 - DNA, 22 bp, Homo sapiens
ccagcagagggtcttggccatt

SEQ ID NO: 8539655 - DNA, 22 bp, Homo sapiens
ccagcagcagcgtccaaggaga

SEQ ID NO: 8539656 - DNA, 22 bp, Homo sapiens
ccagcagcagcgtccaaggaga

SEQ ID NO: 8539657 - DNA, 22 bp, Homo sapiens
ccagcagagttggtttctggta

SEQ ID NO: 8539658 - DNA, 22 bp, Homo sapiens
ccagcagagtggggtttagagt

SEQ ID NO: 8539659 - DNA, 22 bp, Homo sapiens
ccagcagccaccttctcgaaat

SEQ ID NO: 8539660 - DNA, 22 bp, Homo sapiens
ccagcagcatcctgcagcactt

SEQ ID NO: 8539661 - DNA, 22 bp, Homo sapiens
ccagcagcaggccaggccctcc

SEQ ID NO: 8539662 - DNA, 22 bp, Homo sapiens
ccagcagcccacaggcgtccct

SEQ ID NO: 8539663 - DNA, 22 bp, Homo sapiens
ccagcagcgatagggtgagtgc

SEQ ID NO: 8539664 - DNA, 22 bp, Homo sapiens
ccagcagcgatagggtgagtgc

SEQ ID NO: 8539665 - DNA, 22 bp, Homo sapiens
ccagcagcgatagggtgagtgc

SEQ ID NO: 8539666 - DNA, 22 bp, Homo sapiens
ccagcagccctcttccaagact

SEQ ID NO: 8539667 - DNA, 22 bp, Homo sapiens
ccagcagccctcttccaagact

SEQ ID NO: 8539668 - DNA, 19 bp, Homo sapiens
tctgaattatttatgtacc

SEQ ID NO: 8539669 - DNA, 18 bp, Homo sapiens
tctgaatattatgcagtg

SEQ ID NO: 8539670 - DNA, 22 bp, Homo sapiens
tctgaatatgtttatcatctct

SEQ ID NO: 8539671 - DNA, 19 bp, Homo sapiens
tctgaagtccagggcatac

SEQ ID NO: 8539672 - DNA, 22 bp, Homo sapiens
tctgaataatgtccttgtatca

SEQ ID NO: 8539673 - DNA, 22 bp, Homo sapiens
tctgaagttcttaaattagttt

SEQ ID NO: 8539674 - DNA, 22 bp, Homo sapiens
tctgaagttcttaaattagttt

SEQ ID NO: 8539675 - DNA, 22 bp, Homo sapiens
tctgaatatgtttatcatctct

SEQ ID NO: 8539676 - DNA, 22 bp, Homo sapiens
tctgaatatgtttatcatctct

SEQ ID NO: 8539677 - DNA, 22 bp, Homo sapiens
tctgaatagttctattttaaag

SEQ ID NO: 8539678 - DNA, 22 bp, Homo sapiens
tctgaatagttctattttaaag

SEQ ID NO: 8539679 - DNA, 22 bp, Homo sapiens
tctgaatagtatattgaaagca

SEQ ID NO: 8539680 - DNA, 22 bp, Homo sapiens
tctgaatagagagaggtccttt

SEQ ID NO: 8539681 - DNA, 22 bp, Homo sapiens
tctgaattctgacaatttgaat

SEQ ID NO: 8539682 - DNA, 22 bp, Homo sapiens
ccagcatccatgctccctcggg

SEQ ID NO: 8539683 - DNA, 22 bp, Homo sapiens
ccagcatccctggggttggcca

SEQ ID NO: 8539684 - DNA, 22 bp, Homo sapiens
ccagcatcctcagctcacttct

SEQ ID NO: 8539685 - DNA, 22 bp, Homo sapiens
ccagcatcagtcagattttgct

SEQ ID NO: 8539686 - DNA, 22 bp, Homo sapiens
ccagcatcgacttcctgcctga

SEQ ID NO: 8539687 - DNA, 22 bp, Homo sapiens
ccagcatcgacttcctgcctga

SEQ ID NO: 8539688 - DNA, 22 bp, Homo sapiens
ccagcatctaacgctcctggga

SEQ ID NO: 8539689 - DNA, 22 bp, Homo sapiens
ccagcatgagacgatgatgaag

SEQ ID NO: 8539690 - DNA, 22 bp, Homo sapiens
ccagcatgagacgatgatgaag

SEQ ID NO: 8539691 - DNA, 22 bp, Homo sapiens
ccagcatctatgtgctgttgat

SEQ ID NO: 8539692 - DNA, 22 bp, Homo sapiens
ccagcatctgtcctttccctca

SEQ ID NO: 8539693 - DNA, 18 bp, Homo sapiens
ccagcatgccagaggctg

SEQ ID NO: 8539694 - DNA, 18 bp, Homo sapiens
ccagcatgccagaggctg

SEQ ID NO: 8539695 - DNA, 22 bp, Homo sapiens
tctgaaatgacctttccccact

SEQ ID NO: 8539696 - DNA, 22 bp, Homo sapiens
tctgaaatgaactcttgaactt

SEQ ID NO: 8539697 - DNA, 22 bp, Homo sapiens
tctgaaatgacctttccccact

SEQ ID NO: 8539698 - DNA, 22 bp, Homo sapiens
tctcttaaatacttcacatctc

SEQ ID NO: 8539699 - DNA, 22 bp, Homo sapiens
tctctgttcatggcactatgtc

SEQ ID NO: 8539700 - DNA, 22 bp, Homo sapiens
tctctgttcatggcactatgtc

SEQ ID NO: 8539701 - DNA, 22 bp, Homo sapiens
tctcttaaaagagtaatagaga

SEQ ID NO: 8539702 - DNA, 22 bp, Homo sapiens
tctctgttcatggcactatgtc

SEQ ID NO: 8539703 - DNA, 22 bp, Homo sapiens
tctctgtgttgcaggaaaatct

SEQ ID NO: 8539704 - DNA, 22 bp, Homo sapiens
tctctgtgtgtgtgacagcatt

SEQ ID NO: 8539705 - DNA, 22 bp, Homo sapiens
tctctgtgtgtgtgacagcatt

SEQ ID NO: 8539706 - DNA, 22 bp, Homo sapiens
tctctgtgtgttggctgtatat

SEQ ID NO: 8539707 - DNA, 22 bp, Homo sapiens
tctctgtgtgttggctgtatat

SEQ ID NO: 8539708 - DNA, 22 bp, Homo sapiens
tctctgtgtgttggctgtatat

SEQ ID NO: 8539709 - DNA, 21 bp, Homo sapiens
tctctgtgttcaaggtgccag

SEQ ID NO: 8539710 - DNA, 22 bp, Homo sapiens
tctctgtgtgttggctgtatat

SEQ ID NO: 8539711 - DNA, 22 bp, Homo sapiens
tctctgtgtgttggctgtatat

SEQ ID NO: 8539712 - DNA, 22 bp, Homo sapiens
ccagcagggttggtttcttctg

SEQ ID NO: 8539713 - DNA, 22 bp, Homo sapiens
ccagcaggtgtagggctcatgg

SEQ ID NO: 8539714 - DNA, 22 bp, Homo sapiens
ccagcatcagcacccaaggagc

SEQ ID NO: 8539715 - DNA, 22 bp, Homo sapiens
ccagcatcagcattgtcttagg

SEQ ID NO: 8539716 - DNA, 22 bp, Homo sapiens
ccagcatcagcattgtcttagg

SEQ ID NO: 8539717 - DNA, 19 bp, Homo sapiens
ccagcaggttcatttcagg

SEQ ID NO: 8539718 - DNA, 22 bp, Homo sapiens
tctctgtgtgggagatcttttt

SEQ ID NO: 8539719 - DNA, 22 bp, Homo sapiens
tctctgtgtgccttcatctgcc

SEQ ID NO: 8539720 - DNA, 22 bp, Homo sapiens
ccagcccttcccaactggccag

SEQ ID NO: 8539721 - DNA, 22 bp, Homo sapiens
ccagcccttcccaactggccag

SEQ ID NO: 8539722 - DNA, 22 bp, Homo sapiens
ccagcccttagataaacctggc

SEQ ID NO: 8539723 - DNA, 19 bp, Homo sapiens
ccagccctgtcacttcttg

SEQ ID NO: 8539724 - DNA, 22 bp, Homo sapiens
ccagccctgtttatgtgtcact

SEQ ID NO: 8539725 - DNA, 22 bp, Homo sapiens
ccagccctgtcaccaactggag

SEQ ID NO: 8539726 - DNA, 22 bp, Homo sapiens
ccagccctgtcaccaactggag

SEQ ID NO: 8539727 - DNA, 19 bp, Homo sapiens
ccagccctgtcacttcttg

SEQ ID NO: 8539728 - DNA, 22 bp, Homo sapiens
ccagccctgtcaccaactggag

SEQ ID NO: 8539729 - DNA, 22 bp, Homo sapiens
ccagccctgtaaggatgaggca

SEQ ID NO: 8539730 - DNA, 22 bp, Homo sapiens
ccagccctgtcaccaactggag

SEQ ID NO: 8539731 - DNA, 22 bp, Homo sapiens
ccagccctgcctctcagggccc

SEQ ID NO: 8539732 - DNA, 22 bp, Homo sapiens
ccagccctgcctctcagggccc

SEQ ID NO: 8539733 - DNA, 22 bp, Homo sapiens
ccagccctgcctctcagggccc

SEQ ID NO: 8539734 - DNA, 22 bp, Homo sapiens
ccagccaccgcttgtttgcact

SEQ ID NO: 8539735 - DNA, 22 bp, Homo sapiens
ccagccctcactgaggcctctc

SEQ ID NO: 8539736 - DNA, 22 bp, Homo sapiens
ccagccctcactgaggcctctc

SEQ ID NO: 8539737 - DNA, 20 bp, Homo sapiens
ccagcatgtacacatgtgga

SEQ ID NO: 8539738 - DNA, 20 bp, Homo sapiens
ccagcatgtacacatgtgga

SEQ ID NO: 8539739 - DNA, 22 bp, Homo sapiens
ccagcatggcacctgagatgag

SEQ ID NO: 8539740 - DNA, 22 bp, Homo sapiens
ccagcatggcacctgagatgag

SEQ ID NO: 8539741 - DNA, 22 bp, Homo sapiens
ccagcatttgcttctggtgggg

SEQ ID NO: 8539742 - DNA, 22 bp, Homo sapiens
ccagccacagcttccagctcct

SEQ ID NO: 8539743 - DNA, 22 bp, Homo sapiens
ccagcattcacactggttcctt

SEQ ID NO: 8539744 - DNA, 22 bp, Homo sapiens
tctgcagaattcgaggaagaaa

SEQ ID NO: 8539745 - DNA, 22 bp, Homo sapiens
tctgcagaattcgaggaagaaa

SEQ ID NO: 8539746 - DNA, 22 bp, Homo sapiens
tctgcagaaggaatcagctgag

SEQ ID NO: 8539747 - DNA, 22 bp, Homo sapiens
tctgcagaaggaatcagctgag

SEQ ID NO: 8539748 - DNA, 22 bp, Homo sapiens
tctgatatcgcactaaactctg

SEQ ID NO: 8539749 - DNA, 22 bp, Homo sapiens
tctgatataaaagtgacattca

SEQ ID NO: 8539750 - DNA, 22 bp, Homo sapiens
ccagcccttcccaactggccag

SEQ ID NO: 8539751 - DNA, 22 bp, Homo sapiens
catttgtacagaacagctttat

SEQ ID NO: 8539752 - DNA, 22 bp, Homo sapiens
catttgtacagaacagctttat

SEQ ID NO: 8539753 - DNA, 22 bp, Homo sapiens
catttgtagctatttactgtat

SEQ ID NO: 8539754 - DNA, 22 bp, Homo sapiens
tcctcagggaagatgagcctca

SEQ ID NO: 8539755 - DNA, 22 bp, Homo sapiens
tcctcagggaagatgagcctca

SEQ ID NO: 8539756 - DNA, 22 bp, Homo sapiens
tcctcaggctgcctggaagact

SEQ ID NO: 8539757 - DNA, 22 bp, Homo sapiens
tcctcaggctgcctggaagact

SEQ ID NO: 8539758 - DNA, 22 bp, Homo sapiens
tcctcaggctgcctggaagact

SEQ ID NO: 8539759 - DNA, 22 bp, Homo sapiens
tcctcccctcagggcaacggat

SEQ ID NO: 8539760 - DNA, 22 bp, Homo sapiens
catttgtatgttcctccttagg

SEQ ID NO: 8539761 - DNA, 21 bp, Homo sapiens
tcctctccatgatctgtttgt

SEQ ID NO: 8539762 - DNA, 22 bp, Homo sapiens
catttgtatcatatgtatctta

SEQ ID NO: 8539763 - DNA, 22 bp, Homo sapiens
catttgtagtatctgtttatat

SEQ ID NO: 8539764 - DNA, 22 bp, Homo sapiens
tccctagtcgcatctgtggaga

SEQ ID NO: 8539765 - DNA, 22 bp, Homo sapiens
tccctagtcgcatctgtggaga

SEQ ID NO: 8539766 - DNA, 22 bp, Homo sapiens
tccctagtcgcatctgtggaga

SEQ ID NO: 8539767 - DNA, 22 bp, Homo sapiens
tccctagtcgcatctgtggaga

SEQ ID NO: 8539768 - DNA, 22 bp, Homo sapiens
tccctagtcgcatctgtggaga

SEQ ID NO: 8539769 - DNA, 22 bp, Homo sapiens
tccctaggtcctagtcacagta

SEQ ID NO: 8539770 - DNA, 22 bp, Homo sapiens
tccctagtcgcatctgtggaga

SEQ ID NO: 8539771 - DNA, 22 bp, Homo sapiens
tccctaggtcctagtcacagta

SEQ ID NO: 8539772 - DNA, 22 bp, Homo sapiens
tccctcagaaattctctctgaa

SEQ ID NO: 8539773 - DNA, 22 bp, Homo sapiens
tccctcagaaattctctctgaa

SEQ ID NO: 8539774 - DNA, 22 bp, Homo sapiens
tccctcactggttctgcatccc

SEQ ID NO: 8539775 - DNA, 22 bp, Homo sapiens
tcctagaaggatcattctagtg

SEQ ID NO: 8539776 - DNA, 22 bp, Homo sapiens
tcctagaagatggatcagagaa

SEQ ID NO: 8539777 - DNA, 22 bp, Homo sapiens
tcctcagcattagcacagacat

SEQ ID NO: 8539778 - DNA, 18 bp, Homo sapiens
tcctcagcctcacctagc

SEQ ID NO: 8539779 - DNA, 22 bp, Homo sapiens
tcctcagcttttatttcacttg

SEQ ID NO: 8539780 - DNA, 22 bp, Homo sapiens
tcctcaggagagctcctatgcc

SEQ ID NO: 8539781 - DNA, 22 bp, Homo sapiens
tcctcagcttttatttcacttg

SEQ ID NO: 8539782 - DNA, 22 bp, Homo sapiens
tcctcagctttggtttactcat

SEQ ID NO: 8539783 - DNA, 22 bp, Homo sapiens
tcctcaggatctaggagtgctt

SEQ ID NO: 8539784 - DNA, 22 bp, Homo sapiens
tcctcaggatctaggagtgctt

SEQ ID NO: 8539785 - DNA, 22 bp, Homo sapiens
tcctcaggatctaggagtgctt

SEQ ID NO: 8539786 - DNA, 22 bp, Homo sapiens
tcctcaggagagctcctatgcc

SEQ ID NO: 8539787 - DNA, 22 bp, Homo sapiens
tcctcaggagagctcctatgcc

SEQ ID NO: 8539788 - DNA, 22 bp, Homo sapiens
tcctcaggatctaggagtgctt

SEQ ID NO: 8539789 - DNA, 22 bp, Homo sapiens
tcctcaggatctaggagtgctt

SEQ ID NO: 8539790 - DNA, 22 bp, Homo sapiens
tcctcaggatgtggagtagaat

SEQ ID NO: 8539791 - DNA, 22 bp, Homo sapiens
tcctcaggatgtggagtagaat

SEQ ID NO: 8539792 - DNA, 22 bp, Homo sapiens
tcctcaggatgtggagtagaat

SEQ ID NO: 8539793 - DNA, 22 bp, Homo sapiens
tcctcaggatgtggagtagaat

SEQ ID NO: 8539794 - DNA, 22 bp, Homo sapiens
tcctcaggatgtggggtagaat

SEQ ID NO: 8539795 - DNA, 22 bp, Homo sapiens
tcctcaggcggtgaggaggggc

SEQ ID NO: 8539796 - DNA, 22 bp, Homo sapiens
tcctcaggcggtgaggaggggc

SEQ ID NO: 8539797 - DNA, 22 bp, Homo sapiens
tcctcaggctgcctggaagact

SEQ ID NO: 8539798 - DNA, 22 bp, Homo sapiens
tcctcaggatgtggggtagaat

SEQ ID NO: 8539799 - DNA, 22 bp, Homo sapiens
tcctcaggatgtggggtagaat

SEQ ID NO: 8539800 - DNA, 22 bp, Homo sapiens
tcctcaggcggtgaggaggggc

SEQ ID NO: 8539801 - DNA, 22 bp, Homo sapiens
tcccaggatctgagggcagaga

SEQ ID NO: 8539802 - DNA, 22 bp, Homo sapiens
tcccaggatctgagggcagaga

SEQ ID NO: 8539803 - DNA, 22 bp, Homo sapiens
cattgaaaaacgttgactgagt

SEQ ID NO: 8539804 - DNA, 22 bp, Homo sapiens
cattgaaaatgttgcaggctgt

SEQ ID NO: 8539805 - DNA, 22 bp, Homo sapiens
cattgaaaaacgttgactgagt

SEQ ID NO: 8539806 - DNA, 22 bp, Homo sapiens
tcccaggaggtgcttcctagga

SEQ ID NO: 8539807 - DNA, 22 bp, Homo sapiens
tcccaggaggtgcttcctagga

SEQ ID NO: 8539808 - DNA, 16 bp, Homo sapiens
tcccaggaggcggaac

SEQ ID NO: 8539809 - DNA, 22 bp, Homo sapiens
tcccaggagcaccttttgagcc

SEQ ID NO: 8539810 - DNA, 16 bp, Homo sapiens
tcccaggaggcggaac

SEQ ID NO: 8539811 - DNA, 22 bp, Homo sapiens
cattgaaatatggaaactgatg

SEQ ID NO: 8539812 - DNA, 22 bp, Homo sapiens
cattgaaatatggaaactgatg

SEQ ID NO: 8539813 - DNA, 18 bp, Homo sapiens
cattgacagtatatcttt

SEQ ID NO: 8539814 - DNA, 22 bp, Homo sapiens
cattgaaacagatgtacccatg

SEQ ID NO: 8539815 - DNA, 22 bp, Homo sapiens
cattgaaacctaacataggctg

SEQ ID NO: 8539816 - DNA, 22 bp, Homo sapiens
cattgaaacctaacataggctg

SEQ ID NO: 8539817 - DNA, 22 bp, Homo sapiens
cattgaaagagataaagccttt

SEQ ID NO: 8539818 - DNA, 22 bp, Homo sapiens
cattgaaatatggaaactgatg

SEQ ID NO: 8539819 - DNA, 22 bp, Homo sapiens
tcccagggtcctcttctggaat

SEQ ID NO: 8539820 - DNA, 22 bp, Homo sapiens
cattgcacgggcgtctgtctgt

SEQ ID NO: 8539821 - DNA, 22 bp, Homo sapiens
tcccagggtcctcttctggaat

SEQ ID NO: 8539822 - DNA, 22 bp, Homo sapiens
tcccagggtcctcttctggaat

SEQ ID NO: 8539823 - DNA, 22 bp, Homo sapiens
cattgcaccacattgcatccct

SEQ ID NO: 8539824 - DNA, 22 bp, Homo sapiens
cattgcaccacattgcatccct

SEQ ID NO: 8539825 - DNA, 22 bp, Homo sapiens
cattgcaacttcaaactcctgg

SEQ ID NO: 8539826 - DNA, 22 bp, Homo sapiens
cattgcaacttcaaactcctgg

SEQ ID NO: 8539827 - DNA, 22 bp, Homo sapiens
cattgaatccttccttcagaag

SEQ ID NO: 8539828 - DNA, 22 bp, Homo sapiens
cattgagaggctgcctgcctga

SEQ ID NO: 8539829 - DNA, 22 bp, Homo sapiens
tccctaggagaattgccgcagc

SEQ ID NO: 8539830 - DNA, 22 bp, Homo sapiens
tccctagaggtcttcacaagat

SEQ ID NO: 8539831 - DNA, 22 bp, Homo sapiens
tccctaaactctgaactgattc

SEQ ID NO: 8539832 - DNA, 22 bp, Homo sapiens
tccctactgttagggactcagc

SEQ ID NO: 8539833 - DNA, 22 bp, Homo sapiens
tccctaaactctgaactgattc

SEQ ID NO: 8539834 - DNA, 22 bp, Homo sapiens
tcccgtaggttgctgtagtcgg

SEQ ID NO: 8539835 - DNA, 22 bp, Homo sapiens
tcccgtaggttgctgtagtcgg

SEQ ID NO: 8539836 - DNA, 22 bp, Homo sapiens
tcccggcgctgggaggtgggtc

SEQ ID NO: 8539837 - DNA, 22 bp, Homo sapiens
tcccggcgctgggaggtgggtc

SEQ ID NO: 8539838 - DNA, 22 bp, Homo sapiens
tccccagcattgagggtctctc

SEQ ID NO: 8539839 - DNA, 22 bp, Homo sapiens
tccccagccgtgaaggagagga

SEQ ID NO: 8539840 - DNA, 22 bp, Homo sapiens
tccccagccgtgaaggagagga

SEQ ID NO: 8539841 - DNA, 22 bp, Homo sapiens
tccccagccgtgaaggagagga

SEQ ID NO: 8539842 - DNA, 22 bp, Homo sapiens
tccccagcttgctacttctgct

SEQ ID NO: 8539843 - DNA, 22 bp, Homo sapiens
tccccagctctgtgcttccact

SEQ ID NO: 8539844 - DNA, 22 bp, Homo sapiens
tccccagatggccagctacatg

SEQ ID NO: 8539845 - DNA, 22 bp, Homo sapiens
tccccagaggtgaggcagcttt

SEQ ID NO: 8539846 - DNA, 22 bp, Homo sapiens
tccccagatggccagctacatg

SEQ ID NO: 8539847 - DNA, 19 bp, Homo sapiens
tccccagcacctctgagtc

SEQ ID NO: 8539848 - DNA, 19 bp, Homo sapiens
tccccagcacctctgagtc

SEQ ID NO: 8539849 - DNA, 22 bp, Homo sapiens
tccccagaggaatatgagattg

SEQ ID NO: 8539850 - DNA, 22 bp, Homo sapiens
tccccactctctcctggagctt

SEQ ID NO: 8539851 - DNA, 22 bp, Homo sapiens
tcccagagcccaagttggagag

SEQ ID NO: 8539852 - DNA, 22 bp, Homo sapiens
tcccagagcctctgccactctg

SEQ ID NO: 8539853 - DNA, 21 bp, Homo sapiens
tcccactctaaatggactgaa

SEQ ID NO: 8539854 - DNA, 22 bp, Homo sapiens
tcccactgagcatatgcagatg

SEQ ID NO: 8539855 - DNA, 22 bp, Homo sapiens
cattcattcagcaactgttatt

SEQ ID NO: 8539856 - DNA, 22 bp, Homo sapiens
cattcattctgtaagtaactat

SEQ ID NO: 8539857 - DNA, 22 bp, Homo sapiens
tcccagaggaaatggcagctga

SEQ ID NO: 8539858 - DNA, 22 bp, Homo sapiens
tcccagccacaggtgtagccct

SEQ ID NO: 8539859 - DNA, 22 bp, Homo sapiens
tcccagccacaggtgtagccct

SEQ ID NO: 8539860 - DNA, 22 bp, Homo sapiens
tcccagccacaggtgtagccct

SEQ ID NO: 8539861 - DNA, 22 bp, Homo sapiens
tcccagagctgataagccttta

SEQ ID NO: 8539862 - DNA, 22 bp, Homo sapiens
tcccagagctgataagccttta

SEQ ID NO: 8539863 - DNA, 22 bp, Homo sapiens
tcccagagctctggaggttgga

SEQ ID NO: 8539864 - DNA, 22 bp, Homo sapiens
tcccagagctctggaggttgga

SEQ ID NO: 8539865 - DNA, 22 bp, Homo sapiens
tcccagagctctgacaccagct

SEQ ID NO: 8539866 - DNA, 22 bp, Homo sapiens
tcccagagctctgacaccagct

SEQ ID NO: 8539867 - DNA, 22 bp, Homo sapiens
tcccagagcctctgccactctg

SEQ ID NO: 8539868 - DNA, 22 bp, Homo sapiens
tcccaggagcaccttttgagcc

SEQ ID NO: 8539869 - DNA, 22 bp, Homo sapiens
tcccaggacttccagttggagg

SEQ ID NO: 8539870 - DNA, 22 bp, Homo sapiens
tcccaggacttccagttggagg

SEQ ID NO: 8539871 - DNA, 22 bp, Homo sapiens
tcccaggacccaggcattcaca

SEQ ID NO: 8539872 - DNA, 22 bp, Homo sapiens
tcccaggacccaggcattcaca

SEQ ID NO: 8539873 - DNA, 22 bp, Homo sapiens
tcccaggacatgggctctgctc

SEQ ID NO: 8539874 - DNA, 22 bp, Homo sapiens
tcccaggacatgggctctgctc

SEQ ID NO: 8539875 - DNA, 22 bp, Homo sapiens
tcccaggacatgggctctgctc

SEQ ID NO: 8539876 - DNA, 22 bp, Homo sapiens
tcccaggaattgaagccagtgt

SEQ ID NO: 8539877 - DNA, 22 bp, Homo sapiens
tcccaggaattgaagccagtgt

SEQ ID NO: 8539878 - DNA, 22 bp, Homo sapiens
tcccaggacaggccacatggaa

SEQ ID NO: 8539879 - DNA, 22 bp, Homo sapiens
tcccaggacaggccacatggaa

SEQ ID NO: 8539880 - DNA, 22 bp, Homo sapiens
tcccaggacaggccacatggaa

SEQ ID NO: 8539881 - DNA, 22 bp, Homo sapiens
tcccaggacaggccacatggaa

SEQ ID NO: 8539882 - DNA, 22 bp, Homo sapiens
tcccaggaatgtctgaaagtga

SEQ ID NO: 8539883 - DNA, 22 bp, Homo sapiens
tcccaggaatgtctgaaagtga

SEQ ID NO: 8539884 - DNA, 23 bp, Homo sapiens
tcccaggaatctgcatttttaac

SEQ ID NO: 8539885 - DNA, 23 bp, Homo sapiens
tcccaggaatctgcatttttaac

SEQ ID NO: 8539886 - DNA, 22 bp, Homo sapiens
tcccagcccagacttctccagt

SEQ ID NO: 8539887 - DNA, 22 bp, Homo sapiens
tcccagcccagacttctccagt

SEQ ID NO: 8539888 - DNA, 22 bp, Homo sapiens
tcccagcccagacttctccagt

SEQ ID NO: 8539889 - DNA, 22 bp, Homo sapiens
tcccagcccagatttgtgtgac

SEQ ID NO: 8539890 - DNA, 22 bp, Homo sapiens
tcccagcccagatttgtgtgac

SEQ ID NO: 8539891 - DNA, 22 bp, Homo sapiens
tcccagcccagacttctccagt

SEQ ID NO: 8539892 - DNA, 22 bp, Homo sapiens
tcccagccattcctttaggtgt

SEQ ID NO: 8539893 - DNA, 22 bp, Homo sapiens
tcccagccattcctttaggtgt

SEQ ID NO: 8539894 - DNA, 22 bp, Homo sapiens
tcccagccacagtttccacctg

SEQ ID NO: 8539895 - DNA, 22 bp, Homo sapiens
tcccagccacagtttccacctg

SEQ ID NO: 8539896 - DNA, 22 bp, Homo sapiens
tcccagccaggctctaccactt

SEQ ID NO: 8539897 - DNA, 22 bp, Homo sapiens
tcccagccaggctctaccactt

SEQ ID NO: 8539898 - DNA, 22 bp, Homo sapiens
tcccagccaggctctaccactt

SEQ ID NO: 8539899 - DNA, 22 bp, Homo sapiens
cattcattcacattttgtctat

SEQ ID NO: 8539900 - DNA, 22 bp, Homo sapiens
cattcatctatcaaatggtacc

SEQ ID NO: 8539901 - DNA, 22 bp, Homo sapiens
cattcagtcatgctggttttga

SEQ ID NO: 8539902 - DNA, 22 bp, Homo sapiens
cattcagtggagtattattcag

SEQ ID NO: 8539903 - DNA, 22 bp, Homo sapiens
cattcataagactttgctcttg

SEQ ID NO: 8539904 - DNA, 22 bp, Homo sapiens
cattcagtggagtattattcag

SEQ ID NO: 8539905 - DNA, 22 bp, Homo sapiens
cattcagtggagtattattcag

SEQ ID NO: 8539906 - DNA, 22 bp, Homo sapiens
cattcacatcttgttccatcac

SEQ ID NO: 8539907 - DNA, 22 bp, Homo sapiens
cattcacattcttcttactgtt

SEQ ID NO: 8539908 - DNA, 22 bp, Homo sapiens
cattcagagctttcttatcata

SEQ ID NO: 8539909 - DNA, 22 bp, Homo sapiens
cattcagagctttcttatcata

SEQ ID NO: 8539910 - DNA, 22 bp, Homo sapiens
cattcacaatggattgcttcaa

SEQ ID NO: 8539911 - DNA, 22 bp, Homo sapiens
cattcacagagggggaagcatc

SEQ ID NO: 8539912 - DNA, 22 bp, Homo sapiens
cattcacaatagttgaaaggtg

SEQ ID NO: 8539913 - DNA, 22 bp, Homo sapiens
cattcacaaagctgattgatgg

SEQ ID NO: 8539914 - DNA, 22 bp, Homo sapiens
cattcacaaaaccacatgccat

SEQ ID NO: 8539915 - DNA, 22 bp, Homo sapiens
cattcacaaaaccacatgccat

SEQ ID NO: 8539916 - DNA, 22 bp, Homo sapiens
cattcaaatgtgccactgtcct

SEQ ID NO: 8539917 - DNA, 22 bp, Homo sapiens
catgtttctgagaaaagtagga

SEQ ID NO: 8539918 - DNA, 22 bp, Homo sapiens
catgtttctgagaaaagtagga

SEQ ID NO: 8539919 - DNA, 22 bp, Homo sapiens
cattatccaacagcactttcca

SEQ ID NO: 8539920 - DNA, 22 bp, Homo sapiens
cattatctcttctatatgctag

SEQ ID NO: 8539921 - DNA, 22 bp, Homo sapiens
cattatattttactgcatggga

SEQ ID NO: 8539922 - DNA, 22 bp, Homo sapiens
cattatattacagcactgttaa

SEQ ID NO: 8539923 - DNA, 22 bp, Homo sapiens
catgttgaatggccttgatttt

SEQ ID NO: 8539924 - DNA, 22 bp, Homo sapiens
catgttggctgaggctgtattt

SEQ ID NO: 8539925 - DNA, 22 bp, Homo sapiens
catgttaactaagattaactat

SEQ ID NO: 8539926 - DNA, 22 bp, Homo sapiens
catgttaagtgtttgataacca

SEQ ID NO: 8539927 - DNA, 22 bp, Homo sapiens
catgttaagtgtttgataacca

SEQ ID NO: 8539928 - DNA, 22 bp, Homo sapiens
catgttaagtgtttgataacca

SEQ ID NO: 8539929 - DNA, 22 bp, Homo sapiens
catgttatttatccattaaaca

SEQ ID NO: 8539930 - DNA, 22 bp, Homo sapiens
catgaaaaatttactgttaaca

SEQ ID NO: 8539931 - DNA, 22 bp, Homo sapiens
catgaaaaatttactgttaaca

SEQ ID NO: 8539932 - DNA, 22 bp, Homo sapiens
catgaaaaatttactgttaaca

SEQ ID NO: 8539933 - DNA, 22 bp, Homo sapiens
catgaaaaatttactgttaaca

SEQ ID NO: 8539934 - DNA, 18 bp, Homo sapiens
tcattcattaaacttggc

SEQ ID NO: 8539935 - DNA, 20 bp, Homo sapiens
tcattccaaatagttcagca

SEQ ID NO: 8539936 - DNA, 23 bp, Homo sapiens
tcattccacaaatacttatctag

SEQ ID NO: 8539937 - DNA, 23 bp, Homo sapiens
tcattccacaaatacttatctag

SEQ ID NO: 8539938 - DNA, 22 bp, Homo sapiens
tcattcatgaggtgctagtgct

SEQ ID NO: 8539939 - DNA, 22 bp, Homo sapiens
tcattcatcagttggtagagat

SEQ ID NO: 8539940 - DNA, 22 bp, Homo sapiens
tcatgtgacaggcactgttctg

SEQ ID NO: 8539941 - DNA, 22 bp, Homo sapiens
tcatgtgacaggcactgttctg

SEQ ID NO: 8539942 - DNA, 19 bp, Homo sapiens
tcatgcactttgatgtaac

SEQ ID NO: 8539943 - DNA, 22 bp, Homo sapiens
tcatgcaatctcttgttcagga

SEQ ID NO: 8539944 - DNA, 22 bp, Homo sapiens
catcttttcagaagccattctg

SEQ ID NO: 8539945 - DNA, 22 bp, Homo sapiens
tcatgcaaggctgaaacatggt

SEQ ID NO: 8539946 - DNA, 22 bp, Homo sapiens
tcatgcaaggctgaaacatggt

SEQ ID NO: 8539947 - DNA, 20 bp, Homo sapiens
tcatgcaagattcataaagg

SEQ ID NO: 8539948 - DNA, 22 bp, Homo sapiens
tcatgcaagaataataggaagg

SEQ ID NO: 8539949 - DNA, 20 bp, Homo sapiens
tcatgcaagattcataaagg

SEQ ID NO: 8539950 - DNA, 22 bp, Homo sapiens
tcatgcaacggctcgctgagcc

SEQ ID NO: 8539951 - DNA, 22 bp, Homo sapiens
tcatgcaaatactgttccagaa

SEQ ID NO: 8539952 - DNA, 22 bp, Homo sapiens
tcatgcaaagccaattccagct

SEQ ID NO: 8539953 - DNA, 22 bp, Homo sapiens
tcatgcaaagccaattccagct

SEQ ID NO: 8539954 - DNA, 22 bp, Homo sapiens
tcatgcaaaagacttgaacttt

SEQ ID NO: 8539955 - DNA, 22 bp, Homo sapiens
tcatgagtttaaggtttaggct

SEQ ID NO: 8539956 - DNA, 18 bp, Homo sapiens
tcatgaggtagaggctgg

SEQ ID NO: 8539957 - DNA, 22 bp, Homo sapiens
tcatgagtctgcaaattatgga

SEQ ID NO: 8539958 - DNA, 22 bp, Homo sapiens
tcatgagtggattaatatggct

SEQ ID NO: 8539959 - DNA, 22 bp, Homo sapiens
tcatcataatatggaatcttgt

SEQ ID NO: 8539960 - DNA, 22 bp, Homo sapiens
tcatgaacttcctagccagact

SEQ ID NO: 8539961 - DNA, 22 bp, Homo sapiens
cataacagtggcttcagcaagt

SEQ ID NO: 8539962 - DNA, 22 bp, Homo sapiens
cataacacctgatggcaatgat

SEQ ID NO: 8539963 - DNA, 22 bp, Homo sapiens
cataacagtggcttcagcaagt

SEQ ID NO: 8539964 - DNA, 22 bp, Homo sapiens
tcatgacatgtgaattgaatat

SEQ ID NO: 8539965 - DNA, 22 bp, Homo sapiens
tccacagtggtggaattgttca

SEQ ID NO: 8539966 - DNA, 22 bp, Homo sapiens
tccacagggcctttctggtgtg

SEQ ID NO: 8539967 - DNA, 22 bp, Homo sapiens
tccacagggcctttctggtgtg

SEQ ID NO: 8539968 - DNA, 20 bp, Homo sapiens
tccaagccctccttccattc

SEQ ID NO: 8539969 - DNA, 22 bp, Homo sapiens
tcatttatttgactttggagtg

SEQ ID NO: 8539970 - DNA, 17 bp, Homo sapiens
tccaagccagcttgcct

SEQ ID NO: 8539971 - DNA, 22 bp, Homo sapiens
tccacagttttgccactagctg

SEQ ID NO: 8539972 - DNA, 22 bp, Homo sapiens
tccacatcaagggcagagaggt

SEQ ID NO: 8539973 - DNA, 22 bp, Homo sapiens
tccacatctctcgccaaccaat

SEQ ID NO: 8539974 - DNA, 22 bp, Homo sapiens
tccacatccattgcttgacttt

SEQ ID NO: 8539975 - DNA, 22 bp, Homo sapiens
tccacattatgtttctcctttc

SEQ ID NO: 8539976 - DNA, 22 bp, Homo sapiens
tccacattagaatgttttctca

SEQ ID NO: 8539977 - DNA, 22 bp, Homo sapiens
tccacatgacttctaataactg

SEQ ID NO: 8539978 - DNA, 22 bp, Homo sapiens
tccacatgacttctaataactg

SEQ ID NO: 8539979 - DNA, 20 bp, Homo sapiens
tccacatcttttgagatgtg

SEQ ID NO: 8539980 - DNA, 22 bp, Homo sapiens
tccacatgaccattgtgctcct

SEQ ID NO: 8539981 - DNA, 22 bp, Homo sapiens
tccacatgacttctaataactg

SEQ ID NO: 8539982 - DNA, 22 bp, Homo sapiens
tccagaccaaggaaggctgggc

SEQ ID NO: 8539983 - DNA, 21 bp, Homo sapiens
tcatttattgagaaatgactg

SEQ ID NO: 8539984 - DNA, 21 bp, Homo sapiens
tcatttattgagaaatgactg

SEQ ID NO: 8539985 - DNA, 21 bp, Homo sapiens
tcatttattgagaaatgactg

SEQ ID NO: 8539986 - DNA, 21 bp, Homo sapiens
tcatttattgagaaatgactg

SEQ ID NO: 8539987 - DNA, 21 bp, Homo sapiens
tcatttattgagaaatgactg

SEQ ID NO: 8539988 - DNA, 21 bp, Homo sapiens
tcatttattgagaaatgactg

SEQ ID NO: 8539989 - DNA, 21 bp, Homo sapiens
tcatttattgagaaatgactg

SEQ ID NO: 8539990 - DNA, 22 bp, Homo sapiens
tcatttatgtctttgccatcca

SEQ ID NO: 8539991 - DNA, 22 bp, Homo sapiens
tcatttatgcaggaatggcata

SEQ ID NO: 8539992 - DNA, 22 bp, Homo sapiens
tcatttatgcaggaatggcata

SEQ ID NO: 8539993 - DNA, 22 bp, Homo sapiens
tcatttatcgctgccttttaaa

SEQ ID NO: 8539994 - DNA, 22 bp, Homo sapiens
tcattctcagactcttggcctc

SEQ ID NO: 8539995 - DNA, 22 bp, Homo sapiens
tcattctctgggatgcagtttg

SEQ ID NO: 8539996 - DNA, 21 bp, Homo sapiens
tcattcgatttcctctatctc

SEQ ID NO: 8539997 - DNA, 22 bp, Homo sapiens
tcattccctcattgttcactgg

SEQ ID NO: 8539998 - DNA, 22 bp, Homo sapiens
tcattccttatccgtatctttt

SEQ ID NO: 8539999 - DNA, 22 bp, Homo sapiens
tcattctttaccaagttgtcac

SEQ ID NO: 8540000 - DNA, 22 bp, Homo sapiens
tcattgaaaactcagcatctac

SEQ ID NO: 8540001 - DNA, 19 bp, Homo sapiens
tcattgaacataattactt

SEQ ID NO: 8540002 - DNA, 22 bp, Homo sapiens
tcattgaaagtgcctcctcgga

SEQ ID NO: 8540003 - DNA, 22 bp, Homo sapiens
tcattctgcatcactcttgctc

SEQ ID NO: 8540004 - DNA, 22 bp, Homo sapiens
tccaggcccgagatgggctgga

SEQ ID NO: 8540005 - DNA, 22 bp, Homo sapiens
tccaggctcagtcaagcacttc

SEQ ID NO: 8540006 - DNA, 22 bp, Homo sapiens
tccaggcccctgcctgggcctg

SEQ ID NO: 8540007 - DNA, 22 bp, Homo sapiens
tccaggcccctgcctgggcctg

SEQ ID NO: 8540008 - DNA, 22 bp, Homo sapiens
tccaggccccagaccgtactgc

SEQ ID NO: 8540009 - DNA, 22 bp, Homo sapiens
tccaggccccccacgctaatgg

SEQ ID NO: 8540010 - DNA, 22 bp, Homo sapiens
tccaggccccccacgctaatgg

SEQ ID NO: 8540011 - DNA, 22 bp, Homo sapiens
tccaggccccagcaccttggga

SEQ ID NO: 8540012 - DNA, 22 bp, Homo sapiens
tccaggccccagcaccttggga

SEQ ID NO: 8540013 - DNA, 22 bp, Homo sapiens
tccaggcccatggagcagagct

SEQ ID NO: 8540014 - DNA, 22 bp, Homo sapiens
tccaggccccactgaagcccct

SEQ ID NO: 8540015 - DNA, 22 bp, Homo sapiens
tccaggcccatggagcagagct

SEQ ID NO: 8540016 - DNA, 22 bp, Homo sapiens
tccaggcccatagacacttctc

SEQ ID NO: 8540017 - DNA, 22 bp, Homo sapiens
tccagctggcctaacttcaggg

SEQ ID NO: 8540018 - DNA, 22 bp, Homo sapiens
tccagctggcccggccatgaat

SEQ ID NO: 8540019 - DNA, 22 bp, Homo sapiens
tccagctggcttcggaagtgga

SEQ ID NO: 8540020 - DNA, 19 bp, Homo sapiens
tccaggctccattggcaga

SEQ ID NO: 8540021 - DNA, 22 bp, Homo sapiens
tccaggctcagtcaagcacttc

SEQ ID NO: 8540022 - DNA, 18 bp, Homo sapiens
tccaggctccaggctaac

SEQ ID NO: 8540023 - DNA, 18 bp, Homo sapiens
tccaggctccaggctaac

SEQ ID NO: 8540024 - DNA, 22 bp, Homo sapiens
tccaggctcccctgcgtgctcc

SEQ ID NO: 8540025 - DNA, 22 bp, Homo sapiens
tccaggctccctcaggatgcac

SEQ ID NO: 8540026 - DNA, 20 bp, Homo sapiens
tccaggctcctccacttagt

SEQ ID NO: 8540027 - DNA, 22 bp, Homo sapiens
tccaggctccctcaggatgcac

SEQ ID NO: 8540028 - DNA, 22 bp, Homo sapiens
catgtgtgtctccaccagctgc

SEQ ID NO: 8540029 - DNA, 22 bp, Homo sapiens
catgtgtgtgagggaaacatgt

SEQ ID NO: 8540030 - DNA, 22 bp, Homo sapiens
catgtgtgtggacgagcgtggc

SEQ ID NO: 8540031 - DNA, 22 bp, Homo sapiens
catgtgtgtggacgagcgtggc

SEQ ID NO: 8540032 - DNA, 22 bp, Homo sapiens
catgtgtgtccatgtgactaag

SEQ ID NO: 8540033 - DNA, 22 bp, Homo sapiens
catgtgtgtccatgtgactaag

SEQ ID NO: 8540034 - DNA, 22 bp, Homo sapiens
catgtgtggttacctacttgac

SEQ ID NO: 8540035 - DNA, 22 bp, Homo sapiens
catgtgtgtggacgagcgtggc

SEQ ID NO: 8540036 - DNA, 22 bp, Homo sapiens
catgtgttaatctttctgcaaa

SEQ ID NO: 8540037 - DNA, 22 bp, Homo sapiens
catgtgttaatctttctgcaaa

SEQ ID NO: 8540038 - DNA, 18 bp, Homo sapiens
catgtgttctacatcagt

SEQ ID NO: 8540039 - DNA, 22 bp, Homo sapiens
catgtgttttgtcatttcaata

SEQ ID NO: 8540040 - DNA, 22 bp, Homo sapiens
catgtgtttcgagactgttgag

SEQ ID NO: 8540041 - DNA, 22 bp, Homo sapiens
catgtgttttgtcatttcaata

SEQ ID NO: 8540042 - DNA, 22 bp, Homo sapiens
tccagcctcatttctcctgctt

SEQ ID NO: 8540043 - DNA, 22 bp, Homo sapiens
tccagcctcatttctcctgctt

SEQ ID NO: 8540044 - DNA, 22 bp, Homo sapiens
tccagcctcatttctcctgctt

SEQ ID NO: 8540045 - DNA, 22 bp, Homo sapiens
tccagcctaatgttcttcccac

SEQ ID NO: 8540046 - DNA, 22 bp, Homo sapiens
tccagcctaggggaacagctgc

SEQ ID NO: 8540047 - DNA, 22 bp, Homo sapiens
tccagcctaggggaacagctgc

SEQ ID NO: 8540048 - DNA, 22 bp, Homo sapiens
tccagcctcctatttaccctaa

SEQ ID NO: 8540049 - DNA, 22 bp, Homo sapiens
tccagcctcctatttaccctaa

SEQ ID NO: 8540050 - DNA, 17 bp, Homo sapiens
tccagcctcctctgctg

SEQ ID NO: 8540051 - DNA, 17 bp, Homo sapiens
tccagcctcctctgctg

SEQ ID NO: 8540052 - DNA, 22 bp, Homo sapiens
tccagctcttgttgcccactgc

SEQ ID NO: 8540053 - DNA, 22 bp, Homo sapiens
tccagctcttcagttctgcaaa

SEQ ID NO: 8540054 - DNA, 22 bp, Homo sapiens
tccagctgcaaggggcacagct

SEQ ID NO: 8540055 - DNA, 21 bp, Homo sapiens
tccagctgcacaagcatgggg

SEQ ID NO: 8540056 - DNA, 23 bp, Homo sapiens
tccagctgcagtgggatggggaa

SEQ ID NO: 8540057 - DNA, 22 bp, Homo sapiens
tccagctgctgacccagtagcc

SEQ ID NO: 8540058 - DNA, 22 bp, Homo sapiens
tccagctgctgccagccaagct

SEQ ID NO: 8540059 - DNA, 22 bp, Homo sapiens
tccagctgccaaccgggccccg

SEQ ID NO: 8540060 - DNA, 22 bp, Homo sapiens
tccagctgctagctagatgcaa

SEQ ID NO: 8540061 - DNA, 22 bp, Homo sapiens
tccagctgcaaggggcacagct

SEQ ID NO: 8540062 - DNA, 20 bp, Homo sapiens
tccagctgacattctctttc

SEQ ID NO: 8540063 - DNA, 22 bp, Homo sapiens
tccagctgaggtggcctctgtg

SEQ ID NO: 8540064 - DNA, 22 bp, Homo sapiens
tccagctgacacttaaggggag

SEQ ID NO: 8540065 - DNA, 22 bp, Homo sapiens
tccagctcttgttgcccactgc

SEQ ID NO: 8540066 - DNA, 22 bp, Homo sapiens
tccagctgacagttcaaaatga

SEQ ID NO: 8540067 - DNA, 22 bp, Homo sapiens
tccagctgacatctcctgaggg

SEQ ID NO: 8540068 - DNA, 22 bp, Homo sapiens
tccagctgacatctcctgaggg

SEQ ID NO: 8540069 - DNA, 22 bp, Homo sapiens
tccagagagatagtggctaata

SEQ ID NO: 8540070 - DNA, 22 bp, Homo sapiens
tccagagagatagtggctaata

SEQ ID NO: 8540071 - DNA, 22 bp, Homo sapiens
tccagagagccacggacagggg

SEQ ID NO: 8540072 - DNA, 22 bp, Homo sapiens
tccagccctgtgtctgggagag

SEQ ID NO: 8540073 - DNA, 22 bp, Homo sapiens
tccagcctaatgttcttcccac

SEQ ID NO: 8540074 - DNA, 22 bp, Homo sapiens
tccagcctaatgttcttcccac

SEQ ID NO: 8540075 - DNA, 22 bp, Homo sapiens
tccagactgccctgcacatgtg

SEQ ID NO: 8540076 - DNA, 22 bp, Homo sapiens
tccagactggggccatgtctgc

SEQ ID NO: 8540077 - DNA, 22 bp, Homo sapiens
tccagactcactcatgtgacta

SEQ ID NO: 8540078 - DNA, 22 bp, Homo sapiens
tccagactctttaagttcattt

SEQ ID NO: 8540079 - DNA, 22 bp, Homo sapiens
tccagagaacgatgaaagctgg

SEQ ID NO: 8540080 - DNA, 22 bp, Homo sapiens
tccagagaacgatgaaagctgg

SEQ ID NO: 8540081 - DNA, 22 bp, Homo sapiens
tccagagaacgatgaaagctgg

SEQ ID NO: 8540082 - DNA, 22 bp, Homo sapiens
tccagagacttgcatgtgcttg

SEQ ID NO: 8540083 - DNA, 22 bp, Homo sapiens
tccagagacttgcatgtgcttg

SEQ ID NO: 8540084 - DNA, 22 bp, Homo sapiens
tccagagacttgcatgtgcttg

SEQ ID NO: 8540085 - DNA, 22 bp, Homo sapiens
tccagagaattctacgcagtgc

SEQ ID NO: 8540086 - DNA, 22 bp, Homo sapiens
cagtcccagacatagtaaggga

SEQ ID NO: 8540087 - DNA, 22 bp, Homo sapiens
cagtcccagacatagtaaggga

SEQ ID NO: 8540088 - DNA, 22 bp, Homo sapiens
cagtcccagacatagtaaggga

SEQ ID NO: 8540089 - DNA, 22 bp, Homo sapiens
cagtcccagaagagcctgggag

SEQ ID NO: 8540090 - DNA, 22 bp, Homo sapiens
cagtcccagaagagcctgggag

SEQ ID NO: 8540091 - DNA, 22 bp, Homo sapiens
cagtcccagacccagaaggtgg

SEQ ID NO: 8540092 - DNA, 22 bp, Homo sapiens
cagtcccagacccagaaggtgg

SEQ ID NO: 8540093 - DNA, 20 bp, Homo sapiens
cagtcccaatccagggccag

SEQ ID NO: 8540094 - DNA, 22 bp, Homo sapiens
tatttctttcaggtatgtgttg

SEQ ID NO: 8540095 - DNA, 22 bp, Homo sapiens
tatttctttcaggtatgtgttg

SEQ ID NO: 8540096 - DNA, 21 bp, Homo sapiens
tatttctttgactctctccct

SEQ ID NO: 8540097 - DNA, 21 bp, Homo sapiens
tatttctttgactctctccct

SEQ ID NO: 8540098 - DNA, 22 bp, Homo sapiens
tatttcttttcgtgacttattg

SEQ ID NO: 8540099 - DNA, 20 bp, Homo sapiens
cagtcccaatccagggccag

SEQ ID NO: 8540100 - DNA, 20 bp, Homo sapiens
cagtcccaatccagggccag

SEQ ID NO: 8540101 - DNA, 20 bp, Homo sapiens
cagtcccaatccagggccag

SEQ ID NO: 8540102 - DNA, 20 bp, Homo sapiens
cagtcccaatccagggccag

SEQ ID NO: 8540103 - DNA, 22 bp, Homo sapiens
cagtcccacaagatctccacaa

SEQ ID NO: 8540104 - DNA, 22 bp, Homo sapiens
cagtcccacaagatctccacaa

SEQ ID NO: 8540105 - DNA, 22 bp, Homo sapiens
cagtcccaccaggatcgctctt

SEQ ID NO: 8540106 - DNA, 22 bp, Homo sapiens
cagtcccaccaggatcgctctt

SEQ ID NO: 8540107 - DNA, 22 bp, Homo sapiens
cagtcccactagtgccaatacc

SEQ ID NO: 8540108 - DNA, 22 bp, Homo sapiens
cagtcccactagtgccaatacc

SEQ ID NO: 8540109 - DNA, 22 bp, Homo sapiens
cagtcccaaggaggaagcagtc

SEQ ID NO: 8540110 - DNA, 22 bp, Homo sapiens
cagtcccaaggaggaagcagtc

SEQ ID NO: 8540111 - DNA, 19 bp, Homo sapiens
cagtcccaaattcttgtca

SEQ ID NO: 8540112 - DNA, 19 bp, Homo sapiens
cagtcccaaattcttgtca

SEQ ID NO: 8540113 - DNA, 22 bp, Homo sapiens
cagtcccaaggaggaagcagtc

SEQ ID NO: 8540114 - DNA, 18 bp, Homo sapiens
cagtcccaaaccttagga

SEQ ID NO: 8540115 - DNA, 20 bp, Homo sapiens
cagtccaatcagaggccacc

SEQ ID NO: 8540116 - DNA, 22 bp, Homo sapiens
cagtagccactagacacatgta

SEQ ID NO: 8540117 - DNA, 22 bp, Homo sapiens
cagtagcatgtaataaagacag

SEQ ID NO: 8540118 - DNA, 22 bp, Homo sapiens
tatttccagaggagtatagaag

SEQ ID NO: 8540119 - DNA, 22 bp, Homo sapiens
tatttccaaaagcctattatga

SEQ ID NO: 8540120 - DNA, 22 bp, Homo sapiens
tatttccaccctcagtaaggaa

SEQ ID NO: 8540121 - DNA, 22 bp, Homo sapiens
tatttccaagctgaatccaatg

SEQ ID NO: 8540122 - DNA, 22 bp, Homo sapiens
cagtagtctttttcctcctaga

SEQ ID NO: 8540123 - DNA, 22 bp, Homo sapiens
cagtagtagttaaactgtgtat

SEQ ID NO: 8540124 - DNA, 22 bp, Homo sapiens
cagtagtagttaaactgtgtat

SEQ ID NO: 8540125 - DNA, 22 bp, Homo sapiens
cagtagtgaaaagcagcccagc

SEQ ID NO: 8540126 - DNA, 21 bp, Homo sapiens
cagtagtgcgtcgcagaggac

SEQ ID NO: 8540127 - DNA, 21 bp, Homo sapiens
cagtagtgaggtatttgccaa

SEQ ID NO: 8540128 - DNA, 22 bp, Homo sapiens
cagtaggaggttctgaggttct

SEQ ID NO: 8540129 - DNA, 22 bp, Homo sapiens
cagtagggaatgtgggaggctg

SEQ ID NO: 8540130 - DNA, 22 bp, Homo sapiens
cagtataatgccccctgtgggg

SEQ ID NO: 8540131 - DNA, 23 bp, Homo sapiens
cagtataatgtatggatggggca

SEQ ID NO: 8540132 - DNA, 22 bp, Homo sapiens
cagtagtgttgctgagtgtcag

SEQ ID NO: 8540133 - DNA, 22 bp, Homo sapiens
cagtagtggtctatcactggag

SEQ ID NO: 8540134 - DNA, 22 bp, Homo sapiens
cagtagtggggagcccagtgtc

SEQ ID NO: 8540135 - DNA, 22 bp, Homo sapiens
cagggtggggaaatagcgccct

SEQ ID NO: 8540136 - DNA, 22 bp, Homo sapiens
cagggtggggaaatagcgccct

SEQ ID NO: 8540137 - DNA, 22 bp, Homo sapiens
cagggtgggcacccagcctcca

SEQ ID NO: 8540138 - DNA, 22 bp, Homo sapiens
cagggtgggcacccagcctcca

SEQ ID NO: 8540139 - DNA, 22 bp, Homo sapiens
cagggtgggcacccagcctcca

SEQ ID NO: 8540140 - DNA, 22 bp, Homo sapiens
cagggtgggcacccagcctcca

SEQ ID NO: 8540141 - DNA, 22 bp, Homo sapiens
cagggtggccctgtggtctcat

SEQ ID NO: 8540142 - DNA, 22 bp, Homo sapiens
cagggtggccctgtggtctcat

SEQ ID NO: 8540143 - DNA, 22 bp, Homo sapiens
cagggtggccctgtggtctcat

SEQ ID NO: 8540144 - DNA, 22 bp, Homo sapiens
cagggtggccctgtggtctcat

SEQ ID NO: 8540145 - DNA, 22 bp, Homo sapiens
caggttcccaggtccagggctt

SEQ ID NO: 8540146 - DNA, 22 bp, Homo sapiens
tatttcattctttatcaggagc

SEQ ID NO: 8540147 - DNA, 22 bp, Homo sapiens
tatttcattctttatcaggagc

SEQ ID NO: 8540148 - DNA, 22 bp, Homo sapiens
tatttcattctttatcaggagc

SEQ ID NO: 8540149 - DNA, 22 bp, Homo sapiens
tatttcatctggaacaaggtaa

SEQ ID NO: 8540150 - DNA, 22 bp, Homo sapiens
tatttcattctttatcaggagc

SEQ ID NO: 8540151 - DNA, 22 bp, Homo sapiens
tatttcatgtgcaccataattc

SEQ ID NO: 8540152 - DNA, 22 bp, Homo sapiens
tatttcaggtatggtgtgaaat

SEQ ID NO: 8540153 - DNA, 22 bp, Homo sapiens
tatttcagggggtacaagaaga

SEQ ID NO: 8540154 - DNA, 22 bp, Homo sapiens
tatttcatctggaacaaggtaa

SEQ ID NO: 8540155 - DNA, 21 bp, Homo sapiens
tatttagttttacaaatgtgg

SEQ ID NO: 8540156 - DNA, 22 bp, Homo sapiens
caggtttacaaagtaaagtgtg

SEQ ID NO: 8540157 - DNA, 22 bp, Homo sapiens
caggtttctagttctaagaata

SEQ ID NO: 8540158 - DNA, 22 bp, Homo sapiens
caggttggggacttaggatgac

SEQ ID NO: 8540159 - DNA, 22 bp, Homo sapiens
caggttggggacttaggatgac

SEQ ID NO: 8540160 - DNA, 22 bp, Homo sapiens
caggttggagatctgtctatgg

SEQ ID NO: 8540161 - DNA, 22 bp, Homo sapiens
tatttcttttcgtgacttattg

SEQ ID NO: 8540162 - DNA, 22 bp, Homo sapiens
tatttcttttcgtgacttattg

SEQ ID NO: 8540163 - DNA, 22 bp, Homo sapiens
tatttgaaagtgtacaaaaact

SEQ ID NO: 8540164 - DNA, 22 bp, Homo sapiens
tatttgaaagtgtacaaaaact

SEQ ID NO: 8540165 - DNA, 22 bp, Homo sapiens
tatttgaaagtgtacaaaaact

SEQ ID NO: 8540166 - DNA, 22 bp, Homo sapiens
tcacaaatatagtgagaaccag

SEQ ID NO: 8540167 - DNA, 22 bp, Homo sapiens
tcaatgactggtccaaggtggc

SEQ ID NO: 8540168 - DNA, 22 bp, Homo sapiens
tcaatgacattgtatcagagtt

SEQ ID NO: 8540169 - DNA, 22 bp, Homo sapiens
tcacaaatattttaacagtagg

SEQ ID NO: 8540170 - DNA, 22 bp, Homo sapiens
tcacaaatattttaacagtagg

SEQ ID NO: 8540171 - DNA, 22 bp, Homo sapiens
tcacaacttgaagctgatttaa

SEQ ID NO: 8540172 - DNA, 22 bp, Homo sapiens
tcacaactctttccatttaata

SEQ ID NO: 8540173 - DNA, 22 bp, Homo sapiens
tcacaacttgaagctgatttaa

SEQ ID NO: 8540174 - DNA, 21 bp, Homo sapiens
tcacaactttgaatttcaata

SEQ ID NO: 8540175 - DNA, 22 bp, Homo sapiens
tcacaactgggtgtcttcatca

SEQ ID NO: 8540176 - DNA, 22 bp, Homo sapiens
tcacaaatttcagctccctgaa

SEQ ID NO: 8540177 - DNA, 22 bp, Homo sapiens
tcacaactcacagccaccggtg

SEQ ID NO: 8540178 - DNA, 20 bp, Homo sapiens
tcacaactccatcatttccc

SEQ ID NO: 8540179 - DNA, 22 bp, Homo sapiens
tcacaaatttcagctccctgaa

SEQ ID NO: 8540180 - DNA, 22 bp, Homo sapiens
tcacaaatgtctcctgtcctgt

SEQ ID NO: 8540181 - DNA, 22 bp, Homo sapiens
tcacaaatgtttgcatgtgtct

SEQ ID NO: 8540182 - DNA, 22 bp, Homo sapiens
tcacaaatgtctcctgtcctgt

SEQ ID NO: 8540183 - DNA, 22 bp, Homo sapiens
tcacaaatgaggaaatcgagca

SEQ ID NO: 8540184 - DNA, 22 bp, Homo sapiens
tcacaaatcattttatctgtgt

SEQ ID NO: 8540185 - DNA, 22 bp, Homo sapiens
tcacaaatcattttatctgtgt

SEQ ID NO: 8540186 - DNA, 22 bp, Homo sapiens
tcacaaatcgaagccttataat

SEQ ID NO: 8540187 - DNA, 22 bp, Homo sapiens
tcacaaatgaccatggttacta

SEQ ID NO: 8540188 - DNA, 22 bp, Homo sapiens
cagtgagataccacagagcaaa

SEQ ID NO: 8540189 - DNA, 22 bp, Homo sapiens
cagtgagataccacagagcaaa

SEQ ID NO: 8540190 - DNA, 22 bp, Homo sapiens
cagtgaggaagctgtctggacc

SEQ ID NO: 8540191 - DNA, 22 bp, Homo sapiens
tcacacttagagcgaattgttt

SEQ ID NO: 8540192 - DNA, 22 bp, Homo sapiens
tcacagacgcctcccctcgcct

SEQ ID NO: 8540193 - DNA, 22 bp, Homo sapiens
tcacagactcttgattgtctaa

SEQ ID NO: 8540194 - DNA, 22 bp, Homo sapiens
tcacacttatcccactcagtca

SEQ ID NO: 8540195 - DNA, 22 bp, Homo sapiens
tcacacttcaaagggttagatc

SEQ ID NO: 8540196 - DNA, 21 bp, Homo sapiens
tcacacttgattggcttagac

SEQ ID NO: 8540197 - DNA, 18 bp, Homo sapiens
tcacacttcctttgggtc

SEQ ID NO: 8540198 - DNA, 22 bp, Homo sapiens
tcacactttatttatttcatgc

SEQ ID NO: 8540199 - DNA, 22 bp, Homo sapiens
tcacactttccatggctgttaa

SEQ ID NO: 8540200 - DNA, 22 bp, Homo sapiens
cagtgagaccttctaaggtggt

SEQ ID NO: 8540201 - DNA, 22 bp, Homo sapiens
cagtgagaattcagtaggtact

SEQ ID NO: 8540202 - DNA, 22 bp, Homo sapiens
cagtgacgtaaactgcatgtgc

SEQ ID NO: 8540203 - DNA, 22 bp, Homo sapiens
tcacaagacagaaaacatttag

SEQ ID NO: 8540204 - DNA, 22 bp, Homo sapiens
tcacaagactgagcttgcttga

SEQ ID NO: 8540205 - DNA, 22 bp, Homo sapiens
tcacaagagctggactgtcttt

SEQ ID NO: 8540206 - DNA, 22 bp, Homo sapiens
cagtgaagttctactgaatggt

SEQ ID NO: 8540207 - DNA, 22 bp, Homo sapiens
tcacaggaccctgagggtggcg

SEQ ID NO: 8540208 - DNA, 22 bp, Homo sapiens
tcacaggacagccttccacccg

SEQ ID NO: 8540209 - DNA, 22 bp, Homo sapiens
tcacaggaaccatcagagaaat

SEQ ID NO: 8540210 - DNA, 22 bp, Homo sapiens
tcacagctttgagcagagacca

SEQ ID NO: 8540211 - DNA, 22 bp, Homo sapiens
tcacaggaccctgagggtggcg

SEQ ID NO: 8540212 - DNA, 22 bp, Homo sapiens
tcacaggaggaacctggcctgg

SEQ ID NO: 8540213 - DNA, 22 bp, Homo sapiens
tcacagactgtgttgctactca

SEQ ID NO: 8540214 - DNA, 22 bp, Homo sapiens
tcacagagaaaagctatcacaa

SEQ ID NO: 8540215 - DNA, 22 bp, Homo sapiens
tcacagagaactataatccatc

SEQ ID NO: 8540216 - DNA, 22 bp, Homo sapiens
tcacagagaactataatccatc

SEQ ID NO: 8540217 - DNA, 22 bp, Homo sapiens
tcacagctgttttgtccattaa

SEQ ID NO: 8540218 - DNA, 22 bp, Homo sapiens
tcacagctgttttgtccattaa

SEQ ID NO: 8540219 - DNA, 22 bp, Homo sapiens
tcacaggagggagagacaccca

SEQ ID NO: 8540220 - DNA, 22 bp, Homo sapiens
tcacagttaattgttggaatgt

SEQ ID NO: 8540221 - DNA, 22 bp, Homo sapiens
tcacagttactccttcagatga

SEQ ID NO: 8540222 - DNA, 22 bp, Homo sapiens
tcacagtgttggaatcagagct

SEQ ID NO: 8540223 - DNA, 22 bp, Homo sapiens
tcacagtgtggcaactcacaga

SEQ ID NO: 8540224 - DNA, 22 bp, Homo sapiens
tcacagtgtggcaactcacaga

SEQ ID NO: 8540225 - DNA, 22 bp, Homo sapiens
tcacagtgtggcaactcacaga

SEQ ID NO: 8540226 - DNA, 22 bp, Homo sapiens
cagtgcatgaaacaatatgcag

SEQ ID NO: 8540227 - DNA, 22 bp, Homo sapiens
tcacagtttccataggtcagca

SEQ ID NO: 8540228 - DNA, 22 bp, Homo sapiens
tcacagttgattgaaacacagc

SEQ ID NO: 8540229 - DNA, 22 bp, Homo sapiens
tcacagttatagtctgtagaat

SEQ ID NO: 8540230 - DNA, 22 bp, Homo sapiens
tcacagttcaactagttcagat

SEQ ID NO: 8540231 - DNA, 22 bp, Homo sapiens
tcaggaaaatactgcttatcca

SEQ ID NO: 8540232 - DNA, 22 bp, Homo sapiens
tcagcttttgtcagaaattgta

SEQ ID NO: 8540233 - DNA, 22 bp, Homo sapiens
tcagcttttgtcagaaattgta

SEQ ID NO: 8540234 - DNA, 22 bp, Homo sapiens
tcagcttttgtcagaaattgta

SEQ ID NO: 8540235 - DNA, 22 bp, Homo sapiens
tcagctttttacatgtgaaata

SEQ ID NO: 8540236 - DNA, 22 bp, Homo sapiens
tcaggaaagaagatgctcagtg

SEQ ID NO: 8540237 - DNA, 22 bp, Homo sapiens
tcaggaaagaagatgctcagtg

SEQ ID NO: 8540238 - DNA, 22 bp, Homo sapiens
cataaaatggcttgttctttaa

SEQ ID NO: 8540239 - DNA, 22 bp, Homo sapiens
cataaattgtacccattccaac

SEQ ID NO: 8540240 - DNA, 19 bp, Homo sapiens
cataaatgtacaagataca

SEQ ID NO: 8540241 - DNA, 19 bp, Homo sapiens
cataaatgtacaagataca

SEQ ID NO: 8540242 - DNA, 22 bp, Homo sapiens
cataaactcttgagattcttgt

SEQ ID NO: 8540243 - DNA, 22 bp, Homo sapiens
cataaagtagcagagcatgact

SEQ ID NO: 8540244 - DNA, 22 bp, Homo sapiens
cataaagtaggcaagcattcca

SEQ ID NO: 8540245 - DNA, 21 bp, Homo sapiens
tcagctttgcaactgcacatc

SEQ ID NO: 8540246 - DNA, 22 bp, Homo sapiens
tcagctttgatctcaggcaatc

SEQ ID NO: 8540247 - DNA, 22 bp, Homo sapiens
tcagctttgatctcaggcaatc

SEQ ID NO: 8540248 - DNA, 22 bp, Homo sapiens
tcagctgcataagtcaccttgc

SEQ ID NO: 8540249 - DNA, 22 bp, Homo sapiens
tcagctgccccagtggccccag

SEQ ID NO: 8540250 - DNA, 22 bp, Homo sapiens
tcagctttgggggtctcaggag

SEQ ID NO: 8540251 - DNA, 22 bp, Homo sapiens
tcagctttgccaccagctgtaa

SEQ ID NO: 8540252 - DNA, 22 bp, Homo sapiens
tcagctttgccaccagctgtaa

SEQ ID NO: 8540253 - DNA, 22 bp, Homo sapiens
tcagctttgcaagttagaaaat

SEQ ID NO: 8540254 - DNA, 22 bp, Homo sapiens
tcagctttggtcacattgagtt

SEQ ID NO: 8540255 - DNA, 18 bp, Homo sapiens
tcagcttttgaaaaccaa

SEQ ID NO: 8540256 - DNA, 22 bp, Homo sapiens
tcagcttttaaaaacaagaagt

SEQ ID NO: 8540257 - DNA, 21 bp, Homo sapiens
cagtttaataacaaagaagga

SEQ ID NO: 8540258 - DNA, 22 bp, Homo sapiens
cagtttaagtgtgttgaaggta

SEQ ID NO: 8540259 - DNA, 22 bp, Homo sapiens
cagtttaaggcaggacatggga

SEQ ID NO: 8540260 - DNA, 22 bp, Homo sapiens
cagtttaagtagaactgagaat

SEQ ID NO: 8540261 - DNA, 22 bp, Homo sapiens
cagtttacctatatgtaaattt

SEQ ID NO: 8540262 - DNA, 22 bp, Homo sapiens
cagtttagtaggtgatatcaat

SEQ ID NO: 8540263 - DNA, 22 bp, Homo sapiens
cagtttatagctctagcagctt

SEQ ID NO: 8540264 - DNA, 22 bp, Homo sapiens
cagtttagtgttgcatttggag

SEQ ID NO: 8540265 - DNA, 22 bp, Homo sapiens
cagtttatagttgttatgtgtg

SEQ ID NO: 8540266 - DNA, 22 bp, Homo sapiens
cagtttatatataagcacattg

SEQ ID NO: 8540267 - DNA, 22 bp, Homo sapiens
cagtttatatataagcacattg

SEQ ID NO: 8540268 - DNA, 22 bp, Homo sapiens
tcagatgcctgtggggtctagg

SEQ ID NO: 8540269 - DNA, 22 bp, Homo sapiens
cagttaacttcatatgatcatt

SEQ ID NO: 8540270 - DNA, 22 bp, Homo sapiens
cagttaatcttgccattatatc

SEQ ID NO: 8540271 - DNA, 22 bp, Homo sapiens
cagttaatgtcctatacaatag

SEQ ID NO: 8540272 - DNA, 22 bp, Homo sapiens
cagttaaaggcccaatatctgg

SEQ ID NO: 8540273 - DNA, 22 bp, Homo sapiens
cagttaaaggcccaatatctgg

SEQ ID NO: 8540274 - DNA, 22 bp, Homo sapiens
cagttaaacgggccatgtgagt

SEQ ID NO: 8540275 - DNA, 22 bp, Homo sapiens
tcagcagactaggcagattact

SEQ ID NO: 8540276 - DNA, 22 bp, Homo sapiens
tcagcagagcgagaccaagtca

SEQ ID NO: 8540277 - DNA, 22 bp, Homo sapiens
tcagcagatgggttgtgttggc

SEQ ID NO: 8540278 - DNA, 22 bp, Homo sapiens
tcagcagagtggaacattgtca

SEQ ID NO: 8540279 - DNA, 22 bp, Homo sapiens
tcagcagaggggaaggcatctg

SEQ ID NO: 8540280 - DNA, 22 bp, Homo sapiens
tcagcagaggggaaggcatctg

SEQ ID NO: 8540281 - DNA, 22 bp, Homo sapiens
tcagcagcagctcagcatgttt

SEQ ID NO: 8540282 - DNA, 22 bp, Homo sapiens
tcagcagcagctcagcatgttt

SEQ ID NO: 8540283 - DNA, 21 bp, Homo sapiens
tcagcagcatctgcctagagt

SEQ ID NO: 8540284 - DNA, 23 bp, Homo sapiens
tcagcagcagaagtgctgggatg

SEQ ID NO: 8540285 - DNA, 23 bp, Homo sapiens
tcagcagcagaagtgctgggatg

SEQ ID NO: 8540286 - DNA, 23 bp, Homo sapiens
tcagcagcagaagtgctgggatg

SEQ ID NO: 8540287 - DNA, 20 bp, Homo sapiens
cagtttaactttgagcagtt

SEQ ID NO: 8540288 - DNA, 22 bp, Homo sapiens
cagtggggggactgaggcctga

SEQ ID NO: 8540289 - DNA, 22 bp, Homo sapiens
cagtggggggactgaggcctga

SEQ ID NO: 8540290 - DNA, 22 bp, Homo sapiens
cagtggggaggccaggatagaa

SEQ ID NO: 8540291 - DNA, 23 bp, Homo sapiens
cagtgggcttctaactgctcctg

SEQ ID NO: 8540292 - DNA, 23 bp, Homo sapiens
cagtgggcttctaactgctcctg

SEQ ID NO: 8540293 - DNA, 22 bp, Homo sapiens
cagtgggggtgaggccgaggta

SEQ ID NO: 8540294 - DNA, 22 bp, Homo sapiens
cagtggggtttctgtgggtgct

SEQ ID NO: 8540295 - DNA, 22 bp, Homo sapiens
cagtgggtaggaaaggctcttc

SEQ ID NO: 8540296 - DNA, 22 bp, Homo sapiens
cagtgggtcctgcgtctgccag

SEQ ID NO: 8540297 - DNA, 22 bp, Homo sapiens
cagtgggtagtggggattagca

SEQ ID NO: 8540298 - DNA, 22 bp, Homo sapiens
cagtgggtcctaagtacagttc

SEQ ID NO: 8540299 - DNA, 22 bp, Homo sapiens
cagtgggaagggcagaggcttt

SEQ ID NO: 8540300 - DNA, 22 bp, Homo sapiens
cagtgggacatgggcactgggc

SEQ ID NO: 8540301 - DNA, 22 bp, Homo sapiens
cagtgggacatgggcactgggc

SEQ ID NO: 8540302 - DNA, 21 bp, Homo sapiens
cagtgggctgctgcgctccag

SEQ ID NO: 8540303 - DNA, 22 bp, Homo sapiens
cagtgggctgtgatggattcac

SEQ ID NO: 8540304 - DNA, 22 bp, Homo sapiens
cagtgggatatgggggcagcat

SEQ ID NO: 8540305 - DNA, 22 bp, Homo sapiens
cagtgggatatgggggcagcat

SEQ ID NO: 8540306 - DNA, 22 bp, Homo sapiens
cagtgggacatgggcactgggc

SEQ ID NO: 8540307 - DNA, 22 bp, Homo sapiens
cagtgccatgtctgagccccta

SEQ ID NO: 8540308 - DNA, 22 bp, Homo sapiens
cagtgcccaaaggaacagaaag

SEQ ID NO: 8540309 - DNA, 22 bp, Homo sapiens
cagtgccatattgaaagacatt

SEQ ID NO: 8540310 - DNA, 21 bp, Homo sapiens
cagtgccagccacaggacgcc

SEQ ID NO: 8540311 - DNA, 22 bp, Homo sapiens
cagtgccagaggtactagtgga

SEQ ID NO: 8540312 - DNA, 22 bp, Homo sapiens
cagtggcttctcatgtcattca

SEQ ID NO: 8540313 - DNA, 22 bp, Homo sapiens
cagtggcttaaataagattagg

SEQ ID NO: 8540314 - DNA, 22 bp, Homo sapiens
cagtggcttacaatgaactaga

SEQ ID NO: 8540315 - DNA, 22 bp, Homo sapiens
cagtggctgtttctggaaggca

SEQ ID NO: 8540316 - DNA, 22 bp, Homo sapiens
cagtggctgtgaccagggacct

SEQ ID NO: 8540317 - DNA, 22 bp, Homo sapiens
cagtggctgtttctggaaggca

SEQ ID NO: 8540318 - DNA, 22 bp, Homo sapiens
cagtggcttctcatgtcattca

SEQ ID NO: 8540319 - DNA, 22 bp, Homo sapiens
cagtggcttctcatgtcattca

SEQ ID NO: 8540320 - DNA, 22 bp, Homo sapiens
cagtggcttcttcctagagcca

SEQ ID NO: 8540321 - DNA, 22 bp, Homo sapiens
cagtggcttcttcctagagcca

SEQ ID NO: 8540322 - DNA, 22 bp, Homo sapiens
cagtggctgagagtggacactg

SEQ ID NO: 8540323 - DNA, 22 bp, Homo sapiens
cagtggctggttagggacagga

SEQ ID NO: 8540324 - DNA, 22 bp, Homo sapiens
cagtggctggttagggacagga

SEQ ID NO: 8540325 - DNA, 19 bp, Homo sapiens
tcagactgaaagtttagat

SEQ ID NO: 8540326 - DNA, 22 bp, Homo sapiens
tcagactgatcatctatcagat

SEQ ID NO: 8540327 - DNA, 21 bp, Homo sapiens
tcagacttgagctcttctaca

SEQ ID NO: 8540328 - DNA, 22 bp, Homo sapiens
tcagacttgactttgtaagttt

SEQ ID NO: 8540329 - DNA, 20 bp, Homo sapiens
tcagacttgattctatgcta

SEQ ID NO: 8540330 - DNA, 22 bp, Homo sapiens
tcagacttgcctttttataaaa

SEQ ID NO: 8540331 - DNA, 22 bp, Homo sapiens
tcagactttaaaggctaacagg

SEQ ID NO: 8540332 - DNA, 22 bp, Homo sapiens
tcagagaaaatggaaactttta

SEQ ID NO: 8540333 - DNA, 22 bp, Homo sapiens
tcagacttcagtttttagttgt

SEQ ID NO: 8540334 - DNA, 22 bp, Homo sapiens
tcagacttccactttgtgcact

SEQ ID NO: 8540335 - DNA, 22 bp, Homo sapiens
tcagacttctactttgcagagc

SEQ ID NO: 8540336 - DNA, 22 bp, Homo sapiens
cagtgtctccagatgctccaat

SEQ ID NO: 8540337 - DNA, 22 bp, Homo sapiens
cagtgtctccagatgctccaat

SEQ ID NO: 8540338 - DNA, 21 bp, Homo sapiens
tcagagaacccggcaggcaag

SEQ ID NO: 8540339 - DNA, 22 bp, Homo sapiens
cagtgtctcagtttcacttgaa

SEQ ID NO: 8540340 - DNA, 22 bp, Homo sapiens
tcagagaacacagaggtgatgt

SEQ ID NO: 8540341 - DNA, 22 bp, Homo sapiens
tcagagaacacagaggtgatgt

SEQ ID NO: 8540342 - DNA, 22 bp, Homo sapiens
tcagagaaatgctgagctcatg

SEQ ID NO: 8540343 - DNA, 22 bp, Homo sapiens
tcagagaacacagaggtgatgt

SEQ ID NO: 8540344 - DNA, 22 bp, Homo sapiens
tcagacttttaaagactgaatg

SEQ ID NO: 8540345 - DNA, 22 bp, Homo sapiens
tcagagaaataattgctgagtt

SEQ ID NO: 8540346 - DNA, 22 bp, Homo sapiens
tcagagaaataattgctgagtt

SEQ ID NO: 8540347 - DNA, 22 bp, Homo sapiens
tcagagaaataattgctgagtt

SEQ ID NO: 8540348 - DNA, 22 bp, Homo sapiens
tcagagaaatgaagtagggatt

SEQ ID NO: 8540349 - DNA, 22 bp, Homo sapiens
tcagagaaatgaagtagggatt

SEQ ID NO: 8540350 - DNA, 22 bp, Homo sapiens
cagttaaaatgtgctataagaa

SEQ ID NO: 8540351 - DNA, 22 bp, Homo sapiens
cagtgtttgtggaattcaggtg

SEQ ID NO: 8540352 - DNA, 22 bp, Homo sapiens
cagtgtttccgtcagtatgtga

SEQ ID NO: 8540353 - DNA, 22 bp, Homo sapiens
cagtgtctgggacagaaagtca

SEQ ID NO: 8540354 - DNA, 22 bp, Homo sapiens
cagtgtctggttggctctacgt

SEQ ID NO: 8540355 - DNA, 22 bp, Homo sapiens
cagtgtcttatttgtagctcag

SEQ ID NO: 8540356 - DNA, 18 bp, Homo sapiens
cagtgtcttggtaaaata

SEQ ID NO: 8540357 - DNA, 22 bp, Homo sapiens
cagtgtcttatttgtagctcag

SEQ ID NO: 8540358 - DNA, 18 bp, Homo sapiens
cagtgtcttggtaaaata

SEQ ID NO: 8540359 - DNA, 22 bp, Homo sapiens
cagtgtctgaaataacaccgga

SEQ ID NO: 8540360 - DNA, 22 bp, Homo sapiens
cagtgtctcccccaggttctgt

SEQ ID NO: 8540361 - DNA, 22 bp, Homo sapiens
cagtgtctccagatgctccaat

SEQ ID NO: 8540362 - DNA, 22 bp, Homo sapiens
cagtgtctgcctttctgtttgg

SEQ ID NO: 8540363 - DNA, 22 bp, Homo sapiens
cagtgtctgggacagaaagtca

SEQ ID NO: 8540364 - DNA, 22 bp, Homo sapiens
cagtgtgaggaattagtgtcca

SEQ ID NO: 8540365 - DNA, 22 bp, Homo sapiens
cagtgtgcctgaatcaagtgtt

SEQ ID NO: 8540366 - DNA, 22 bp, Homo sapiens
cagtgtgcctgaatcaagtgtt

SEQ ID NO: 8540367 - DNA, 22 bp, Homo sapiens
cagtgtgacttctgagctgcca

SEQ ID NO: 8540368 - DNA, 22 bp, Homo sapiens
cagtgtgacttctgagctgcca

SEQ ID NO: 8540369 - DNA, 22 bp, Homo sapiens
cagtgtctttcagactcagaaa

SEQ ID NO: 8540370 - DNA, 23 bp, Homo sapiens
cagtgtgacgaggtgaggcaggc

SEQ ID NO: 8540371 - DNA, 22 bp, Homo sapiens
gtgaggggtggctgagcagttt

SEQ ID NO: 8540372 - DNA, 22 bp, Homo sapiens
gtgaggggtggctgagcagttt

SEQ ID NO: 8540373 - DNA, 22 bp, Homo sapiens
gtgaggggtggctgagcagttt

SEQ ID NO: 8540374 - DNA, 22 bp, Homo sapiens
gtgaggggccaagagtagggca

SEQ ID NO: 8540375 - DNA, 22 bp, Homo sapiens
gtgaggggccaagagtagggca

SEQ ID NO: 8540376 - DNA, 22 bp, Homo sapiens
gtgaggggtctggacgcacagt

SEQ ID NO: 8540377 - DNA, 22 bp, Homo sapiens
gtgaggggtctggacgcacagt

SEQ ID NO: 8540378 - DNA, 22 bp, Homo sapiens
tactatttggaattttaaattg

SEQ ID NO: 8540379 - DNA, 22 bp, Homo sapiens
tactatgttcttcctaaatagt

SEQ ID NO: 8540380 - DNA, 22 bp, Homo sapiens
tactattgaatcattgtcaatc

SEQ ID NO: 8540381 - DNA, 22 bp, Homo sapiens
tactatttatggagtggttatt

SEQ ID NO: 8540382 - DNA, 22 bp, Homo sapiens
tactatgtgaaaatactatagt

SEQ ID NO: 8540383 - DNA, 22 bp, Homo sapiens
tacctgaagtaacaatgaatat

SEQ ID NO: 8540384 - DNA, 22 bp, Homo sapiens
tacctgaaccaagcccagctct

SEQ ID NO: 8540385 - DNA, 22 bp, Homo sapiens
tacctctggacattgtggagca

SEQ ID NO: 8540386 - DNA, 22 bp, Homo sapiens
tacctgaaccaagcccagctct

SEQ ID NO: 8540387 - DNA, 20 bp, Homo sapiens
cagccctgtgacctggccct

SEQ ID NO: 8540388 - DNA, 20 bp, Homo sapiens
cagccctgtgacctggccct

SEQ ID NO: 8540389 - DNA, 22 bp, Homo sapiens
cagccctgtctatgactgatga

SEQ ID NO: 8540390 - DNA, 20 bp, Homo sapiens
cagccctgtgacctggccct

SEQ ID NO: 8540391 - DNA, 22 bp, Homo sapiens
gtgaggggccaagagtagggca

SEQ ID NO: 8540392 - DNA, 17 bp, Homo sapiens
gtgagggcagaggatgg

SEQ ID NO: 8540393 - DNA, 17 bp, Homo sapiens
gtgagggcagaggatgg

SEQ ID NO: 8540394 - DNA, 22 bp, Homo sapiens
gtgaggggagtaaagccatgtt

SEQ ID NO: 8540395 - DNA, 22 bp, Homo sapiens
gtgaggggagtaaagccatgtt

SEQ ID NO: 8540396 - DNA, 22 bp, Homo sapiens
gtgaggggagtaaagccatgtt

SEQ ID NO: 8540397 - DNA, 22 bp, Homo sapiens
gtgaggggagtaaagccatgtt

SEQ ID NO: 8540398 - DNA, 22 bp, Homo sapiens
tactattttgacatgaaattga

SEQ ID NO: 8540399 - DNA, 22 bp, Homo sapiens
tactcaaactcactaagacaga

SEQ ID NO: 8540400 - DNA, 22 bp, Homo sapiens
tactcaaaaagttatgaatcat

SEQ ID NO: 8540401 - DNA, 22 bp, Homo sapiens
tactcacattctgtttcttgct

SEQ ID NO: 8540402 - DNA, 22 bp, Homo sapiens
tactcagagtcattgcccttct

SEQ ID NO: 8540403 - DNA, 22 bp, Homo sapiens
tactgtatatgcttgtatctga

SEQ ID NO: 8540404 - DNA, 22 bp, Homo sapiens
tactgtatactactgctgttct

SEQ ID NO: 8540405 - DNA, 21 bp, Homo sapiens
tactgtatagatgtgttcttg

SEQ ID NO: 8540406 - DNA, 22 bp, Homo sapiens
tactgtatgatttcatgtatat

SEQ ID NO: 8540407 - DNA, 22 bp, Homo sapiens
tactgtatgaattatgttattt

SEQ ID NO: 8540408 - DNA, 23 bp, Homo sapiens
tactgtatattactgtgttatac

SEQ ID NO: 8540409 - DNA, 22 bp, Homo sapiens
tactgtctggagttgccaaagg

SEQ ID NO: 8540410 - DNA, 22 bp, Homo sapiens
tactgtctgcttcttatagctt

SEQ ID NO: 8540411 - DNA, 22 bp, Homo sapiens
tactgtctggagttgccaaagg

SEQ ID NO: 8540412 - DNA, 22 bp, Homo sapiens
tactgtctatacacttgattac

SEQ ID NO: 8540413 - DNA, 22 bp, Homo sapiens
tactgtctatacacttgattac

SEQ ID NO: 8540414 - DNA, 22 bp, Homo sapiens
tactgtctctgccctggccagg

SEQ ID NO: 8540415 - DNA, 22 bp, Homo sapiens
tactgtctctgccctggccagg

SEQ ID NO: 8540416 - DNA, 22 bp, Homo sapiens
tactgtatttgataagtgaagt

SEQ ID NO: 8540417 - DNA, 22 bp, Homo sapiens
tactgtatttgataagtgaagt

SEQ ID NO: 8540418 - DNA, 22 bp, Homo sapiens
tactgtatttgataagtgaagt

SEQ ID NO: 8540419 - DNA, 22 bp, Homo sapiens
tactgtctaataagattgatgg

SEQ ID NO: 8540420 - DNA, 22 bp, Homo sapiens
caggctggagtgcagtggcgct

SEQ ID NO: 8540421 - DNA, 22 bp, Homo sapiens
caggctggagtgcagtggcgct

SEQ ID NO: 8540422 - DNA, 22 bp, Homo sapiens
caggctggagtgcagtggggcg

SEQ ID NO: 8540423 - DNA, 22 bp, Homo sapiens
caggctggagtgcagtggggcg

SEQ ID NO: 8540424 - DNA, 22 bp, Homo sapiens
caggctggagtgcagtggggcg

SEQ ID NO: 8540425 - DNA, 22 bp, Homo sapiens
caggctggagtgcagtggggcg

SEQ ID NO: 8540426 - DNA, 22 bp, Homo sapiens
caggctggagtgcagtggcgcc

SEQ ID NO: 8540427 - DNA, 22 bp, Homo sapiens
caggctggagtgcagtggcgcc

SEQ ID NO: 8540428 - DNA, 22 bp, Homo sapiens
caggctggagtgcagtggcgct

SEQ ID NO: 8540429 - DNA, 22 bp, Homo sapiens
caggctggagtgcagtggcgct

SEQ ID NO: 8540430 - DNA, 22 bp, Homo sapiens
caggctggagtgcagtggcgct

SEQ ID NO: 8540431 - DNA, 22 bp, Homo sapiens
caggctggagtgcagtggtgcc

SEQ ID NO: 8540432 - DNA, 22 bp, Homo sapiens
caggctggagtgcagtggggcg

SEQ ID NO: 8540433 - DNA, 22 bp, Homo sapiens
caggctggagtgcagtggtgcc

SEQ ID NO: 8540434 - DNA, 22 bp, Homo sapiens
tagaacataagtcattcatttg

SEQ ID NO: 8540435 - DNA, 22 bp, Homo sapiens
tagaacataagtcattcatttg

SEQ ID NO: 8540436 - DNA, 22 bp, Homo sapiens
tagaatatgattaattttctta

SEQ ID NO: 8540437 - DNA, 22 bp, Homo sapiens
tagaatatacactacagcttaa

SEQ ID NO: 8540438 - DNA, 22 bp, Homo sapiens
caggctggagtgcaatgacgcc

SEQ ID NO: 8540439 - DNA, 22 bp, Homo sapiens
caggctggagtgcaatggcaca

SEQ ID NO: 8540440 - DNA, 22 bp, Homo sapiens
caggctggagtgcagtggcgcc

SEQ ID NO: 8540441 - DNA, 22 bp, Homo sapiens
caggctggagtgcagtggcgcc

SEQ ID NO: 8540442 - DNA, 22 bp, Homo sapiens
caggctggagtgcagtggcgcc

SEQ ID NO: 8540443 - DNA, 22 bp, Homo sapiens
caggctggagtgcaatggtgct

SEQ ID NO: 8540444 - DNA, 22 bp, Homo sapiens
caggctggagtgcaatggtgct

SEQ ID NO: 8540445 - DNA, 22 bp, Homo sapiens
caggctggagtgcaatggtgct

SEQ ID NO: 8540446 - DNA, 22 bp, Homo sapiens
caggctggagtgagtgtagtgg

SEQ ID NO: 8540447 - DNA, 22 bp, Homo sapiens
caggctggagtgagtgtagtgg

SEQ ID NO: 8540448 - DNA, 22 bp, Homo sapiens
caggctggagtgagtgtagtgg

SEQ ID NO: 8540449 - DNA, 22 bp, Homo sapiens
caggctggagtgagtgtagtgg

SEQ ID NO: 8540450 - DNA, 22 bp, Homo sapiens
tactgtctgggttcccaagcaa

SEQ ID NO: 8540451 - DNA, 22 bp, Homo sapiens
tactgtgaatacaaaataaatt

SEQ ID NO: 8540452 - DNA, 22 bp, Homo sapiens
tactgtgaatacaaaataaatt

SEQ ID NO: 8540453 - DNA, 22 bp, Homo sapiens
tactgtgacagagtacttaaac

SEQ ID NO: 8540454 - DNA, 22 bp, Homo sapiens
tactgtgacagagtacttaaac

SEQ ID NO: 8540455 - DNA, 22 bp, Homo sapiens
tactgtctgcttcttatagctt

SEQ ID NO: 8540456 - DNA, 22 bp, Homo sapiens
caggctgccgtggggtccaggc

SEQ ID NO: 8540457 - DNA, 22 bp, Homo sapiens
caggctggtcccagagcattgc

SEQ ID NO: 8540458 - DNA, 22 bp, Homo sapiens
caggctggtcccagagcattgc

SEQ ID NO: 8540459 - DNA, 22 bp, Homo sapiens
tagacattttctcaacatctct

SEQ ID NO: 8540460 - DNA, 22 bp, Homo sapiens
tagacattttaagacatatacc

SEQ ID NO: 8540461 - DNA, 22 bp, Homo sapiens
caggctgggctggtgttagagt

SEQ ID NO: 8540462 - DNA, 22 bp, Homo sapiens
caggctgggctccggagataaa

SEQ ID NO: 8540463 - DNA, 22 bp, Homo sapiens
caggctgggcagcctccccggc

SEQ ID NO: 8540464 - DNA, 22 bp, Homo sapiens
caggctgggcagcctccccggc

SEQ ID NO: 8540465 - DNA, 22 bp, Homo sapiens
caggctgggctccggagataaa

SEQ ID NO: 8540466 - DNA, 22 bp, Homo sapiens
caggctgggcagcctccccggc

SEQ ID NO: 8540467 - DNA, 22 bp, Homo sapiens
caggctgggcagcctccccggc

SEQ ID NO: 8540468 - DNA, 21 bp, Homo sapiens
tagaatcactaataagatgta

SEQ ID NO: 8540469 - DNA, 21 bp, Homo sapiens
tagaatcactaataagatgta

SEQ ID NO: 8540470 - DNA, 22 bp, Homo sapiens
tagaatatgtggtaggatctgg

SEQ ID NO: 8540471 - DNA, 22 bp, Homo sapiens
tagagctggaatttgcagcaag

SEQ ID NO: 8540472 - DNA, 22 bp, Homo sapiens
tagagctggaatttgcagcaag

SEQ ID NO: 8540473 - DNA, 22 bp, Homo sapiens
tagagctggaatttgcagcaag

SEQ ID NO: 8540474 - DNA, 22 bp, Homo sapiens
tagagctggccgggacagctgg

SEQ ID NO: 8540475 - DNA, 22 bp, Homo sapiens
tagagctggccgggacagctgg

SEQ ID NO: 8540476 - DNA, 22 bp, Homo sapiens
tagagctgggcagtgctctgag

SEQ ID NO: 8540477 - DNA, 22 bp, Homo sapiens
tagagctgggcagtgctctgag

SEQ ID NO: 8540478 - DNA, 19 bp, Homo sapiens
tagagctgcttcctggcag

SEQ ID NO: 8540479 - DNA, 22 bp, Homo sapiens
tagagctggaaaactgcaggta

SEQ ID NO: 8540480 - DNA, 22 bp, Homo sapiens
tagagctggaaaactgcaggta

SEQ ID NO: 8540481 - DNA, 22 bp, Homo sapiens
tagagcttggactgcattttcg

SEQ ID NO: 8540482 - DNA, 22 bp, Homo sapiens
tagaggaaatttccaaggtgag

SEQ ID NO: 8540483 - DNA, 22 bp, Homo sapiens
tagagcttggggatttagtagt

SEQ ID NO: 8540484 - DNA, 22 bp, Homo sapiens
tagagctgtatcaaagagcctt

SEQ ID NO: 8540485 - DNA, 17 bp, Homo sapiens
tagagctggttcaggag

SEQ ID NO: 8540486 - DNA, 17 bp, Homo sapiens
tagagctggttcaggag

SEQ ID NO: 8540487 - DNA, 17 bp, Homo sapiens
tagagctggttcaggag

SEQ ID NO: 8540488 - DNA, 22 bp, Homo sapiens
tagaggagaacacaaattatag

SEQ ID NO: 8540489 - DNA, 22 bp, Homo sapiens
tagaggaaccaggcaggctgag

SEQ ID NO: 8540490 - DNA, 19 bp, Homo sapiens
tagaggagaagggaagtgg

SEQ ID NO: 8540491 - DNA, 22 bp, Homo sapiens
tagagtgtccaacacataggag

SEQ ID NO: 8540492 - DNA, 22 bp, Homo sapiens
tagagtgtccaacacataggag

SEQ ID NO: 8540493 - DNA, 22 bp, Homo sapiens
tagataaattagaaagtttact

SEQ ID NO: 8540494 - DNA, 22 bp, Homo sapiens
tagataaattagaaagtttact

SEQ ID NO: 8540495 - DNA, 21 bp, Homo sapiens
cagggcacacagaggatggta

SEQ ID NO: 8540496 - DNA, 21 bp, Homo sapiens
cagggcacacagaggatggta

SEQ ID NO: 8540497 - DNA, 20 bp, Homo sapiens
cagggcacactgcagcctcg

SEQ ID NO: 8540498 - DNA, 22 bp, Homo sapiens
cagggcacagttatggaggtgg

SEQ ID NO: 8540499 - DNA, 22 bp, Homo sapiens
cagggcacagttatggaggtgg

SEQ ID NO: 8540500 - DNA, 22 bp, Homo sapiens
cagggcacagatcggggcgcac

SEQ ID NO: 8540501 - DNA, 22 bp, Homo sapiens
cagggcacttaaattgcctcgt

SEQ ID NO: 8540502 - DNA, 22 bp, Homo sapiens
cagggcagaacatatagatagt

SEQ ID NO: 8540503 - DNA, 22 bp, Homo sapiens
cagggcagaacatatagatagt

SEQ ID NO: 8540504 - DNA, 22 bp, Homo sapiens
cagggcagaaggcactctactc

SEQ ID NO: 8540505 - DNA, 22 bp, Homo sapiens
cagggcagaaggcactctactc

SEQ ID NO: 8540506 - DNA, 22 bp, Homo sapiens
cagggcaaagagagcacatgct

SEQ ID NO: 8540507 - DNA, 22 bp, Homo sapiens
cagggcaaagagagcacatgct

SEQ ID NO: 8540508 - DNA, 22 bp, Homo sapiens
cagggcaaagagagcacatgct

SEQ ID NO: 8540509 - DNA, 21 bp, Homo sapiens
cagggcaaccaagtccagaga

SEQ ID NO: 8540510 - DNA, 21 bp, Homo sapiens
cagggcacacagaggatggta

SEQ ID NO: 8540511 - DNA, 22 bp, Homo sapiens
tagataatttggcatcatattg

SEQ ID NO: 8540512 - DNA, 19 bp, Homo sapiens
tagataaggcatttaatct

SEQ ID NO: 8540513 - DNA, 22 bp, Homo sapiens
tagataacttgcacctacagga

SEQ ID NO: 8540514 - DNA, 22 bp, Homo sapiens
tagataaattagaaagtttact

SEQ ID NO: 8540515 - DNA, 22 bp, Homo sapiens
tagataacagcactggcctcgc

SEQ ID NO: 8540516 - DNA, 22 bp, Homo sapiens
tagctacaatcactgtcctttg

SEQ ID NO: 8540517 - DNA, 22 bp, Homo sapiens
tagctaatggtgaagattcaga

SEQ ID NO: 8540518 - DNA, 22 bp, Homo sapiens
tagcattccatcttggacttgt

SEQ ID NO: 8540519 - DNA, 22 bp, Homo sapiens
tagcattccttgtggcttctga

SEQ ID NO: 8540520 - DNA, 22 bp, Homo sapiens
tagcattccatcactcagcacc

SEQ ID NO: 8540521 - DNA, 22 bp, Homo sapiens
tagcattcagaactgagagcaa

SEQ ID NO: 8540522 - DNA, 20 bp, Homo sapiens
tagcaatgagtgttccattt

SEQ ID NO: 8540523 - DNA, 22 bp, Homo sapiens
tagcaatagaaacatataaagt

SEQ ID NO: 8540524 - DNA, 22 bp, Homo sapiens
tagcaatgctctatgatgaaaa

SEQ ID NO: 8540525 - DNA, 22 bp, Homo sapiens
tagcaatgtgtgtgtataaatt

SEQ ID NO: 8540526 - DNA, 22 bp, Homo sapiens
tagcaatgtgtgtgtataaatt

SEQ ID NO: 8540527 - DNA, 22 bp, Homo sapiens
tagcaatgcttcattatttaaa

SEQ ID NO: 8540528 - DNA, 22 bp, Homo sapiens
tagcaatgtaagatgttaacac

SEQ ID NO: 8540529 - DNA, 22 bp, Homo sapiens
tagcaaggtgaagtatgggtga

SEQ ID NO: 8540530 - DNA, 22 bp, Homo sapiens
tagcaaggacgtccaaagaact

SEQ ID NO: 8540531 - DNA, 22 bp, Homo sapiens
tagcaaggtgaagtatgggtga

SEQ ID NO: 8540532 - DNA, 22 bp, Homo sapiens
tagcaagtgttggtgaagatgt

SEQ ID NO: 8540533 - DNA, 22 bp, Homo sapiens
tagcaaggcgtggcactcaaat

SEQ ID NO: 8540534 - DNA, 22 bp, Homo sapiens
tagcaaggcttccaatgaacag

SEQ ID NO: 8540535 - DNA, 22 bp, Homo sapiens
tagcaaggacaacatatgagag

SEQ ID NO: 8540536 - DNA, 22 bp, Homo sapiens
tagcaaggacaacatatgagag

SEQ ID NO: 8540537 - DNA, 22 bp, Homo sapiens
tagcaagatcgtgtctctaaaa

SEQ ID NO: 8540538 - DNA, 22 bp, Homo sapiens
tatcatgatcagcaactaatca

SEQ ID NO: 8540539 - DNA, 22 bp, Homo sapiens
tatcatctgcaaagcacatcta

SEQ ID NO: 8540540 - DNA, 22 bp, Homo sapiens
tatcataagttaattaaacagt

SEQ ID NO: 8540541 - DNA, 22 bp, Homo sapiens
tatcataagttaattaaacagt

SEQ ID NO: 8540542 - DNA, 22 bp, Homo sapiens
tatcatcactgtaatccgttga

SEQ ID NO: 8540543 - DNA, 22 bp, Homo sapiens
tatcagtagaacaatggacatt

SEQ ID NO: 8540544 - DNA, 22 bp, Homo sapiens
tatcagtagataaacggattgc

SEQ ID NO: 8540545 - DNA, 20 bp, Homo sapiens
tatcagtaggatattctgcc

SEQ ID NO: 8540546 - DNA, 22 bp, Homo sapiens
tatcagtatggattcatggatt

SEQ ID NO: 8540547 - DNA, 22 bp, Homo sapiens
tatcataagttaattaaacagt

SEQ ID NO: 8540548 - DNA, 22 bp, Homo sapiens
tatcatttaacagaatcattgc

SEQ ID NO: 8540549 - DNA, 22 bp, Homo sapiens
cagggtggcactcagcgcatct

SEQ ID NO: 8540550 - DNA, 22 bp, Homo sapiens
tatcatttaacagaatcattgc

SEQ ID NO: 8540551 - DNA, 22 bp, Homo sapiens
tatcatttaacagaatcattgc

SEQ ID NO: 8540552 - DNA, 22 bp, Homo sapiens
tatcattatacagacgtataca

SEQ ID NO: 8540553 - DNA, 22 bp, Homo sapiens
tatcattgtgtttgccagtcac

SEQ ID NO: 8540554 - DNA, 22 bp, Homo sapiens
tatcattgtgttatttcttcca

SEQ ID NO: 8540555 - DNA, 22 bp, Homo sapiens
tatcattgctgatgtgctgaga

SEQ ID NO: 8540556 - DNA, 22 bp, Homo sapiens
cagggtggcaggcaccatggcc

SEQ ID NO: 8540557 - DNA, 22 bp, Homo sapiens
cagggtggccaggtagataata

SEQ ID NO: 8540558 - DNA, 22 bp, Homo sapiens
cagggtggcaggcaccatggcc

SEQ ID NO: 8540559 - DNA, 22 bp, Homo sapiens
cagggtggcaggcaccatggcc

SEQ ID NO: 8540560 - DNA, 22 bp, Homo sapiens
cagggtggcaggcaccatggcc

SEQ ID NO: 8540561 - DNA, 22 bp, Homo sapiens
cagggtggcactcagcgcatct

SEQ ID NO: 8540562 - DNA, 22 bp, Homo sapiens
cagggtggcactcagcgcatct

SEQ ID NO: 8540563 - DNA, 22 bp, Homo sapiens
tagtgattaaaggcagaatgtt

SEQ ID NO: 8540564 - DNA, 22 bp, Homo sapiens
tatatttaaatccaggttgaaa

SEQ ID NO: 8540565 - DNA, 22 bp, Homo sapiens
tatatttaaatccaggttgaaa

SEQ ID NO: 8540566 - DNA, 22 bp, Homo sapiens
tagtgaaacctgacagatcatg

SEQ ID NO: 8540567 - DNA, 22 bp, Homo sapiens
tagtgaaagtcaaagacagcta

SEQ ID NO: 8540568 - DNA, 22 bp, Homo sapiens
tagtgaaagtcaaagacagcta

SEQ ID NO: 8540569 - DNA, 22 bp, Homo sapiens
tagtgaaatgataacagagcag

SEQ ID NO: 8540570 - DNA, 22 bp, Homo sapiens
tagtctttttaataaataatgc

SEQ ID NO: 8540571 - DNA, 22 bp, Homo sapiens
tagtctttttaataaataatgc

SEQ ID NO: 8540572 - DNA, 22 bp, Homo sapiens
tagtgaaacctgacagatcatg

SEQ ID NO: 8540573 - DNA, 22 bp, Homo sapiens
tagtgaaacctgacagatcatg

SEQ ID NO: 8540574 - DNA, 19 bp, Homo sapiens
tagtctttattcttaattt

SEQ ID NO: 8540575 - DNA, 22 bp, Homo sapiens
tagtcttttgagaagtatatct

SEQ ID NO: 8540576 - DNA, 22 bp, Homo sapiens
caggggagttttatgcaacaga

SEQ ID NO: 8540577 - DNA, 22 bp, Homo sapiens
caggggcaagaatgctgtcagc

SEQ ID NO: 8540578 - DNA, 22 bp, Homo sapiens
caggggcaagaatgctgtcagc

SEQ ID NO: 8540579 - DNA, 22 bp, Homo sapiens
caggggagttttatgcaacaga

SEQ ID NO: 8540580 - DNA, 22 bp, Homo sapiens
cagggctttgaacaggcatcaa

SEQ ID NO: 8540581 - DNA, 22 bp, Homo sapiens
cagggctttgtgtgcctgggga

SEQ ID NO: 8540582 - DNA, 22 bp, Homo sapiens
caggggaaggagccttgaaact

SEQ ID NO: 8540583 - DNA, 22 bp, Homo sapiens
caggggaagatgccaagggaga

SEQ ID NO: 8540584 - DNA, 22 bp, Homo sapiens
caggggacagtatggtggatga

SEQ ID NO: 8540585 - DNA, 22 bp, Homo sapiens
caggggacactcctgcttgggc

SEQ ID NO: 8540586 - DNA, 22 bp, Homo sapiens
caggggacattaaagctccata

SEQ ID NO: 8540587 - DNA, 22 bp, Homo sapiens
caggggacattaaagctccata

SEQ ID NO: 8540588 - DNA, 22 bp, Homo sapiens
taggtagatacatgtgttggct

SEQ ID NO: 8540589 - DNA, 22 bp, Homo sapiens
taggtacttaagatctcagcta

SEQ ID NO: 8540590 - DNA, 22 bp, Homo sapiens
taggtacagctaaaaattatct

SEQ ID NO: 8540591 - DNA, 22 bp, Homo sapiens
taggtagctttggcgtttcttg

SEQ ID NO: 8540592 - DNA, 22 bp, Homo sapiens
tagggtggagactggaagcagg

SEQ ID NO: 8540593 - DNA, 22 bp, Homo sapiens
tagggtggagactggaagcagg

SEQ ID NO: 8540594 - DNA, 22 bp, Homo sapiens
tagggtgggcagttcttgggga

SEQ ID NO: 8540595 - DNA, 22 bp, Homo sapiens
tagggtggagactggaagcagg

SEQ ID NO: 8540596 - DNA, 22 bp, Homo sapiens
tagggtggttagaaggagtatg

SEQ ID NO: 8540597 - DNA, 22 bp, Homo sapiens
tagggtggttagaaggagtatg

SEQ ID NO: 8540598 - DNA, 22 bp, Homo sapiens
tagggtggttagaaggagtatg

SEQ ID NO: 8540599 - DNA, 22 bp, Homo sapiens
tagggtagtaccatgctgccag

SEQ ID NO: 8540600 - DNA, 22 bp, Homo sapiens
tagggtacatgtgcacaacatg

SEQ ID NO: 8540601 - DNA, 22 bp, Homo sapiens
tagggctcgggcacaggacagg

SEQ ID NO: 8540602 - DNA, 22 bp, Homo sapiens
tagggctcgggcacaggacagg

SEQ ID NO: 8540603 - DNA, 22 bp, Homo sapiens
tagggctcagctctagctcctg

SEQ ID NO: 8540604 - DNA, 22 bp, Homo sapiens
tagggctcagagtccagtttct

SEQ ID NO: 8540605 - DNA, 22 bp, Homo sapiens
tagggctcagagaagtggggcc

SEQ ID NO: 8540606 - DNA, 20 bp, Homo sapiens
tagggctcattatgatctcc

SEQ ID NO: 8540607 - DNA, 22 bp, Homo sapiens
tagggctccactcccagagatt

SEQ ID NO: 8540608 - DNA, 22 bp, Homo sapiens
tagggcagtttcatgttatctt

SEQ ID NO: 8540609 - DNA, 22 bp, Homo sapiens
tagggcagttataacattagtg

SEQ ID NO: 8540610 - DNA, 22 bp, Homo sapiens
tagggctcagagaagtggggcc

SEQ ID NO: 8540611 - DNA, 22 bp, Homo sapiens
tagggctcactgagatgaatat

SEQ ID NO: 8540612 - DNA, 21 bp, Homo sapiens
tagggcaggcattggaagaga

SEQ ID NO: 8540613 - DNA, 22 bp, Homo sapiens
cagggctcatctgtgtgaccag

SEQ ID NO: 8540614 - DNA, 22 bp, Homo sapiens
tagggcaggggaggaatctgaa

SEQ ID NO: 8540615 - DNA, 22 bp, Homo sapiens
tagggcaggtgaagaaaagcta

SEQ ID NO: 8540616 - DNA, 22 bp, Homo sapiens
cagggcctgtacaagtcccacc

SEQ ID NO: 8540617 - DNA, 22 bp, Homo sapiens
cagggccttatcctgccattga

SEQ ID NO: 8540618 - DNA, 22 bp, Homo sapiens
cagggccttatcctgccattga

SEQ ID NO: 8540619 - DNA, 22 bp, Homo sapiens
cagggccttgttcaggagtgaa

SEQ ID NO: 8540620 - DNA, 22 bp, Homo sapiens
cagggcctttcagggtaaaagg

SEQ ID NO: 8540621 - DNA, 22 bp, Homo sapiens
cagggccttgttcaggagtgaa

SEQ ID NO: 8540622 - DNA, 22 bp, Homo sapiens
cagggcggggtctgccggccct

SEQ ID NO: 8540623 - DNA, 21 bp, Homo sapiens
cagggctagagagaatgacaa

SEQ ID NO: 8540624 - DNA, 22 bp, Homo sapiens
cagggccttttagcatcttctc

SEQ ID NO: 8540625 - DNA, 22 bp, Homo sapiens
cagggccttttagcatcttctc

SEQ ID NO: 8540626 - DNA, 22 bp, Homo sapiens
cagggctcagggactgcagaaa

SEQ ID NO: 8540627 - DNA, 22 bp, Homo sapiens
cagggctcagggactgcagaaa

SEQ ID NO: 8540628 - DNA, 22 bp, Homo sapiens
cagggctcagggactgcagaaa

SEQ ID NO: 8540629 - DNA, 22 bp, Homo sapiens
cagggctcaggaaatcagacgt

SEQ ID NO: 8540630 - DNA, 22 bp, Homo sapiens
cagggctcaggaaatcagacgt

SEQ ID NO: 8540631 - DNA, 22 bp, Homo sapiens
cagggctcagaagacagacctc

SEQ ID NO: 8540632 - DNA, 22 bp, Homo sapiens
cagggctcactcggctggcgtc

SEQ ID NO: 8540633 - DNA, 22 bp, Homo sapiens
cagggcctgcttccttcttgtt

SEQ ID NO: 8540634 - DNA, 22 bp, Homo sapiens
cagggcctgcttccttcttgtt

SEQ ID NO: 8540635 - DNA, 22 bp, Homo sapiens
cagggcctgcctggttcctgga

SEQ ID NO: 8540636 - DNA, 22 bp, Homo sapiens
cagggcctgcctggttcctgga

SEQ ID NO: 8540637 - DNA, 22 bp, Homo sapiens
cagggcctggagctgggcctgc

SEQ ID NO: 8540638 - DNA, 22 bp, Homo sapiens
cagggcctggagctgggcctgc

SEQ ID NO: 8540639 - DNA, 22 bp, Homo sapiens
taggagcttttggagtcctgtg

SEQ ID NO: 8540640 - DNA, 22 bp, Homo sapiens
taggagctataatgtgaagtct

SEQ ID NO: 8540641 - DNA, 22 bp, Homo sapiens
taggagctaaaatattttatat

SEQ ID NO: 8540642 - DNA, 22 bp, Homo sapiens
cagggcctcattgtcagtcctg

SEQ ID NO: 8540643 - DNA, 22 bp, Homo sapiens
taggagaggtgaatggcacact

SEQ ID NO: 8540644 - DNA, 18 bp, Homo sapiens
taggagagaatttattta

SEQ ID NO: 8540645 - DNA, 17 bp, Homo sapiens
taggagactggctgtcc

SEQ ID NO: 8540646 - DNA, 22 bp, Homo sapiens
taggagacattgatcccaagaa

SEQ ID NO: 8540647 - DNA, 22 bp, Homo sapiens
taggactttggcgtcagaactg

SEQ ID NO: 8540648 - DNA, 22 bp, Homo sapiens
taggagaagagtcagggcctaa

SEQ ID NO: 8540649 - DNA, 22 bp, Homo sapiens
taggacttggtgactctcaatg

SEQ ID NO: 8540650 - DNA, 19 bp, Homo sapiens
taggaccctggtggccccc

SEQ ID NO: 8540651 - DNA, 19 bp, Homo sapiens
taggaccctggtggccccc

SEQ ID NO: 8540652 - DNA, 19 bp, Homo sapiens
taggaccctggtggccccc

SEQ ID NO: 8540653 - DNA, 22 bp, Homo sapiens
tagctatttgagcatattccag

SEQ ID NO: 8540654 - DNA, 22 bp, Homo sapiens
tagctatttggaaaattccaat

SEQ ID NO: 8540655 - DNA, 22 bp, Homo sapiens
tagctatttggaaaattccaat

SEQ ID NO: 8540656 - DNA, 22 bp, Homo sapiens
tagctatttggaaaattccaat

SEQ ID NO: 8540657 - DNA, 22 bp, Homo sapiens
tagctattttgcttggaaatac

SEQ ID NO: 8540658 - DNA, 22 bp, Homo sapiens
tagctattgttggtagttaccc

SEQ ID NO: 8540659 - DNA, 22 bp, Homo sapiens
tagctacactgaggctgcttaa

SEQ ID NO: 8540660 - DNA, 22 bp, Homo sapiens
tagctaccattattgagcacct

SEQ ID NO: 8540661 - DNA, 22 bp, Homo sapiens
tagctagggtaagacttggacc

SEQ ID NO: 8540662 - DNA, 22 bp, Homo sapiens
tagctagctgcacaggccctgg

SEQ ID NO: 8540663 - DNA, 22 bp, Homo sapiens
tagctcctccccatccaggttc

SEQ ID NO: 8540664 - DNA, 22 bp, Homo sapiens
tagctcctccccatccaggttc

SEQ ID NO: 8540665 - DNA, 22 bp, Homo sapiens
tagctcctggctgcagggcctc

SEQ ID NO: 8540666 - DNA, 22 bp, Homo sapiens
tagctcctggctgcagggcctc

SEQ ID NO: 8540667 - DNA, 22 bp, Homo sapiens
tagctcatgtaatccgaacata

SEQ ID NO: 8540668 - DNA, 22 bp, Homo sapiens
tagctcatctaggctaccacag

SEQ ID NO: 8540669 - DNA, 22 bp, Homo sapiens
tagctcaaaggttaagtgtgga

SEQ ID NO: 8540670 - DNA, 22 bp, Homo sapiens
tagctcaaaggttaagtgtgga

SEQ ID NO: 8540671 - DNA, 22 bp, Homo sapiens
cagggcagccaggccccgtggg

SEQ ID NO: 8540672 - DNA, 22 bp, Homo sapiens
cagggcagccaggccccgtggg

SEQ ID NO: 8540673 - DNA, 22 bp, Homo sapiens
cagggcagccaggccccgtggg

SEQ ID NO: 8540674 - DNA, 22 bp, Homo sapiens
cagggcagcttcctttgttagg

SEQ ID NO: 8540675 - DNA, 22 bp, Homo sapiens
cagggcagcttcctttgttagg

SEQ ID NO: 8540676 - DNA, 22 bp, Homo sapiens
cagggcagagccaggatttcaa

SEQ ID NO: 8540677 - DNA, 22 bp, Homo sapiens
cagggcagagccaggatttcaa

SEQ ID NO: 8540678 - DNA, 22 bp, Homo sapiens
cagggcagagggaaactccttt

SEQ ID NO: 8540679 - DNA, 22 bp, Homo sapiens
cagggcagagggaaactccttt

SEQ ID NO: 8540680 - DNA, 22 bp, Homo sapiens
taggaaattggaaactcttcac

SEQ ID NO: 8540681 - DNA, 22 bp, Homo sapiens
taggaacaaagagcctcacatt

SEQ ID NO: 8540682 - DNA, 22 bp, Homo sapiens
taggaacagtcctagaaatctg

SEQ ID NO: 8540683 - DNA, 22 bp, Homo sapiens
taggaacacagggacttgatga

SEQ ID NO: 8540684 - DNA, 22 bp, Homo sapiens
taggaacaactgcaggtacaag

SEQ ID NO: 8540685 - DNA, 22 bp, Homo sapiens
taggaacaagtttccttgctgt

SEQ ID NO: 8540686 - DNA, 22 bp, Homo sapiens
taggaaccagagcactctgggc

SEQ ID NO: 8540687 - DNA, 18 bp, Homo sapiens
taggaaccacttgcagag

SEQ ID NO: 8540688 - DNA, 22 bp, Homo sapiens
cagggcaggaatttgacattgc

SEQ ID NO: 8540689 - DNA, 22 bp, Homo sapiens
cagggcaggaatttgacattgc

SEQ ID NO: 8540690 - DNA, 22 bp, Homo sapiens
cagggcaggaatttgacattgc

SEQ ID NO: 8540691 - DNA, 22 bp, Homo sapiens
tagctttaagatgagatgtgga

SEQ ID NO: 8540692 - DNA, 22 bp, Homo sapiens
tagctttaataagctgctgaat

SEQ ID NO: 8540693 - DNA, 22 bp, Homo sapiens
taggaaatggctcagttactgc

SEQ ID NO: 8540694 - DNA, 22 bp, Homo sapiens
tgtaagtagtaatggaaggaca

SEQ ID NO: 8540695 - DNA, 21 bp, Homo sapiens
tgtaagtttcatctgaattgg

SEQ ID NO: 8540696 - DNA, 21 bp, Homo sapiens
tgtaagtttcatctgaattgg

SEQ ID NO: 8540697 - DNA, 22 bp, Homo sapiens
tgtaatgatgtacttagaagga

SEQ ID NO: 8540698 - DNA, 18 bp, Homo sapiens
tgtaatgcagcgggtggc

SEQ ID NO: 8540699 - DNA, 22 bp, Homo sapiens
tgtaatgagaaagagagtgaat

SEQ ID NO: 8540700 - DNA, 22 bp, Homo sapiens
tgtaatcattacagtacatgga

SEQ ID NO: 8540701 - DNA, 22 bp, Homo sapiens
tgtaatcattacagtacatgga

SEQ ID NO: 8540702 - DNA, 22 bp, Homo sapiens
tgtaatcatgcatcagttagtt

SEQ ID NO: 8540703 - DNA, 22 bp, Homo sapiens
cctgcttaacattgccatgaca

SEQ ID NO: 8540704 - DNA, 22 bp, Homo sapiens
cctgcttcagggatgatggcac

SEQ ID NO: 8540705 - DNA, 22 bp, Homo sapiens
cctgcttcagggatgatggcac

SEQ ID NO: 8540706 - DNA, 22 bp, Homo sapiens
cctgctgttctgtttagtgaac

SEQ ID NO: 8540707 - DNA, 20 bp, Homo sapiens
cctgctgtgctttccatgga

SEQ ID NO: 8540708 - DNA, 22 bp, Homo sapiens
cctggaaaacatgggaatcaca

SEQ ID NO: 8540709 - DNA, 22 bp, Homo sapiens
tgtaaagaaatagcatttgtag

SEQ ID NO: 8540710 - DNA, 22 bp, Homo sapiens
cctgcttccttcaagtttatct

SEQ ID NO: 8540711 - DNA, 22 bp, Homo sapiens
cctgctttgagatgggcagcag

SEQ ID NO: 8540712 - DNA, 22 bp, Homo sapiens
cctgcttcagggatgatggcac

SEQ ID NO: 8540713 - DNA, 22 bp, Homo sapiens
cctggagcactctccctggctg

SEQ ID NO: 8540714 - DNA, 22 bp, Homo sapiens
cctggagcactctccctggctg

SEQ ID NO: 8540715 - DNA, 22 bp, Homo sapiens
cctggagcactctccctggctg

SEQ ID NO: 8540716 - DNA, 22 bp, Homo sapiens
cctggagcacatggcaggaggc

SEQ ID NO: 8540717 - DNA, 22 bp, Homo sapiens
tgtacatttagagctcaataga

SEQ ID NO: 8540718 - DNA, 22 bp, Homo sapiens
tgtacatttagagctcaataga

SEQ ID NO: 8540719 - DNA, 22 bp, Homo sapiens
tgtacattttctcagagtttat

SEQ ID NO: 8540720 - DNA, 22 bp, Homo sapiens
tgtacattgtcactcatcaagt

SEQ ID NO: 8540721 - DNA, 22 bp, Homo sapiens
tgtacatgtgtctgtatatctt

SEQ ID NO: 8540722 - DNA, 22 bp, Homo sapiens
tgtacattgtcactcatcaagt

SEQ ID NO: 8540723 - DNA, 19 bp, Homo sapiens
tgtacatatagagctcagt

SEQ ID NO: 8540724 - DNA, 22 bp, Homo sapiens
tgtacatacatagatatacaca

SEQ ID NO: 8540725 - DNA, 22 bp, Homo sapiens
tgtacatacatagatatacaca

SEQ ID NO: 8540726 - DNA, 22 bp, Homo sapiens
tgtacatacatagatatacaca

SEQ ID NO: 8540727 - DNA, 22 bp, Homo sapiens
tgtacatacatagatatacaca

SEQ ID NO: 8540728 - DNA, 22 bp, Homo sapiens
tgtaattgcttgtttacctgct

SEQ ID NO: 8540729 - DNA, 22 bp, Homo sapiens
tgtacagtggaaaatggattcg

SEQ ID NO: 8540730 - DNA, 22 bp, Homo sapiens
tgtacagtgtagtcatgaggtt

SEQ ID NO: 8540731 - DNA, 18 bp, Homo sapiens
tgtacagttatgagcatt

SEQ ID NO: 8540732 - DNA, 22 bp, Homo sapiens
tgtacagttttaactctgaggg

SEQ ID NO: 8540733 - DNA, 22 bp, Homo sapiens
tgtattccaaaatgctgaggat

SEQ ID NO: 8540734 - DNA, 19 bp, Homo sapiens
cctggaggtgaaggttctc

SEQ ID NO: 8540735 - DNA, 22 bp, Homo sapiens
tgtcaaatttttattgcagtat

SEQ ID NO: 8540736 - DNA, 22 bp, Homo sapiens
tgtcaaatagtagaaagatggc

SEQ ID NO: 8540737 - DNA, 22 bp, Homo sapiens
tgtcaaatttttattgcagtat

SEQ ID NO: 8540738 - DNA, 22 bp, Homo sapiens
tgtcaaattatgtaatgggaag

SEQ ID NO: 8540739 - DNA, 18 bp, Homo sapiens
cctggaggtcttcggggt

SEQ ID NO: 8540740 - DNA, 22 bp, Homo sapiens
tgtcaaccaggtattttggtct

SEQ ID NO: 8540741 - DNA, 22 bp, Homo sapiens
tgtcaacagatactagagagct

SEQ ID NO: 8540742 - DNA, 22 bp, Homo sapiens
tgtcaagtctagttgctggctt

SEQ ID NO: 8540743 - DNA, 22 bp, Homo sapiens
tgtcaagtgattagccataatg

SEQ ID NO: 8540744 - DNA, 23 bp, Homo sapiens
tgtcaagtatagcaggccctccc

SEQ ID NO: 8540745 - DNA, 18 bp, Homo sapiens
cctggagctccacagcaa

SEQ ID NO: 8540746 - DNA, 22 bp, Homo sapiens
cctggagcttggtcacgctgcg

SEQ ID NO: 8540747 - DNA, 18 bp, Homo sapiens
cctggagctccacagcaa

SEQ ID NO: 8540748 - DNA, 18 bp, Homo sapiens
cctggagctccacagcaa

SEQ ID NO: 8540749 - DNA, 18 bp, Homo sapiens
cctggagctccacagcaa

SEQ ID NO: 8540750 - DNA, 22 bp, Homo sapiens
cctggagcttttccagttgaca

SEQ ID NO: 8540751 - DNA, 22 bp, Homo sapiens
cctggagcttggtcacgctgcg

SEQ ID NO: 8540752 - DNA, 22 bp, Homo sapiens
cctggagcttggtcacgctgcg

SEQ ID NO: 8540753 - DNA, 22 bp, Homo sapiens
cctggagcttggtcacgctgcg

SEQ ID NO: 8540754 - DNA, 22 bp, Homo sapiens
cctggagcttggtcacgctgcg

SEQ ID NO: 8540755 - DNA, 22 bp, Homo sapiens
cctggagcttttccatcctgga

SEQ ID NO: 8540756 - DNA, 22 bp, Homo sapiens
cctggagcttttccatcctgga

SEQ ID NO: 8540757 - DNA, 22 bp, Homo sapiens
cctggagcttttccatcctgga

SEQ ID NO: 8540758 - DNA, 22 bp, Homo sapiens
cctggagcttttccatcctgga

SEQ ID NO: 8540759 - DNA, 22 bp, Homo sapiens
cctggagcttttccatcctgga

SEQ ID NO: 8540760 - DNA, 22 bp, Homo sapiens
cctggaggagcgctgaccagct

SEQ ID NO: 8540761 - DNA, 22 bp, Homo sapiens
cctggaggagcgctgaccagct

SEQ ID NO: 8540762 - DNA, 22 bp, Homo sapiens
cctggaggctctgggagggcag

SEQ ID NO: 8540763 - DNA, 22 bp, Homo sapiens
cctggaggcggaggttgcagtg

SEQ ID NO: 8540764 - DNA, 22 bp, Homo sapiens
cctggaggcggaggttgcagtg

SEQ ID NO: 8540765 - DNA, 22 bp, Homo sapiens
cctggaggcggaggttgcagtg

SEQ ID NO: 8540766 - DNA, 22 bp, Homo sapiens
cctggagggcagcccattctgg

SEQ ID NO: 8540767 - DNA, 22 bp, Homo sapiens
cctggagggcgccgcacagtcc

SEQ ID NO: 8540768 - DNA, 22 bp, Homo sapiens
cctggagggaccctggccctgt

SEQ ID NO: 8540769 - DNA, 22 bp, Homo sapiens
cctggagggaccctggccctgt

SEQ ID NO: 8540770 - DNA, 22 bp, Homo sapiens
cctggagggaccctggccctgt

SEQ ID NO: 8540771 - DNA, 22 bp, Homo sapiens
tggtctgggcaaatccttctga

SEQ ID NO: 8540772 - DNA, 22 bp, Homo sapiens
tggtctgggcaaatccttctga

SEQ ID NO: 8540773 - DNA, 22 bp, Homo sapiens
tggtctggaactcctggcttca

SEQ ID NO: 8540774 - DNA, 22 bp, Homo sapiens
tggtctggaactcctggcttca

SEQ ID NO: 8540775 - DNA, 22 bp, Homo sapiens
cctgctgcttaggccatatttc

SEQ ID NO: 8540776 - DNA, 22 bp, Homo sapiens
cctgctggacgtggaggagggg

SEQ ID NO: 8540777 - DNA, 22 bp, Homo sapiens
cctgctgctatgaaggtgacag

SEQ ID NO: 8540778 - DNA, 22 bp, Homo sapiens
cctgctctaaatctcatggaac

SEQ ID NO: 8540779 - DNA, 22 bp, Homo sapiens
cctgctctaaatctcatggaac

SEQ ID NO: 8540780 - DNA, 22 bp, Homo sapiens
tggtctgttcaaggtggctgat

SEQ ID NO: 8540781 - DNA, 22 bp, Homo sapiens
tggtctgttcaaggtggctgat

SEQ ID NO: 8540782 - DNA, 22 bp, Homo sapiens
tggtctcttcttccaagatggc

SEQ ID NO: 8540783 - DNA, 22 bp, Homo sapiens
tggtctcttcttccaagatggc

SEQ ID NO: 8540784 - DNA, 22 bp, Homo sapiens
tggtctcttcttccaagatggc

SEQ ID NO: 8540785 - DNA, 23 bp, Homo sapiens
tggtctgaagcctcaggttcctc

SEQ ID NO: 8540786 - DNA, 22 bp, Homo sapiens
tggtctgaactaagacagtagt

SEQ ID NO: 8540787 - DNA, 21 bp, Homo sapiens
tggtctgaaagtatttgtggc

SEQ ID NO: 8540788 - DNA, 22 bp, Homo sapiens
cctgccttccagccttgggctc

SEQ ID NO: 8540789 - DNA, 22 bp, Homo sapiens
cctgccttcccagcttggcttt

SEQ ID NO: 8540790 - DNA, 22 bp, Homo sapiens
cctgcctgtccctcagtccaca

SEQ ID NO: 8540791 - DNA, 22 bp, Homo sapiens
cctgccttccagccttgggctc

SEQ ID NO: 8540792 - DNA, 22 bp, Homo sapiens
tggtctgattcttgctccccaa

SEQ ID NO: 8540793 - DNA, 22 bp, Homo sapiens
tggtctgattccacctaactga

SEQ ID NO: 8540794 - DNA, 22 bp, Homo sapiens
tggtctgatttctttctggagt

SEQ ID NO: 8540795 - DNA, 22 bp, Homo sapiens
tggtctgatggtcccaccaccg

SEQ ID NO: 8540796 - DNA, 22 bp, Homo sapiens
tggtctgatagtctgaaaatga

SEQ ID NO: 8540797 - DNA, 22 bp, Homo sapiens
tggtctgatattttttcttacc

SEQ ID NO: 8540798 - DNA, 22 bp, Homo sapiens
tggtctgattcttgctccccaa

SEQ ID NO: 8540799 - DNA, 22 bp, Homo sapiens
tggtctgatttttcatctgttg

SEQ ID NO: 8540800 - DNA, 22 bp, Homo sapiens
tggtctgataccggattccagt

SEQ ID NO: 8540801 - DNA, 22 bp, Homo sapiens
tggtctgataccggattccagt

SEQ ID NO: 8540802 - DNA, 22 bp, Homo sapiens
tggtctgaggaacaccagcact

SEQ ID NO: 8540803 - DNA, 22 bp, Homo sapiens
tggtctgagcggggccattcag

SEQ ID NO: 8540804 - DNA, 22 bp, Homo sapiens
tggtctgagcaactgccctatc

SEQ ID NO: 8540805 - DNA, 23 bp, Homo sapiens
tggtctgacttgtagctgtgaga

SEQ ID NO: 8540806 - DNA, 22 bp, Homo sapiens
tggtctgaaggtggatttgaga

SEQ ID NO: 8540807 - DNA, 22 bp, Homo sapiens
tggtctgaacacattttaggta

SEQ ID NO: 8540808 - DNA, 23 bp, Homo sapiens
tggtctgaagcctcaggttcctc

SEQ ID NO: 8540809 - DNA, 22 bp, Homo sapiens
tggtctgaaggacttctgaggg

SEQ ID NO: 8540810 - DNA, 22 bp, Homo sapiens
tggtctgaatgacttgttagtt

SEQ ID NO: 8540811 - DNA, 22 bp, Homo sapiens
tggtctgaaggtggatttgaga

SEQ ID NO: 8540812 - DNA, 22 bp, Homo sapiens
tggtctgactacaataggaaga

SEQ ID NO: 8540813 - DNA, 22 bp, Homo sapiens
tggtctgacttgctttggacag

SEQ ID NO: 8540814 - DNA, 22 bp, Homo sapiens
cctgctggccagtggagggctg

SEQ ID NO: 8540815 - DNA, 22 bp, Homo sapiens
cctgctggccactgctccacct

SEQ ID NO: 8540816 - DNA, 22 bp, Homo sapiens
cctgctgggcctgagcaatgag

SEQ ID NO: 8540817 - DNA, 22 bp, Homo sapiens
cctgctgggcctgagcaatgag

SEQ ID NO: 8540818 - DNA, 20 bp, Homo sapiens
cctgctgggaaccctctgaa

SEQ ID NO: 8540819 - DNA, 22 bp, Homo sapiens
cctgctggctggtagagttccg

SEQ ID NO: 8540820 - DNA, 22 bp, Homo sapiens
cctgctggctggtagagttccg

SEQ ID NO: 8540821 - DNA, 21 bp, Homo sapiens
cctgctgtgatcttagtgagt

SEQ ID NO: 8540822 - DNA, 22 bp, Homo sapiens
cctgctgtgaccggggagcagg

SEQ ID NO: 8540823 - DNA, 22 bp, Homo sapiens
cctgctgtgaagccaggcctgt

SEQ ID NO: 8540824 - DNA, 22 bp, Homo sapiens
cctgctgtctctgggcaggcag

SEQ ID NO: 8540825 - DNA, 22 bp, Homo sapiens
cctgctgtctgctgtgttaagc

SEQ ID NO: 8540826 - DNA, 22 bp, Homo sapiens
cctgctgtgaaactggcatatg

SEQ ID NO: 8540827 - DNA, 22 bp, Homo sapiens
cctgctgtaatgtgtctttatt

SEQ ID NO: 8540828 - DNA, 22 bp, Homo sapiens
cctgctgtcccctgagcctgga

SEQ ID NO: 8540829 - DNA, 22 bp, Homo sapiens
cctgcctgtccctcagtccaca

SEQ ID NO: 8540830 - DNA, 22 bp, Homo sapiens
cctgcctgtccctcagtccaca

SEQ ID NO: 8540831 - DNA, 22 bp, Homo sapiens
cctgcctgtccctcagtccaca

SEQ ID NO: 8540832 - DNA, 22 bp, Homo sapiens
cctgcctgtctttatcccctgt

SEQ ID NO: 8540833 - DNA, 23 bp, Homo sapiens
cctgcctgttctaactccatttc

SEQ ID NO: 8540834 - DNA, 23 bp, Homo sapiens
cctgcctgttctaactccatttc

SEQ ID NO: 8540835 - DNA, 20 bp, Homo sapiens
cctgcctgtgtttgtgatga

SEQ ID NO: 8540836 - DNA, 20 bp, Homo sapiens
cctgcctgtgtttgtgatga

SEQ ID NO: 8540837 - DNA, 22 bp, Homo sapiens
cctgcctgtaagatgggtacaa

SEQ ID NO: 8540838 - DNA, 22 bp, Homo sapiens
cctgcctgtaagatgggtacaa

SEQ ID NO: 8540839 - DNA, 22 bp, Homo sapiens
cctgcctgtactagagacccag

SEQ ID NO: 8540840 - DNA, 22 bp, Homo sapiens
cctgcctgtaagatgggtacaa

SEQ ID NO: 8540841 - DNA, 22 bp, Homo sapiens
cctgcctgtcatcgcctgcgcc

SEQ ID NO: 8540842 - DNA, 22 bp, Homo sapiens
cctgcctgtcatcgcctgcgcc

SEQ ID NO: 8540843 - DNA, 22 bp, Homo sapiens
cctgcctgtcatcgcctgcgcc

SEQ ID NO: 8540844 - DNA, 22 bp, Homo sapiens
cctgcctgtactagagacccag

SEQ ID NO: 8540845 - DNA, 22 bp, Homo sapiens
cctgcctggggacaaaggaggg

SEQ ID NO: 8540846 - DNA, 22 bp, Homo sapiens
cctgcctggtgtaagtctaagg

SEQ ID NO: 8540847 - DNA, 22 bp, Homo sapiens
cctgcctgggctcacttgccag

SEQ ID NO: 8540848 - DNA, 22 bp, Homo sapiens
cctgcctgggctcacttgccag

SEQ ID NO: 8540849 - DNA, 20 bp, Homo sapiens
cctgcctgcctcggctcatt

SEQ ID NO: 8540850 - DNA, 22 bp, Homo sapiens
cctgcctgcctgctggccggga

SEQ ID NO: 8540851 - DNA, 22 bp, Homo sapiens
cctgcctgggctcacttgccag

SEQ ID NO: 8540852 - DNA, 22 bp, Homo sapiens
cctgcctgggctcacttgccag

SEQ ID NO: 8540853 - DNA, 22 bp, Homo sapiens
cctgcctgcctgctggccggga

SEQ ID NO: 8540854 - DNA, 22 bp, Homo sapiens
tgggtcaggctgggagtcctga

SEQ ID NO: 8540855 - DNA, 22 bp, Homo sapiens
tgggtcagtttgggggccagcc

SEQ ID NO: 8540856 - DNA, 22 bp, Homo sapiens
tgggtcagtttgggggccagcc

SEQ ID NO: 8540857 - DNA, 22 bp, Homo sapiens
tgggtcagaggacctcgtggcc

SEQ ID NO: 8540858 - DNA, 22 bp, Homo sapiens
tgggtcagattgagcccctggt

SEQ ID NO: 8540859 - DNA, 22 bp, Homo sapiens
tgggtcagattgagcccctggt

SEQ ID NO: 8540860 - DNA, 22 bp, Homo sapiens
tgggtcaggctgggagtcctga

SEQ ID NO: 8540861 - DNA, 22 bp, Homo sapiens
cctgccagtcactatgtcacct

SEQ ID NO: 8540862 - DNA, 18 bp, Homo sapiens
cctgccagtctggagcag

SEQ ID NO: 8540863 - DNA, 18 bp, Homo sapiens
cctgccagtctggagcag

SEQ ID NO: 8540864 - DNA, 18 bp, Homo sapiens
cctgccagtctggagcag

SEQ ID NO: 8540865 - DNA, 22 bp, Homo sapiens
cctgccagggccttggaagaaa

SEQ ID NO: 8540866 - DNA, 22 bp, Homo sapiens
cctgccagggccagaggccagc

SEQ ID NO: 8540867 - DNA, 22 bp, Homo sapiens
cctgccagggccagaggccagc

SEQ ID NO: 8540868 - DNA, 22 bp, Homo sapiens
cctgccaggctttgggcttctg

SEQ ID NO: 8540869 - DNA, 22 bp, Homo sapiens
cctgccaggctttgggcttctg

SEQ ID NO: 8540870 - DNA, 22 bp, Homo sapiens
cctgccaggctttgggcttctg

SEQ ID NO: 8540871 - DNA, 22 bp, Homo sapiens
cctgccagggccagaggccagc

SEQ ID NO: 8540872 - DNA, 22 bp, Homo sapiens
cctgccaggccagtgagcttcc

SEQ ID NO: 8540873 - DNA, 22 bp, Homo sapiens
cctgccaggcgagtctaggcca

SEQ ID NO: 8540874 - DNA, 22 bp, Homo sapiens
tgggtaggggacgtggaagaaa

SEQ ID NO: 8540875 - DNA, 18 bp, Homo sapiens
cctgccagtctggagcag

SEQ ID NO: 8540876 - DNA, 22 bp, Homo sapiens
tgggtaggtgctggggattcag

SEQ ID NO: 8540877 - DNA, 22 bp, Homo sapiens
tgggtcagacagccagtgggcc

SEQ ID NO: 8540878 - DNA, 22 bp, Homo sapiens
tgggtcagagctgtgctgccca

SEQ ID NO: 8540879 - DNA, 22 bp, Homo sapiens
tgggtcagacagccagtgggcc

SEQ ID NO: 8540880 - DNA, 22 bp, Homo sapiens
tgggtcagagcagacctctgga

SEQ ID NO: 8540881 - DNA, 22 bp, Homo sapiens
tgggtcagagctgtgctgccca

SEQ ID NO: 8540882 - DNA, 22 bp, Homo sapiens
tgggggtgtcctggtgcacaca

SEQ ID NO: 8540883 - DNA, 22 bp, Homo sapiens
tgggggtgtcctggtgcacaca

SEQ ID NO: 8540884 - DNA, 22 bp, Homo sapiens
tgggggtggttcttgcctccag

SEQ ID NO: 8540885 - DNA, 22 bp, Homo sapiens
tgggggtggttcttgcctccag

SEQ ID NO: 8540886 - DNA, 22 bp, Homo sapiens
cctgaggtcatggtccagtgtt

SEQ ID NO: 8540887 - DNA, 21 bp, Homo sapiens
tgggggagaattggttgcttt

SEQ ID NO: 8540888 - DNA, 21 bp, Homo sapiens
cctgagggtggttgtgaagat

SEQ ID NO: 8540889 - DNA, 22 bp, Homo sapiens
cctgaggtcacaacttgcttat

SEQ ID NO: 8540890 - DNA, 22 bp, Homo sapiens
cctgaggtcacaacttgcttat

SEQ ID NO: 8540891 - DNA, 21 bp, Homo sapiens
cctgagggtggttgtgaagat

SEQ ID NO: 8540892 - DNA, 22 bp, Homo sapiens
cctgaggtcagcggttcccaca

SEQ ID NO: 8540893 - DNA, 22 bp, Homo sapiens
cctgaggtcatgcatttccaac

SEQ ID NO: 8540894 - DNA, 22 bp, Homo sapiens
cctgaggtcagccattcttgcc

SEQ ID NO: 8540895 - DNA, 22 bp, Homo sapiens
cctgaggtcacaacttgcttat

SEQ ID NO: 8540896 - DNA, 22 bp, Homo sapiens
tgggggtgtgccagggacctcc

SEQ ID NO: 8540897 - DNA, 22 bp, Homo sapiens
tgggggtgtcctggtgcacaca

SEQ ID NO: 8540898 - DNA, 22 bp, Homo sapiens
tgggggtgtcctggtgcacaca

SEQ ID NO: 8540899 - DNA, 22 bp, Homo sapiens
tgggggtgtgccagggacctcc

SEQ ID NO: 8540900 - DNA, 22 bp, Homo sapiens
tggggtacttgtatcaaagcac

SEQ ID NO: 8540901 - DNA, 22 bp, Homo sapiens
tggggtaggagtcagcgagaga

SEQ ID NO: 8540902 - DNA, 22 bp, Homo sapiens
tggggtaggagtcagcgagaga

SEQ ID NO: 8540903 - DNA, 17 bp, Homo sapiens
tggggtccccgatggtg

SEQ ID NO: 8540904 - DNA, 22 bp, Homo sapiens
tggggtagggaaaagaagtcga

SEQ ID NO: 8540905 - DNA, 22 bp, Homo sapiens
tggggtaggtatgaaaactagg

SEQ ID NO: 8540906 - DNA, 22 bp, Homo sapiens
tggggtaggagtcagcgagaga

SEQ ID NO: 8540907 - DNA, 22 bp, Homo sapiens
tggggtagggaaaagaagtcga

SEQ ID NO: 8540908 - DNA, 22 bp, Homo sapiens
cctgcagacacttgtccagcaa

SEQ ID NO: 8540909 - DNA, 22 bp, Homo sapiens
cctgcagaagagtccagctcat

SEQ ID NO: 8540910 - DNA, 22 bp, Homo sapiens
cctgccagacgcaccagggggc

SEQ ID NO: 8540911 - DNA, 22 bp, Homo sapiens
cctgccagagcagcttgtcctc

SEQ ID NO: 8540912 - DNA, 22 bp, Homo sapiens
cctgccaggagctggtgctgca

SEQ ID NO: 8540913 - DNA, 22 bp, Homo sapiens
cctgccaggccagtgagcttcc

SEQ ID NO: 8540914 - DNA, 22 bp, Homo sapiens
cctgcacccaggccgcacctct

SEQ ID NO: 8540915 - DNA, 22 bp, Homo sapiens
cctgcagaaagggtccccagga

SEQ ID NO: 8540916 - DNA, 22 bp, Homo sapiens
cctgcagaaagggtccccagga

SEQ ID NO: 8540917 - DNA, 22 bp, Homo sapiens
cctgcactacctggggctgctg

SEQ ID NO: 8540918 - DNA, 22 bp, Homo sapiens
cctgcacttctcacagctgctg

SEQ ID NO: 8540919 - DNA, 22 bp, Homo sapiens
cctgattattgtaaatatattt

SEQ ID NO: 8540920 - DNA, 22 bp, Homo sapiens
cctgattcagtggtgcccagag

SEQ ID NO: 8540921 - DNA, 22 bp, Homo sapiens
cctgattctgatgcctcatgga

SEQ ID NO: 8540922 - DNA, 22 bp, Homo sapiens
tggggtcctctcacttggaggg

SEQ ID NO: 8540923 - DNA, 20 bp, Homo sapiens
tggggtcctggaggggatcc

SEQ ID NO: 8540924 - DNA, 22 bp, Homo sapiens
tggggtcgagggttctctggca

SEQ ID NO: 8540925 - DNA, 22 bp, Homo sapiens
cctgcacatgtgtgcgcctgta

SEQ ID NO: 8540926 - DNA, 22 bp, Homo sapiens
cctgcacagccttggctgacac

SEQ ID NO: 8540927 - DNA, 22 bp, Homo sapiens
cctgcacagccggacccctgct

SEQ ID NO: 8540928 - DNA, 22 bp, Homo sapiens
cctgattctgccactactagcc

SEQ ID NO: 8540929 - DNA, 22 bp, Homo sapiens
cctgcaagactatttagttcca

SEQ ID NO: 8540930 - DNA, 22 bp, Homo sapiens
cctgcaagagcggagaagccag

SEQ ID NO: 8540931 - DNA, 22 bp, Homo sapiens
cctgcacagccggacccctgct

SEQ ID NO: 8540932 - DNA, 22 bp, Homo sapiens
cctgaggcttaatctgtcccaa

SEQ ID NO: 8540933 - DNA, 22 bp, Homo sapiens
cctgaggcttaatctgtcccaa

SEQ ID NO: 8540934 - DNA, 22 bp, Homo sapiens
cctgaggcttaatctgtcccaa

SEQ ID NO: 8540935 - DNA, 22 bp, Homo sapiens
cctgagggcgccgagctcccag

SEQ ID NO: 8540936 - DNA, 22 bp, Homo sapiens
cctgagggcgccgagctcccag

SEQ ID NO: 8540937 - DNA, 22 bp, Homo sapiens
cctgagggctcagcccccagcc

SEQ ID NO: 8540938 - DNA, 22 bp, Homo sapiens
cctgaggctctcctgaataatg

SEQ ID NO: 8540939 - DNA, 22 bp, Homo sapiens
cctgaggctcgcgcgcccctgg

SEQ ID NO: 8540940 - DNA, 22 bp, Homo sapiens
cctgaggcttaatctgtcccaa

SEQ ID NO: 8540941 - DNA, 22 bp, Homo sapiens
cctgaggctggcccttccatcc

SEQ ID NO: 8540942 - DNA, 22 bp, Homo sapiens
cctgaggctctcctgaataatg

SEQ ID NO: 8540943 - DNA, 22 bp, Homo sapiens
cctgagcttacaatttaagaac

SEQ ID NO: 8540944 - DNA, 22 bp, Homo sapiens
cctgagcttgatccttctgtct

SEQ ID NO: 8540945 - DNA, 22 bp, Homo sapiens
cctgagcttgatccttctgtct

SEQ ID NO: 8540946 - DNA, 22 bp, Homo sapiens
cctgaggccctggctgtgctga

SEQ ID NO: 8540947 - DNA, 22 bp, Homo sapiens
cctgagcttgatccttctgtct

SEQ ID NO: 8540948 - DNA, 22 bp, Homo sapiens
cctgaggccctggctgtgctga

SEQ ID NO: 8540949 - DNA, 22 bp, Homo sapiens
cctgaggctccacctccagaga

SEQ ID NO: 8540950 - DNA, 22 bp, Homo sapiens
cctgaggccctggctgtgctga

SEQ ID NO: 8540951 - DNA, 22 bp, Homo sapiens
cctgaggccctggctgtgctga

SEQ ID NO: 8540952 - DNA, 22 bp, Homo sapiens
cctgaggctccacctccagaga

SEQ ID NO: 8540953 - DNA, 22 bp, Homo sapiens
cctgaggctccacctccagaga

SEQ ID NO: 8540954 - DNA, 22 bp, Homo sapiens
cctgagacatgaaccaggctcc

SEQ ID NO: 8540955 - DNA, 22 bp, Homo sapiens
cctgagaatgtttaacagagaa

SEQ ID NO: 8540956 - DNA, 22 bp, Homo sapiens
cctgagaataattctccatagc

SEQ ID NO: 8540957 - DNA, 22 bp, Homo sapiens
cctgactctggccaggccagct

SEQ ID NO: 8540958 - DNA, 22 bp, Homo sapiens
cctgagaaacctggtgcaatta

SEQ ID NO: 8540959 - DNA, 22 bp, Homo sapiens
cctgaccatttgccacatgggt

SEQ ID NO: 8540960 - DNA, 22 bp, Homo sapiens
cctgaccacccttggacaaggt

SEQ ID NO: 8540961 - DNA, 19 bp, Homo sapiens
cctgaccacacaggccttg

SEQ ID NO: 8540962 - DNA, 22 bp, Homo sapiens
cctgaccagagtgagggcttag

SEQ ID NO: 8540963 - DNA, 22 bp, Homo sapiens
cctgacagtccttttctagtgt

SEQ ID NO: 8540964 - DNA, 22 bp, Homo sapiens
cctgacaggagaagcgcagcat

SEQ ID NO: 8540965 - DNA, 23 bp, Homo sapiens
cctgacacaaaaggattcttgct

SEQ ID NO: 8540966 - DNA, 21 bp, Homo sapiens
tggctctgaaagagtgctgca

SEQ ID NO: 8540967 - DNA, 21 bp, Homo sapiens
tggctctgaaagagtgctgca

SEQ ID NO: 8540968 - DNA, 21 bp, Homo sapiens
tggctctgaaagagtgctgca

SEQ ID NO: 8540969 - DNA, 22 bp, Homo sapiens
tggctctctgggaggtcctggc

SEQ ID NO: 8540970 - DNA, 20 bp, Homo sapiens
tggctctctctagtaagtgg

SEQ ID NO: 8540971 - DNA, 22 bp, Homo sapiens
tggctctctgggaggtcctggc

SEQ ID NO: 8540972 - DNA, 22 bp, Homo sapiens
tggctctctgggaggtcctggc

SEQ ID NO: 8540973 - DNA, 22 bp, Homo sapiens
tggctctcttgtaaggtagtag

SEQ ID NO: 8540974 - DNA, 22 bp, Homo sapiens
tggctctcttgtaaggtagtag

SEQ ID NO: 8540975 - DNA, 22 bp, Homo sapiens
tggctctgaccaggtagaggag

SEQ ID NO: 8540976 - DNA, 21 bp, Homo sapiens
tgggagagcgttgctgtcctc

SEQ ID NO: 8540977 - DNA, 21 bp, Homo sapiens
tgggagagcgttgctgtcctc

SEQ ID NO: 8540978 - DNA, 21 bp, Homo sapiens
tgggagagcgttgctgtcctc

SEQ ID NO: 8540979 - DNA, 21 bp, Homo sapiens
tgggagagcgttgctgtcctc

SEQ ID NO: 8540980 - DNA, 22 bp, Homo sapiens
tgggagcaggaagcaggaagta

SEQ ID NO: 8540981 - DNA, 22 bp, Homo sapiens
tgggagcaggaagcaggaagta

SEQ ID NO: 8540982 - DNA, 22 bp, Homo sapiens
cctccctgcgctcctgcggcgg

SEQ ID NO: 8540983 - DNA, 22 bp, Homo sapiens
cctccctgcgctcctgcggcgg

SEQ ID NO: 8540984 - DNA, 22 bp, Homo sapiens
cctccctgcgctcctgcggcgg

SEQ ID NO: 8540985 - DNA, 22 bp, Homo sapiens
tggctctcagctcccagcagcc

SEQ ID NO: 8540986 - DNA, 22 bp, Homo sapiens
tggctctcagctcccagcagcc

SEQ ID NO: 8540987 - DNA, 22 bp, Homo sapiens
tggctctcagctcccagcagcc

SEQ ID NO: 8540988 - DNA, 22 bp, Homo sapiens
tggctctcagctcccagcagcc

SEQ ID NO: 8540989 - DNA, 22 bp, Homo sapiens
cctccctgctcctcaactggca

SEQ ID NO: 8540990 - DNA, 22 bp, Homo sapiens
cctccctgctcctcaactggca

SEQ ID NO: 8540991 - DNA, 23 bp, Homo sapiens
tggctctctcagtgctgcagagg

SEQ ID NO: 8540992 - DNA, 20 bp, Homo sapiens
tggctctctctagtaagtgg

SEQ ID NO: 8540993 - DNA, 20 bp, Homo sapiens
tggctctctctagtaagtgg

SEQ ID NO: 8540994 - DNA, 22 bp, Homo sapiens
tggctctctacaggtcaagacc

SEQ ID NO: 8540995 - DNA, 23 bp, Homo sapiens
tggctctctcagtgctgcagagg

SEQ ID NO: 8540996 - DNA, 22 bp, Homo sapiens
tggctctcaggcctgctgcgtt

SEQ ID NO: 8540997 - DNA, 22 bp, Homo sapiens
tggctctcaggcctgctgcgtt

SEQ ID NO: 8540998 - DNA, 22 bp, Homo sapiens
tggctctccagagcctatggta

SEQ ID NO: 8540999 - DNA, 22 bp, Homo sapiens
tggctctccagctctaaggcct

SEQ ID NO: 8541000 - DNA, 22 bp, Homo sapiens
tggctctcaggcctgctgcgtt

SEQ ID NO: 8541001 - DNA, 22 bp, Homo sapiens
cctctggcaacttcacagccca

SEQ ID NO: 8541002 - DNA, 22 bp, Homo sapiens
cctctggcaacttcacagccca

SEQ ID NO: 8541003 - DNA, 22 bp, Homo sapiens
cctctggatctttctccacact

SEQ ID NO: 8541004 - DNA, 22 bp, Homo sapiens
tgggagctcagaaagggaggtc

SEQ ID NO: 8541005 - DNA, 22 bp, Homo sapiens
cctctggcagccagccagttgt

SEQ ID NO: 8541006 - DNA, 22 bp, Homo sapiens
cctctggcagccagccagttgt

SEQ ID NO: 8541007 - DNA, 22 bp, Homo sapiens
cctctggcaacttcacagccca

SEQ ID NO: 8541008 - DNA, 22 bp, Homo sapiens
cctctggcaacttcacagccca

SEQ ID NO: 8541009 - DNA, 22 bp, Homo sapiens
tgggagcagttgcatctccagt

SEQ ID NO: 8541010 - DNA, 22 bp, Homo sapiens
tgggagcagttcaggtgtggct

SEQ ID NO: 8541011 - DNA, 22 bp, Homo sapiens
tgggagcagttcaggtgtggct

SEQ ID NO: 8541012 - DNA, 22 bp, Homo sapiens
tgggagcagttgtgaagctcag

SEQ ID NO: 8541013 - DNA, 22 bp, Homo sapiens
tgggagcaggtgtgctagggaa

SEQ ID NO: 8541014 - DNA, 22 bp, Homo sapiens
tgggccactcttccctgggtct

SEQ ID NO: 8541015 - DNA, 22 bp, Homo sapiens
cctctggccatcccccattaag

SEQ ID NO: 8541016 - DNA, 22 bp, Homo sapiens
cctctggcctaggccgggagag

SEQ ID NO: 8541017 - DNA, 22 bp, Homo sapiens
cctctggcctaggccgggagag

SEQ ID NO: 8541018 - DNA, 22 bp, Homo sapiens
cctctggccagagaaaggccag

SEQ ID NO: 8541019 - DNA, 22 bp, Homo sapiens
tgggccagcaattgctgctcag

SEQ ID NO: 8541020 - DNA, 22 bp, Homo sapiens
tgggccagcaattgctgctcag

SEQ ID NO: 8541021 - DNA, 22 bp, Homo sapiens
tgggccagaggcatggagctat

SEQ ID NO: 8541022 - DNA, 22 bp, Homo sapiens
tgggccagaggcatggagctat

SEQ ID NO: 8541023 - DNA, 22 bp, Homo sapiens
tgggccagagagtaagaaaggt

SEQ ID NO: 8541024 - DNA, 22 bp, Homo sapiens
tgggccagagagtaagaaaggt

SEQ ID NO: 8541025 - DNA, 22 bp, Homo sapiens
tgggccacttgaaagtggatgt

SEQ ID NO: 8541026 - DNA, 22 bp, Homo sapiens
tgggccacttgaaagtggatgt

SEQ ID NO: 8541027 - DNA, 22 bp, Homo sapiens
tgggccagaagtatgcatgttt

SEQ ID NO: 8541028 - DNA, 22 bp, Homo sapiens
cctcttgccaatcagctacaga

SEQ ID NO: 8541029 - DNA, 22 bp, Homo sapiens
cctcttgattggttggaagcgg

SEQ ID NO: 8541030 - DNA, 22 bp, Homo sapiens
cctcttgattggttggaagcgg

SEQ ID NO: 8541031 - DNA, 22 bp, Homo sapiens
cctcttctgagtgagactccct

SEQ ID NO: 8541032 - DNA, 22 bp, Homo sapiens
cctcttctgagtgagactccct

SEQ ID NO: 8541033 - DNA, 22 bp, Homo sapiens
cctcttctgcttcaggagcact

SEQ ID NO: 8541034 - DNA, 22 bp, Homo sapiens
cctcttctgcttcaggagcact

SEQ ID NO: 8541035 - DNA, 18 bp, Homo sapiens
cctgaagcctgtgtcttt

SEQ ID NO: 8541036 - DNA, 22 bp, Homo sapiens
cctgaagctcttaagaccttta

SEQ ID NO: 8541037 - DNA, 22 bp, Homo sapiens
cctgaagggactccagagagca

SEQ ID NO: 8541038 - DNA, 17 bp, Homo sapiens
cctgaaggcacttccag

SEQ ID NO: 8541039 - DNA, 22 bp, Homo sapiens
cctgaataggctctgctcaaaa

SEQ ID NO: 8541040 - DNA, 22 bp, Homo sapiens
cctgaatactggtgctgaaagt

SEQ ID NO: 8541041 - DNA, 22 bp, Homo sapiens
cctgaataatttgtgaaaagat

SEQ ID NO: 8541042 - DNA, 22 bp, Homo sapiens
cctgaagcacccggagctggca

SEQ ID NO: 8541043 - DNA, 22 bp, Homo sapiens
cctgaagcaagggtaggcaggt

SEQ ID NO: 8541044 - DNA, 22 bp, Homo sapiens
cctgaaaatcaaggtagtttgg

SEQ ID NO: 8541045 - DNA, 22 bp, Homo sapiens
cctgaaaatatcctctcctttg

SEQ ID NO: 8541046 - DNA, 22 bp, Homo sapiens
cctgaagcaagggtaggcaggt

SEQ ID NO: 8541047 - DNA, 22 bp, Homo sapiens
cctgaaaatcaaggtagtttgg

SEQ ID NO: 8541048 - DNA, 22 bp, Homo sapiens
cctgaaaatcaaggtagtttgg

SEQ ID NO: 8541049 - DNA, 22 bp, Homo sapiens
cctctttgtgcctgcaggctgc

SEQ ID NO: 8541050 - DNA, 22 bp, Homo sapiens
cctctttgtgcctgcaggctgc

SEQ ID NO: 8541051 - DNA, 22 bp, Homo sapiens
cctgaaaatatcctctcctttg

SEQ ID NO: 8541052 - DNA, 22 bp, Homo sapiens
cctgaaaatatcctctcctttg

SEQ ID NO: 8541053 - DNA, 22 bp, Homo sapiens
ccggctactcgggaggctgacg

SEQ ID NO: 8541054 - DNA, 22 bp, Homo sapiens
ccggctcggcgaccaggctgaa

SEQ ID NO: 8541055 - DNA, 22 bp, Homo sapiens
ccgggagagtggaaccaagagg

SEQ ID NO: 8541056 - DNA, 22 bp, Homo sapiens
ccgggagcaggcgccaccgcca

SEQ ID NO: 8541057 - DNA, 22 bp, Homo sapiens
ccgggagcaggcgccaccgcca

SEQ ID NO: 8541058 - DNA, 22 bp, Homo sapiens
ccgggagactttgagcaccatg

SEQ ID NO: 8541059 - DNA, 22 bp, Homo sapiens
ccggctcggcgaccaggctgaa

SEQ ID NO: 8541060 - DNA, 22 bp, Homo sapiens
ccggctactcgggaggctgacg

SEQ ID NO: 8541061 - DNA, 22 bp, Homo sapiens
ccggctactcgggaggctgacg

SEQ ID NO: 8541062 - DNA, 22 bp, Homo sapiens
ccggctactcgggaggctgacg

SEQ ID NO: 8541063 - DNA, 22 bp, Homo sapiens
ccggctactcgggaggctgacg

SEQ ID NO: 8541064 - DNA, 22 bp, Homo sapiens
ccgggagcaggcgccaccgcca

SEQ ID NO: 8541065 - DNA, 22 bp, Homo sapiens
ccgggcctcgggacaccgggta

SEQ ID NO: 8541066 - DNA, 22 bp, Homo sapiens
ccgggcgggggctctcgtcacc

SEQ ID NO: 8541067 - DNA, 22 bp, Homo sapiens
ccgggcctcgggacaccgggta

SEQ ID NO: 8541068 - DNA, 22 bp, Homo sapiens
ccggtcccaggtgccccggtga

SEQ ID NO: 8541069 - DNA, 22 bp, Homo sapiens
ccgtattataagtttttccttc

SEQ ID NO: 8541070 - DNA, 22 bp, Homo sapiens
ccggggacttaaagtgaaggaa

SEQ ID NO: 8541071 - DNA, 18 bp, Homo sapiens
ccgggctttggtgacaca

SEQ ID NO: 8541072 - DNA, 17 bp, Homo sapiens
cctcacagggaccagac

SEQ ID NO: 8541073 - DNA, 17 bp, Homo sapiens
cctcacagggaccagac

SEQ ID NO: 8541074 - DNA, 22 bp, Homo sapiens
cctcacagcctcatgcccagcc

SEQ ID NO: 8541075 - DNA, 22 bp, Homo sapiens
cctcacagcctcatgcccagcc

SEQ ID NO: 8541076 - DNA, 17 bp, Homo sapiens
cctcacagggaccagac

SEQ ID NO: 8541077 - DNA, 22 bp, Homo sapiens
cctcacagggccaggcccctca

SEQ ID NO: 8541078 - DNA, 22 bp, Homo sapiens
cctcacccactacactcaaggg

SEQ ID NO: 8541079 - DNA, 22 bp, Homo sapiens
cctcacagtttggctaactgtg

SEQ ID NO: 8541080 - DNA, 22 bp, Homo sapiens
cctcacagtgttcgtgtcagat

SEQ ID NO: 8541081 - DNA, 22 bp, Homo sapiens
cctcacccagtcacctaggtgg

SEQ ID NO: 8541082 - DNA, 21 bp, Homo sapiens
cctcaaagatgatggggtttc

SEQ ID NO: 8541083 - DNA, 22 bp, Homo sapiens
cctcacagagcccagatgtcta

SEQ ID NO: 8541084 - DNA, 22 bp, Homo sapiens
ccgttaatcccataatatggat

SEQ ID NO: 8541085 - DNA, 22 bp, Homo sapiens
ccgtgtgtatggtggaactgct

SEQ ID NO: 8541086 - DNA, 22 bp, Homo sapiens
ccgtgtgtatggtggaactgct

SEQ ID NO: 8541087 - DNA, 23 bp, Homo sapiens
ccgtgtgtatactctgtaataga

SEQ ID NO: 8541088 - DNA, 23 bp, Homo sapiens
ccgtgtgtatactctgtaataga

SEQ ID NO: 8541089 - DNA, 22 bp, Homo sapiens
cctcacagccctcctctagcac

SEQ ID NO: 8541090 - DNA, 22 bp, Homo sapiens
cctcacagccctcctctagcac

SEQ ID NO: 8541091 - DNA, 22 bp, Homo sapiens
cctcacagagcccagatgtcta

SEQ ID NO: 8541092 - DNA, 22 bp, Homo sapiens
cctcacagaggggcagccatct

SEQ ID NO: 8541093 - DNA, 22 bp, Homo sapiens
cctcacagcaaggatttcagtg

SEQ ID NO: 8541094 - DNA, 22 bp, Homo sapiens
ccggctactcgggaggctgacg

SEQ ID NO: 8541095 - DNA, 22 bp, Homo sapiens
ccggcgggcgcggtgacgtcag

SEQ ID NO: 8541096 - DNA, 22 bp, Homo sapiens
ccggagtgtctggcctgctggg

SEQ ID NO: 8541097 - DNA, 22 bp, Homo sapiens
ccggagtgtctggcctgctggg

SEQ ID NO: 8541098 - DNA, 22 bp, Homo sapiens
ccggcgaccgctgtcggaggcg

SEQ ID NO: 8541099 - DNA, 22 bp, Homo sapiens
ccggcgggcagcggcagtgagc

SEQ ID NO: 8541100 - DNA, 22 bp, Homo sapiens
ccctgtgggaactcctgagttg

SEQ ID NO: 8541101 - DNA, 22 bp, Homo sapiens
ccgcggggcgtgggctcttacc

SEQ ID NO: 8541102 - DNA, 22 bp, Homo sapiens
ccgcgcgcgtgggcgtccaggg

SEQ ID NO: 8541103 - DNA, 22 bp, Homo sapiens
ccctgtgcacacacttcactct

SEQ ID NO: 8541104 - DNA, 22 bp, Homo sapiens
ccctgtgcagatggcagctggg

SEQ ID NO: 8541105 - DNA, 20 bp, Homo sapiens
ccctgtgattggcaagtgtc

SEQ ID NO: 8541106 - DNA, 22 bp, Homo sapiens
ccctgtgatgtagctagagtag

SEQ ID NO: 8541107 - DNA, 20 bp, Homo sapiens
ccctgtgattggcaagtgtc

SEQ ID NO: 8541108 - DNA, 22 bp, Homo sapiens
ccctgtgctgtcatgctgggcg

SEQ ID NO: 8541109 - DNA, 22 bp, Homo sapiens
ccctgtggaggcagcatcctgc

SEQ ID NO: 8541110 - DNA, 22 bp, Homo sapiens
ccctgtgccagagaggcaggag

SEQ ID NO: 8541111 - DNA, 22 bp, Homo sapiens
ccctgtgcctagttggcctaaa

SEQ ID NO: 8541112 - DNA, 22 bp, Homo sapiens
ccctgtgcctagttggcctaaa

SEQ ID NO: 8541113 - DNA, 22 bp, Homo sapiens
ccctgtctgtaccgtgatgagc

SEQ ID NO: 8541114 - DNA, 22 bp, Homo sapiens
ccctgtccttggctgtgaggct

SEQ ID NO: 8541115 - DNA, 22 bp, Homo sapiens
ccctgtctcattgatcacttgt

SEQ ID NO: 8541116 - DNA, 22 bp, Homo sapiens
ccctgtcctggatgggagcact

SEQ ID NO: 8541117 - DNA, 23 bp, Homo sapiens
ccctgtagcccaggacaggcttt

SEQ ID NO: 8541118 - DNA, 22 bp, Homo sapiens
ccctggtgtccactggaggaag

SEQ ID NO: 8541119 - DNA, 22 bp, Homo sapiens
ccctggtgtccactggaggaag

SEQ ID NO: 8541120 - DNA, 22 bp, Homo sapiens
ccctggttcaggtttctctgaa

SEQ ID NO: 8541121 - DNA, 21 bp, Homo sapiens
ccctggttccactgtcaccgc

SEQ ID NO: 8541122 - DNA, 22 bp, Homo sapiens
ccctggtggtacggcactggca

SEQ ID NO: 8541123 - DNA, 22 bp, Homo sapiens
ccctggtggtacggcactggca

SEQ ID NO: 8541124 - DNA, 22 bp, Homo sapiens
ccctgggttctggctgggctgc

SEQ ID NO: 8541125 - DNA, 22 bp, Homo sapiens
ccctggtggggccagacttgct

SEQ ID NO: 8541126 - DNA, 22 bp, Homo sapiens
ccctggtggggccagacttgct

SEQ ID NO: 8541127 - DNA, 22 bp, Homo sapiens
ccctggtgccctgggtcagcct

SEQ ID NO: 8541128 - DNA, 22 bp, Homo sapiens
ccctggaggaagaaacaatggc

SEQ ID NO: 8541129 - DNA, 22 bp, Homo sapiens
ccctgggagtccactgatgtca

SEQ ID NO: 8541130 - DNA, 22 bp, Homo sapiens
ccctggaggaagaaacaatggc

SEQ ID NO: 8541131 - DNA, 22 bp, Homo sapiens
ccctggaggaagaaacaatggc

SEQ ID NO: 8541132 - DNA, 22 bp, Homo sapiens
ccctggaggaaaatctgaggct

SEQ ID NO: 8541133 - DNA, 22 bp, Homo sapiens
ccctggaggaaaatctgaggct

SEQ ID NO: 8541134 - DNA, 22 bp, Homo sapiens
ccctggaggaaaatctgaggct

SEQ ID NO: 8541135 - DNA, 22 bp, Homo sapiens
ccctggagctgcttgcatgttg

SEQ ID NO: 8541136 - DNA, 22 bp, Homo sapiens
ccctggagctgcttgcatgttg

SEQ ID NO: 8541137 - DNA, 22 bp, Homo sapiens
ccctggagctgcttgcatgttg

SEQ ID NO: 8541138 - DNA, 22 bp, Homo sapiens
ccctggaggaaaatctgaggct

SEQ ID NO: 8541139 - DNA, 22 bp, Homo sapiens
tggctaacaaggtgaaaccccg

SEQ ID NO: 8541140 - DNA, 22 bp, Homo sapiens
tggctaacaaggtgaaaccccg

SEQ ID NO: 8541141 - DNA, 22 bp, Homo sapiens
tggctaagatttaaatgtttgc

SEQ ID NO: 8541142 - DNA, 22 bp, Homo sapiens
tggctaagctggggaggcctgg

SEQ ID NO: 8541143 - DNA, 22 bp, Homo sapiens
tggctaatcttaaggcttttgc

SEQ ID NO: 8541144 - DNA, 22 bp, Homo sapiens
tggctacaagtgtgtttagttt

SEQ ID NO: 8541145 - DNA, 22 bp, Homo sapiens
tggctacaagtgtgtttagttt

SEQ ID NO: 8541146 - DNA, 22 bp, Homo sapiens
tggctagaattgggttcacagg

SEQ ID NO: 8541147 - DNA, 22 bp, Homo sapiens
tggctacctgatttcttttcag

SEQ ID NO: 8541148 - DNA, 22 bp, Homo sapiens
tggctacatcacagagaattcc

SEQ ID NO: 8541149 - DNA, 22 bp, Homo sapiens
tggctacagtggcatatcaaat

SEQ ID NO: 8541150 - DNA, 22 bp, Homo sapiens
tggctacagatttgctgacaat

SEQ ID NO: 8541151 - DNA, 22 bp, Homo sapiens
tggctcagcgcggcctggtctt

SEQ ID NO: 8541152 - DNA, 22 bp, Homo sapiens
tggctcagcgcggcctggtctt

SEQ ID NO: 8541153 - DNA, 22 bp, Homo sapiens
tggctcagcgcggcctggtctt

SEQ ID NO: 8541154 - DNA, 22 bp, Homo sapiens
tggctcagccattcgtgttgcc

SEQ ID NO: 8541155 - DNA, 22 bp, Homo sapiens
tggctcagccattcgtgttgcc

SEQ ID NO: 8541156 - DNA, 22 bp, Homo sapiens
cctccctccattgccatcgtct

SEQ ID NO: 8541157 - DNA, 22 bp, Homo sapiens
cctccctctttcagtcccacag

SEQ ID NO: 8541158 - DNA, 22 bp, Homo sapiens
cctccctctttcagtcccacag

SEQ ID NO: 8541159 - DNA, 22 bp, Homo sapiens
cctccctctgttagagctgtct

SEQ ID NO: 8541160 - DNA, 22 bp, Homo sapiens
cctccctctgttagagctgtct

SEQ ID NO: 8541161 - DNA, 22 bp, Homo sapiens
cctccctccattgccatcgtct

SEQ ID NO: 8541162 - DNA, 18 bp, Homo sapiens
cctccctcattttcccag

SEQ ID NO: 8541163 - DNA, 19 bp, Homo sapiens
cctccccttggaccagcaa

SEQ ID NO: 8541164 - DNA, 22 bp, Homo sapiens
cctcccctgctcagaactctgg

SEQ ID NO: 8541165 - DNA, 23 bp, Homo sapiens
cctccccttcccacagctgggtg

SEQ ID NO: 8541166 - DNA, 22 bp, Homo sapiens
tggctcagcggtggcagcagac

SEQ ID NO: 8541167 - DNA, 22 bp, Homo sapiens
cctcccctcagacagagactgg

SEQ ID NO: 8541168 - DNA, 22 bp, Homo sapiens
cctcccagatgtgcccaatgga

SEQ ID NO: 8541169 - DNA, 22 bp, Homo sapiens
cctcccaggcattgccattttc

SEQ ID NO: 8541170 - DNA, 22 bp, Homo sapiens
cctcccaggcattgccattttc

SEQ ID NO: 8541171 - DNA, 22 bp, Homo sapiens
cctcccagatgtgcccaatgga

SEQ ID NO: 8541172 - DNA, 22 bp, Homo sapiens
cctcccacttcttgctgaggtc

SEQ ID NO: 8541173 - DNA, 19 bp, Homo sapiens
cctcaccctgcagaggagg

SEQ ID NO: 8541174 - DNA, 22 bp, Homo sapiens
cctcaccttttctctgattgct

SEQ ID NO: 8541175 - DNA, 22 bp, Homo sapiens
cctcacctcagtctgggcctca

SEQ ID NO: 8541176 - DNA, 19 bp, Homo sapiens
cctcaccctgcagaggagg

SEQ ID NO: 8541177 - DNA, 22 bp, Homo sapiens
cctcactgaagaggtgacattt

SEQ ID NO: 8541178 - DNA, 22 bp, Homo sapiens
cctcactctgcaccctgcagca

SEQ ID NO: 8541179 - DNA, 22 bp, Homo sapiens
cctcagaagactttagggaaga

SEQ ID NO: 8541180 - DNA, 22 bp, Homo sapiens
cctcagaagctcaaggacattg

SEQ ID NO: 8541181 - DNA, 22 bp, Homo sapiens
cctcagaagaagtggaattgat

SEQ ID NO: 8541182 - DNA, 22 bp, Homo sapiens
cctcagaacggaaatggttttg

SEQ ID NO: 8541183 - DNA, 22 bp, Homo sapiens
cctcactggccagccaggggtg

SEQ ID NO: 8541184 - DNA, 22 bp, Homo sapiens
cctcactgtcatcagtagttat

SEQ ID NO: 8541185 - DNA, 22 bp, Homo sapiens
cctcactgtcacttatagtggt

SEQ ID NO: 8541186 - DNA, 22 bp, Homo sapiens
cctcactgaagaggtgacattt

SEQ ID NO: 8541187 - DNA, 22 bp, Homo sapiens
cctcactgctatgtgtttgctc

SEQ ID NO: 8541188 - DNA, 22 bp, Homo sapiens
cctcactggccagccaggggtg

SEQ ID NO: 8541189 - DNA, 22 bp, Homo sapiens
cctcactgctatgtgtttgctc

SEQ ID NO: 8541190 - DNA, 22 bp, Homo sapiens
cctcactgaagaggtgacattt

SEQ ID NO: 8541191 - DNA, 22 bp, Homo sapiens
tggcctcaaccgtcctaagcac

SEQ ID NO: 8541192 - DNA, 22 bp, Homo sapiens
tggccctgcttatgtctctctt

SEQ ID NO: 8541193 - DNA, 22 bp, Homo sapiens
cctcagaagctcaaggacattg

SEQ ID NO: 8541194 - DNA, 22 bp, Homo sapiens
cctcagaagctcaaggacattg

SEQ ID NO: 8541195 - DNA, 22 bp, Homo sapiens
tggcctcaagtctgagggcctt

SEQ ID NO: 8541196 - DNA, 22 bp, Homo sapiens
tggcctcagattattgcacagt

SEQ ID NO: 8541197 - DNA, 22 bp, Homo sapiens
tggcctcccctaacagcctctt

SEQ ID NO: 8541198 - DNA, 22 bp, Homo sapiens
tggcctcccctaacagcctctt

SEQ ID NO: 8541199 - DNA, 21 bp, Homo sapiens
tggcctcccacacttccatgg

SEQ ID NO: 8541200 - DNA, 21 bp, Homo sapiens
tggcctcccacacttccatgg

SEQ ID NO: 8541201 - DNA, 21 bp, Homo sapiens
tggcctcccacacttccatgg

SEQ ID NO: 8541202 - DNA, 22 bp, Homo sapiens
cctcagccttggccccaggcag

SEQ ID NO: 8541203 - DNA, 22 bp, Homo sapiens
cctcagccttggccccaggcag

SEQ ID NO: 8541204 - DNA, 22 bp, Homo sapiens
cctcagcccctgaatggagaga

SEQ ID NO: 8541205 - DNA, 22 bp, Homo sapiens
cctcagcatcctcctgctcagt

SEQ ID NO: 8541206 - DNA, 23 bp, Homo sapiens
cctcagcatggcaggagcccagc

SEQ ID NO: 8541207 - DNA, 22 bp, Homo sapiens
tggcctcggcatccagcaagag

SEQ ID NO: 8541208 - DNA, 22 bp, Homo sapiens
tggcctcggcatccagcaagag

SEQ ID NO: 8541209 - DNA, 22 bp, Homo sapiens
tggcctcctcgggctgaccctg

SEQ ID NO: 8541210 - DNA, 23 bp, Homo sapiens
tggcctctccccacctggcagaa

SEQ ID NO: 8541211 - DNA, 22 bp, Homo sapiens
tggcctcggcatccagcaagag

SEQ ID NO: 8541212 - DNA, 22 bp, Homo sapiens
cctcagctcccatgagatctgc

SEQ ID NO: 8541213 - DNA, 22 bp, Homo sapiens
cctcagctcttccctgtgcaca

SEQ ID NO: 8541214 - DNA, 22 bp, Homo sapiens
cctcagctcttccctgtgcaca

SEQ ID NO: 8541215 - DNA, 22 bp, Homo sapiens
cctcagctgctgcacagctttt

SEQ ID NO: 8541216 - DNA, 22 bp, Homo sapiens
cctcagctcttccctgtgcaca

SEQ ID NO: 8541217 - DNA, 22 bp, Homo sapiens
cctcagctgcttccctggagcc

SEQ ID NO: 8541218 - DNA, 22 bp, Homo sapiens
cctcagctgctgcacagctttt

SEQ ID NO: 8541219 - DNA, 22 bp, Homo sapiens
tggcctggggacctgtgagacc

SEQ ID NO: 8541220 - DNA, 22 bp, Homo sapiens
tggcctggggacctgtgagacc

SEQ ID NO: 8541221 - DNA, 22 bp, Homo sapiens
tggctaacaaggtgaaaccccg

SEQ ID NO: 8541222 - DNA, 22 bp, Homo sapiens
tggctaacaaggtgaaaccccg

SEQ ID NO: 8541223 - DNA, 22 bp, Homo sapiens
tgctttatttataaaatagcaa

SEQ ID NO: 8541224 - DNA, 22 bp, Homo sapiens
tgctttatttataaaatagcaa

SEQ ID NO: 8541225 - DNA, 22 bp, Homo sapiens
tgcttgtctctctgtgcccact

SEQ ID NO: 8541226 - DNA, 22 bp, Homo sapiens
tgcttgtctcagataaaactat

SEQ ID NO: 8541227 - DNA, 19 bp, Homo sapiens
tgcctgctcctggcttcca

SEQ ID NO: 8541228 - DNA, 22 bp, Homo sapiens
tgcttgtccgaggtgagtactt

SEQ ID NO: 8541229 - DNA, 19 bp, Homo sapiens
tgcctgctcctggcttcca

SEQ ID NO: 8541230 - DNA, 22 bp, Homo sapiens
tgcctgctaggccctgctgggt

SEQ ID NO: 8541231 - DNA, 22 bp, Homo sapiens
tgcctgctaggccctgctgggt

SEQ ID NO: 8541232 - DNA, 22 bp, Homo sapiens
tgcctgctagatatccaggtga

SEQ ID NO: 8541233 - DNA, 21 bp, Homo sapiens
tgctttcagactcttacagaa

SEQ ID NO: 8541234 - DNA, 21 bp, Homo sapiens
tgctttcagactcttacagaa

SEQ ID NO: 8541235 - DNA, 22 bp, Homo sapiens
tgctttcacttctctgcagcca

SEQ ID NO: 8541236 - DNA, 22 bp, Homo sapiens
tgctttcagccagtgtctggat

SEQ ID NO: 8541237 - DNA, 22 bp, Homo sapiens
tgctttcatgaagtctatagag

SEQ ID NO: 8541238 - DNA, 22 bp, Homo sapiens
tgctttcatattgcctatgact

SEQ ID NO: 8541239 - DNA, 22 bp, Homo sapiens
tgctttcaaaggctttctagat

SEQ ID NO: 8541240 - DNA, 22 bp, Homo sapiens
tgctttcaaaggctttctagat

SEQ ID NO: 8541241 - DNA, 22 bp, Homo sapiens
tgctttcacaccatgcctataa

SEQ ID NO: 8541242 - DNA, 22 bp, Homo sapiens
tgctttcacatgtatgcacaaa

SEQ ID NO: 8541243 - DNA, 22 bp, Homo sapiens
tgctttcacatgtatgcacaaa

SEQ ID NO: 8541244 - DNA, 22 bp, Homo sapiens
tgcctgcctaggaagctgtgaa

SEQ ID NO: 8541245 - DNA, 22 bp, Homo sapiens
tgcctgcctcaggccgagtgct

SEQ ID NO: 8541246 - DNA, 22 bp, Homo sapiens
tgcctgcctaggaagctgtgaa

SEQ ID NO: 8541247 - DNA, 20 bp, Homo sapiens
tgcctgcccctgctttttcc

SEQ ID NO: 8541248 - DNA, 22 bp, Homo sapiens
tgcctgccctgaaaactgccca

SEQ ID NO: 8541249 - DNA, 22 bp, Homo sapiens
tgcctgccctttccacacagcc

SEQ ID NO: 8541250 - DNA, 22 bp, Homo sapiens
tgcctgcctctggcagccctgc

SEQ ID NO: 8541251 - DNA, 22 bp, Homo sapiens
tgcctgccttgctgctggacag

SEQ ID NO: 8541252 - DNA, 22 bp, Homo sapiens
tgcctgcgaggcatgggtgaga

SEQ ID NO: 8541253 - DNA, 22 bp, Homo sapiens
tgcctgcctctggcagccctgc

SEQ ID NO: 8541254 - DNA, 22 bp, Homo sapiens
tgcctgcctgcatagtcccacg

SEQ ID NO: 8541255 - DNA, 22 bp, Homo sapiens
tgcctcagtttctccatatgaa

SEQ ID NO: 8541256 - DNA, 22 bp, Homo sapiens
tgcctcataacactcctggagt

SEQ ID NO: 8541257 - DNA, 22 bp, Homo sapiens
tgcctcagtttcatctgcagaa

SEQ ID NO: 8541258 - DNA, 22 bp, Homo sapiens
tgcctcagtttcatctgcagaa

SEQ ID NO: 8541259 - DNA, 22 bp, Homo sapiens
ccctagaacacgcagacactga

SEQ ID NO: 8541260 - DNA, 22 bp, Homo sapiens
ccctagaacacgcagacactga

SEQ ID NO: 8541261 - DNA, 22 bp, Homo sapiens
ccctagaacacgcagacactga

SEQ ID NO: 8541262 - DNA, 22 bp, Homo sapiens
tggaaagacattcagccgctgg

SEQ ID NO: 8541263 - DNA, 22 bp, Homo sapiens
tggaagaatatgggggtacaga

SEQ ID NO: 8541264 - DNA, 22 bp, Homo sapiens
tggaagaataggatagaagaac

SEQ ID NO: 8541265 - DNA, 22 bp, Homo sapiens
tggaagaataggatagaagaac

SEQ ID NO: 8541266 - DNA, 22 bp, Homo sapiens
tggaagaaggcagagaggcatt

SEQ ID NO: 8541267 - DNA, 22 bp, Homo sapiens
tggaagaaggcagagaggcatt

SEQ ID NO: 8541268 - DNA, 22 bp, Homo sapiens
cccgggttgtccgcgcgtccgg

SEQ ID NO: 8541269 - DNA, 22 bp, Homo sapiens
cccgtgtggacagcgtgccagt

SEQ ID NO: 8541270 - DNA, 22 bp, Homo sapiens
cccgggaggtggagactgcagt

SEQ ID NO: 8541271 - DNA, 22 bp, Homo sapiens
cccgtttaattactcgagctgt

SEQ ID NO: 8541272 - DNA, 23 bp, Homo sapiens
ccctaactaattctagggcctaa

SEQ ID NO: 8541273 - DNA, 21 bp, Homo sapiens
ccctaactctaaaggatccat

SEQ ID NO: 8541274 - DNA, 22 bp, Homo sapiens
cccgtgtggatgcgctggtgct

SEQ ID NO: 8541275 - DNA, 22 bp, Homo sapiens
tggaagacaatgtacatgcagt

SEQ ID NO: 8541276 - DNA, 22 bp, Homo sapiens
tggaagaatgtttgccttataa

SEQ ID NO: 8541277 - DNA, 22 bp, Homo sapiens
tggaagacagttgatgggagtt

SEQ ID NO: 8541278 - DNA, 22 bp, Homo sapiens
tggaagacagtgactggttgtg

SEQ ID NO: 8541279 - DNA, 22 bp, Homo sapiens
tggaaggcatgggaactgttct

SEQ ID NO: 8541280 - DNA, 22 bp, Homo sapiens
tggaaggcaggacctgccttgg

SEQ ID NO: 8541281 - DNA, 22 bp, Homo sapiens
tggaaggcaacggagtgagctg

SEQ ID NO: 8541282 - DNA, 22 bp, Homo sapiens
tggaaggcactgggagaagact

SEQ ID NO: 8541283 - DNA, 22 bp, Homo sapiens
tggaaggctgagagtcctgggg

SEQ ID NO: 8541284 - DNA, 22 bp, Homo sapiens
tggaaggctaggtgctaggccc

SEQ ID NO: 8541285 - DNA, 21 bp, Homo sapiens
tggaaggctgctctgccaggg

SEQ ID NO: 8541286 - DNA, 21 bp, Homo sapiens
tggaaggctgctctgccaggg

SEQ ID NO: 8541287 - DNA, 22 bp, Homo sapiens
tggaaggcatttcacacaggat

SEQ ID NO: 8541288 - DNA, 22 bp, Homo sapiens
tggaaggcgcagtgatgatgct

SEQ ID NO: 8541289 - DNA, 22 bp, Homo sapiens
tggaaggcgtctcgaaggccta

SEQ ID NO: 8541290 - DNA, 19 bp, Homo sapiens
tggaaggctaagacacttg

SEQ ID NO: 8541291 - DNA, 22 bp, Homo sapiens
tggaaggctaggtgctaggccc

SEQ ID NO: 8541292 - DNA, 22 bp, Homo sapiens
tggaagggaacaggtgggtgtt

SEQ ID NO: 8541293 - DNA, 22 bp, Homo sapiens
tggaagggaacaggtgggtgtt

SEQ ID NO: 8541294 - DNA, 22 bp, Homo sapiens
tggaagggaaagtttggggtcc

SEQ ID NO: 8541295 - DNA, 22 bp, Homo sapiens
tggaagggaaagtttggggtcc

SEQ ID NO: 8541296 - DNA, 22 bp, Homo sapiens
tggaggtgagtgtggtacagca

SEQ ID NO: 8541297 - DNA, 22 bp, Homo sapiens
tggaggtgagtgtggtacagca

SEQ ID NO: 8541298 - DNA, 22 bp, Homo sapiens
tggaggtgagtgtggtacagca

SEQ ID NO: 8541299 - DNA, 22 bp, Homo sapiens
ccctggagctagtctgagcaga

SEQ ID NO: 8541300 - DNA, 22 bp, Homo sapiens
ccctggagctagtctgagcaga

SEQ ID NO: 8541301 - DNA, 22 bp, Homo sapiens
ccctggagctgcttgcatgttg

SEQ ID NO: 8541302 - DNA, 23 bp, Homo sapiens
ccctggagctagtctgagcgggg

SEQ ID NO: 8541303 - DNA, 23 bp, Homo sapiens
ccctggagctagtctgagcgggg

SEQ ID NO: 8541304 - DNA, 23 bp, Homo sapiens
ccctggagctagtctgagcagag

SEQ ID NO: 8541305 - DNA, 23 bp, Homo sapiens
ccctggagctagtctgagcgggg

SEQ ID NO: 8541306 - DNA, 22 bp, Homo sapiens
ccctggagctagtctgagcaga

SEQ ID NO: 8541307 - DNA, 23 bp, Homo sapiens
ccctggagctagtctgagcagag

SEQ ID NO: 8541308 - DNA, 23 bp, Homo sapiens
ccctggagctagtctgagcagag

SEQ ID NO: 8541309 - DNA, 23 bp, Homo sapiens
ccctggagctagtctgagcagag

SEQ ID NO: 8541310 - DNA, 19 bp, Homo sapiens
tggaggggtttgaatgtgg

SEQ ID NO: 8541311 - DNA, 19 bp, Homo sapiens
tggaggggtttgaatgtgg

SEQ ID NO: 8541312 - DNA, 22 bp, Homo sapiens
tggaggggcaatggagcgcgga

SEQ ID NO: 8541313 - DNA, 22 bp, Homo sapiens
tggaggggcaatggagcgcgga

SEQ ID NO: 8541314 - DNA, 19 bp, Homo sapiens
tggaggggtttgaatgtgg

SEQ ID NO: 8541315 - DNA, 22 bp, Homo sapiens
tggaggtcctgcaggatggcac

SEQ ID NO: 8541316 - DNA, 22 bp, Homo sapiens
tggaggtctgcaaggcgctgga

SEQ ID NO: 8541317 - DNA, 22 bp, Homo sapiens
ccctgctagtccttccttggct

SEQ ID NO: 8541318 - DNA, 22 bp, Homo sapiens
ccctgctagttgtctcagtgat

SEQ ID NO: 8541319 - DNA, 23 bp, Homo sapiens
ccctgctcaggggtctgattctc

SEQ ID NO: 8541320 - DNA, 23 bp, Homo sapiens
ccctgctcaggggtctgattctc

SEQ ID NO: 8541321 - DNA, 22 bp, Homo sapiens
ccctgctcttagtgcctgtgtg

SEQ ID NO: 8541322 - DNA, 22 bp, Homo sapiens
ccctgctcttctgactcaagct

SEQ ID NO: 8541323 - DNA, 22 bp, Homo sapiens
tggaggccagaggtactgggac

SEQ ID NO: 8541324 - DNA, 22 bp, Homo sapiens
tggaggccaggaaggcagcgag

SEQ ID NO: 8541325 - DNA, 19 bp, Homo sapiens
tggaggccaggacacaggt

SEQ ID NO: 8541326 - DNA, 18 bp, Homo sapiens
tggagggcttgctgcagc

SEQ ID NO: 8541327 - DNA, 22 bp, Homo sapiens
tggaggggcaatggagcgcgga

SEQ ID NO: 8541328 - DNA, 22 bp, Homo sapiens
ccctgccttgttggagcctatg

SEQ ID NO: 8541329 - DNA, 22 bp, Homo sapiens
ccctgccttgttggagcctatg

SEQ ID NO: 8541330 - DNA, 22 bp, Homo sapiens
ccctgccttgttggagcctatg

SEQ ID NO: 8541331 - DNA, 22 bp, Homo sapiens
ccctgccttgtctgggctaggt

SEQ ID NO: 8541332 - DNA, 22 bp, Homo sapiens
ccctgccttgtctgggctaggt

SEQ ID NO: 8541333 - DNA, 22 bp, Homo sapiens
ccctgccttgtctgggctaggt

SEQ ID NO: 8541334 - DNA, 22 bp, Homo sapiens
ccctgccttggggtccacaccg

SEQ ID NO: 8541335 - DNA, 22 bp, Homo sapiens
ccctgccttggggtccacaccg

SEQ ID NO: 8541336 - DNA, 22 bp, Homo sapiens
ccctgccttggggtccacaccg

SEQ ID NO: 8541337 - DNA, 22 bp, Homo sapiens
ccctgccttcttggcctttaaa

SEQ ID NO: 8541338 - DNA, 22 bp, Homo sapiens
ccctgccttcttggcctttaaa

SEQ ID NO: 8541339 - DNA, 22 bp, Homo sapiens
ccctgccttcttggcctttaaa

SEQ ID NO: 8541340 - DNA, 22 bp, Homo sapiens
ccctgccttggggtccacaccg

SEQ ID NO: 8541341 - DNA, 22 bp, Homo sapiens
ccctgcagccggccagctcatt

SEQ ID NO: 8541342 - DNA, 20 bp, Homo sapiens
ccctgcagccatgggagtgg

SEQ ID NO: 8541343 - DNA, 22 bp, Homo sapiens
tggacaggtgcacacagcagcc

SEQ ID NO: 8541344 - DNA, 22 bp, Homo sapiens
tggacaggtgcacacagcagcc

SEQ ID NO: 8541345 - DNA, 22 bp, Homo sapiens
tggacaggtgcacacagcagcc

SEQ ID NO: 8541346 - DNA, 22 bp, Homo sapiens
ccctgcagagccagccctgacc

SEQ ID NO: 8541347 - DNA, 22 bp, Homo sapiens
ccctgcagatcagtgagaactt

SEQ ID NO: 8541348 - DNA, 22 bp, Homo sapiens
ccctgcagatctagggtccttc

SEQ ID NO: 8541349 - DNA, 22 bp, Homo sapiens
ccctgcagcattctctaactgg

SEQ ID NO: 8541350 - DNA, 22 bp, Homo sapiens
ccctgcagcattctctaactgg

SEQ ID NO: 8541351 - DNA, 22 bp, Homo sapiens
ccctgcacagcctggctctctt

SEQ ID NO: 8541352 - DNA, 22 bp, Homo sapiens
ccctgaggagagcgcttcccga

SEQ ID NO: 8541353 - DNA, 22 bp, Homo sapiens
ccctgaggaccaggaaggaggg

SEQ ID NO: 8541354 - DNA, 22 bp, Homo sapiens
ccctgaggaccaggaaggaggg

SEQ ID NO: 8541355 - DNA, 22 bp, Homo sapiens
tggaagggaacaggtgggtgtt

SEQ ID NO: 8541356 - DNA, 22 bp, Homo sapiens
ccctgaggaccaggaaggaggg

SEQ ID NO: 8541357 - DNA, 21 bp, Homo sapiens
tggaagggaagtcttggttgt

SEQ ID NO: 8541358 - DNA, 22 bp, Homo sapiens
ccctgcagaaccacagacaaac

SEQ ID NO: 8541359 - DNA, 22 bp, Homo sapiens
ccctgcagacgtcttgatgcct

SEQ ID NO: 8541360 - DNA, 22 bp, Homo sapiens
ccctgcagaccaatgccataga

SEQ ID NO: 8541361 - DNA, 22 bp, Homo sapiens
ccctgcagaccaatgccataga

SEQ ID NO: 8541362 - DNA, 22 bp, Homo sapiens
ccctgcagagaccactgacctt

SEQ ID NO: 8541363 - DNA, 22 bp, Homo sapiens
ccctgcagagaccactgacctt

SEQ ID NO: 8541364 - DNA, 22 bp, Homo sapiens
ccctgcagagagtgcttttgtg

SEQ ID NO: 8541365 - DNA, 22 bp, Homo sapiens
ccctgcagagccagccctgacc

SEQ ID NO: 8541366 - DNA, 22 bp, Homo sapiens
tggacatcttagtcatgtcaat

SEQ ID NO: 8541367 - DNA, 22 bp, Homo sapiens
tggacatgagctgagtgggtgt

SEQ ID NO: 8541368 - DNA, 22 bp, Homo sapiens
tggacatgacctcgagcgagat

SEQ ID NO: 8541369 - DNA, 22 bp, Homo sapiens
tggacaggtttgggtgcctgtt

SEQ ID NO: 8541370 - DNA, 22 bp, Homo sapiens
tggacaggttgagtaggaggag

SEQ ID NO: 8541371 - DNA, 22 bp, Homo sapiens
tggacaggttgagtaggaggag

SEQ ID NO: 8541372 - DNA, 22 bp, Homo sapiens
tggacaggttgagtaggaggag

SEQ ID NO: 8541373 - DNA, 22 bp, Homo sapiens
tggacaggttgagtaggaggag

SEQ ID NO: 8541374 - DNA, 22 bp, Homo sapiens
tggacaggttgagtaggaggag

SEQ ID NO: 8541375 - DNA, 22 bp, Homo sapiens
ccctgcctgtgggcatcaacat

SEQ ID NO: 8541376 - DNA, 22 bp, Homo sapiens
ccctgcctgtgggcatcaacat

SEQ ID NO: 8541377 - DNA, 22 bp, Homo sapiens
ccctgcctgtgggcatcaacat

SEQ ID NO: 8541378 - DNA, 22 bp, Homo sapiens
ccctgcctctgaagctgctcag

SEQ ID NO: 8541379 - DNA, 22 bp, Homo sapiens
ccctgcctctgaagctgctcag

SEQ ID NO: 8541380 - DNA, 22 bp, Homo sapiens
ccctgcctgtgggcatcaacat

SEQ ID NO: 8541381 - DNA, 22 bp, Homo sapiens
ccctgcagtgtgacctcaccta

SEQ ID NO: 8541382 - DNA, 19 bp, Homo sapiens
ccctgccctggtgactggg

SEQ ID NO: 8541383 - DNA, 22 bp, Homo sapiens
ccctgcctacagggttttcttt

SEQ ID NO: 8541384 - DNA, 22 bp, Homo sapiens
ccctgcctacagggttttcttt

SEQ ID NO: 8541385 - DNA, 22 bp, Homo sapiens
ccctgcctctgaagctgctcag

SEQ ID NO: 8541386 - DNA, 22 bp, Homo sapiens
ccctgcctacagggttttcttt

SEQ ID NO: 8541387 - DNA, 22 bp, Homo sapiens
tgagctgggagtggtgatgagg

SEQ ID NO: 8541388 - DNA, 22 bp, Homo sapiens
tgagctggcttgtcaaccaggg

SEQ ID NO: 8541389 - DNA, 22 bp, Homo sapiens
tgagctggcacttttcctggga

SEQ ID NO: 8541390 - DNA, 22 bp, Homo sapiens
tgagctggcaggggctcaggga

SEQ ID NO: 8541391 - DNA, 22 bp, Homo sapiens
tgagcccaggagttggaggctg

SEQ ID NO: 8541392 - DNA, 22 bp, Homo sapiens
tgagcccaggagttggaggctg

SEQ ID NO: 8541393 - DNA, 22 bp, Homo sapiens
tgagcccaggagttggaggctg

SEQ ID NO: 8541394 - DNA, 22 bp, Homo sapiens
tgagctggcaggggctcaggga

SEQ ID NO: 8541395 - DNA, 22 bp, Homo sapiens
tgagcagacttgatgaggcagc

SEQ ID NO: 8541396 - DNA, 22 bp, Homo sapiens
tgagcagacttgatgaggcagc

SEQ ID NO: 8541397 - DNA, 22 bp, Homo sapiens
tgagcccaggagttggagaccg

SEQ ID NO: 8541398 - DNA, 22 bp, Homo sapiens
tgagcagactctgcagagccac

SEQ ID NO: 8541399 - DNA, 22 bp, Homo sapiens
tgagcagaatgttcagataaat

SEQ ID NO: 8541400 - DNA, 22 bp, Homo sapiens
tgagcagaagttataaataaga

SEQ ID NO: 8541401 - DNA, 22 bp, Homo sapiens
tgagcagaagccctcctggact

SEQ ID NO: 8541402 - DNA, 22 bp, Homo sapiens
tgagcagaacacgggatccatg

SEQ ID NO: 8541403 - DNA, 22 bp, Homo sapiens
tgagcagaagattggaacttac

SEQ ID NO: 8541404 - DNA, 22 bp, Homo sapiens
tgagcagaaaagaatgctgagc

SEQ ID NO: 8541405 - DNA, 22 bp, Homo sapiens
tgagcagaaaagaatgctgagc

SEQ ID NO: 8541406 - DNA, 22 bp, Homo sapiens
tgaggacattggtcaggacatg

SEQ ID NO: 8541407 - DNA, 22 bp, Homo sapiens
ccagtggccatgcacgagcagc

SEQ ID NO: 8541408 - DNA, 22 bp, Homo sapiens
ccagtgtggactctctcctttg

SEQ ID NO: 8541409 - DNA, 22 bp, Homo sapiens
ccagtgtggccaggtgctggta

SEQ ID NO: 8541410 - DNA, 23 bp, Homo sapiens
ccagtggcgtaaactagaggata

SEQ ID NO: 8541411 - DNA, 22 bp, Homo sapiens
tgaggacatgagtgggacagag

SEQ ID NO: 8541412 - DNA, 22 bp, Homo sapiens
tgaggacatgagtgggacagag

SEQ ID NO: 8541413 - DNA, 22 bp, Homo sapiens
tgaggacattaggaagtgaagg

SEQ ID NO: 8541414 - DNA, 22 bp, Homo sapiens
tgaggacattaggaagtgaagg

SEQ ID NO: 8541415 - DNA, 22 bp, Homo sapiens
tgaggacattgagactggagac

SEQ ID NO: 8541416 - DNA, 22 bp, Homo sapiens
tgaggacattaggaagtgaagg

SEQ ID NO: 8541417 - DNA, 22 bp, Homo sapiens
tgaggacattgagactggagac

SEQ ID NO: 8541418 - DNA, 22 bp, Homo sapiens
tgagctgggctgggctgagctg

SEQ ID NO: 8541419 - DNA, 23 bp, Homo sapiens
tgagctgggcctgcaggggtctc

SEQ ID NO: 8541420 - DNA, 23 bp, Homo sapiens
tgagctgggcctgcaggggtctc

SEQ ID NO: 8541421 - DNA, 22 bp, Homo sapiens
tgagctgggctgggctgagctg

SEQ ID NO: 8541422 - DNA, 22 bp, Homo sapiens
tgagctgggctgggctgagctg

SEQ ID NO: 8541423 - DNA, 22 bp, Homo sapiens
tgagctgggctgggctgagctg

SEQ ID NO: 8541424 - DNA, 23 bp, Homo sapiens
tgagctggtattgtccatctcca

SEQ ID NO: 8541425 - DNA, 23 bp, Homo sapiens
tgagctggtattgtccatctcca

SEQ ID NO: 8541426 - DNA, 22 bp, Homo sapiens
tgaggaatgctgagcagaggaa

SEQ ID NO: 8541427 - DNA, 22 bp, Homo sapiens
tgaggaagttgtttctcttcta

SEQ ID NO: 8541428 - DNA, 22 bp, Homo sapiens
tgaggacaatccctaactcaga

SEQ ID NO: 8541429 - DNA, 22 bp, Homo sapiens
tgaggaatgttttgagtgccga

SEQ ID NO: 8541430 - DNA, 22 bp, Homo sapiens
tgaggaatgctgagcagaggaa

SEQ ID NO: 8541431 - DNA, 22 bp, Homo sapiens
ccaggtctatcaagttgggctc

SEQ ID NO: 8541432 - DNA, 19 bp, Homo sapiens
tgagactgggtgcagtact

SEQ ID NO: 8541433 - DNA, 22 bp, Homo sapiens
ccaggtcctgttttcaccacag

SEQ ID NO: 8541434 - DNA, 22 bp, Homo sapiens
ccaggtcctgttttcaccacag

SEQ ID NO: 8541435 - DNA, 22 bp, Homo sapiens
tgagacttggcactgaggaact

SEQ ID NO: 8541436 - DNA, 22 bp, Homo sapiens
tgagaggtgaggcatgaggcat

SEQ ID NO: 8541437 - DNA, 22 bp, Homo sapiens
tgagagtagagtcttcatctgt

SEQ ID NO: 8541438 - DNA, 22 bp, Homo sapiens
tgagagtctgttcctcttgcag

SEQ ID NO: 8541439 - DNA, 22 bp, Homo sapiens
tgagagtattttggcattatca

SEQ ID NO: 8541440 - DNA, 22 bp, Homo sapiens
tgagagtctcagacctcctggt

SEQ ID NO: 8541441 - DNA, 22 bp, Homo sapiens
tgagagtattttggcattatca

SEQ ID NO: 8541442 - DNA, 22 bp, Homo sapiens
tgagcacctactgtattccagg

SEQ ID NO: 8541443 - DNA, 22 bp, Homo sapiens
tgagcacctaccttgtccagtg

SEQ ID NO: 8541444 - DNA, 22 bp, Homo sapiens
tgagataataaacatctcctta

SEQ ID NO: 8541445 - DNA, 22 bp, Homo sapiens
tgagcaccatctgtttgtgtgc

SEQ ID NO: 8541446 - DNA, 22 bp, Homo sapiens
tgagagttttgacgcttgtaac

SEQ ID NO: 8541447 - DNA, 22 bp, Homo sapiens
tgagagttctctcttcaggtgg

SEQ ID NO: 8541448 - DNA, 22 bp, Homo sapiens
tgagagttcctcctctttccac

SEQ ID NO: 8541449 - DNA, 22 bp, Homo sapiens
tgagataacatggaagagtagc

SEQ ID NO: 8541450 - DNA, 22 bp, Homo sapiens
tgagataactattctgtcaact

SEQ ID NO: 8541451 - DNA, 22 bp, Homo sapiens
tgagataactctgatttatgtt

SEQ ID NO: 8541452 - DNA, 22 bp, Homo sapiens
tgagataacaaaattatcttca

SEQ ID NO: 8541453 - DNA, 22 bp, Homo sapiens
tgagataacatggaagagtagc

SEQ ID NO: 8541454 - DNA, 22 bp, Homo sapiens
tgagataagcaaggataaaggt

SEQ ID NO: 8541455 - DNA, 22 bp, Homo sapiens
ccagggtggggcaggcccactg

SEQ ID NO: 8541456 - DNA, 22 bp, Homo sapiens
ccagggtggggcaggcccactg

SEQ ID NO: 8541457 - DNA, 22 bp, Homo sapiens
ccagggtgggaggctgaaggcg

SEQ ID NO: 8541458 - DNA, 22 bp, Homo sapiens
ccagggtgggaggctgaaggcg

SEQ ID NO: 8541459 - DNA, 22 bp, Homo sapiens
ccagggtggcgtagatgctggg

SEQ ID NO: 8541460 - DNA, 22 bp, Homo sapiens
ccagggtggcgtagatgctggg

SEQ ID NO: 8541461 - DNA, 22 bp, Homo sapiens
ccagggtgggaggctgaaggcg

SEQ ID NO: 8541462 - DNA, 22 bp, Homo sapiens
ccagggtgggaggctgaaggcg

SEQ ID NO: 8541463 - DNA, 22 bp, Homo sapiens
ccagggtggggtccaggaacca

SEQ ID NO: 8541464 - DNA, 22 bp, Homo sapiens
ccagggtggggtccaggaacca

SEQ ID NO: 8541465 - DNA, 22 bp, Homo sapiens
ccagggtggggtccaggaacca

SEQ ID NO: 8541466 - DNA, 22 bp, Homo sapiens
ccagggtggggtccaggaacca

SEQ ID NO: 8541467 - DNA, 22 bp, Homo sapiens
ccagggtggggtccaggaacca

SEQ ID NO: 8541468 - DNA, 22 bp, Homo sapiens
ccagggtgtgagaaggaagtag

SEQ ID NO: 8541469 - DNA, 22 bp, Homo sapiens
ccagggtgtagggattccagat

SEQ ID NO: 8541470 - DNA, 22 bp, Homo sapiens
ccagggtgtgagaaggaagtag

SEQ ID NO: 8541471 - DNA, 22 bp, Homo sapiens
ccagggtgtgagaaggaagtag

SEQ ID NO: 8541472 - DNA, 22 bp, Homo sapiens
ccagggtgtgggcgtcggcacg

SEQ ID NO: 8541473 - DNA, 22 bp, Homo sapiens
ccagggttgctttagattctga

SEQ ID NO: 8541474 - DNA, 22 bp, Homo sapiens
ccagggtgtgggcgtcggcacg

SEQ ID NO: 8541475 - DNA, 22 bp, Homo sapiens
ccagggtgtgggcgtcggcacg

SEQ ID NO: 8541476 - DNA, 22 bp, Homo sapiens
ccagggttataaatgcatctgt

SEQ ID NO: 8541477 - DNA, 22 bp, Homo sapiens
ccagggtgtgggcgtcggcacg

SEQ ID NO: 8541478 - DNA, 21 bp, Homo sapiens
ccaggtacatggagaatgtgg

SEQ ID NO: 8541479 - DNA, 22 bp, Homo sapiens
ccaggtacatggagaagaacag

SEQ ID NO: 8541480 - DNA, 22 bp, Homo sapiens
ccaggtagccaaggggtctggg

SEQ ID NO: 8541481 - DNA, 22 bp, Homo sapiens
ccaggtacttggtatgcattca

SEQ ID NO: 8541482 - DNA, 22 bp, Homo sapiens
ccaggtaccagtcaaatctgta

SEQ ID NO: 8541483 - DNA, 22 bp, Homo sapiens
ccaggtaggagagagggatcct

SEQ ID NO: 8541484 - DNA, 22 bp, Homo sapiens
ccaggtagccaaggggtctggg

SEQ ID NO: 8541485 - DNA, 22 bp, Homo sapiens
ccaggtccctggaatttatgag

SEQ ID NO: 8541486 - DNA, 22 bp, Homo sapiens
ccagggttggtctctctgaggt

SEQ ID NO: 8541487 - DNA, 22 bp, Homo sapiens
ccagggcatgtaactaatggtg

SEQ ID NO: 8541488 - DNA, 22 bp, Homo sapiens
ccagggcatgtaactaatggtg

SEQ ID NO: 8541489 - DNA, 22 bp, Homo sapiens
ccagggccaagagacctcgagg

SEQ ID NO: 8541490 - DNA, 22 bp, Homo sapiens
ccagggcatgtccaagacttag

SEQ ID NO: 8541491 - DNA, 22 bp, Homo sapiens
ccagggcatgtccaagacttag

SEQ ID NO: 8541492 - DNA, 22 bp, Homo sapiens
ccagggcatgtccaagacttag

SEQ ID NO: 8541493 - DNA, 22 bp, Homo sapiens
tgacagagtccagaagtagtgt

SEQ ID NO: 8541494 - DNA, 22 bp, Homo sapiens
tgacagaggctgagttagtctg

SEQ ID NO: 8541495 - DNA, 22 bp, Homo sapiens
tgacagagtccagaagtagtgt

SEQ ID NO: 8541496 - DNA, 22 bp, Homo sapiens
tgacagagtgacactcttgtct

SEQ ID NO: 8541497 - DNA, 22 bp, Homo sapiens
ccagggcatgggaagaactgaa

SEQ ID NO: 8541498 - DNA, 22 bp, Homo sapiens
ccagggcatgggaagaactgaa

SEQ ID NO: 8541499 - DNA, 22 bp, Homo sapiens
ccagggcatgggaagaactgaa

SEQ ID NO: 8541500 - DNA, 22 bp, Homo sapiens
ccagggcatgggaagaactgaa

SEQ ID NO: 8541501 - DNA, 22 bp, Homo sapiens
tgacagagaggtaagttatgaa

SEQ ID NO: 8541502 - DNA, 19 bp, Homo sapiens
tgacagagagcagggtggt

SEQ ID NO: 8541503 - DNA, 19 bp, Homo sapiens
tgacagagagcagggtggt

SEQ ID NO: 8541504 - DNA, 23 bp, Homo sapiens
tgacagagcaagacttggtctca

SEQ ID NO: 8541505 - DNA, 22 bp, Homo sapiens
tgacagagctgggatttgaagc

SEQ ID NO: 8541506 - DNA, 22 bp, Homo sapiens
tgacagagcatgtagtgacagc

SEQ ID NO: 8541507 - DNA, 22 bp, Homo sapiens
tgacagagcatgtagtgacagc

SEQ ID NO: 8541508 - DNA, 22 bp, Homo sapiens
tgacagagcatgtagtgacagc

SEQ ID NO: 8541509 - DNA, 22 bp, Homo sapiens
tgacaattgcagacacagaagt

SEQ ID NO: 8541510 - DNA, 22 bp, Homo sapiens
tgacaatgggtggacaagatag

SEQ ID NO: 8541511 - DNA, 22 bp, Homo sapiens
tgacaatgggtggacaagatag

SEQ ID NO: 8541512 - DNA, 22 bp, Homo sapiens
tgacagagacagattgaagctt

SEQ ID NO: 8541513 - DNA, 22 bp, Homo sapiens
tgacagactactgcctctattg

SEQ ID NO: 8541514 - DNA, 22 bp, Homo sapiens
tgacagactttacttctcctat

SEQ ID NO: 8541515 - DNA, 22 bp, Homo sapiens
tgacagagagatgggaaagggc

SEQ ID NO: 8541516 - DNA, 22 bp, Homo sapiens
ccagggaagaataggtgtggtt

SEQ ID NO: 8541517 - DNA, 22 bp, Homo sapiens
ccagggaaactttggagtggag

SEQ ID NO: 8541518 - DNA, 22 bp, Homo sapiens
ccaggctttctcctgactcaca

SEQ ID NO: 8541519 - DNA, 22 bp, Homo sapiens
ccaggcttttagctgcatggca

SEQ ID NO: 8541520 - DNA, 22 bp, Homo sapiens
ccagggaaaatcaacttctact

SEQ ID NO: 8541521 - DNA, 22 bp, Homo sapiens
ccaggcttttctcatggagtca

SEQ ID NO: 8541522 - DNA, 22 bp, Homo sapiens
ccagggaaacagcccagtgtga

SEQ ID NO: 8541523 - DNA, 19 bp, Homo sapiens
ccaggctttatgcaaatac

SEQ ID NO: 8541524 - DNA, 22 bp, Homo sapiens
ccaggctttaagaggtggaaac

SEQ ID NO: 8541525 - DNA, 19 bp, Homo sapiens
ccaggctttatgcaaatac

SEQ ID NO: 8541526 - DNA, 22 bp, Homo sapiens
ccaggcttggtgtgtggtcagg

SEQ ID NO: 8541527 - DNA, 22 bp, Homo sapiens
tgaaggagaaatggaaagtggg

SEQ ID NO: 8541528 - DNA, 22 bp, Homo sapiens
tgaaggagaattaataggcatt

SEQ ID NO: 8541529 - DNA, 22 bp, Homo sapiens
tgaaggagaattaataggcatt

SEQ ID NO: 8541530 - DNA, 22 bp, Homo sapiens
tgaaggagaattaataggcatt

SEQ ID NO: 8541531 - DNA, 21 bp, Homo sapiens
tgaaggagaggaccgagtgct

SEQ ID NO: 8541532 - DNA, 22 bp, Homo sapiens
ccagggccagtaagattggcat

SEQ ID NO: 8541533 - DNA, 22 bp, Homo sapiens
ccagggccagtaagattggcat

SEQ ID NO: 8541534 - DNA, 22 bp, Homo sapiens
ccagggccaagagacctcgagg

SEQ ID NO: 8541535 - DNA, 22 bp, Homo sapiens
tgacatttttgtacaaagtcag

SEQ ID NO: 8541536 - DNA, 22 bp, Homo sapiens
tgacatgaaactgtgttgctac

SEQ ID NO: 8541537 - DNA, 22 bp, Homo sapiens
tgacatctttgatctcatttag

SEQ ID NO: 8541538 - DNA, 23 bp, Homo sapiens
ccagggcccctacaccactgtcc

SEQ ID NO: 8541539 - DNA, 22 bp, Homo sapiens
tgacatctgggccctcagctaa

SEQ ID NO: 8541540 - DNA, 22 bp, Homo sapiens
tgaccacagacccaatgactac

SEQ ID NO: 8541541 - DNA, 22 bp, Homo sapiens
tgaccacagacccaatgactac

SEQ ID NO: 8541542 - DNA, 22 bp, Homo sapiens
tgaccactgtagccacttaaga

SEQ ID NO: 8541543 - DNA, 22 bp, Homo sapiens
tgaccaatactgtggatgccag

SEQ ID NO: 8541544 - DNA, 22 bp, Homo sapiens
tgaccaaaggtggtttatttgg

SEQ ID NO: 8541545 - DNA, 22 bp, Homo sapiens
tgaccaaagagttgcttgtatt

SEQ ID NO: 8541546 - DNA, 22 bp, Homo sapiens
tgaccaggatactgcagggatg

SEQ ID NO: 8541547 - DNA, 22 bp, Homo sapiens
tgacccatcaggccacatgagg

SEQ ID NO: 8541548 - DNA, 22 bp, Homo sapiens
tgagaaaactcaaagacagatc

SEQ ID NO: 8541549 - DNA, 22 bp, Homo sapiens
tgagaaaaggttgagatgataa

SEQ ID NO: 8541550 - DNA, 22 bp, Homo sapiens
tgagaaaaggttgagatgataa

SEQ ID NO: 8541551 - DNA, 22 bp, Homo sapiens
tgagaaaactcaaagacagatc

SEQ ID NO: 8541552 - DNA, 22 bp, Homo sapiens
ccagggtctctgctgcctgaga

SEQ ID NO: 8541553 - DNA, 22 bp, Homo sapiens
ccagggtctctgctgcctgaga

SEQ ID NO: 8541554 - DNA, 22 bp, Homo sapiens
ccagggtggaggctggatggag

SEQ ID NO: 8541555 - DNA, 22 bp, Homo sapiens
tgagaaaacagtttgtaataat

SEQ ID NO: 8541556 - DNA, 22 bp, Homo sapiens
tgagaaaactcaaagacagatc

SEQ ID NO: 8541557 - DNA, 22 bp, Homo sapiens
tgagaaaactcaaagacagatc

SEQ ID NO: 8541558 - DNA, 22 bp, Homo sapiens
tgagaaaacagtttgtaataat

SEQ ID NO: 8541559 - DNA, 22 bp, Homo sapiens
tgagaaaacagtttgtaataat

SEQ ID NO: 8541560 - DNA, 22 bp, Homo sapiens
tgagaaaacagtttgtaataat

SEQ ID NO: 8541561 - DNA, 22 bp, Homo sapiens
tgacttttggacctcactgtcc

SEQ ID NO: 8541562 - DNA, 22 bp, Homo sapiens
tgacttttggacctcactgtcc

SEQ ID NO: 8541563 - DNA, 22 bp, Homo sapiens
tgactttggcttaagcagcagt

SEQ ID NO: 8541564 - DNA, 22 bp, Homo sapiens
tgactttgtgcaagtgaattat

SEQ ID NO: 8541565 - DNA, 22 bp, Homo sapiens
tgactttgtccctttcaaatcc

SEQ ID NO: 8541566 - DNA, 22 bp, Homo sapiens
tgaccctgagagctgaatggct

SEQ ID NO: 8541567 - DNA, 22 bp, Homo sapiens
tgaccctcttccccatgcgctc

SEQ ID NO: 8541568 - DNA, 22 bp, Homo sapiens
tgactttaaagctcactctttt

SEQ ID NO: 8541569 - DNA, 22 bp, Homo sapiens
tgaccctgcttcttggtgcagg

SEQ ID NO: 8541570 - DNA, 21 bp, Homo sapiens
tgactttatttgacagcccag

SEQ ID NO: 8541571 - DNA, 22 bp, Homo sapiens
tgaaggaaatgacggcagaaga

SEQ ID NO: 8541572 - DNA, 22 bp, Homo sapiens
tgaaggaagaataggcagtgtt

SEQ ID NO: 8541573 - DNA, 22 bp, Homo sapiens
tgaaggaatgagggagtgggtc

SEQ ID NO: 8541574 - DNA, 17 bp, Homo sapiens
tgaaggaaggatgatgt

SEQ ID NO: 8541575 - DNA, 22 bp, Homo sapiens
tgaaggaatgagggagtgggtc

SEQ ID NO: 8541576 - DNA, 22 bp, Homo sapiens
tgaaggagaaatggaaagtggg

SEQ ID NO: 8541577 - DNA, 22 bp, Homo sapiens
tgaaggagaattaataggcatt

SEQ ID NO: 8541578 - DNA, 22 bp, Homo sapiens
tgaaggaatgagtatactgttt

SEQ ID NO: 8541579 - DNA, 22 bp, Homo sapiens
tgaaggaatgagtatactgttt

SEQ ID NO: 8541580 - DNA, 22 bp, Homo sapiens
tgaaggaatgagtatactgttt

SEQ ID NO: 8541581 - DNA, 22 bp, Homo sapiens
tgaaggaatgagtatactgttt

SEQ ID NO: 8541582 - DNA, 22 bp, Homo sapiens
tgaagctttaggatgggttcat

SEQ ID NO: 8541583 - DNA, 22 bp, Homo sapiens
tgaagctttcctgtggtcagga

SEQ ID NO: 8541584 - DNA, 22 bp, Homo sapiens
tgaaggaaagagggaacatccc

SEQ ID NO: 8541585 - DNA, 22 bp, Homo sapiens
tgaagatttccaccaaatcaca

SEQ ID NO: 8541586 - DNA, 22 bp, Homo sapiens
tgaagctttaggatgggttcat

SEQ ID NO: 8541587 - DNA, 22 bp, Homo sapiens
tgaagatttaagcatctcaatt

SEQ ID NO: 8541588 - DNA, 22 bp, Homo sapiens
tgaagatttccaccaaatcaca

SEQ ID NO: 8541589 - DNA, 22 bp, Homo sapiens
tgaagatttagacctctttgcc

SEQ ID NO: 8541590 - DNA, 22 bp, Homo sapiens
tgaagatctgtcaaccccatat

SEQ ID NO: 8541591 - DNA, 17 bp, Homo sapiens
tgaagatgcatggcagc

SEQ ID NO: 8541592 - DNA, 22 bp, Homo sapiens
tgaagatgtcagcaggggtggt

SEQ ID NO: 8541593 - DNA, 22 bp, Homo sapiens
tgaagatgtcagcaggggtggt

SEQ ID NO: 8541594 - DNA, 22 bp, Homo sapiens
tgaagattgtgcttggcctgta

SEQ ID NO: 8541595 - DNA, 22 bp, Homo sapiens
tgaagagaagaaaattatcttt

SEQ ID NO: 8541596 - DNA, 23 bp, Homo sapiens
tgaacagtatgtgggacattgag

SEQ ID NO: 8541597 - DNA, 22 bp, Homo sapiens
tgaagagatagaagtacatgct

SEQ ID NO: 8541598 - DNA, 22 bp, Homo sapiens
tgaagagatagaagtacatgct

SEQ ID NO: 8541599 - DNA, 22 bp, Homo sapiens
tgaagagatagaagtacatgct

SEQ ID NO: 8541600 - DNA, 22 bp, Homo sapiens
tgaagagatagaagtacatgct

SEQ ID NO: 8541601 - DNA, 22 bp, Homo sapiens
tgaagaggccgtgtgcaggtga

SEQ ID NO: 8541602 - DNA, 22 bp, Homo sapiens
tgaagaggccaaactatcattg

SEQ ID NO: 8541603 - DNA, 22 bp, Homo sapiens
tgaacagatggcccagcagagg

SEQ ID NO: 8541604 - DNA, 22 bp, Homo sapiens
tgaacagatggcccagcagagg

SEQ ID NO: 8541605 - DNA, 22 bp, Homo sapiens
tgaacagatcaatagaactgac

SEQ ID NO: 8541606 - DNA, 22 bp, Homo sapiens
tgaacagatcaatagaactgac

SEQ ID NO: 8541607 - DNA, 22 bp, Homo sapiens
tgaacagatcaatagaactgac

SEQ ID NO: 8541608 - DNA, 22 bp, Homo sapiens
tgaacagatcaatagaactgac

SEQ ID NO: 8541609 - DNA, 18 bp, Homo sapiens
tgaacagatgagttgaag

SEQ ID NO: 8541610 - DNA, 22 bp, Homo sapiens
tgaacagatggcccagcagagg

SEQ ID NO: 8541611 - DNA, 22 bp, Homo sapiens
tgaacacgcttcatacagaggg

SEQ ID NO: 8541612 - DNA, 22 bp, Homo sapiens
tgaacacattttcttcagtaga

SEQ ID NO: 8541613 - DNA, 20 bp, Homo sapiens
tgaacactggggtgtttcag

SEQ ID NO: 8541614 - DNA, 22 bp, Homo sapiens
tgaacactgtatattcttcttg

SEQ ID NO: 8541615 - DNA, 22 bp, Homo sapiens
ccaggctgccgaggaaagaaag

SEQ ID NO: 8541616 - DNA, 22 bp, Homo sapiens
ccaggctgccgaggaaagaaag

SEQ ID NO: 8541617 - DNA, 22 bp, Homo sapiens
ccaggctgcagtcaaggggcat

SEQ ID NO: 8541618 - DNA, 22 bp, Homo sapiens
ccaggctgccgaggaaagaaag

SEQ ID NO: 8541619 - DNA, 22 bp, Homo sapiens
ccaggctgcagtcaaggggcat

SEQ ID NO: 8541620 - DNA, 22 bp, Homo sapiens
ccaggctgcagtcaaggggcat

SEQ ID NO: 8541621 - DNA, 22 bp, Homo sapiens
ccaggctgcagtcaaggggcat

SEQ ID NO: 8541622 - DNA, 22 bp, Homo sapiens
ccaggctgagcatgattggagc

SEQ ID NO: 8541623 - DNA, 22 bp, Homo sapiens
ccaggctgagcatgattggagc

SEQ ID NO: 8541624 - DNA, 22 bp, Homo sapiens
ccaggctgagcatgattggagc

SEQ ID NO: 8541625 - DNA, 22 bp, Homo sapiens
ccaggctgagcatgattggagc

SEQ ID NO: 8541626 - DNA, 22 bp, Homo sapiens
ccaggctgctcacaagctgccc

SEQ ID NO: 8541627 - DNA, 22 bp, Homo sapiens
ccaggctgctcacaagctgccc

SEQ ID NO: 8541628 - DNA, 22 bp, Homo sapiens
ccaggctgctcacaagctgccc

SEQ ID NO: 8541629 - DNA, 22 bp, Homo sapiens
ccaggctgctcacaagctgccc

SEQ ID NO: 8541630 - DNA, 22 bp, Homo sapiens
tgaaatgcaacagttatttttg

SEQ ID NO: 8541631 - DNA, 22 bp, Homo sapiens
tgaaatgattatatggtgtttg

SEQ ID NO: 8541632 - DNA, 22 bp, Homo sapiens
tgaacacagttctgatgagctt

SEQ ID NO: 8541633 - DNA, 18 bp, Homo sapiens
tgaacacagtacaattcc

SEQ ID NO: 8541634 - DNA, 22 bp, Homo sapiens
tgaacacagcatattttgttac

SEQ ID NO: 8541635 - DNA, 22 bp, Homo sapiens
tgaacacagggccaaacttgag

SEQ ID NO: 8541636 - DNA, 22 bp, Homo sapiens
tgaaagcatgcttgccaagctt

SEQ ID NO: 8541637 - DNA, 22 bp, Homo sapiens
tgaaagcatatgctaaagacca

SEQ ID NO: 8541638 - DNA, 22 bp, Homo sapiens
tgaaagcagtgatttctccttc

SEQ ID NO: 8541639 - DNA, 22 bp, Homo sapiens
tgaaagcaggcgggctacttta

SEQ ID NO: 8541640 - DNA, 22 bp, Homo sapiens
tgaaagcagtgccatgattatg

SEQ ID NO: 8541641 - DNA, 22 bp, Homo sapiens
tgaaagcattagtctaaggtag

SEQ ID NO: 8541642 - DNA, 22 bp, Homo sapiens
tgaaagctgaggacaggagggt

SEQ ID NO: 8541643 - DNA, 22 bp, Homo sapiens
tgaaagcatgcttgccaagctt

SEQ ID NO: 8541644 - DNA, 22 bp, Homo sapiens
tgaaagctgtccactaggctgt

SEQ ID NO: 8541645 - DNA, 22 bp, Homo sapiens
ccaggctccccaggaggccctt

SEQ ID NO: 8541646 - DNA, 22 bp, Homo sapiens
ccaggctccgcatagaccccac

SEQ ID NO: 8541647 - DNA, 22 bp, Homo sapiens
ccaggctcctcatgatcttgtt

SEQ ID NO: 8541648 - DNA, 22 bp, Homo sapiens
tgaaagcagatagctctgttgt

SEQ ID NO: 8541649 - DNA, 22 bp, Homo sapiens
tgaaagcagatagctctgttgt

SEQ ID NO: 8541650 - DNA, 22 bp, Homo sapiens
tgaaagcagcaccaataccatt

SEQ ID NO: 8541651 - DNA, 22 bp, Homo sapiens
tgaaagcactgattctcaactc

SEQ ID NO: 8541652 - DNA, 21 bp, Homo sapiens
ccagcctcagatcagggagct

SEQ ID NO: 8541653 - DNA, 21 bp, Homo sapiens
ccagcctcagatcagggagct

SEQ ID NO: 8541654 - DNA, 22 bp, Homo sapiens
tcttgcctcttcccctttccat

SEQ ID NO: 8541655 - DNA, 21 bp, Homo sapiens
ccagcctcagatcagggagct

SEQ ID NO: 8541656 - DNA, 22 bp, Homo sapiens
ccagcctcactggcatcaccta

SEQ ID NO: 8541657 - DNA, 22 bp, Homo sapiens
tcttggtctttcatccttcaac

SEQ ID NO: 8541658 - DNA, 22 bp, Homo sapiens
tcttgggggactttggcatgga

SEQ ID NO: 8541659 - DNA, 22 bp, Homo sapiens
tctttaaagttggagcttgcaa

SEQ ID NO: 8541660 - DNA, 22 bp, Homo sapiens
tctttaacaggaattattacag

SEQ ID NO: 8541661 - DNA, 22 bp, Homo sapiens
tctttaagagtaattattttgg

SEQ ID NO: 8541662 - DNA, 22 bp, Homo sapiens
tcttgttaaagtgaagatactg

SEQ ID NO: 8541663 - DNA, 22 bp, Homo sapiens
tcttgtcctaagagctggattc

SEQ ID NO: 8541664 - DNA, 21 bp, Homo sapiens
tcttgtccttgctctcccact

SEQ ID NO: 8541665 - DNA, 22 bp, Homo sapiens
tctgcagagggagtgctgggtc

SEQ ID NO: 8541666 - DNA, 22 bp, Homo sapiens
tctgcagagggagtgctgggtc

SEQ ID NO: 8541667 - DNA, 19 bp, Homo sapiens
tctgcagaggaattcttca

SEQ ID NO: 8541668 - DNA, 22 bp, Homo sapiens
tctgcagacttgcctaagtgtg

SEQ ID NO: 8541669 - DNA, 22 bp, Homo sapiens
tctgcagagattctgggctgag

SEQ ID NO: 8541670 - DNA, 22 bp, Homo sapiens
tctgcagacttgataaccactg

SEQ ID NO: 8541671 - DNA, 22 bp, Homo sapiens
tctgcagacaggaagctgaggc

SEQ ID NO: 8541672 - DNA, 23 bp, Homo sapiens
tctgcagacgctgttctattgtc

SEQ ID NO: 8541673 - DNA, 22 bp, Homo sapiens
ccagcccttgagatggaaggga

SEQ ID NO: 8541674 - DNA, 22 bp, Homo sapiens
ccagcccttgagatggaaggga

SEQ ID NO: 8541675 - DNA, 22 bp, Homo sapiens
ccagcccttgagatggaaggga

SEQ ID NO: 8541676 - DNA, 22 bp, Homo sapiens
ccagcccttgagatggaaggga

SEQ ID NO: 8541677 - DNA, 22 bp, Homo sapiens
ccagcccttgagatggaaggga

SEQ ID NO: 8541678 - DNA, 22 bp, Homo sapiens
tctgcagaggtaatttacagat

SEQ ID NO: 8541679 - DNA, 22 bp, Homo sapiens
ccagcccttgctgaagggtggc

SEQ ID NO: 8541680 - DNA, 22 bp, Homo sapiens
ccagcccttgctgaagggtggc

SEQ ID NO: 8541681 - DNA, 22 bp, Homo sapiens
ccagcctcactggcatcaccta

SEQ ID NO: 8541682 - DNA, 22 bp, Homo sapiens
ccagcctcactggcatcaccta

SEQ ID NO: 8541683 - DNA, 22 bp, Homo sapiens
ccaggctcacagcatcccagga

SEQ ID NO: 8541684 - DNA, 22 bp, Homo sapiens
ccaggctcacctggagcccctg

SEQ ID NO: 8541685 - DNA, 22 bp, Homo sapiens
ccaggctcactgactaccacat

SEQ ID NO: 8541686 - DNA, 22 bp, Homo sapiens
ccaggctcagcgcgcacgtctg

SEQ ID NO: 8541687 - DNA, 22 bp, Homo sapiens
ccaggctcacagcatcccagga

SEQ ID NO: 8541688 - DNA, 22 bp, Homo sapiens
ccaggctcacagcatcccagga

SEQ ID NO: 8541689 - DNA, 22 bp, Homo sapiens
ccaggctcacagcatcccagga

SEQ ID NO: 8541690 - DNA, 22 bp, Homo sapiens
ccaggctcagcgcgcacgtctg

SEQ ID NO: 8541691 - DNA, 22 bp, Homo sapiens
ccaggctcaggcctgctcgttg

SEQ ID NO: 8541692 - DNA, 17 bp, Homo sapiens
ccaggctccatcactgt

SEQ ID NO: 8541693 - DNA, 22 bp, Homo sapiens
ccaggctcaggtgcgagagaca

SEQ ID NO: 8541694 - DNA, 17 bp, Homo sapiens
ccaggctccatcactgt

SEQ ID NO: 8541695 - DNA, 17 bp, Homo sapiens
ccaggctccatcactgt

SEQ ID NO: 8541696 - DNA, 22 bp, Homo sapiens
ccaggctccccaggaggccctt

SEQ ID NO: 8541697 - DNA, 17 bp, Homo sapiens
ccaggctccatcactgt

SEQ ID NO: 8541698 - DNA, 18 bp, Homo sapiens
tctttaagttgtcagagt

SEQ ID NO: 8541699 - DNA, 22 bp, Homo sapiens
tctttaaggtgatttctgctac

SEQ ID NO: 8541700 - DNA, 22 bp, Homo sapiens
tctttaagggatgttctgcttt

SEQ ID NO: 8541701 - DNA, 22 bp, Homo sapiens
tctttaagagttcatttgcatg

SEQ ID NO: 8541702 - DNA, 22 bp, Homo sapiens
tctttaagccaagatatattta

SEQ ID NO: 8541703 - DNA, 22 bp, Homo sapiens
tctttaatatctgccccagagc

SEQ ID NO: 8541704 - DNA, 22 bp, Homo sapiens
tctttatttaagtctgttgtaa

SEQ ID NO: 8541705 - DNA, 22 bp, Homo sapiens
tctttatttaagtctgttgtaa

SEQ ID NO: 8541706 - DNA, 22 bp, Homo sapiens
tctttatttaagtctgttgtaa

SEQ ID NO: 8541707 - DNA, 22 bp, Homo sapiens
tctttatttctgaatcccccat

SEQ ID NO: 8541708 - DNA, 22 bp, Homo sapiens
tctttcaaagtaacaaccacga

SEQ ID NO: 8541709 - DNA, 22 bp, Homo sapiens
tctttcaaagctgtagtagatt

SEQ ID NO: 8541710 - DNA, 22 bp, Homo sapiens
tctttcaaagcaaaatgaggct

SEQ ID NO: 8541711 - DNA, 22 bp, Homo sapiens
tctttattttatgcttgtgcaa

SEQ ID NO: 8541712 - DNA, 22 bp, Homo sapiens
tctttattttatgcttgtgcaa

SEQ ID NO: 8541713 - DNA, 22 bp, Homo sapiens
cccagcccacggtcctgggtgg

SEQ ID NO: 8541714 - DNA, 22 bp, Homo sapiens
cccagcccagcgttcgaggggt

SEQ ID NO: 8541715 - DNA, 22 bp, Homo sapiens
cccagcccagcgttcgaggggt

SEQ ID NO: 8541716 - DNA, 22 bp, Homo sapiens
cccagcccagcgttcgaggggt

SEQ ID NO: 8541717 - DNA, 18 bp, Homo sapiens
cccagcccaccatttctc

SEQ ID NO: 8541718 - DNA, 18 bp, Homo sapiens
cccagcccaccatttctc

SEQ ID NO: 8541719 - DNA, 19 bp, Homo sapiens
cccagccaggtcttgcatc

SEQ ID NO: 8541720 - DNA, 22 bp, Homo sapiens
cccagccctgacctattggaaa

SEQ ID NO: 8541721 - DNA, 20 bp, Homo sapiens
cccagcccgggccgcgctcg

SEQ ID NO: 8541722 - DNA, 22 bp, Homo sapiens
cccagccctgacctattggaaa

SEQ ID NO: 8541723 - DNA, 20 bp, Homo sapiens
cccagcccctacctgttgcc

SEQ ID NO: 8541724 - DNA, 20 bp, Homo sapiens
cccagcccctacctgttgcc

SEQ ID NO: 8541725 - DNA, 22 bp, Homo sapiens
cccagcccccgagtgtctggaa

SEQ ID NO: 8541726 - DNA, 22 bp, Homo sapiens
cccagcccccgagtgtctggaa

SEQ ID NO: 8541727 - DNA, 22 bp, Homo sapiens
cccagcccccgagtgtctggaa

SEQ ID NO: 8541728 - DNA, 22 bp, Homo sapiens
cccagcccccgagtgtctggaa

SEQ ID NO: 8541729 - DNA, 22 bp, Homo sapiens
cccagcccatctcaaaggtcta

SEQ ID NO: 8541730 - DNA, 22 bp, Homo sapiens
cccagcccatctcaaaggtcta

SEQ ID NO: 8541731 - DNA, 22 bp, Homo sapiens
cccagcccatctcaaaggtcta

SEQ ID NO: 8541732 - DNA, 22 bp, Homo sapiens
cccagcatctccaggcatggcc

SEQ ID NO: 8541733 - DNA, 22 bp, Homo sapiens
cccagcatggagtgaggactca

SEQ ID NO: 8541734 - DNA, 22 bp, Homo sapiens
cccagcatggagtgaggactca

SEQ ID NO: 8541735 - DNA, 22 bp, Homo sapiens
cccagcatgcacgctgacactc

SEQ ID NO: 8541736 - DNA, 22 bp, Homo sapiens
cccagcatttctgggctgcact

SEQ ID NO: 8541737 - DNA, 22 bp, Homo sapiens
cccagcatttctgggctgcact

SEQ ID NO: 8541738 - DNA, 22 bp, Homo sapiens
cccagcatggagtgaggactca

SEQ ID NO: 8541739 - DNA, 22 bp, Homo sapiens
cccagccaaggtgctggtgttg

SEQ ID NO: 8541740 - DNA, 22 bp, Homo sapiens
cccagccaaggtgctggtgttg

SEQ ID NO: 8541741 - DNA, 22 bp, Homo sapiens
cccagcatttctgggctgcact

SEQ ID NO: 8541742 - DNA, 22 bp, Homo sapiens
cccagccaagtgatctgaccgc

SEQ ID NO: 8541743 - DNA, 22 bp, Homo sapiens
cccagccaagtgatctgaccgc

SEQ ID NO: 8541744 - DNA, 22 bp, Homo sapiens
cccagccagcctcttcccatat

SEQ ID NO: 8541745 - DNA, 22 bp, Homo sapiens
cccagccagcctcttcccatat

SEQ ID NO: 8541746 - DNA, 22 bp, Homo sapiens
cccagccagcctcttcccatat

SEQ ID NO: 8541747 - DNA, 22 bp, Homo sapiens
tgcagcagtttaatgcagggtt

SEQ ID NO: 8541748 - DNA, 17 bp, Homo sapiens
tgcagcagttcccatct

SEQ ID NO: 8541749 - DNA, 22 bp, Homo sapiens
tgcagcagtgttccttggcttg

SEQ ID NO: 8541750 - DNA, 22 bp, Homo sapiens
tgcagcatgccaaacgaggagg

SEQ ID NO: 8541751 - DNA, 22 bp, Homo sapiens
tgcagcatctccttaaatcttg

SEQ ID NO: 8541752 - DNA, 22 bp, Homo sapiens
tgcagcagtttaatgcagggtt

SEQ ID NO: 8541753 - DNA, 22 bp, Homo sapiens
tgcagcagtttaatgcagggtt

SEQ ID NO: 8541754 - DNA, 22 bp, Homo sapiens
tgcagcatatagcttagtgatg

SEQ ID NO: 8541755 - DNA, 22 bp, Homo sapiens
tgcagcattgcaaagcagtctt

SEQ ID NO: 8541756 - DNA, 22 bp, Homo sapiens
tgcagcatttgctgaagcagga

SEQ ID NO: 8541757 - DNA, 22 bp, Homo sapiens
tgcagcattattcacagtagcc

SEQ ID NO: 8541758 - DNA, 22 bp, Homo sapiens
tgcagcattattcacagtagcc

SEQ ID NO: 8541759 - DNA, 22 bp, Homo sapiens
tgcagcattcttggccactact

SEQ ID NO: 8541760 - DNA, 22 bp, Homo sapiens
tgcagcattctggtaaaaggca

SEQ ID NO: 8541761 - DNA, 22 bp, Homo sapiens
tgcagcattagtacaagtctca

SEQ ID NO: 8541762 - DNA, 22 bp, Homo sapiens
tgcagcattatgtagctgtttt

SEQ ID NO: 8541763 - DNA, 22 bp, Homo sapiens
cccagctcatcaggagccgccc

SEQ ID NO: 8541764 - DNA, 22 bp, Homo sapiens
cccagctcatcaggagccgccc

SEQ ID NO: 8541765 - DNA, 22 bp, Homo sapiens
cccagctcatcaggagccgccc

SEQ ID NO: 8541766 - DNA, 22 bp, Homo sapiens
cccagctcaagcagagagctaa

SEQ ID NO: 8541767 - DNA, 22 bp, Homo sapiens
cccagctcaagcagagagctaa

SEQ ID NO: 8541768 - DNA, 22 bp, Homo sapiens
cccagctccaagggacagcgaa

SEQ ID NO: 8541769 - DNA, 22 bp, Homo sapiens
cccagctcatcaggagccgccc

SEQ ID NO: 8541770 - DNA, 22 bp, Homo sapiens
cccagctccaagggacagcgaa

SEQ ID NO: 8541771 - DNA, 22 bp, Homo sapiens
cccagctcatcaggagccgccc

SEQ ID NO: 8541772 - DNA, 22 bp, Homo sapiens
cccagctccaagggacagcgaa

SEQ ID NO: 8541773 - DNA, 18 bp, Homo sapiens
cccagctccacttccctc

SEQ ID NO: 8541774 - DNA, 22 bp, Homo sapiens
tgcagtggaagaggtggagatc

SEQ ID NO: 8541775 - DNA, 22 bp, Homo sapiens
tgcagtggaagaggtggagatc

SEQ ID NO: 8541776 - DNA, 22 bp, Homo sapiens
tgcagtggaatctggagagcag

SEQ ID NO: 8541777 - DNA, 22 bp, Homo sapiens
tgcagtggaggccgtgagacag

SEQ ID NO: 8541778 - DNA, 22 bp, Homo sapiens
tgcagtggaggccgtgagacag

SEQ ID NO: 8541779 - DNA, 22 bp, Homo sapiens
tgcagtggaggccgtgagacag

SEQ ID NO: 8541780 - DNA, 22 bp, Homo sapiens
tgcagtctggatgtcctcagat

SEQ ID NO: 8541781 - DNA, 22 bp, Homo sapiens
cccagccctgacctattggaaa

SEQ ID NO: 8541782 - DNA, 22 bp, Homo sapiens
tgcagtgcctcggcagtgcagc

SEQ ID NO: 8541783 - DNA, 22 bp, Homo sapiens
tgcagtggaaagactcagactt

SEQ ID NO: 8541784 - DNA, 22 bp, Homo sapiens
tgcagtggaaagactcagactt

SEQ ID NO: 8541785 - DNA, 22 bp, Homo sapiens
tgcagtggaacaatttcaacag

SEQ ID NO: 8541786 - DNA, 22 bp, Homo sapiens
tgcagtggaaagactcagactt

SEQ ID NO: 8541787 - DNA, 22 bp, Homo sapiens
cccagctcccatgttctccaat

SEQ ID NO: 8541788 - DNA, 22 bp, Homo sapiens
cccagctcccatgttctccaat

SEQ ID NO: 8541789 - DNA, 22 bp, Homo sapiens
cccagctcccatgttctccaat

SEQ ID NO: 8541790 - DNA, 22 bp, Homo sapiens
cccagctcccaagttgctatgg

SEQ ID NO: 8541791 - DNA, 22 bp, Homo sapiens
cccagctcccatgttctccaat

SEQ ID NO: 8541792 - DNA, 22 bp, Homo sapiens
cccagctccagagccagaaaca

SEQ ID NO: 8541793 - DNA, 22 bp, Homo sapiens
cccagctccagagccagaaaca

SEQ ID NO: 8541794 - DNA, 22 bp, Homo sapiens
cccagctccagagccagaaaca

SEQ ID NO: 8541795 - DNA, 18 bp, Homo sapiens
cccagctccacttccctc

SEQ ID NO: 8541796 - DNA, 18 bp, Homo sapiens
cccagctccacttccctc

SEQ ID NO: 8541797 - DNA, 18 bp, Homo sapiens
cccagctccacttccctc

SEQ ID NO: 8541798 - DNA, 22 bp, Homo sapiens
cccagctccagagccagaaaca

SEQ ID NO: 8541799 - DNA, 22 bp, Homo sapiens
cccaggaaatagccaggaggtg

SEQ ID NO: 8541800 - DNA, 22 bp, Homo sapiens
cccaggaaatagccaggaggtg

SEQ ID NO: 8541801 - DNA, 22 bp, Homo sapiens
cccaggaattggaggctgcagt

SEQ ID NO: 8541802 - DNA, 22 bp, Homo sapiens
cccagctccgagctccgagccg

SEQ ID NO: 8541803 - DNA, 22 bp, Homo sapiens
cccagctccgagctccgagccg

SEQ ID NO: 8541804 - DNA, 22 bp, Homo sapiens
cccagctccgagctccgagccg

SEQ ID NO: 8541805 - DNA, 22 bp, Homo sapiens
cccagctccctggtatttgtgc

SEQ ID NO: 8541806 - DNA, 22 bp, Homo sapiens
cccagctccctggtatttgtgc

SEQ ID NO: 8541807 - DNA, 22 bp, Homo sapiens
cccaggaccgcgcggctgagcg

SEQ ID NO: 8541808 - DNA, 22 bp, Homo sapiens
cccaggaattggaggctgcagt

SEQ ID NO: 8541809 - DNA, 22 bp, Homo sapiens
cccaggactcttcactgcagcc

SEQ ID NO: 8541810 - DNA, 22 bp, Homo sapiens
cccaggactcttcactgcagcc

SEQ ID NO: 8541811 - DNA, 22 bp, Homo sapiens
cccaggagaatataatgttctt

SEQ ID NO: 8541812 - DNA, 21 bp, Homo sapiens
cccaggagaagaaaagatgca

SEQ ID NO: 8541813 - DNA, 20 bp, Homo sapiens
cccaggagtgagcagcttta

SEQ ID NO: 8541814 - DNA, 22 bp, Homo sapiens
tgccctggttacactggagtcc

SEQ ID NO: 8541815 - DNA, 22 bp, Homo sapiens
tgccctggttacactggagtcc

SEQ ID NO: 8541816 - DNA, 20 bp, Homo sapiens
cccaggagtgagcagcttta

SEQ ID NO: 8541817 - DNA, 20 bp, Homo sapiens
cccaggagtgagcagcttta

SEQ ID NO: 8541818 - DNA, 19 bp, Homo sapiens
cccaggagtctggctggtt

SEQ ID NO: 8541819 - DNA, 23 bp, Homo sapiens
tgcctcagtggaatgtgagggtg

SEQ ID NO: 8541820 - DNA, 23 bp, Homo sapiens
tgcctcagtggaatgtgagggtg

SEQ ID NO: 8541821 - DNA, 23 bp, Homo sapiens
tgcctcagtggaatgtgagggtg

SEQ ID NO: 8541822 - DNA, 22 bp, Homo sapiens
tgcctcagtttcatctgcagaa

SEQ ID NO: 8541823 - DNA, 22 bp, Homo sapiens
tgcctcagtttcatctgcagaa

SEQ ID NO: 8541824 - DNA, 22 bp, Homo sapiens
tgcctcagtctaaagtctctca

SEQ ID NO: 8541825 - DNA, 22 bp, Homo sapiens
tgcctcagtctaaagtctctca

SEQ ID NO: 8541826 - DNA, 22 bp, Homo sapiens
tgcctcagtctaaagtctctca

SEQ ID NO: 8541827 - DNA, 22 bp, Homo sapiens
tgcctcagtctaaagtctctca

SEQ ID NO: 8541828 - DNA, 22 bp, Homo sapiens
cccaggaggttgaggctgcagt

SEQ ID NO: 8541829 - DNA, 22 bp, Homo sapiens
cccaggaggttgaggctgcagt

SEQ ID NO: 8541830 - DNA, 22 bp, Homo sapiens
tgccctctttctgtacagctcc

SEQ ID NO: 8541831 - DNA, 19 bp, Homo sapiens
tgccctgcacgctgtcctg

SEQ ID NO: 8541832 - DNA, 21 bp, Homo sapiens
cccaggagtcctatttaaatg

SEQ ID NO: 8541833 - DNA, 19 bp, Homo sapiens
cccaggagtctggctggtt

SEQ ID NO: 8541834 - DNA, 22 bp, Homo sapiens
cccaggaggttggggctacagt

SEQ ID NO: 8541835 - DNA, 22 bp, Homo sapiens
cccaggagtaagtgacattgtt

SEQ ID NO: 8541836 - DNA, 22 bp, Homo sapiens
tgccctcccacattatggctgt

SEQ ID NO: 8541837 - DNA, 23 bp, Homo sapiens
tgccctcccaatgcttcggtcac

SEQ ID NO: 8541838 - DNA, 22 bp, Homo sapiens
tgccctccacagtggctccacc

SEQ ID NO: 8541839 - DNA, 22 bp, Homo sapiens
tgccctcattataagaggctca

SEQ ID NO: 8541840 - DNA, 22 bp, Homo sapiens
tgccctctaggctacagttcca

SEQ ID NO: 8541841 - DNA, 22 bp, Homo sapiens
tgccctctgcctcctctgcaga

SEQ ID NO: 8541842 - DNA, 22 bp, Homo sapiens
tgccctcagaattgctccctgc

SEQ ID NO: 8541843 - DNA, 22 bp, Homo sapiens
tgccctcagcagcagctcctgc

SEQ ID NO: 8541844 - DNA, 22 bp, Homo sapiens
tgccctcagccacctccaagtt

SEQ ID NO: 8541845 - DNA, 22 bp, Homo sapiens
tgccctcagcagcagctcctgc

SEQ ID NO: 8541846 - DNA, 22 bp, Homo sapiens
tgcccagcttcttacttttaaa

SEQ ID NO: 8541847 - DNA, 21 bp, Homo sapiens
cccaggaggctgagaagagca

SEQ ID NO: 8541848 - DNA, 22 bp, Homo sapiens
cccaggaggcggaggttgtggt

SEQ ID NO: 8541849 - DNA, 22 bp, Homo sapiens
cccaggaggcggaggttgcagt

SEQ ID NO: 8541850 - DNA, 22 bp, Homo sapiens
cccaggaggcggaggttgcagt

SEQ ID NO: 8541851 - DNA, 22 bp, Homo sapiens
cccaggaggcggaggttgcagt

SEQ ID NO: 8541852 - DNA, 22 bp, Homo sapiens
cccaggaggcagatgttgcagt

SEQ ID NO: 8541853 - DNA, 22 bp, Homo sapiens
cccaggaggcagaggttggagc

SEQ ID NO: 8541854 - DNA, 22 bp, Homo sapiens
cccaggaggcagatgttgcagt

SEQ ID NO: 8541855 - DNA, 22 bp, Homo sapiens
cccaggaggcagaggttgcagt

SEQ ID NO: 8541856 - DNA, 22 bp, Homo sapiens
cccaggaggcagaggttgcagt

SEQ ID NO: 8541857 - DNA, 22 bp, Homo sapiens
cccaggaggcagaggttgcagt

SEQ ID NO: 8541858 - DNA, 22 bp, Homo sapiens
cccaggaggcctgcctggccgg

SEQ ID NO: 8541859 - DNA, 22 bp, Homo sapiens
cccaggaggcgcaggttgcggt

SEQ ID NO: 8541860 - DNA, 22 bp, Homo sapiens
cccaggaggccaaggttgcagt

SEQ ID NO: 8541861 - DNA, 22 bp, Homo sapiens
cccaggaggccaaggttgcagt

SEQ ID NO: 8541862 - DNA, 22 bp, Homo sapiens
cccaggaggccaaggttgcagt

SEQ ID NO: 8541863 - DNA, 22 bp, Homo sapiens
cccaggaggcctgcctggccgg

SEQ ID NO: 8541864 - DNA, 22 bp, Homo sapiens
cccaggaggcagagcttgcagt

SEQ ID NO: 8541865 - DNA, 22 bp, Homo sapiens
cccaggaggcagagcttgcagt

SEQ ID NO: 8541866 - DNA, 22 bp, Homo sapiens
cccaggaggcagagcttgcagt

SEQ ID NO: 8541867 - DNA, 22 bp, Homo sapiens
cccaggaggcagagcttgcagt

SEQ ID NO: 8541868 - DNA, 22 bp, Homo sapiens
cccaggaggcagagatagcagt

SEQ ID NO: 8541869 - DNA, 22 bp, Homo sapiens
cccaggaggcagaagttgcagt

SEQ ID NO: 8541870 - DNA, 22 bp, Homo sapiens
cccaggaggcagaagttgcagt

SEQ ID NO: 8541871 - DNA, 22 bp, Homo sapiens
cccaggaggcagaagttgcagt

SEQ ID NO: 8541872 - DNA, 22 bp, Homo sapiens
cccaggaggaggaaaaagctcg

SEQ ID NO: 8541873 - DNA, 21 bp, Homo sapiens
cccaggaggagctccggctcc

SEQ ID NO: 8541874 - DNA, 22 bp, Homo sapiens
tgcatattgtgaaaatgtagat

SEQ ID NO: 8541875 - DNA, 22 bp, Homo sapiens
tgcatattgtgaaaatgtagat

SEQ ID NO: 8541876 - DNA, 22 bp, Homo sapiens
tgcatattgtccttgatattat

SEQ ID NO: 8541877 - DNA, 22 bp, Homo sapiens
tgcatattgtccttgatattat

SEQ ID NO: 8541878 - DNA, 22 bp, Homo sapiens
tgcatattgtccttgatattat

SEQ ID NO: 8541879 - DNA, 21 bp, Homo sapiens
tgcatattcttctggtggctg

SEQ ID NO: 8541880 - DNA, 22 bp, Homo sapiens
tgcatatttgtatgatgtttag

SEQ ID NO: 8541881 - DNA, 22 bp, Homo sapiens
tgcatatttgtatgatgtttag

SEQ ID NO: 8541882 - DNA, 22 bp, Homo sapiens
tgcatattttataaagatggaa

SEQ ID NO: 8541883 - DNA, 22 bp, Homo sapiens
tgcatattgtgaaaatgtagat

SEQ ID NO: 8541884 - DNA, 22 bp, Homo sapiens
tgcatatttgattgagatacct

SEQ ID NO: 8541885 - DNA, 22 bp, Homo sapiens
tgcatatttgtatgatgtttag

SEQ ID NO: 8541886 - DNA, 22 bp, Homo sapiens
cccaggaggacattccataccc

SEQ ID NO: 8541887 - DNA, 21 bp, Homo sapiens
cccaggaggagctccggctcc

SEQ ID NO: 8541888 - DNA, 21 bp, Homo sapiens
cccaggaggagctccggctcc

SEQ ID NO: 8541889 - DNA, 21 bp, Homo sapiens
cccaggaggagctccggctcc

SEQ ID NO: 8541890 - DNA, 22 bp, Homo sapiens
tgcatattttataaagatggaa

SEQ ID NO: 8541891 - DNA, 22 bp, Homo sapiens
tgcatattttctgattcagaag

SEQ ID NO: 8541892 - DNA, 22 bp, Homo sapiens
cccaggagataacgttcccaag

SEQ ID NO: 8541893 - DNA, 22 bp, Homo sapiens
cccaggagataacgttcccaag

SEQ ID NO: 8541894 - DNA, 22 bp, Homo sapiens
cccaggagacagaaacagaggt

SEQ ID NO: 8541895 - DNA, 21 bp, Homo sapiens
tgcatatataagtgcatacac

SEQ ID NO: 8541896 - DNA, 19 bp, Homo sapiens
tgcatatatctatgaaaga

SEQ ID NO: 8541897 - DNA, 21 bp, Homo sapiens
tgcatatataagtgcatacac

SEQ ID NO: 8541898 - DNA, 22 bp, Homo sapiens
cccaggagacagaaacagaggt

SEQ ID NO: 8541899 - DNA, 22 bp, Homo sapiens
cccaggagacagaaacagaggt

SEQ ID NO: 8541900 - DNA, 22 bp, Homo sapiens
cccaggagacagaaacagaggt

SEQ ID NO: 8541901 - DNA, 22 bp, Homo sapiens
cccaggagacagaaacagaggt

SEQ ID NO: 8541902 - DNA, 22 bp, Homo sapiens
tgcatatatcttatttttctgt

SEQ ID NO: 8541903 - DNA, 22 bp, Homo sapiens
tgcatattatgtgtatctgtct

SEQ ID NO: 8541904 - DNA, 22 bp, Homo sapiens
tgcatattataaagagaattag

SEQ ID NO: 8541905 - DNA, 22 bp, Homo sapiens
tgcatattatgtgtatctgtct

SEQ ID NO: 8541906 - DNA, 22 bp, Homo sapiens
tgcatattctcctttattttgt

SEQ ID NO: 8541907 - DNA, 22 bp, Homo sapiens
tgcagaggtttccaggcaagtt

SEQ ID NO: 8541908 - DNA, 22 bp, Homo sapiens
tgcagaggtttccaggcaagtt

SEQ ID NO: 8541909 - DNA, 22 bp, Homo sapiens
tgcagaggtttccaggcaagtt

SEQ ID NO: 8541910 - DNA, 22 bp, Homo sapiens
tgcagaggtttccaggcaagtt

SEQ ID NO: 8541911 - DNA, 22 bp, Homo sapiens
tgcagaggtgttgctgagataa

SEQ ID NO: 8541912 - DNA, 22 bp, Homo sapiens
tgcagaggtgttgctgagataa

SEQ ID NO: 8541913 - DNA, 22 bp, Homo sapiens
tgcagaggtgttgctgagataa

SEQ ID NO: 8541914 - DNA, 22 bp, Homo sapiens
tgcagaggtgttgctgagataa

SEQ ID NO: 8541915 - DNA, 22 bp, Homo sapiens
tgcagaggtgtgcattcttaag

SEQ ID NO: 8541916 - DNA, 15 bp, Homo sapiens
tgcagaggtacctgg

SEQ ID NO: 8541917 - DNA, 22 bp, Homo sapiens
tgcagaggtgaaagactagcaa

SEQ ID NO: 8541918 - DNA, 22 bp, Homo sapiens
cccacccctggacaggtgagtg

SEQ ID NO: 8541919 - DNA, 21 bp, Homo sapiens
cccaccccataaggcagaacc

SEQ ID NO: 8541920 - DNA, 22 bp, Homo sapiens
cccacccagcctggctgagggg

SEQ ID NO: 8541921 - DNA, 21 bp, Homo sapiens
cccaccccataaggcagaacc

SEQ ID NO: 8541922 - DNA, 22 bp, Homo sapiens
cccacccactctgaccagaagc

SEQ ID NO: 8541923 - DNA, 22 bp, Homo sapiens
cccaccagtacagatggtagat

SEQ ID NO: 8541924 - DNA, 22 bp, Homo sapiens
cccaccatgtgcccattggctt

SEQ ID NO: 8541925 - DNA, 22 bp, Homo sapiens
cccaccacgtgctttgctggag

SEQ ID NO: 8541926 - DNA, 22 bp, Homo sapiens
cccacaggtggaagcctcggaa

SEQ ID NO: 8541927 - DNA, 22 bp, Homo sapiens
cccacaggtggaagcctcggaa

SEQ ID NO: 8541928 - DNA, 22 bp, Homo sapiens
cccacaggtggaagcctcggaa

SEQ ID NO: 8541929 - DNA, 22 bp, Homo sapiens
cccacagggctgctgatggcag

SEQ ID NO: 8541930 - DNA, 22 bp, Homo sapiens
cccacagggctgctgatggcag

SEQ ID NO: 8541931 - DNA, 22 bp, Homo sapiens
cccacaggtccccatgaactcg

SEQ ID NO: 8541932 - DNA, 22 bp, Homo sapiens
cccacaggccctgctgccttga

SEQ ID NO: 8541933 - DNA, 22 bp, Homo sapiens
cccacaggctaggggtagggca

SEQ ID NO: 8541934 - DNA, 22 bp, Homo sapiens
cccacagggctgctgatggcag

SEQ ID NO: 8541935 - DNA, 22 bp, Homo sapiens
cccacaggccctgctgccttga

SEQ ID NO: 8541936 - DNA, 22 bp, Homo sapiens
cccacaggccctgctgccttga

SEQ ID NO: 8541937 - DNA, 22 bp, Homo sapiens
cccacaggcaggtgcatgggct

SEQ ID NO: 8541938 - DNA, 22 bp, Homo sapiens
cccacaggcaggtgcatgggct

SEQ ID NO: 8541939 - DNA, 22 bp, Homo sapiens
cccacaggcaggtgcatgggct

SEQ ID NO: 8541940 - DNA, 22 bp, Homo sapiens
cccacagaatgccaatgagacc

SEQ ID NO: 8541941 - DNA, 19 bp, Homo sapiens
cccacaggaggacatatgg

SEQ ID NO: 8541942 - DNA, 22 bp, Homo sapiens
tgattcaactttcttgaatgca

SEQ ID NO: 8541943 - DNA, 22 bp, Homo sapiens
tgattcaactttcttgaatgca

SEQ ID NO: 8541944 - DNA, 22 bp, Homo sapiens
cccaagggtgcccagcagagga

SEQ ID NO: 8541945 - DNA, 22 bp, Homo sapiens
tgattcaactttcttgaatgca

SEQ ID NO: 8541946 - DNA, 22 bp, Homo sapiens
cccacactctgagaaatgctga

SEQ ID NO: 8541947 - DNA, 22 bp, Homo sapiens
cccagcagccagaatgaggagc

SEQ ID NO: 8541948 - DNA, 22 bp, Homo sapiens
cccagcagccagaatgaggagc

SEQ ID NO: 8541949 - DNA, 22 bp, Homo sapiens
cccagcagccagaatgaggagc

SEQ ID NO: 8541950 - DNA, 22 bp, Homo sapiens
cccagcagccagaatgaggagc

SEQ ID NO: 8541951 - DNA, 22 bp, Homo sapiens
cccagcagatggctatgtgcta

SEQ ID NO: 8541952 - DNA, 22 bp, Homo sapiens
cccagcagatggctatgtgcta

SEQ ID NO: 8541953 - DNA, 23 bp, Homo sapiens
cccagcagattgtaaagtgtcca

SEQ ID NO: 8541954 - DNA, 23 bp, Homo sapiens
cccagcagattgtaaagtgtcca

SEQ ID NO: 8541955 - DNA, 23 bp, Homo sapiens
cccagcagattgtaaagtgtcca

SEQ ID NO: 8541956 - DNA, 22 bp, Homo sapiens
tgcagcagtcagtcaggcctgg

SEQ ID NO: 8541957 - DNA, 22 bp, Homo sapiens
tgcagcagtcagtcaggcctgg

SEQ ID NO: 8541958 - DNA, 22 bp, Homo sapiens
tgcagcaggtgacaacgagtgg

SEQ ID NO: 8541959 - DNA, 22 bp, Homo sapiens
tgcagcaggttccaaagggtta

SEQ ID NO: 8541960 - DNA, 22 bp, Homo sapiens
tgcagcaggttccaaagggtta

SEQ ID NO: 8541961 - DNA, 22 bp, Homo sapiens
tgcagcaggttccaaagggtta

SEQ ID NO: 8541962 - DNA, 22 bp, Homo sapiens
tgcagcaggtatggcaagctcc

SEQ ID NO: 8541963 - DNA, 22 bp, Homo sapiens
tgcagcaggtatggcaagctcc

SEQ ID NO: 8541964 - DNA, 22 bp, Homo sapiens
cccagcagaatctgatgagggc

SEQ ID NO: 8541965 - DNA, 22 bp, Homo sapiens
cccagcagaatctgatgagggc

SEQ ID NO: 8541966 - DNA, 22 bp, Homo sapiens
cccagcactttgaatatgtcac

SEQ ID NO: 8541967 - DNA, 22 bp, Homo sapiens
cccagcactttgaatatgtcac

SEQ ID NO: 8541968 - DNA, 23 bp, Homo sapiens
cccagcagagatgaggaggggtc

SEQ ID NO: 8541969 - DNA, 22 bp, Homo sapiens
cccagcagaccgctgtgatggc

SEQ ID NO: 8541970 - DNA, 22 bp, Homo sapiens
cccagcagaatctgatgagggc

SEQ ID NO: 8541971 - DNA, 23 bp, Homo sapiens
cccagcagagatgaggaggggtc

SEQ ID NO: 8541972 - DNA, 23 bp, Homo sapiens
cccagcagagatgaggaggggtc

SEQ ID NO: 8541973 - DNA, 22 bp, Homo sapiens
cccagagaatctttcagaaagg

SEQ ID NO: 8541974 - DNA, 22 bp, Homo sapiens
cccagagaattccacatagagg

SEQ ID NO: 8541975 - DNA, 22 bp, Homo sapiens
cccagagaagtgaagtgacttg

SEQ ID NO: 8541976 - DNA, 22 bp, Homo sapiens
cccagagaatctttcagaaagg

SEQ ID NO: 8541977 - DNA, 22 bp, Homo sapiens
cccagagaaccttctgtgccac

SEQ ID NO: 8541978 - DNA, 22 bp, Homo sapiens
cccagagaagtgaagtgacttg

SEQ ID NO: 8541979 - DNA, 22 bp, Homo sapiens
cccagactgcagagcgggcaga

SEQ ID NO: 8541980 - DNA, 22 bp, Homo sapiens
cccagactgcagagcgggcaga

SEQ ID NO: 8541981 - DNA, 22 bp, Homo sapiens
tgcagagtaaaagcagatgcta

SEQ ID NO: 8541982 - DNA, 22 bp, Homo sapiens
tgcagagtaaaagcagatgcta

SEQ ID NO: 8541983 - DNA, 22 bp, Homo sapiens
tgcagagtaaaagcagatgcta

SEQ ID NO: 8541984 - DNA, 22 bp, Homo sapiens
tgcagaggtttgtggtgttgct

SEQ ID NO: 8541985 - DNA, 22 bp, Homo sapiens
tgcagaggtttttaatacattt

SEQ ID NO: 8541986 - DNA, 22 bp, Homo sapiens
tgcagaggtttgtggtgttgct

SEQ ID NO: 8541987 - DNA, 22 bp, Homo sapiens
tgcagaggtttccaggcaagtt

SEQ ID NO: 8541988 - DNA, 17 bp, Homo sapiens
cccagagatgctgcctt

SEQ ID NO: 8541989 - DNA, 22 bp, Homo sapiens
cccagagggtggaggttgcagt

SEQ ID NO: 8541990 - DNA, 22 bp, Homo sapiens
cccagagggtggaggttgcagt

SEQ ID NO: 8541991 - DNA, 22 bp, Homo sapiens
cccagagatcttgtcctttcca

SEQ ID NO: 8541992 - DNA, 22 bp, Homo sapiens
cccagaggtgaaggaggtggga

SEQ ID NO: 8541993 - DNA, 22 bp, Homo sapiens
cccagaggtctgaaaaggttga

SEQ ID NO: 8541994 - DNA, 22 bp, Homo sapiens
cccagcactcagcaggctcata

SEQ ID NO: 8541995 - DNA, 22 bp, Homo sapiens
cccagagagcatttggacaaag

SEQ ID NO: 8541996 - DNA, 22 bp, Homo sapiens
cccagagaattccacatagagg

SEQ ID NO: 8541997 - DNA, 22 bp, Homo sapiens
ccattgtagtatctgttttagt

SEQ ID NO: 8541998 - DNA, 22 bp, Homo sapiens
ccatttttaaagagcttaagta

SEQ ID NO: 8541999 - DNA, 22 bp, Homo sapiens
ccatggccgccgctgctcagga

SEQ ID NO: 8542000 - DNA, 22 bp, Homo sapiens
ccatggccgccgctgctcagga

SEQ ID NO: 8542001 - DNA, 22 bp, Homo sapiens
ccattgtaaattctgtggaagt

SEQ ID NO: 8542002 - DNA, 22 bp, Homo sapiens
ccatttttcacaagactcactt

SEQ ID NO: 8542003 - DNA, 22 bp, Homo sapiens
ccatttttcataaactatccaa

SEQ ID NO: 8542004 - DNA, 22 bp, Homo sapiens
ccatttttgacagaaggcctaa

SEQ ID NO: 8542005 - DNA, 22 bp, Homo sapiens
cccaaaatgtgcatgttcgaat

SEQ ID NO: 8542006 - DNA, 22 bp, Homo sapiens
ccatggcattttatgtgtctta

SEQ ID NO: 8542007 - DNA, 20 bp, Homo sapiens
ccatggccacatctgtgctg

SEQ ID NO: 8542008 - DNA, 19 bp, Homo sapiens
ccatggcaatgatctgatg

SEQ ID NO: 8542009 - DNA, 22 bp, Homo sapiens
ccatggagcgggtgagtgagtg

SEQ ID NO: 8542010 - DNA, 22 bp, Homo sapiens
ccatggagttcctctggtctat

SEQ ID NO: 8542011 - DNA, 22 bp, Homo sapiens
ccatggagttcctctggtctat

SEQ ID NO: 8542012 - DNA, 22 bp, Homo sapiens
ccatggagttcctctggtctat

SEQ ID NO: 8542013 - DNA, 22 bp, Homo sapiens
cccaagatctttcgtgcactaa

SEQ ID NO: 8542014 - DNA, 22 bp, Homo sapiens
cccaagagatcgcatgtagttg

SEQ ID NO: 8542015 - DNA, 22 bp, Homo sapiens
tgattacacaccacagtgctcc

SEQ ID NO: 8542016 - DNA, 22 bp, Homo sapiens
cccaagatctttcgtgcactaa

SEQ ID NO: 8542017 - DNA, 22 bp, Homo sapiens
cccaagcagggtgcagaggcat

SEQ ID NO: 8542018 - DNA, 22 bp, Homo sapiens
cccaagcagggtgcagaggcat

SEQ ID NO: 8542019 - DNA, 22 bp, Homo sapiens
cccaaagggtgtcagcagcaag

SEQ ID NO: 8542020 - DNA, 22 bp, Homo sapiens
cccaaagggtgtcagcagcaag

SEQ ID NO: 8542021 - DNA, 22 bp, Homo sapiens
cccaaagtacaagtaaacatgt

SEQ ID NO: 8542022 - DNA, 22 bp, Homo sapiens
cccaaccagaaattgacagaca

SEQ ID NO: 8542023 - DNA, 22 bp, Homo sapiens
cccaaccagaaattgacagaga

SEQ ID NO: 8542024 - DNA, 22 bp, Homo sapiens
cccaactactctcaggcagctt

SEQ ID NO: 8542025 - DNA, 22 bp, Homo sapiens
cccaaccccaacttcctatgtt

SEQ ID NO: 8542026 - DNA, 22 bp, Homo sapiens
cccaaccccaacttcctatgtt

SEQ ID NO: 8542027 - DNA, 21 bp, Homo sapiens
cccaacccatttccagttcat

SEQ ID NO: 8542028 - DNA, 22 bp, Homo sapiens
tgattacagtatttgagatcca

SEQ ID NO: 8542029 - DNA, 22 bp, Homo sapiens
tgattacagtctgacagatgtt

SEQ ID NO: 8542030 - DNA, 22 bp, Homo sapiens
tgattacattggtaatgtttat

SEQ ID NO: 8542031 - DNA, 22 bp, Homo sapiens
tgattagacaaaggaatcatgc

SEQ ID NO: 8542032 - DNA, 22 bp, Homo sapiens
tgattacacagcagtaatttca

SEQ ID NO: 8542033 - DNA, 22 bp, Homo sapiens
tgattacactatttgggaatag

SEQ ID NO: 8542034 - DNA, 22 bp, Homo sapiens
tgattacactatttgggaatag

SEQ ID NO: 8542035 - DNA, 23 bp, Homo sapiens
tgattacaggaagttcaagtgtt

SEQ ID NO: 8542036 - DNA, 23 bp, Homo sapiens
tgattacaggaagttcaagtgtt

SEQ ID NO: 8542037 - DNA, 22 bp, Homo sapiens
tgattacagtatttgagatcca

SEQ ID NO: 8542038 - DNA, 22 bp, Homo sapiens
tgattatattctaacttcataa

SEQ ID NO: 8542039 - DNA, 22 bp, Homo sapiens
tgattagattgagtcaaccttg

SEQ ID NO: 8542040 - DNA, 22 bp, Homo sapiens
tgattagctttgaatgtgctgc

SEQ ID NO: 8542041 - DNA, 22 bp, Homo sapiens
tgattcaactttcataacaaaa

SEQ ID NO: 8542042 - DNA, 22 bp, Homo sapiens
tgattcaactttcataacaaaa

SEQ ID NO: 8542043 - DNA, 17 bp, Homo sapiens
tgattcaactagaaact

SEQ ID NO: 8542044 - DNA, 17 bp, Homo sapiens
tgattcaactagaaact

SEQ ID NO: 8542045 - DNA, 22 bp, Homo sapiens
tgattcaaatattgtgtatgat

SEQ ID NO: 8542046 - DNA, 22 bp, Homo sapiens
tgaggcagtattctccattcca

SEQ ID NO: 8542047 - DNA, 22 bp, Homo sapiens
tgaggcaggtggattacaaggt

SEQ ID NO: 8542048 - DNA, 22 bp, Homo sapiens
tgaggcaggtggattacaaggt

SEQ ID NO: 8542049 - DNA, 22 bp, Homo sapiens
tgaggcaggtaagcaagttttg

SEQ ID NO: 8542050 - DNA, 22 bp, Homo sapiens
ccagtgttccagagagctgatg

SEQ ID NO: 8542051 - DNA, 22 bp, Homo sapiens
tgaggcagtattttagtgactt

SEQ ID NO: 8542052 - DNA, 22 bp, Homo sapiens
tgaggcagtattttagtgactt

SEQ ID NO: 8542053 - DNA, 22 bp, Homo sapiens
tgaggcagtattttagtgactt

SEQ ID NO: 8542054 - DNA, 22 bp, Homo sapiens
tgaggcagtcaccccctcctgc

SEQ ID NO: 8542055 - DNA, 18 bp, Homo sapiens
tgaggcagtcagtgatgg

SEQ ID NO: 8542056 - DNA, 22 bp, Homo sapiens
ccagtgtggtaggtccacaggt

SEQ ID NO: 8542057 - DNA, 22 bp, Homo sapiens
ccagtgtggtaggtccacaggt

SEQ ID NO: 8542058 - DNA, 23 bp, Homo sapiens
ccagtgtggtaggtccacaggtg

SEQ ID NO: 8542059 - DNA, 23 bp, Homo sapiens
ccagtgtggtaggtccacaggtg

SEQ ID NO: 8542060 - DNA, 23 bp, Homo sapiens
ccagtgtggtaggtccacaggtg

SEQ ID NO: 8542061 - DNA, 22 bp, Homo sapiens
ccagtgtgttagtggatttccc

SEQ ID NO: 8542062 - DNA, 22 bp, Homo sapiens
ccagtgtgttccctgcctcact

SEQ ID NO: 8542063 - DNA, 22 bp, Homo sapiens
ccagtgtggccaggtgctggta

SEQ ID NO: 8542064 - DNA, 22 bp, Homo sapiens
ccagtgtgggcccggcctcctc

SEQ ID NO: 8542065 - DNA, 22 bp, Homo sapiens
ccagtgtggtaggtccacaggt

SEQ ID NO: 8542066 - DNA, 22 bp, Homo sapiens
ccagtgttcataattttacact

SEQ ID NO: 8542067 - DNA, 22 bp, Homo sapiens
ccagtgttcatcaagaaaatgt

SEQ ID NO: 8542068 - DNA, 22 bp, Homo sapiens
ccagtgttcagtatgcattaag

SEQ ID NO: 8542069 - DNA, 22 bp, Homo sapiens
ccagtgttcaatacatatttgt

SEQ ID NO: 8542070 - DNA, 22 bp, Homo sapiens
ccagtgttagagactgatacag

SEQ ID NO: 8542071 - DNA, 22 bp, Homo sapiens
ccagtgttattttagagtgtga

SEQ ID NO: 8542072 - DNA, 22 bp, Homo sapiens
ccagtgttacggcttgaactat

SEQ ID NO: 8542073 - DNA, 22 bp, Homo sapiens
ccagtgtgtttttctctgactc

SEQ ID NO: 8542074 - DNA, 22 bp, Homo sapiens
ccagtgtgtttaatgcattcca

SEQ ID NO: 8542075 - DNA, 22 bp, Homo sapiens
ccagtgtgttccctgcctcact

SEQ ID NO: 8542076 - DNA, 22 bp, Homo sapiens
tgatgaggggctcagaggtcag

SEQ ID NO: 8542077 - DNA, 21 bp, Homo sapiens
tgatgaggtcatagcaccctc

SEQ ID NO: 8542078 - DNA, 22 bp, Homo sapiens
tgatgagggggaacagagattt

SEQ ID NO: 8542079 - DNA, 22 bp, Homo sapiens
tgatgagggcagttcttgttgc

SEQ ID NO: 8542080 - DNA, 22 bp, Homo sapiens
tgatgagggagatttgagccca

SEQ ID NO: 8542081 - DNA, 22 bp, Homo sapiens
tgatgagggcagttcttgttgc

SEQ ID NO: 8542082 - DNA, 22 bp, Homo sapiens
tgatgaggggctcagaggtcag

SEQ ID NO: 8542083 - DNA, 22 bp, Homo sapiens
tgatgaggcttcttggtgaaca

SEQ ID NO: 8542084 - DNA, 22 bp, Homo sapiens
tgatgaggcatatgctacacat

SEQ ID NO: 8542085 - DNA, 22 bp, Homo sapiens
tgatgagggaactggttcatac

SEQ ID NO: 8542086 - DNA, 22 bp, Homo sapiens
tgatgaggacctggtctctgct

SEQ ID NO: 8542087 - DNA, 22 bp, Homo sapiens
tgatgaggagactgtggcttgg

SEQ ID NO: 8542088 - DNA, 22 bp, Homo sapiens
tgatgaggagactgtggcttgg

SEQ ID NO: 8542089 - DNA, 22 bp, Homo sapiens
tgatgaggacccatcacctggt

SEQ ID NO: 8542090 - DNA, 22 bp, Homo sapiens
tgatgaccgccaacgtttaggt

SEQ ID NO: 8542091 - DNA, 22 bp, Homo sapiens
tgatgactatatatgactagtg

SEQ ID NO: 8542092 - DNA, 22 bp, Homo sapiens
tgatgacaaactttcctgatgc

SEQ ID NO: 8542093 - DNA, 22 bp, Homo sapiens
tgatgaattagtaacaaatgag

SEQ ID NO: 8542094 - DNA, 18 bp, Homo sapiens
tgaggcagtcagtgatgg

SEQ ID NO: 8542095 - DNA, 18 bp, Homo sapiens
tgaggcagtcagtgatgg

SEQ ID NO: 8542096 - DNA, 18 bp, Homo sapiens
tgaggcagtcagtgatgg

SEQ ID NO: 8542097 - DNA, 22 bp, Homo sapiens
tgatacagtcagctcacaattg

SEQ ID NO: 8542098 - DNA, 22 bp, Homo sapiens
tgaggcagtgatgtttaagcac

SEQ ID NO: 8542099 - DNA, 22 bp, Homo sapiens
tttcagtttatgtcttgaatta

SEQ ID NO: 8542100 - DNA, 22 bp, Homo sapiens
ctccttcctgccccagtgataa

SEQ ID NO: 8542101 - DNA, 22 bp, Homo sapiens
ctccttcctgcagatctgagat

SEQ ID NO: 8542102 - DNA, 22 bp, Homo sapiens
ctccttcccttcaagtgttcct

SEQ ID NO: 8542103 - DNA, 19 bp, Homo sapiens
ctccttccctggtttctgt

SEQ ID NO: 8542104 - DNA, 22 bp, Homo sapiens
ctccttcccctactcagcatcc

SEQ ID NO: 8542105 - DNA, 22 bp, Homo sapiens
ctccttcacgcaggctgccatg

SEQ ID NO: 8542106 - DNA, 22 bp, Homo sapiens
ctccttcacgcaggctgccatg

SEQ ID NO: 8542107 - DNA, 22 bp, Homo sapiens
ctccttcaaaagtcatagtaaa

SEQ ID NO: 8542108 - DNA, 22 bp, Homo sapiens
ctccttcatgtcatgtgtccgg

SEQ ID NO: 8542109 - DNA, 22 bp, Homo sapiens
ctccttcagtctgcgtggctgt

SEQ ID NO: 8542110 - DNA, 23 bp, Homo sapiens
tttcagaagtggtcctaggaagc

SEQ ID NO: 8542111 - DNA, 22 bp, Homo sapiens
tttcagaagtcacagttgactg

SEQ ID NO: 8542112 - DNA, 22 bp, Homo sapiens
tttcagaagtcaactaggtaaa

SEQ ID NO: 8542113 - DNA, 23 bp, Homo sapiens
tttcagaagtggtcctaggaagc

SEQ ID NO: 8542114 - DNA, 22 bp, Homo sapiens
tttcagaatatcgattcagtga

SEQ ID NO: 8542115 - DNA, 22 bp, Homo sapiens
ctcctgtggtcaagggtgggac

SEQ ID NO: 8542116 - DNA, 22 bp, Homo sapiens
tttcagaatatcgattcagtga

SEQ ID NO: 8542117 - DNA, 22 bp, Homo sapiens
tttcagaatagcaaagcaagct

SEQ ID NO: 8542118 - DNA, 22 bp, Homo sapiens
tttcagaaattgttattattct

SEQ ID NO: 8542119 - DNA, 22 bp, Homo sapiens
tttcagaacagggattgggcct

SEQ ID NO: 8542120 - DNA, 22 bp, Homo sapiens
tttcagaaccaagagagacatc

SEQ ID NO: 8542121 - DNA, 22 bp, Homo sapiens
tttcagaaattatattagatgc

SEQ ID NO: 8542122 - DNA, 22 bp, Homo sapiens
tttcagaaattatattagatgc

SEQ ID NO: 8542123 - DNA, 22 bp, Homo sapiens
tttcagaaattatattagatgc

SEQ ID NO: 8542124 - DNA, 22 bp, Homo sapiens
tttcagaaattatattagatgc

SEQ ID NO: 8542125 - DNA, 22 bp, Homo sapiens
tttcagaaatggcactgaaatc

SEQ ID NO: 8542126 - DNA, 22 bp, Homo sapiens
tttcagaagtcaactaggtaaa

SEQ ID NO: 8542127 - DNA, 22 bp, Homo sapiens
tttcagaaggggagaaaggtca

SEQ ID NO: 8542128 - DNA, 22 bp, Homo sapiens
tttcagaaggggagaaaggtca

SEQ ID NO: 8542129 - DNA, 22 bp, Homo sapiens
tttcagaaccgctaaaataaat

SEQ ID NO: 8542130 - DNA, 22 bp, Homo sapiens
tttcagaaccgctaaaataaat

SEQ ID NO: 8542131 - DNA, 22 bp, Homo sapiens
tttcagaaccaagagagacatc

SEQ ID NO: 8542132 - DNA, 22 bp, Homo sapiens
tttcagaaccgctaaaataaat

SEQ ID NO: 8542133 - DNA, 22 bp, Homo sapiens
tttattcagcagcagcagtggt

SEQ ID NO: 8542134 - DNA, 22 bp, Homo sapiens
tttattcagcagcagcagtggt

SEQ ID NO: 8542135 - DNA, 22 bp, Homo sapiens
tttattcagcagcagcagtggt

SEQ ID NO: 8542136 - DNA, 20 bp, Homo sapiens
tttattcagcctaccctctt

SEQ ID NO: 8542137 - DNA, 20 bp, Homo sapiens
tttattcagcctaccctctt

SEQ ID NO: 8542138 - DNA, 20 bp, Homo sapiens
tttattcagcctaccctctt

SEQ ID NO: 8542139 - DNA, 22 bp, Homo sapiens
tttattcatcatctgttcatat

SEQ ID NO: 8542140 - DNA, 22 bp, Homo sapiens
tttattcatcatctgttcatat

SEQ ID NO: 8542141 - DNA, 22 bp, Homo sapiens
tttattcatcatctgttcatat

SEQ ID NO: 8542142 - DNA, 22 bp, Homo sapiens
tttattcatcatctgttcatat

SEQ ID NO: 8542143 - DNA, 22 bp, Homo sapiens
tttattcatcatctgttcatat

SEQ ID NO: 8542144 - DNA, 22 bp, Homo sapiens
tttattcattgtttcgtcgcag

SEQ ID NO: 8542145 - DNA, 22 bp, Homo sapiens
tttattcattgtttcgtcgcag

SEQ ID NO: 8542146 - DNA, 22 bp, Homo sapiens
tttattcattgtttcgtcgcag

SEQ ID NO: 8542147 - DNA, 22 bp, Homo sapiens
tttattccaaagcttgcacttt

SEQ ID NO: 8542148 - DNA, 22 bp, Homo sapiens
tttcacatataggggaagctac

SEQ ID NO: 8542149 - DNA, 22 bp, Homo sapiens
ctccaggccatggctgcggagg

SEQ ID NO: 8542150 - DNA, 22 bp, Homo sapiens
ctccaggccagggaagtggaca

SEQ ID NO: 8542151 - DNA, 22 bp, Homo sapiens
ctccaggccagggaagtggaca

SEQ ID NO: 8542152 - DNA, 22 bp, Homo sapiens
ctccaggccagggaagtggaca

SEQ ID NO: 8542153 - DNA, 22 bp, Homo sapiens
ctccaggcccacggccgcggcc

SEQ ID NO: 8542154 - DNA, 22 bp, Homo sapiens
ctccaggcccacgtcgaggagg

SEQ ID NO: 8542155 - DNA, 22 bp, Homo sapiens
ctccaggcccctggccttctgc

SEQ ID NO: 8542156 - DNA, 23 bp, Homo sapiens
tttatattcctaatgtcttgagc

SEQ ID NO: 8542157 - DNA, 23 bp, Homo sapiens
tttatattcctaatgtcttgagc

SEQ ID NO: 8542158 - DNA, 23 bp, Homo sapiens
tttatattcctaatgtcttgagc

SEQ ID NO: 8542159 - DNA, 22 bp, Homo sapiens
tttatgattaatccaattctgt

SEQ ID NO: 8542160 - DNA, 22 bp, Homo sapiens
tttatgattattttaaagcagc

SEQ ID NO: 8542161 - DNA, 22 bp, Homo sapiens
ctccaggccaagattaagtaat

SEQ ID NO: 8542162 - DNA, 22 bp, Homo sapiens
ctccaggatgttagacgtccag

SEQ ID NO: 8542163 - DNA, 19 bp, Homo sapiens
ctccaggatggctgggcga

SEQ ID NO: 8542164 - DNA, 22 bp, Homo sapiens
ctccaggatgttagacgtccag

SEQ ID NO: 8542165 - DNA, 22 bp, Homo sapiens
ctccaggagtggcctggacacc

SEQ ID NO: 8542166 - DNA, 22 bp, Homo sapiens
ctccaggatacctgttcctata

SEQ ID NO: 8542167 - DNA, 19 bp, Homo sapiens
ctccaggatggctgggcga

SEQ ID NO: 8542168 - DNA, 19 bp, Homo sapiens
ctccaggatggctgggcga

SEQ ID NO: 8542169 - DNA, 22 bp, Homo sapiens
ctccaggactgaggacagagct

SEQ ID NO: 8542170 - DNA, 22 bp, Homo sapiens
ctccaggagctgtgtctttctt

SEQ ID NO: 8542171 - DNA, 22 bp, Homo sapiens
ctccaggagggcttcctgtgat

SEQ ID NO: 8542172 - DNA, 22 bp, Homo sapiens
ctccaggagggggatggctgta

SEQ ID NO: 8542173 - DNA, 22 bp, Homo sapiens
tttattcactggggtctgcccg

SEQ ID NO: 8542174 - DNA, 22 bp, Homo sapiens
tttattcacttcagtgccaaag

SEQ ID NO: 8542175 - DNA, 22 bp, Homo sapiens
tttattcactggggtctgcccg

SEQ ID NO: 8542176 - DNA, 22 bp, Homo sapiens
tttattcactggggtctgcccg

SEQ ID NO: 8542177 - DNA, 22 bp, Homo sapiens
tttattcacttcagtgccaaag

SEQ ID NO: 8542178 - DNA, 22 bp, Homo sapiens
tttattcacttcagtgccaaag

SEQ ID NO: 8542179 - DNA, 22 bp, Homo sapiens
tttattcacttcagtgccaaag

SEQ ID NO: 8542180 - DNA, 22 bp, Homo sapiens
tttattcactcattcagccagt

SEQ ID NO: 8542181 - DNA, 22 bp, Homo sapiens
tttattcactcattcagccagt

SEQ ID NO: 8542182 - DNA, 22 bp, Homo sapiens
tttattcactcattcagccagt

SEQ ID NO: 8542183 - DNA, 19 bp, Homo sapiens
tttattcacctttaccttg

SEQ ID NO: 8542184 - DNA, 22 bp, Homo sapiens
tttatgtaagtggaatgatgcc

SEQ ID NO: 8542185 - DNA, 22 bp, Homo sapiens
tttatgtaagtggaatgatgcc

SEQ ID NO: 8542186 - DNA, 22 bp, Homo sapiens
tttatgtaagtggaatgatgcc

SEQ ID NO: 8542187 - DNA, 19 bp, Homo sapiens
tttattcacctttaccttg

SEQ ID NO: 8542188 - DNA, 19 bp, Homo sapiens
tttattcacctttaccttg

SEQ ID NO: 8542189 - DNA, 22 bp, Homo sapiens
tttatgcagcgtttcaccaccc

SEQ ID NO: 8542190 - DNA, 23 bp, Homo sapiens
tttatgcagcatgtagaacatgg

SEQ ID NO: 8542191 - DNA, 22 bp, Homo sapiens
tttatgcagcctcagtatcaga

SEQ ID NO: 8542192 - DNA, 22 bp, Homo sapiens
tttatgattattttaaagcagc

SEQ ID NO: 8542193 - DNA, 22 bp, Homo sapiens
tttatgcacacttagacatggc

SEQ ID NO: 8542194 - DNA, 22 bp, Homo sapiens
tttatgcacacttagacatggc

SEQ ID NO: 8542195 - DNA, 23 bp, Homo sapiens
tttatgcagcatgtagaacatgg

SEQ ID NO: 8542196 - DNA, 22 bp, Homo sapiens
tttatgcagcactttacatttg

SEQ ID NO: 8542197 - DNA, 21 bp, Homo sapiens
tttatgcagataatgctattt

SEQ ID NO: 8542198 - DNA, 22 bp, Homo sapiens
tttctacagtactgatttcata

SEQ ID NO: 8542199 - DNA, 22 bp, Homo sapiens
tttctacaggttgatgggtttg

SEQ ID NO: 8542200 - DNA, 22 bp, Homo sapiens
tttctacagctggtgcaacttt

SEQ ID NO: 8542201 - DNA, 22 bp, Homo sapiens
tttctacagctggtgcaacttt

SEQ ID NO: 8542202 - DNA, 22 bp, Homo sapiens
tttctacagctggtgcaacttt

SEQ ID NO: 8542203 - DNA, 22 bp, Homo sapiens
tttctacagaagatacactgct

SEQ ID NO: 8542204 - DNA, 22 bp, Homo sapiens
tttctacagctggtgcaacttt

SEQ ID NO: 8542205 - DNA, 22 bp, Homo sapiens
tttctacagaagatacactgct

SEQ ID NO: 8542206 - DNA, 22 bp, Homo sapiens
tttctacagaagatacactgct

SEQ ID NO: 8542207 - DNA, 22 bp, Homo sapiens
tttctacaacacttctgaatct

SEQ ID NO: 8542208 - DNA, 22 bp, Homo sapiens
tttctacaacacttctgaatct

SEQ ID NO: 8542209 - DNA, 22 bp, Homo sapiens
tttcctttctagaagcctaaat

SEQ ID NO: 8542210 - DNA, 22 bp, Homo sapiens
tttccactctggccaccatctt

SEQ ID NO: 8542211 - DNA, 22 bp, Homo sapiens
tttccactcctattgcatctca

SEQ ID NO: 8542212 - DNA, 22 bp, Homo sapiens
tttccacactgcagccagcaaa

SEQ ID NO: 8542213 - DNA, 22 bp, Homo sapiens
tttccacactgcagccagcaaa

SEQ ID NO: 8542214 - DNA, 22 bp, Homo sapiens
tttccacagctgtataaaataa

SEQ ID NO: 8542215 - DNA, 22 bp, Homo sapiens
tttccacatcaccatgaggtga

SEQ ID NO: 8542216 - DNA, 22 bp, Homo sapiens
tttccacaatttgagcagcaga

SEQ ID NO: 8542217 - DNA, 22 bp, Homo sapiens
tttccacaatttgagcagcaga

SEQ ID NO: 8542218 - DNA, 22 bp, Homo sapiens
tttccacactcactgcactcat

SEQ ID NO: 8542219 - DNA, 22 bp, Homo sapiens
tttccacacaggctctactact

SEQ ID NO: 8542220 - DNA, 22 bp, Homo sapiens
tttccaatttggtagtcatcgg

SEQ ID NO: 8542221 - DNA, 22 bp, Homo sapiens
tttccacaatgtttttgcagga

SEQ ID NO: 8542222 - DNA, 22 bp, Homo sapiens
tttcattaaagtcaaatctggt

SEQ ID NO: 8542223 - DNA, 22 bp, Homo sapiens
tttcatgttttcttaaatggca

SEQ ID NO: 8542224 - DNA, 22 bp, Homo sapiens
tttcatgtttatggaaaatgag

SEQ ID NO: 8542225 - DNA, 22 bp, Homo sapiens
tttcattaaagtcaaatctggt

SEQ ID NO: 8542226 - DNA, 22 bp, Homo sapiens
tttcattacgtgtttgacttgt

SEQ ID NO: 8542227 - DNA, 22 bp, Homo sapiens
tttcattaaagtcaaatctggt

SEQ ID NO: 8542228 - DNA, 23 bp, Homo sapiens
tttcatgttggcatgactgactt

SEQ ID NO: 8542229 - DNA, 22 bp, Homo sapiens
tttcatgttggatactgtttca

SEQ ID NO: 8542230 - DNA, 22 bp, Homo sapiens
tttcatgttattaatagtgctg

SEQ ID NO: 8542231 - DNA, 22 bp, Homo sapiens
tttcatgttacatttaaaatgt

SEQ ID NO: 8542232 - DNA, 22 bp, Homo sapiens
tttcatgttacatttaaaatgt

SEQ ID NO: 8542233 - DNA, 22 bp, Homo sapiens
tttcattacgtgtttgacttgt

SEQ ID NO: 8542234 - DNA, 22 bp, Homo sapiens
tttcattatacagcttcataaa

SEQ ID NO: 8542235 - DNA, 22 bp, Homo sapiens
tttccaagataatacacagaaa

SEQ ID NO: 8542236 - DNA, 22 bp, Homo sapiens
tttccaagctgtcttggcccac

SEQ ID NO: 8542237 - DNA, 18 bp, Homo sapiens
tttccaagaagagagctc

SEQ ID NO: 8542238 - DNA, 22 bp, Homo sapiens
tttccaataaggtcaccttcct

SEQ ID NO: 8542239 - DNA, 22 bp, Homo sapiens
tttccaataaagtgtcattgtt

SEQ ID NO: 8542240 - DNA, 22 bp, Homo sapiens
tttctacatgtcaatccaaacc

SEQ ID NO: 8542241 - DNA, 22 bp, Homo sapiens
tttctacatgtcaatccaaacc

SEQ ID NO: 8542242 - DNA, 22 bp, Homo sapiens
tttctacatgtcaatccaaacc

SEQ ID NO: 8542243 - DNA, 22 bp, Homo sapiens
tttctacatgtcagtaactgat

SEQ ID NO: 8542244 - DNA, 22 bp, Homo sapiens
tttctacatgtcaatccaaacc

SEQ ID NO: 8542245 - DNA, 22 bp, Homo sapiens
tttctattttaaaggcatatgg

SEQ ID NO: 8542246 - DNA, 22 bp, Homo sapiens
tttctattttaaaggcatatgg

SEQ ID NO: 8542247 - DNA, 22 bp, Homo sapiens
tttctcaaattgcatgagtagc

SEQ ID NO: 8542248 - DNA, 22 bp, Homo sapiens
tttctcaacctcaacactattt

SEQ ID NO: 8542249 - DNA, 22 bp, Homo sapiens
tttctcaacagagtatgccctt

SEQ ID NO: 8542250 - DNA, 22 bp, Homo sapiens
tttctcaacctcaacactattt

SEQ ID NO: 8542251 - DNA, 22 bp, Homo sapiens
tttctcaaaagacagaagtgaa

SEQ ID NO: 8542252 - DNA, 22 bp, Homo sapiens
tttctcaaatactgttccagga

SEQ ID NO: 8542253 - DNA, 22 bp, Homo sapiens
tttctcaagtactgcacatgaa

SEQ ID NO: 8542254 - DNA, 22 bp, Homo sapiens
tttctcaaggtgtcatgtattt

SEQ ID NO: 8542255 - DNA, 22 bp, Homo sapiens
tttctcaaggtgtcatgtattt

SEQ ID NO: 8542256 - DNA, 18 bp, Homo sapiens
ctctctggtctggatccc

SEQ ID NO: 8542257 - DNA, 19 bp, Homo sapiens
ctctctggcggtgtctgcg

SEQ ID NO: 8542258 - DNA, 22 bp, Homo sapiens
ctctctggcttggcacggagat

SEQ ID NO: 8542259 - DNA, 22 bp, Homo sapiens
ctctctggtcccagattccaga

SEQ ID NO: 8542260 - DNA, 22 bp, Homo sapiens
tttctcaagttcagatatttga

SEQ ID NO: 8542261 - DNA, 22 bp, Homo sapiens
tttctcaagttcagatatttga

SEQ ID NO: 8542262 - DNA, 22 bp, Homo sapiens
tttctcaagttcagatatttga

SEQ ID NO: 8542263 - DNA, 22 bp, Homo sapiens
ctctcttcccgtgagtgttgca

SEQ ID NO: 8542264 - DNA, 22 bp, Homo sapiens
ctctcttcccgtgagtgttgca

SEQ ID NO: 8542265 - DNA, 22 bp, Homo sapiens
ctctctgttatgctttcatgaa

SEQ ID NO: 8542266 - DNA, 22 bp, Homo sapiens
ctctctgttatgctttcatgaa

SEQ ID NO: 8542267 - DNA, 22 bp, Homo sapiens
ctctctgttatgctttcatgaa

SEQ ID NO: 8542268 - DNA, 22 bp, Homo sapiens
ctctctgttatgctttcatgaa

SEQ ID NO: 8542269 - DNA, 18 bp, Homo sapiens
ctctctttccactctttg

SEQ ID NO: 8542270 - DNA, 22 bp, Homo sapiens
ctctctttcattggtcgccttg

SEQ ID NO: 8542271 - DNA, 22 bp, Homo sapiens
ctctctgtatgtgtatatttat

SEQ ID NO: 8542272 - DNA, 22 bp, Homo sapiens
ctctctggtttcagcgaagggg

SEQ ID NO: 8542273 - DNA, 22 bp, Homo sapiens
ctctctggtttcagcgaagggg

SEQ ID NO: 8542274 - DNA, 22 bp, Homo sapiens
ctctctgtggtggctgtcccat

SEQ ID NO: 8542275 - DNA, 22 bp, Homo sapiens
ctctctgtggtggctgtcccat

SEQ ID NO: 8542276 - DNA, 22 bp, Homo sapiens
ctctctgtgctcacaagggcag

SEQ ID NO: 8542277 - DNA, 22 bp, Homo sapiens
ctctctgtggtggctgtcccat

SEQ ID NO: 8542278 - DNA, 22 bp, Homo sapiens
ctctctgtggtggctgtcccat

SEQ ID NO: 8542279 - DNA, 22 bp, Homo sapiens
ctctctgtggtggctgtcccat

SEQ ID NO: 8542280 - DNA, 22 bp, Homo sapiens
ctctgaaagcaaaactagagaa

SEQ ID NO: 8542281 - DNA, 22 bp, Homo sapiens
ctctgaaagcaaaactagagaa

SEQ ID NO: 8542282 - DNA, 22 bp, Homo sapiens
ctctgaaattggccctcagcag

SEQ ID NO: 8542283 - DNA, 22 bp, Homo sapiens
ctctgaaagttagagaaaatag

SEQ ID NO: 8542284 - DNA, 22 bp, Homo sapiens
ctctgaaagttagagaaaatag

SEQ ID NO: 8542285 - DNA, 22 bp, Homo sapiens
ctctgaaagagtttagtattat

SEQ ID NO: 8542286 - DNA, 22 bp, Homo sapiens
ctctgaaagagtttagtattat

SEQ ID NO: 8542287 - DNA, 22 bp, Homo sapiens
ctctgaaagacaagctctcatt

SEQ ID NO: 8542288 - DNA, 18 bp, Homo sapiens
ctctgaaagacacaccag

SEQ ID NO: 8542289 - DNA, 22 bp, Homo sapiens
ctctgaaaatgtggtggggaaa

SEQ ID NO: 8542290 - DNA, 22 bp, Homo sapiens
ctctgaaactccagccccaggt

SEQ ID NO: 8542291 - DNA, 22 bp, Homo sapiens
ctctgaaactcctgcaccttct

SEQ ID NO: 8542292 - DNA, 22 bp, Homo sapiens
ctctctttgatgtataaataat

SEQ ID NO: 8542293 - DNA, 22 bp, Homo sapiens
ctctctttttcgtgtgccgaag

SEQ ID NO: 8542294 - DNA, 22 bp, Homo sapiens
ctctctttctgaatgaggacta

SEQ ID NO: 8542295 - DNA, 18 bp, Homo sapiens
ctctctttccactctttg

SEQ ID NO: 8542296 - DNA, 21 bp, Homo sapiens
tttgttcaggggcaaagttaa

SEQ ID NO: 8542297 - DNA, 21 bp, Homo sapiens
tttgttcaggcaagttacagt

SEQ ID NO: 8542298 - DNA, 21 bp, Homo sapiens
tttgttcaggcaagttacagt

SEQ ID NO: 8542299 - DNA, 22 bp, Homo sapiens
ctctgggtgttaatgtcagtgt

SEQ ID NO: 8542300 - DNA, 22 bp, Homo sapiens
ctctgggtgtcttaggagctca

SEQ ID NO: 8542301 - DNA, 22 bp, Homo sapiens
ctctgggtgtgacagcacctgg

SEQ ID NO: 8542302 - DNA, 22 bp, Homo sapiens
ctctgggtgttaatgtcagtgt

SEQ ID NO: 8542303 - DNA, 22 bp, Homo sapiens
ctctgggtgtgacagcacctgg

SEQ ID NO: 8542304 - DNA, 22 bp, Homo sapiens
tttgttcagctctcattgatta

SEQ ID NO: 8542305 - DNA, 22 bp, Homo sapiens
tttgttcatgcctatattctca

SEQ ID NO: 8542306 - DNA, 22 bp, Homo sapiens
tttgttcatgcctatattctca

SEQ ID NO: 8542307 - DNA, 22 bp, Homo sapiens
tttgttcattagtacagttgta

SEQ ID NO: 8542308 - DNA, 21 bp, Homo sapiens
tttgttcaggggcaaagttaa

SEQ ID NO: 8542309 - DNA, 22 bp, Homo sapiens
tttgttcataatggcaaagaga

SEQ ID NO: 8542310 - DNA, 21 bp, Homo sapiens
tttgttcatagctcactcttt

SEQ ID NO: 8542311 - DNA, 17 bp, Homo sapiens
ctctgggtctcctgctt

SEQ ID NO: 8542312 - DNA, 17 bp, Homo sapiens
ctctgggtctcctgctt

SEQ ID NO: 8542313 - DNA, 22 bp, Homo sapiens
ctctgggtgagacagacctggt

SEQ ID NO: 8542314 - DNA, 22 bp, Homo sapiens
ctctgggtcctggggctacaag

SEQ ID NO: 8542315 - DNA, 23 bp, Homo sapiens
ctctgggtccgatgtcctgacag

SEQ ID NO: 8542316 - DNA, 20 bp, Homo sapiens
ctctgggtcgagacagactt

SEQ ID NO: 8542317 - DNA, 22 bp, Homo sapiens
ctctgggtgggcagcagatgga

SEQ ID NO: 8542318 - DNA, 22 bp, Homo sapiens
ctctgggtggtctcactgagtg

SEQ ID NO: 8542319 - DNA, 22 bp, Homo sapiens
tttggaatattaaaatgtctca

SEQ ID NO: 8542320 - DNA, 22 bp, Homo sapiens
ctctggctccatttccctatgt

SEQ ID NO: 8542321 - DNA, 22 bp, Homo sapiens
ctctggctatggcacggcgctc

SEQ ID NO: 8542322 - DNA, 22 bp, Homo sapiens
ctctggctatctgtttctatgt

SEQ ID NO: 8542323 - DNA, 22 bp, Homo sapiens
ctctggctatctgtttctatgt

SEQ ID NO: 8542324 - DNA, 22 bp, Homo sapiens
tttggaatggtaccttcagttg

SEQ ID NO: 8542325 - DNA, 22 bp, Homo sapiens
tttggaatgtagtttaatcatc

SEQ ID NO: 8542326 - DNA, 22 bp, Homo sapiens
tttggaattggaaagtgctgtg

SEQ ID NO: 8542327 - DNA, 23 bp, Homo sapiens
ctctgggtccgatgtcctgacag

SEQ ID NO: 8542328 - DNA, 22 bp, Homo sapiens
tttgttcattttgagctcatca

SEQ ID NO: 8542329 - DNA, 22 bp, Homo sapiens
tttgttcattttgagctcatca

SEQ ID NO: 8542330 - DNA, 22 bp, Homo sapiens
tttgttctaacttctgcagaca

SEQ ID NO: 8542331 - DNA, 22 bp, Homo sapiens
ctctgtgctcccatgctagtaa

SEQ ID NO: 8542332 - DNA, 22 bp, Homo sapiens
ctctgtgcctcagttttcttct

SEQ ID NO: 8542333 - DNA, 22 bp, Homo sapiens
ctctgtgcttatgctccatggg

SEQ ID NO: 8542334 - DNA, 22 bp, Homo sapiens
ctctgtgattttgtgagccaga

SEQ ID NO: 8542335 - DNA, 22 bp, Homo sapiens
ctctgtgattttgtgagccaga

SEQ ID NO: 8542336 - DNA, 22 bp, Homo sapiens
ctctgtgcctcagttttcttct

SEQ ID NO: 8542337 - DNA, 22 bp, Homo sapiens
ctctgtgccctactgctcagct

SEQ ID NO: 8542338 - DNA, 22 bp, Homo sapiens
ctctgtgccctactgctcagct

SEQ ID NO: 8542339 - DNA, 22 bp, Homo sapiens
ctctgtgccctactgctcagct

SEQ ID NO: 8542340 - DNA, 22 bp, Homo sapiens
ctctgtggtggagtgggtcacc

SEQ ID NO: 8542341 - DNA, 22 bp, Homo sapiens
ctctgtggtggagtgggtcacc

SEQ ID NO: 8542342 - DNA, 22 bp, Homo sapiens
ctctgtggtaaaatagcagtat

SEQ ID NO: 8542343 - DNA, 22 bp, Homo sapiens
ctctgtgggtatttatatgtat

SEQ ID NO: 8542344 - DNA, 22 bp, Homo sapiens
ctctgtgggggagaggcagctg

SEQ ID NO: 8542345 - DNA, 22 bp, Homo sapiens
ctctgtgggggagaggcagctg

SEQ ID NO: 8542346 - DNA, 22 bp, Homo sapiens
ctctgtgggggagaggcagctg

SEQ ID NO: 8542347 - DNA, 22 bp, Homo sapiens
ctctgtgggccagagaggcccc

SEQ ID NO: 8542348 - DNA, 22 bp, Homo sapiens
ctctgtgggccagagaggcccc

SEQ ID NO: 8542349 - DNA, 22 bp, Homo sapiens
ctctgtgggaggaggagtaggc

SEQ ID NO: 8542350 - DNA, 22 bp, Homo sapiens
ctctgtgggaagctgggtgtga

SEQ ID NO: 8542351 - DNA, 22 bp, Homo sapiens
ctctgtggcttgcctttctgtc

SEQ ID NO: 8542352 - DNA, 22 bp, Homo sapiens
ctctgtggctacacaaacctcc

SEQ ID NO: 8542353 - DNA, 22 bp, Homo sapiens
ctctgtggcttgcctttctgtc

SEQ ID NO: 8542354 - DNA, 17 bp, Homo sapiens
ctctgtggaggtgttta

SEQ ID NO: 8542355 - DNA, 22 bp, Homo sapiens
ctctgtgtcagctgggtgtgca

SEQ ID NO: 8542356 - DNA, 22 bp, Homo sapiens
ctctgtgtcagctgggtgtgca

SEQ ID NO: 8542357 - DNA, 22 bp, Homo sapiens
ctctgtgtctgagttatggtct

SEQ ID NO: 8542358 - DNA, 22 bp, Homo sapiens
ctctgtgtctgaagccctattt

SEQ ID NO: 8542359 - DNA, 22 bp, Homo sapiens
ctctgtgtctgagttatggtct

SEQ ID NO: 8542360 - DNA, 22 bp, Homo sapiens
ctctgtgtgctggtggggtcct

SEQ ID NO: 8542361 - DNA, 22 bp, Homo sapiens
ctctgtgtggtagattccatta

SEQ ID NO: 8542362 - DNA, 22 bp, Homo sapiens
ctctgtgtgctggtggggtcct

SEQ ID NO: 8542363 - DNA, 22 bp, Homo sapiens
ctctgtgtcagctgggtgtgca

SEQ ID NO: 8542364 - DNA, 22 bp, Homo sapiens
ctctgtgtatccaagttcaggt

SEQ ID NO: 8542365 - DNA, 22 bp, Homo sapiens
ctctgtggttagactatggctg

SEQ ID NO: 8542366 - DNA, 22 bp, Homo sapiens
ctctgtggttagactatggctg

SEQ ID NO: 8542367 - DNA, 22 bp, Homo sapiens
ctctgtggttagactatggctg

SEQ ID NO: 8542368 - DNA, 22 bp, Homo sapiens
ctctgtggttagactatggctg

SEQ ID NO: 8542369 - DNA, 22 bp, Homo sapiens
ctctgtgttcagcctagcagaa

SEQ ID NO: 8542370 - DNA, 22 bp, Homo sapiens
ctctgtgtggtcctctgtattg

SEQ ID NO: 8542371 - DNA, 22 bp, Homo sapiens
ctctgtgtggtatgattgtcat

SEQ ID NO: 8542372 - DNA, 22 bp, Homo sapiens
ctctgtgtggtcctctgtattg

SEQ ID NO: 8542373 - DNA, 22 bp, Homo sapiens
ctctgtgtggtatgattgtcat

SEQ ID NO: 8542374 - DNA, 22 bp, Homo sapiens
ctctgtgttcagcctagcagaa

SEQ ID NO: 8542375 - DNA, 22 bp, Homo sapiens
ctctgtgttcagcctagcagaa

SEQ ID NO: 8542376 - DNA, 22 bp, Homo sapiens
ctctgtgtggtcctctgtattg

SEQ ID NO: 8542377 - DNA, 22 bp, Homo sapiens
ctctgtgttaaattgggttttt

SEQ ID NO: 8542378 - DNA, 22 bp, Homo sapiens
ctctgtgttccgggttgctgct

SEQ ID NO: 8542379 - DNA, 22 bp, Homo sapiens
ctctgtgttcagcctagcagaa

SEQ ID NO: 8542380 - DNA, 22 bp, Homo sapiens
ctctgtgttccgggttgctgct

SEQ ID NO: 8542381 - DNA, 22 bp, Homo sapiens
ctctgtgttccgggttgctgct

SEQ ID NO: 8542382 - DNA, 22 bp, Homo sapiens
ttttgcttaatctagattttgc

SEQ ID NO: 8542383 - DNA, 22 bp, Homo sapiens
ttttgcctgagagtgaaaataa

SEQ ID NO: 8542384 - DNA, 22 bp, Homo sapiens
ttttctcttccctctggacctg

SEQ ID NO: 8542385 - DNA, 21 bp, Homo sapiens
ctctgtgttgagggtgttgag

SEQ ID NO: 8542386 - DNA, 21 bp, Homo sapiens
ctctgtgttgagggtgttgag

SEQ ID NO: 8542387 - DNA, 21 bp, Homo sapiens
ctctgtgttgagggtgttgag

SEQ ID NO: 8542388 - DNA, 17 bp, Homo sapiens
ttttctctcttggattc

SEQ ID NO: 8542389 - DNA, 22 bp, Homo sapiens
ctctggccagagcctgcgggaa

SEQ ID NO: 8542390 - DNA, 22 bp, Homo sapiens
ctctggccagagcctgcgggaa

SEQ ID NO: 8542391 - DNA, 22 bp, Homo sapiens
ctctggccgcagctcagctctg

SEQ ID NO: 8542392 - DNA, 19 bp, Homo sapiens
ctctggcctctggatgctg

SEQ ID NO: 8542393 - DNA, 22 bp, Homo sapiens
ctctggcctggggcctgctccc

SEQ ID NO: 8542394 - DNA, 22 bp, Homo sapiens
ctctggcggccatgctcgtggt

SEQ ID NO: 8542395 - DNA, 22 bp, Homo sapiens
ctctggcctgcttcctcaggta

SEQ ID NO: 8542396 - DNA, 22 bp, Homo sapiens
ctctggcctgcttcctcaggta

SEQ ID NO: 8542397 - DNA, 22 bp, Homo sapiens
ctctggcctgcttcctcaggta

SEQ ID NO: 8542398 - DNA, 22 bp, Homo sapiens
tttgcaaactttcctctggacc

SEQ ID NO: 8542399 - DNA, 18 bp, Homo sapiens
tttgcaaaggaagtatgg

SEQ ID NO: 8542400 - DNA, 22 bp, Homo sapiens
tttgcaaagtccattgaagtta

SEQ ID NO: 8542401 - DNA, 20 bp, Homo sapiens
ctctggcaaaggatgcctat

SEQ ID NO: 8542402 - DNA, 22 bp, Homo sapiens
tttgcaaagtgactattatatg

SEQ ID NO: 8542403 - DNA, 22 bp, Homo sapiens
tttgcaaagtgactattatatg

SEQ ID NO: 8542404 - DNA, 22 bp, Homo sapiens
ctctggagtgcagcctggtggc

SEQ ID NO: 8542405 - DNA, 22 bp, Homo sapiens
tttgactcctgccttctcctgt

SEQ ID NO: 8542406 - DNA, 22 bp, Homo sapiens
tttgactcctgtgtttctggaa

SEQ ID NO: 8542407 - DNA, 22 bp, Homo sapiens
tttgactcctgtgtttctggaa

SEQ ID NO: 8542408 - DNA, 22 bp, Homo sapiens
tttgactcttgtctcttgttag

SEQ ID NO: 8542409 - DNA, 22 bp, Homo sapiens
tttgacttctgggcattttggt

SEQ ID NO: 8542410 - DNA, 22 bp, Homo sapiens
tttgagaaactgattattatgg

SEQ ID NO: 8542411 - DNA, 22 bp, Homo sapiens
tttgagaaactgattattatgg

SEQ ID NO: 8542412 - DNA, 22 bp, Homo sapiens
tttgagaaaggggatttaattc

SEQ ID NO: 8542413 - DNA, 22 bp, Homo sapiens
tttgagaaccctgtattttaag

SEQ ID NO: 8542414 - DNA, 22 bp, Homo sapiens
tttgagaaaaccagaaagatct

SEQ ID NO: 8542415 - DNA, 22 bp, Homo sapiens
tttgactttgggctctaactca

SEQ ID NO: 8542416 - DNA, 22 bp, Homo sapiens
tttgagaaacagacgaaagaca

SEQ ID NO: 8542417 - DNA, 22 bp, Homo sapiens
tttgagaaacagacgaaagaca

SEQ ID NO: 8542418 - DNA, 22 bp, Homo sapiens
tttgagaaacagacgaaagaca

SEQ ID NO: 8542419 - DNA, 22 bp, Homo sapiens
tttgagaagataggggaatact

SEQ ID NO: 8542420 - DNA, 22 bp, Homo sapiens
tttgagaaccctgtattttaag

SEQ ID NO: 8542421 - DNA, 22 bp, Homo sapiens
tttgagaactttggtattttcc

SEQ ID NO: 8542422 - DNA, 22 bp, Homo sapiens
tttgagaagagtttgaggtatt

SEQ ID NO: 8542423 - DNA, 22 bp, Homo sapiens
tttgagaagagtttgaggtatt

SEQ ID NO: 8542424 - DNA, 22 bp, Homo sapiens
tttgcaaaattattcccagcat

SEQ ID NO: 8542425 - DNA, 22 bp, Homo sapiens
tttgcaaaatgaggtgaagagt

SEQ ID NO: 8542426 - DNA, 22 bp, Homo sapiens
tttgagaagatgtaatgttaag

SEQ ID NO: 8542427 - DNA, 22 bp, Homo sapiens
tttgcaaacacttaagaagaga

SEQ ID NO: 8542428 - DNA, 22 bp, Homo sapiens
tttgcaaaccggagctctgcaa

SEQ ID NO: 8542429 - DNA, 22 bp, Homo sapiens
tttgactcagcaaattcacagg

SEQ ID NO: 8542430 - DNA, 22 bp, Homo sapiens
tttgactcaagcctttctttag

SEQ ID NO: 8542431 - DNA, 22 bp, Homo sapiens
tttgactcattgattttctctg

SEQ ID NO: 8542432 - DNA, 21 bp, Homo sapiens
tttgaatagaaatagtgctta

SEQ ID NO: 8542433 - DNA, 22 bp, Homo sapiens
ctctgcagaggcccaaggctga

SEQ ID NO: 8542434 - DNA, 22 bp, Homo sapiens
tttgacattggcttattctgtt

SEQ ID NO: 8542435 - DNA, 22 bp, Homo sapiens
tttgaatagcataggattacat

SEQ ID NO: 8542436 - DNA, 22 bp, Homo sapiens
tttgaatagaggcccctcagaa

SEQ ID NO: 8542437 - DNA, 22 bp, Homo sapiens
ctctgcagaggcccaaggctga

SEQ ID NO: 8542438 - DNA, 22 bp, Homo sapiens
ctctgcagagcctccagcccag

SEQ ID NO: 8542439 - DNA, 22 bp, Homo sapiens
ctctgcagagcctccagcccag

SEQ ID NO: 8542440 - DNA, 22 bp, Homo sapiens
ctctgcagaatttgagctgctc

SEQ ID NO: 8542441 - DNA, 22 bp, Homo sapiens
ctctgcaccttgtaggaggcaa

SEQ ID NO: 8542442 - DNA, 22 bp, Homo sapiens
ctctgaggtttcctcacaagct

SEQ ID NO: 8542443 - DNA, 22 bp, Homo sapiens
ctctgaggtctaggaccatggc

SEQ ID NO: 8542444 - DNA, 19 bp, Homo sapiens
tttgaaagagttttattgg

SEQ ID NO: 8542445 - DNA, 22 bp, Homo sapiens
ctctgagtttcatttccctcct

SEQ ID NO: 8542446 - DNA, 22 bp, Homo sapiens
ctctgcaatctgagcacttgta

SEQ ID NO: 8542447 - DNA, 22 bp, Homo sapiens
ctctgcaagtccagcccctggc

SEQ ID NO: 8542448 - DNA, 22 bp, Homo sapiens
ctctgcaacttctagcagtgtc

SEQ ID NO: 8542449 - DNA, 22 bp, Homo sapiens
tttgaaagaaaccagtgagtga

SEQ ID NO: 8542450 - DNA, 22 bp, Homo sapiens
tttgaaactctgaacatgtttc

SEQ ID NO: 8542451 - DNA, 22 bp, Homo sapiens
tttgaaactctgaacatgtttc

SEQ ID NO: 8542452 - DNA, 22 bp, Homo sapiens
tttgaaagacagaatatttttg

SEQ ID NO: 8542453 - DNA, 22 bp, Homo sapiens
tttgaaagaatttatgtacttt

SEQ ID NO: 8542454 - DNA, 22 bp, Homo sapiens
tttgaaagaatttatgtacttt

SEQ ID NO: 8542455 - DNA, 22 bp, Homo sapiens
tttgaaacctagttatatgact

SEQ ID NO: 8542456 - DNA, 22 bp, Homo sapiens
tttgaaacctagttatatgact

SEQ ID NO: 8542457 - DNA, 22 bp, Homo sapiens
tttgaaacccgtcactttgagt

SEQ ID NO: 8542458 - DNA, 22 bp, Homo sapiens
tttgaaaatttaagtgctacac

SEQ ID NO: 8542459 - DNA, 22 bp, Homo sapiens
tttgaaaatttaagtgctacac

SEQ ID NO: 8542460 - DNA, 22 bp, Homo sapiens
tttgaaaattagacacaggcta

SEQ ID NO: 8542461 - DNA, 22 bp, Homo sapiens
tttgaaaattagacacaggcta

SEQ ID NO: 8542462 - DNA, 22 bp, Homo sapiens
tttcttggatgtgaaactaggg

SEQ ID NO: 8542463 - DNA, 22 bp, Homo sapiens
tttcttggagctcttagggtcg

SEQ ID NO: 8542464 - DNA, 22 bp, Homo sapiens
tttgaaaaaggcctttggtatg

SEQ ID NO: 8542465 - DNA, 22 bp, Homo sapiens
tttcttgtaaaagctgtgggaa

SEQ ID NO: 8542466 - DNA, 22 bp, Homo sapiens
tttgaaaagaaccatcgcctta

SEQ ID NO: 8542467 - DNA, 22 bp, Homo sapiens
tttgaaaacttaatttggtcgt

SEQ ID NO: 8542468 - DNA, 22 bp, Homo sapiens
ctctgaactcttgggcagcatg

SEQ ID NO: 8542469 - DNA, 22 bp, Homo sapiens
ctctgaagggagggccaagccc

SEQ ID NO: 8542470 - DNA, 21 bp, Homo sapiens
ctctgaatcctgcttctcagt

SEQ ID NO: 8542471 - DNA, 22 bp, Homo sapiens
tttcttgattagctgtggctca

SEQ ID NO: 8542472 - DNA, 22 bp, Homo sapiens
tttcttgattagctgtggctca

SEQ ID NO: 8542473 - DNA, 20 bp, Homo sapiens
ctgcccagccactgagggat

SEQ ID NO: 8542474 - DNA, 20 bp, Homo sapiens
ctgcccagccactgagggat

SEQ ID NO: 8542475 - DNA, 22 bp, Homo sapiens
ctgcccaggaaccagaggggca

SEQ ID NO: 8542476 - DNA, 22 bp, Homo sapiens
ctgcccagattttaccacctgc

SEQ ID NO: 8542477 - DNA, 20 bp, Homo sapiens
ctgcccagccactgagggat

SEQ ID NO: 8542478 - DNA, 20 bp, Homo sapiens
ctgcccagccactgagggat

SEQ ID NO: 8542479 - DNA, 22 bp, Homo sapiens
ctgccatgttacctgcacaggt

SEQ ID NO: 8542480 - DNA, 22 bp, Homo sapiens
ctgccatgttacctgcacaggt

SEQ ID NO: 8542481 - DNA, 18 bp, Homo sapiens
ctgccatgtcctactgtc

SEQ ID NO: 8542482 - DNA, 22 bp, Homo sapiens
ctgcaggagcaagcctgggaga

SEQ ID NO: 8542483 - DNA, 22 bp, Homo sapiens
ctgcaggcatctaactgtgggc

SEQ ID NO: 8542484 - DNA, 21 bp, Homo sapiens
ctgcaggatgctgaagccagg

SEQ ID NO: 8542485 - DNA, 22 bp, Homo sapiens
ctgcccagtttgggagcctttc

SEQ ID NO: 8542486 - DNA, 22 bp, Homo sapiens
ctgcccagtttgggagcctttc

SEQ ID NO: 8542487 - DNA, 22 bp, Homo sapiens
ctgcccataaactttccacctg

SEQ ID NO: 8542488 - DNA, 22 bp, Homo sapiens
ctgcccatcgtcatttaataaa

SEQ ID NO: 8542489 - DNA, 21 bp, Homo sapiens
ctgcccatttgtgatgtcccc

SEQ ID NO: 8542490 - DNA, 22 bp, Homo sapiens
ctgcccattcaaccagctacag

SEQ ID NO: 8542491 - DNA, 22 bp, Homo sapiens
ctgccccacaggcttggtaggg

SEQ ID NO: 8542492 - DNA, 22 bp, Homo sapiens
ctgccccacaggcttggtaggg

SEQ ID NO: 8542493 - DNA, 23 bp, Homo sapiens
ctgccccaattataaaagaagat

SEQ ID NO: 8542494 - DNA, 22 bp, Homo sapiens
ctgccccaccccaacctgaggt

SEQ ID NO: 8542495 - DNA, 22 bp, Homo sapiens
ctgcccaggctgaaggaacatc

SEQ ID NO: 8542496 - DNA, 22 bp, Homo sapiens
ctgcccaggctgaaggaacatc

SEQ ID NO: 8542497 - DNA, 22 bp, Homo sapiens
ctgcccaggggagtgctgtcgg

SEQ ID NO: 8542498 - DNA, 22 bp, Homo sapiens
ctgccccaggcctccttttctt

SEQ ID NO: 8542499 - DNA, 22 bp, Homo sapiens
ctgccccaggcctcgggaggag

SEQ ID NO: 8542500 - DNA, 22 bp, Homo sapiens
ctgccccagtgccaggcaggtg

SEQ ID NO: 8542501 - DNA, 22 bp, Homo sapiens
ctgccccagtgccaggcaggtg

SEQ ID NO: 8542502 - DNA, 22 bp, Homo sapiens
ctgccccaggacctcttctgga

SEQ ID NO: 8542503 - DNA, 22 bp, Homo sapiens
ctgccccaccccaacctgaggt

SEQ ID NO: 8542504 - DNA, 22 bp, Homo sapiens
ctgccccagcctggggccttct

SEQ ID NO: 8542505 - DNA, 22 bp, Homo sapiens
ctgccccagtgccaggcaggtg

SEQ ID NO: 8542506 - DNA, 22 bp, Homo sapiens
ctgccccatggtccctggtggg

SEQ ID NO: 8542507 - DNA, 22 bp, Homo sapiens
ctgccccatggtccctggtggg

SEQ ID NO: 8542508 - DNA, 22 bp, Homo sapiens
ctgccccatggtccctggtggg

SEQ ID NO: 8542509 - DNA, 22 bp, Homo sapiens
ctgccccatggtccctggtggg

SEQ ID NO: 8542510 - DNA, 22 bp, Homo sapiens
ctgcccctgccaggcagctgtc

SEQ ID NO: 8542511 - DNA, 22 bp, Homo sapiens
ctgcccctcgaccaagcgcgtc

SEQ ID NO: 8542512 - DNA, 22 bp, Homo sapiens
ctgcagctttttgtgcttgtaa

SEQ ID NO: 8542513 - DNA, 22 bp, Homo sapiens
ctgcagcttatttgctgtgtga

SEQ ID NO: 8542514 - DNA, 22 bp, Homo sapiens
ctgcagcttatttgctgtgtga

SEQ ID NO: 8542515 - DNA, 22 bp, Homo sapiens
ctgcagctttggaaacctgttt

SEQ ID NO: 8542516 - DNA, 22 bp, Homo sapiens
ctgcagctttcgctccatcagc

SEQ ID NO: 8542517 - DNA, 22 bp, Homo sapiens
ctgcagctgtctctactgggca

SEQ ID NO: 8542518 - DNA, 22 bp, Homo sapiens
ctgcagcctcaacctcctgagc

SEQ ID NO: 8542519 - DNA, 22 bp, Homo sapiens
ctgcagctgtagaggacagtgg

SEQ ID NO: 8542520 - DNA, 22 bp, Homo sapiens
ctgcagcttaaaggagttcaat

SEQ ID NO: 8542521 - DNA, 22 bp, Homo sapiens
ctgcagctgtctctactgggca

SEQ ID NO: 8542522 - DNA, 22 bp, Homo sapiens
ctgcagctgtgagtgctggatg

SEQ ID NO: 8542523 - DNA, 22 bp, Homo sapiens
ctgcagcctcaacctcctgagc

SEQ ID NO: 8542524 - DNA, 22 bp, Homo sapiens
ctgaggtttacaagctattgct

SEQ ID NO: 8542525 - DNA, 22 bp, Homo sapiens
ctgaggtttacaagctattgct

SEQ ID NO: 8542526 - DNA, 22 bp, Homo sapiens
ctgcagcctaggtgcagctggg

SEQ ID NO: 8542527 - DNA, 22 bp, Homo sapiens
ctgcagcctaggtgcagctggg

SEQ ID NO: 8542528 - DNA, 22 bp, Homo sapiens
ctgaggtggcgcctctctttaa

SEQ ID NO: 8542529 - DNA, 22 bp, Homo sapiens
ctgaggtggcatcctagctcta

SEQ ID NO: 8542530 - DNA, 23 bp, Homo sapiens
ctgaggtggagagtgaggtaagt

SEQ ID NO: 8542531 - DNA, 22 bp, Homo sapiens
ctgaggtgtttagtaggggcgg

SEQ ID NO: 8542532 - DNA, 22 bp, Homo sapiens
ctgaggtgttgatgacctatgc

SEQ ID NO: 8542533 - DNA, 22 bp, Homo sapiens
ctgaggtgtgaaatggtggcaa

SEQ ID NO: 8542534 - DNA, 22 bp, Homo sapiens
ctgaggtggggcctgggcatca

SEQ ID NO: 8542535 - DNA, 19 bp, Homo sapiens
ctgaggtgcagtaagaggc

SEQ ID NO: 8542536 - DNA, 19 bp, Homo sapiens
ctgaggtgcagtaagaggc

SEQ ID NO: 8542537 - DNA, 22 bp, Homo sapiens
ctgaggtgctagggtccctgct

SEQ ID NO: 8542538 - DNA, 22 bp, Homo sapiens
ctgaggtggaacagaggtgaag

SEQ ID NO: 8542539 - DNA, 22 bp, Homo sapiens
ctgaggtgctatggaggatacg

SEQ ID NO: 8542540 - DNA, 23 bp, Homo sapiens
ctgaggtctgcaattctagtagt

SEQ ID NO: 8542541 - DNA, 22 bp, Homo sapiens
ctgaggtctctttccatagtga

SEQ ID NO: 8542542 - DNA, 22 bp, Homo sapiens
ctgaggtctctttccatagtga

SEQ ID NO: 8542543 - DNA, 22 bp, Homo sapiens
ctgaggtctattttgaaactgc

SEQ ID NO: 8542544 - DNA, 23 bp, Homo sapiens
ctgaggtctgcaattctagtagt

SEQ ID NO: 8542545 - DNA, 22 bp, Homo sapiens
ctgaggtgagcttccctgggct

SEQ ID NO: 8542546 - DNA, 22 bp, Homo sapiens
ctgaggtgagaggaggccatgt

SEQ ID NO: 8542547 - DNA, 22 bp, Homo sapiens
ctgaggcctgggggcgtggacg

SEQ ID NO: 8542548 - DNA, 22 bp, Homo sapiens
ctgaggcctgggggcgtggacg

SEQ ID NO: 8542549 - DNA, 22 bp, Homo sapiens
ctgaggcctggccccaccacag

SEQ ID NO: 8542550 - DNA, 22 bp, Homo sapiens
ctgaggcctggccccaccacag

SEQ ID NO: 8542551 - DNA, 22 bp, Homo sapiens
ctgaggctaacctcgagagaca

SEQ ID NO: 8542552 - DNA, 22 bp, Homo sapiens
ctgaggcctgtgttggggcagt

SEQ ID NO: 8542553 - DNA, 22 bp, Homo sapiens
ctgaggcctggtgaggtggtga

SEQ ID NO: 8542554 - DNA, 22 bp, Homo sapiens
ctgaggctcaagggcaggtggg

SEQ ID NO: 8542555 - DNA, 22 bp, Homo sapiens
ctgaggctcaagggcaggtggg

SEQ ID NO: 8542556 - DNA, 22 bp, Homo sapiens
ctgaggctcaagggcaggtggg

SEQ ID NO: 8542557 - DNA, 22 bp, Homo sapiens
ctgaggctaacctcgagagaca

SEQ ID NO: 8542558 - DNA, 22 bp, Homo sapiens
ctgagcatgctacatgcagcac

SEQ ID NO: 8542559 - DNA, 22 bp, Homo sapiens
ctgagcatccagcaggtactgc

SEQ ID NO: 8542560 - DNA, 22 bp, Homo sapiens
ctgagcatttgtgcagcttctc

SEQ ID NO: 8542561 - DNA, 22 bp, Homo sapiens
ctgagccaaaaagcagagcttg

SEQ ID NO: 8542562 - DNA, 22 bp, Homo sapiens
ctgagccaaaaagcagagcttg

SEQ ID NO: 8542563 - DNA, 22 bp, Homo sapiens
ctgagccaaaaagcagagcttg

SEQ ID NO: 8542564 - DNA, 22 bp, Homo sapiens
ctgagcatttgtgcagcttctc

SEQ ID NO: 8542565 - DNA, 22 bp, Homo sapiens
ctgaggccgtctgggtctgcag

SEQ ID NO: 8542566 - DNA, 22 bp, Homo sapiens
ctgaggccgtctgggtctgcag

SEQ ID NO: 8542567 - DNA, 22 bp, Homo sapiens
ctgaggccgtctgggtctgcag

SEQ ID NO: 8542568 - DNA, 23 bp, Homo sapiens
ctgaggcctgctgcgttcaggtt

SEQ ID NO: 8542569 - DNA, 22 bp, Homo sapiens
ctgaggccgttggtgggcctta

SEQ ID NO: 8542570 - DNA, 22 bp, Homo sapiens
ctgaggctgcccagggccaggt

SEQ ID NO: 8542571 - DNA, 22 bp, Homo sapiens
ctgaggctgagacaggtgaaat

SEQ ID NO: 8542572 - DNA, 22 bp, Homo sapiens
ctgaggctctgggtgtcactgt

SEQ ID NO: 8542573 - DNA, 22 bp, Homo sapiens
ctgaggctctgagaaagccaaa

SEQ ID NO: 8542574 - DNA, 22 bp, Homo sapiens
ctgaggctccctcgggtctgct

SEQ ID NO: 8542575 - DNA, 22 bp, Homo sapiens
ctgaggctcagcgtgaggaaag

SEQ ID NO: 8542576 - DNA, 22 bp, Homo sapiens
ctgaggtcaggagttcaagctg

SEQ ID NO: 8542577 - DNA, 17 bp, Homo sapiens
ctgaggggagtgctgtg

SEQ ID NO: 8542578 - DNA, 17 bp, Homo sapiens
ctgaggggagtgctgtg

SEQ ID NO: 8542579 - DNA, 22 bp, Homo sapiens
ctgaggtctattttgaaactgc

SEQ ID NO: 8542580 - DNA, 22 bp, Homo sapiens
ctgaggtctagacaccccaggg

SEQ ID NO: 8542581 - DNA, 22 bp, Homo sapiens
ctgaggtccttgactgcttgcc

SEQ ID NO: 8542582 - DNA, 22 bp, Homo sapiens
ctgaggtcaggagttcaagctg

SEQ ID NO: 8542583 - DNA, 22 bp, Homo sapiens
ctgaggtcctcagagggaaagg

SEQ ID NO: 8542584 - DNA, 23 bp, Homo sapiens
ctgaggggaaaagggcttcaggc

SEQ ID NO: 8542585 - DNA, 22 bp, Homo sapiens
ctgaggggaaaagtcaggatga

SEQ ID NO: 8542586 - DNA, 22 bp, Homo sapiens
ctgaggggaaaagtcaggatga

SEQ ID NO: 8542587 - DNA, 22 bp, Homo sapiens
ctgaggctggagtgcagtggtg

SEQ ID NO: 8542588 - DNA, 22 bp, Homo sapiens
ctgaggctggagtgcagtggtg

SEQ ID NO: 8542589 - DNA, 22 bp, Homo sapiens
ctgaggctggagtgcagtggtg

SEQ ID NO: 8542590 - DNA, 19 bp, Homo sapiens
ctgagcagcggcagcactt

SEQ ID NO: 8542591 - DNA, 19 bp, Homo sapiens
ctgagcagcggcagcactt

SEQ ID NO: 8542592 - DNA, 22 bp, Homo sapiens
ctgagcagaccatggcagaggt

SEQ ID NO: 8542593 - DNA, 22 bp, Homo sapiens
ctgagcagaccatggcagaggt

SEQ ID NO: 8542594 - DNA, 22 bp, Homo sapiens
ctgagcagaagggtgcacgtgc

SEQ ID NO: 8542595 - DNA, 22 bp, Homo sapiens
ctgagcagctgttacagagtgt

SEQ ID NO: 8542596 - DNA, 22 bp, Homo sapiens
ctgagcagtctgactcaagcta

SEQ ID NO: 8542597 - DNA, 22 bp, Homo sapiens
ctgagcagtggttcttgagcgc

SEQ ID NO: 8542598 - DNA, 22 bp, Homo sapiens
ctgagcaggatattcacagcag

SEQ ID NO: 8542599 - DNA, 19 bp, Homo sapiens
ctgagcaggcaggtaggat

SEQ ID NO: 8542600 - DNA, 22 bp, Homo sapiens
ctcttcccagctccacgagagg

SEQ ID NO: 8542601 - DNA, 22 bp, Homo sapiens
ctcttcccagctccacgagagg

SEQ ID NO: 8542602 - DNA, 22 bp, Homo sapiens
ctcttcctacagtctgctatgc

SEQ ID NO: 8542603 - DNA, 22 bp, Homo sapiens
ttttggaatcatttacagagca

SEQ ID NO: 8542604 - DNA, 22 bp, Homo sapiens
ttttggaacacagacattagaa

SEQ ID NO: 8542605 - DNA, 22 bp, Homo sapiens
ttttggaacacagacattagaa

SEQ ID NO: 8542606 - DNA, 22 bp, Homo sapiens
ttttgcttgagtgcacaaaatg

SEQ ID NO: 8542607 - DNA, 22 bp, Homo sapiens
ttttgcttgagtgcacaaaatg

SEQ ID NO: 8542608 - DNA, 22 bp, Homo sapiens
ttttgcttttgtaacacagtgt

SEQ ID NO: 8542609 - DNA, 22 bp, Homo sapiens
ttttgctttaagatggagagga

SEQ ID NO: 8542610 - DNA, 19 bp, Homo sapiens
ttttggaaatgtgaacagc

SEQ ID NO: 8542611 - DNA, 22 bp, Homo sapiens
ctcttcctttcccttgagggtg

SEQ ID NO: 8542612 - DNA, 22 bp, Homo sapiens
ctcttcctagtgtgcagcgtgg

SEQ ID NO: 8542613 - DNA, 22 bp, Homo sapiens
ctcttcctctcatgcggtcata

SEQ ID NO: 8542614 - DNA, 22 bp, Homo sapiens
ctcttctgtacctcggcctcca

SEQ ID NO: 8542615 - DNA, 22 bp, Homo sapiens
ctcttcttatggccgtggctga

SEQ ID NO: 8542616 - DNA, 22 bp, Homo sapiens
ctcttcttatggccgtggctga

SEQ ID NO: 8542617 - DNA, 22 bp, Homo sapiens
ctgagcactgggcacatagctg

SEQ ID NO: 8542618 - DNA, 22 bp, Homo sapiens
ctcttcttgaaagaggaattca

SEQ ID NO: 8542619 - DNA, 22 bp, Homo sapiens
ctcttcttatggccgtggctga

SEQ ID NO: 8542620 - DNA, 22 bp, Homo sapiens
ctcttctctgcagcctttgaag

SEQ ID NO: 8542621 - DNA, 22 bp, Homo sapiens
ctcttctctgcagcctttgaag

SEQ ID NO: 8542622 - DNA, 22 bp, Homo sapiens
ctcttctgtacctcggcctcca

SEQ ID NO: 8542623 - DNA, 22 bp, Homo sapiens
ctgctgggaaggtctgctcagt

SEQ ID NO: 8542624 - DNA, 22 bp, Homo sapiens
ctgctgagcatcagggctgccc

SEQ ID NO: 8542625 - DNA, 22 bp, Homo sapiens
ctgctgagcatcagggctgccc

SEQ ID NO: 8542626 - DNA, 22 bp, Homo sapiens
ctgctgggaaggtctgctcagt

SEQ ID NO: 8542627 - DNA, 22 bp, Homo sapiens
ctgctgggaaggtctgctcagt

SEQ ID NO: 8542628 - DNA, 19 bp, Homo sapiens
ctgctgaattagctctgga

SEQ ID NO: 8542629 - DNA, 22 bp, Homo sapiens
ctgctgactcattttcaacact

SEQ ID NO: 8542630 - DNA, 22 bp, Homo sapiens
ctgctgactcttcctggagtga

SEQ ID NO: 8542631 - DNA, 22 bp, Homo sapiens
ctgctgacaaaataaaatgctc

SEQ ID NO: 8542632 - DNA, 22 bp, Homo sapiens
ctgctgacagccctgcttcagg

SEQ ID NO: 8542633 - DNA, 22 bp, Homo sapiens
ctgctgacagccctgcttcagg

SEQ ID NO: 8542634 - DNA, 22 bp, Homo sapiens
ctgctgaaaacaataatgatga

SEQ ID NO: 8542635 - DNA, 22 bp, Homo sapiens
ctgctgacttacactgtttatt

SEQ ID NO: 8542636 - DNA, 22 bp, Homo sapiens
ctgctgggtttgcctttcacca

SEQ ID NO: 8542637 - DNA, 22 bp, Homo sapiens
ctgctgggtttgcctttcacca

SEQ ID NO: 8542638 - DNA, 19 bp, Homo sapiens
ctgctgggtgctgagggag

SEQ ID NO: 8542639 - DNA, 22 bp, Homo sapiens
ctgctgggtctatgcaagtgga

SEQ ID NO: 8542640 - DNA, 22 bp, Homo sapiens
ctgctgggtctatgcaagtgga

SEQ ID NO: 8542641 - DNA, 22 bp, Homo sapiens
ctgctgggtccccctgctgatt

SEQ ID NO: 8542642 - DNA, 22 bp, Homo sapiens
ctgctgggtccccctgctgatt

SEQ ID NO: 8542643 - DNA, 22 bp, Homo sapiens
ctgctgtcaaaaatcactccat

SEQ ID NO: 8542644 - DNA, 22 bp, Homo sapiens
ctgctgtcaaaggaaatatttg

SEQ ID NO: 8542645 - DNA, 22 bp, Homo sapiens
ctgctgtcaaaaatcactccat

SEQ ID NO: 8542646 - DNA, 22 bp, Homo sapiens
ctgctgtccaggagtgccctgt

SEQ ID NO: 8542647 - DNA, 22 bp, Homo sapiens
ctgctgtcatagccatccctcc

SEQ ID NO: 8542648 - DNA, 22 bp, Homo sapiens
ctgctgtcaaaggaaatatttg

SEQ ID NO: 8542649 - DNA, 22 bp, Homo sapiens
ctgccttctttcaagggtaagc

SEQ ID NO: 8542650 - DNA, 22 bp, Homo sapiens
ctgccttgaaaatgaagcttta

SEQ ID NO: 8542651 - DNA, 21 bp, Homo sapiens
ctgccttgaatggtactggga

SEQ ID NO: 8542652 - DNA, 18 bp, Homo sapiens
ctgcctgttgctgagagg

SEQ ID NO: 8542653 - DNA, 22 bp, Homo sapiens
ctgcctgtttcctcttgctccc

SEQ ID NO: 8542654 - DNA, 22 bp, Homo sapiens
ctgccttcatctctgagctggg

SEQ ID NO: 8542655 - DNA, 22 bp, Homo sapiens
ctgcctgttttctgatagattt

SEQ ID NO: 8542656 - DNA, 22 bp, Homo sapiens
ctgcctgttttctgatagattt

SEQ ID NO: 8542657 - DNA, 22 bp, Homo sapiens
ctgcctggggaatgtgaggatt

SEQ ID NO: 8542658 - DNA, 22 bp, Homo sapiens
ctgcctggggaatgtgaggatt

SEQ ID NO: 8542659 - DNA, 22 bp, Homo sapiens
ctgcctggggaatgtgaggatt

SEQ ID NO: 8542660 - DNA, 22 bp, Homo sapiens
ctgcctggggcatcagtcaagg

SEQ ID NO: 8542661 - DNA, 22 bp, Homo sapiens
ctgcctggggaatgtgaggatt

SEQ ID NO: 8542662 - DNA, 22 bp, Homo sapiens
ctgcctggggcatcagtcaagg

SEQ ID NO: 8542663 - DNA, 22 bp, Homo sapiens
ctgcctggggaatgtgaggatt

SEQ ID NO: 8542664 - DNA, 22 bp, Homo sapiens
ctgcctgtgtgtgcctgcagaa

SEQ ID NO: 8542665 - DNA, 22 bp, Homo sapiens
ctgcctgttagtctagcagtta

SEQ ID NO: 8542666 - DNA, 19 bp, Homo sapiens
ctgcctgttatggagagaa

SEQ ID NO: 8542667 - DNA, 22 bp, Homo sapiens
ctgcctgtggtctgtgatctaa

SEQ ID NO: 8542668 - DNA, 22 bp, Homo sapiens
ctgcctgtgggtacaagtggaa

SEQ ID NO: 8542669 - DNA, 22 bp, Homo sapiens
ctgcctgtggtctgtgatctaa

SEQ ID NO: 8542670 - DNA, 22 bp, Homo sapiens
ctgctctgtttcttagctgggt

SEQ ID NO: 8542671 - DNA, 22 bp, Homo sapiens
ctgctctgtttcttagctgggt

SEQ ID NO: 8542672 - DNA, 22 bp, Homo sapiens
ctgctctgtttcttagctgggt

SEQ ID NO: 8542673 - DNA, 22 bp, Homo sapiens
ctgctctgttcccccatcatct

SEQ ID NO: 8542674 - DNA, 22 bp, Homo sapiens
ctgctctgttcccccatcatct

SEQ ID NO: 8542675 - DNA, 22 bp, Homo sapiens
ctgctctgttcccccatcatct

SEQ ID NO: 8542676 - DNA, 22 bp, Homo sapiens
ctgctctgttaattaaactttg

SEQ ID NO: 8542677 - DNA, 22 bp, Homo sapiens
ctgctctgttcccccatcatct

SEQ ID NO: 8542678 - DNA, 22 bp, Homo sapiens
ctgctctgaccctttcaccttc

SEQ ID NO: 8542679 - DNA, 22 bp, Homo sapiens
ctgctctgaccctttcaccttc

SEQ ID NO: 8542680 - DNA, 21 bp, Homo sapiens
ctgctctgacagtgaggccag

SEQ ID NO: 8542681 - DNA, 22 bp, Homo sapiens
ctgctctgaccctttcaccttc

SEQ ID NO: 8542682 - DNA, 22 bp, Homo sapiens
ctgctctgaccctttcaccttc

SEQ ID NO: 8542683 - DNA, 22 bp, Homo sapiens
ctgctctgtggtccatgagaca

SEQ ID NO: 8542684 - DNA, 22 bp, Homo sapiens
ctgctctgtggtccatgagaca

SEQ ID NO: 8542685 - DNA, 22 bp, Homo sapiens
ctgctctgtggtccatgagaca

SEQ ID NO: 8542686 - DNA, 21 bp, Homo sapiens
ctgctctgacagtgaggccag

SEQ ID NO: 8542687 - DNA, 21 bp, Homo sapiens
ctgctctgacagtgaggccag

SEQ ID NO: 8542688 - DNA, 22 bp, Homo sapiens
ctgcctttgtgatcagttcttt

SEQ ID NO: 8542689 - DNA, 22 bp, Homo sapiens
ctgccttttcatctgagctgga

SEQ ID NO: 8542690 - DNA, 22 bp, Homo sapiens
ctgccttttaaagccagtgtta

SEQ ID NO: 8542691 - DNA, 22 bp, Homo sapiens
ctgcctttggggagttagaggg

SEQ ID NO: 8542692 - DNA, 22 bp, Homo sapiens
ctgccttggttcccagccagca

SEQ ID NO: 8542693 - DNA, 22 bp, Homo sapiens
ctgccttggttcccagccagca

SEQ ID NO: 8542694 - DNA, 22 bp, Homo sapiens
ctgccttggccctagttcatgg

SEQ ID NO: 8542695 - DNA, 22 bp, Homo sapiens
ctgcctttgcccttgacactgt

SEQ ID NO: 8542696 - DNA, 22 bp, Homo sapiens
ctgcctttgcccttgacactgt

SEQ ID NO: 8542697 - DNA, 22 bp, Homo sapiens
ctgccttgtcttgttttcaggg

SEQ ID NO: 8542698 - DNA, 22 bp, Homo sapiens
ctggaagagtgactttgcattt

SEQ ID NO: 8542699 - DNA, 22 bp, Homo sapiens
ctggaaggagaaggaggctgtg

SEQ ID NO: 8542700 - DNA, 22 bp, Homo sapiens
ctggaaggagaaggaggctgtg

SEQ ID NO: 8542701 - DNA, 22 bp, Homo sapiens
ctggaaggagaaggaggctgtg

SEQ ID NO: 8542702 - DNA, 22 bp, Homo sapiens
ctggaagagtcctaaacagata

SEQ ID NO: 8542703 - DNA, 22 bp, Homo sapiens
ctggaagagtcctaaacagata

SEQ ID NO: 8542704 - DNA, 22 bp, Homo sapiens
ctggaagagtaatataaattag

SEQ ID NO: 8542705 - DNA, 22 bp, Homo sapiens
ctggaagaggacacacgaatca

SEQ ID NO: 8542706 - DNA, 22 bp, Homo sapiens
ctggaagaggggaaatgccatg

SEQ ID NO: 8542707 - DNA, 22 bp, Homo sapiens
ctggaagaggggaaatgccatg

SEQ ID NO: 8542708 - DNA, 22 bp, Homo sapiens
ctggaagaggaagccagctgga

SEQ ID NO: 8542709 - DNA, 22 bp, Homo sapiens
ctggaagaggaagccagctgga

SEQ ID NO: 8542710 - DNA, 22 bp, Homo sapiens
ctggaagaggacacacgaatca

SEQ ID NO: 8542711 - DNA, 22 bp, Homo sapiens
ctgctgtgagtggttcttgcct

SEQ ID NO: 8542712 - DNA, 22 bp, Homo sapiens
ctgctgtgagcactccagcctg

SEQ ID NO: 8542713 - DNA, 22 bp, Homo sapiens
ctgctgtgacagctgccgtgtt

SEQ ID NO: 8542714 - DNA, 23 bp, Homo sapiens
ctgctgtgaaacatggttttggt

SEQ ID NO: 8542715 - DNA, 22 bp, Homo sapiens
ctgctgtgacagctgccgtgtt

SEQ ID NO: 8542716 - DNA, 22 bp, Homo sapiens
ctgctgtgagcactccagcctg

SEQ ID NO: 8542717 - DNA, 23 bp, Homo sapiens
ctgctgtgaaacatggttttggt

SEQ ID NO: 8542718 - DNA, 22 bp, Homo sapiens
ctgctgtctagtatcttaaaaa

SEQ ID NO: 8542719 - DNA, 22 bp, Homo sapiens
ctgctgtgagtttggaggtcta

SEQ ID NO: 8542720 - DNA, 22 bp, Homo sapiens
ctggaaagtgcttttctgagag

SEQ ID NO: 8542721 - DNA, 22 bp, Homo sapiens
ctggaaggtaacaaggccatta

SEQ ID NO: 8542722 - DNA, 22 bp, Homo sapiens
ctggaaggtaacaaggccatta

SEQ ID NO: 8542723 - DNA, 22 bp, Homo sapiens
ctggaaggtctgtccccactgc

SEQ ID NO: 8542724 - DNA, 22 bp, Homo sapiens
ctggaaggtctgtccccactgc

SEQ ID NO: 8542725 - DNA, 22 bp, Homo sapiens
ctggaaggtggatggcgaggcc

SEQ ID NO: 8542726 - DNA, 22 bp, Homo sapiens
ctggaaggtggatggcgaggcc

SEQ ID NO: 8542727 - DNA, 22 bp, Homo sapiens
ctggaaggtgactgtcttgaat

SEQ ID NO: 8542728 - DNA, 22 bp, Homo sapiens
ctggaagggtcagagtgatgag

SEQ ID NO: 8542729 - DNA, 22 bp, Homo sapiens
ctggaagggtcagagtgatgag

SEQ ID NO: 8542730 - DNA, 22 bp, Homo sapiens
ctggaagggtctacttagcaga

SEQ ID NO: 8542731 - DNA, 22 bp, Homo sapiens
ctggaagggtctacttagcaga

SEQ ID NO: 8542732 - DNA, 22 bp, Homo sapiens
ctggaaggtaacaaggccatta

SEQ ID NO: 8542733 - DNA, 22 bp, Homo sapiens
ctggaagggtctacttagcaga

SEQ ID NO: 8542734 - DNA, 22 bp, Homo sapiens
ctggagaactagttaaacacgt

SEQ ID NO: 8542735 - DNA, 22 bp, Homo sapiens
ctggagagaccgaaagaggctg

SEQ ID NO: 8542736 - DNA, 22 bp, Homo sapiens
ctggagagaccgaaagaggctg

SEQ ID NO: 8542737 - DNA, 22 bp, Homo sapiens
ctggagagaccgaaagaggctg

SEQ ID NO: 8542738 - DNA, 22 bp, Homo sapiens
ctggaaggttcctcccagctcc

SEQ ID NO: 8542739 - DNA, 22 bp, Homo sapiens
ctggaaggttcctcccagctcc

SEQ ID NO: 8542740 - DNA, 22 bp, Homo sapiens
ctggaaggtggatggcgaggcc

SEQ ID NO: 8542741 - DNA, 22 bp, Homo sapiens
ctggagaaaatccatgtgtatg

SEQ ID NO: 8542742 - DNA, 19 bp, Homo sapiens
ctggaaggagggactgttc

SEQ ID NO: 8542743 - DNA, 19 bp, Homo sapiens
ctggaaggagggactgttc

SEQ ID NO: 8542744 - DNA, 22 bp, Homo sapiens
ctggaaggagcccgggcggatc

SEQ ID NO: 8542745 - DNA, 22 bp, Homo sapiens
ctggaaggagaaggaggctgtg

SEQ ID NO: 8542746 - DNA, 22 bp, Homo sapiens
ctggaaggcggaggttgtagtg

SEQ ID NO: 8542747 - DNA, 22 bp, Homo sapiens
ctggaaggcagaggttgcagtg

SEQ ID NO: 8542748 - DNA, 22 bp, Homo sapiens
ctggaaggcagaggttgcagtg

SEQ ID NO: 8542749 - DNA, 22 bp, Homo sapiens
ctggaaggcagaggttgcagtg

SEQ ID NO: 8542750 - DNA, 22 bp, Homo sapiens
ctggaagggaaatctcttggca

SEQ ID NO: 8542751 - DNA, 22 bp, Homo sapiens
ctggaaggctctgctgcctgtc

SEQ ID NO: 8542752 - DNA, 22 bp, Homo sapiens
ctggaagggagcactgtagaga

SEQ ID NO: 8542753 - DNA, 22 bp, Homo sapiens
ctggaagggagcactgtagaga

SEQ ID NO: 8542754 - DNA, 22 bp, Homo sapiens
ctggaagggaaatctcttggca

SEQ ID NO: 8542755 - DNA, 22 bp, Homo sapiens
ctggaaggctctgctgcctgtc

SEQ ID NO: 8542756 - DNA, 22 bp, Homo sapiens
ctggaaggctctgctgcctgtc

SEQ ID NO: 8542757 - DNA, 22 bp, Homo sapiens
ctggaagggtacataggaaact

SEQ ID NO: 8542758 - DNA, 22 bp, Homo sapiens
ctggaaggggcagtctttgggc

SEQ ID NO: 8542759 - DNA, 22 bp, Homo sapiens
ctggaagggggacagccacaca

SEQ ID NO: 8542760 - DNA, 22 bp, Homo sapiens
ctggagccggcgagccccagcc

SEQ ID NO: 8542761 - DNA, 22 bp, Homo sapiens
ctggagccggcgagccccagcc

SEQ ID NO: 8542762 - DNA, 22 bp, Homo sapiens
ctggagccggcgagccccagcc

SEQ ID NO: 8542763 - DNA, 22 bp, Homo sapiens
ctggagccggcgagccccagcc

SEQ ID NO: 8542764 - DNA, 22 bp, Homo sapiens
ctggagcctaggttgacctggg

SEQ ID NO: 8542765 - DNA, 22 bp, Homo sapiens
ctggagcctaggttgacctggg

SEQ ID NO: 8542766 - DNA, 22 bp, Homo sapiens
ctggagcctgcagttttcactt

SEQ ID NO: 8542767 - DNA, 22 bp, Homo sapiens
ctggagcctgcagttttcactt

SEQ ID NO: 8542768 - DNA, 22 bp, Homo sapiens
ctggagcctgcagttttcactt

SEQ ID NO: 8542769 - DNA, 17 bp, Homo sapiens
ctggagcctccaactcc

SEQ ID NO: 8542770 - DNA, 22 bp, Homo sapiens
ctggagcctaggttgacctggg

SEQ ID NO: 8542771 - DNA, 17 bp, Homo sapiens
ctggagcctccaactcc

SEQ ID NO: 8542772 - DNA, 22 bp, Homo sapiens
ctggagccggaccagggacggt

SEQ ID NO: 8542773 - DNA, 22 bp, Homo sapiens
ctggagccgcatggagcaggga

SEQ ID NO: 8542774 - DNA, 22 bp, Homo sapiens
ctggagccggaccagggacggt

SEQ ID NO: 8542775 - DNA, 22 bp, Homo sapiens
ctggagccggaccagggacggt

SEQ ID NO: 8542776 - DNA, 22 bp, Homo sapiens
ctggagccggaccagggacggt

SEQ ID NO: 8542777 - DNA, 22 bp, Homo sapiens
ctggagccgcatggagcaggga

SEQ ID NO: 8542778 - DNA, 22 bp, Homo sapiens
ctggagccgcatggagcaggga

SEQ ID NO: 8542779 - DNA, 22 bp, Homo sapiens
ctggagccctgaatgggcagga

SEQ ID NO: 8542780 - DNA, 22 bp, Homo sapiens
ctggagccctgaatgggcagga

SEQ ID NO: 8542781 - DNA, 22 bp, Homo sapiens
ctggagcaggtttaggagtccc

SEQ ID NO: 8542782 - DNA, 22 bp, Homo sapiens
ctggagcaggcttgtcccagct

SEQ ID NO: 8542783 - DNA, 22 bp, Homo sapiens
ctggagcaggtttaggagtccc

SEQ ID NO: 8542784 - DNA, 22 bp, Homo sapiens
ctggagcaggcttgtcccagct

SEQ ID NO: 8542785 - DNA, 22 bp, Homo sapiens
ctggagcaggtttaggagtccc

SEQ ID NO: 8542786 - DNA, 22 bp, Homo sapiens
ctggagcaggtttaggagtccc

SEQ ID NO: 8542787 - DNA, 22 bp, Homo sapiens
ctggagcaggtttaggagtccc

SEQ ID NO: 8542788 - DNA, 22 bp, Homo sapiens
ctggagcagcaggtggccaggg

SEQ ID NO: 8542789 - DNA, 22 bp, Homo sapiens
ctggagcagcaggtggccaggg

SEQ ID NO: 8542790 - DNA, 22 bp, Homo sapiens
ctggagcaggcttgtcccagct

SEQ ID NO: 8542791 - DNA, 22 bp, Homo sapiens
ctggagcaggcttgtcccagct

SEQ ID NO: 8542792 - DNA, 22 bp, Homo sapiens
ctggagcaggcttgtcccagct

SEQ ID NO: 8542793 - DNA, 22 bp, Homo sapiens
ctggagcatccatgcccagggt

SEQ ID NO: 8542794 - DNA, 22 bp, Homo sapiens
ctggagccccaggctgtgcaga

SEQ ID NO: 8542795 - DNA, 22 bp, Homo sapiens
ctggagcatccatgcccagggt

SEQ ID NO: 8542796 - DNA, 22 bp, Homo sapiens
ctggagcatccatgcccagggt

SEQ ID NO: 8542797 - DNA, 22 bp, Homo sapiens
ctggagccccaggctgtgcaga

SEQ ID NO: 8542798 - DNA, 22 bp, Homo sapiens
ctggagccctgaatgggcagga

SEQ ID NO: 8542799 - DNA, 22 bp, Homo sapiens
ctggagccctgaatgggcagga

SEQ ID NO: 8542800 - DNA, 22 bp, Homo sapiens
ctggagccccaggctgtgcaga

SEQ ID NO: 8542801 - DNA, 22 bp, Homo sapiens
ctggagccccaggctgtgcaga

SEQ ID NO: 8542802 - DNA, 22 bp, Homo sapiens
ctggagagggagccctggcagt

SEQ ID NO: 8542803 - DNA, 22 bp, Homo sapiens
ctggagagggagccctggcagt

SEQ ID NO: 8542804 - DNA, 22 bp, Homo sapiens
ctggagagggagccctggcagt

SEQ ID NO: 8542805 - DNA, 22 bp, Homo sapiens
ctggagagggagccctggcagt

SEQ ID NO: 8542806 - DNA, 22 bp, Homo sapiens
ctggagaggctgggaacaggtt

SEQ ID NO: 8542807 - DNA, 22 bp, Homo sapiens
ctggagaggctgggaacaggtt

SEQ ID NO: 8542808 - DNA, 22 bp, Homo sapiens
ctggagagatcctcctgaaaaa

SEQ ID NO: 8542809 - DNA, 22 bp, Homo sapiens
ctggagagatcctcctgaaaaa

SEQ ID NO: 8542810 - DNA, 22 bp, Homo sapiens
ctggagagatcctcctgaaaaa

SEQ ID NO: 8542811 - DNA, 22 bp, Homo sapiens
ctggagagagaaaaagccttaa

SEQ ID NO: 8542812 - DNA, 22 bp, Homo sapiens
ctggagagagaaaaagccttaa

SEQ ID NO: 8542813 - DNA, 22 bp, Homo sapiens
ctggagagagaaaaagccttaa

SEQ ID NO: 8542814 - DNA, 22 bp, Homo sapiens
ctggagagaccgaaagaggctg

SEQ ID NO: 8542815 - DNA, 22 bp, Homo sapiens
ctggagaggctgggaacaggtt

SEQ ID NO: 8542816 - DNA, 22 bp, Homo sapiens
ctggagaggctgggaacaggtt

SEQ ID NO: 8542817 - DNA, 22 bp, Homo sapiens
ctggagaggctgggaacaggtt

SEQ ID NO: 8542818 - DNA, 22 bp, Homo sapiens
ctggagaggctgggaacaggtt

SEQ ID NO: 8542819 - DNA, 22 bp, Homo sapiens
ctggagaggccccaagatattt

SEQ ID NO: 8542820 - DNA, 22 bp, Homo sapiens
ctggagaggccccaagatattt

SEQ ID NO: 8542821 - DNA, 22 bp, Homo sapiens
ctggagaggccccaagatattt

SEQ ID NO: 8542822 - DNA, 22 bp, Homo sapiens
ctggagaggccccaagatattt

SEQ ID NO: 8542823 - DNA, 22 bp, Homo sapiens
ctggagagttggaagatggact

SEQ ID NO: 8542824 - DNA, 22 bp, Homo sapiens
ctggagagttggaagatggact

SEQ ID NO: 8542825 - DNA, 22 bp, Homo sapiens
ctggagagttggaagatggact

SEQ ID NO: 8542826 - DNA, 22 bp, Homo sapiens
ctggagagttggaagatggact

SEQ ID NO: 8542827 - DNA, 22 bp, Homo sapiens
ctggagagttggaagatggact

SEQ ID NO: 8542828 - DNA, 22 bp, Homo sapiens
ctggagagttggaagatggact

SEQ ID NO: 8542829 - DNA, 22 bp, Homo sapiens
ctggagagtaatctctgtgtta

SEQ ID NO: 8542830 - DNA, 22 bp, Homo sapiens
ctggagagtaatctctgtgtta

SEQ ID NO: 8542831 - DNA, 22 bp, Homo sapiens
ctggagagggagctgttggaag

SEQ ID NO: 8542832 - DNA, 22 bp, Homo sapiens
ctggagagggagctgttggaag

SEQ ID NO: 8542833 - DNA, 19 bp, Homo sapiens
ctggagatagggcctttaa

SEQ ID NO: 8542834 - DNA, 22 bp, Homo sapiens
ctggagatactgctctccatat

SEQ ID NO: 8542835 - DNA, 22 bp, Homo sapiens
ctggagataagtaaagaggcaa

SEQ ID NO: 8542836 - DNA, 22 bp, Homo sapiens
ctggagataagcagtcccaggc

SEQ ID NO: 8542837 - DNA, 17 bp, Homo sapiens
ctggagcagacaaaagg

SEQ ID NO: 8542838 - DNA, 22 bp, Homo sapiens
ctggagcaaaagtgactcctct

SEQ ID NO: 8542839 - DNA, 22 bp, Homo sapiens
ctggagcaaaagtgactcctct

SEQ ID NO: 8542840 - DNA, 22 bp, Homo sapiens
ctggagcaaaagtgactcctct

SEQ ID NO: 8542841 - DNA, 22 bp, Homo sapiens
ctggagattaagttctcagcca

SEQ ID NO: 8542842 - DNA, 22 bp, Homo sapiens
ccttttctgtttcctgtcactg

SEQ ID NO: 8542843 - DNA, 22 bp, Homo sapiens
ccttttctgtgtgggtaattta

SEQ ID NO: 8542844 - DNA, 22 bp, Homo sapiens
ccttttctggccaccaagcgct

SEQ ID NO: 8542845 - DNA, 22 bp, Homo sapiens
ccttttctgaaccacttaaata

SEQ ID NO: 8542846 - DNA, 22 bp, Homo sapiens
ccttttgaggcttgggctcaga

SEQ ID NO: 8542847 - DNA, 22 bp, Homo sapiens
ccttttgagacttccactgtgt

SEQ ID NO: 8542848 - DNA, 22 bp, Homo sapiens
ccttttgaaggtgttgttaagt

SEQ ID NO: 8542849 - DNA, 22 bp, Homo sapiens
ccttttgaaggtgttgttaagt

SEQ ID NO: 8542850 - DNA, 22 bp, Homo sapiens
ccttttcttgccactgactcgg

SEQ ID NO: 8542851 - DNA, 22 bp, Homo sapiens
ccttttgctctcccatccagaa

SEQ ID NO: 8542852 - DNA, 22 bp, Homo sapiens
ccttttgctctcccatccagaa

SEQ ID NO: 8542853 - DNA, 22 bp, Homo sapiens
cctttttccctggagggacagc

SEQ ID NO: 8542854 - DNA, 22 bp, Homo sapiens
cctttttccctggagggacagc

SEQ ID NO: 8542855 - DNA, 22 bp, Homo sapiens
cctttttcaatatagaattgca

SEQ ID NO: 8542856 - DNA, 22 bp, Homo sapiens
ttatccaacatgacttatgtcc

SEQ ID NO: 8542857 - DNA, 22 bp, Homo sapiens
ttatccaagcagaagctgcaca

SEQ ID NO: 8542858 - DNA, 22 bp, Homo sapiens
cctttggtaacattccaacctt

SEQ ID NO: 8542859 - DNA, 22 bp, Homo sapiens
ccttttctatccttctaggttc

SEQ ID NO: 8542860 - DNA, 22 bp, Homo sapiens
ccttttctatgtaccagcagtg

SEQ ID NO: 8542861 - DNA, 22 bp, Homo sapiens
ccttttctatgtaccagcagtg

SEQ ID NO: 8542862 - DNA, 16 bp, Homo sapiens
ccttttctcatctcta

SEQ ID NO: 8542863 - DNA, 22 bp, Homo sapiens
ccttttctaggatgctttatag

SEQ ID NO: 8542864 - DNA, 22 bp, Homo sapiens
ccttttctagaaagggaggcaa

SEQ ID NO: 8542865 - DNA, 22 bp, Homo sapiens
ccttttctaatcttaagaatgt

SEQ ID NO: 8542866 - DNA, 22 bp, Homo sapiens
ccttttctacaagcaaatgtgc

SEQ ID NO: 8542867 - DNA, 22 bp, Homo sapiens
ttattgcaaccttttctggtgt

SEQ ID NO: 8542868 - DNA, 22 bp, Homo sapiens
ttattcagcatttagaggaagg

SEQ ID NO: 8542869 - DNA, 22 bp, Homo sapiens
ttattcagcatttagaggaagg

SEQ ID NO: 8542870 - DNA, 22 bp, Homo sapiens
ttattcaggaaggtgttactta

SEQ ID NO: 8542871 - DNA, 22 bp, Homo sapiens
ttattcagctctctagaggcac

SEQ ID NO: 8542872 - DNA, 22 bp, Homo sapiens
ttattcagcagggacttccttt

SEQ ID NO: 8542873 - DNA, 22 bp, Homo sapiens
ttattcagattggctacaggat

SEQ ID NO: 8542874 - DNA, 22 bp, Homo sapiens
cgagatccttcagagcgcggac

SEQ ID NO: 8542875 - DNA, 22 bp, Homo sapiens
cgagagttagctaggagtcaca

SEQ ID NO: 8542876 - DNA, 22 bp, Homo sapiens
cgagagttagctaggagtcaca

SEQ ID NO: 8542877 - DNA, 22 bp, Homo sapiens
cgagagttagctaggagtcaca

SEQ ID NO: 8542878 - DNA, 22 bp, Homo sapiens
cgaacacacttgggagttctga

SEQ ID NO: 8542879 - DNA, 22 bp, Homo sapiens
ccttttttctatgccaactctg

SEQ ID NO: 8542880 - DNA, 22 bp, Homo sapiens
cgaaaatagatctgtttcccag

SEQ ID NO: 8542881 - DNA, 19 bp, Homo sapiens
ccttttttaacttcagcaa

SEQ ID NO: 8542882 - DNA, 22 bp, Homo sapiens
cctttttctgagttgtagcttc

SEQ ID NO: 8542883 - DNA, 22 bp, Homo sapiens
cgagaggctggacagggctggg

SEQ ID NO: 8542884 - DNA, 22 bp, Homo sapiens
cgagagatgggttggcaggggc

SEQ ID NO: 8542885 - DNA, 22 bp, Homo sapiens
cgacgggctcggtccgcttcct

SEQ ID NO: 8542886 - DNA, 22 bp, Homo sapiens
cgaagacagaccatctgagtag

SEQ ID NO: 8542887 - DNA, 22 bp, Homo sapiens
cgaagacagaccatctgagtag

SEQ ID NO: 8542888 - DNA, 22 bp, Homo sapiens
cgacagcagaagaagcaagcca

SEQ ID NO: 8542889 - DNA, 22 bp, Homo sapiens
ttatttattcattctgtctgtc

SEQ ID NO: 8542890 - DNA, 22 bp, Homo sapiens
ttatttattcattctgtctgtc

SEQ ID NO: 8542891 - DNA, 22 bp, Homo sapiens
ttatttatgttaacagtcgaga

SEQ ID NO: 8542892 - DNA, 22 bp, Homo sapiens
ttattgctatggtgagagggat

SEQ ID NO: 8542893 - DNA, 22 bp, Homo sapiens
ttatttatgttaacagtcgaga

SEQ ID NO: 8542894 - DNA, 22 bp, Homo sapiens
ttatttattgtgtacctactgt

SEQ ID NO: 8542895 - DNA, 22 bp, Homo sapiens
ttatttattcattctgtctgtc

SEQ ID NO: 8542896 - DNA, 22 bp, Homo sapiens
ttatttattgtgtacctactgt

SEQ ID NO: 8542897 - DNA, 22 bp, Homo sapiens
ttatttattgtgtacctactgt

SEQ ID NO: 8542898 - DNA, 22 bp, Homo sapiens
ttatttattgtgtacctactgt

SEQ ID NO: 8542899 - DNA, 20 bp, Homo sapiens
ttatttcagttgctagattg

SEQ ID NO: 8542900 - DNA, 20 bp, Homo sapiens
ttatttcagttgctagattg

SEQ ID NO: 8542901 - DNA, 20 bp, Homo sapiens
ttatttcagttgctagattg

SEQ ID NO: 8542902 - DNA, 22 bp, Homo sapiens
ttatttcatataatgttatcaa

SEQ ID NO: 8542903 - DNA, 22 bp, Homo sapiens
ttattgcaactttagggataga

SEQ ID NO: 8542904 - DNA, 22 bp, Homo sapiens
ttattgcaactcctaaatagag

SEQ ID NO: 8542905 - DNA, 17 bp, Homo sapiens
ttattgcagtgctgaag

SEQ ID NO: 8542906 - DNA, 22 bp, Homo sapiens
ttattgcagatggtgtgagaga

SEQ ID NO: 8542907 - DNA, 22 bp, Homo sapiens
ttattgccatcctggaacctag

SEQ ID NO: 8542908 - DNA, 22 bp, Homo sapiens
ttattgcctgattgaggtcatt

SEQ ID NO: 8542909 - DNA, 22 bp, Homo sapiens
cgctgcagatgggagctggttg

SEQ ID NO: 8542910 - DNA, 22 bp, Homo sapiens
cgctgcagaagcgtgttcagga

SEQ ID NO: 8542911 - DNA, 22 bp, Homo sapiens
cgctgccaggtcaccaggggta

SEQ ID NO: 8542912 - DNA, 22 bp, Homo sapiens
cgctgccaggatcccctgccgg

SEQ ID NO: 8542913 - DNA, 22 bp, Homo sapiens
cgctgccttcatcccacgccta

SEQ ID NO: 8542914 - DNA, 22 bp, Homo sapiens
cgctgctccgccttgtccatat

SEQ ID NO: 8542915 - DNA, 22 bp, Homo sapiens
cgctggaaattgccgttggctt

SEQ ID NO: 8542916 - DNA, 22 bp, Homo sapiens
cgctggccatagcctcctgtgt

SEQ ID NO: 8542917 - DNA, 22 bp, Homo sapiens
ttatttcatgtaaaatttatgt

SEQ ID NO: 8542918 - DNA, 16 bp, Homo sapiens
cgcctccctccctcgc

SEQ ID NO: 8542919 - DNA, 22 bp, Homo sapiens
cgcctcagccgtggtcatcttc

SEQ ID NO: 8542920 - DNA, 22 bp, Homo sapiens
cgcctcagccgtggtcatcttc

SEQ ID NO: 8542921 - DNA, 20 bp, Homo sapiens
cgctccagtcgctggtgtgt

SEQ ID NO: 8542922 - DNA, 22 bp, Homo sapiens
cgctgataaacgtcacgttccc

SEQ ID NO: 8542923 - DNA, 19 bp, Homo sapiens
cgctctgggtttcgtgtca

SEQ ID NO: 8542924 - DNA, 22 bp, Homo sapiens
cgctctggagaatagtagcttt

SEQ ID NO: 8542925 - DNA, 22 bp, Homo sapiens
cggggctgcgctcttcctgccg

SEQ ID NO: 8542926 - DNA, 22 bp, Homo sapiens
cggggctgctcgtcctcctgtg

SEQ ID NO: 8542927 - DNA, 22 bp, Homo sapiens
cggggctgacagcaggtgtgct

SEQ ID NO: 8542928 - DNA, 22 bp, Homo sapiens
cggggcctagtctacctcggca

SEQ ID NO: 8542929 - DNA, 22 bp, Homo sapiens
cggggcctagctgcacaccctc

SEQ ID NO: 8542930 - DNA, 22 bp, Homo sapiens
cggggccctggggctgaaggtc

SEQ ID NO: 8542931 - DNA, 22 bp, Homo sapiens
cggggccctggggctgaaggtc

SEQ ID NO: 8542932 - DNA, 22 bp, Homo sapiens
cgtgggaggaaaaatgggcttc

SEQ ID NO: 8542933 - DNA, 22 bp, Homo sapiens
cgtgggagtggtgggtgctcag

SEQ ID NO: 8542934 - DNA, 22 bp, Homo sapiens
cgtggtctcccacagaaagaag

SEQ ID NO: 8542935 - DNA, 22 bp, Homo sapiens
cgtgagcaaaatggacactccc

SEQ ID NO: 8542936 - DNA, 22 bp, Homo sapiens
cgtggctggtggacctgagggc

SEQ ID NO: 8542937 - DNA, 22 bp, Homo sapiens
cgtggctggtggacctgagggc

SEQ ID NO: 8542938 - DNA, 22 bp, Homo sapiens
cgtgagcaaaatggacactccc

SEQ ID NO: 8542939 - DNA, 22 bp, Homo sapiens
cgtgagcaaaatggacactccc

SEQ ID NO: 8542940 - DNA, 22 bp, Homo sapiens
cgggcaaggcgagactaggccc

SEQ ID NO: 8542941 - DNA, 22 bp, Homo sapiens
cgggcaaggcgagactaggccc

SEQ ID NO: 8542942 - DNA, 22 bp, Homo sapiens
cgggcaaggcgagactaggccc

SEQ ID NO: 8542943 - DNA, 22 bp, Homo sapiens
cgggctggctgcagctgctgga

SEQ ID NO: 8542944 - DNA, 22 bp, Homo sapiens
cggggacacactggcagctcct

SEQ ID NO: 8542945 - DNA, 22 bp, Homo sapiens
cggggaagcggttctggcggta

SEQ ID NO: 8542946 - DNA, 22 bp, Homo sapiens
cggggaggcttcggattaaagc

SEQ ID NO: 8542947 - DNA, 22 bp, Homo sapiens
cggggagaacactgtgtccttc

SEQ ID NO: 8542948 - DNA, 22 bp, Homo sapiens
cggggaggcttcggattaaagc

SEQ ID NO: 8542949 - DNA, 22 bp, Homo sapiens
cggggcagaaagttgtcttttg

SEQ ID NO: 8542950 - DNA, 22 bp, Homo sapiens
cggggcagagggtcttctccag

SEQ ID NO: 8542951 - DNA, 22 bp, Homo sapiens
cggggcagagggtcttctccag

SEQ ID NO: 8542952 - DNA, 22 bp, Homo sapiens
cggggcagagggtcttctccag

SEQ ID NO: 8542953 - DNA, 22 bp, Homo sapiens
cggggcaggagtccctgtagag

SEQ ID NO: 8542954 - DNA, 22 bp, Homo sapiens
cggggagggcagaggctccctc

SEQ ID NO: 8542955 - DNA, 22 bp, Homo sapiens
cggggagggcagaggctccctc

SEQ ID NO: 8542956 - DNA, 22 bp, Homo sapiens
cggggagggcagaggctccctc

SEQ ID NO: 8542957 - DNA, 22 bp, Homo sapiens
cggggcaggagtccctgtagag

SEQ ID NO: 8542958 - DNA, 22 bp, Homo sapiens
cggggccctggggctgaaggtc

SEQ ID NO: 8542959 - DNA, 22 bp, Homo sapiens
cggggccctggggctgaaggtc

SEQ ID NO: 8542960 - DNA, 22 bp, Homo sapiens
cggggccctggggctgaaggtc

SEQ ID NO: 8542961 - DNA, 22 bp, Homo sapiens
cggggccctggggctgaaggtc

SEQ ID NO: 8542962 - DNA, 22 bp, Homo sapiens
cggggccctggggctgaaggtc

SEQ ID NO: 8542963 - DNA, 22 bp, Homo sapiens
cggatcctcagtcgtgcgggag

SEQ ID NO: 8542964 - DNA, 22 bp, Homo sapiens
cggcagagacggcgctttgaac

SEQ ID NO: 8542965 - DNA, 18 bp, Homo sapiens
cggatcatgcgctgaggc

SEQ ID NO: 8542966 - DNA, 22 bp, Homo sapiens
cggatcatgtgacctttgagtg

SEQ ID NO: 8542967 - DNA, 22 bp, Homo sapiens
cggcagagcttcctgctcagcg

SEQ ID NO: 8542968 - DNA, 22 bp, Homo sapiens
cggcagagcttcctgctcagcg

SEQ ID NO: 8542969 - DNA, 22 bp, Homo sapiens
cggcagagcggcgagcccctcc

SEQ ID NO: 8542970 - DNA, 22 bp, Homo sapiens
cggcagagccctgagtcagcct

SEQ ID NO: 8542971 - DNA, 22 bp, Homo sapiens
cggcagagacggcgctttgaac

SEQ ID NO: 8542972 - DNA, 22 bp, Homo sapiens
cggcagagccctgagtcagcct

SEQ ID NO: 8542973 - DNA, 22 bp, Homo sapiens
cggcagcatcgaaactacattc

SEQ ID NO: 8542974 - DNA, 22 bp, Homo sapiens
cggcagcaaaggaagccaggtc

SEQ ID NO: 8542975 - DNA, 22 bp, Homo sapiens
cggcagcaaaggaagccaggtc

SEQ ID NO: 8542976 - DNA, 22 bp, Homo sapiens
cggcagagtgtgtgcgtgcatg

SEQ ID NO: 8542977 - DNA, 22 bp, Homo sapiens
cggcagagcttcctgctcagcg

SEQ ID NO: 8542978 - DNA, 22 bp, Homo sapiens
cggcagagcttcctgctcagcg

SEQ ID NO: 8542979 - DNA, 18 bp, Homo sapiens
cggcagagtgcttctagc

SEQ ID NO: 8542980 - DNA, 18 bp, Homo sapiens
cggcagagtgcttctagc

SEQ ID NO: 8542981 - DNA, 22 bp, Homo sapiens
ttcaaatgatggcagtcctggc

SEQ ID NO: 8542982 - DNA, 22 bp, Homo sapiens
ttcaaatcactttggagcttaa

SEQ ID NO: 8542983 - DNA, 22 bp, Homo sapiens
ttcaaatcactttggagcttaa

SEQ ID NO: 8542984 - DNA, 22 bp, Homo sapiens
ttcaaatccctgctccactatt

SEQ ID NO: 8542985 - DNA, 21 bp, Homo sapiens
ttcaaagtttgcctaaagatt

SEQ ID NO: 8542986 - DNA, 22 bp, Homo sapiens
ttcaaagttgcatgacagctta

SEQ ID NO: 8542987 - DNA, 20 bp, Homo sapiens
ttcaaagtgtatgatatgca

SEQ ID NO: 8542988 - DNA, 22 bp, Homo sapiens
ttcaaagtgtgacctgacaagc

SEQ ID NO: 8542989 - DNA, 22 bp, Homo sapiens
ttcaaagtgcatgttcctcaga

SEQ ID NO: 8542990 - DNA, 22 bp, Homo sapiens
ttcaaagtcctgtcaggtagcc

SEQ ID NO: 8542991 - DNA, 22 bp, Homo sapiens
cggaggttgaggctgcagtgag

SEQ ID NO: 8542992 - DNA, 22 bp, Homo sapiens
cggaggttgaggctgcagtgag

SEQ ID NO: 8542993 - DNA, 22 bp, Homo sapiens
cggagaggtgggggcagcatct

SEQ ID NO: 8542994 - DNA, 22 bp, Homo sapiens
cggagtcttgctatgttgccca

SEQ ID NO: 8542995 - DNA, 22 bp, Homo sapiens
cggagtcttgctatgttgccca

SEQ ID NO: 8542996 - DNA, 22 bp, Homo sapiens
cggagtcttgctatgttgccca

SEQ ID NO: 8542997 - DNA, 22 bp, Homo sapiens
cggagtcttgctatgttgccca

SEQ ID NO: 8542998 - DNA, 22 bp, Homo sapiens
cggagtcttgctatgttgccca

SEQ ID NO: 8542999 - DNA, 22 bp, Homo sapiens
ttcaaatgcaagttactacttt

SEQ ID NO: 8543000 - DNA, 22 bp, Homo sapiens
ttcaaatggttagactgttagc

SEQ ID NO: 8543001 - DNA, 20 bp, Homo sapiens
cggactttcttctcagggca

SEQ ID NO: 8543002 - DNA, 22 bp, Homo sapiens
cggagaggacctgcaactcgct

SEQ ID NO: 8543003 - DNA, 22 bp, Homo sapiens
ttacagtttaagaggaaacaaa

SEQ ID NO: 8543004 - DNA, 22 bp, Homo sapiens
ttacagttgttctatcagcatg

SEQ ID NO: 8543005 - DNA, 22 bp, Homo sapiens
ttacagtttaccaagaatattg

SEQ ID NO: 8543006 - DNA, 22 bp, Homo sapiens
ttacagttaggtgtgtagtggt

SEQ ID NO: 8543007 - DNA, 22 bp, Homo sapiens
ttacagttagaatctgatgaaa

SEQ ID NO: 8543008 - DNA, 22 bp, Homo sapiens
ttacagttactggtactgttaa

SEQ ID NO: 8543009 - DNA, 22 bp, Homo sapiens
ttacagaagtttcagcgtttta

SEQ ID NO: 8543010 - DNA, 22 bp, Homo sapiens
ttacagtgttacttgatgtcca

SEQ ID NO: 8543011 - DNA, 22 bp, Homo sapiens
ttacaaagcgttgagacaagta

SEQ ID NO: 8543012 - DNA, 22 bp, Homo sapiens
ttacaaagcgctttacctctga

SEQ ID NO: 8543013 - DNA, 22 bp, Homo sapiens
ttacaaagcgttgagacaagta

SEQ ID NO: 8543014 - DNA, 22 bp, Homo sapiens
ttacaaagcaggtcagctgaaa

SEQ ID NO: 8543015 - DNA, 22 bp, Homo sapiens
ttacaaagcgctttacctctga

SEQ ID NO: 8543016 - DNA, 22 bp, Homo sapiens
ttacaaagagtgttcttttcca

SEQ ID NO: 8543017 - DNA, 22 bp, Homo sapiens
ttacaaagattatattcagtta

SEQ ID NO: 8543018 - DNA, 22 bp, Homo sapiens
ttacaaagattatattcagtta

SEQ ID NO: 8543019 - DNA, 21 bp, Homo sapiens
ttacaaagcaagtgctgtgtc

SEQ ID NO: 8543020 - DNA, 22 bp, Homo sapiens
ttacaaagcaggtcagctgaaa

SEQ ID NO: 8543021 - DNA, 22 bp, Homo sapiens
ttacaaagattatattcagtta

SEQ ID NO: 8543022 - DNA, 22 bp, Homo sapiens
ccttaaaagaactatctcttct

SEQ ID NO: 8543023 - DNA, 22 bp, Homo sapiens
ccttaaaagaactatctcttct

SEQ ID NO: 8543024 - DNA, 22 bp, Homo sapiens
ccttacaatgcagtttacttag

SEQ ID NO: 8543025 - DNA, 22 bp, Homo sapiens
ccttacacctaaaatgagagtt

SEQ ID NO: 8543026 - DNA, 22 bp, Homo sapiens
ccttaaattctccatttgaaag

SEQ ID NO: 8543027 - DNA, 22 bp, Homo sapiens
ttaagcatggaagtgaaataat

SEQ ID NO: 8543028 - DNA, 18 bp, Homo sapiens
cctgtgtgtgttgcaggc

SEQ ID NO: 8543029 - DNA, 22 bp, Homo sapiens
cctgtgtgtctgtcactgcaca

SEQ ID NO: 8543030 - DNA, 21 bp, Homo sapiens
cctgtgtgtgtccctttaaga

SEQ ID NO: 8543031 - DNA, 21 bp, Homo sapiens
cctgtgtgtgtccctttaaga

SEQ ID NO: 8543032 - DNA, 22 bp, Homo sapiens
cctgtgtgtctgtcactgcaca

SEQ ID NO: 8543033 - DNA, 22 bp, Homo sapiens
ttacaaagagtgccagagtgtg

SEQ ID NO: 8543034 - DNA, 22 bp, Homo sapiens
ccttagtgtgcctgaggcagat

SEQ ID NO: 8543035 - DNA, 22 bp, Homo sapiens
ccttagtgtgaggggatacccc

SEQ ID NO: 8543036 - DNA, 22 bp, Homo sapiens
ccttagtgaaacagaggcaatt

SEQ ID NO: 8543037 - DNA, 17 bp, Homo sapiens
ccttagggcagtgtggt

SEQ ID NO: 8543038 - DNA, 22 bp, Homo sapiens
ccttagctggagtggtggaatg

SEQ ID NO: 8543039 - DNA, 22 bp, Homo sapiens
ccttacaatgcagtttacttag

SEQ ID NO: 8543040 - DNA, 22 bp, Homo sapiens
ttaaattgtcatttgagcaatg

SEQ ID NO: 8543041 - DNA, 22 bp, Homo sapiens
ttaaattccagcctcataatag

SEQ ID NO: 8543042 - DNA, 22 bp, Homo sapiens
ttaaattccagcctcataatag

SEQ ID NO: 8543043 - DNA, 22 bp, Homo sapiens
ttaaattccagcctcataatag

SEQ ID NO: 8543044 - DNA, 22 bp, Homo sapiens
ttaaatttctacgtgatccagg

SEQ ID NO: 8543045 - DNA, 22 bp, Homo sapiens
ttaaattattgagggattgtca

SEQ ID NO: 8543046 - DNA, 22 bp, Homo sapiens
ttaaattatttctagtgaggtg

SEQ ID NO: 8543047 - DNA, 22 bp, Homo sapiens
ttaaattatttctagtgaggtg

SEQ ID NO: 8543048 - DNA, 22 bp, Homo sapiens
ttaaattccagcctcataatag

SEQ ID NO: 8543049 - DNA, 22 bp, Homo sapiens
ttaaattccagcctcataatag

SEQ ID NO: 8543050 - DNA, 22 bp, Homo sapiens
ttaaattcattccaacttttga

SEQ ID NO: 8543051 - DNA, 22 bp, Homo sapiens
ttaaattatttctagtgaggtg

SEQ ID NO: 8543052 - DNA, 22 bp, Homo sapiens
ttaagaggtggtcgtgtctgtg

SEQ ID NO: 8543053 - DNA, 22 bp, Homo sapiens
ttaagatagaacccagtagtct

SEQ ID NO: 8543054 - DNA, 22 bp, Homo sapiens
ttaagatcaagataagcaataa

SEQ ID NO: 8543055 - DNA, 22 bp, Homo sapiens
ttaagatttgtagagaaaaagc

SEQ ID NO: 8543056 - DNA, 22 bp, Homo sapiens
ttaagatttgtagagaaaaagc

SEQ ID NO: 8543057 - DNA, 22 bp, Homo sapiens
ttaagattttcttcagtattat

SEQ ID NO: 8543058 - DNA, 22 bp, Homo sapiens
ttaagaggagatcatactggag

SEQ ID NO: 8543059 - DNA, 22 bp, Homo sapiens
ttaagaggagatcatactggag

SEQ ID NO: 8543060 - DNA, 22 bp, Homo sapiens
ttaagagggtgatgctagcatt

SEQ ID NO: 8543061 - DNA, 22 bp, Homo sapiens
ttaagaggtgaggcctttaaga

SEQ ID NO: 8543062 - DNA, 22 bp, Homo sapiens
ttaagagggtgatgctagcatt

SEQ ID NO: 8543063 - DNA, 22 bp, Homo sapiens
ttaagaggtggtcgtgtctgtg

SEQ ID NO: 8543064 - DNA, 22 bp, Homo sapiens
ttaagaggtgaggcctttaaga

SEQ ID NO: 8543065 - DNA, 22 bp, Homo sapiens
tgtcagcagatctcctgcagcc

SEQ ID NO: 8543066 - DNA, 22 bp, Homo sapiens
tgtcagcagaagtggtgcactc

SEQ ID NO: 8543067 - DNA, 22 bp, Homo sapiens
tgtcagcatcatttgttgaagg

SEQ ID NO: 8543068 - DNA, 22 bp, Homo sapiens
tgtcagccttgctttagcggtt

SEQ ID NO: 8543069 - DNA, 22 bp, Homo sapiens
ttaaattagtcaagcttctctg

SEQ ID NO: 8543070 - DNA, 22 bp, Homo sapiens
ttaaattagtcaagcttctctg

SEQ ID NO: 8543071 - DNA, 22 bp, Homo sapiens
ttaaatagtaggtctattttgg

SEQ ID NO: 8543072 - DNA, 22 bp, Homo sapiens
ttaaatagtaggtctattttgg

SEQ ID NO: 8543073 - DNA, 22 bp, Homo sapiens
ttaaatagctcttgtagaagaa

SEQ ID NO: 8543074 - DNA, 22 bp, Homo sapiens
tgtcagcacatctgtaatcaca

SEQ ID NO: 8543075 - DNA, 22 bp, Homo sapiens
tgtcagcagaaatctggtctgc

SEQ ID NO: 8543076 - DNA, 21 bp, Homo sapiens
tgtcagcacgcatgaggccag

SEQ ID NO: 8543077 - DNA, 22 bp, Homo sapiens
tgtcagcaccatgggtagtgat

SEQ ID NO: 8543078 - DNA, 22 bp, Homo sapiens
tgtcagaggctcagggtctcag

SEQ ID NO: 8543079 - DNA, 22 bp, Homo sapiens
tgtcaatagttttgagttctct

SEQ ID NO: 8543080 - DNA, 22 bp, Homo sapiens
tgtcagacacagccagagactg

SEQ ID NO: 8543081 - DNA, 22 bp, Homo sapiens
tgtcagacctgtgatttcagca

SEQ ID NO: 8543082 - DNA, 21 bp, Homo sapiens
tgtcagagcttgtaggacatt

SEQ ID NO: 8543083 - DNA, 23 bp, Homo sapiens
ttataaatattttcaggtgtgtt

SEQ ID NO: 8543084 - DNA, 22 bp, Homo sapiens
ttataaagtgagaagtgctatg

SEQ ID NO: 8543085 - DNA, 22 bp, Homo sapiens
ttataaagtgagaagtgctatg

SEQ ID NO: 8543086 - DNA, 22 bp, Homo sapiens
ttataacaacagtttactttaa

SEQ ID NO: 8543087 - DNA, 22 bp, Homo sapiens
ttataacaacagtttactttaa

SEQ ID NO: 8543088 - DNA, 22 bp, Homo sapiens
ttatattagttagacttgctgt

SEQ ID NO: 8543089 - DNA, 22 bp, Homo sapiens
ttataacatcaatcagagttaa

SEQ ID NO: 8543090 - DNA, 22 bp, Homo sapiens
ttataacatcaatcagagttaa

SEQ ID NO: 8543091 - DNA, 22 bp, Homo sapiens
ttatcagagtccccaaaagaaa

SEQ ID NO: 8543092 - DNA, 22 bp, Homo sapiens
ttatcagttgtgtgtatacacg

SEQ ID NO: 8543093 - DNA, 22 bp, Homo sapiens
ttatcagttgtgtgtatacacg

SEQ ID NO: 8543094 - DNA, 22 bp, Homo sapiens
ttatccaaactggtgaatcatt

SEQ ID NO: 8543095 - DNA, 22 bp, Homo sapiens
ttatcattgtcgcagtctaatt

SEQ ID NO: 8543096 - DNA, 22 bp, Homo sapiens
ttatatttctggtagccttcag

SEQ ID NO: 8543097 - DNA, 22 bp, Homo sapiens
ttatatttctggtagccttcag

SEQ ID NO: 8543098 - DNA, 22 bp, Homo sapiens
ttatatttctggtagccttcag

SEQ ID NO: 8543099 - DNA, 22 bp, Homo sapiens
ttatcacttatgagctttttgc

SEQ ID NO: 8543100 - DNA, 22 bp, Homo sapiens
ccttgcatttaaaggcgtaggg

SEQ ID NO: 8543101 - DNA, 22 bp, Homo sapiens
ccttgcatatattatatctttg

SEQ ID NO: 8543102 - DNA, 22 bp, Homo sapiens
ccttgcaggggaacaggcagtg

SEQ ID NO: 8543103 - DNA, 22 bp, Homo sapiens
ccttgagccagggagctggcag

SEQ ID NO: 8543104 - DNA, 22 bp, Homo sapiens
ccttgagccagggagctggcag

SEQ ID NO: 8543105 - DNA, 22 bp, Homo sapiens
ccttgaaatgttctcactgggg

SEQ ID NO: 8543106 - DNA, 22 bp, Homo sapiens
ccttgactgccttcaggctggg

SEQ ID NO: 8543107 - DNA, 22 bp, Homo sapiens
ttagggaaacaaacattttctt

SEQ ID NO: 8543108 - DNA, 22 bp, Homo sapiens
ccttgcctcattgtgcttctcc

SEQ ID NO: 8543109 - DNA, 22 bp, Homo sapiens
ttagggaaagcagcattccctt

SEQ ID NO: 8543110 - DNA, 22 bp, Homo sapiens
ttagggaaataaaattatcagt

SEQ ID NO: 8543111 - DNA, 22 bp, Homo sapiens
ttagttttcccatctttatggt

SEQ ID NO: 8543112 - DNA, 22 bp, Homo sapiens
ttagttttctcatctatctcac

SEQ ID NO: 8543113 - DNA, 22 bp, Homo sapiens
ttagttttcccatctttatggt

SEQ ID NO: 8543114 - DNA, 22 bp, Homo sapiens
ttataaagattgttatgtatct

SEQ ID NO: 8543115 - DNA, 22 bp, Homo sapiens
ttataaagattgttatgtatct

SEQ ID NO: 8543116 - DNA, 22 bp, Homo sapiens
ttagttttctcatctatctcac

SEQ ID NO: 8543117 - DNA, 22 bp, Homo sapiens
ttacataacggtatgaaaaatg

SEQ ID NO: 8543118 - DNA, 22 bp, Homo sapiens
ttacataacggtatgaaaaatg

SEQ ID NO: 8543119 - DNA, 22 bp, Homo sapiens
ttacatacttactagatctatg

SEQ ID NO: 8543120 - DNA, 22 bp, Homo sapiens
ttacataactttaaaatgccgt

SEQ ID NO: 8543121 - DNA, 22 bp, Homo sapiens
ccttcaaactttcattaaccag

SEQ ID NO: 8543122 - DNA, 22 bp, Homo sapiens
ccttcaaagtacacatctttat

SEQ ID NO: 8543123 - DNA, 22 bp, Homo sapiens
ccttcagacctagacaggaatc

SEQ ID NO: 8543124 - DNA, 22 bp, Homo sapiens
ccttcagaatgaaattctaatg

SEQ ID NO: 8543125 - DNA, 22 bp, Homo sapiens
ccttcagaggtgtagattgcgt

SEQ ID NO: 8543126 - DNA, 22 bp, Homo sapiens
ccttcagaatgaaattctaatg

SEQ ID NO: 8543127 - DNA, 23 bp, Homo sapiens
ccttcagaagaagtaacaggggc

SEQ ID NO: 8543128 - DNA, 22 bp, Homo sapiens
ccttcagccagttttctttgtt

SEQ ID NO: 8543129 - DNA, 22 bp, Homo sapiens
ccttcagccttcatccttcctt

SEQ ID NO: 8543130 - DNA, 22 bp, Homo sapiens
ccttcagcctcaagatccttca

SEQ ID NO: 8543131 - DNA, 22 bp, Homo sapiens
ccttcagcctagaacttgagag

SEQ ID NO: 8543132 - DNA, 22 bp, Homo sapiens
ccttcaaatttagaacaagtga

SEQ ID NO: 8543133 - DNA, 22 bp, Homo sapiens
ccttcaatcagcagtctagctt

SEQ ID NO: 8543134 - DNA, 22 bp, Homo sapiens
ccttcaagttcctggtccctgg

SEQ ID NO: 8543135 - DNA, 22 bp, Homo sapiens
ccttcacactttcacttggata

SEQ ID NO: 8543136 - DNA, 23 bp, Homo sapiens
ccttcagaagaagtaacaggggc

SEQ ID NO: 8543137 - DNA, 22 bp, Homo sapiens
ccttcacacaggtagaagcaga

SEQ ID NO: 8543138 - DNA, 22 bp, Homo sapiens
ccttcaatcttaagtcagccca

SEQ ID NO: 8543139 - DNA, 22 bp, Homo sapiens
ccttcacaccatctttaccagg

SEQ ID NO: 8543140 - DNA, 22 bp, Homo sapiens
ttagcaagataacagtaatttt

SEQ ID NO: 8543141 - DNA, 22 bp, Homo sapiens
ttagcaaatatcttgaaacagg

SEQ ID NO: 8543142 - DNA, 22 bp, Homo sapiens
ttagcaagaaagattgcagcac

SEQ ID NO: 8543143 - DNA, 22 bp, Homo sapiens
ttagcaaatttccaggtgatgc

SEQ ID NO: 8543144 - DNA, 22 bp, Homo sapiens
ttagcactggattaatcaaagt

SEQ ID NO: 8543145 - DNA, 22 bp, Homo sapiens
ttagcactggatttcatcagaa

SEQ ID NO: 8543146 - DNA, 21 bp, Homo sapiens
ttagcaaagcaaacacatgct

SEQ ID NO: 8543147 - DNA, 21 bp, Homo sapiens
ttagcaaagcaaacacatgct

SEQ ID NO: 8543148 - DNA, 21 bp, Homo sapiens
ttagcaaagcaaacacatgct

SEQ ID NO: 8543149 - DNA, 22 bp, Homo sapiens
ttagcaaactctgttagattct

SEQ ID NO: 8543150 - DNA, 22 bp, Homo sapiens
ttagcaaagtttgccatctagt

SEQ ID NO: 8543151 - DNA, 22 bp, Homo sapiens
ttagcaaatatcttgaaacagg

SEQ ID NO: 8543152 - DNA, 22 bp, Homo sapiens
ttagcaaagtttgccatctagt

SEQ ID NO: 8543153 - DNA, 22 bp, Homo sapiens
ttagcaaagtttgccatctagt

SEQ ID NO: 8543154 - DNA, 18 bp, Homo sapiens
ccttcagctctgccagta

SEQ ID NO: 8543155 - DNA, 18 bp, Homo sapiens
ccttcagctctgccagta

SEQ ID NO: 8543156 - DNA, 22 bp, Homo sapiens
ccttcagcgtcccctttacccg

SEQ ID NO: 8543157 - DNA, 22 bp, Homo sapiens
ccttcagcgtcccctttacccg

SEQ ID NO: 8543158 - DNA, 22 bp, Homo sapiens
ccttcagcctttgtttatcaga

SEQ ID NO: 8543159 - DNA, 22 bp, Homo sapiens
ttagacaggatgtatgaaagct

SEQ ID NO: 8543160 - DNA, 22 bp, Homo sapiens
ttagcaaactctgttagattct

SEQ ID NO: 8543161 - DNA, 22 bp, Homo sapiens
ttagacatagaatattgtctag

SEQ ID NO: 8543162 - DNA, 22 bp, Homo sapiens
ctcaggaggtggtagaggccct

SEQ ID NO: 8543163 - DNA, 22 bp, Homo sapiens
ctcaggaggtggtagaggccct

SEQ ID NO: 8543164 - DNA, 22 bp, Homo sapiens
ctcaggaggtggtagaggccct

SEQ ID NO: 8543165 - DNA, 22 bp, Homo sapiens
ctcaggaggtggtagaggccct

SEQ ID NO: 8543166 - DNA, 22 bp, Homo sapiens
ctcaggaggtttcctgtctagg

SEQ ID NO: 8543167 - DNA, 22 bp, Homo sapiens
ctcaggagtagttcagcagctg

SEQ ID NO: 8543168 - DNA, 22 bp, Homo sapiens
ctcaggaggtttcctgtctagg

SEQ ID NO: 8543169 - DNA, 22 bp, Homo sapiens
ctcaggaggatgactgccttgg

SEQ ID NO: 8543170 - DNA, 22 bp, Homo sapiens
ctcaggaggccattctcaaggt

SEQ ID NO: 8543171 - DNA, 22 bp, Homo sapiens
ctcaggagatgacagaaggtat

SEQ ID NO: 8543172 - DNA, 22 bp, Homo sapiens
ctcaggagcttcctcagcccat

SEQ ID NO: 8543173 - DNA, 22 bp, Homo sapiens
ctcaggaggaggaagttcattg

SEQ ID NO: 8543174 - DNA, 22 bp, Homo sapiens
ctcaggaggaggaagttcattg

SEQ ID NO: 8543175 - DNA, 22 bp, Homo sapiens
ttgcataaagattttattgcat

SEQ ID NO: 8543176 - DNA, 22 bp, Homo sapiens
ttgcataaaagagtatatctta

SEQ ID NO: 8543177 - DNA, 22 bp, Homo sapiens
ttgcataaatgcttaaaatttg

SEQ ID NO: 8543178 - DNA, 23 bp, Homo sapiens
ttgcatagacatcctcatagatt

SEQ ID NO: 8543179 - DNA, 22 bp, Homo sapiens
ttgcatagtgctgaggttcggg

SEQ ID NO: 8543180 - DNA, 22 bp, Homo sapiens
ttgcagaacttaaagacagagt

SEQ ID NO: 8543181 - DNA, 22 bp, Homo sapiens
ctcaggagagtcttatatctcc

SEQ ID NO: 8543182 - DNA, 22 bp, Homo sapiens
ctcaggagatgacagaaggtat

SEQ ID NO: 8543183 - DNA, 22 bp, Homo sapiens
ctcaggagatgacagaaggtat

SEQ ID NO: 8543184 - DNA, 22 bp, Homo sapiens
ctcaggagatgacagaaggtat

SEQ ID NO: 8543185 - DNA, 22 bp, Homo sapiens
ctcaggagatgacagaaggtat

SEQ ID NO: 8543186 - DNA, 22 bp, Homo sapiens
ctcaggagatgacagaaggtat

SEQ ID NO: 8543187 - DNA, 22 bp, Homo sapiens
ctcaggagatgacagaaggtat

SEQ ID NO: 8543188 - DNA, 22 bp, Homo sapiens
ctcaggagacagtgtccacatg

SEQ ID NO: 8543189 - DNA, 22 bp, Homo sapiens
ctcaggagacagtgtccacatg

SEQ ID NO: 8543190 - DNA, 22 bp, Homo sapiens
ctcaggagacagtgtccacatg

SEQ ID NO: 8543191 - DNA, 22 bp, Homo sapiens
ctcaggactttcaaatagaaat

SEQ ID NO: 8543192 - DNA, 22 bp, Homo sapiens
ctcaggacccggtccaggtggg

SEQ ID NO: 8543193 - DNA, 22 bp, Homo sapiens
ctcaggacagattccagagaaa

SEQ ID NO: 8543194 - DNA, 22 bp, Homo sapiens
ctcaggacccggtccaggtggg

SEQ ID NO: 8543195 - DNA, 22 bp, Homo sapiens
ctcaggacggccgggggagcct

SEQ ID NO: 8543196 - DNA, 22 bp, Homo sapiens
ctcaggaaggaagcagggagcc

SEQ ID NO: 8543197 - DNA, 22 bp, Homo sapiens
ctcaggaaaggccatgcaaggg

SEQ ID NO: 8543198 - DNA, 22 bp, Homo sapiens
ctcaggaaaatattgaagaagt

SEQ ID NO: 8543199 - DNA, 22 bp, Homo sapiens
ctcaggaaaggccatgcaaggg

SEQ ID NO: 8543200 - DNA, 22 bp, Homo sapiens
ctcaggaaccgcggcagcagcc

SEQ ID NO: 8543201 - DNA, 22 bp, Homo sapiens
ctcagcttctacctcctgagtg

SEQ ID NO: 8543202 - DNA, 22 bp, Homo sapiens
ctcagaggcaagcaaggagctg

SEQ ID NO: 8543203 - DNA, 23 bp, Homo sapiens
ctcagaggcctgtccagggtggt

SEQ ID NO: 8543204 - DNA, 22 bp, Homo sapiens
ctcagccccaatttgccctctt

SEQ ID NO: 8543205 - DNA, 22 bp, Homo sapiens
ctcagctggcaattctggctcc

SEQ ID NO: 8543206 - DNA, 19 bp, Homo sapiens
ctcagctgtagctcatgtg

SEQ ID NO: 8543207 - DNA, 22 bp, Homo sapiens
ctcagggcttgagtgtccagga

SEQ ID NO: 8543208 - DNA, 22 bp, Homo sapiens
ctcagggctggaaagccaggaa

SEQ ID NO: 8543209 - DNA, 22 bp, Homo sapiens
ctcagggggaatcaggtcacag

SEQ ID NO: 8543210 - DNA, 22 bp, Homo sapiens
ctcaggtagagtctgcatgggg

SEQ ID NO: 8543211 - DNA, 22 bp, Homo sapiens
ctcaggtcgctatttctcttac

SEQ ID NO: 8543212 - DNA, 22 bp, Homo sapiens
ctcaggtcacggatctgagctg

SEQ ID NO: 8543213 - DNA, 22 bp, Homo sapiens
ctcagtactttatgtatatgat

SEQ ID NO: 8543214 - DNA, 20 bp, Homo sapiens
ctcagtaaaagcacagggtc

SEQ ID NO: 8543215 - DNA, 22 bp, Homo sapiens
ctcagtaaggatgcttcagcgg

SEQ ID NO: 8543216 - DNA, 22 bp, Homo sapiens
ctcagggctctgcatgcacacg

SEQ ID NO: 8543217 - DNA, 22 bp, Homo sapiens
ctcagggctggaaagccaggaa

SEQ ID NO: 8543218 - DNA, 22 bp, Homo sapiens
ctcagggccaaggatgctgttg

SEQ ID NO: 8543219 - DNA, 18 bp, Homo sapiens
ctcagggcatcagtctgg

SEQ ID NO: 8543220 - DNA, 22 bp, Homo sapiens
ctcagggcagtatggctgagag

SEQ ID NO: 8543221 - DNA, 22 bp, Homo sapiens
ctcagggcagtatggctgagag

SEQ ID NO: 8543222 - DNA, 22 bp, Homo sapiens
ctcagggatggtgaagcaccca

SEQ ID NO: 8543223 - DNA, 22 bp, Homo sapiens
ctcagggatggtgaagcaccca

SEQ ID NO: 8543224 - DNA, 22 bp, Homo sapiens
ttgccctgtcagtagaagtgca

SEQ ID NO: 8543225 - DNA, 22 bp, Homo sapiens
ttgccctgtctcactatgttaa

SEQ ID NO: 8543226 - DNA, 22 bp, Homo sapiens
ttgccctgtcttaagctggcaa

SEQ ID NO: 8543227 - DNA, 22 bp, Homo sapiens
ttgccctgcgggtcctgcgcaa

SEQ ID NO: 8543228 - DNA, 22 bp, Homo sapiens
ttgccctgcgttaccatctctt

SEQ ID NO: 8543229 - DNA, 22 bp, Homo sapiens
ttgccctggggctggcctggca

SEQ ID NO: 8543230 - DNA, 22 bp, Homo sapiens
ttgccctgaagaacgtcccaga

SEQ ID NO: 8543231 - DNA, 22 bp, Homo sapiens
ttgccctgcctccctgaggtga

SEQ ID NO: 8543232 - DNA, 22 bp, Homo sapiens
ttgcccaggctggagtgcagta

SEQ ID NO: 8543233 - DNA, 22 bp, Homo sapiens
ttgcccaggctggagtgcagtg

SEQ ID NO: 8543234 - DNA, 22 bp, Homo sapiens
ttgcatcatttcctggccgtgt

SEQ ID NO: 8543235 - DNA, 22 bp, Homo sapiens
ttgcccagagtccacagcgtac

SEQ ID NO: 8543236 - DNA, 22 bp, Homo sapiens
ttgcatatcctccaacacatgg

SEQ ID NO: 8543237 - DNA, 22 bp, Homo sapiens
ttgcatatcctccaacacatgg

SEQ ID NO: 8543238 - DNA, 22 bp, Homo sapiens
ttgcatatgaagctgacttaaa

SEQ ID NO: 8543239 - DNA, 22 bp, Homo sapiens
ttgcatatcctccaacacatgg

SEQ ID NO: 8543240 - DNA, 22 bp, Homo sapiens
ttgcatatatttctaaggaggt

SEQ ID NO: 8543241 - DNA, 22 bp, Homo sapiens
ttgcatcaaatatgtaccacag

SEQ ID NO: 8543242 - DNA, 22 bp, Homo sapiens
ttgcatatgaagctgacttaaa

SEQ ID NO: 8543243 - DNA, 22 bp, Homo sapiens
ttgcatcacagtatctctgtaa

SEQ ID NO: 8543244 - DNA, 22 bp, Homo sapiens
ttgcatcagaaaatatgggaag

SEQ ID NO: 8543245 - DNA, 22 bp, Homo sapiens
ttggaggtttcccaactgtggg

SEQ ID NO: 8543246 - DNA, 20 bp, Homo sapiens
ttggaggtgcagtgcatgca

SEQ ID NO: 8543247 - DNA, 22 bp, Homo sapiens
ttggaggttattaacactggcc

SEQ ID NO: 8543248 - DNA, 22 bp, Homo sapiens
ttggagtgacagatgaggaaac

SEQ ID NO: 8543249 - DNA, 22 bp, Homo sapiens
ctccactcaacaagcccagtgt

SEQ ID NO: 8543250 - DNA, 22 bp, Homo sapiens
ctccactcaacaagcccagtgt

SEQ ID NO: 8543251 - DNA, 22 bp, Homo sapiens
ttggatccatctcaggcatagg

SEQ ID NO: 8543252 - DNA, 22 bp, Homo sapiens
ttggatccatctcaggcatagg

SEQ ID NO: 8543253 - DNA, 22 bp, Homo sapiens
ttggatccatctcaggcatagg

SEQ ID NO: 8543254 - DNA, 22 bp, Homo sapiens
ttggatcactctgaagccttac

SEQ ID NO: 8543255 - DNA, 22 bp, Homo sapiens
ttggatccatctcaggcatagg

SEQ ID NO: 8543256 - DNA, 20 bp, Homo sapiens
ttggaaggtggagaagagga

SEQ ID NO: 8543257 - DNA, 20 bp, Homo sapiens
ttggaaggtggagaagagga

SEQ ID NO: 8543258 - DNA, 22 bp, Homo sapiens
ttggaaggtgagtccctgggtt

SEQ ID NO: 8543259 - DNA, 22 bp, Homo sapiens
ttggaaggtgagtccctgggtt

SEQ ID NO: 8543260 - DNA, 22 bp, Homo sapiens
ttggaagggtttcagttagtct

SEQ ID NO: 8543261 - DNA, 22 bp, Homo sapiens
ttggaaggggcagagtggctgc

SEQ ID NO: 8543262 - DNA, 22 bp, Homo sapiens
ttggaagggatattggcatatg

SEQ ID NO: 8543263 - DNA, 22 bp, Homo sapiens
ttggaaggccctgcctagcagg

SEQ ID NO: 8543264 - DNA, 22 bp, Homo sapiens
ttggaaggccctgcctagcagg

SEQ ID NO: 8543265 - DNA, 22 bp, Homo sapiens
ttggaaggctgaatggcctctc

SEQ ID NO: 8543266 - DNA, 22 bp, Homo sapiens
ttggaagggaacaccatttgac

SEQ ID NO: 8543267 - DNA, 23 bp, Homo sapiens
ttggaagggaagagcatttgaga

SEQ ID NO: 8543268 - DNA, 22 bp, Homo sapiens
ttggaagggaaccgagtttgct

SEQ ID NO: 8543269 - DNA, 22 bp, Homo sapiens
ttggagggactgagcttcagtc

SEQ ID NO: 8543270 - DNA, 22 bp, Homo sapiens
ttggagggactgagcttcagtc

SEQ ID NO: 8543271 - DNA, 22 bp, Homo sapiens
ttggaaggttctggtcatggtt

SEQ ID NO: 8543272 - DNA, 22 bp, Homo sapiens
ttggagggacagatggctaggc

SEQ ID NO: 8543273 - DNA, 22 bp, Homo sapiens
ttggaggggccactgcagagct

SEQ ID NO: 8543274 - DNA, 22 bp, Homo sapiens
ttggaggggccactgcagagct

SEQ ID NO: 8543275 - DNA, 22 bp, Homo sapiens
ttggaggggccactgcagagct

SEQ ID NO: 8543276 - DNA, 22 bp, Homo sapiens
ttggaggggccactgcagagct

SEQ ID NO: 8543277 - DNA, 22 bp, Homo sapiens
ttggagggtcttccacagccat

SEQ ID NO: 8543278 - DNA, 22 bp, Homo sapiens
ttggagggtcttccacagccat

SEQ ID NO: 8543279 - DNA, 22 bp, Homo sapiens
ttggaaaagtgaaactagatgc

SEQ ID NO: 8543280 - DNA, 22 bp, Homo sapiens
ttggaaaatgaggcacagagag

SEQ ID NO: 8543281 - DNA, 22 bp, Homo sapiens
ttggaaaatgaggcacagagag

SEQ ID NO: 8543282 - DNA, 22 bp, Homo sapiens
ttggaaaagtgaaactagatgc

SEQ ID NO: 8543283 - DNA, 22 bp, Homo sapiens
ctcagtgcaaccaaagtgatct

SEQ ID NO: 8543284 - DNA, 22 bp, Homo sapiens
ctcagtgcagctaggcatgaga

SEQ ID NO: 8543285 - DNA, 19 bp, Homo sapiens
ctcagtctggctctgcctg

SEQ ID NO: 8543286 - DNA, 22 bp, Homo sapiens
ctcagtctgtcttgtctgtgtt

SEQ ID NO: 8543287 - DNA, 22 bp, Homo sapiens
ctcagtctgtcttgtctgtgtt

SEQ ID NO: 8543288 - DNA, 22 bp, Homo sapiens
ctcagtcatgacgctcaggacc

SEQ ID NO: 8543289 - DNA, 22 bp, Homo sapiens
ctcagtccagggaccggcctcc

SEQ ID NO: 8543290 - DNA, 22 bp, Homo sapiens
ttggaaggatttagagatgtct

SEQ ID NO: 8543291 - DNA, 22 bp, Homo sapiens
ttggaaggatttagagatgtct

SEQ ID NO: 8543292 - DNA, 22 bp, Homo sapiens
ttggaaggagtcaaccagctga

SEQ ID NO: 8543293 - DNA, 22 bp, Homo sapiens
ttggaaggagtctttggggatg

SEQ ID NO: 8543294 - DNA, 22 bp, Homo sapiens
ttggaaggccagcaccttgagt

SEQ ID NO: 8543295 - DNA, 22 bp, Homo sapiens
ttggaaggccctgcctagcagg

SEQ ID NO: 8543296 - DNA, 22 bp, Homo sapiens
ttggaaggccagcaccttgagt

SEQ ID NO: 8543297 - DNA, 22 bp, Homo sapiens
ttggaaggcagcatttgtccat

SEQ ID NO: 8543298 - DNA, 19 bp, Homo sapiens
ttggaaggagccagagtgg

SEQ ID NO: 8543299 - DNA, 19 bp, Homo sapiens
ttggaaggagccagagtgg

SEQ ID NO: 8543300 - DNA, 19 bp, Homo sapiens
ttggaaggagccagagtgg

SEQ ID NO: 8543301 - DNA, 22 bp, Homo sapiens
ttggaaggagtcaaccagctga

SEQ ID NO: 8543302 - DNA, 22 bp, Homo sapiens
ttggaaggaagaaccgcggtag

SEQ ID NO: 8543303 - DNA, 22 bp, Homo sapiens
ttggaaggaccaggccttgatt

SEQ ID NO: 8543304 - DNA, 22 bp, Homo sapiens
ttggaaggaattaaggtcatga

SEQ ID NO: 8543305 - DNA, 23 bp, Homo sapiens
ttggaagccagacagctgtgcag

SEQ ID NO: 8543306 - DNA, 22 bp, Homo sapiens
ttggaagccctgtgataggcca

SEQ ID NO: 8543307 - DNA, 22 bp, Homo sapiens
ttggaagcgagcacatggagga

SEQ ID NO: 8543308 - DNA, 22 bp, Homo sapiens
ttggaagcagtgtacactgtac

SEQ ID NO: 8543309 - DNA, 22 bp, Homo sapiens
ttggaagattctgtgtctggtg

SEQ ID NO: 8543310 - DNA, 18 bp, Homo sapiens
ctccagagctgtgagaca

SEQ ID NO: 8543311 - DNA, 18 bp, Homo sapiens
ctccagagctgtgagaca

SEQ ID NO: 8543312 - DNA, 22 bp, Homo sapiens
ctccagaggaaagcacatagtg

SEQ ID NO: 8543313 - DNA, 22 bp, Homo sapiens
ctccagaggaaagcacatagtg

SEQ ID NO: 8543314 - DNA, 22 bp, Homo sapiens
ctccagaggatgcaggtgaggg

SEQ ID NO: 8543315 - DNA, 22 bp, Homo sapiens
ctccagaggatgcaggtgaggg

SEQ ID NO: 8543316 - DNA, 22 bp, Homo sapiens
ctccagaggccctatcccacta

SEQ ID NO: 8543317 - DNA, 22 bp, Homo sapiens
ctccagaggccctatcccacta

SEQ ID NO: 8543318 - DNA, 22 bp, Homo sapiens
ctccagaggccctatcccacta

SEQ ID NO: 8543319 - DNA, 22 bp, Homo sapiens
ctccagaggcgacttgcatcac

SEQ ID NO: 8543320 - DNA, 22 bp, Homo sapiens
ctccagagggtcagactctgag

SEQ ID NO: 8543321 - DNA, 22 bp, Homo sapiens
ctccagagggtcagactctgag

SEQ ID NO: 8543322 - DNA, 22 bp, Homo sapiens
ctccagaggtccccgcggcact

SEQ ID NO: 8543323 - DNA, 22 bp, Homo sapiens
ctccagaggtccccgcggcact

SEQ ID NO: 8543324 - DNA, 22 bp, Homo sapiens
ctccagagggtcagactctgag

SEQ ID NO: 8543325 - DNA, 22 bp, Homo sapiens
ctccagaggttctcatctggga

SEQ ID NO: 8543326 - DNA, 22 bp, Homo sapiens
ctccagagtcacactgcctggg

SEQ ID NO: 8543327 - DNA, 22 bp, Homo sapiens
ctccagaggttctcatctggga

SEQ ID NO: 8543328 - DNA, 22 bp, Homo sapiens
ctccagaggttctcatctggga

SEQ ID NO: 8543329 - DNA, 22 bp, Homo sapiens
ctccagagtcacactgcctggg

SEQ ID NO: 8543330 - DNA, 22 bp, Homo sapiens
ctccagagtcacactgcctggg

SEQ ID NO: 8543331 - DNA, 22 bp, Homo sapiens
ttggctgccttcacccctggcc

SEQ ID NO: 8543332 - DNA, 22 bp, Homo sapiens
ctccagcctcatctcctggctg

SEQ ID NO: 8543333 - DNA, 22 bp, Homo sapiens
ctccagcctcatctcctggctg

SEQ ID NO: 8543334 - DNA, 22 bp, Homo sapiens
ctccaggacactaacccaggct

SEQ ID NO: 8543335 - DNA, 22 bp, Homo sapiens
ctccaggacatgactttcttgc

SEQ ID NO: 8543336 - DNA, 22 bp, Homo sapiens
ctccaggaccagggctcctgga

SEQ ID NO: 8543337 - DNA, 22 bp, Homo sapiens
ctccaggacactaacccaggct

SEQ ID NO: 8543338 - DNA, 22 bp, Homo sapiens
ctccaggacagattcagggcca

SEQ ID NO: 8543339 - DNA, 22 bp, Homo sapiens
ctccaggacagattcagggcca

SEQ ID NO: 8543340 - DNA, 22 bp, Homo sapiens
ctccaggacagattcagggcca

SEQ ID NO: 8543341 - DNA, 22 bp, Homo sapiens
ctccaggaccagggctcctgga

SEQ ID NO: 8543342 - DNA, 22 bp, Homo sapiens
ctccaggacccagtggctccag

SEQ ID NO: 8543343 - DNA, 22 bp, Homo sapiens
ctccaggactcaggcccctggg

SEQ ID NO: 8543344 - DNA, 22 bp, Homo sapiens
ctccaggactgaggacagagct

SEQ ID NO: 8543345 - DNA, 22 bp, Homo sapiens
ctccaggactgaggacagagct

SEQ ID NO: 8543346 - DNA, 22 bp, Homo sapiens
ttctatgtgttgacaagcctga

SEQ ID NO: 8543347 - DNA, 22 bp, Homo sapiens
ttctatgttagtatgggtctcc

SEQ ID NO: 8543348 - DNA, 22 bp, Homo sapiens
ttctatgttagtatgggtctcc

SEQ ID NO: 8543349 - DNA, 22 bp, Homo sapiens
ttctatgtgctggagaatattt

SEQ ID NO: 8543350 - DNA, 22 bp, Homo sapiens
ttctatgtggatatagaactgc

SEQ ID NO: 8543351 - DNA, 22 bp, Homo sapiens
ttctatgtcagtgtgctctgtg

SEQ ID NO: 8543352 - DNA, 22 bp, Homo sapiens
ttctatgtcagtgtgctctgtg

SEQ ID NO: 8543353 - DNA, 22 bp, Homo sapiens
ttctatgtcagtgtgctctgtg

SEQ ID NO: 8543354 - DNA, 22 bp, Homo sapiens
ttctatgtagataaggctgctc

SEQ ID NO: 8543355 - DNA, 22 bp, Homo sapiens
ttctatgtacctagcgttgtat

SEQ ID NO: 8543356 - DNA, 22 bp, Homo sapiens
ttctattgacattcactgtaac

SEQ ID NO: 8543357 - DNA, 22 bp, Homo sapiens
ttctattgcacacaaataatta

SEQ ID NO: 8543358 - DNA, 22 bp, Homo sapiens
ttctattgcacacaaataatta

SEQ ID NO: 8543359 - DNA, 22 bp, Homo sapiens
ttctattgcacacaaataatta

SEQ ID NO: 8543360 - DNA, 22 bp, Homo sapiens
ttctattgacattcactgtaac

SEQ ID NO: 8543361 - DNA, 22 bp, Homo sapiens
ttctattgggcagcattgcttc

SEQ ID NO: 8543362 - DNA, 22 bp, Homo sapiens
ttctgcagtgttaacaatgtca

SEQ ID NO: 8543363 - DNA, 22 bp, Homo sapiens
ttctgcaggagccctagtgtat

SEQ ID NO: 8543364 - DNA, 22 bp, Homo sapiens
ttctgcatacactgaatgtagt

SEQ ID NO: 8543365 - DNA, 22 bp, Homo sapiens
ttctgcatcccagaagaggaca

SEQ ID NO: 8543366 - DNA, 22 bp, Homo sapiens
ttctgcataggctatatttgtt

SEQ ID NO: 8543367 - DNA, 22 bp, Homo sapiens
ttctatttcttaatcttggctg

SEQ ID NO: 8543368 - DNA, 22 bp, Homo sapiens
ttctatttcttaatcttggctg

SEQ ID NO: 8543369 - DNA, 22 bp, Homo sapiens
ttctatttccagtccttcagag

SEQ ID NO: 8543370 - DNA, 22 bp, Homo sapiens
ttctgcagcccaacagtagttt

SEQ ID NO: 8543371 - DNA, 22 bp, Homo sapiens
ttctgaaggctcctcaggaaag

SEQ ID NO: 8543372 - DNA, 22 bp, Homo sapiens
ttctggaaggcagggagaaccc

SEQ ID NO: 8543373 - DNA, 22 bp, Homo sapiens
ttctggaaggcagggagaaccc

SEQ ID NO: 8543374 - DNA, 22 bp, Homo sapiens
ttctggaagggtggagtagctt

SEQ ID NO: 8543375 - DNA, 22 bp, Homo sapiens
ttctggaagctgggcagcaccc

SEQ ID NO: 8543376 - DNA, 22 bp, Homo sapiens
ttctggaagctgggcagcaccc

SEQ ID NO: 8543377 - DNA, 22 bp, Homo sapiens
ttctggaagctggaaaaggcaa

SEQ ID NO: 8543378 - DNA, 22 bp, Homo sapiens
ttctggaagccccagagtcaga

SEQ ID NO: 8543379 - DNA, 22 bp, Homo sapiens
ttctggaagctgcaggtggccg

SEQ ID NO: 8543380 - DNA, 22 bp, Homo sapiens
ttctggaagctgcaggtggccg

SEQ ID NO: 8543381 - DNA, 22 bp, Homo sapiens
ttctggaagctgcaggtggccg

SEQ ID NO: 8543382 - DNA, 22 bp, Homo sapiens
ttctggaagccatgggaacagg

SEQ ID NO: 8543383 - DNA, 22 bp, Homo sapiens
ttctggaagccatgggaacagg

SEQ ID NO: 8543384 - DNA, 22 bp, Homo sapiens
ttctggaagccccagagtcaga

SEQ ID NO: 8543385 - DNA, 22 bp, Homo sapiens
ttctggaaccaacatgccagtt

SEQ ID NO: 8543386 - DNA, 22 bp, Homo sapiens
ttctgcatgtgtttcaaatact

SEQ ID NO: 8543387 - DNA, 22 bp, Homo sapiens
ttctggaaccagcctgcctggg

SEQ ID NO: 8543388 - DNA, 22 bp, Homo sapiens
ttctggaaccagcctgcctggg

SEQ ID NO: 8543389 - DNA, 22 bp, Homo sapiens
ttctggaaccagcctgcctggg

SEQ ID NO: 8543390 - DNA, 22 bp, Homo sapiens
ttctggaagagtaaaataagcc

SEQ ID NO: 8543391 - DNA, 22 bp, Homo sapiens
ttctggaagatacctctcctaa

SEQ ID NO: 8543392 - DNA, 22 bp, Homo sapiens
ttctggaagaataatgggcaaa

SEQ ID NO: 8543393 - DNA, 22 bp, Homo sapiens
ttctgcatgaaaagaactgaac

SEQ ID NO: 8543394 - DNA, 22 bp, Homo sapiens
ttctgcatctcacagccagtgc

SEQ ID NO: 8543395 - DNA, 22 bp, Homo sapiens
ttctgcatgaaaagaactgaac

SEQ ID NO: 8543396 - DNA, 22 bp, Homo sapiens
ttctgcatgaacagtttattcc

SEQ ID NO: 8543397 - DNA, 22 bp, Homo sapiens
ttctgcatgatattaaatgtaa

SEQ ID NO: 8543398 - DNA, 22 bp, Homo sapiens
ttctgcatcctatgatcgcata

SEQ ID NO: 8543399 - DNA, 22 bp, Homo sapiens
ttctgcatggagaaactgagtc

SEQ ID NO: 8543400 - DNA, 17 bp, Homo sapiens
ttctgcatgtgaagatg

SEQ ID NO: 8543401 - DNA, 22 bp, Homo sapiens
ttctgcatggttggggagaagc

SEQ ID NO: 8543402 - DNA, 22 bp, Homo sapiens
cgtgtacagtctatcttttttc

SEQ ID NO: 8543403 - DNA, 22 bp, Homo sapiens
cgtgtacagtctatcttttttc

SEQ ID NO: 8543404 - DNA, 22 bp, Homo sapiens
cgtgtacacgcacacgtgtcct

SEQ ID NO: 8543405 - DNA, 22 bp, Homo sapiens
cgtgtatgataaatgttaataa

SEQ ID NO: 8543406 - DNA, 22 bp, Homo sapiens
cgtgtatgtgcctgcattcaca

SEQ ID NO: 8543407 - DNA, 22 bp, Homo sapiens
cgtgtctgggctcccatggcag

SEQ ID NO: 8543408 - DNA, 22 bp, Homo sapiens
cgtgtctgggatagcagaagta

SEQ ID NO: 8543409 - DNA, 22 bp, Homo sapiens
cgtgtctgtgtatgcaggccgt

SEQ ID NO: 8543410 - DNA, 22 bp, Homo sapiens
cgtgtctgtatgtcaatcagct

SEQ ID NO: 8543411 - DNA, 23 bp, Homo sapiens
cgtgtctgtgggcgatccggcct

SEQ ID NO: 8543412 - DNA, 17 bp, Homo sapiens
cgtgtgcttgtgtgcac

SEQ ID NO: 8543413 - DNA, 22 bp, Homo sapiens
cgtgtggtcccggcaaggcaag

SEQ ID NO: 8543414 - DNA, 22 bp, Homo sapiens
cgtgtggtcccggcaaggcaag

SEQ ID NO: 8543415 - DNA, 17 bp, Homo sapiens
cgtgtgcttgtgtgcac

SEQ ID NO: 8543416 - DNA, 22 bp, Homo sapiens
cgtgtgcgcacacctgtttcca

SEQ ID NO: 8543417 - DNA, 22 bp, Homo sapiens
cgtgtgcgtgcatatgcacaag

SEQ ID NO: 8543418 - DNA, 22 bp, Homo sapiens
cgtgtgtgtacctgcgcattta

SEQ ID NO: 8543419 - DNA, 20 bp, Homo sapiens
cgtgtgtggctattttgggt

SEQ ID NO: 8543420 - DNA, 22 bp, Homo sapiens
cgtgtgtgtacctgcgcattta

SEQ ID NO: 8543421 - DNA, 20 bp, Homo sapiens
cgtgtgtggctattttgggt

SEQ ID NO: 8543422 - DNA, 20 bp, Homo sapiens
cgtgtgtggctattttgggt

SEQ ID NO: 8543423 - DNA, 22 bp, Homo sapiens
cgtgtggtcccggcaaggcaag

SEQ ID NO: 8543424 - DNA, 22 bp, Homo sapiens
cgtgtggtcccggcaaggcaag

SEQ ID NO: 8543425 - DNA, 22 bp, Homo sapiens
cgtgtggtcccggcaaggcaag

SEQ ID NO: 8543426 - DNA, 23 bp, Homo sapiens
cgttttttcctcagatgttctgg

SEQ ID NO: 8543427 - DNA, 22 bp, Homo sapiens
ctaaaaactctacgatgcacag

SEQ ID NO: 8543428 - DNA, 22 bp, Homo sapiens
ctaaaaatccacactaggtgaa

SEQ ID NO: 8543429 - DNA, 22 bp, Homo sapiens
cgtttattttgaagattccact

SEQ ID NO: 8543430 - DNA, 22 bp, Homo sapiens
cgtttgaaagcctttgtacact

SEQ ID NO: 8543431 - DNA, 22 bp, Homo sapiens
cgttcacatcgtattattggga

SEQ ID NO: 8543432 - DNA, 22 bp, Homo sapiens
cgttagtggagtttgaagctgt

SEQ ID NO: 8543433 - DNA, 17 bp, Homo sapiens
cgttagtgattcctgcc

SEQ ID NO: 8543434 - DNA, 22 bp, Homo sapiens
cgttaataggtgcaaggtaagg

SEQ ID NO: 8543435 - DNA, 22 bp, Homo sapiens
cgtgtttcagccagggccacct

SEQ ID NO: 8543436 - DNA, 22 bp, Homo sapiens
cgtgtgtgtacctgcgcattta

SEQ ID NO: 8543437 - DNA, 22 bp, Homo sapiens
cgtttaaccagcacgcttggcc

SEQ ID NO: 8543438 - DNA, 22 bp, Homo sapiens
cgtttactgtgtaccaggcact

SEQ ID NO: 8543439 - DNA, 22 bp, Homo sapiens
cgttggagacacttgaggactt

SEQ ID NO: 8543440 - DNA, 22 bp, Homo sapiens
cgttcttttcatatttacatgg

SEQ ID NO: 8543441 - DNA, 22 bp, Homo sapiens
ctagaggaacagtttcaggttt

SEQ ID NO: 8543442 - DNA, 22 bp, Homo sapiens
ctagagaggtggtgttgggtgg

SEQ ID NO: 8543443 - DNA, 22 bp, Homo sapiens
ctagagctgttctgtgcactca

SEQ ID NO: 8543444 - DNA, 17 bp, Homo sapiens
ctagagagaaagagcta

SEQ ID NO: 8543445 - DNA, 22 bp, Homo sapiens
ctagagaattgtcttgagagtt

SEQ ID NO: 8543446 - DNA, 22 bp, Homo sapiens
ttctatgccatgttcagctact

SEQ ID NO: 8543447 - DNA, 22 bp, Homo sapiens
ttctatgattcatttagaagtt

SEQ ID NO: 8543448 - DNA, 22 bp, Homo sapiens
ctagatcagattgctgtttcta

SEQ ID NO: 8543449 - DNA, 22 bp, Homo sapiens
ctagatcagctaactttccagt

SEQ ID NO: 8543450 - DNA, 22 bp, Homo sapiens
ctagaaatacaggcacgtgcca

SEQ ID NO: 8543451 - DNA, 22 bp, Homo sapiens
ctaaaaatccacactaggtgaa

SEQ ID NO: 8543452 - DNA, 22 bp, Homo sapiens
ctagagaaaatgatagcaggaa

SEQ ID NO: 8543453 - DNA, 22 bp, Homo sapiens
ctagagaaacagtgctctgaac

SEQ ID NO: 8543454 - DNA, 22 bp, Homo sapiens
ctagagaaacagtgctctgaac

SEQ ID NO: 8543455 - DNA, 22 bp, Homo sapiens
ctagagaagaggctcagccagc

SEQ ID NO: 8543456 - DNA, 22 bp, Homo sapiens
ctagagaagaggttaagcatga

SEQ ID NO: 8543457 - DNA, 22 bp, Homo sapiens
ctagagaacaacattcatatgg

SEQ ID NO: 8543458 - DNA, 22 bp, Homo sapiens
ctagagaaacgccgtgggagga

SEQ ID NO: 8543459 - DNA, 22 bp, Homo sapiens
ctagagaatcttttaagaagtg

SEQ ID NO: 8543460 - DNA, 22 bp, Homo sapiens
ctagagaatcttttaagaagtg

SEQ ID NO: 8543461 - DNA, 22 bp, Homo sapiens
ctcactcagacatccagtgcag

SEQ ID NO: 8543462 - DNA, 22 bp, Homo sapiens
ctcactgcaacctccgcctcct

SEQ ID NO: 8543463 - DNA, 22 bp, Homo sapiens
ctcactgactgcaagtcaagtt

SEQ ID NO: 8543464 - DNA, 22 bp, Homo sapiens
ctcactgcaacctctgcctccc

SEQ ID NO: 8543465 - DNA, 22 bp, Homo sapiens
ctcactgcaagctcagcctccc

SEQ ID NO: 8543466 - DNA, 22 bp, Homo sapiens
ctcactgcaagctcagcctccc

SEQ ID NO: 8543467 - DNA, 22 bp, Homo sapiens
ctatagaaaattgtatcacacg

SEQ ID NO: 8543468 - DNA, 22 bp, Homo sapiens
ctcacaggttctgcagctcaca

SEQ ID NO: 8543469 - DNA, 18 bp, Homo sapiens
ctcaccattctgcccaat

SEQ ID NO: 8543470 - DNA, 22 bp, Homo sapiens
ctcacccatatctccatgactc

SEQ ID NO: 8543471 - DNA, 22 bp, Homo sapiens
ctatacatcccaatttcagaga

SEQ ID NO: 8543472 - DNA, 22 bp, Homo sapiens
ctatactactatacagatgtaa

SEQ ID NO: 8543473 - DNA, 22 bp, Homo sapiens
ctatacagtaaccacagtgatt

SEQ ID NO: 8543474 - DNA, 19 bp, Homo sapiens
ctatacagcctctgaggaa

SEQ ID NO: 8543475 - DNA, 22 bp, Homo sapiens
ctatacagcagcttactagtta

SEQ ID NO: 8543476 - DNA, 22 bp, Homo sapiens
ctatacagcagcttactagtta

SEQ ID NO: 8543477 - DNA, 22 bp, Homo sapiens
ttctggccaaggctgccagatt

SEQ ID NO: 8543478 - DNA, 22 bp, Homo sapiens
ctataaatctacccagcattgg

SEQ ID NO: 8543479 - DNA, 22 bp, Homo sapiens
ctataaatctacccagcattgg

SEQ ID NO: 8543480 - DNA, 22 bp, Homo sapiens
ctataaatctacccagcattgg

SEQ ID NO: 8543481 - DNA, 22 bp, Homo sapiens
ctataaatctacccagcattgg

SEQ ID NO: 8543482 - DNA, 22 bp, Homo sapiens
ctatacactttttgaaaataga

SEQ ID NO: 8543483 - DNA, 22 bp, Homo sapiens
ctatacactttttgaaaataga

SEQ ID NO: 8543484 - DNA, 22 bp, Homo sapiens
ttctggcttcatctgacaagcc

SEQ ID NO: 8543485 - DNA, 22 bp, Homo sapiens
ttctggctttaggcttttcaag

SEQ ID NO: 8543486 - DNA, 22 bp, Homo sapiens
ctcagagccagttagcaggtgc

SEQ ID NO: 8543487 - DNA, 22 bp, Homo sapiens
ctcagagccagttagcaggtgc

SEQ ID NO: 8543488 - DNA, 22 bp, Homo sapiens
ctcagagcccagggtacacccg

SEQ ID NO: 8543489 - DNA, 22 bp, Homo sapiens
ctcagagccagttagcaggtgc

SEQ ID NO: 8543490 - DNA, 22 bp, Homo sapiens
ctcagagccagttagcaggtgc

SEQ ID NO: 8543491 - DNA, 22 bp, Homo sapiens
ctcagagccagttagcaggtgc

SEQ ID NO: 8543492 - DNA, 21 bp, Homo sapiens
ctcagagcagttcagagggat

SEQ ID NO: 8543493 - DNA, 17 bp, Homo sapiens
ctcagagcaggacagaa

SEQ ID NO: 8543494 - DNA, 22 bp, Homo sapiens
ctcagagcccagggtacacccg

SEQ ID NO: 8543495 - DNA, 22 bp, Homo sapiens
ctcagagctcagctttgttagt

SEQ ID NO: 8543496 - DNA, 22 bp, Homo sapiens
ctcagagctgaggccagggaca

SEQ ID NO: 8543497 - DNA, 22 bp, Homo sapiens
ctcagagctgaggccagggaca

SEQ ID NO: 8543498 - DNA, 22 bp, Homo sapiens
ctcagaggcaagcaaggagctg

SEQ ID NO: 8543499 - DNA, 22 bp, Homo sapiens
ctcagaggcaagcaaggagctg

SEQ ID NO: 8543500 - DNA, 22 bp, Homo sapiens
ctcagaggaggcagggtgtgcc

SEQ ID NO: 8543501 - DNA, 17 bp, Homo sapiens
ctcagagcaggacagaa

SEQ ID NO: 8543502 - DNA, 17 bp, Homo sapiens
ctcagagcaggacagaa

SEQ ID NO: 8543503 - DNA, 22 bp, Homo sapiens
ctcagagcacagtttatgacag

SEQ ID NO: 8543504 - DNA, 22 bp, Homo sapiens
ctcagagcaatgaacatgcaaa

SEQ ID NO: 8543505 - DNA, 22 bp, Homo sapiens
ctcagagcaatgaacatgcaaa

SEQ ID NO: 8543506 - DNA, 18 bp, Homo sapiens
ctcagagatgcccttatt

SEQ ID NO: 8543507 - DNA, 22 bp, Homo sapiens
ctcagagagtgaattcctgcct

SEQ ID NO: 8543508 - DNA, 22 bp, Homo sapiens
ctcagagagttaagtgaattac

SEQ ID NO: 8543509 - DNA, 21 bp, Homo sapiens
ctcagagacaaatgccatccc

SEQ ID NO: 8543510 - DNA, 17 bp, Homo sapiens
ctcagagagggtaagta

SEQ ID NO: 8543511 - DNA, 22 bp, Homo sapiens
ctcagagaggttgaacaacttg

SEQ ID NO: 8543512 - DNA, 19 bp, Homo sapiens
ctcagagaggggcagtgcc

SEQ ID NO: 8543513 - DNA, 22 bp, Homo sapiens
ctcagagagggcaccagggcca

SEQ ID NO: 8543514 - DNA, 22 bp, Homo sapiens
ctcagagaggcagtggaagtca

SEQ ID NO: 8543515 - DNA, 22 bp, Homo sapiens
ctcagagagacaatgtgggaca

SEQ ID NO: 8543516 - DNA, 22 bp, Homo sapiens
ttctttctctccacaaggcttg

SEQ ID NO: 8543517 - DNA, 22 bp, Homo sapiens
ctcactgcaagctccacctctt

SEQ ID NO: 8543518 - DNA, 22 bp, Homo sapiens
ttctttctctactagcagagct

SEQ ID NO: 8543519 - DNA, 22 bp, Homo sapiens
ctcactgcaagctcagcctccc

SEQ ID NO: 8543520 - DNA, 22 bp, Homo sapiens
ttctttctctactagcagagct

SEQ ID NO: 8543521 - DNA, 22 bp, Homo sapiens
ttctttctgaatacagttgagt

SEQ ID NO: 8543522 - DNA, 22 bp, Homo sapiens
ttctttctgggaagagttcaga

SEQ ID NO: 8543523 - DNA, 22 bp, Homo sapiens
ttctttctggggtccttcggct

SEQ ID NO: 8543524 - DNA, 22 bp, Homo sapiens
ttctttctgggaagagttcaga

SEQ ID NO: 8543525 - DNA, 22 bp, Homo sapiens
ttctttctgggaagagttcaga

SEQ ID NO: 8543526 - DNA, 21 bp, Homo sapiens
ctcagagaaatgtctgggagc

SEQ ID NO: 8543527 - DNA, 21 bp, Homo sapiens
ctcagagaaatgtctgggagc

SEQ ID NO: 8543528 - DNA, 22 bp, Homo sapiens
ctcagagaagtctttgctaaac

SEQ ID NO: 8543529 - DNA, 22 bp, Homo sapiens
ctcagagaagatggatgaggta

SEQ ID NO: 8543530 - DNA, 22 bp, Homo sapiens
ctcagagaacctaagcggagga

SEQ ID NO: 8543531 - DNA, 22 bp, Homo sapiens
ctcagaaaggtgccatttatgt

SEQ ID NO: 8543532 - DNA, 22 bp, Homo sapiens
ttctttctgtccataatgagac

SEQ ID NO: 8543533 - DNA, 22 bp, Homo sapiens
ctcagaaagggttgctgagggc

SEQ ID NO: 8543534 - DNA, 22 bp, Homo sapiens
ctcagaaagggttgctgagggc

SEQ ID NO: 8543535 - DNA, 22 bp, Homo sapiens
ctcagaaagggttgctgagggc

SEQ ID NO: 8543536 - DNA, 22 bp, Homo sapiens
ttctttctgtcatggtgtactg

SEQ ID NO: 8543537 - DNA, 22 bp, Homo sapiens
ttctttctgtccataatgagac

SEQ ID NO: 8543538 - DNA, 22 bp, Homo sapiens
gaaagacatagttgcaagatgg

SEQ ID NO: 8543539 - DNA, 22 bp, Homo sapiens
gaaagaccgtttgggctctaaa

SEQ ID NO: 8543540 - DNA, 22 bp, Homo sapiens
gaaagaccagcatgaggcttta

SEQ ID NO: 8543541 - DNA, 22 bp, Homo sapiens
gaaatatacattgcaggaagag

SEQ ID NO: 8543542 - DNA, 22 bp, Homo sapiens
gaaatatacattgcaggaagag

SEQ ID NO: 8543543 - DNA, 22 bp, Homo sapiens
gaaatacaggaatgccacacag

SEQ ID NO: 8543544 - DNA, 22 bp, Homo sapiens
gaaagagaacctgggcctagat

SEQ ID NO: 8543545 - DNA, 22 bp, Homo sapiens
gaaagagaacctgggcctagat

SEQ ID NO: 8543546 - DNA, 22 bp, Homo sapiens
gaaagagaacctgggcctagat

SEQ ID NO: 8543547 - DNA, 22 bp, Homo sapiens
gaaatattcttgtcttgttttc

SEQ ID NO: 8543548 - DNA, 22 bp, Homo sapiens
gaaatattcttgtcttgttttc

SEQ ID NO: 8543549 - DNA, 22 bp, Homo sapiens
gaaatattcttgtcttgttttc

SEQ ID NO: 8543550 - DNA, 22 bp, Homo sapiens
gaaatattacagtggaggggat

SEQ ID NO: 8543551 - DNA, 22 bp, Homo sapiens
gaaatattcttgtcttgttttc

SEQ ID NO: 8543552 - DNA, 22 bp, Homo sapiens
gaaatattcttgtcttgttttc

SEQ ID NO: 8543553 - DNA, 22 bp, Homo sapiens
gaaatattcttgtcttgttttc

SEQ ID NO: 8543554 - DNA, 22 bp, Homo sapiens
gaaatattacagtggaggggat

SEQ ID NO: 8543555 - DNA, 22 bp, Homo sapiens
gaaatattacagtggaggggat

SEQ ID NO: 8543556 - DNA, 22 bp, Homo sapiens
gaaatattacagtggaggggat

SEQ ID NO: 8543557 - DNA, 22 bp, Homo sapiens
gaaatattacagtggaggggat

SEQ ID NO: 8543558 - DNA, 22 bp, Homo sapiens
gaaatatacattgcaggaagag

SEQ ID NO: 8543559 - DNA, 22 bp, Homo sapiens
gaaatatacattgcaggaagag

SEQ ID NO: 8543560 - DNA, 22 bp, Homo sapiens
gaaatattacagtggaggggat

SEQ ID NO: 8543561 - DNA, 22 bp, Homo sapiens
gaaatattgtactggagatgtt

SEQ ID NO: 8543562 - DNA, 22 bp, Homo sapiens
gaaatattgtactggagatgtt

SEQ ID NO: 8543563 - DNA, 22 bp, Homo sapiens
gaaatattgtactggagatgtt

SEQ ID NO: 8543564 - DNA, 22 bp, Homo sapiens
gaaatgtagagtatctgaggat

SEQ ID NO: 8543565 - DNA, 22 bp, Homo sapiens
gaaatgtaggcataattatttt

SEQ ID NO: 8543566 - DNA, 22 bp, Homo sapiens
gaaatatttctcttgagcccct

SEQ ID NO: 8543567 - DNA, 22 bp, Homo sapiens
gaaatgtagaattgcttaactg

SEQ ID NO: 8543568 - DNA, 22 bp, Homo sapiens
gaaatattgtactggagatgtt

SEQ ID NO: 8543569 - DNA, 22 bp, Homo sapiens
gaaatattgggactcagagctt

SEQ ID NO: 8543570 - DNA, 22 bp, Homo sapiens
gaaatattgtactggagatgtt

SEQ ID NO: 8543571 - DNA, 22 bp, Homo sapiens
gaaatattgtactggagatgtt

SEQ ID NO: 8543572 - DNA, 22 bp, Homo sapiens
gaaatattgggactcagagctt

SEQ ID NO: 8543573 - DNA, 22 bp, Homo sapiens
gaaatattgggactcagagctt

SEQ ID NO: 8543574 - DNA, 22 bp, Homo sapiens
gaaatattgggactcagagctt

SEQ ID NO: 8543575 - DNA, 22 bp, Homo sapiens
gaaatattgggactcagagctt

SEQ ID NO: 8543576 - DNA, 22 bp, Homo sapiens
gaaatattgggactcagagctt

SEQ ID NO: 8543577 - DNA, 22 bp, Homo sapiens
gaaatgtctttgacaagagagg

SEQ ID NO: 8543578 - DNA, 22 bp, Homo sapiens
gaaatgtgacctacttccttgt

SEQ ID NO: 8543579 - DNA, 18 bp, Homo sapiens
gaaatgtgattctagggc

SEQ ID NO: 8543580 - DNA, 20 bp, Homo sapiens
gaaatgtgacctcttctgtg

SEQ ID NO: 8543581 - DNA, 20 bp, Homo sapiens
gaaatgtgacctcttctgtg

SEQ ID NO: 8543582 - DNA, 22 bp, Homo sapiens
gaaatgtgcagaatgtgttaga

SEQ ID NO: 8543583 - DNA, 22 bp, Homo sapiens
gaaatgtgtgacaagtttcaat

SEQ ID NO: 8543584 - DNA, 22 bp, Homo sapiens
gaaatgtgggtcatgacccatt

SEQ ID NO: 8543585 - DNA, 22 bp, Homo sapiens
gaaatgtaggcataattatttt

SEQ ID NO: 8543586 - DNA, 22 bp, Homo sapiens
gaaatgtataagctggtctttt

SEQ ID NO: 8543587 - DNA, 20 bp, Homo sapiens
gaaatgtatctcttgattct

SEQ ID NO: 8543588 - DNA, 20 bp, Homo sapiens
gaaatgtatctcttgattct

SEQ ID NO: 8543589 - DNA, 22 bp, Homo sapiens
gaaatgtatgtcttcccccatt

SEQ ID NO: 8543590 - DNA, 22 bp, Homo sapiens
gaaatgtatgtcttcccccatt

SEQ ID NO: 8543591 - DNA, 22 bp, Homo sapiens
gaaatgtatgtcttcccccatt

SEQ ID NO: 8543592 - DNA, 22 bp, Homo sapiens
gaaatgtcaagatatgtttgga

SEQ ID NO: 8543593 - DNA, 22 bp, Homo sapiens
gaaatgtatttgacagtccttg

SEQ ID NO: 8543594 - DNA, 22 bp, Homo sapiens
gaaatgtatttgacagtccttg

SEQ ID NO: 8543595 - DNA, 22 bp, Homo sapiens
gaaattgtcagcttctttcagt

SEQ ID NO: 8543596 - DNA, 22 bp, Homo sapiens
gaaattgtcagcttctttcagt

SEQ ID NO: 8543597 - DNA, 22 bp, Homo sapiens
gaaattgtcagcttctttcagt

SEQ ID NO: 8543598 - DNA, 22 bp, Homo sapiens
gaaattgaaagaccaactgcat

SEQ ID NO: 8543599 - DNA, 22 bp, Homo sapiens
gaaattgtaaaggattgcgcca

SEQ ID NO: 8543600 - DNA, 22 bp, Homo sapiens
gaaattctgtgtcccagagtgc

SEQ ID NO: 8543601 - DNA, 22 bp, Homo sapiens
gaaattcactgtatttcttggg

SEQ ID NO: 8543602 - DNA, 22 bp, Homo sapiens
gaaattcaggacaaagactctt

SEQ ID NO: 8543603 - DNA, 20 bp, Homo sapiens
gaaattctcgtattagttta

SEQ ID NO: 8543604 - DNA, 22 bp, Homo sapiens
gaaattcaaataagatatgtag

SEQ ID NO: 8543605 - DNA, 22 bp, Homo sapiens
gaaattcaaaatgtcagtatag

SEQ ID NO: 8543606 - DNA, 22 bp, Homo sapiens
gaaattcaaataagatatgtag

SEQ ID NO: 8543607 - DNA, 22 bp, Homo sapiens
gaaatgttgtctctgcagcaat

SEQ ID NO: 8543608 - DNA, 22 bp, Homo sapiens
gaaatgtgttgttcatttctaa

SEQ ID NO: 8543609 - DNA, 22 bp, Homo sapiens
gaaatgttttacaaggcatact

SEQ ID NO: 8543610 - DNA, 22 bp, Homo sapiens
gaaattaaccacctttggcttt

SEQ ID NO: 8543611 - DNA, 22 bp, Homo sapiens
gaaattaagcaggggtctgtgg

SEQ ID NO: 8543612 - DNA, 22 bp, Homo sapiens
gaagaactgtgacagaagcagt

SEQ ID NO: 8543613 - DNA, 22 bp, Homo sapiens
gaagaactgtgacagaagcagt

SEQ ID NO: 8543614 - DNA, 22 bp, Homo sapiens
gaagaactgacaaactagatca

SEQ ID NO: 8543615 - DNA, 22 bp, Homo sapiens
gaagaactgtgacagaagcagt

SEQ ID NO: 8543616 - DNA, 22 bp, Homo sapiens
gaagaactttagggcagaattt

SEQ ID NO: 8543617 - DNA, 22 bp, Homo sapiens
gaagaacttataggaatgtcat

SEQ ID NO: 8543618 - DNA, 22 bp, Homo sapiens
gaagaagacatggaacaatagt

SEQ ID NO: 8543619 - DNA, 22 bp, Homo sapiens
gaagaagagataatggggagca

SEQ ID NO: 8543620 - DNA, 19 bp, Homo sapiens
gaagaagcttgagaagtag

SEQ ID NO: 8543621 - DNA, 22 bp, Homo sapiens
gaagaagcctctgtggatctga

SEQ ID NO: 8543622 - DNA, 22 bp, Homo sapiens
gaagaagcaggagtgtgtagca

SEQ ID NO: 8543623 - DNA, 22 bp, Homo sapiens
gaagaagcaggagtgtgtagca

SEQ ID NO: 8543624 - DNA, 22 bp, Homo sapiens
gaagaagcattctgctgttttg

SEQ ID NO: 8543625 - DNA, 22 bp, Homo sapiens
gaagaagcctctgtggatctga

SEQ ID NO: 8543626 - DNA, 22 bp, Homo sapiens
gaactttaaaacaaagtacagt

SEQ ID NO: 8543627 - DNA, 22 bp, Homo sapiens
gaaattgtctgtgcccaagtct

SEQ ID NO: 8543628 - DNA, 22 bp, Homo sapiens
gaaattgtcagtgatatgatac

SEQ ID NO: 8543629 - DNA, 22 bp, Homo sapiens
gaacttcttctttaagagactc

SEQ ID NO: 8543630 - DNA, 22 bp, Homo sapiens
gaagaacaagcagtgctttcct

SEQ ID NO: 8543631 - DNA, 22 bp, Homo sapiens
gaagaaattgaattcatgagct

SEQ ID NO: 8543632 - DNA, 22 bp, Homo sapiens
gaagaacaagcagtgctttcct

SEQ ID NO: 8543633 - DNA, 22 bp, Homo sapiens
gaagaaattgaattcatgagct

SEQ ID NO: 8543634 - DNA, 22 bp, Homo sapiens
gaagaactgaaagttgatgcac

SEQ ID NO: 8543635 - DNA, 22 bp, Homo sapiens
gaagaactgacaaactagatca

SEQ ID NO: 8543636 - DNA, 22 bp, Homo sapiens
gaagaacacttcatgattcatt

SEQ ID NO: 8543637 - DNA, 22 bp, Homo sapiens
gaagaacacctgctgcccagtg

SEQ ID NO: 8543638 - DNA, 22 bp, Homo sapiens
gaaaaagtgaccttggtagcta

SEQ ID NO: 8543639 - DNA, 22 bp, Homo sapiens
gaaaaagtgaccttggtagcta

SEQ ID NO: 8543640 - DNA, 22 bp, Homo sapiens
gaaaaatgagctgatgtcaggg

SEQ ID NO: 8543641 - DNA, 22 bp, Homo sapiens
gaaaaatgagctgatgtcaggg

SEQ ID NO: 8543642 - DNA, 22 bp, Homo sapiens
gaaaaagtgaccttggtagcta

SEQ ID NO: 8543643 - DNA, 22 bp, Homo sapiens
cttttttcctaaggcaacatga

SEQ ID NO: 8543644 - DNA, 22 bp, Homo sapiens
cttttttcctaaggcaacatga

SEQ ID NO: 8543645 - DNA, 22 bp, Homo sapiens
ctttttgttgtataagcccttt

SEQ ID NO: 8543646 - DNA, 22 bp, Homo sapiens
cttttttaaggtagctcctcct

SEQ ID NO: 8543647 - DNA, 22 bp, Homo sapiens
ctttttgttgtccacactagga

SEQ ID NO: 8543648 - DNA, 22 bp, Homo sapiens
gaaaccagctagaggcagaggg

SEQ ID NO: 8543649 - DNA, 22 bp, Homo sapiens
gaaacagctttaagtgatactg

SEQ ID NO: 8543650 - DNA, 22 bp, Homo sapiens
gaaaccagctagaggcagaggg

SEQ ID NO: 8543651 - DNA, 22 bp, Homo sapiens
gaaacagctttaagtgatactg

SEQ ID NO: 8543652 - DNA, 22 bp, Homo sapiens
gaaacagctagaaagccattgg

SEQ ID NO: 8543653 - DNA, 22 bp, Homo sapiens
gaaaccagataagggaggctga

SEQ ID NO: 8543654 - DNA, 22 bp, Homo sapiens
gaaaccagataagggaggctga

SEQ ID NO: 8543655 - DNA, 22 bp, Homo sapiens
gaaaaatgctccaaatctgtgg

SEQ ID NO: 8543656 - DNA, 22 bp, Homo sapiens
gaaaaatgctccaaatctgtgg

SEQ ID NO: 8543657 - DNA, 22 bp, Homo sapiens
gaaacagcccctgtgtgaagca

SEQ ID NO: 8543658 - DNA, 22 bp, Homo sapiens
gaaacagctagaaagccattgg

SEQ ID NO: 8543659 - DNA, 22 bp, Homo sapiens
gaaacagcccctgtgtgaagca

SEQ ID NO: 8543660 - DNA, 22 bp, Homo sapiens
gaaaaatgctccaaatctgtgg

SEQ ID NO: 8543661 - DNA, 22 bp, Homo sapiens
gaaaaatgctccaaatctgtgg

SEQ ID NO: 8543662 - DNA, 22 bp, Homo sapiens
gaaaaatgctccaaatctgtgg

SEQ ID NO: 8543663 - DNA, 22 bp, Homo sapiens
gaaaaatgagctgatgtcaggg

SEQ ID NO: 8543664 - DNA, 22 bp, Homo sapiens
gaaaaatgagctgatgtcaggg

SEQ ID NO: 8543665 - DNA, 22 bp, Homo sapiens
gaaactttggctaaaagccaga

SEQ ID NO: 8543666 - DNA, 22 bp, Homo sapiens
gaaactttggctaaaagccaga

SEQ ID NO: 8543667 - DNA, 22 bp, Homo sapiens
gaaactttcatgaatataagat

SEQ ID NO: 8543668 - DNA, 22 bp, Homo sapiens
gaaactttcatgaatataagat

SEQ ID NO: 8543669 - DNA, 22 bp, Homo sapiens
gaaacttgataattgaaacaga

SEQ ID NO: 8543670 - DNA, 22 bp, Homo sapiens
gaaactgtttctggctttggtg

SEQ ID NO: 8543671 - DNA, 22 bp, Homo sapiens
gaaactgtgaggatcttaactt

SEQ ID NO: 8543672 - DNA, 22 bp, Homo sapiens
gaaactgtgatcgtgttctggg

SEQ ID NO: 8543673 - DNA, 22 bp, Homo sapiens
gaaacttacttactcacatttc

SEQ ID NO: 8543674 - DNA, 22 bp, Homo sapiens
gaaacttcttgtctcacagttc

SEQ ID NO: 8543675 - DNA, 22 bp, Homo sapiens
gaaacttcttgtctcacagttc

SEQ ID NO: 8543676 - DNA, 22 bp, Homo sapiens
gaaactgtttctggctttggtg

SEQ ID NO: 8543677 - DNA, 22 bp, Homo sapiens
gaaagaagctttagatggctat

SEQ ID NO: 8543678 - DNA, 22 bp, Homo sapiens
gaaacttttaaacctcatgagt

SEQ ID NO: 8543679 - DNA, 22 bp, Homo sapiens
gaaagaagctttagatggctat

SEQ ID NO: 8543680 - DNA, 22 bp, Homo sapiens
gaaagaatgctgggagccatct

SEQ ID NO: 8543681 - DNA, 22 bp, Homo sapiens
gaaagaatgctatagtgacttc

SEQ ID NO: 8543682 - DNA, 22 bp, Homo sapiens
gaaagaatgctatagtgacttc

SEQ ID NO: 8543683 - DNA, 22 bp, Homo sapiens
gaaagaatcaactatgtctctg

SEQ ID NO: 8543684 - DNA, 22 bp, Homo sapiens
gaaagaatgagcatcatgactt

SEQ ID NO: 8543685 - DNA, 22 bp, Homo sapiens
gaaagaatgagcatcatgactt

SEQ ID NO: 8543686 - DNA, 22 bp, Homo sapiens
gaaacctgggatatataagttt

SEQ ID NO: 8543687 - DNA, 22 bp, Homo sapiens
gaaacctgagtgcagatcagga

SEQ ID NO: 8543688 - DNA, 22 bp, Homo sapiens
gaaacctcttagcctctctttg

SEQ ID NO: 8543689 - DNA, 22 bp, Homo sapiens
gaaacctgagccagagtgggga

SEQ ID NO: 8543690 - DNA, 18 bp, Homo sapiens
gaaacctgaggaagaaag

SEQ ID NO: 8543691 - DNA, 22 bp, Homo sapiens
gaaacctttgccgatggggtcc

SEQ ID NO: 8543692 - DNA, 22 bp, Homo sapiens
gaaacctgtgctgatttgttag

SEQ ID NO: 8543693 - DNA, 22 bp, Homo sapiens
gaaacctggttctgcgtgaggg

SEQ ID NO: 8543694 - DNA, 22 bp, Homo sapiens
gaaacctgtcccctcttcctca

SEQ ID NO: 8543695 - DNA, 22 bp, Homo sapiens
gaaacgttggcataagtttatg

SEQ ID NO: 8543696 - DNA, 22 bp, Homo sapiens
gaaacgttaaaccatatgtaat

SEQ ID NO: 8543697 - DNA, 22 bp, Homo sapiens
gaaacctggttctgcgtgaggg

SEQ ID NO: 8543698 - DNA, 22 bp, Homo sapiens
gaaacgttgtggaaaatcctct

SEQ ID NO: 8543699 - DNA, 22 bp, Homo sapiens
gaaactctcgcatcctgggaac

SEQ ID NO: 8543700 - DNA, 22 bp, Homo sapiens
gaaactctcgcatcctgggaac

SEQ ID NO: 8543701 - DNA, 22 bp, Homo sapiens
gaaactgagtaggctagagcac

SEQ ID NO: 8543702 - DNA, 22 bp, Homo sapiens
gaaactgaatataagaaaggta

SEQ ID NO: 8543703 - DNA, 22 bp, Homo sapiens
gaaactgtatgtagtttttggg

SEQ ID NO: 8543704 - DNA, 22 bp, Homo sapiens
gaaactgtatgtagtttttggg

SEQ ID NO: 8543705 - DNA, 22 bp, Homo sapiens
gaaactgtgaggatcttaactt

SEQ ID NO: 8543706 - DNA, 22 bp, Homo sapiens
ctttggaagtgaccacaatcct

SEQ ID NO: 8543707 - DNA, 22 bp, Homo sapiens
ctttggagaagaatgcatcctt

SEQ ID NO: 8543708 - DNA, 22 bp, Homo sapiens
ctttggaggaaaattgaggtca

SEQ ID NO: 8543709 - DNA, 19 bp, Homo sapiens
ctttggaggatgaggctgg

SEQ ID NO: 8543710 - DNA, 22 bp, Homo sapiens
ctttggcaacacatgtgggaca

SEQ ID NO: 8543711 - DNA, 22 bp, Homo sapiens
ctttggcaagggttttaattgt

SEQ ID NO: 8543712 - DNA, 22 bp, Homo sapiens
ctttggatgactggtgcaggtt

SEQ ID NO: 8543713 - DNA, 22 bp, Homo sapiens
ctttttctaatcataattgtct

SEQ ID NO: 8543714 - DNA, 20 bp, Homo sapiens
ctttttctccagctctgagc

SEQ ID NO: 8543715 - DNA, 20 bp, Homo sapiens
ctttttctccagctctgagc

SEQ ID NO: 8543716 - DNA, 22 bp, Homo sapiens
ctttttcttctaggtgtgcctg

SEQ ID NO: 8543717 - DNA, 22 bp, Homo sapiens
ctttttgtctctgtcctgatga

SEQ ID NO: 8543718 - DNA, 22 bp, Homo sapiens
ctttttctgatgttccatgatt

SEQ ID NO: 8543719 - DNA, 16 bp, Homo sapiens
ctttttctcccctctt

SEQ ID NO: 8543720 - DNA, 20 bp, Homo sapiens
ctttggcaatgagaacaggg

SEQ ID NO: 8543721 - DNA, 22 bp, Homo sapiens
ctttggcaatgtcattttcaat

SEQ ID NO: 8543722 - DNA, 22 bp, Homo sapiens
ctttggcacagtctcatttgat

SEQ ID NO: 8543723 - DNA, 22 bp, Homo sapiens
cttttgttaggagaaaacatca

SEQ ID NO: 8543724 - DNA, 22 bp, Homo sapiens
cttttgttaggagaaaacatca

SEQ ID NO: 8543725 - DNA, 22 bp, Homo sapiens
cttcactgatgggacagctcaa

SEQ ID NO: 8543726 - DNA, 22 bp, Homo sapiens
cttcactggaatctgtaatagt

SEQ ID NO: 8543727 - DNA, 22 bp, Homo sapiens
cttcactgcagtcatggctctg

SEQ ID NO: 8543728 - DNA, 22 bp, Homo sapiens
cttcacctcctcctctgtgggc

SEQ ID NO: 8543729 - DNA, 22 bp, Homo sapiens
cttcactgagtagtctagactc

SEQ ID NO: 8543730 - DNA, 22 bp, Homo sapiens
cttcacatttgcgaaggccaaa

SEQ ID NO: 8543731 - DNA, 22 bp, Homo sapiens
cttcacattgggcttgatatga

SEQ ID NO: 8543732 - DNA, 22 bp, Homo sapiens
cttcacattgggcttgatatga

SEQ ID NO: 8543733 - DNA, 22 bp, Homo sapiens
cttcacattgggcttgatatga

SEQ ID NO: 8543734 - DNA, 22 bp, Homo sapiens
cttcacattagtttggatcaaa

SEQ ID NO: 8543735 - DNA, 22 bp, Homo sapiens
cttcacagtctttatttcctcc

SEQ ID NO: 8543736 - DNA, 22 bp, Homo sapiens
cttcacagtctttatttcctcc

SEQ ID NO: 8543737 - DNA, 22 bp, Homo sapiens
cttcacagtctttatttcctcc

SEQ ID NO: 8543738 - DNA, 22 bp, Homo sapiens
cttcacatctccctaaaacagc

SEQ ID NO: 8543739 - DNA, 22 bp, Homo sapiens
cttcacataaacaaagggccat

SEQ ID NO: 8543740 - DNA, 22 bp, Homo sapiens
cttcacatgttggagtcctttg

SEQ ID NO: 8543741 - DNA, 22 bp, Homo sapiens
cttcacatgttggagtcctttg

SEQ ID NO: 8543742 - DNA, 22 bp, Homo sapiens
cttcacatgggtactgctgatc

SEQ ID NO: 8543743 - DNA, 22 bp, Homo sapiens
cttcacatgatgtccgtgctgt

SEQ ID NO: 8543744 - DNA, 19 bp, Homo sapiens
cttcacatctgtgagggga

SEQ ID NO: 8543745 - DNA, 22 bp, Homo sapiens
cttcacttgctcatcatgctat

SEQ ID NO: 8543746 - DNA, 22 bp, Homo sapiens
cttcacttgctcatcatgctat

SEQ ID NO: 8543747 - DNA, 22 bp, Homo sapiens
cttccaggacaccagggtagta

SEQ ID NO: 8543748 - DNA, 22 bp, Homo sapiens
cttccaggtaggcctaaggcag

SEQ ID NO: 8543749 - DNA, 22 bp, Homo sapiens
cttcagaaataacaacaattac

SEQ ID NO: 8543750 - DNA, 22 bp, Homo sapiens
cttcagaaccagccagaagagg

SEQ ID NO: 8543751 - DNA, 22 bp, Homo sapiens
ctgttaaatgagaaagcagact

SEQ ID NO: 8543752 - DNA, 23 bp, Homo sapiens
ctgttaaattccttaagagcagg

SEQ ID NO: 8543753 - DNA, 22 bp, Homo sapiens
cttcaaatacaagtagattatg

SEQ ID NO: 8543754 - DNA, 20 bp, Homo sapiens
ctgttaaaaggtatgaattc

SEQ ID NO: 8543755 - DNA, 20 bp, Homo sapiens
ctgttaaaaggtatgaattc

SEQ ID NO: 8543756 - DNA, 20 bp, Homo sapiens
ctgttaaaaggtatgaattc

SEQ ID NO: 8543757 - DNA, 22 bp, Homo sapiens
ctgttaaaatgtggtcttaaaa

SEQ ID NO: 8543758 - DNA, 22 bp, Homo sapiens
ctgttaaaatgtggtcttaaaa

SEQ ID NO: 8543759 - DNA, 22 bp, Homo sapiens
ctgttaaagatagttaagcttc

SEQ ID NO: 8543760 - DNA, 22 bp, Homo sapiens
ctgttaaagatagttaagcttc

SEQ ID NO: 8543761 - DNA, 22 bp, Homo sapiens
cttcacagtcaccctgctgtgt

SEQ ID NO: 8543762 - DNA, 22 bp, Homo sapiens
cttcacagtcaccctgctgtgt

SEQ ID NO: 8543763 - DNA, 22 bp, Homo sapiens
cttcacagtcaccctgctgtgt

SEQ ID NO: 8543764 - DNA, 22 bp, Homo sapiens
cttcacagtataggtccctgag

SEQ ID NO: 8543765 - DNA, 22 bp, Homo sapiens
cttcacagtaaatccagaagaa

SEQ ID NO: 8543766 - DNA, 22 bp, Homo sapiens
cttcacagccaacatgggcaca

SEQ ID NO: 8543767 - DNA, 22 bp, Homo sapiens
cttcacaggcaagtctgttttt

SEQ ID NO: 8543768 - DNA, 23 bp, Homo sapiens
cttcacaggttcaggggattaag

SEQ ID NO: 8543769 - DNA, 22 bp, Homo sapiens
cttcacaggcaagtctgttttt

SEQ ID NO: 8543770 - DNA, 22 bp, Homo sapiens
cttcacagtaaatccagaagaa

SEQ ID NO: 8543771 - DNA, 22 bp, Homo sapiens
cttcacagtaaatccagaagaa

SEQ ID NO: 8543772 - DNA, 22 bp, Homo sapiens
cttcacagtaaatccagaagaa

SEQ ID NO: 8543773 - DNA, 23 bp, Homo sapiens
cttcacaggttcaggggattaag

SEQ ID NO: 8543774 - DNA, 23 bp, Homo sapiens
cttcacaggttcaggggattaag

SEQ ID NO: 8543775 - DNA, 22 bp, Homo sapiens
cttcacagatgctgagagggct

SEQ ID NO: 8543776 - DNA, 22 bp, Homo sapiens
cttcacagagtccctgattgtt

SEQ ID NO: 8543777 - DNA, 22 bp, Homo sapiens
cttcacagcatgagctttggag

SEQ ID NO: 8543778 - DNA, 22 bp, Homo sapiens
cttcacagccaacatgggcaca

SEQ ID NO: 8543779 - DNA, 22 bp, Homo sapiens
cttcacagccaacatgggcaca

SEQ ID NO: 8543780 - DNA, 22 bp, Homo sapiens
cttcacagcatgagctttggag

SEQ ID NO: 8543781 - DNA, 22 bp, Homo sapiens
cttcacagaataaactcattat

SEQ ID NO: 8543782 - DNA, 22 bp, Homo sapiens
cttcaaatgtgattttaataac

SEQ ID NO: 8543783 - DNA, 22 bp, Homo sapiens
cttcaaatgtgattttaataac

SEQ ID NO: 8543784 - DNA, 16 bp, Homo sapiens
cttcacagaggagagt

SEQ ID NO: 8543785 - DNA, 16 bp, Homo sapiens
cttcacagaggagagt

SEQ ID NO: 8543786 - DNA, 22 bp, Homo sapiens
cttcacagaataaactcattat

SEQ ID NO: 8543787 - DNA, 22 bp, Homo sapiens
cttcacagaataaactcattat

SEQ ID NO: 8543788 - DNA, 22 bp, Homo sapiens
cttcacagagtccctgattgtt

SEQ ID NO: 8543789 - DNA, 22 bp, Homo sapiens
cttcacagagtccctgattgtt

SEQ ID NO: 8543790 - DNA, 22 bp, Homo sapiens
cttcttcaatagcaagcgcata

SEQ ID NO: 8543791 - DNA, 22 bp, Homo sapiens
cttcttcagaggccagcctctg

SEQ ID NO: 8543792 - DNA, 20 bp, Homo sapiens
cttcttcagcctatgcttca

SEQ ID NO: 8543793 - DNA, 22 bp, Homo sapiens
cttcttcataggcagtcctgtt

SEQ ID NO: 8543794 - DNA, 22 bp, Homo sapiens
cttcttcataggcagtcctgtt

SEQ ID NO: 8543795 - DNA, 22 bp, Homo sapiens
cttcttcatctgtaaaacttgg

SEQ ID NO: 8543796 - DNA, 22 bp, Homo sapiens
cttcccttctgcagatctttgg

SEQ ID NO: 8543797 - DNA, 22 bp, Homo sapiens
cttcccttctgtgcagggcaga

SEQ ID NO: 8543798 - DNA, 22 bp, Homo sapiens
cttcccttggtgaacagagcat

SEQ ID NO: 8543799 - DNA, 22 bp, Homo sapiens
cttccctttctggtgacttctc

SEQ ID NO: 8543800 - DNA, 22 bp, Homo sapiens
cttccctttagcatatagtagt

SEQ ID NO: 8543801 - DNA, 22 bp, Homo sapiens
cttcccttggtgaacagagcat

SEQ ID NO: 8543802 - DNA, 22 bp, Homo sapiens
cttctgtgacgtatgtgaggac

SEQ ID NO: 8543803 - DNA, 22 bp, Homo sapiens
cttctgtgagtcagtgtttctg

SEQ ID NO: 8543804 - DNA, 22 bp, Homo sapiens
cttctgtgacgtatgtgaggac

SEQ ID NO: 8543805 - DNA, 22 bp, Homo sapiens
cttctgtgaccaccagcagccc

SEQ ID NO: 8543806 - DNA, 22 bp, Homo sapiens
cttctgtgaagagcagaaccat

SEQ ID NO: 8543807 - DNA, 22 bp, Homo sapiens
cttctgtgaatgaagtgtggga

SEQ ID NO: 8543808 - DNA, 19 bp, Homo sapiens
cttctgtgatacatcagtc

SEQ ID NO: 8543809 - DNA, 22 bp, Homo sapiens
cttctgtgagtcagtgtttctg

SEQ ID NO: 8543810 - DNA, 19 bp, Homo sapiens
cttcccctgttacctcact

SEQ ID NO: 8543811 - DNA, 19 bp, Homo sapiens
cttcccctgttacctcact

SEQ ID NO: 8543812 - DNA, 21 bp, Homo sapiens
cttccccaggctggtctgtat

SEQ ID NO: 8543813 - DNA, 22 bp, Homo sapiens
cttccctgataagagcctcaga

SEQ ID NO: 8543814 - DNA, 22 bp, Homo sapiens
cttccctgataagagcctcaga

SEQ ID NO: 8543815 - DNA, 22 bp, Homo sapiens
cttccctgagctttctcaggct

SEQ ID NO: 8543816 - DNA, 22 bp, Homo sapiens
cttccctgagctttctcaggct

SEQ ID NO: 8543817 - DNA, 22 bp, Homo sapiens
cttccctgataagagcctcaga

SEQ ID NO: 8543818 - DNA, 22 bp, Homo sapiens
cttccctgataagagcctcaga

SEQ ID NO: 8543819 - DNA, 22 bp, Homo sapiens
cttccctggtgttagcccaatg

SEQ ID NO: 8543820 - DNA, 22 bp, Homo sapiens
cttcccttcctggggcaattta

SEQ ID NO: 8543821 - DNA, 22 bp, Homo sapiens
cttcccttcccctcacggagac

SEQ ID NO: 8543822 - DNA, 22 bp, Homo sapiens
cttcccagaccttagagtgcag

SEQ ID NO: 8543823 - DNA, 22 bp, Homo sapiens
cttcccagaacaatgtaggctt

SEQ ID NO: 8543824 - DNA, 22 bp, Homo sapiens
cttcccagacggggtggcagcc

SEQ ID NO: 8543825 - DNA, 22 bp, Homo sapiens
cttcccagttctgcttgagggg

SEQ ID NO: 8543826 - DNA, 22 bp, Homo sapiens
cttcccatataactaatttctg

SEQ ID NO: 8543827 - DNA, 22 bp, Homo sapiens
cttccccaaccccgactgtgtg

SEQ ID NO: 8543828 - DNA, 22 bp, Homo sapiens
cttccccaagtagagaggggag

SEQ ID NO: 8543829 - DNA, 22 bp, Homo sapiens
cttccccaaccccgactgtgtg

SEQ ID NO: 8543830 - DNA, 22 bp, Homo sapiens
cttggacccactcccagaattg

SEQ ID NO: 8543831 - DNA, 22 bp, Homo sapiens
cttggagaaaggaaagggcttg

SEQ ID NO: 8543832 - DNA, 18 bp, Homo sapiens
cttggagaactaatgata

SEQ ID NO: 8543833 - DNA, 22 bp, Homo sapiens
cttggagaaaggaaagggcttg

SEQ ID NO: 8543834 - DNA, 22 bp, Homo sapiens
cttggactttagtctctctcca

SEQ ID NO: 8543835 - DNA, 21 bp, Homo sapiens
cttggaacgggtagaactcac

SEQ ID NO: 8543836 - DNA, 22 bp, Homo sapiens
cttggaacttagtaatatgaca

SEQ ID NO: 8543837 - DNA, 22 bp, Homo sapiens
cttggaatggggcagaaaatgg

SEQ ID NO: 8543838 - DNA, 22 bp, Homo sapiens
cttggagacattgatcttttgc

SEQ ID NO: 8543839 - DNA, 22 bp, Homo sapiens
cttggagacaggacaggcagaa

SEQ ID NO: 8543840 - DNA, 22 bp, Homo sapiens
cttggagaatgacagtggatta

SEQ ID NO: 8543841 - DNA, 22 bp, Homo sapiens
cttggagacaggacaggcagaa

SEQ ID NO: 8543842 - DNA, 22 bp, Homo sapiens
cttggagaatgacagtggatta

SEQ ID NO: 8543843 - DNA, 19 bp, Homo sapiens
cttggagaaggctatgacc

SEQ ID NO: 8543844 - DNA, 22 bp, Homo sapiens
cttggagaatcctggttattca

SEQ ID NO: 8543845 - DNA, 22 bp, Homo sapiens
cttggagatacagaggacattt

SEQ ID NO: 8543846 - DNA, 22 bp, Homo sapiens
cttggagagtggttatccctgt

SEQ ID NO: 8543847 - DNA, 22 bp, Homo sapiens
cttggagatacaagtggtacct

SEQ ID NO: 8543848 - DNA, 22 bp, Homo sapiens
cttggagagagcctcagctgtt

SEQ ID NO: 8543849 - DNA, 22 bp, Homo sapiens
cttggagaccagtgacattgct

SEQ ID NO: 8543850 - DNA, 22 bp, Homo sapiens
cttggagagagcctcagctgtt

SEQ ID NO: 8543851 - DNA, 22 bp, Homo sapiens
cttggagagggagaaaaataac

SEQ ID NO: 8543852 - DNA, 22 bp, Homo sapiens
cttgctttccaaatgactcact

SEQ ID NO: 8543853 - DNA, 22 bp, Homo sapiens
cttggaacaaattaaacaatac

SEQ ID NO: 8543854 - DNA, 22 bp, Homo sapiens
cttggaaaggttttacaaagcg

SEQ ID NO: 8543855 - DNA, 22 bp, Homo sapiens
cttgcttctgctgcactatcct

SEQ ID NO: 8543856 - DNA, 22 bp, Homo sapiens
cttgctgttgtgggagactggg

SEQ ID NO: 8543857 - DNA, 22 bp, Homo sapiens
cttgctgtgtgccatcagggct

SEQ ID NO: 8543858 - DNA, 22 bp, Homo sapiens
cttgctgtgtggtgttctcaga

SEQ ID NO: 8543859 - DNA, 22 bp, Homo sapiens
cttgctgtcttgcatttagagc

SEQ ID NO: 8543860 - DNA, 22 bp, Homo sapiens
cttgctttcagtctcggcctca

SEQ ID NO: 8543861 - DNA, 22 bp, Homo sapiens
cttgctttatctggtttctcat

SEQ ID NO: 8543862 - DNA, 22 bp, Homo sapiens
cttgcttgattatgatcataaa

SEQ ID NO: 8543863 - DNA, 22 bp, Homo sapiens
cttgcttggagaagagatcagt

SEQ ID NO: 8543864 - DNA, 22 bp, Homo sapiens
cttgcttgccatgggcttgggc

SEQ ID NO: 8543865 - DNA, 22 bp, Homo sapiens
cttgcttgtttagttcacagat

SEQ ID NO: 8543866 - DNA, 22 bp, Homo sapiens
cttgcctgccactacagctgaa

SEQ ID NO: 8543867 - DNA, 22 bp, Homo sapiens
cttgcctctgctaatggtttct

SEQ ID NO: 8543868 - DNA, 22 bp, Homo sapiens
cttgcctgaggaacagagggta

SEQ ID NO: 8543869 - DNA, 22 bp, Homo sapiens
cttgctggggtaagtctgtgct

SEQ ID NO: 8543870 - DNA, 22 bp, Homo sapiens
cttgctggggtaagtctgtgct

SEQ ID NO: 8543871 - DNA, 22 bp, Homo sapiens
cttgctgtcttgcatttagagc

SEQ ID NO: 8543872 - DNA, 22 bp, Homo sapiens
cttgctgtcccttggtatgaac

SEQ ID NO: 8543873 - DNA, 22 bp, Homo sapiens
cttgctggtggtgttttctatg

SEQ ID NO: 8543874 - DNA, 19 bp, Homo sapiens
cttgctgggtggtttctgc

SEQ ID NO: 8543875 - DNA, 22 bp, Homo sapiens
cttcttcttcccccttcagggg

SEQ ID NO: 8543876 - DNA, 22 bp, Homo sapiens
cttcttctggacaggcagctcc

SEQ ID NO: 8543877 - DNA, 22 bp, Homo sapiens
cttcttctggtttatgtggcaa

SEQ ID NO: 8543878 - DNA, 22 bp, Homo sapiens
cttgcctacttgtcaaccagca

SEQ ID NO: 8543879 - DNA, 22 bp, Homo sapiens
cttgcctccctcagctcacagc

SEQ ID NO: 8543880 - DNA, 22 bp, Homo sapiens
cttgcctccctcagctcacagc

SEQ ID NO: 8543881 - DNA, 22 bp, Homo sapiens
cttcttccaagcttatgctcaa

SEQ ID NO: 8543882 - DNA, 22 bp, Homo sapiens
cttcttccaagcttatgctcaa

SEQ ID NO: 8543883 - DNA, 22 bp, Homo sapiens
cttcttcccagcttccctcacc

SEQ ID NO: 8543884 - DNA, 22 bp, Homo sapiens
cttcttctctacatcctttgat

SEQ ID NO: 8543885 - DNA, 22 bp, Homo sapiens
cttcttctctacatcctttgat

SEQ ID NO: 8543886 - DNA, 22 bp, Homo sapiens
cttcttctcaaggggcaggtgg

SEQ ID NO: 8543887 - DNA, 22 bp, Homo sapiens
cttcttcctgctgcagcctcca

SEQ ID NO: 8543888 - DNA, 22 bp, Homo sapiens
cttcttcctgctgcagcctcca

SEQ ID NO: 8543889 - DNA, 22 bp, Homo sapiens
cttcttcctgaaagctggctct

SEQ ID NO: 8543890 - DNA, 22 bp, Homo sapiens
ctttcctctggcactgtctggt

SEQ ID NO: 8543891 - DNA, 22 bp, Homo sapiens
ctttcctgaaatctcttctgca

SEQ ID NO: 8543892 - DNA, 22 bp, Homo sapiens
ctttcctctggcactgtctggt

SEQ ID NO: 8543893 - DNA, 22 bp, Homo sapiens
ctttcctccactccctaggctt

SEQ ID NO: 8543894 - DNA, 22 bp, Homo sapiens
ctttcctgagaaaggagaagga

SEQ ID NO: 8543895 - DNA, 22 bp, Homo sapiens
ctttcctgagaaaggagaagga

SEQ ID NO: 8543896 - DNA, 22 bp, Homo sapiens
ctttcctgaggagtatggctgt

SEQ ID NO: 8543897 - DNA, 22 bp, Homo sapiens
ctttcctggctggcagttgtgg

SEQ ID NO: 8543898 - DNA, 22 bp, Homo sapiens
ctttcctggctggcagttgtgg

SEQ ID NO: 8543899 - DNA, 22 bp, Homo sapiens
ctttcctgccttattcattcat

SEQ ID NO: 8543900 - DNA, 23 bp, Homo sapiens
ctttcctttctttgacacccagc

SEQ ID NO: 8543901 - DNA, 23 bp, Homo sapiens
ctttcctttctttgacacccagc

SEQ ID NO: 8543902 - DNA, 23 bp, Homo sapiens
ctttcctttctttgacacccagc

SEQ ID NO: 8543903 - DNA, 22 bp, Homo sapiens
ctttccttctcgtggttctcac

SEQ ID NO: 8543904 - DNA, 22 bp, Homo sapiens
cttggagattcattgcctgaaa

SEQ ID NO: 8543905 - DNA, 22 bp, Homo sapiens
cttggaggaaaggcagggagac

SEQ ID NO: 8543906 - DNA, 22 bp, Homo sapiens
cttggagcccagcaggcctgga

SEQ ID NO: 8543907 - DNA, 22 bp, Homo sapiens
cttggaggaaaggcagggagac

SEQ ID NO: 8543908 - DNA, 22 bp, Homo sapiens
cttggaggatgtgcggctgccc

SEQ ID NO: 8543909 - DNA, 22 bp, Homo sapiens
cttggagtgaatgggggcaggt

SEQ ID NO: 8543910 - DNA, 22 bp, Homo sapiens
ctttcctagttggtcccagcac

SEQ ID NO: 8543911 - DNA, 22 bp, Homo sapiens
ctttccagacctccttgtagct

SEQ ID NO: 8543912 - DNA, 22 bp, Homo sapiens
ctttccagatttgtccagttat

SEQ ID NO: 8543913 - DNA, 22 bp, Homo sapiens
ctttccagacctccttgtagct

SEQ ID NO: 8543914 - DNA, 22 bp, Homo sapiens
ctttgcatacaatttttagaaa

SEQ ID NO: 8543915 - DNA, 22 bp, Homo sapiens
ctttctcttcactgtcatgatc

SEQ ID NO: 8543916 - DNA, 22 bp, Homo sapiens
ctttctcttacccaaggatctg

SEQ ID NO: 8543917 - DNA, 22 bp, Homo sapiens
ctttctctgtgtttcacatgct

SEQ ID NO: 8543918 - DNA, 22 bp, Homo sapiens
ctttctcttacccaaggatctg

SEQ ID NO: 8543919 - DNA, 22 bp, Homo sapiens
ctttctctgtgtggtaaagggc

SEQ ID NO: 8543920 - DNA, 22 bp, Homo sapiens
ctttctctgtggtgaggagggt

SEQ ID NO: 8543921 - DNA, 22 bp, Homo sapiens
ctttctctgtgtttcacatgct

SEQ ID NO: 8543922 - DNA, 22 bp, Homo sapiens
ctttctctgtgtttcacatgct

SEQ ID NO: 8543923 - DNA, 22 bp, Homo sapiens
ctttctctggaggggagtggtt

SEQ ID NO: 8543924 - DNA, 22 bp, Homo sapiens
ctttctctggaggggagtggtt

SEQ ID NO: 8543925 - DNA, 20 bp, Homo sapiens
ctttctctaatttataagta

SEQ ID NO: 8543926 - DNA, 22 bp, Homo sapiens
ctttctaattctcccatagtct

SEQ ID NO: 8543927 - DNA, 22 bp, Homo sapiens
ctttctcagtgttaattacttt

SEQ ID NO: 8543928 - DNA, 22 bp, Homo sapiens
ctttctcagtgttaattacttt

SEQ ID NO: 8543929 - DNA, 22 bp, Homo sapiens
ctgggcctcaccctagaccaat

SEQ ID NO: 8543930 - DNA, 22 bp, Homo sapiens
ctgggcctcaatctcagagttt

SEQ ID NO: 8543931 - DNA, 22 bp, Homo sapiens
ctgggcctcaatctcagagttt

SEQ ID NO: 8543932 - DNA, 22 bp, Homo sapiens
ctgggcctcatcctcagagttt

SEQ ID NO: 8543933 - DNA, 22 bp, Homo sapiens
ctgggcctcatcctcagagttt

SEQ ID NO: 8543934 - DNA, 22 bp, Homo sapiens
ctgggcctcatgcacagagatg

SEQ ID NO: 8543935 - DNA, 22 bp, Homo sapiens
ctgggcctcatccccagagttt

SEQ ID NO: 8543936 - DNA, 22 bp, Homo sapiens
ctgggcctagaggaagctgaca

SEQ ID NO: 8543937 - DNA, 22 bp, Homo sapiens
ctgggccctgaagacagtcagg

SEQ ID NO: 8543938 - DNA, 22 bp, Homo sapiens
ctgggccctatggaagaaaggg

SEQ ID NO: 8543939 - DNA, 22 bp, Homo sapiens
ctgggccctatggaagaaaggg

SEQ ID NO: 8543940 - DNA, 22 bp, Homo sapiens
ctgggcctagcaacagaggagt

SEQ ID NO: 8543941 - DNA, 22 bp, Homo sapiens
ctgggcctagcaacagaggagt

SEQ ID NO: 8543942 - DNA, 22 bp, Homo sapiens
ctgggcctagcaacagaggagt

SEQ ID NO: 8543943 - DNA, 22 bp, Homo sapiens
ctgggcctagcaacagaggagt

SEQ ID NO: 8543944 - DNA, 23 bp, Homo sapiens
ctgggcctatggtctgaatccaa

SEQ ID NO: 8543945 - DNA, 22 bp, Homo sapiens
ctgggcctaggatggaagggcc

SEQ ID NO: 8543946 - DNA, 22 bp, Homo sapiens
ctgggctccactacttgctaac

SEQ ID NO: 8543947 - DNA, 21 bp, Homo sapiens
ctgggctcatggtgttacaga

SEQ ID NO: 8543948 - DNA, 22 bp, Homo sapiens
ctgggctccactcccacagtgt

SEQ ID NO: 8543949 - DNA, 22 bp, Homo sapiens
ctgggctcagcccatgctgtcc

SEQ ID NO: 8543950 - DNA, 22 bp, Homo sapiens
ctgggctcagtggctcatggct

SEQ ID NO: 8543951 - DNA, 22 bp, Homo sapiens
ctgggctcagtgtctcactcct

SEQ ID NO: 8543952 - DNA, 22 bp, Homo sapiens
ctgggctcagtgtctcactcct

SEQ ID NO: 8543953 - DNA, 22 bp, Homo sapiens
ctgggctcagtggctcatggct

SEQ ID NO: 8543954 - DNA, 22 bp, Homo sapiens
ctgggcctccacgggccatcac

SEQ ID NO: 8543955 - DNA, 22 bp, Homo sapiens
ctgggcctccagctctgccagc

SEQ ID NO: 8543956 - DNA, 22 bp, Homo sapiens
ctgggctcaaatcctggccctg

SEQ ID NO: 8543957 - DNA, 22 bp, Homo sapiens
ctgggctcaaatcctggccctg

SEQ ID NO: 8543958 - DNA, 22 bp, Homo sapiens
ctgggctcaagaagtcttccct

SEQ ID NO: 8543959 - DNA, 22 bp, Homo sapiens
ctgggctcagcccatgctgtcc

SEQ ID NO: 8543960 - DNA, 22 bp, Homo sapiens
ctgggctcagcccatgctgtcc

SEQ ID NO: 8543961 - DNA, 22 bp, Homo sapiens
ctgggaggcggaggttgcagtg

SEQ ID NO: 8543962 - DNA, 22 bp, Homo sapiens
ctgggaggcggaggttgcagtg

SEQ ID NO: 8543963 - DNA, 22 bp, Homo sapiens
ctgggaggcggaggttgcagtg

SEQ ID NO: 8543964 - DNA, 22 bp, Homo sapiens
ctgggaggcggaggttgcagtg

SEQ ID NO: 8543965 - DNA, 22 bp, Homo sapiens
ctgggagtcaccaggagcaagg

SEQ ID NO: 8543966 - DNA, 22 bp, Homo sapiens
ctgggagtcaccaggagcaagg

SEQ ID NO: 8543967 - DNA, 22 bp, Homo sapiens
ctgggagtctggcctctggtcc

SEQ ID NO: 8543968 - DNA, 22 bp, Homo sapiens
ctgggagtctggcctctggtcc

SEQ ID NO: 8543969 - DNA, 22 bp, Homo sapiens
ctgggagtggtgacagctctcg

SEQ ID NO: 8543970 - DNA, 22 bp, Homo sapiens
ctgggagtctaagctagcaccg

SEQ ID NO: 8543971 - DNA, 22 bp, Homo sapiens
ctggagctaggaagtccaagat

SEQ ID NO: 8543972 - DNA, 22 bp, Homo sapiens
ctggagctaggaagtccaagat

SEQ ID NO: 8543973 - DNA, 22 bp, Homo sapiens
ctggagctaataatccatctga

SEQ ID NO: 8543974 - DNA, 22 bp, Homo sapiens
ctggagctaataatccatctga

SEQ ID NO: 8543975 - DNA, 22 bp, Homo sapiens
ctggagctcagcccaggttcca

SEQ ID NO: 8543976 - DNA, 22 bp, Homo sapiens
ctggagctcagcccaggttcca

SEQ ID NO: 8543977 - DNA, 22 bp, Homo sapiens
ctggagctaggaagtccaagat

SEQ ID NO: 8543978 - DNA, 22 bp, Homo sapiens
ctggagccttcaccaggggaaa

SEQ ID NO: 8543979 - DNA, 22 bp, Homo sapiens
ctggagccttcaccaggggaaa

SEQ ID NO: 8543980 - DNA, 22 bp, Homo sapiens
ctggagccttcaccaggggaaa

SEQ ID NO: 8543981 - DNA, 22 bp, Homo sapiens
ctggagctaataatccatctga

SEQ ID NO: 8543982 - DNA, 22 bp, Homo sapiens
ctggagccttcaccaggggaaa

SEQ ID NO: 8543983 - DNA, 22 bp, Homo sapiens
ctggagctccagggtctcctct

SEQ ID NO: 8543984 - DNA, 22 bp, Homo sapiens
ctgggaggcggaggttgcagtg

SEQ ID NO: 8543985 - DNA, 22 bp, Homo sapiens
ctggagctccagggtctcctct

SEQ ID NO: 8543986 - DNA, 22 bp, Homo sapiens
ctggagctccagggtctcctct

SEQ ID NO: 8543987 - DNA, 22 bp, Homo sapiens
ctgggcccacgagggctctggg

SEQ ID NO: 8543988 - DNA, 22 bp, Homo sapiens
ctgggcccacgagggctctggg

SEQ ID NO: 8543989 - DNA, 22 bp, Homo sapiens
ctgggcccacgagggctctggg

SEQ ID NO: 8543990 - DNA, 22 bp, Homo sapiens
ctgggccaggaccagggttgaa

SEQ ID NO: 8543991 - DNA, 22 bp, Homo sapiens
ctgggccaggaccagggttgaa

SEQ ID NO: 8543992 - DNA, 22 bp, Homo sapiens
ctgggatgtctatagaacactt

SEQ ID NO: 8543993 - DNA, 22 bp, Homo sapiens
ctgggccagcaactgcaatgga

SEQ ID NO: 8543994 - DNA, 22 bp, Homo sapiens
ctgggccagcaactgcaatgga

SEQ ID NO: 8543995 - DNA, 22 bp, Homo sapiens
ctgggatgtctatagaacactt

SEQ ID NO: 8543996 - DNA, 19 bp, Homo sapiens
ctgggagttcactgctgcc

SEQ ID NO: 8543997 - DNA, 19 bp, Homo sapiens
ctgggagttcactgctgcc

SEQ ID NO: 8543998 - DNA, 22 bp, Homo sapiens
ctgggagttgacgaggcttgta

SEQ ID NO: 8543999 - DNA, 22 bp, Homo sapiens
ctgggagttgacgaggcttgta

SEQ ID NO: 8544000 - DNA, 22 bp, Homo sapiens
ctgggagtgttctaggtcacat

SEQ ID NO: 8544001 - DNA, 22 bp, Homo sapiens
ctgggagtgttctaggtcacat

SEQ ID NO: 8544002 - DNA, 22 bp, Homo sapiens
ctgggagtgttctaggtcacat

SEQ ID NO: 8544003 - DNA, 22 bp, Homo sapiens
ctgggatgatagtgctagtatt

SEQ ID NO: 8544004 - DNA, 22 bp, Homo sapiens
ctgggatgatagtgctagtatt

SEQ ID NO: 8544005 - DNA, 22 bp, Homo sapiens
ctggggggagctgcgtccagca

SEQ ID NO: 8544006 - DNA, 22 bp, Homo sapiens
ctgggggcagcaagaagccatg

SEQ ID NO: 8544007 - DNA, 22 bp, Homo sapiens
ctggggctgtaggaggacttat

SEQ ID NO: 8544008 - DNA, 22 bp, Homo sapiens
ctggggctggtgaggcaggctc

SEQ ID NO: 8544009 - DNA, 22 bp, Homo sapiens
ctggggctggtgaggcaggctc

SEQ ID NO: 8544010 - DNA, 22 bp, Homo sapiens
ctgggctctaagggagcaccgt

SEQ ID NO: 8544011 - DNA, 22 bp, Homo sapiens
ctgggctccctcatgtgtctgc

SEQ ID NO: 8544012 - DNA, 22 bp, Homo sapiens
ctgggctcctaaccatccaggt

SEQ ID NO: 8544013 - DNA, 22 bp, Homo sapiens
ctgggctcctaaccatccaggt

SEQ ID NO: 8544014 - DNA, 22 bp, Homo sapiens
ctgggctcctaaccatccaggt

SEQ ID NO: 8544015 - DNA, 22 bp, Homo sapiens
ctgggctcctaaccatccaggt

SEQ ID NO: 8544016 - DNA, 20 bp, Homo sapiens
ctgggctcggtggccctggc

SEQ ID NO: 8544017 - DNA, 18 bp, Homo sapiens
ctgggctcgagagatcct

SEQ ID NO: 8544018 - DNA, 18 bp, Homo sapiens
ctgggctcgagagatcct

SEQ ID NO: 8544019 - DNA, 22 bp, Homo sapiens
ctggggggctactgacagagga

SEQ ID NO: 8544020 - DNA, 22 bp, Homo sapiens
ctgggggtcgcgcctctgggca

SEQ ID NO: 8544021 - DNA, 22 bp, Homo sapiens
ctggggtctcaattctagcggg

SEQ ID NO: 8544022 - DNA, 22 bp, Homo sapiens
ctggggtctcaattctagcggg

SEQ ID NO: 8544023 - DNA, 22 bp, Homo sapiens
ctggggtgagcagaaacagggg

SEQ ID NO: 8544024 - DNA, 22 bp, Homo sapiens
ctggggtcagggatcagagagc

SEQ ID NO: 8544025 - DNA, 22 bp, Homo sapiens
ctggggtggaggagctcccctg

SEQ ID NO: 8544026 - DNA, 22 bp, Homo sapiens
ctggggtggagattggcaatct

SEQ ID NO: 8544027 - DNA, 22 bp, Homo sapiens
ctggggtggatgggtccaagtt

SEQ ID NO: 8544028 - DNA, 22 bp, Homo sapiens
ctggggtggatgggtccaagtt

SEQ ID NO: 8544029 - DNA, 22 bp, Homo sapiens
ctggggtgtctcgtctgccatt

SEQ ID NO: 8544030 - DNA, 22 bp, Homo sapiens
ctggggtgtctcgtctgccatt

SEQ ID NO: 8544031 - DNA, 22 bp, Homo sapiens
ctgggtgcttactttgtgctag

SEQ ID NO: 8544032 - DNA, 22 bp, Homo sapiens
ctggggtggatgggtccaagtt

SEQ ID NO: 8544033 - DNA, 22 bp, Homo sapiens
ctggggtggtgcaggcctcatg

SEQ ID NO: 8544034 - DNA, 22 bp, Homo sapiens
ctggggtggtgcaggcctcatg

SEQ ID NO: 8544035 - DNA, 22 bp, Homo sapiens
ctggggtggtgcaggcctcatg

SEQ ID NO: 8544036 - DNA, 22 bp, Homo sapiens
ctggggtggtgcaggcctcatg

SEQ ID NO: 8544037 - DNA, 22 bp, Homo sapiens
ctgggtgttgggtactgaccgt

SEQ ID NO: 8544038 - DNA, 22 bp, Homo sapiens
ctgggtgttcaggagctgggct

SEQ ID NO: 8544039 - DNA, 22 bp, Homo sapiens
ctgggtgtagcccagtatgagg

SEQ ID NO: 8544040 - DNA, 22 bp, Homo sapiens
ctgggtgtcaggagacatgatg

SEQ ID NO: 8544041 - DNA, 22 bp, Homo sapiens
ctgggtggaaagtgctgagaat

SEQ ID NO: 8544042 - DNA, 22 bp, Homo sapiens
ctgggtggaaagtgctgagaat

SEQ ID NO: 8544043 - DNA, 22 bp, Homo sapiens
ctgggtggaaagtgctgagaat

SEQ ID NO: 8544044 - DNA, 22 bp, Homo sapiens
ctgggtggaaagtgctgagaat

SEQ ID NO: 8544045 - DNA, 22 bp, Homo sapiens
ctgggtggaaagtgctgagaat

SEQ ID NO: 8544046 - DNA, 22 bp, Homo sapiens
ctgggtggttttgatgtgaatt

SEQ ID NO: 8544047 - DNA, 22 bp, Homo sapiens
ctgggtgtagatggaagtttgg

SEQ ID NO: 8544048 - DNA, 22 bp, Homo sapiens
ctgggtggttttgatgtgaatt

SEQ ID NO: 8544049 - DNA, 22 bp, Homo sapiens
ctgggtggttttgatgtgaatt

SEQ ID NO: 8544050 - DNA, 22 bp, Homo sapiens
ctgggtggttctaactgttgat

SEQ ID NO: 8544051 - DNA, 22 bp, Homo sapiens
ctgggtttagggtctccccttg

SEQ ID NO: 8544052 - DNA, 22 bp, Homo sapiens
ctgggttttattacagtgagct

SEQ ID NO: 8544053 - DNA, 22 bp, Homo sapiens
ctgggttttattacagtgagct

SEQ ID NO: 8544054 - DNA, 22 bp, Homo sapiens
ctggtacaaaatgctgatatca

SEQ ID NO: 8544055 - DNA, 22 bp, Homo sapiens
ctggtgctggagcctagtccct

SEQ ID NO: 8544056 - DNA, 22 bp, Homo sapiens
ctggtggggagtcctggtctcc

SEQ ID NO: 8544057 - DNA, 22 bp, Homo sapiens
ctggtcacctccttcccagcta

SEQ ID NO: 8544058 - DNA, 22 bp, Homo sapiens
ctggtgcctcctccctgtgctt

SEQ ID NO: 8544059 - DNA, 22 bp, Homo sapiens
ctggtgcctcctccctgtgctt

SEQ ID NO: 8544060 - DNA, 22 bp, Homo sapiens
ctggtcaaaaattatgcttact

SEQ ID NO: 8544061 - DNA, 22 bp, Homo sapiens
ctggtcaataatcatgtagtac

SEQ ID NO: 8544062 - DNA, 22 bp, Homo sapiens
ctggtgtggactccgcgcggag

SEQ ID NO: 8544063 - DNA, 22 bp, Homo sapiens
ctggtgtggcggcgccctgtag

SEQ ID NO: 8544064 - DNA, 22 bp, Homo sapiens
ctggtgtggcggcgccctgtag

SEQ ID NO: 8544065 - DNA, 22 bp, Homo sapiens
ctggtgtggcggcgccctgtag

SEQ ID NO: 8544066 - DNA, 22 bp, Homo sapiens
ctggtgtctactacatggttga

SEQ ID NO: 8544067 - DNA, 21 bp, Homo sapiens
ctggtgtagcactcaggtgct

SEQ ID NO: 8544068 - DNA, 22 bp, Homo sapiens
ctggtgtctgctccctcacagc

SEQ ID NO: 8544069 - DNA, 22 bp, Homo sapiens
ctggtgtctgctccctcacagc

SEQ ID NO: 8544070 - DNA, 22 bp, Homo sapiens
ctggtgtctgattctcccctga

SEQ ID NO: 8544071 - DNA, 22 bp, Homo sapiens
ctggtgtgattgagcccaggtg

SEQ ID NO: 8544072 - DNA, 22 bp, Homo sapiens
ctggttcatccccttccaggaa

SEQ ID NO: 8544073 - DNA, 22 bp, Homo sapiens
ctggttctgatgttcttggctt

SEQ ID NO: 8544074 - DNA, 22 bp, Homo sapiens
ctggttggaagtgcagactctc

SEQ ID NO: 8544075 - DNA, 22 bp, Homo sapiens
ctggttctgattttgctgcatt

SEQ ID NO: 8544076 - DNA, 22 bp, Homo sapiens
ctggtttagctgtaaggttccc

SEQ ID NO: 8544077 - DNA, 22 bp, Homo sapiens
ctggttggtgccacatggtggc

SEQ ID NO: 8544078 - DNA, 22 bp, Homo sapiens
ctggttgggaggttggctttca

SEQ ID NO: 8544079 - DNA, 22 bp, Homo sapiens
ctggtttagctgtaaggttccc

SEQ ID NO: 8544080 - DNA, 22 bp, Homo sapiens
ctgtcattgagcctgtcagggc

SEQ ID NO: 8544081 - DNA, 22 bp, Homo sapiens
ctgtcattcttacataatgtga

SEQ ID NO: 8544082 - DNA, 22 bp, Homo sapiens
ctgtcattgagcctgtcagggc

SEQ ID NO: 8544083 - DNA, 22 bp, Homo sapiens
ctgtcattcttacataatgtga

SEQ ID NO: 8544084 - DNA, 22 bp, Homo sapiens
ctgtcagtaggctcccatcatt

SEQ ID NO: 8544085 - DNA, 22 bp, Homo sapiens
ctgtcatcacagttgagcagcc

SEQ ID NO: 8544086 - DNA, 22 bp, Homo sapiens
ctgtcagttcttccagatagag

SEQ ID NO: 8544087 - DNA, 22 bp, Homo sapiens
ctggttttatgttatagatgga

SEQ ID NO: 8544088 - DNA, 22 bp, Homo sapiens
ctgtcccctgtgctttcacttg

SEQ ID NO: 8544089 - DNA, 22 bp, Homo sapiens
ctgtccccgcgagtccagagct

SEQ ID NO: 8544090 - DNA, 22 bp, Homo sapiens
ctgtccccgcgagtccagagct

SEQ ID NO: 8544091 - DNA, 20 bp, Homo sapiens
ctgtccccgaggtcaccagg

SEQ ID NO: 8544092 - DNA, 22 bp, Homo sapiens
ctgtccccgcgagtccagagct

SEQ ID NO: 8544093 - DNA, 20 bp, Homo sapiens
ctgtccccgaggtcaccagg

SEQ ID NO: 8544094 - DNA, 22 bp, Homo sapiens
ctgtcccatactatctgggtga

SEQ ID NO: 8544095 - DNA, 18 bp, Homo sapiens
ctgtcccatcctcaggtt

SEQ ID NO: 8544096 - DNA, 22 bp, Homo sapiens
ctgtccccacccaaatctcatc

SEQ ID NO: 8544097 - DNA, 18 bp, Homo sapiens
ctgtcccatcctcaggtt

SEQ ID NO: 8544098 - DNA, 22 bp, Homo sapiens
ctgtcccatccttactctaccc

SEQ ID NO: 8544099 - DNA, 22 bp, Homo sapiens
ctgtccccacccaaatctcatc

SEQ ID NO: 8544100 - DNA, 22 bp, Homo sapiens
ctgtcccacaagcagtgtgcac

SEQ ID NO: 8544101 - DNA, 22 bp, Homo sapiens
ctgtcccacaagcagtgtgcac

SEQ ID NO: 8544102 - DNA, 22 bp, Homo sapiens
ctgtccatggtgctggacggtc

SEQ ID NO: 8544103 - DNA, 22 bp, Homo sapiens
ctgtccatgcatgttgtctgct

SEQ ID NO: 8544104 - DNA, 22 bp, Homo sapiens
ctgtccatattcaaggggtagg

SEQ ID NO: 8544105 - DNA, 22 bp, Homo sapiens
ctgtccatcagaaaggggctta

SEQ ID NO: 8544106 - DNA, 22 bp, Homo sapiens
ctgtcccagatgttctcagcac

SEQ ID NO: 8544107 - DNA, 22 bp, Homo sapiens
ctgtcccagatgttctcagcac

SEQ ID NO: 8544108 - DNA, 22 bp, Homo sapiens
ctgtcccagatgttctcagcac

SEQ ID NO: 8544109 - DNA, 22 bp, Homo sapiens
ctgtcccagccccgtactctaa

SEQ ID NO: 8544110 - DNA, 22 bp, Homo sapiens
ctgtcccaggagctgtaagaca

SEQ ID NO: 8544111 - DNA, 22 bp, Homo sapiens
ctgtgacagagcttgagtgaga

SEQ ID NO: 8544112 - DNA, 22 bp, Homo sapiens
ctgtgaatttaaagcacacatc

SEQ ID NO: 8544113 - DNA, 22 bp, Homo sapiens
ctgtgaattgcaacaattgcaa

SEQ ID NO: 8544114 - DNA, 22 bp, Homo sapiens
ctgtgaatttaaagcacacatc

SEQ ID NO: 8544115 - DNA, 22 bp, Homo sapiens
ctgtgaattaagtattgttatc

SEQ ID NO: 8544116 - DNA, 22 bp, Homo sapiens
ctgtgaatgttatatctcaatg

SEQ ID NO: 8544117 - DNA, 22 bp, Homo sapiens
ctgtgaacaatagcagcatctt

SEQ ID NO: 8544118 - DNA, 22 bp, Homo sapiens
ctgtccctcatcacctctgggt

SEQ ID NO: 8544119 - DNA, 22 bp, Homo sapiens
ctgtccctcatcacctctgggt

SEQ ID NO: 8544120 - DNA, 21 bp, Homo sapiens
ctgtccctctttgcttccctc

SEQ ID NO: 8544121 - DNA, 22 bp, Homo sapiens
ctgtccctcatcacctctgggt

SEQ ID NO: 8544122 - DNA, 22 bp, Homo sapiens
ctgtccctctcacacctcacca

SEQ ID NO: 8544123 - DNA, 22 bp, Homo sapiens
ctgtctgtttcaaaagtggtta

SEQ ID NO: 8544124 - DNA, 22 bp, Homo sapiens
ctgtgaaactggacagcacttg

SEQ ID NO: 8544125 - DNA, 22 bp, Homo sapiens
ctgtgaaatcaaccttgagccc

SEQ ID NO: 8544126 - DNA, 22 bp, Homo sapiens
ctgtctgttgaccatagtttgc

SEQ ID NO: 8544127 - DNA, 22 bp, Homo sapiens
ctgtctgttcagattcattact

SEQ ID NO: 8544128 - DNA, 22 bp, Homo sapiens
ctgtctgttatctcaccagtcc

SEQ ID NO: 8544129 - DNA, 22 bp, Homo sapiens
ctgtctgtgtggacacggctgc

SEQ ID NO: 8544130 - DNA, 22 bp, Homo sapiens
ctgtctgtggtctcagtaggcc

SEQ ID NO: 8544131 - DNA, 22 bp, Homo sapiens
ctgtgagggcagggaccagagg

SEQ ID NO: 8544132 - DNA, 22 bp, Homo sapiens
ctgtgaggcgggtggagtggag

SEQ ID NO: 8544133 - DNA, 22 bp, Homo sapiens
ctgtgaggcctttggccagata

SEQ ID NO: 8544134 - DNA, 22 bp, Homo sapiens
ctgtgaggcctttggccagata

SEQ ID NO: 8544135 - DNA, 22 bp, Homo sapiens
ctgtgaggcctttggccagata

SEQ ID NO: 8544136 - DNA, 22 bp, Homo sapiens
ctgtgagctgggtggccaggac

SEQ ID NO: 8544137 - DNA, 22 bp, Homo sapiens
ctgtggaatcatcaggtcttac

SEQ ID NO: 8544138 - DNA, 22 bp, Homo sapiens
ctgtggaaggtttagataggta

SEQ ID NO: 8544139 - DNA, 22 bp, Homo sapiens
ctgtggaattgatgcttagtgt

SEQ ID NO: 8544140 - DNA, 22 bp, Homo sapiens
ctgtgagactgatagggaagag

SEQ ID NO: 8544141 - DNA, 22 bp, Homo sapiens
ctgtgagaaaggtgatggaggt

SEQ ID NO: 8544142 - DNA, 22 bp, Homo sapiens
ctgtgagatatgcatatgctct

SEQ ID NO: 8544143 - DNA, 22 bp, Homo sapiens
ctgtgagatatgcatatgctct

SEQ ID NO: 8544144 - DNA, 22 bp, Homo sapiens
ctgtgagatgaccaactgactg

SEQ ID NO: 8544145 - DNA, 22 bp, Homo sapiens
ctgtgagatgtttctggttaga

SEQ ID NO: 8544146 - DNA, 22 bp, Homo sapiens
ctgtgagatttttaaataactt

SEQ ID NO: 8544147 - DNA, 22 bp, Homo sapiens
ctgtgactgtgttggatgcaca

SEQ ID NO: 8544148 - DNA, 22 bp, Homo sapiens
ctgtgactggaatctggctctt

SEQ ID NO: 8544149 - DNA, 22 bp, Homo sapiens
ctgtgactggaatctggctctt

SEQ ID NO: 8544150 - DNA, 22 bp, Homo sapiens
ctgtgactggaatctggctctt

SEQ ID NO: 8544151 - DNA, 22 bp, Homo sapiens
ctgtgactgggtgacagtcctc

SEQ ID NO: 8544152 - DNA, 22 bp, Homo sapiens
ctgtgactgggtgacagtcctc

SEQ ID NO: 8544153 - DNA, 22 bp, Homo sapiens
ctgtgacttccactactgatca

SEQ ID NO: 8544154 - DNA, 22 bp, Homo sapiens
ctgtgactgtgttggatgcaca

SEQ ID NO: 8544155 - DNA, 22 bp, Homo sapiens
ctgtgactagacctgcaggaga

SEQ ID NO: 8544156 - DNA, 21 bp, Homo sapiens
ctgtgactccctgggcaatcc

SEQ ID NO: 8544157 - DNA, 18 bp, Homo sapiens
ctgtgactcctagatctc

SEQ ID NO: 8544158 - DNA, 18 bp, Homo sapiens
ctgtgactcctagatctc

SEQ ID NO: 8544159 - DNA, 22 bp, Homo sapiens
ctgtgactgcagcaccaagtaa

SEQ ID NO: 8544160 - DNA, 22 bp, Homo sapiens
ctgtgactgcagcaccaagtaa

SEQ ID NO: 8544161 - DNA, 22 bp, Homo sapiens
ctgtggcattgtgaggactgca

SEQ ID NO: 8544162 - DNA, 22 bp, Homo sapiens
ctgtggcattgccgaggctggc

SEQ ID NO: 8544163 - DNA, 22 bp, Homo sapiens
ctgtggcattgccgaggctggc

SEQ ID NO: 8544164 - DNA, 22 bp, Homo sapiens
ctgtggcattgccgaggctggc

SEQ ID NO: 8544165 - DNA, 22 bp, Homo sapiens
ctgtggcaggtgtctggggcag

SEQ ID NO: 8544166 - DNA, 22 bp, Homo sapiens
ctgtggcaggtgtctggggcag

SEQ ID NO: 8544167 - DNA, 22 bp, Homo sapiens
ctgtggcaggtgtctggggcag

SEQ ID NO: 8544168 - DNA, 20 bp, Homo sapiens
ctgtggcatctgtcatggtg

SEQ ID NO: 8544169 - DNA, 20 bp, Homo sapiens
ctgtggcatctgtcatggtg

SEQ ID NO: 8544170 - DNA, 22 bp, Homo sapiens
ctgtggcaggaagggactagca

SEQ ID NO: 8544171 - DNA, 22 bp, Homo sapiens
ctgtggatttaggcagagctga

SEQ ID NO: 8544172 - DNA, 23 bp, Homo sapiens
ctgtggcaagtcctgcacctgcc

SEQ ID NO: 8544173 - DNA, 22 bp, Homo sapiens
ctgtgggatgggacctcagctg

SEQ ID NO: 8544174 - DNA, 22 bp, Homo sapiens
ctgtgggatgggacctcagctg

SEQ ID NO: 8544175 - DNA, 22 bp, Homo sapiens
ctgtggctttctctgcctcctt

SEQ ID NO: 8544176 - DNA, 22 bp, Homo sapiens
ctgtggctttctctgcctcctt

SEQ ID NO: 8544177 - DNA, 22 bp, Homo sapiens
ctgtggctttctctgcctcctt

SEQ ID NO: 8544178 - DNA, 22 bp, Homo sapiens
ctgtgggagcactggggaccga

SEQ ID NO: 8544179 - DNA, 22 bp, Homo sapiens
ctgtggctttgcagggcttgtt

SEQ ID NO: 8544180 - DNA, 23 bp, Homo sapiens
ctgtggccacccctagctggagg

SEQ ID NO: 8544181 - DNA, 22 bp, Homo sapiens
ctgtggcttctaggtccccgat

SEQ ID NO: 8544182 - DNA, 22 bp, Homo sapiens
ctgtggcttctgcttgggcctc

SEQ ID NO: 8544183 - DNA, 22 bp, Homo sapiens
ctgtggcttctgggtcagttca

SEQ ID NO: 8544184 - DNA, 22 bp, Homo sapiens
ctgtgtgtgtctgcagcatact

SEQ ID NO: 8544185 - DNA, 22 bp, Homo sapiens
ctgtgtgtgtctgcagcatact

SEQ ID NO: 8544186 - DNA, 22 bp, Homo sapiens
ctgtgtgtgtctgcagcatact

SEQ ID NO: 8544187 - DNA, 22 bp, Homo sapiens
ctgtgtgtgtctgcagcatact

SEQ ID NO: 8544188 - DNA, 22 bp, Homo sapiens
ctgtgtgtgctacaggcttcca

SEQ ID NO: 8544189 - DNA, 22 bp, Homo sapiens
ctgtgtgtgctacaggcttcca

SEQ ID NO: 8544190 - DNA, 22 bp, Homo sapiens
ctgtgtgtgctacaggcttcca

SEQ ID NO: 8544191 - DNA, 22 bp, Homo sapiens
ctgtgtgtgctacaggcttcca

SEQ ID NO: 8544192 - DNA, 22 bp, Homo sapiens
ctgtgtgtgctacaggcttcca

SEQ ID NO: 8544193 - DNA, 22 bp, Homo sapiens
ctgtgtgtgagaagcaggttga

SEQ ID NO: 8544194 - DNA, 23 bp, Homo sapiens
ctgtgtgtgccgagggtggccac

SEQ ID NO: 8544195 - DNA, 23 bp, Homo sapiens
ctgtgtgtgccgagggtggccac

SEQ ID NO: 8544196 - DNA, 23 bp, Homo sapiens
ctgtgtgtgccgagggtggccac

SEQ ID NO: 8544197 - DNA, 23 bp, Homo sapiens
ctgtgtgtgccgagggtggccac

SEQ ID NO: 8544198 - DNA, 22 bp, Homo sapiens
ctgtgtgtgagaagcaggttga

SEQ ID NO: 8544199 - DNA, 22 bp, Homo sapiens
ctgtgtgtgagaagcaggttga

SEQ ID NO: 8544200 - DNA, 22 bp, Homo sapiens
ctgtgtgtgaacacagcccagc

SEQ ID NO: 8544201 - DNA, 22 bp, Homo sapiens
ctgtgtgtgaacacagcccagc

SEQ ID NO: 8544202 - DNA, 22 bp, Homo sapiens
ctgtgtgtgagaagcaggttga

SEQ ID NO: 8544203 - DNA, 22 bp, Homo sapiens
ctgtgtttctgagaagtgggga

SEQ ID NO: 8544204 - DNA, 22 bp, Homo sapiens
ctgtgttggcttttctcttgta

SEQ ID NO: 8544205 - DNA, 22 bp, Homo sapiens
ctgtgtgtttatatcatttcct

SEQ ID NO: 8544206 - DNA, 22 bp, Homo sapiens
ctgtgtgtttatatcatttcct

SEQ ID NO: 8544207 - DNA, 22 bp, Homo sapiens
ctgtgtgtgtctgcagcatact

SEQ ID NO: 8544208 - DNA, 22 bp, Homo sapiens
ctgtgtgtttatatcatttcct

SEQ ID NO: 8544209 - DNA, 22 bp, Homo sapiens
ctgtgtttggacaacttttcag

SEQ ID NO: 8544210 - DNA, 22 bp, Homo sapiens
ctgtgtttgatgagaagccacc

SEQ ID NO: 8544211 - DNA, 22 bp, Homo sapiens
ctgtgtttgacaggcggtctcc

SEQ ID NO: 8544212 - DNA, 22 bp, Homo sapiens
ctgtgtttgacaggcggtctcc

SEQ ID NO: 8544213 - DNA, 22 bp, Homo sapiens
ctgtgttttgagatattattaa

SEQ ID NO: 8544214 - DNA, 22 bp, Homo sapiens
ctgtgtttttggtctgatctat

SEQ ID NO: 8544215 - DNA, 22 bp, Homo sapiens
ctgtgtttttggtctgatctat

SEQ ID NO: 8544216 - DNA, 22 bp, Homo sapiens
ctgtgtttttggtctgatctat

SEQ ID NO: 8544217 - DNA, 22 bp, Homo sapiens
ctgtgggctgaaagtgctcccg

SEQ ID NO: 8544218 - DNA, 22 bp, Homo sapiens
ctgtggtcaccaggctggggcc

SEQ ID NO: 8544219 - DNA, 22 bp, Homo sapiens
ctgtggtcaccaggctggggcc

SEQ ID NO: 8544220 - DNA, 22 bp, Homo sapiens
ctgtgtgtgaacacagcccagc

SEQ ID NO: 8544221 - DNA, 22 bp, Homo sapiens
ctgtgtgagcatcacttcagat

SEQ ID NO: 8544222 - DNA, 22 bp, Homo sapiens
ctgtgtctttcctactttgtgg

SEQ ID NO: 8544223 - DNA, 22 bp, Homo sapiens
ctgtgtcttgagtaattcggtg

SEQ ID NO: 8544224 - DNA, 22 bp, Homo sapiens
ctgtgtctttcctactttgtgg

SEQ ID NO: 8544225 - DNA, 22 bp, Homo sapiens
ctgtgtcttctgttttgaagtt

SEQ ID NO: 8544226 - DNA, 22 bp, Homo sapiens
ctgtggtggcacagcgggctgg

SEQ ID NO: 8544227 - DNA, 22 bp, Homo sapiens
ctgtggtggcacagcgggctgg

SEQ ID NO: 8544228 - DNA, 20 bp, Homo sapiens
ctgtggtgagcaggagagta

SEQ ID NO: 8544229 - DNA, 22 bp, Homo sapiens
ctgtggtggcacagcgggctgg

SEQ ID NO: 8544230 - DNA, 22 bp, Homo sapiens
ctgtggtcaccaggctggggcc

SEQ ID NO: 8544231 - DNA, 22 bp, Homo sapiens
ctgtggtcatctcagagtggcc

SEQ ID NO: 8544232 - DNA, 22 bp, Homo sapiens
ctgtggtgagcaactgactgaa

SEQ ID NO: 8544233 - DNA, 22 bp, Homo sapiens
ctgtggtgagcaactgactgaa

SEQ ID NO: 8544234 - DNA, 22 bp, Homo sapiens
gaattaaaatagttttggtcga

SEQ ID NO: 8544235 - DNA, 22 bp, Homo sapiens
gaattaaaatagttttggtcga

SEQ ID NO: 8544236 - DNA, 22 bp, Homo sapiens
gaattacataataaaatgagag

SEQ ID NO: 8544237 - DNA, 22 bp, Homo sapiens
gaattacaaagtgagacaagct

SEQ ID NO: 8544238 - DNA, 22 bp, Homo sapiens
gaattacaaagtgagacaagct

SEQ ID NO: 8544239 - DNA, 22 bp, Homo sapiens
gaattacagccagaagaatgaa

SEQ ID NO: 8544240 - DNA, 22 bp, Homo sapiens
gaattacagccagaagaatgaa

SEQ ID NO: 8544241 - DNA, 22 bp, Homo sapiens
gaatggctatcggattattagg

SEQ ID NO: 8544242 - DNA, 23 bp, Homo sapiens
gaatggctaagcacatagacttg

SEQ ID NO: 8544243 - DNA, 23 bp, Homo sapiens
gaatggctaagcacatagacttg

SEQ ID NO: 8544244 - DNA, 22 bp, Homo sapiens
gaatggctgaatgtcttaaatt

SEQ ID NO: 8544245 - DNA, 21 bp, Homo sapiens
gaatggctcgcgcgccacact

SEQ ID NO: 8544246 - DNA, 22 bp, Homo sapiens
gaatgtaaaattgcctacaaga

SEQ ID NO: 8544247 - DNA, 22 bp, Homo sapiens
gaatgctgagtcttatctctta

SEQ ID NO: 8544248 - DNA, 22 bp, Homo sapiens
gaatgctggcttacaggcagtt

SEQ ID NO: 8544249 - DNA, 22 bp, Homo sapiens
gaatgctgtagacagactctat

SEQ ID NO: 8544250 - DNA, 22 bp, Homo sapiens
gaatgcttggaacctgaagttc

SEQ ID NO: 8544251 - DNA, 22 bp, Homo sapiens
gaatggcatagctttctttaca

SEQ ID NO: 8544252 - DNA, 21 bp, Homo sapiens
gaatggcaccattagcatata

SEQ ID NO: 8544253 - DNA, 22 bp, Homo sapiens
gaatggcatagctttctttaca

SEQ ID NO: 8544254 - DNA, 22 bp, Homo sapiens
gaatggcattgtcagcctttat

SEQ ID NO: 8544255 - DNA, 22 bp, Homo sapiens
gaatggaaactgggagatggcc

SEQ ID NO: 8544256 - DNA, 22 bp, Homo sapiens
gaagaatctgaggacagtcatt

SEQ ID NO: 8544257 - DNA, 22 bp, Homo sapiens
gaagaatctgaggacagtcatt

SEQ ID NO: 8544258 - DNA, 22 bp, Homo sapiens
gaagaatattcttgatcttaga

SEQ ID NO: 8544259 - DNA, 22 bp, Homo sapiens
gaagaatattcttgatcttaga

SEQ ID NO: 8544260 - DNA, 22 bp, Homo sapiens
gaagaatatataatgattttgt

SEQ ID NO: 8544261 - DNA, 22 bp, Homo sapiens
gaagaatatataatgattttgt

SEQ ID NO: 8544262 - DNA, 22 bp, Homo sapiens
gaagaaggtggcccaggggtag

SEQ ID NO: 8544263 - DNA, 22 bp, Homo sapiens
gaagaaggtgctacacagggca

SEQ ID NO: 8544264 - DNA, 22 bp, Homo sapiens
gaagaaggtggcccaggggtag

SEQ ID NO: 8544265 - DNA, 22 bp, Homo sapiens
gaagaagtatttttgtcctgtt

SEQ ID NO: 8544266 - DNA, 22 bp, Homo sapiens
gaagaaggtgccagaggcttac

SEQ ID NO: 8544267 - DNA, 22 bp, Homo sapiens
gaagaagggtaaggagtgttga

SEQ ID NO: 8544268 - DNA, 22 bp, Homo sapiens
gaagaaggtgccagaggcttac

SEQ ID NO: 8544269 - DNA, 22 bp, Homo sapiens
gaagaaggtgctacacagggca

SEQ ID NO: 8544270 - DNA, 22 bp, Homo sapiens
gaagaaggtgctacacagggca

SEQ ID NO: 8544271 - DNA, 22 bp, Homo sapiens
gaatgcattctcttagcatcta

SEQ ID NO: 8544272 - DNA, 22 bp, Homo sapiens
gaatgctaagcatgtgggagtt

SEQ ID NO: 8544273 - DNA, 22 bp, Homo sapiens
gaatgcatgtgaagcaaagaat

SEQ ID NO: 8544274 - DNA, 22 bp, Homo sapiens
gaatgcattccacggtagtgat

SEQ ID NO: 8544275 - DNA, 22 bp, Homo sapiens
gaatgcattccacggtagtgat

SEQ ID NO: 8544276 - DNA, 22 bp, Homo sapiens
gaatgcatgtgaagcaaagaat

SEQ ID NO: 8544277 - DNA, 22 bp, Homo sapiens
gaatgcagtgacggaggcttac

SEQ ID NO: 8544278 - DNA, 22 bp, Homo sapiens
gaatgcagtggtgagatcttgg

SEQ ID NO: 8544279 - DNA, 22 bp, Homo sapiens
gaatgcaaagctctctatgtta

SEQ ID NO: 8544280 - DNA, 22 bp, Homo sapiens
gaatgcaaatatatggatcagt

SEQ ID NO: 8544281 - DNA, 21 bp, Homo sapiens
gaagacaaatgggaatagctg

SEQ ID NO: 8544282 - DNA, 21 bp, Homo sapiens
gaagacaaatgggaatagctg

SEQ ID NO: 8544283 - DNA, 19 bp, Homo sapiens
gaatgcagaagagagtgga

SEQ ID NO: 8544284 - DNA, 22 bp, Homo sapiens
gaatgcagatggctggtgtatg

SEQ ID NO: 8544285 - DNA, 22 bp, Homo sapiens
gaatgcagctgacagtcgtttt

SEQ ID NO: 8544286 - DNA, 22 bp, Homo sapiens
gaatgcagatggctggtgtatg

SEQ ID NO: 8544287 - DNA, 22 bp, Homo sapiens
gaatgcacacgtgtgtgcatgc

SEQ ID NO: 8544288 - DNA, 22 bp, Homo sapiens
gaatgcacttccaacatctatt

SEQ ID NO: 8544289 - DNA, 22 bp, Homo sapiens
gaatgcactcacccatcactca

SEQ ID NO: 8544290 - DNA, 19 bp, Homo sapiens
gaatgcagaagagagtgga

SEQ ID NO: 8544291 - DNA, 22 bp, Homo sapiens
gacaaaacacattagtttaaaa

SEQ ID NO: 8544292 - DNA, 22 bp, Homo sapiens
gacaaaacacattagtttaaaa

SEQ ID NO: 8544293 - DNA, 22 bp, Homo sapiens
gaatttttctggaagcaattat

SEQ ID NO: 8544294 - DNA, 22 bp, Homo sapiens
gaattttgcttttatgtcaagt

SEQ ID NO: 8544295 - DNA, 22 bp, Homo sapiens
gaattttgcttttatgtcaagt

SEQ ID NO: 8544296 - DNA, 22 bp, Homo sapiens
gaatttttctggaagcaattat

SEQ ID NO: 8544297 - DNA, 22 bp, Homo sapiens
gaattttattactagtcaactg

SEQ ID NO: 8544298 - DNA, 20 bp, Homo sapiens
gaattttatgaacactacca

SEQ ID NO: 8544299 - DNA, 22 bp, Homo sapiens
gacaaaactgagatcacactgt

SEQ ID NO: 8544300 - DNA, 22 bp, Homo sapiens
gacaaaactgagatcacactgt

SEQ ID NO: 8544301 - DNA, 22 bp, Homo sapiens
gacaaagagaagtaacagtacc

SEQ ID NO: 8544302 - DNA, 22 bp, Homo sapiens
gacagcaggatgtgaggggatg

SEQ ID NO: 8544303 - DNA, 22 bp, Homo sapiens
gacagcaggatgtgaggggatg

SEQ ID NO: 8544304 - DNA, 22 bp, Homo sapiens
gacagcaggagatcatgataga

SEQ ID NO: 8544305 - DNA, 22 bp, Homo sapiens
gacagcaggagatcatgataga

SEQ ID NO: 8544306 - DNA, 22 bp, Homo sapiens
gacagcagggacatgtaggaag

SEQ ID NO: 8544307 - DNA, 22 bp, Homo sapiens
gacagcagggaaagtccagacc

SEQ ID NO: 8544308 - DNA, 22 bp, Homo sapiens
gacagcagggaaagtccagacc

SEQ ID NO: 8544309 - DNA, 22 bp, Homo sapiens
gacagcagggaaagtccagacc

SEQ ID NO: 8544310 - DNA, 22 bp, Homo sapiens
gacagcagggaaagtccagacc

SEQ ID NO: 8544311 - DNA, 22 bp, Homo sapiens
gacagcagccacagggagaggg

SEQ ID NO: 8544312 - DNA, 22 bp, Homo sapiens
gacagcagccacagggagaggg

SEQ ID NO: 8544313 - DNA, 20 bp, Homo sapiens
gacaacagagtaccaggaag

SEQ ID NO: 8544314 - DNA, 22 bp, Homo sapiens
gacaacacatgtatgccactct

SEQ ID NO: 8544315 - DNA, 22 bp, Homo sapiens
gacaacaataatgtggagctga

SEQ ID NO: 8544316 - DNA, 22 bp, Homo sapiens
gacaaagcagacaagataattc

SEQ ID NO: 8544317 - DNA, 22 bp, Homo sapiens
gacaaagcagacaagataattc

SEQ ID NO: 8544318 - DNA, 22 bp, Homo sapiens
gacaaaggatcagaggttggga

SEQ ID NO: 8544319 - DNA, 22 bp, Homo sapiens
gacaaaggatcagaggttggga

SEQ ID NO: 8544320 - DNA, 22 bp, Homo sapiens
gacagctggacagacactgatg

SEQ ID NO: 8544321 - DNA, 22 bp, Homo sapiens
gacagctggcagtggaaaggtg

SEQ ID NO: 8544322 - DNA, 22 bp, Homo sapiens
gacagctggacagacactgatg

SEQ ID NO: 8544323 - DNA, 22 bp, Homo sapiens
gacagctgctcccgtttctgct

SEQ ID NO: 8544324 - DNA, 22 bp, Homo sapiens
gacagctggacagacactgatg

SEQ ID NO: 8544325 - DNA, 22 bp, Homo sapiens
gacagctgaacaggtgggataa

SEQ ID NO: 8544326 - DNA, 22 bp, Homo sapiens
gacagctgaaggatgattcagg

SEQ ID NO: 8544327 - DNA, 22 bp, Homo sapiens
gacagcctggcttaatctgtct

SEQ ID NO: 8544328 - DNA, 22 bp, Homo sapiens
gacagctgaaaaatgtaaggta

SEQ ID NO: 8544329 - DNA, 22 bp, Homo sapiens
gacagctgaaaaatgtaaggta

SEQ ID NO: 8544330 - DNA, 22 bp, Homo sapiens
gacagcctcatgaggagcaaaa

SEQ ID NO: 8544331 - DNA, 22 bp, Homo sapiens
gacagcctcatgtgcatgaact

SEQ ID NO: 8544332 - DNA, 22 bp, Homo sapiens
gacagccaggtctgatgaccca

SEQ ID NO: 8544333 - DNA, 22 bp, Homo sapiens
gacagcagtttttctctagggt

SEQ ID NO: 8544334 - DNA, 22 bp, Homo sapiens
gacagcagtcctggagttccca

SEQ ID NO: 8544335 - DNA, 22 bp, Homo sapiens
gacagcagtcctggagttccca

SEQ ID NO: 8544336 - DNA, 22 bp, Homo sapiens
gacagcagtcctggagttccca

SEQ ID NO: 8544337 - DNA, 22 bp, Homo sapiens
gacagcaggtgcttgggaaagg

SEQ ID NO: 8544338 - DNA, 22 bp, Homo sapiens
gacagcagggacatgtaggaag

SEQ ID NO: 8544339 - DNA, 22 bp, Homo sapiens
gacagcagggacatgtaggaag

SEQ ID NO: 8544340 - DNA, 22 bp, Homo sapiens
gacagcagggacatgtaggaag

SEQ ID NO: 8544341 - DNA, 22 bp, Homo sapiens
gacagcagggacatgtaggaag

SEQ ID NO: 8544342 - DNA, 22 bp, Homo sapiens
gacagcagggacatgtaggaag

SEQ ID NO: 8544343 - DNA, 22 bp, Homo sapiens
gacagcaggtaattagttaaca

SEQ ID NO: 8544344 - DNA, 22 bp, Homo sapiens
gacatccatcatttcctgttga

SEQ ID NO: 8544345 - DNA, 21 bp, Homo sapiens
gacatccatgtgagtggcagt

SEQ ID NO: 8544346 - DNA, 22 bp, Homo sapiens
gacatcatgttctgctaatagt

SEQ ID NO: 8544347 - DNA, 17 bp, Homo sapiens
gacatcagtacttacag

SEQ ID NO: 8544348 - DNA, 22 bp, Homo sapiens
gacatcatggagaggataaata

SEQ ID NO: 8544349 - DNA, 22 bp, Homo sapiens
gacatctggaggagatgaatgg

SEQ ID NO: 8544350 - DNA, 22 bp, Homo sapiens
gacatctgaggccctcagagcc

SEQ ID NO: 8544351 - DNA, 22 bp, Homo sapiens
gacatctgaatattagagagaa

SEQ ID NO: 8544352 - DNA, 22 bp, Homo sapiens
gacatctgaatattagagagaa

SEQ ID NO: 8544353 - DNA, 22 bp, Homo sapiens
gacatctgaatttagcagtttt

SEQ ID NO: 8544354 - DNA, 22 bp, Homo sapiens
gacatcaggaagacatgagagg

SEQ ID NO: 8544355 - DNA, 22 bp, Homo sapiens
gacatcaggaagacatgagagg

SEQ ID NO: 8544356 - DNA, 22 bp, Homo sapiens
gacatcaggcctgcagtctggg

SEQ ID NO: 8544357 - DNA, 22 bp, Homo sapiens
gacatagtctctgtcttcatgg

SEQ ID NO: 8544358 - DNA, 22 bp, Homo sapiens
gacatacagccctctccctggt

SEQ ID NO: 8544359 - DNA, 22 bp, Homo sapiens
gacagtctgggcacacatgaaa

SEQ ID NO: 8544360 - DNA, 22 bp, Homo sapiens
gacagtgaacaggttcccactg

SEQ ID NO: 8544361 - DNA, 22 bp, Homo sapiens
gacagtccttgcccagtatcta

SEQ ID NO: 8544362 - DNA, 22 bp, Homo sapiens
gacagtctggcctaaagggtta

SEQ ID NO: 8544363 - DNA, 22 bp, Homo sapiens
gacagtgacagcttggaaagca

SEQ ID NO: 8544364 - DNA, 22 bp, Homo sapiens
gacagtgagagtctacaccctc

SEQ ID NO: 8544365 - DNA, 22 bp, Homo sapiens
gacagtgattagttactataaa

SEQ ID NO: 8544366 - DNA, 22 bp, Homo sapiens
gacagtgagtacctcaaaggcc

SEQ ID NO: 8544367 - DNA, 22 bp, Homo sapiens
gacagtgagtacctcaaaggcc

SEQ ID NO: 8544368 - DNA, 19 bp, Homo sapiens
gacagtgcagttgtagtac

SEQ ID NO: 8544369 - DNA, 22 bp, Homo sapiens
gacatacaagctggtacctcct

SEQ ID NO: 8544370 - DNA, 17 bp, Homo sapiens
gacagctgggcgcacgc

SEQ ID NO: 8544371 - DNA, 17 bp, Homo sapiens
gacagctgggcgcacgc

SEQ ID NO: 8544372 - DNA, 17 bp, Homo sapiens
gacagctgggcgcacgc

SEQ ID NO: 8544373 - DNA, 22 bp, Homo sapiens
gacagctggcagtggaaaggtg

SEQ ID NO: 8544374 - DNA, 22 bp, Homo sapiens
gacagctgggaggatgacataa

SEQ ID NO: 8544375 - DNA, 17 bp, Homo sapiens
gacagctggttcctggc

SEQ ID NO: 8544376 - DNA, 22 bp, Homo sapiens
gaccttcttgctgtgtcctaac

SEQ ID NO: 8544377 - DNA, 22 bp, Homo sapiens
gaccttcttgctgtgtcctaac

SEQ ID NO: 8544378 - DNA, 22 bp, Homo sapiens
gaccttcttgctgtgtcctaac

SEQ ID NO: 8544379 - DNA, 22 bp, Homo sapiens
gactacaggtgtgtgccaccat

SEQ ID NO: 8544380 - DNA, 22 bp, Homo sapiens
gactagaagggcaagagtccct

SEQ ID NO: 8544381 - DNA, 22 bp, Homo sapiens
gactagggaatcattcttggat

SEQ ID NO: 8544382 - DNA, 22 bp, Homo sapiens
gactatttatttacagaaagct

SEQ ID NO: 8544383 - DNA, 22 bp, Homo sapiens
gacctggcctgcacagccctta

SEQ ID NO: 8544384 - DNA, 23 bp, Homo sapiens
gacctggctttgaatcttgactc

SEQ ID NO: 8544385 - DNA, 22 bp, Homo sapiens
gacctggggtggaaggaaggca

SEQ ID NO: 8544386 - DNA, 22 bp, Homo sapiens
gacctggggtaagcttggcaac

SEQ ID NO: 8544387 - DNA, 22 bp, Homo sapiens
gaccttcaagcaccatatttat

SEQ ID NO: 8544388 - DNA, 22 bp, Homo sapiens
gaccttcagtgtgtttctcaca

SEQ ID NO: 8544389 - DNA, 22 bp, Homo sapiens
gaccttcttgctgtgtcctaac

SEQ ID NO: 8544390 - DNA, 22 bp, Homo sapiens
gaccttcttgctgtgtcctaac

SEQ ID NO: 8544391 - DNA, 22 bp, Homo sapiens
gacattaatttctttggtaatt

SEQ ID NO: 8544392 - DNA, 22 bp, Homo sapiens
gacatgttatctctggcttcaa

SEQ ID NO: 8544393 - DNA, 22 bp, Homo sapiens
gacattaaatgtcttagttgcc

SEQ ID NO: 8544394 - DNA, 22 bp, Homo sapiens
gacctggaatttgtgtgtgttc

SEQ ID NO: 8544395 - DNA, 22 bp, Homo sapiens
gacctggaatgaagggtccctc

SEQ ID NO: 8544396 - DNA, 22 bp, Homo sapiens
gacctggaatttgtgtgtgttc

SEQ ID NO: 8544397 - DNA, 22 bp, Homo sapiens
gacctggactgagttagatggc

SEQ ID NO: 8544398 - DNA, 22 bp, Homo sapiens
gacctggactgagttagatggc

SEQ ID NO: 8544399 - DNA, 22 bp, Homo sapiens
gacctggaggatcctcttcttg

SEQ ID NO: 8544400 - DNA, 22 bp, Homo sapiens
gacctggaggcttttcccaaga

SEQ ID NO: 8544401 - DNA, 22 bp, Homo sapiens
gacctggattcaaattcagact

SEQ ID NO: 8544402 - DNA, 22 bp, Homo sapiens
gacctggcatattcattggcac

SEQ ID NO: 8544403 - DNA, 22 bp, Homo sapiens
gacctgcccactctgaggacat

SEQ ID NO: 8544404 - DNA, 22 bp, Homo sapiens
gacctgcctgagctgcctctgc

SEQ ID NO: 8544405 - DNA, 22 bp, Homo sapiens
gacctggaagatggtcctcacc

SEQ ID NO: 8544406 - DNA, 22 bp, Homo sapiens
gacctggaagaactgaggcctt

SEQ ID NO: 8544407 - DNA, 22 bp, Homo sapiens
gacatggatacttgataagggg

SEQ ID NO: 8544408 - DNA, 22 bp, Homo sapiens
gacatgctgaataactatatga

SEQ ID NO: 8544409 - DNA, 22 bp, Homo sapiens
gacatgcattaagacacactga

SEQ ID NO: 8544410 - DNA, 22 bp, Homo sapiens
gacatgggatgagatgaagcat

SEQ ID NO: 8544411 - DNA, 22 bp, Homo sapiens
gacatgtattagtacatatggt

SEQ ID NO: 8544412 - DNA, 22 bp, Homo sapiens
gacatgtattagtcatgcacag

SEQ ID NO: 8544413 - DNA, 22 bp, Homo sapiens
gacatgtcggatagaatgagtt

SEQ ID NO: 8544414 - DNA, 20 bp, Homo sapiens
gacatgtctttctcacacaa

SEQ ID NO: 8544415 - DNA, 22 bp, Homo sapiens
gacatgaatgttatactttatt

SEQ ID NO: 8544416 - DNA, 22 bp, Homo sapiens
gacatgaacctaccataatgat

SEQ ID NO: 8544417 - DNA, 23 bp, Homo sapiens
gacatctgttttgtccctgtgct

SEQ ID NO: 8544418 - DNA, 22 bp, Homo sapiens
gacatgcaatgcagtggtaagt

SEQ ID NO: 8544419 - DNA, 22 bp, Homo sapiens
gacatgcaatgcagtggtaagt

SEQ ID NO: 8544420 - DNA, 22 bp, Homo sapiens
gacatgcagttctcaagggtag

SEQ ID NO: 8544421 - DNA, 22 bp, Homo sapiens
gacatgcatgaatgcaggtctc

SEQ ID NO: 8544422 - DNA, 17 bp, Homo sapiens
gagattttcgtcctgaa

SEQ ID NO: 8544423 - DNA, 22 bp, Homo sapiens
gagatttcttttgatgcctgtc

SEQ ID NO: 8544424 - DNA, 22 bp, Homo sapiens
gagattttcagcttgactggga

SEQ ID NO: 8544425 - DNA, 22 bp, Homo sapiens
gagatttattgacttaacagta

SEQ ID NO: 8544426 - DNA, 22 bp, Homo sapiens
gagaggcaggcgctgcaatggt

SEQ ID NO: 8544427 - DNA, 22 bp, Homo sapiens
gagaggcagaggcctgaaaccg

SEQ ID NO: 8544428 - DNA, 22 bp, Homo sapiens
gagaggcaggaatcctgggtga

SEQ ID NO: 8544429 - DNA, 22 bp, Homo sapiens
gagaggagtccctatcacagtt

SEQ ID NO: 8544430 - DNA, 22 bp, Homo sapiens
gagaggagtccctatcacagtt

SEQ ID NO: 8544431 - DNA, 22 bp, Homo sapiens
gagcaaacaaaactgatgtgac

SEQ ID NO: 8544432 - DNA, 22 bp, Homo sapiens
gagcaaaataaattctgacaaa

SEQ ID NO: 8544433 - DNA, 22 bp, Homo sapiens
gagcaaagcttttagggccttt

SEQ ID NO: 8544434 - DNA, 22 bp, Homo sapiens
gagcaaagcttttagggccttt

SEQ ID NO: 8544435 - DNA, 19 bp, Homo sapiens
gagcaacatatgtaaactc

SEQ ID NO: 8544436 - DNA, 22 bp, Homo sapiens
gagcaacagtttatggtttttc

SEQ ID NO: 8544437 - DNA, 22 bp, Homo sapiens
gagcaacactccacattgctag

SEQ ID NO: 8544438 - DNA, 22 bp, Homo sapiens
gagcaacactccacattgctag

SEQ ID NO: 8544439 - DNA, 22 bp, Homo sapiens
gagcaaggtagctctctggggc

SEQ ID NO: 8544440 - DNA, 22 bp, Homo sapiens
gagcaatggaagatagataaca

SEQ ID NO: 8544441 - DNA, 22 bp, Homo sapiens
gagcaatgcccttcaccagccc

SEQ ID NO: 8544442 - DNA, 22 bp, Homo sapiens
gagcacagaatcttcccatgca

SEQ ID NO: 8544443 - DNA, 22 bp, Homo sapiens
gagcacagaatcttcccatgca

SEQ ID NO: 8544444 - DNA, 22 bp, Homo sapiens
gagcacagaatcttcccatgca

SEQ ID NO: 8544445 - DNA, 22 bp, Homo sapiens
gagcacagaactaaatgctggt

SEQ ID NO: 8544446 - DNA, 22 bp, Homo sapiens
gagcacagaactaaatgctggt

SEQ ID NO: 8544447 - DNA, 22 bp, Homo sapiens
gagcacagaaggagaaatatgg

SEQ ID NO: 8544448 - DNA, 22 bp, Homo sapiens
gagcacagaactaaatgctggt

SEQ ID NO: 8544449 - DNA, 22 bp, Homo sapiens
gagcacagatcctggagccaca

SEQ ID NO: 8544450 - DNA, 22 bp, Homo sapiens
gagcacagatcctggagccaca

SEQ ID NO: 8544451 - DNA, 22 bp, Homo sapiens
gagcacagaatcttcccatgca

SEQ ID NO: 8544452 - DNA, 22 bp, Homo sapiens
gagcacagatcctggagccaca

SEQ ID NO: 8544453 - DNA, 22 bp, Homo sapiens
gagcacagatcctggagccaca

SEQ ID NO: 8544454 - DNA, 22 bp, Homo sapiens
gagcaagactcactgcatcttg

SEQ ID NO: 8544455 - DNA, 22 bp, Homo sapiens
gagcaaggagggtggggccttt

SEQ ID NO: 8544456 - DNA, 22 bp, Homo sapiens
gagcaaggagggtggggccttt

SEQ ID NO: 8544457 - DNA, 22 bp, Homo sapiens
gagcaaggatgggtctatagta

SEQ ID NO: 8544458 - DNA, 22 bp, Homo sapiens
gagcaaggatggccggggccgt

SEQ ID NO: 8544459 - DNA, 22 bp, Homo sapiens
gagcaaggcggcatctctctga

SEQ ID NO: 8544460 - DNA, 22 bp, Homo sapiens
gagcaaggcggcatctctctga

SEQ ID NO: 8544461 - DNA, 22 bp, Homo sapiens
gagcaaggatgggtctatagta

SEQ ID NO: 8544462 - DNA, 22 bp, Homo sapiens
gagcaaggcggcatctctctga

SEQ ID NO: 8544463 - DNA, 22 bp, Homo sapiens
gagcaaggtagctctctggggc

SEQ ID NO: 8544464 - DNA, 22 bp, Homo sapiens
gagcaaggtagctctctggggc

SEQ ID NO: 8544465 - DNA, 22 bp, Homo sapiens
gagcaggaaggccagaagggtc

SEQ ID NO: 8544466 - DNA, 22 bp, Homo sapiens
gagcaggaacagatcccttgga

SEQ ID NO: 8544467 - DNA, 22 bp, Homo sapiens
gagcaggaaggccagaagggtc

SEQ ID NO: 8544468 - DNA, 22 bp, Homo sapiens
gagcaggaaggccagaagggtc

SEQ ID NO: 8544469 - DNA, 22 bp, Homo sapiens
gagcaggacagcagcttcctgg

SEQ ID NO: 8544470 - DNA, 22 bp, Homo sapiens
gagcaggacagcagcttcctgg

SEQ ID NO: 8544471 - DNA, 22 bp, Homo sapiens
gagcaggacgtgggaatgggaa

SEQ ID NO: 8544472 - DNA, 23 bp, Homo sapiens
gagcagagcgggcgggggtcctg

SEQ ID NO: 8544473 - DNA, 23 bp, Homo sapiens
gagcagagcgggcgggggtcctg

SEQ ID NO: 8544474 - DNA, 22 bp, Homo sapiens
gagcagagacagtacaactggc

SEQ ID NO: 8544475 - DNA, 22 bp, Homo sapiens
gagcagagacagtacaactggc

SEQ ID NO: 8544476 - DNA, 22 bp, Homo sapiens
gagcagagaatccagctaagtg

SEQ ID NO: 8544477 - DNA, 22 bp, Homo sapiens
gagcagagacagtacaactggc

SEQ ID NO: 8544478 - DNA, 22 bp, Homo sapiens
gagcagagacagtacaactggc

SEQ ID NO: 8544479 - DNA, 22 bp, Homo sapiens
gagcagagacagtacaactggc

SEQ ID NO: 8544480 - DNA, 22 bp, Homo sapiens
gagcagagcttctcaaagtaaa

SEQ ID NO: 8544481 - DNA, 22 bp, Homo sapiens
gagcagagcttctcaaagtaaa

SEQ ID NO: 8544482 - DNA, 22 bp, Homo sapiens
gagcagagcttctcaaagtaaa

SEQ ID NO: 8544483 - DNA, 22 bp, Homo sapiens
gagcacagtccttttgttaaaa

SEQ ID NO: 8544484 - DNA, 22 bp, Homo sapiens
gagcacagtccttttgttaaaa

SEQ ID NO: 8544485 - DNA, 20 bp, Homo sapiens
gagcacagtaatgactgcta

SEQ ID NO: 8544486 - DNA, 22 bp, Homo sapiens
gagcacagtccttttgttaaaa

SEQ ID NO: 8544487 - DNA, 20 bp, Homo sapiens
gagcacagtaatgactgcta

SEQ ID NO: 8544488 - DNA, 22 bp, Homo sapiens
gagcacagtaaagcagtgtcac

SEQ ID NO: 8544489 - DNA, 22 bp, Homo sapiens
gagcacagtaaagcagtgtcac

SEQ ID NO: 8544490 - DNA, 22 bp, Homo sapiens
gagcacagatcctggagccaca

SEQ ID NO: 8544491 - DNA, 22 bp, Homo sapiens
gagcaccctacctgccactgag

SEQ ID NO: 8544492 - DNA, 22 bp, Homo sapiens
gagcacagtgcagtttctgcta

SEQ ID NO: 8544493 - DNA, 22 bp, Homo sapiens
gagcacagtgtgttgtgatttc

SEQ ID NO: 8544494 - DNA, 22 bp, Homo sapiens
gagcacagtgtgttgtgatttc

SEQ ID NO: 8544495 - DNA, 22 bp, Homo sapiens
gagcaccaaggctctgccatgg

SEQ ID NO: 8544496 - DNA, 22 bp, Homo sapiens
gagcacatgtggagagtctggg

SEQ ID NO: 8544497 - DNA, 22 bp, Homo sapiens
gagcacattcccaggagctgct

SEQ ID NO: 8544498 - DNA, 22 bp, Homo sapiens
gagcactgaggaaagctggtta

SEQ ID NO: 8544499 - DNA, 22 bp, Homo sapiens
gagcactgatttatttttgtct

SEQ ID NO: 8544500 - DNA, 22 bp, Homo sapiens
gagcacctcaatttgctatttg

SEQ ID NO: 8544501 - DNA, 22 bp, Homo sapiens
gagcacctgctaaatgacagtt

SEQ ID NO: 8544502 - DNA, 22 bp, Homo sapiens
gagcactgtactcatttgcact

SEQ ID NO: 8544503 - DNA, 22 bp, Homo sapiens
gagcactgtactcatttgcact

SEQ ID NO: 8544504 - DNA, 22 bp, Homo sapiens
gagcacttagatgctatgaatg

SEQ ID NO: 8544505 - DNA, 22 bp, Homo sapiens
gagcagaacaggccgggtggga

SEQ ID NO: 8544506 - DNA, 22 bp, Homo sapiens
gagcagagaatccagctaagtg

SEQ ID NO: 8544507 - DNA, 22 bp, Homo sapiens
gagcagacgctgcagtcttggg

SEQ ID NO: 8544508 - DNA, 22 bp, Homo sapiens
gagcagaacaggccgggtggga

SEQ ID NO: 8544509 - DNA, 22 bp, Homo sapiens
gagcagaactactcacatatcg

SEQ ID NO: 8544510 - DNA, 22 bp, Homo sapiens
gagaagcaatcagtggccaccc

SEQ ID NO: 8544511 - DNA, 22 bp, Homo sapiens
gagaagcaatcagtggccaccc

SEQ ID NO: 8544512 - DNA, 22 bp, Homo sapiens
gagaagcaatcagcagccaccc

SEQ ID NO: 8544513 - DNA, 22 bp, Homo sapiens
gagaagcaatcgtgacatctcc

SEQ ID NO: 8544514 - DNA, 22 bp, Homo sapiens
gagaagcaatttccaactgtgc

SEQ ID NO: 8544515 - DNA, 22 bp, Homo sapiens
gagaagcaatttccaactgtgc

SEQ ID NO: 8544516 - DNA, 22 bp, Homo sapiens
gagaagccgagtcagctgagcc

SEQ ID NO: 8544517 - DNA, 22 bp, Homo sapiens
gagaagccgagtcagctgagcc

SEQ ID NO: 8544518 - DNA, 22 bp, Homo sapiens
gagaagccgagtcagctgagcc

SEQ ID NO: 8544519 - DNA, 22 bp, Homo sapiens
gagaagcaggtttagcagacaa

SEQ ID NO: 8544520 - DNA, 22 bp, Homo sapiens
gagaagcaggtttagcagacaa

SEQ ID NO: 8544521 - DNA, 22 bp, Homo sapiens
gagagaagaatgttccgaggcc

SEQ ID NO: 8544522 - DNA, 22 bp, Homo sapiens
gagagaagaatgttccgaggcc

SEQ ID NO: 8544523 - DNA, 22 bp, Homo sapiens
gagagaagaatgttccgaggcc

SEQ ID NO: 8544524 - DNA, 22 bp, Homo sapiens
gagagaagaatgttccgaggcc

SEQ ID NO: 8544525 - DNA, 22 bp, Homo sapiens
gagagaagggggatatgagcct

SEQ ID NO: 8544526 - DNA, 22 bp, Homo sapiens
gagagaatgtacatgctagggg

SEQ ID NO: 8544527 - DNA, 22 bp, Homo sapiens
gagagaagggggatatgagcct

SEQ ID NO: 8544528 - DNA, 18 bp, Homo sapiens
gagaagctgattgaatgc

SEQ ID NO: 8544529 - DNA, 22 bp, Homo sapiens
gagagaagaaagccatggtcct

SEQ ID NO: 8544530 - DNA, 22 bp, Homo sapiens
gagaaggaagttgagccagcat

SEQ ID NO: 8544531 - DNA, 22 bp, Homo sapiens
gagagaagaaagccatggtcct

SEQ ID NO: 8544532 - DNA, 22 bp, Homo sapiens
gagagaagaaagccatggtcct

SEQ ID NO: 8544533 - DNA, 19 bp, Homo sapiens
gactccaactttaagcatg

SEQ ID NO: 8544534 - DNA, 22 bp, Homo sapiens
gactcagatttagagggtaaga

SEQ ID NO: 8544535 - DNA, 22 bp, Homo sapiens
gactccagaatctggacggtcc

SEQ ID NO: 8544536 - DNA, 19 bp, Homo sapiens
gactcacaccttccgctgt

SEQ ID NO: 8544537 - DNA, 22 bp, Homo sapiens
gactcagagatccctggaggtc

SEQ ID NO: 8544538 - DNA, 22 bp, Homo sapiens
gagaacaggctctggagtcaga

SEQ ID NO: 8544539 - DNA, 22 bp, Homo sapiens
gagaaagggaacttacagagtg

SEQ ID NO: 8544540 - DNA, 22 bp, Homo sapiens
gactccagagtgactatttgtc

SEQ ID NO: 8544541 - DNA, 22 bp, Homo sapiens
gagaaagggaacttacagagtg

SEQ ID NO: 8544542 - DNA, 22 bp, Homo sapiens
gagaacctctccacaagtctgg

SEQ ID NO: 8544543 - DNA, 22 bp, Homo sapiens
gagaactaatcatgcatggagt

SEQ ID NO: 8544544 - DNA, 22 bp, Homo sapiens
gagaactgattagcatttgcca

SEQ ID NO: 8544545 - DNA, 22 bp, Homo sapiens
gagaagaacttgggcaaagtca

SEQ ID NO: 8544546 - DNA, 22 bp, Homo sapiens
gagaagaaatagaatcacattt

SEQ ID NO: 8544547 - DNA, 22 bp, Homo sapiens
gagaagaacttgggcaaagtca

SEQ ID NO: 8544548 - DNA, 22 bp, Homo sapiens
gagaggaggtggctatgacagc

SEQ ID NO: 8544549 - DNA, 22 bp, Homo sapiens
gagaggaggtggctatgacagc

SEQ ID NO: 8544550 - DNA, 22 bp, Homo sapiens
gagaggaggtggctatgacagc

SEQ ID NO: 8544551 - DNA, 22 bp, Homo sapiens
gagaggagtccctatcacagtt

SEQ ID NO: 8544552 - DNA, 22 bp, Homo sapiens
gagaggagtaggctgatggtgc

SEQ ID NO: 8544553 - DNA, 22 bp, Homo sapiens
gagagccctcactccttccctg

SEQ ID NO: 8544554 - DNA, 17 bp, Homo sapiens
gagagccctcagatgtc

SEQ ID NO: 8544555 - DNA, 22 bp, Homo sapiens
gagagctgtaatagtcatgtct

SEQ ID NO: 8544556 - DNA, 22 bp, Homo sapiens
gagagctgtaatagtcatgtct

SEQ ID NO: 8544557 - DNA, 22 bp, Homo sapiens
gagagctgtccggctgagcagc

SEQ ID NO: 8544558 - DNA, 22 bp, Homo sapiens
gagagctgtcagcgtagcaccg

SEQ ID NO: 8544559 - DNA, 22 bp, Homo sapiens
gagaggagacttatccagattg

SEQ ID NO: 8544560 - DNA, 22 bp, Homo sapiens
gagaggagacttatccagattg

SEQ ID NO: 8544561 - DNA, 22 bp, Homo sapiens
gagaggagacttatccagattg

SEQ ID NO: 8544562 - DNA, 22 bp, Homo sapiens
gagaggagaagcctgcgcttca

SEQ ID NO: 8544563 - DNA, 22 bp, Homo sapiens
gagagacccagacaccatgcat

SEQ ID NO: 8544564 - DNA, 22 bp, Homo sapiens
gagagaccttgctaagtgcctt

SEQ ID NO: 8544565 - DNA, 22 bp, Homo sapiens
gagagacctcagaaacaatcta

SEQ ID NO: 8544566 - DNA, 22 bp, Homo sapiens
gagagacagcagaacgtgcagc

SEQ ID NO: 8544567 - DNA, 22 bp, Homo sapiens
gagagacagcagaacgtgcagc

SEQ ID NO: 8544568 - DNA, 22 bp, Homo sapiens
gagagaatgtacatgctagggg

SEQ ID NO: 8544569 - DNA, 22 bp, Homo sapiens
gagagagaaggcctgtgggtgt

SEQ ID NO: 8544570 - DNA, 22 bp, Homo sapiens
gagagactgggcagggccggca

SEQ ID NO: 8544571 - DNA, 22 bp, Homo sapiens
gagagagaaaatgactccggac

SEQ ID NO: 8544572 - DNA, 22 bp, Homo sapiens
gagagactgatgtggctatgta

SEQ ID NO: 8544573 - DNA, 22 bp, Homo sapiens
gagagactggaatgggctgtgg

SEQ ID NO: 8544574 - DNA, 22 bp, Homo sapiens
gagagactgatgtggctatgta

SEQ ID NO: 8544575 - DNA, 22 bp, Homo sapiens
gagagccatggtggagatgggg

SEQ ID NO: 8544576 - DNA, 22 bp, Homo sapiens
gagagccatggtggagatgggg

SEQ ID NO: 8544577 - DNA, 22 bp, Homo sapiens
gagagccagctcactccagggc

SEQ ID NO: 8544578 - DNA, 18 bp, Homo sapiens
gagagcccagcaggtggt

SEQ ID NO: 8544579 - DNA, 18 bp, Homo sapiens
gagagcccagcaggtggt

SEQ ID NO: 8544580 - DNA, 18 bp, Homo sapiens
gagagcccagcaggtggt

SEQ ID NO: 8544581 - DNA, 22 bp, Homo sapiens
gagagcaggaggcagcgggacg

SEQ ID NO: 8544582 - DNA, 22 bp, Homo sapiens
gagagcaggctctcgggggcca

SEQ ID NO: 8544583 - DNA, 22 bp, Homo sapiens
gagctccagcatctctgccaaa

SEQ ID NO: 8544584 - DNA, 22 bp, Homo sapiens
gagctccacttagcaaggccac

SEQ ID NO: 8544585 - DNA, 22 bp, Homo sapiens
gagctccaccaccttcaggcag

SEQ ID NO: 8544586 - DNA, 22 bp, Homo sapiens
gagctcattcattcattgcctg

SEQ ID NO: 8544587 - DNA, 22 bp, Homo sapiens
gagctcattcattcattgcctg

SEQ ID NO: 8544588 - DNA, 22 bp, Homo sapiens
gagctcattcattcattgcctg

SEQ ID NO: 8544589 - DNA, 22 bp, Homo sapiens
gagctcagtgtagtcatggctt

SEQ ID NO: 8544590 - DNA, 22 bp, Homo sapiens
gagctcaggtggtcaaaacaat

SEQ ID NO: 8544591 - DNA, 22 bp, Homo sapiens
gagctcataccctcttctcttt

SEQ ID NO: 8544592 - DNA, 22 bp, Homo sapiens
gagctcagtgtagtcatggctt

SEQ ID NO: 8544593 - DNA, 22 bp, Homo sapiens
gagctcatccccatggtccgtc

SEQ ID NO: 8544594 - DNA, 23 bp, Homo sapiens
gagctcaggtagggctcgcccgc

SEQ ID NO: 8544595 - DNA, 22 bp, Homo sapiens
gagctcaggtggtcaaaacaat

SEQ ID NO: 8544596 - DNA, 22 bp, Homo sapiens
gagctcaggagcatcagaagaa

SEQ ID NO: 8544597 - DNA, 22 bp, Homo sapiens
gagctcaggagcatcagaagaa

SEQ ID NO: 8544598 - DNA, 22 bp, Homo sapiens
gagctcaggagcatcagaagaa

SEQ ID NO: 8544599 - DNA, 22 bp, Homo sapiens
gagctcaggagcatcagaagaa

SEQ ID NO: 8544600 - DNA, 22 bp, Homo sapiens
gagctcagcccaaagagcagtg

SEQ ID NO: 8544601 - DNA, 22 bp, Homo sapiens
gagctcagcctgaggcctggct

SEQ ID NO: 8544602 - DNA, 22 bp, Homo sapiens
gagctcagcccaaagagcagtg

SEQ ID NO: 8544603 - DNA, 22 bp, Homo sapiens
gagctcagcccaaagagcagtg

SEQ ID NO: 8544604 - DNA, 22 bp, Homo sapiens
gagctcagcccaaagagcagtg

SEQ ID NO: 8544605 - DNA, 22 bp, Homo sapiens
gagctcagcactaaaatcatgt

SEQ ID NO: 8544606 - DNA, 22 bp, Homo sapiens
gagctcagcactaaaatcatgt

SEQ ID NO: 8544607 - DNA, 22 bp, Homo sapiens
gagctcagcactaaaatcatgt

SEQ ID NO: 8544608 - DNA, 22 bp, Homo sapiens
gagctcagcaaaggtctgtgtg

SEQ ID NO: 8544609 - DNA, 22 bp, Homo sapiens
gagctcagattctggtgtcaga

SEQ ID NO: 8544610 - DNA, 22 bp, Homo sapiens
gagctcagattctggtgtcaga

SEQ ID NO: 8544611 - DNA, 22 bp, Homo sapiens
gagctcagcaaaggtctgtgtg

SEQ ID NO: 8544612 - DNA, 22 bp, Homo sapiens
gagcaggcattctagtggctga

SEQ ID NO: 8544613 - DNA, 22 bp, Homo sapiens
gagcaggcattctagtggctga

SEQ ID NO: 8544614 - DNA, 22 bp, Homo sapiens
gagcaggcattctagtggctga

SEQ ID NO: 8544615 - DNA, 22 bp, Homo sapiens
gagcaggatgggagctggggcc

SEQ ID NO: 8544616 - DNA, 22 bp, Homo sapiens
gagctcagaggcgtctttgtcc

SEQ ID NO: 8544617 - DNA, 22 bp, Homo sapiens
gagctcagaggattctggggag

SEQ ID NO: 8544618 - DNA, 22 bp, Homo sapiens
gagcaggctctgcctgtgtgtc

SEQ ID NO: 8544619 - DNA, 22 bp, Homo sapiens
gagctcagactcgggcctgggg

SEQ ID NO: 8544620 - DNA, 22 bp, Homo sapiens
gagcaggctctgcctgtgtgtc

SEQ ID NO: 8544621 - DNA, 22 bp, Homo sapiens
gagcaggccagcaatggaaggg

SEQ ID NO: 8544622 - DNA, 22 bp, Homo sapiens
gagcaggcctggggtgaggcct

SEQ ID NO: 8544623 - DNA, 22 bp, Homo sapiens
gagcaggcctggggtgaggcct

SEQ ID NO: 8544624 - DNA, 22 bp, Homo sapiens
gagctggtcgaaatgggctgac

SEQ ID NO: 8544625 - DNA, 22 bp, Homo sapiens
gagctggtccacaatctgcagg

SEQ ID NO: 8544626 - DNA, 22 bp, Homo sapiens
gagctggtcgaaatgggctgac

SEQ ID NO: 8544627 - DNA, 22 bp, Homo sapiens
gagctggtgatcagctggagga

SEQ ID NO: 8544628 - DNA, 22 bp, Homo sapiens
gagctggtgatcagctggagga

SEQ ID NO: 8544629 - DNA, 22 bp, Homo sapiens
gagctggtgatcagctggagga

SEQ ID NO: 8544630 - DNA, 22 bp, Homo sapiens
gagctggtgctcttgtcaagac

SEQ ID NO: 8544631 - DNA, 22 bp, Homo sapiens
gagctggtggtgagaaagctct

SEQ ID NO: 8544632 - DNA, 22 bp, Homo sapiens
gagctggtgtgtgcccgagcac

SEQ ID NO: 8544633 - DNA, 22 bp, Homo sapiens
gagctggtggtgagaaagctct

SEQ ID NO: 8544634 - DNA, 22 bp, Homo sapiens
gagctggtcagtttcagggcca

SEQ ID NO: 8544635 - DNA, 22 bp, Homo sapiens
gagctggtcagtttcaggagag

SEQ ID NO: 8544636 - DNA, 22 bp, Homo sapiens
gagctggtcagtttcaggagag

SEQ ID NO: 8544637 - DNA, 22 bp, Homo sapiens
gagctgggtctccaccttggca

SEQ ID NO: 8544638 - DNA, 22 bp, Homo sapiens
gagctgggtctccaccttggca

SEQ ID NO: 8544639 - DNA, 22 bp, Homo sapiens
gagctcctatggtcggtggctc

SEQ ID NO: 8544640 - DNA, 22 bp, Homo sapiens
gagctccagggaacagcagcta

SEQ ID NO: 8544641 - DNA, 22 bp, Homo sapiens
gagctccagggaacagcagcta

SEQ ID NO: 8544642 - DNA, 22 bp, Homo sapiens
gagctccagggaacagcagcta

SEQ ID NO: 8544643 - DNA, 22 bp, Homo sapiens
gagctcccaggccccagcaagg

SEQ ID NO: 8544644 - DNA, 22 bp, Homo sapiens
gagctcccaggccccagcaagg

SEQ ID NO: 8544645 - DNA, 22 bp, Homo sapiens
gagctcccaggccccagcaagg

SEQ ID NO: 8544646 - DNA, 22 bp, Homo sapiens
gagctccctggaggttcagata

SEQ ID NO: 8544647 - DNA, 22 bp, Homo sapiens
gagctccctggaggttcagata

SEQ ID NO: 8544648 - DNA, 22 bp, Homo sapiens
gagctcctggattgctcctagg

SEQ ID NO: 8544649 - DNA, 22 bp, Homo sapiens
gagctgggcacacgccacttga

SEQ ID NO: 8544650 - DNA, 22 bp, Homo sapiens
gagctgtgcttataccaattca

SEQ ID NO: 8544651 - DNA, 22 bp, Homo sapiens
gagctgtgccaatctgtctggg

SEQ ID NO: 8544652 - DNA, 20 bp, Homo sapiens
gagctgtgctctcaggagcc

SEQ ID NO: 8544653 - DNA, 20 bp, Homo sapiens
gagctgtgctctcaggagcc

SEQ ID NO: 8544654 - DNA, 17 bp, Homo sapiens
gaggacagggaagtagg

SEQ ID NO: 8544655 - DNA, 17 bp, Homo sapiens
gaggacagggaagtagg

SEQ ID NO: 8544656 - DNA, 22 bp, Homo sapiens
gaggacaggagactcactgttt

SEQ ID NO: 8544657 - DNA, 22 bp, Homo sapiens
gaggacaggagactcactgttt

SEQ ID NO: 8544658 - DNA, 22 bp, Homo sapiens
gagctgtgtgcctggatggtct

SEQ ID NO: 8544659 - DNA, 22 bp, Homo sapiens
gagctggttctgtccagggaat

SEQ ID NO: 8544660 - DNA, 22 bp, Homo sapiens
gagctgtctctatatgaatgct

SEQ ID NO: 8544661 - DNA, 22 bp, Homo sapiens
gagctgtcctaccaggagtcct

SEQ ID NO: 8544662 - DNA, 22 bp, Homo sapiens
gagctgtcctaccaggagtcct

SEQ ID NO: 8544663 - DNA, 22 bp, Homo sapiens
gagctgtccgcccctgggccga

SEQ ID NO: 8544664 - DNA, 22 bp, Homo sapiens
gagctgtccgcccctgggccga

SEQ ID NO: 8544665 - DNA, 22 bp, Homo sapiens
gagctgtccaagatggtcgtaa

SEQ ID NO: 8544666 - DNA, 22 bp, Homo sapiens
gagctgtccgcccctgggccga

SEQ ID NO: 8544667 - DNA, 22 bp, Homo sapiens
gagctgtgagggacacattgct

SEQ ID NO: 8544668 - DNA, 22 bp, Homo sapiens
gagctgtgagggacacattgct

SEQ ID NO: 8544669 - DNA, 22 bp, Homo sapiens
gagctgtgagggacacattgct

SEQ ID NO: 8544670 - DNA, 22 bp, Homo sapiens
gagctgtgattggtgtctcact

SEQ ID NO: 8544671 - DNA, 22 bp, Homo sapiens
gagctgtgaaaagtgcctgggg

SEQ ID NO: 8544672 - DNA, 22 bp, Homo sapiens
gagctgtctggggactctgggt

SEQ ID NO: 8544673 - DNA, 22 bp, Homo sapiens
gagctgtctggggactctgggt

SEQ ID NO: 8544674 - DNA, 18 bp, Homo sapiens
gaggatggaaggagatgc

SEQ ID NO: 8544675 - DNA, 18 bp, Homo sapiens
gaggatggaaggagatgc

SEQ ID NO: 8544676 - DNA, 18 bp, Homo sapiens
gaggatggaaggagatgc

SEQ ID NO: 8544677 - DNA, 18 bp, Homo sapiens
gaggatggaaggagatgc

SEQ ID NO: 8544678 - DNA, 22 bp, Homo sapiens
gaggatggaggcagttagggcc

SEQ ID NO: 8544679 - DNA, 22 bp, Homo sapiens
gaggatgcctgggtcggggaag

SEQ ID NO: 8544680 - DNA, 20 bp, Homo sapiens
gaggatgcagacagagggca

SEQ ID NO: 8544681 - DNA, 22 bp, Homo sapiens
gaggatcatttgagcctaggag

SEQ ID NO: 8544682 - DNA, 22 bp, Homo sapiens
gaggagtgggttagtgcttatt

SEQ ID NO: 8544683 - DNA, 22 bp, Homo sapiens
gaggagtgtattccacaccact

SEQ ID NO: 8544684 - DNA, 22 bp, Homo sapiens
gaggagtgtattccacaccact

SEQ ID NO: 8544685 - DNA, 18 bp, Homo sapiens
gaggatcagaaatctgta

SEQ ID NO: 8544686 - DNA, 22 bp, Homo sapiens
gaggagtggagttgctgggttg

SEQ ID NO: 8544687 - DNA, 22 bp, Homo sapiens
gaggagtggagttgctgggttg

SEQ ID NO: 8544688 - DNA, 22 bp, Homo sapiens
gaggagtggagttgctgggttg

SEQ ID NO: 8544689 - DNA, 22 bp, Homo sapiens
gaggagtctagtttatggcttc

SEQ ID NO: 8544690 - DNA, 22 bp, Homo sapiens
gaggagtgccagccgtggagtc

SEQ ID NO: 8544691 - DNA, 22 bp, Homo sapiens
gaggagtgccagccgtggagtc

SEQ ID NO: 8544692 - DNA, 22 bp, Homo sapiens
gaggaggtggagtcatgcagag

SEQ ID NO: 8544693 - DNA, 22 bp, Homo sapiens
gaggaggtggagtcatgcagag

SEQ ID NO: 8544694 - DNA, 22 bp, Homo sapiens
gaggaggttccgggtggagaag

SEQ ID NO: 8544695 - DNA, 22 bp, Homo sapiens
gaggaggttccgggtggagaag

SEQ ID NO: 8544696 - DNA, 22 bp, Homo sapiens
gaggaggttccgggtggagaag

SEQ ID NO: 8544697 - DNA, 22 bp, Homo sapiens
gaggagacatatttttgaagca

SEQ ID NO: 8544698 - DNA, 22 bp, Homo sapiens
gaggagacatatttttgaagca

SEQ ID NO: 8544699 - DNA, 22 bp, Homo sapiens
gaggactgcagatgggtgcatc

SEQ ID NO: 8544700 - DNA, 22 bp, Homo sapiens
gaggagacagtggagccgctac

SEQ ID NO: 8544701 - DNA, 22 bp, Homo sapiens
gaggagacggggtgcctggagc

SEQ ID NO: 8544702 - DNA, 22 bp, Homo sapiens
gaggagactgacagcagattct

SEQ ID NO: 8544703 - DNA, 22 bp, Homo sapiens
gaggagactgacagcagattct

SEQ ID NO: 8544704 - DNA, 22 bp, Homo sapiens
gaggagagaacattcctccata

SEQ ID NO: 8544705 - DNA, 22 bp, Homo sapiens
gaggagagaagctaacggtgct

SEQ ID NO: 8544706 - DNA, 22 bp, Homo sapiens
gaggacagtgtgatctgccagc

SEQ ID NO: 8544707 - DNA, 22 bp, Homo sapiens
gaggacagtgtgatctgccagc

SEQ ID NO: 8544708 - DNA, 22 bp, Homo sapiens
gaggacagtgtgatctgccagc

SEQ ID NO: 8544709 - DNA, 17 bp, Homo sapiens
gaggacagggaagtagg

SEQ ID NO: 8544710 - DNA, 22 bp, Homo sapiens
gaggacagtgtgatctgccagc

SEQ ID NO: 8544711 - DNA, 22 bp, Homo sapiens
gaggacagtgtgatctgccagc

SEQ ID NO: 8544712 - DNA, 22 bp, Homo sapiens
gaggaccacagatgagcctgca

SEQ ID NO: 8544713 - DNA, 22 bp, Homo sapiens
gaggaccacagatgagcctgca

SEQ ID NO: 8544714 - DNA, 23 bp, Homo sapiens
gaggaccaaatatatacatggaa

SEQ ID NO: 8544715 - DNA, 22 bp, Homo sapiens
gaggactctgcaggctgctcct

SEQ ID NO: 8544716 - DNA, 22 bp, Homo sapiens
gaggaccacagatgagcctgca

SEQ ID NO: 8544717 - DNA, 22 bp, Homo sapiens
gaggaccacagatgagcctgca

SEQ ID NO: 8544718 - DNA, 22 bp, Homo sapiens
gaggcatgcagagctggagcag

SEQ ID NO: 8544719 - DNA, 22 bp, Homo sapiens
gaggcatggcctgaggctagga

SEQ ID NO: 8544720 - DNA, 22 bp, Homo sapiens
gaggccacggaagggagctgtg

SEQ ID NO: 8544721 - DNA, 22 bp, Homo sapiens
gaggccacggttttccttgggg

SEQ ID NO: 8544722 - DNA, 22 bp, Homo sapiens
gaggccacggttttccttgggg

SEQ ID NO: 8544723 - DNA, 22 bp, Homo sapiens
gaggccacgtgcttatgtttct

SEQ ID NO: 8544724 - DNA, 22 bp, Homo sapiens
gaggccacgtgcttatgtttct

SEQ ID NO: 8544725 - DNA, 22 bp, Homo sapiens
gaggccacggaagggagctgtg

SEQ ID NO: 8544726 - DNA, 22 bp, Homo sapiens
gaggccactgtccctgccttcc

SEQ ID NO: 8544727 - DNA, 21 bp, Homo sapiens
gaggccactaataggggcaga

SEQ ID NO: 8544728 - DNA, 21 bp, Homo sapiens
gaggccactaataggggcaga

SEQ ID NO: 8544729 - DNA, 22 bp, Homo sapiens
gaggatggaggtgtgagctatg

SEQ ID NO: 8544730 - DNA, 22 bp, Homo sapiens
gaggatggaggtgtgagctatg

SEQ ID NO: 8544731 - DNA, 22 bp, Homo sapiens
gaggatggaggcagttagggcc

SEQ ID NO: 8544732 - DNA, 22 bp, Homo sapiens
gaggatggtgagcaggacccag

SEQ ID NO: 8544733 - DNA, 22 bp, Homo sapiens
gaggatggtatgaggcaagcaa

SEQ ID NO: 8544734 - DNA, 22 bp, Homo sapiens
gaggatggtatgaggcaagcaa

SEQ ID NO: 8544735 - DNA, 22 bp, Homo sapiens
gaggatggtatgaggcaagcaa

SEQ ID NO: 8544736 - DNA, 22 bp, Homo sapiens
gaggatgtaaaatagacaaaat

SEQ ID NO: 8544737 - DNA, 22 bp, Homo sapiens
gaggatttgatggctttctccc

SEQ ID NO: 8544738 - DNA, 22 bp, Homo sapiens
gaggccagactgccttttatga

SEQ ID NO: 8544739 - DNA, 22 bp, Homo sapiens
gaggccagaatgagtctctggg

SEQ ID NO: 8544740 - DNA, 22 bp, Homo sapiens
gaggccagaatgagtctctggg

SEQ ID NO: 8544741 - DNA, 22 bp, Homo sapiens
gaggcctggaccagccacagag

SEQ ID NO: 8544742 - DNA, 22 bp, Homo sapiens
gaggcctggaattccagcctgg

SEQ ID NO: 8544743 - DNA, 22 bp, Homo sapiens
gaggccagaagtctgagatcag

SEQ ID NO: 8544744 - DNA, 22 bp, Homo sapiens
gaggccacttcctactggagga

SEQ ID NO: 8544745 - DNA, 22 bp, Homo sapiens
gaggccacttcctactggagga

SEQ ID NO: 8544746 - DNA, 22 bp, Homo sapiens
gaggccactgtccctgccttcc

SEQ ID NO: 8544747 - DNA, 22 bp, Homo sapiens
gaggccagaagtgcctcgggct

SEQ ID NO: 8544748 - DNA, 22 bp, Homo sapiens
gaggccagaagtgcctcgggct

SEQ ID NO: 8544749 - DNA, 22 bp, Homo sapiens
gaggccagaatgagctgaatgc

SEQ ID NO: 8544750 - DNA, 22 bp, Homo sapiens
gaggccagaatgagtctctggg

SEQ ID NO: 8544751 - DNA, 22 bp, Homo sapiens
gaggcctggtctatgagatgtt

SEQ ID NO: 8544752 - DNA, 22 bp, Homo sapiens
gaggcctgggttggaggtgcat

SEQ ID NO: 8544753 - DNA, 22 bp, Homo sapiens
gaggcctggtttccagcatcct

SEQ ID NO: 8544754 - DNA, 22 bp, Homo sapiens
gaggcctggtttgcatgagaat

SEQ ID NO: 8544755 - DNA, 22 bp, Homo sapiens
gaggcctggtttccagcatcct

SEQ ID NO: 8544756 - DNA, 22 bp, Homo sapiens
gaggcctggtttgcatgagaat

SEQ ID NO: 8544757 - DNA, 22 bp, Homo sapiens
gaggcctggtttgcatgagaat

SEQ ID NO: 8544758 - DNA, 19 bp, Homo sapiens
gaggcgaggcgtgcaggag

SEQ ID NO: 8544759 - DNA, 22 bp, Homo sapiens
gaggccttgggatgtgccacgg

SEQ ID NO: 8544760 - DNA, 22 bp, Homo sapiens
gaggcctgtcgctaggcctctg

SEQ ID NO: 8544761 - DNA, 22 bp, Homo sapiens
gaggcctgtcgctaggcctctg

SEQ ID NO: 8544762 - DNA, 22 bp, Homo sapiens
gaggcctgtcgctaggcctctg

SEQ ID NO: 8544763 - DNA, 22 bp, Homo sapiens
gaggcctgtagtcatggatgta

SEQ ID NO: 8544764 - DNA, 22 bp, Homo sapiens
gaggctggtaggaaaggaaaca

SEQ ID NO: 8544765 - DNA, 22 bp, Homo sapiens
gaggctggtaggaaaggaaaca

SEQ ID NO: 8544766 - DNA, 22 bp, Homo sapiens
gaggctggtaggaaaggaaaca

SEQ ID NO: 8544767 - DNA, 22 bp, Homo sapiens
gaggctggtcagccctaagatc

SEQ ID NO: 8544768 - DNA, 22 bp, Homo sapiens
gaggctggtaggaaaggaaaca

SEQ ID NO: 8544769 - DNA, 22 bp, Homo sapiens
gaggctggtcagccctaagatc

SEQ ID NO: 8544770 - DNA, 22 bp, Homo sapiens
gaggctggtggttagttccatt

SEQ ID NO: 8544771 - DNA, 22 bp, Homo sapiens
gaggctggtggttagttccatt

SEQ ID NO: 8544772 - DNA, 22 bp, Homo sapiens
gaggctggtggttagttccatt

SEQ ID NO: 8544773 - DNA, 22 bp, Homo sapiens
gaggctggtttgccttttggca

SEQ ID NO: 8544774 - DNA, 22 bp, Homo sapiens
gaggctggttctgaagtactgt

SEQ ID NO: 8544775 - DNA, 22 bp, Homo sapiens
gaggctggttctgaagtactgt

SEQ ID NO: 8544776 - DNA, 22 bp, Homo sapiens
gaggctggttcccttgatcttt

SEQ ID NO: 8544777 - DNA, 22 bp, Homo sapiens
gaggctggtggttagttccatt

SEQ ID NO: 8544778 - DNA, 22 bp, Homo sapiens
gaggctggttcccttgatcttt

SEQ ID NO: 8544779 - DNA, 22 bp, Homo sapiens
gaggctcaaacctggacagagc

SEQ ID NO: 8544780 - DNA, 22 bp, Homo sapiens
gaggctggtaggaaaggaaaca

SEQ ID NO: 8544781 - DNA, 22 bp, Homo sapiens
gaggctggtaggaaaggaaaca

SEQ ID NO: 8544782 - DNA, 22 bp, Homo sapiens
gaggctggggtctgcctttctg

SEQ ID NO: 8544783 - DNA, 22 bp, Homo sapiens
gaggctaagtaactgtccatgg

SEQ ID NO: 8544784 - DNA, 22 bp, Homo sapiens
gaggctagagcaggggctcaat

SEQ ID NO: 8544785 - DNA, 22 bp, Homo sapiens
gaggctgtaagtgtggagccta

SEQ ID NO: 8544786 - DNA, 22 bp, Homo sapiens
gaggctggttctgaagtactgt

SEQ ID NO: 8544787 - DNA, 22 bp, Homo sapiens
gagggaagattccccatatggg

SEQ ID NO: 8544788 - DNA, 22 bp, Homo sapiens
gagggccagagtcctggggtca

SEQ ID NO: 8544789 - DNA, 22 bp, Homo sapiens
gagggacagctaaagagaaatt

SEQ ID NO: 8544790 - DNA, 22 bp, Homo sapiens
gagggaatggtgtgcaagaggt

SEQ ID NO: 8544791 - DNA, 22 bp, Homo sapiens
gagggccagcagcctcagcatg

SEQ ID NO: 8544792 - DNA, 22 bp, Homo sapiens
gagggccagcagcctcagcatg

SEQ ID NO: 8544793 - DNA, 22 bp, Homo sapiens
gagggccagatcccaggaggaa

SEQ ID NO: 8544794 - DNA, 22 bp, Homo sapiens
gagggccagatcccaggaggaa

SEQ ID NO: 8544795 - DNA, 22 bp, Homo sapiens
gagggccagatcccaggaggaa

SEQ ID NO: 8544796 - DNA, 22 bp, Homo sapiens
gagggccagatcccaggaggaa

SEQ ID NO: 8544797 - DNA, 22 bp, Homo sapiens
gagggccaggcagcaagaaggc

SEQ ID NO: 8544798 - DNA, 22 bp, Homo sapiens
gagggccaggcagcaagaaggc

SEQ ID NO: 8544799 - DNA, 22 bp, Homo sapiens
gagggccaggcagcaagaaggc

SEQ ID NO: 8544800 - DNA, 22 bp, Homo sapiens
gagggccagcctgccaagggcc

SEQ ID NO: 8544801 - DNA, 22 bp, Homo sapiens
gagggccaggcggagacaggcg

SEQ ID NO: 8544802 - DNA, 22 bp, Homo sapiens
gagggccaggcggagacaggcg

SEQ ID NO: 8544803 - DNA, 22 bp, Homo sapiens
gagggccaggcggagacaggcg

SEQ ID NO: 8544804 - DNA, 22 bp, Homo sapiens
gagggccaggcggagacaggcg

SEQ ID NO: 8544805 - DNA, 22 bp, Homo sapiens
gagggcctggcacagggaggct

SEQ ID NO: 8544806 - DNA, 22 bp, Homo sapiens
gagggcctctgtgggtgctcac

SEQ ID NO: 8544807 - DNA, 22 bp, Homo sapiens
gagggcctctgctgctccacat

SEQ ID NO: 8544808 - DNA, 22 bp, Homo sapiens
gagggctgataaatgcgcatgg

SEQ ID NO: 8544809 - DNA, 22 bp, Homo sapiens
gagggctgataacaggaataca

SEQ ID NO: 8544810 - DNA, 22 bp, Homo sapiens
gaggtggatgttgcagtgagct

SEQ ID NO: 8544811 - DNA, 22 bp, Homo sapiens
gaggtggctccaggagcaatgc

SEQ ID NO: 8544812 - DNA, 22 bp, Homo sapiens
gaggtggatgttgcagtgagct

SEQ ID NO: 8544813 - DNA, 22 bp, Homo sapiens
gaggtggatgttgcagtgagct

SEQ ID NO: 8544814 - DNA, 22 bp, Homo sapiens
gaggtggaggggaaaaatagat

SEQ ID NO: 8544815 - DNA, 22 bp, Homo sapiens
gaggtggctccttcagggaata

SEQ ID NO: 8544816 - DNA, 22 bp, Homo sapiens
gaggtggctgcttgctgggaaa

SEQ ID NO: 8544817 - DNA, 22 bp, Homo sapiens
gaggtggctgcttgctgggaaa

SEQ ID NO: 8544818 - DNA, 18 bp, Homo sapiens
gaggtggctgggccatct

SEQ ID NO: 8544819 - DNA, 18 bp, Homo sapiens
gaggtggctgggccatct

SEQ ID NO: 8544820 - DNA, 22 bp, Homo sapiens
gaggtggctgggagtagggaat

SEQ ID NO: 8544821 - DNA, 22 bp, Homo sapiens
gaggtgagaagggggtcagatg

SEQ ID NO: 8544822 - DNA, 22 bp, Homo sapiens
gaggtgagaagggggtcagatg

SEQ ID NO: 8544823 - DNA, 22 bp, Homo sapiens
gaggtgagaagggggtcagatg

SEQ ID NO: 8544824 - DNA, 22 bp, Homo sapiens
gaggtgagaagggggtcagatg

SEQ ID NO: 8544825 - DNA, 22 bp, Homo sapiens
gaggtgagaagggggtcagatg

SEQ ID NO: 8544826 - DNA, 22 bp, Homo sapiens
gaggtgagtggatcacgaggtc

SEQ ID NO: 8544827 - DNA, 22 bp, Homo sapiens
gaggtgagtggatcacgaggtc

SEQ ID NO: 8544828 - DNA, 22 bp, Homo sapiens
gaggtgagtggatcacgaggtc

SEQ ID NO: 8544829 - DNA, 22 bp, Homo sapiens
gaggtgattttcaaaagaactt

SEQ ID NO: 8544830 - DNA, 22 bp, Homo sapiens
gaggtgcctggcgatgtctctg

SEQ ID NO: 8544831 - DNA, 22 bp, Homo sapiens
gaggtgcttcctttgggctctg

SEQ ID NO: 8544832 - DNA, 22 bp, Homo sapiens
gaggtgggagggcagtccctaa

SEQ ID NO: 8544833 - DNA, 22 bp, Homo sapiens
gaggtgggagggcagtccctaa

SEQ ID NO: 8544834 - DNA, 22 bp, Homo sapiens
gaggtgggagggcagtccctaa

SEQ ID NO: 8544835 - DNA, 22 bp, Homo sapiens
gaggtggcttagtctctggaca

SEQ ID NO: 8544836 - DNA, 22 bp, Homo sapiens
gaggtggcttagtctctggaca

SEQ ID NO: 8544837 - DNA, 22 bp, Homo sapiens
gaggtttcactgtgttgtccag

SEQ ID NO: 8544838 - DNA, 22 bp, Homo sapiens
gaggtttcactgtgttgtccag

SEQ ID NO: 8544839 - DNA, 23 bp, Homo sapiens
gaggtgtgaattctgggtgctgc

SEQ ID NO: 8544840 - DNA, 23 bp, Homo sapiens
gaggtgtgaattctgggtgctgc

SEQ ID NO: 8544841 - DNA, 22 bp, Homo sapiens
gagtaaaagttggattacaaag

SEQ ID NO: 8544842 - DNA, 22 bp, Homo sapiens
gagtaaaagttggattacaaag

SEQ ID NO: 8544843 - DNA, 22 bp, Homo sapiens
gaggttttaagttgaaggggga

SEQ ID NO: 8544844 - DNA, 22 bp, Homo sapiens
gaggttttaggctgccattatt

SEQ ID NO: 8544845 - DNA, 22 bp, Homo sapiens
gaggtttcttatcaagaaagct

SEQ ID NO: 8544846 - DNA, 19 bp, Homo sapiens
gaggtttctgaagtgggct

SEQ ID NO: 8544847 - DNA, 22 bp, Homo sapiens
gagtaattctggtaaatcattg

SEQ ID NO: 8544848 - DNA, 22 bp, Homo sapiens
gagtaattccaatataaatcac

SEQ ID NO: 8544849 - DNA, 22 bp, Homo sapiens
gagtaattttcttgatttctta

SEQ ID NO: 8544850 - DNA, 22 bp, Homo sapiens
gagtaatttatccagtgaagta

SEQ ID NO: 8544851 - DNA, 22 bp, Homo sapiens
gagtaattttcttaaaacatca

SEQ ID NO: 8544852 - DNA, 19 bp, Homo sapiens
gagtacaggtgcagaaatg

SEQ ID NO: 8544853 - DNA, 22 bp, Homo sapiens
gagtacatcttaatttgactaa

SEQ ID NO: 8544854 - DNA, 22 bp, Homo sapiens
gagtacatgtatagagattaac

SEQ ID NO: 8544855 - DNA, 22 bp, Homo sapiens
gagtaacataccaaaattcaca

SEQ ID NO: 8544856 - DNA, 22 bp, Homo sapiens
gagtaaaagttggattacaaag

SEQ ID NO: 8544857 - DNA, 22 bp, Homo sapiens
gagtaaaagttggattacaaag

SEQ ID NO: 8544858 - DNA, 22 bp, Homo sapiens
gagtaaaataggtgagaatcaa

SEQ ID NO: 8544859 - DNA, 22 bp, Homo sapiens
gagtaagagctggctttggtgt

SEQ ID NO: 8544860 - DNA, 22 bp, Homo sapiens
gagtaacataccaaaattcaca

SEQ ID NO: 8544861 - DNA, 22 bp, Homo sapiens
gagggtggggaatagactgcta

SEQ ID NO: 8544862 - DNA, 22 bp, Homo sapiens
gagggtgggtacaccagccctc

SEQ ID NO: 8544863 - DNA, 22 bp, Homo sapiens
gagggtgggtacaccagccctc

SEQ ID NO: 8544864 - DNA, 22 bp, Homo sapiens
gagggtggggaatagactgcta

SEQ ID NO: 8544865 - DNA, 22 bp, Homo sapiens
gagggtggggaatagactgcta

SEQ ID NO: 8544866 - DNA, 22 bp, Homo sapiens
gagggtggggaatagactgcta

SEQ ID NO: 8544867 - DNA, 22 bp, Homo sapiens
gagggtgggctcctatctgggt

SEQ ID NO: 8544868 - DNA, 22 bp, Homo sapiens
gagggtgggctttgttcctcca

SEQ ID NO: 8544869 - DNA, 22 bp, Homo sapiens
gagggtgggctttgttcctcca

SEQ ID NO: 8544870 - DNA, 22 bp, Homo sapiens
gagggtgggctcctatctgggt

SEQ ID NO: 8544871 - DNA, 22 bp, Homo sapiens
gagggtgggccagatatgaggg

SEQ ID NO: 8544872 - DNA, 22 bp, Homo sapiens
gagggtgggccagatatgaggg

SEQ ID NO: 8544873 - DNA, 22 bp, Homo sapiens
gagggtgggccagatatgaggg

SEQ ID NO: 8544874 - DNA, 22 bp, Homo sapiens
gagggtggtggcttaaggtgct

SEQ ID NO: 8544875 - DNA, 22 bp, Homo sapiens
gaggtcctgtctgagaatggag

SEQ ID NO: 8544876 - DNA, 22 bp, Homo sapiens
gaggtctgagtgcggaaagcct

SEQ ID NO: 8544877 - DNA, 22 bp, Homo sapiens
gaggtctcactatgttgcccag

SEQ ID NO: 8544878 - DNA, 22 bp, Homo sapiens
gagggtggtggcttaaggtgct

SEQ ID NO: 8544879 - DNA, 22 bp, Homo sapiens
gagggtggtggcttaaggtgct

SEQ ID NO: 8544880 - DNA, 22 bp, Homo sapiens
gagggtggtggcttaaggtgct

SEQ ID NO: 8544881 - DNA, 22 bp, Homo sapiens
gagggtgggtttcttgcacgtc

SEQ ID NO: 8544882 - DNA, 22 bp, Homo sapiens
gagggtgggtttcttgcacgtc

SEQ ID NO: 8544883 - DNA, 22 bp, Homo sapiens
gaggtctgggatggggcctgaa

SEQ ID NO: 8544884 - DNA, 22 bp, Homo sapiens
gaggtctgggcttgggcctggt

SEQ ID NO: 8544885 - DNA, 22 bp, Homo sapiens
gaggtctggaccaagtcgcccc

SEQ ID NO: 8544886 - DNA, 22 bp, Homo sapiens
gaggtctgagtgcggaaagcct

SEQ ID NO: 8544887 - DNA, 22 bp, Homo sapiens
gaggtctgccttcaggagagtt

SEQ ID NO: 8544888 - DNA, 22 bp, Homo sapiens
gagggtggcctttagagcccat

SEQ ID NO: 8544889 - DNA, 22 bp, Homo sapiens
gagggtggcctttagagcccat

SEQ ID NO: 8544890 - DNA, 22 bp, Homo sapiens
gagggtggctcctccctgggcc

SEQ ID NO: 8544891 - DNA, 22 bp, Homo sapiens
gagggtggctcctccctgggcc

SEQ ID NO: 8544892 - DNA, 22 bp, Homo sapiens
gagggtggctcctccctgggcc

SEQ ID NO: 8544893 - DNA, 22 bp, Homo sapiens
gagggtggctcctccctgggcc

SEQ ID NO: 8544894 - DNA, 20 bp, Homo sapiens
gagggtgggacttcctaggc

SEQ ID NO: 8544895 - DNA, 20 bp, Homo sapiens
gagggtgggacttcctaggc

SEQ ID NO: 8544896 - DNA, 22 bp, Homo sapiens
gagggtggagctccagaatctg

SEQ ID NO: 8544897 - DNA, 22 bp, Homo sapiens
gagggtggagctccagaatctg

SEQ ID NO: 8544898 - DNA, 22 bp, Homo sapiens
gagggtggatcagcctgattgg

SEQ ID NO: 8544899 - DNA, 22 bp, Homo sapiens
gagggtggaagagctgctgaga

SEQ ID NO: 8544900 - DNA, 22 bp, Homo sapiens
gagggtggaagagctgctgaga

SEQ ID NO: 8544901 - DNA, 22 bp, Homo sapiens
gagggtggagctccagaatctg

SEQ ID NO: 8544902 - DNA, 22 bp, Homo sapiens
gagggtgcaggaggatggtagt

SEQ ID NO: 8544903 - DNA, 22 bp, Homo sapiens
gagggtgcaggaggatggtagt

SEQ ID NO: 8544904 - DNA, 22 bp, Homo sapiens
gagggtgcagctgggccccacg

SEQ ID NO: 8544905 - DNA, 22 bp, Homo sapiens
gagggtgacagttctggtctct

SEQ ID NO: 8544906 - DNA, 22 bp, Homo sapiens
gagggtgcaggcaagagcaaaa

SEQ ID NO: 8544907 - DNA, 22 bp, Homo sapiens
gagggtgctctgagcccttttg

SEQ ID NO: 8544908 - DNA, 22 bp, Homo sapiens
gagggtgctgtgccaagatgac

SEQ ID NO: 8544909 - DNA, 22 bp, Homo sapiens
gagggtggaaagggtgtacctg

SEQ ID NO: 8544910 - DNA, 22 bp, Homo sapiens
gagggctgataacaggaataca

SEQ ID NO: 8544911 - DNA, 22 bp, Homo sapiens
gagggctgatgcttacttattt

SEQ ID NO: 8544912 - DNA, 22 bp, Homo sapiens
tcccagaggactgttggtgcta

SEQ ID NO: 8544913 - DNA, 22 bp, Homo sapiens
tcccagaggcagttggtaactt

SEQ ID NO: 8544914 - DNA, 22 bp, Homo sapiens
tcccagagccaagctatggatg

SEQ ID NO: 8544915 - DNA, 22 bp, Homo sapiens
tcccagagccaagctatggatg

SEQ ID NO: 8544916 - DNA, 22 bp, Homo sapiens
tcccagagccaagctatggatg

SEQ ID NO: 8544917 - DNA, 22 bp, Homo sapiens
tcccagaggctccagtctctat

SEQ ID NO: 8544918 - DNA, 22 bp, Homo sapiens
tcccagaggctccagtctctat

SEQ ID NO: 8544919 - DNA, 22 bp, Homo sapiens
tcccagaggctccagtctctat

SEQ ID NO: 8544920 - DNA, 22 bp, Homo sapiens
tcccagaggctccagtctctat

SEQ ID NO: 8544921 - DNA, 22 bp, Homo sapiens
tcccagaggttgagtcacttat

SEQ ID NO: 8544922 - DNA, 22 bp, Homo sapiens
tcccagagtattagcaattgct

SEQ ID NO: 8544923 - DNA, 22 bp, Homo sapiens
tcccagcataacaaactgcccg

SEQ ID NO: 8544924 - DNA, 22 bp, Homo sapiens
tcccagaggtctctgctggttc

SEQ ID NO: 8544925 - DNA, 22 bp, Homo sapiens
tcccagaggttgagtcacttat

SEQ ID NO: 8544926 - DNA, 22 bp, Homo sapiens
tcccagcctcctgacagttttg

SEQ ID NO: 8544927 - DNA, 23 bp, Homo sapiens
tcccagcctcttctcttgcatac

SEQ ID NO: 8544928 - DNA, 23 bp, Homo sapiens
tcccagcctcttctcttgcatac

SEQ ID NO: 8544929 - DNA, 22 bp, Homo sapiens
tcccagccggtgcctgggtccc

SEQ ID NO: 8544930 - DNA, 22 bp, Homo sapiens
tcccagccggtgcctgggtccc

SEQ ID NO: 8544931 - DNA, 22 bp, Homo sapiens
tcccagcattaatgcctgtcag

SEQ ID NO: 8544932 - DNA, 22 bp, Homo sapiens
tcccagcccaggtatgatgata

SEQ ID NO: 8544933 - DNA, 22 bp, Homo sapiens
tcccagccttccttgtggtgaa

SEQ ID NO: 8544934 - DNA, 22 bp, Homo sapiens
tcccagccttccttgtggtgaa

SEQ ID NO: 8544935 - DNA, 22 bp, Homo sapiens
tcccagcctttctttctccagc

SEQ ID NO: 8544936 - DNA, 22 bp, Homo sapiens
tcccagcctttctttctccagc

SEQ ID NO: 8544937 - DNA, 22 bp, Homo sapiens
tcccagcctttctttctccagc

SEQ ID NO: 8544938 - DNA, 22 bp, Homo sapiens
tcccagcctttctttctccagc

SEQ ID NO: 8544939 - DNA, 22 bp, Homo sapiens
tcccaggcgcctggtggggagc

SEQ ID NO: 8544940 - DNA, 22 bp, Homo sapiens
tcccaggcgcctggtggggagc

SEQ ID NO: 8544941 - DNA, 22 bp, Homo sapiens
tcccaggccataaaactcagag

SEQ ID NO: 8544942 - DNA, 22 bp, Homo sapiens
tcccagccttccagtctggttt

SEQ ID NO: 8544943 - DNA, 22 bp, Homo sapiens
tcccagccttccagtctggttt

SEQ ID NO: 8544944 - DNA, 22 bp, Homo sapiens
tcccagccttatctcccctggc

SEQ ID NO: 8544945 - DNA, 22 bp, Homo sapiens
tcccagccttatctcccctggc

SEQ ID NO: 8544946 - DNA, 22 bp, Homo sapiens
tcccagcctggaccctgccagt

SEQ ID NO: 8544947 - DNA, 22 bp, Homo sapiens
tcccagccttatctcccctggc

SEQ ID NO: 8544948 - DNA, 22 bp, Homo sapiens
tcccagcctggaccctgccagt

SEQ ID NO: 8544949 - DNA, 22 bp, Homo sapiens
tcccagcctgacagtgcatcaa

SEQ ID NO: 8544950 - DNA, 22 bp, Homo sapiens
tcccagcctgacagtgcatcaa

SEQ ID NO: 8544951 - DNA, 22 bp, Homo sapiens
tcccagcctgacagtgcatcaa

SEQ ID NO: 8544952 - DNA, 22 bp, Homo sapiens
tcccagcctggaccctgccagt

SEQ ID NO: 8544953 - DNA, 22 bp, Homo sapiens
tcccagagacatcatttctccg

SEQ ID NO: 8544954 - DNA, 22 bp, Homo sapiens
tcccagagacatcatttctccg

SEQ ID NO: 8544955 - DNA, 22 bp, Homo sapiens
tcccagagacagagcctcctcc

SEQ ID NO: 8544956 - DNA, 22 bp, Homo sapiens
tcccagagacagagcctcctcc

SEQ ID NO: 8544957 - DNA, 22 bp, Homo sapiens
tcccagagatttcctctccttc

SEQ ID NO: 8544958 - DNA, 22 bp, Homo sapiens
tcccagagatttcctctccttc

SEQ ID NO: 8544959 - DNA, 22 bp, Homo sapiens
tcccagagatttcctctccttc

SEQ ID NO: 8544960 - DNA, 22 bp, Homo sapiens
tcccagagcagtactccaggag

SEQ ID NO: 8544961 - DNA, 22 bp, Homo sapiens
tcccagagcagtactccaggag

SEQ ID NO: 8544962 - DNA, 22 bp, Homo sapiens
tcccagagccaagctatggatg

SEQ ID NO: 8544963 - DNA, 22 bp, Homo sapiens
tcccagagcagatgtgctaaag

SEQ ID NO: 8544964 - DNA, 22 bp, Homo sapiens
tcccagagcagatgtgctaaag

SEQ ID NO: 8544965 - DNA, 22 bp, Homo sapiens
tcccagagcagtactccaggag

SEQ ID NO: 8544966 - DNA, 22 bp, Homo sapiens
tcccagagcagatgtgctaaag

SEQ ID NO: 8544967 - DNA, 22 bp, Homo sapiens
tcccagagaagagctggatgga

SEQ ID NO: 8544968 - DNA, 19 bp, Homo sapiens
tcccaagatttctgtatca

SEQ ID NO: 8544969 - DNA, 22 bp, Homo sapiens
tcccaagagctctgggataagg

SEQ ID NO: 8544970 - DNA, 22 bp, Homo sapiens
tcccaaagtcaagctgtgtctt

SEQ ID NO: 8544971 - DNA, 22 bp, Homo sapiens
tcccaaagtattagcatttcaa

SEQ ID NO: 8544972 - DNA, 22 bp, Homo sapiens
tcccaaagctactcttctgact

SEQ ID NO: 8544973 - DNA, 22 bp, Homo sapiens
tcccaaagtattagcatttcaa

SEQ ID NO: 8544974 - DNA, 22 bp, Homo sapiens
tcccaaagtattagcatttcaa

SEQ ID NO: 8544975 - DNA, 22 bp, Homo sapiens
tcccaagacgatgtgcttggcc

SEQ ID NO: 8544976 - DNA, 22 bp, Homo sapiens
tccattatacttctgattcaaa

SEQ ID NO: 8544977 - DNA, 22 bp, Homo sapiens
tccattatacttctgattcaaa

SEQ ID NO: 8544978 - DNA, 22 bp, Homo sapiens
tccattaatgattatttctgtg

SEQ ID NO: 8544979 - DNA, 22 bp, Homo sapiens
tccatgtgttttcctgtccaca

SEQ ID NO: 8544980 - DNA, 22 bp, Homo sapiens
tccatgtggccagacactggca

SEQ ID NO: 8544981 - DNA, 22 bp, Homo sapiens
tccatggggcccaggatgagag

SEQ ID NO: 8544982 - DNA, 22 bp, Homo sapiens
tccatgggtagccctggttgag

SEQ ID NO: 8544983 - DNA, 22 bp, Homo sapiens
tccatgtgcttcctcaggggaa

SEQ ID NO: 8544984 - DNA, 22 bp, Homo sapiens
tccatgtggcaataggagacag

SEQ ID NO: 8544985 - DNA, 22 bp, Homo sapiens
tccatgtgccaaggggcagagg

SEQ ID NO: 8544986 - DNA, 22 bp, Homo sapiens
tccatggagatggatgactgta

SEQ ID NO: 8544987 - DNA, 22 bp, Homo sapiens
tccatggggcccaggatgagag

SEQ ID NO: 8544988 - DNA, 22 bp, Homo sapiens
tccatggggcccaggatgagag

SEQ ID NO: 8544989 - DNA, 22 bp, Homo sapiens
tccattcttttgctgtcttcct

SEQ ID NO: 8544990 - DNA, 22 bp, Homo sapiens
tccattcattcattgatgaaca

SEQ ID NO: 8544991 - DNA, 22 bp, Homo sapiens
tccattcattcaggtatttagt

SEQ ID NO: 8544992 - DNA, 22 bp, Homo sapiens
tccatttagctggcaaacaatg

SEQ ID NO: 8544993 - DNA, 22 bp, Homo sapiens
tccatttagctggcaaacaatg

SEQ ID NO: 8544994 - DNA, 22 bp, Homo sapiens
tccatttactattctcatatcg

SEQ ID NO: 8544995 - DNA, 22 bp, Homo sapiens
tcccaaagctactcttctgact

SEQ ID NO: 8544996 - DNA, 22 bp, Homo sapiens
tcccaaagctactcttctgact

SEQ ID NO: 8544997 - DNA, 22 bp, Homo sapiens
tcccaaaggtccgagcgggaat

SEQ ID NO: 8544998 - DNA, 22 bp, Homo sapiens
tcccaaagctactcttctgact

SEQ ID NO: 8544999 - DNA, 22 bp, Homo sapiens
tccattggtctctgtgcccagg

SEQ ID NO: 8545000 - DNA, 22 bp, Homo sapiens
tccaggcctggctccattcagt

SEQ ID NO: 8545001 - DNA, 22 bp, Homo sapiens
tccaggcctgcctggtgtttgc

SEQ ID NO: 8545002 - DNA, 22 bp, Homo sapiens
tccaggcctggctccattcagt

SEQ ID NO: 8545003 - DNA, 20 bp, Homo sapiens
tccaggccttgttctcagat

SEQ ID NO: 8545004 - DNA, 22 bp, Homo sapiens
tccaggccttgacaggtcagtt

SEQ ID NO: 8545005 - DNA, 22 bp, Homo sapiens
tccaggccttgacaggtcagtt

SEQ ID NO: 8545006 - DNA, 22 bp, Homo sapiens
tccaggctaattttgcattgtt

SEQ ID NO: 8545007 - DNA, 20 bp, Homo sapiens
tccaggccttgttctcagat

SEQ ID NO: 8545008 - DNA, 22 bp, Homo sapiens
tccaggcctttgcacatgttgt

SEQ ID NO: 8545009 - DNA, 22 bp, Homo sapiens
tccaggcctttgcacatgttgt

SEQ ID NO: 8545010 - DNA, 18 bp, Homo sapiens
tccaggcctgaagtgtcc

SEQ ID NO: 8545011 - DNA, 22 bp, Homo sapiens
tccaggcctgactataaatgta

SEQ ID NO: 8545012 - DNA, 18 bp, Homo sapiens
tccaggcctgaagtgtcc

SEQ ID NO: 8545013 - DNA, 22 bp, Homo sapiens
tccaggcctgcaatgacaaagc

SEQ ID NO: 8545014 - DNA, 22 bp, Homo sapiens
tccaggcctgactataaatgta

SEQ ID NO: 8545015 - DNA, 22 bp, Homo sapiens
tccaggcctctagcccctatct

SEQ ID NO: 8545016 - DNA, 22 bp, Homo sapiens
tccaggcctctagcccctatct

SEQ ID NO: 8545017 - DNA, 22 bp, Homo sapiens
tccaggcctctagccctctctt

SEQ ID NO: 8545018 - DNA, 22 bp, Homo sapiens
tccaggcctctagccctctctt

SEQ ID NO: 8545019 - DNA, 22 bp, Homo sapiens
tccacaaggcagctcctccagg

SEQ ID NO: 8545020 - DNA, 22 bp, Homo sapiens
tccacaaggcagctcctccagg

SEQ ID NO: 8545021 - DNA, 22 bp, Homo sapiens
tccaggctacttggattcctgg

SEQ ID NO: 8545022 - DNA, 22 bp, Homo sapiens
tccaggctagaagtcacaggcc

SEQ ID NO: 8545023 - DNA, 22 bp, Homo sapiens
tccaggctagaagtcacaggcc

SEQ ID NO: 8545024 - DNA, 22 bp, Homo sapiens
tccaggctagagtgcagtggcc

SEQ ID NO: 8545025 - DNA, 22 bp, Homo sapiens
tccaggctagaagtcacaggcc

SEQ ID NO: 8545026 - DNA, 22 bp, Homo sapiens
tccaggctagcctggtagagaa

SEQ ID NO: 8545027 - DNA, 22 bp, Homo sapiens
tccaggctaggtttacaggaca

SEQ ID NO: 8545028 - DNA, 22 bp, Homo sapiens
tccaggctggacatgaggcggg

SEQ ID NO: 8545029 - DNA, 22 bp, Homo sapiens
tccaggctggacatgaggcggg

SEQ ID NO: 8545030 - DNA, 22 bp, Homo sapiens
tccaggctagagtgcagtggcc

SEQ ID NO: 8545031 - DNA, 22 bp, Homo sapiens
tccaggctaggtttacaggaca

SEQ ID NO: 8545032 - DNA, 21 bp, Homo sapiens
tccaggctggaaggggcgttg

SEQ ID NO: 8545033 - DNA, 18 bp, Homo sapiens
tccaggctggattgatga

SEQ ID NO: 8545034 - DNA, 22 bp, Homo sapiens
tccaggctggcctcgcgtgaca

SEQ ID NO: 8545035 - DNA, 22 bp, Homo sapiens
tccaggctggctcttcaaaatt

SEQ ID NO: 8545036 - DNA, 22 bp, Homo sapiens
tccaggctggctcttcaaaatt

SEQ ID NO: 8545037 - DNA, 22 bp, Homo sapiens
tccaggctggctcttcaaaatt

SEQ ID NO: 8545038 - DNA, 22 bp, Homo sapiens
tccaggctggctcttcaaaatt

SEQ ID NO: 8545039 - DNA, 22 bp, Homo sapiens
tccaggctggagtgcagtggca

SEQ ID NO: 8545040 - DNA, 22 bp, Homo sapiens
tccaggctggagtgcagtggcg

SEQ ID NO: 8545041 - DNA, 22 bp, Homo sapiens
tccaggctggagtgcagtggca

SEQ ID NO: 8545042 - DNA, 22 bp, Homo sapiens
tccaggctggagtgcagtggcg

SEQ ID NO: 8545043 - DNA, 18 bp, Homo sapiens
tccagggcttcctcctct

SEQ ID NO: 8545044 - DNA, 22 bp, Homo sapiens
tccagggctgggttggctcagc

SEQ ID NO: 8545045 - DNA, 22 bp, Homo sapiens
tccagggctgttactttacata

SEQ ID NO: 8545046 - DNA, 22 bp, Homo sapiens
tccagggctgggttggctcagc

SEQ ID NO: 8545047 - DNA, 22 bp, Homo sapiens
tccagggctgggttggctcagc

SEQ ID NO: 8545048 - DNA, 23 bp, Homo sapiens
tccagggctggccagacctcggt

SEQ ID NO: 8545049 - DNA, 22 bp, Homo sapiens
tccagggacacagagtccttct

SEQ ID NO: 8545050 - DNA, 22 bp, Homo sapiens
tccagggacacagagtccttct

SEQ ID NO: 8545051 - DNA, 23 bp, Homo sapiens
tccagggctggccagacctcggt

SEQ ID NO: 8545052 - DNA, 22 bp, Homo sapiens
tccagggctgacttgggagagg

SEQ ID NO: 8545053 - DNA, 22 bp, Homo sapiens
tccagggctgacttgggagagg

SEQ ID NO: 8545054 - DNA, 22 bp, Homo sapiens
tccagggctgacttgggagagg

SEQ ID NO: 8545055 - DNA, 22 bp, Homo sapiens
tccagggctgacttgggagagg

SEQ ID NO: 8545056 - DNA, 22 bp, Homo sapiens
tccagggctgacttgggagagg

SEQ ID NO: 8545057 - DNA, 22 bp, Homo sapiens
tccagggaaggtgtgaggctgg

SEQ ID NO: 8545058 - DNA, 21 bp, Homo sapiens
tccagggaatttcaactttta

SEQ ID NO: 8545059 - DNA, 22 bp, Homo sapiens
tccagggaagagcagaggctac

SEQ ID NO: 8545060 - DNA, 22 bp, Homo sapiens
tccagggaagagcagaggctac

SEQ ID NO: 8545061 - DNA, 22 bp, Homo sapiens
tccagggaagagcagaggctac

SEQ ID NO: 8545062 - DNA, 23 bp, Homo sapiens
tccaggctgggacttcaactggc

SEQ ID NO: 8545063 - DNA, 22 bp, Homo sapiens
tccaggctgggctgaagggtgc

SEQ ID NO: 8545064 - DNA, 21 bp, Homo sapiens
tccagggaacttctcaggaat

SEQ ID NO: 8545065 - DNA, 21 bp, Homo sapiens
tccagggctttgattctctca

SEQ ID NO: 8545066 - DNA, 18 bp, Homo sapiens
tccagggcttcctcctct

SEQ ID NO: 8545067 - DNA, 22 bp, Homo sapiens
tccagggcttgacagggtgcct

SEQ ID NO: 8545068 - DNA, 22 bp, Homo sapiens
tccagggcttgacagggtgcct

SEQ ID NO: 8545069 - DNA, 22 bp, Homo sapiens
tccagggcttggctgggacggt

SEQ ID NO: 8545070 - DNA, 22 bp, Homo sapiens
tccagggcttggctgggacggt

SEQ ID NO: 8545071 - DNA, 22 bp, Homo sapiens
tccagggcttggctgggacggt

SEQ ID NO: 8545072 - DNA, 22 bp, Homo sapiens
tccagggcttggctgggacggt

SEQ ID NO: 8545073 - DNA, 22 bp, Homo sapiens
tccagggcttgacagggtgcct

SEQ ID NO: 8545074 - DNA, 22 bp, Homo sapiens
tccagtcacttcattttacaga

SEQ ID NO: 8545075 - DNA, 22 bp, Homo sapiens
tccagtactgaagctccttcaa

SEQ ID NO: 8545076 - DNA, 22 bp, Homo sapiens
tccatgctcttgtctagcctcc

SEQ ID NO: 8545077 - DNA, 22 bp, Homo sapiens
tccagtcaagcttgagaatttc

SEQ ID NO: 8545078 - DNA, 22 bp, Homo sapiens
tccagtcaacttaatctcttta

SEQ ID NO: 8545079 - DNA, 22 bp, Homo sapiens
tccagtatgactgatgtccttc

SEQ ID NO: 8545080 - DNA, 20 bp, Homo sapiens
tccagtatgttatttggtgt

SEQ ID NO: 8545081 - DNA, 22 bp, Homo sapiens
tccagtatcaaagtcctagtcc

SEQ ID NO: 8545082 - DNA, 22 bp, Homo sapiens
tccagtatcaaagtcctagtcc

SEQ ID NO: 8545083 - DNA, 22 bp, Homo sapiens
tccagtatgactgatgtccttc

SEQ ID NO: 8545084 - DNA, 22 bp, Homo sapiens
tccagtacaggtctctcatttc

SEQ ID NO: 8545085 - DNA, 22 bp, Homo sapiens
tccagtacaggtctctcatttc

SEQ ID NO: 8545086 - DNA, 22 bp, Homo sapiens
tccaggtgtgctctgtgccctg

SEQ ID NO: 8545087 - DNA, 22 bp, Homo sapiens
tccctggctgtgttcaggtgcg

SEQ ID NO: 8545088 - DNA, 22 bp, Homo sapiens
tccctggctgtgttcaggtgcg

SEQ ID NO: 8545089 - DNA, 22 bp, Homo sapiens
tccctgggaaatgtcagtttca

SEQ ID NO: 8545090 - DNA, 22 bp, Homo sapiens
tccctgggaacaaaggatgaga

SEQ ID NO: 8545091 - DNA, 22 bp, Homo sapiens
tccctgggaattaatatttgga

SEQ ID NO: 8545092 - DNA, 19 bp, Homo sapiens
tccctggcgcctctcgggc

SEQ ID NO: 8545093 - DNA, 19 bp, Homo sapiens
tccctggcgcctctcgggc

SEQ ID NO: 8545094 - DNA, 22 bp, Homo sapiens
tccctggctgggggctgccttg

SEQ ID NO: 8545095 - DNA, 22 bp, Homo sapiens
tccctggctgggggctgccttg

SEQ ID NO: 8545096 - DNA, 22 bp, Homo sapiens
tccctggctgggggctgccttg

SEQ ID NO: 8545097 - DNA, 22 bp, Homo sapiens
tccctggccattcctctaggcc

SEQ ID NO: 8545098 - DNA, 22 bp, Homo sapiens
tccctggaacagagagacaacg

SEQ ID NO: 8545099 - DNA, 22 bp, Homo sapiens
tccctggacaacagacttcact

SEQ ID NO: 8545100 - DNA, 22 bp, Homo sapiens
tccctggacaacagacttcact

SEQ ID NO: 8545101 - DNA, 22 bp, Homo sapiens
tccctggacaacagacttcact

SEQ ID NO: 8545102 - DNA, 22 bp, Homo sapiens
tccctggagataacttctggga

SEQ ID NO: 8545103 - DNA, 22 bp, Homo sapiens
tccctggacagccttgcctggg

SEQ ID NO: 8545104 - DNA, 23 bp, Homo sapiens
tccctggaggcaggtccagggcc

SEQ ID NO: 8545105 - DNA, 20 bp, Homo sapiens
tccctggaggtggtggcatc

SEQ ID NO: 8545106 - DNA, 20 bp, Homo sapiens
tccctggaggtggtggcatc

SEQ ID NO: 8545107 - DNA, 20 bp, Homo sapiens
tccctggaggtggtggcatc

SEQ ID NO: 8545108 - DNA, 22 bp, Homo sapiens
tccctggcacaagaaggctgtc

SEQ ID NO: 8545109 - DNA, 22 bp, Homo sapiens
tccctggcagctaagggtggtc

SEQ ID NO: 8545110 - DNA, 16 bp, Homo sapiens
tccctgggagtggtgg

SEQ ID NO: 8545111 - DNA, 18 bp, Homo sapiens
tccctgggatataattac

SEQ ID NO: 8545112 - DNA, 22 bp, Homo sapiens
tccgtatttgactattgcaccg

SEQ ID NO: 8545113 - DNA, 22 bp, Homo sapiens
tcctaaaggctgcttttatatt

SEQ ID NO: 8545114 - DNA, 22 bp, Homo sapiens
tccgtggagattttgtgcaggg

SEQ ID NO: 8545115 - DNA, 22 bp, Homo sapiens
tccgttgagtcagcttcggacc

SEQ ID NO: 8545116 - DNA, 22 bp, Homo sapiens
tccgttgacagggcacttgaca

SEQ ID NO: 8545117 - DNA, 22 bp, Homo sapiens
tccgttgacttggaagccctga

SEQ ID NO: 8545118 - DNA, 22 bp, Homo sapiens
tccgtgttctccagagataatc

SEQ ID NO: 8545119 - DNA, 22 bp, Homo sapiens
tccgttctctaggagaaacttc

SEQ ID NO: 8545120 - DNA, 22 bp, Homo sapiens
tccgttgacactgcatggagat

SEQ ID NO: 8545121 - DNA, 15 bp, Homo sapiens
tccctgggagatggt

SEQ ID NO: 8545122 - DNA, 16 bp, Homo sapiens
tccctgggagtggtgg

SEQ ID NO: 8545123 - DNA, 22 bp, Homo sapiens
tccctgggagatgatgatgagg

SEQ ID NO: 8545124 - DNA, 22 bp, Homo sapiens
tccctgggagatgatgatgagg

SEQ ID NO: 8545125 - DNA, 22 bp, Homo sapiens
tccctgggactcagacatggaa

SEQ ID NO: 8545126 - DNA, 22 bp, Homo sapiens
tccctgggacggccttttggag

SEQ ID NO: 8545127 - DNA, 22 bp, Homo sapiens
tccctgggaccggcagctcaca

SEQ ID NO: 8545128 - DNA, 22 bp, Homo sapiens
tccctgggaccggcagctcaca

SEQ ID NO: 8545129 - DNA, 22 bp, Homo sapiens
tccctgggaccggcagctcaca

SEQ ID NO: 8545130 - DNA, 22 bp, Homo sapiens
tcctagaatgcacctctgctgt

SEQ ID NO: 8545131 - DNA, 22 bp, Homo sapiens
tcctagaatctttgtaagattg

SEQ ID NO: 8545132 - DNA, 22 bp, Homo sapiens
tcctagagagtaatacagtttt

SEQ ID NO: 8545133 - DNA, 22 bp, Homo sapiens
tcctagagatgcaatttgattt

SEQ ID NO: 8545134 - DNA, 22 bp, Homo sapiens
tcctagaataatctttgactgc

SEQ ID NO: 8545135 - DNA, 22 bp, Homo sapiens
tcctagaataagtaacaggaca

SEQ ID NO: 8545136 - DNA, 22 bp, Homo sapiens
tcctagaatagtgtgtctggag

SEQ ID NO: 8545137 - DNA, 22 bp, Homo sapiens
tcctcagggaagatgagcctca

SEQ ID NO: 8545138 - DNA, 21 bp, Homo sapiens
tcctcagggccccagagcact

SEQ ID NO: 8545139 - DNA, 21 bp, Homo sapiens
tcctcagggccccagagcact

SEQ ID NO: 8545140 - DNA, 21 bp, Homo sapiens
tcctcagggccccagagcact

SEQ ID NO: 8545141 - DNA, 21 bp, Homo sapiens
tcctcagggccccagagcact

SEQ ID NO: 8545142 - DNA, 19 bp, Homo sapiens
tcctcaggggctcacagac

SEQ ID NO: 8545143 - DNA, 19 bp, Homo sapiens
tcctcaggggctcacagac

SEQ ID NO: 8545144 - DNA, 22 bp, Homo sapiens
tcctcagggcggcctccgtctt

SEQ ID NO: 8545145 - DNA, 22 bp, Homo sapiens
tcctcagggcggcctccgtctt

SEQ ID NO: 8545146 - DNA, 22 bp, Homo sapiens
tcctcaggggtttcaggtgtac

SEQ ID NO: 8545147 - DNA, 22 bp, Homo sapiens
tcctcagggggccaacccagcc

SEQ ID NO: 8545148 - DNA, 19 bp, Homo sapiens
tcctcaggggctcacagac

SEQ ID NO: 8545149 - DNA, 19 bp, Homo sapiens
tcctcaggggctcacagac

SEQ ID NO: 8545150 - DNA, 22 bp, Homo sapiens
tcctcaggtcaaagcaggagaa

SEQ ID NO: 8545151 - DNA, 22 bp, Homo sapiens
tcctcaggtcaaagcaggagaa

SEQ ID NO: 8545152 - DNA, 22 bp, Homo sapiens
tcctcagacttccctttgtgta

SEQ ID NO: 8545153 - DNA, 22 bp, Homo sapiens
tcctcagacaccctgctggctt

SEQ ID NO: 8545154 - DNA, 22 bp, Homo sapiens
tcctcagacttccctttgtgta

SEQ ID NO: 8545155 - DNA, 22 bp, Homo sapiens
tcctcagatacctggcagatca

SEQ ID NO: 8545156 - DNA, 22 bp, Homo sapiens
tcctcagatgctcttggacgcc

SEQ ID NO: 8545157 - DNA, 22 bp, Homo sapiens
tcctcagcaaacacttcactct

SEQ ID NO: 8545158 - DNA, 22 bp, Homo sapiens
tcctcagcaaacacttcactct

SEQ ID NO: 8545159 - DNA, 23 bp, Homo sapiens
tcctcagcatgttttgtcatgta

SEQ ID NO: 8545160 - DNA, 23 bp, Homo sapiens
tcctcagcatgttttgtcatgta

SEQ ID NO: 8545161 - DNA, 22 bp, Homo sapiens
tcctcagcattagcacagacat

SEQ ID NO: 8545162 - DNA, 22 bp, Homo sapiens
tcctcacagggcaggaaggagg

SEQ ID NO: 8545163 - DNA, 22 bp, Homo sapiens
tcctcacagggcaggaaggagg

SEQ ID NO: 8545164 - DNA, 22 bp, Homo sapiens
tcctcacatggtgagccacaca

SEQ ID NO: 8545165 - DNA, 22 bp, Homo sapiens
tcctcacagtcaacactttgag

SEQ ID NO: 8545166 - DNA, 22 bp, Homo sapiens
tcctcacagtcaacactttgag

SEQ ID NO: 8545167 - DNA, 22 bp, Homo sapiens
tcctcagaaacccctgtgaggt

SEQ ID NO: 8545168 - DNA, 22 bp, Homo sapiens
tcctcagaaacccctgtgaggt

SEQ ID NO: 8545169 - DNA, 22 bp, Homo sapiens
tcctcacatggtgagccacaca

SEQ ID NO: 8545170 - DNA, 22 bp, Homo sapiens
tcctcacatggtgagccacaca

SEQ ID NO: 8545171 - DNA, 22 bp, Homo sapiens
tcctcagaatcacctggcagct

SEQ ID NO: 8545172 - DNA, 22 bp, Homo sapiens
tcctcagaatcacctggcagct

SEQ ID NO: 8545173 - DNA, 22 bp, Homo sapiens
tcctcagaatcacctggcagct

SEQ ID NO: 8545174 - DNA, 22 bp, Homo sapiens
tcctcagaagaacccctagatt

SEQ ID NO: 8545175 - DNA, 22 bp, Homo sapiens
tcctcagaaacccctgtgaggt

SEQ ID NO: 8545176 - DNA, 22 bp, Homo sapiens
tcctcagaaacccctgtgaggt

SEQ ID NO: 8545177 - DNA, 20 bp, Homo sapiens
tcctcagaagacatttgggg

SEQ ID NO: 8545178 - DNA, 22 bp, Homo sapiens
tcctcacagctggttcattcag

SEQ ID NO: 8545179 - DNA, 22 bp, Homo sapiens
tcctcacagctggttcattcag

SEQ ID NO: 8545180 - DNA, 22 bp, Homo sapiens
tcctcacagcatgaccaggcag

SEQ ID NO: 8545181 - DNA, 22 bp, Homo sapiens
tcctcacagctggttcattcag

SEQ ID NO: 8545182 - DNA, 22 bp, Homo sapiens
tcctcacagcatgaccaggcag

SEQ ID NO: 8545183 - DNA, 22 bp, Homo sapiens
tcctcacagatgggtgcatagc

SEQ ID NO: 8545184 - DNA, 22 bp, Homo sapiens
tcctcacagagtggcaggcaat

SEQ ID NO: 8545185 - DNA, 22 bp, Homo sapiens
tcctcacagatgggtgcatagc

SEQ ID NO: 8545186 - DNA, 22 bp, Homo sapiens
tcctcacagagtggcaggcaat

SEQ ID NO: 8545187 - DNA, 22 bp, Homo sapiens
tcctcacaagcatcctgtctca

SEQ ID NO: 8545188 - DNA, 22 bp, Homo sapiens
tcctcacaagcatcctgtctca

SEQ ID NO: 8545189 - DNA, 22 bp, Homo sapiens
tcctcacacccataccactgac

SEQ ID NO: 8545190 - DNA, 22 bp, Homo sapiens
tcctcacactatagatgaggat

SEQ ID NO: 8545191 - DNA, 22 bp, Homo sapiens
tcctcacactatagatgaggat

SEQ ID NO: 8545192 - DNA, 18 bp, Homo sapiens
tcctagtgaaatgcctgt

SEQ ID NO: 8545193 - DNA, 22 bp, Homo sapiens
tcctagtgcaaattggagcatg

SEQ ID NO: 8545194 - DNA, 22 bp, Homo sapiens
tcctagttctctgccagtcgct

SEQ ID NO: 8545195 - DNA, 22 bp, Homo sapiens
tcctcacaagcaagcacaggta

SEQ ID NO: 8545196 - DNA, 22 bp, Homo sapiens
tcctcacaagcaagcacaggta

SEQ ID NO: 8545197 - DNA, 22 bp, Homo sapiens
tcctcacaagcaagcacaggta

SEQ ID NO: 8545198 - DNA, 22 bp, Homo sapiens
tcctcacaagcaagcacaggta

SEQ ID NO: 8545199 - DNA, 22 bp, Homo sapiens
tcccagggacccagcctgatac

SEQ ID NO: 8545200 - DNA, 22 bp, Homo sapiens
tcccagggacaccaagctgttt

SEQ ID NO: 8545201 - DNA, 22 bp, Homo sapiens
tcccagggactctctgccttcc

SEQ ID NO: 8545202 - DNA, 22 bp, Homo sapiens
tcccagggactctctgccttcc

SEQ ID NO: 8545203 - DNA, 19 bp, Homo sapiens
tcccgcccactgagcgtgc

SEQ ID NO: 8545204 - DNA, 22 bp, Homo sapiens
tcccgcccttgtacttgccgag

SEQ ID NO: 8545205 - DNA, 19 bp, Homo sapiens
tcccgcccactgagcgtgc

SEQ ID NO: 8545206 - DNA, 22 bp, Homo sapiens
tcccgataggcagggctctggc

SEQ ID NO: 8545207 - DNA, 22 bp, Homo sapiens
tccctcagacagatgtgttcct

SEQ ID NO: 8545208 - DNA, 22 bp, Homo sapiens
tccctcagacagatgtgttcct

SEQ ID NO: 8545209 - DNA, 18 bp, Homo sapiens
tccctcagaattatagaa

SEQ ID NO: 8545210 - DNA, 18 bp, Homo sapiens
tccctcagaattatagaa

SEQ ID NO: 8545211 - DNA, 21 bp, Homo sapiens
tccctcagaaggtagccaagc

SEQ ID NO: 8545212 - DNA, 21 bp, Homo sapiens
tccctcagaagctcttggtca

SEQ ID NO: 8545213 - DNA, 22 bp, Homo sapiens
tccctcagatgagctcctagca

SEQ ID NO: 8545214 - DNA, 22 bp, Homo sapiens
tccctcagatgagctcctagca

SEQ ID NO: 8545215 - DNA, 22 bp, Homo sapiens
tccctcagatgagctcctagca

SEQ ID NO: 8545216 - DNA, 22 bp, Homo sapiens
tccctcagagggcaagcgcaga

SEQ ID NO: 8545217 - DNA, 22 bp, Homo sapiens
tccctcagatgagctcctagca

SEQ ID NO: 8545218 - DNA, 21 bp, Homo sapiens
tccctcagacagggtgcctat

SEQ ID NO: 8545219 - DNA, 22 bp, Homo sapiens
tccctcagagaccgtggtgcag

SEQ ID NO: 8545220 - DNA, 22 bp, Homo sapiens
tccctcagagaccgtggtgcag

SEQ ID NO: 8545221 - DNA, 22 bp, Homo sapiens
tccctcagagggcaagcgcaga

SEQ ID NO: 8545222 - DNA, 21 bp, Homo sapiens
tccctcagacagggtgcctat

SEQ ID NO: 8545223 - DNA, 21 bp, Homo sapiens
tccctcagacagggtgcctat

SEQ ID NO: 8545224 - DNA, 22 bp, Homo sapiens
tccctcagatgagctcctagca

SEQ ID NO: 8545225 - DNA, 22 bp, Homo sapiens
tccctcagattggcaattagat

SEQ ID NO: 8545226 - DNA, 22 bp, Homo sapiens
tccctcagattggcaattagat

SEQ ID NO: 8545227 - DNA, 22 bp, Homo sapiens
tccctcagattggcaattagat

SEQ ID NO: 8545228 - DNA, 20 bp, Homo sapiens
tccctcagcacttctacctc

SEQ ID NO: 8545229 - DNA, 20 bp, Homo sapiens
tccctcagcacttctacctc

SEQ ID NO: 8545230 - DNA, 22 bp, Homo sapiens
tccctcagcaggaatgtggcag

SEQ ID NO: 8545231 - DNA, 22 bp, Homo sapiens
tccctcagcaggaatgtggcag

SEQ ID NO: 8545232 - DNA, 22 bp, Homo sapiens
tccctcagcaggaatgtggcag

SEQ ID NO: 8545233 - DNA, 22 bp, Homo sapiens
tccctcagcaggaactggcctg

SEQ ID NO: 8545234 - DNA, 22 bp, Homo sapiens
tccctcagcaggaactggcctg

SEQ ID NO: 8545235 - DNA, 22 bp, Homo sapiens
tccctcagcaggaactggcctg

SEQ ID NO: 8545236 - DNA, 20 bp, Homo sapiens
tcccaggctccaccctagac

SEQ ID NO: 8545237 - DNA, 20 bp, Homo sapiens
tcccaggctccaccctagac

SEQ ID NO: 8545238 - DNA, 22 bp, Homo sapiens
tcccaggctggcaggcagcagt

SEQ ID NO: 8545239 - DNA, 22 bp, Homo sapiens
tcccaggctggcaggcagcagt

SEQ ID NO: 8545240 - DNA, 22 bp, Homo sapiens
tcccaggctaggcctctgcgtt

SEQ ID NO: 8545241 - DNA, 20 bp, Homo sapiens
tcccaggctccaccctagac

SEQ ID NO: 8545242 - DNA, 22 bp, Homo sapiens
tcccaggctaggcctctgcgtt

SEQ ID NO: 8545243 - DNA, 22 bp, Homo sapiens
tcccaggctaggcctctgcgtt

SEQ ID NO: 8545244 - DNA, 22 bp, Homo sapiens
tcccaggctaggcctctgcgtt

SEQ ID NO: 8545245 - DNA, 22 bp, Homo sapiens
tcccagggacaccaagctgttt

SEQ ID NO: 8545246 - DNA, 22 bp, Homo sapiens
tcccagggacaccaagctgttt

SEQ ID NO: 8545247 - DNA, 23 bp, Homo sapiens
tcccagggaaggtgagcgaggct

SEQ ID NO: 8545248 - DNA, 23 bp, Homo sapiens
tcccagggaaggtgagcgaggct

SEQ ID NO: 8545249 - DNA, 22 bp, Homo sapiens
tcccaggctgggggcctgaagt

SEQ ID NO: 8545250 - DNA, 22 bp, Homo sapiens
tcccaggctgggggcctgaagt

SEQ ID NO: 8545251 - DNA, 22 bp, Homo sapiens
tcccaggctgggggcctgaagt

SEQ ID NO: 8545252 - DNA, 23 bp, Homo sapiens
tcccagggaaggtgagcgaggct

SEQ ID NO: 8545253 - DNA, 22 bp, Homo sapiens
tcccaggctggggccaggtgac

SEQ ID NO: 8545254 - DNA, 22 bp, Homo sapiens
tcccaggctgggggcctgaagt

SEQ ID NO: 8545255 - DNA, 20 bp, Homo sapiens
tcccaggctgggctccagct

SEQ ID NO: 8545256 - DNA, 20 bp, Homo sapiens
tcccaggctgggctccagct

SEQ ID NO: 8545257 - DNA, 20 bp, Homo sapiens
tcccaggctgggctccagct

SEQ ID NO: 8545258 - DNA, 22 bp, Homo sapiens
tccctcagctcatatttatgcc

SEQ ID NO: 8545259 - DNA, 22 bp, Homo sapiens
tccctcagcttgtctccatgca

SEQ ID NO: 8545260 - DNA, 22 bp, Homo sapiens
tccctcagctcatatttatgcc

SEQ ID NO: 8545261 - DNA, 15 bp, Homo sapiens
tccctcagctaaaga

SEQ ID NO: 8545262 - DNA, 22 bp, Homo sapiens
tccctcagcttgtctccatgca

SEQ ID NO: 8545263 - DNA, 22 bp, Homo sapiens
tccctcagcttgtctccatgca

SEQ ID NO: 8545264 - DNA, 22 bp, Homo sapiens
tccctcagcttgtctccatgca

SEQ ID NO: 8545265 - DNA, 22 bp, Homo sapiens
tccctcagcttgtctccatgca

SEQ ID NO: 8545266 - DNA, 22 bp, Homo sapiens
tccctcagcttgtctccatgca

SEQ ID NO: 8545267 - DNA, 22 bp, Homo sapiens
tccctcagcttgtctccatgca

SEQ ID NO: 8545268 - DNA, 23 bp, Homo sapiens
tccctcaggccttatctccatct

SEQ ID NO: 8545269 - DNA, 23 bp, Homo sapiens
tccctcaggccttatctccatct

SEQ ID NO: 8545270 - DNA, 22 bp, Homo sapiens
tccctcaggacccaacttgtaa

SEQ ID NO: 8545271 - DNA, 22 bp, Homo sapiens
tccctcagtccctggacaggca

SEQ ID NO: 8545272 - DNA, 22 bp, Homo sapiens
tccctcaggtggttcttgtttc

SEQ ID NO: 8545273 - DNA, 22 bp, Homo sapiens
tccctcaggtggttcttgtttc

SEQ ID NO: 8545274 - DNA, 22 bp, Homo sapiens
tccctcagtccctggacaggca

SEQ ID NO: 8545275 - DNA, 22 bp, Homo sapiens
tccctcagtccctggacaggca

SEQ ID NO: 8545276 - DNA, 22 bp, Homo sapiens
tccctcagtccctggacaggca

SEQ ID NO: 8545277 - DNA, 22 bp, Homo sapiens
tccctcagggtgcagttgcttt

SEQ ID NO: 8545278 - DNA, 22 bp, Homo sapiens
tccctcagggtgcagttgcttt

SEQ ID NO: 8545279 - DNA, 20 bp, Homo sapiens
tccctcaggtcattgggctg

SEQ ID NO: 8545280 - DNA, 20 bp, Homo sapiens
tccctcaggtcattgggctg

SEQ ID NO: 8545281 - DNA, 22 bp, Homo sapiens
tccctcagggtgcagttgcttt

SEQ ID NO: 8545282 - DNA, 23 bp, Homo sapiens
tccctcaggccttatctccatct

SEQ ID NO: 8545283 - DNA, 23 bp, Homo sapiens
tccctcaggccttatctccatct

SEQ ID NO: 8545284 - DNA, 22 bp, Homo sapiens
tccctccccacttctgagcttt

SEQ ID NO: 8545285 - DNA, 20 bp, Homo sapiens
tccctccctccagctctggg

SEQ ID NO: 8545286 - DNA, 20 bp, Homo sapiens
tccctccctccagctctggg

SEQ ID NO: 8545287 - DNA, 22 bp, Homo sapiens
tccctccaggcagctgggtact

SEQ ID NO: 8545288 - DNA, 22 bp, Homo sapiens
tccctccataacagaggtgagc

SEQ ID NO: 8545289 - DNA, 22 bp, Homo sapiens
tccctccccacttctgagcttt

SEQ ID NO: 8545290 - DNA, 20 bp, Homo sapiens
tccctcagtttccagccctg

SEQ ID NO: 8545291 - DNA, 22 bp, Homo sapiens
tccctccacacctgctggtacc

SEQ ID NO: 8545292 - DNA, 20 bp, Homo sapiens
tccctcagtttccagccctg

SEQ ID NO: 8545293 - DNA, 20 bp, Homo sapiens
tccctcagtttccagccctg

SEQ ID NO: 8545294 - DNA, 22 bp, Homo sapiens
tccctccagaatggtgaggaag

SEQ ID NO: 8545295 - DNA, 22 bp, Homo sapiens
tccctccacacctgctggtacc

SEQ ID NO: 8545296 - DNA, 19 bp, Homo sapiens
tccctcagtctgccaggcc

SEQ ID NO: 8545297 - DNA, 19 bp, Homo sapiens
tccctcagtctgccaggcc

SEQ ID NO: 8545298 - DNA, 19 bp, Homo sapiens
tccctcagtctgccaggcc

SEQ ID NO: 8545299 - DNA, 20 bp, Homo sapiens
tccctcagtcctggctttgt

SEQ ID NO: 8545300 - DNA, 20 bp, Homo sapiens
tccctcagtcctggctttgt

SEQ ID NO: 8545301 - DNA, 20 bp, Homo sapiens
tccctcagtcctggctttgt

SEQ ID NO: 8545302 - DNA, 19 bp, Homo sapiens
tccctcagtctgccaggcc

SEQ ID NO: 8545303 - DNA, 20 bp, Homo sapiens
tccctccctccagctctggg

SEQ ID NO: 8545304 - DNA, 20 bp, Homo sapiens
tccctccctccagctctggg

SEQ ID NO: 8545305 - DNA, 18 bp, Homo sapiens
tccctccctgctgtggcc

SEQ ID NO: 8545306 - DNA, 19 bp, Homo sapiens
tccctccctgtaatctcac

SEQ ID NO: 8545307 - DNA, 19 bp, Homo sapiens
tccctccctgtaatctcac

SEQ ID NO: 8545308 - DNA, 18 bp, Homo sapiens
tccctccctgctgtggcc

SEQ ID NO: 8545309 - DNA, 22 bp, Homo sapiens
tccctctgctagtgcttgagct

SEQ ID NO: 8545310 - DNA, 22 bp, Homo sapiens
tccctctggtcctcggtggaga

SEQ ID NO: 8545311 - DNA, 22 bp, Homo sapiens
tccctctggtctggacgccata

SEQ ID NO: 8545312 - DNA, 22 bp, Homo sapiens
tccctctgggctggagcagggt

SEQ ID NO: 8545313 - DNA, 22 bp, Homo sapiens
tccctctgggctccagcacgga

SEQ ID NO: 8545314 - DNA, 22 bp, Homo sapiens
tccctgaaccactagtgatgag

SEQ ID NO: 8545315 - DNA, 22 bp, Homo sapiens
tccctgaatctcgaactagcct

SEQ ID NO: 8545316 - DNA, 22 bp, Homo sapiens
tccctgaaccactagtgatgag

SEQ ID NO: 8545317 - DNA, 22 bp, Homo sapiens
tccctctgttctgttccaagtg

SEQ ID NO: 8545318 - DNA, 22 bp, Homo sapiens
tccctgaaacataatagatgcc

SEQ ID NO: 8545319 - DNA, 22 bp, Homo sapiens
tccctctgtgttgggcatgcct

SEQ ID NO: 8545320 - DNA, 22 bp, Homo sapiens
tccctctgtgttgggcatgcct

SEQ ID NO: 8545321 - DNA, 22 bp, Homo sapiens
tccctgcctcctggcagtgcca

SEQ ID NO: 8545322 - DNA, 22 bp, Homo sapiens
tccctgccctgccttcatggtt

SEQ ID NO: 8545323 - DNA, 22 bp, Homo sapiens
tccctgagagcactggggagcc

SEQ ID NO: 8545324 - DNA, 22 bp, Homo sapiens
tccctgaatctcgaactagcct

SEQ ID NO: 8545325 - DNA, 22 bp, Homo sapiens
tcctgcctgcaatcccagcact

SEQ ID NO: 8545326 - DNA, 22 bp, Homo sapiens
tcctgcctgcaatcccagcact

SEQ ID NO: 8545327 - DNA, 22 bp, Homo sapiens
tcctgcctgcaatcccagcact

SEQ ID NO: 8545328 - DNA, 22 bp, Homo sapiens
tcctgcctgcaatcccagcact

SEQ ID NO: 8545329 - DNA, 22 bp, Homo sapiens
tcctgcctgagcgtggaggagg

SEQ ID NO: 8545330 - DNA, 22 bp, Homo sapiens
tcctgcctgagcgtggaggagg

SEQ ID NO: 8545331 - DNA, 22 bp, Homo sapiens
tcctgcctgagcgtggaggagg

SEQ ID NO: 8545332 - DNA, 22 bp, Homo sapiens
tcctgcctcttttcttattcca

SEQ ID NO: 8545333 - DNA, 22 bp, Homo sapiens
tcctgcctcttttcttattcca

SEQ ID NO: 8545334 - DNA, 22 bp, Homo sapiens
tcctgcctcttgccttcttcac

SEQ ID NO: 8545335 - DNA, 22 bp, Homo sapiens
tcctgcctcttgccttcttcac

SEQ ID NO: 8545336 - DNA, 22 bp, Homo sapiens
tcctgcctctccatgctaacta

SEQ ID NO: 8545337 - DNA, 22 bp, Homo sapiens
tcctgcctctccatgctaacta

SEQ ID NO: 8545338 - DNA, 22 bp, Homo sapiens
tcctgcctcaggctctggagta

SEQ ID NO: 8545339 - DNA, 22 bp, Homo sapiens
tcctgcctctccatgctaacta

SEQ ID NO: 8545340 - DNA, 22 bp, Homo sapiens
tcctgcctcacagttgaagttt

SEQ ID NO: 8545341 - DNA, 22 bp, Homo sapiens
tcctgcctcacagttgaagttt

SEQ ID NO: 8545342 - DNA, 22 bp, Homo sapiens
tcctgcctcaggctctggagta

SEQ ID NO: 8545343 - DNA, 22 bp, Homo sapiens
tcctgcctcacagttgaagttt

SEQ ID NO: 8545344 - DNA, 22 bp, Homo sapiens
tcctgcctaccttgcggaggtg

SEQ ID NO: 8545345 - DNA, 22 bp, Homo sapiens
tcctgcctaccttgcggaggtg

SEQ ID NO: 8545346 - DNA, 22 bp, Homo sapiens
tcctgcctagcaggtgacctat

SEQ ID NO: 8545347 - DNA, 22 bp, Homo sapiens
tcctgcctagcaggtgacctat

SEQ ID NO: 8545348 - DNA, 22 bp, Homo sapiens
tcctgcctagcaggtgacctat

SEQ ID NO: 8545349 - DNA, 22 bp, Homo sapiens
tcctgcctagcaggtgacctat

SEQ ID NO: 8545350 - DNA, 22 bp, Homo sapiens
tcctgcagatcaaagcctttga

SEQ ID NO: 8545351 - DNA, 22 bp, Homo sapiens
tcctgcagccactgcaggcaga

SEQ ID NO: 8545352 - DNA, 22 bp, Homo sapiens
tcctgcagccactgcaggcaga

SEQ ID NO: 8545353 - DNA, 22 bp, Homo sapiens
tcctgcagccattagaggtcaa

SEQ ID NO: 8545354 - DNA, 22 bp, Homo sapiens
tcctgcagagccgccctcaggt

SEQ ID NO: 8545355 - DNA, 22 bp, Homo sapiens
tcctgcagagccgccctcaggt

SEQ ID NO: 8545356 - DNA, 22 bp, Homo sapiens
tcctgcagagacagaggcctca

SEQ ID NO: 8545357 - DNA, 23 bp, Homo sapiens
tcctgcagataagctggttgaca

SEQ ID NO: 8545358 - DNA, 22 bp, Homo sapiens
tcctgcagagtcccactgattt

SEQ ID NO: 8545359 - DNA, 22 bp, Homo sapiens
tcctgcagacctcagtcaggtc

SEQ ID NO: 8545360 - DNA, 19 bp, Homo sapiens
tcctgcagaccagacctgt

SEQ ID NO: 8545361 - DNA, 19 bp, Homo sapiens
tcctgcagaccagacctgt

SEQ ID NO: 8545362 - DNA, 22 bp, Homo sapiens
tcctgcagagacagaggcctca

SEQ ID NO: 8545363 - DNA, 22 bp, Homo sapiens
tcctgcagagacagaggcctca

SEQ ID NO: 8545364 - DNA, 22 bp, Homo sapiens
tcctgcagagacagaggcctca

SEQ ID NO: 8545365 - DNA, 22 bp, Homo sapiens
tcctgcagacctcagtcaggtc

SEQ ID NO: 8545366 - DNA, 22 bp, Homo sapiens
tcctgcagacatttacaccttt

SEQ ID NO: 8545367 - DNA, 22 bp, Homo sapiens
tcctgattaggtttccatagct

SEQ ID NO: 8545368 - DNA, 22 bp, Homo sapiens
tcctgcacaccttgagcttgga

SEQ ID NO: 8545369 - DNA, 22 bp, Homo sapiens
tcctgcagctgcagacctgggg

SEQ ID NO: 8545370 - DNA, 22 bp, Homo sapiens
tcctgcagctgcagacctgggg

SEQ ID NO: 8545371 - DNA, 22 bp, Homo sapiens
tcctgcagctgaagctcatgtg

SEQ ID NO: 8545372 - DNA, 22 bp, Homo sapiens
tcctgcagctctgagaagcatc

SEQ ID NO: 8545373 - DNA, 22 bp, Homo sapiens
tcctgcaggcctgttcccagta

SEQ ID NO: 8545374 - DNA, 22 bp, Homo sapiens
tcctgcaggcctgttcccagta

SEQ ID NO: 8545375 - DNA, 22 bp, Homo sapiens
tcctgcaggcttgagtcctcag

SEQ ID NO: 8545376 - DNA, 22 bp, Homo sapiens
tcctgcagctgcagacctgggg

SEQ ID NO: 8545377 - DNA, 18 bp, Homo sapiens
tcctgcagcttctatgta

SEQ ID NO: 8545378 - DNA, 20 bp, Homo sapiens
tcctgcagtcgctagcgccc

SEQ ID NO: 8545379 - DNA, 22 bp, Homo sapiens
tcctgcagtctgcactctgcct

SEQ ID NO: 8545380 - DNA, 22 bp, Homo sapiens
tcctgcccagagctctccactc

SEQ ID NO: 8545381 - DNA, 22 bp, Homo sapiens
tcctgcaggtggatgattctct

SEQ ID NO: 8545382 - DNA, 22 bp, Homo sapiens
tcctgcaggcttgagtcctcag

SEQ ID NO: 8545383 - DNA, 22 bp, Homo sapiens
tcctgaagaacgaagtcatgta

SEQ ID NO: 8545384 - DNA, 22 bp, Homo sapiens
tcctgaacattatgcaagcttc

SEQ ID NO: 8545385 - DNA, 22 bp, Homo sapiens
tcctgaacattatgcaagcttc

SEQ ID NO: 8545386 - DNA, 22 bp, Homo sapiens
tcctgaagaaggcagatatttg

SEQ ID NO: 8545387 - DNA, 22 bp, Homo sapiens
tcctgaagagccctgctctgtg

SEQ ID NO: 8545388 - DNA, 19 bp, Homo sapiens
tcctgaagatttcctcagc

SEQ ID NO: 8545389 - DNA, 22 bp, Homo sapiens
tcctgaagcagttagcatgagc

SEQ ID NO: 8545390 - DNA, 22 bp, Homo sapiens
tcctgaagaggctacactgctt

SEQ ID NO: 8545391 - DNA, 22 bp, Homo sapiens
tcctgaagatgaaaagagaggt

SEQ ID NO: 8545392 - DNA, 22 bp, Homo sapiens
tcctgaaattctggttgtcact

SEQ ID NO: 8545393 - DNA, 22 bp, Homo sapiens
tcctgaaattctggttgtcact

SEQ ID NO: 8545394 - DNA, 22 bp, Homo sapiens
tcctgaaattctggttgtcact

SEQ ID NO: 8545395 - DNA, 22 bp, Homo sapiens
tcctgaaatttgttttaattct

SEQ ID NO: 8545396 - DNA, 22 bp, Homo sapiens
tcctgaacagctcctgagcatg

SEQ ID NO: 8545397 - DNA, 22 bp, Homo sapiens
tcctgaaatgtgcacatgacat

SEQ ID NO: 8545398 - DNA, 22 bp, Homo sapiens
tcctgaaaataatttcacaaga

SEQ ID NO: 8545399 - DNA, 22 bp, Homo sapiens
tcctgaaatgtgcacatgacat

SEQ ID NO: 8545400 - DNA, 22 bp, Homo sapiens
tcctctttctcaacattagtta

SEQ ID NO: 8545401 - DNA, 22 bp, Homo sapiens
tcctgaaaaattacatgttcag

SEQ ID NO: 8545402 - DNA, 19 bp, Homo sapiens
tcctgaaaacttctggaat

SEQ ID NO: 8545403 - DNA, 19 bp, Homo sapiens
tcctgaaaacttctggaat

SEQ ID NO: 8545404 - DNA, 19 bp, Homo sapiens
tcctgaaaacttctggaat

SEQ ID NO: 8545405 - DNA, 19 bp, Homo sapiens
tcctgaaaacttctggaat

SEQ ID NO: 8545406 - DNA, 22 bp, Homo sapiens
tcctgagacatctctgctggtc

SEQ ID NO: 8545407 - DNA, 20 bp, Homo sapiens
tcctgagacctgggaaggtt

SEQ ID NO: 8545408 - DNA, 22 bp, Homo sapiens
tcctgagagcagagtccaggtg

SEQ ID NO: 8545409 - DNA, 22 bp, Homo sapiens
tcctgagagcagctgctttgga

SEQ ID NO: 8545410 - DNA, 22 bp, Homo sapiens
tcctgagagcagctgctttgga

SEQ ID NO: 8545411 - DNA, 20 bp, Homo sapiens
tcctgagaggctcttggaga

SEQ ID NO: 8545412 - DNA, 22 bp, Homo sapiens
tcctgagagccttggcttcaga

SEQ ID NO: 8545413 - DNA, 22 bp, Homo sapiens
tcctgagaatagagttgcatgt

SEQ ID NO: 8545414 - DNA, 22 bp, Homo sapiens
tcctgaaggcctgagttccacc

SEQ ID NO: 8545415 - DNA, 22 bp, Homo sapiens
tcctgagaaggcacagcttgca

SEQ ID NO: 8545416 - DNA, 22 bp, Homo sapiens
tcctgaagctctcttaaggaaa

SEQ ID NO: 8545417 - DNA, 22 bp, Homo sapiens
tcctgaagcctgagtgatgact

SEQ ID NO: 8545418 - DNA, 22 bp, Homo sapiens
tcctgaaggcagatggggatca

SEQ ID NO: 8545419 - DNA, 22 bp, Homo sapiens
tcctgaaggagcagttgctggg

SEQ ID NO: 8545420 - DNA, 22 bp, Homo sapiens
tcctctggtcttcggtgtggac

SEQ ID NO: 8545421 - DNA, 22 bp, Homo sapiens
tcctctggttatacttgcaccc

SEQ ID NO: 8545422 - DNA, 22 bp, Homo sapiens
tcctctggtcctgcagcagatc

SEQ ID NO: 8545423 - DNA, 22 bp, Homo sapiens
tcctctgggctccctgcaacag

SEQ ID NO: 8545424 - DNA, 22 bp, Homo sapiens
tcctctgggctccctgcaacag

SEQ ID NO: 8545425 - DNA, 22 bp, Homo sapiens
tcctctgggctccctgcaacag

SEQ ID NO: 8545426 - DNA, 22 bp, Homo sapiens
tcctcaggtgactaggtatctt

SEQ ID NO: 8545427 - DNA, 22 bp, Homo sapiens
tcctcaggtcaaagcaggagaa

SEQ ID NO: 8545428 - DNA, 22 bp, Homo sapiens
tcctcaggtgactaggtatctt

SEQ ID NO: 8545429 - DNA, 22 bp, Homo sapiens
tcctctgggcctatttgttcac

SEQ ID NO: 8545430 - DNA, 22 bp, Homo sapiens
tcctcttctgtggattccctga

SEQ ID NO: 8545431 - DNA, 22 bp, Homo sapiens
tcctctttaaatgcttttatct

SEQ ID NO: 8545432 - DNA, 22 bp, Homo sapiens
tcctcttgggaatacctttcta

SEQ ID NO: 8545433 - DNA, 22 bp, Homo sapiens
tcctcttctgcctatatctgcc

SEQ ID NO: 8545434 - DNA, 22 bp, Homo sapiens
tcctcttctgcctatatctgcc

SEQ ID NO: 8545435 - DNA, 22 bp, Homo sapiens
tcctcttctgcctatatctgcc

SEQ ID NO: 8545436 - DNA, 22 bp, Homo sapiens
tcctcttctgcccatcagaggc

SEQ ID NO: 8545437 - DNA, 22 bp, Homo sapiens
tcctctggttatacttgcaccc

SEQ ID NO: 8545438 - DNA, 22 bp, Homo sapiens
tcctcttcaaaaggatttcctt

SEQ ID NO: 8545439 - DNA, 22 bp, Homo sapiens
tcctcttcagagggacctcggg

SEQ ID NO: 8545440 - DNA, 22 bp, Homo sapiens
tcctcttccttctgtccaaatg

SEQ ID NO: 8545441 - DNA, 22 bp, Homo sapiens
tcctcttcaaaatagctctgaa

SEQ ID NO: 8545442 - DNA, 22 bp, Homo sapiens
tcctcttcaaaatagctctgaa

SEQ ID NO: 8545443 - DNA, 22 bp, Homo sapiens
tcctcttcagagggacctcggg

SEQ ID NO: 8545444 - DNA, 22 bp, Homo sapiens
tcctgagatccttttagggatc

SEQ ID NO: 8545445 - DNA, 22 bp, Homo sapiens
tcctgagatccttttagggatc

SEQ ID NO: 8545446 - DNA, 22 bp, Homo sapiens
tcctgagatccttttagggatc

SEQ ID NO: 8545447 - DNA, 23 bp, Homo sapiens
tcctgagatgagacagtgctgcc

SEQ ID NO: 8545448 - DNA, 22 bp, Homo sapiens
tcctgagatgagacagtgctgc

SEQ ID NO: 8545449 - DNA, 22 bp, Homo sapiens
tcctgagatgagacagtgctgc

SEQ ID NO: 8545450 - DNA, 23 bp, Homo sapiens
tcctgagatgagacagtgctgcc

SEQ ID NO: 8545451 - DNA, 23 bp, Homo sapiens
tcctgagatgagacagtgctgcc

SEQ ID NO: 8545452 - DNA, 23 bp, Homo sapiens
tcctgagatgagacagtgctgcc

SEQ ID NO: 8545453 - DNA, 22 bp, Homo sapiens
tcctgagagtcaagaatgcagg

SEQ ID NO: 8545454 - DNA, 22 bp, Homo sapiens
tcctgagaggtgtgaggtgcag

SEQ ID NO: 8545455 - DNA, 20 bp, Homo sapiens
tcctgagaggctcttggaga

SEQ ID NO: 8545456 - DNA, 22 bp, Homo sapiens
tcctgagataaatctcatgtga

SEQ ID NO: 8545457 - DNA, 22 bp, Homo sapiens
tcctgagagtcaagaatgcagg

SEQ ID NO: 8545458 - DNA, 22 bp, Homo sapiens
tcctgagagtcaagaatgcagg

SEQ ID NO: 8545459 - DNA, 22 bp, Homo sapiens
tcctgagataggagttgaaggc

SEQ ID NO: 8545460 - DNA, 22 bp, Homo sapiens
tcctgagataggagttgaaggc

SEQ ID NO: 8545461 - DNA, 22 bp, Homo sapiens
tcctgagccctggggtcagtgt

SEQ ID NO: 8545462 - DNA, 20 bp, Homo sapiens
tcctgagcctccaccatgtc

SEQ ID NO: 8545463 - DNA, 22 bp, Homo sapiens
tcctgagccccagggaggttgg

SEQ ID NO: 8545464 - DNA, 22 bp, Homo sapiens
tcctgagcacctatgccatggc

SEQ ID NO: 8545465 - DNA, 22 bp, Homo sapiens
tcctgagccccagggaggttgg

SEQ ID NO: 8545466 - DNA, 20 bp, Homo sapiens
tcctgagatttaaggggttc

SEQ ID NO: 8545467 - DNA, 20 bp, Homo sapiens
tcctgagatttaaggggttc

SEQ ID NO: 8545468 - DNA, 22 bp, Homo sapiens
tcctgagattctgcatttctaa

SEQ ID NO: 8545469 - DNA, 22 bp, Homo sapiens
tcctgagatgtggagctccatg

SEQ ID NO: 8545470 - DNA, 22 bp, Homo sapiens
tcctgagatgtggagctccatg

SEQ ID NO: 8545471 - DNA, 22 bp, Homo sapiens
tcctgaggccctgttagggtct

SEQ ID NO: 8545472 - DNA, 22 bp, Homo sapiens
tcctgaggcctctgtgatgtga

SEQ ID NO: 8545473 - DNA, 22 bp, Homo sapiens
tcctgaggcctctgtgatgtga

SEQ ID NO: 8545474 - DNA, 22 bp, Homo sapiens
tcctgaggctaaagtgcagtgg

SEQ ID NO: 8545475 - DNA, 22 bp, Homo sapiens
tcctgaggagaagagtgctagg

SEQ ID NO: 8545476 - DNA, 22 bp, Homo sapiens
tcctgaggatggttgaagtgca

SEQ ID NO: 8545477 - DNA, 22 bp, Homo sapiens
tcctgaggatggttgaagtgca

SEQ ID NO: 8545478 - DNA, 22 bp, Homo sapiens
tcctgaggcacaatcctagaat

SEQ ID NO: 8545479 - DNA, 22 bp, Homo sapiens
tcctgaggcacaatcctagaat

SEQ ID NO: 8545480 - DNA, 22 bp, Homo sapiens
tcctgatggaggggtcatcttt

SEQ ID NO: 8545481 - DNA, 22 bp, Homo sapiens
tcctgaggctcactttgaatgt

SEQ ID NO: 8545482 - DNA, 22 bp, Homo sapiens
tcctgaggctaaagtgcagtgg

SEQ ID NO: 8545483 - DNA, 22 bp, Homo sapiens
tcctgaggctaaagtgcagtgg

SEQ ID NO: 8545484 - DNA, 22 bp, Homo sapiens
tcctgaggttttaaaactattc

SEQ ID NO: 8545485 - DNA, 22 bp, Homo sapiens
tcctgaggttttaaaactattc

SEQ ID NO: 8545486 - DNA, 22 bp, Homo sapiens
tcctgaggactaacaggaagga

SEQ ID NO: 8545487 - DNA, 22 bp, Homo sapiens
tcctgaggactaacaggaagga

SEQ ID NO: 8545488 - DNA, 22 bp, Homo sapiens
tcctgaggactaacaggaagga

SEQ ID NO: 8545489 - DNA, 22 bp, Homo sapiens
tcctgaggaccctgtcaggggc

SEQ ID NO: 8545490 - DNA, 22 bp, Homo sapiens
tcctgaggaatgtgaagagaac

SEQ ID NO: 8545491 - DNA, 23 bp, Homo sapiens
tcctgaggaatggcatctcacat

SEQ ID NO: 8545492 - DNA, 23 bp, Homo sapiens
tcctgaggaatggcatctcacat

SEQ ID NO: 8545493 - DNA, 22 bp, Homo sapiens
tcctgaggaccctgtcaggggc

SEQ ID NO: 8545494 - DNA, 22 bp, Homo sapiens
tcctgaggaccctgtcaggggc

SEQ ID NO: 8545495 - DNA, 22 bp, Homo sapiens
tcctgaggaatgtgaagagaac

SEQ ID NO: 8545496 - DNA, 22 bp, Homo sapiens
tcctgagctgacacttggggag

SEQ ID NO: 8545497 - DNA, 22 bp, Homo sapiens
tcctgaggaaagttcatgaatg

SEQ ID NO: 8545498 - DNA, 22 bp, Homo sapiens
tcctgaggaaagttcatgaatg

SEQ ID NO: 8545499 - DNA, 22 bp, Homo sapiens
tcctgagcttcaaaacactttg

SEQ ID NO: 8545500 - DNA, 22 bp, Homo sapiens
tcagaatgaaatttctttcaga

SEQ ID NO: 8545501 - DNA, 22 bp, Homo sapiens
tcagaatctttctagagtctag

SEQ ID NO: 8545502 - DNA, 23 bp, Homo sapiens
tcagaatgcactgaatttaccct

SEQ ID NO: 8545503 - DNA, 22 bp, Homo sapiens
tcagaatctgaaaagcgcttgg

SEQ ID NO: 8545504 - DNA, 22 bp, Homo sapiens
tcagaatctaaataggctccag

SEQ ID NO: 8545505 - DNA, 22 bp, Homo sapiens
tcagaatctctggaggcttggc

SEQ ID NO: 8545506 - DNA, 22 bp, Homo sapiens
tcagaatatgctaatgacattt

SEQ ID NO: 8545507 - DNA, 22 bp, Homo sapiens
tcagaataagttatgaaatgaa

SEQ ID NO: 8545508 - DNA, 23 bp, Homo sapiens
tcagaataataacctagtaactg

SEQ ID NO: 8545509 - DNA, 22 bp, Homo sapiens
tcagaatatattcatgttgtca

SEQ ID NO: 8545510 - DNA, 20 bp, Homo sapiens
tcagaacagtagaggagcta

SEQ ID NO: 8545511 - DNA, 22 bp, Homo sapiens
tcagaagccggaagtgctcctc

SEQ ID NO: 8545512 - DNA, 22 bp, Homo sapiens
tcagaagccaccttttgttggg

SEQ ID NO: 8545513 - DNA, 22 bp, Homo sapiens
tcagaagccgggcaggttttgg

SEQ ID NO: 8545514 - DNA, 22 bp, Homo sapiens
tcagaagccttgattatctaga

SEQ ID NO: 8545515 - DNA, 22 bp, Homo sapiens
tcagaagccttgattatctaga

SEQ ID NO: 8545516 - DNA, 22 bp, Homo sapiens
tcagaacagctctcagatatcc

SEQ ID NO: 8545517 - DNA, 22 bp, Homo sapiens
tcagaacagcgagaatattcac

SEQ ID NO: 8545518 - DNA, 22 bp, Homo sapiens
tcagaacaggttgtactatgtc

SEQ ID NO: 8545519 - DNA, 22 bp, Homo sapiens
tcagaacaggttgtactatgtc

SEQ ID NO: 8545520 - DNA, 22 bp, Homo sapiens
tcagaacaggactggctgccat

SEQ ID NO: 8545521 - DNA, 22 bp, Homo sapiens
tcagaacagctctcagatatcc

SEQ ID NO: 8545522 - DNA, 22 bp, Homo sapiens
tcagaacagaagaaggaacacg

SEQ ID NO: 8545523 - DNA, 22 bp, Homo sapiens
tcagaacagaagctggctataa

SEQ ID NO: 8545524 - DNA, 22 bp, Homo sapiens
tcagaacagaagctggctataa

SEQ ID NO: 8545525 - DNA, 22 bp, Homo sapiens
tcagaacaattgggaaccatta

SEQ ID NO: 8545526 - DNA, 22 bp, Homo sapiens
tcagaacaattgggaaccatta

SEQ ID NO: 8545527 - DNA, 22 bp, Homo sapiens
tcagaacactttctctactgac

SEQ ID NO: 8545528 - DNA, 22 bp, Homo sapiens
tcagaacagaagaaggaacacg

SEQ ID NO: 8545529 - DNA, 22 bp, Homo sapiens
tcagaacagaagaaggaacacg

SEQ ID NO: 8545530 - DNA, 22 bp, Homo sapiens
tcagaaaggagttagaggtctc

SEQ ID NO: 8545531 - DNA, 22 bp, Homo sapiens
tcagaaaggccacatggtgcag

SEQ ID NO: 8545532 - DNA, 22 bp, Homo sapiens
tcagaaaggttctatgttttac

SEQ ID NO: 8545533 - DNA, 22 bp, Homo sapiens
tcagaaaggttctatgttttac

SEQ ID NO: 8545534 - DNA, 22 bp, Homo sapiens
tcagaaagacgaaacagatggg

SEQ ID NO: 8545535 - DNA, 22 bp, Homo sapiens
tcagaaagctatatggtgtgtc

SEQ ID NO: 8545536 - DNA, 22 bp, Homo sapiens
tcagaaagcttttacttaaaca

SEQ ID NO: 8545537 - DNA, 22 bp, Homo sapiens
tcagaaagcttttacttaaaca

SEQ ID NO: 8545538 - DNA, 22 bp, Homo sapiens
tcagaaagcttagtgtcttgca

SEQ ID NO: 8545539 - DNA, 22 bp, Homo sapiens
tcagaaagctgattcttgatac

SEQ ID NO: 8545540 - DNA, 22 bp, Homo sapiens
tcagaaaatgaaatggactctc

SEQ ID NO: 8545541 - DNA, 22 bp, Homo sapiens
tcagaaaatgaaatggactctc

SEQ ID NO: 8545542 - DNA, 22 bp, Homo sapiens
tcagaaacactcttcttctgtc

SEQ ID NO: 8545543 - DNA, 22 bp, Homo sapiens
tcagaaacagaaactaagaacc

SEQ ID NO: 8545544 - DNA, 22 bp, Homo sapiens
tcagaaaccccaacaatggaga

SEQ ID NO: 8545545 - DNA, 22 bp, Homo sapiens
tcagaaaccagctctctcaatt

SEQ ID NO: 8545546 - DNA, 22 bp, Homo sapiens
tcagaaagaacacaggcagtag

SEQ ID NO: 8545547 - DNA, 22 bp, Homo sapiens
tcacatttgcaattgcattgtt

SEQ ID NO: 8545548 - DNA, 22 bp, Homo sapiens
tcacatttgcaattgcattgtt

SEQ ID NO: 8545549 - DNA, 22 bp, Homo sapiens
tcacatttgctatcccactcct

SEQ ID NO: 8545550 - DNA, 22 bp, Homo sapiens
tcacatttgcaattgcattgtt

SEQ ID NO: 8545551 - DNA, 22 bp, Homo sapiens
tcacatttgcaattgcattgtt

SEQ ID NO: 8545552 - DNA, 22 bp, Homo sapiens
tcacatttgataatgcccattg

SEQ ID NO: 8545553 - DNA, 22 bp, Homo sapiens
tcacatttggagaaagcctgcc

SEQ ID NO: 8545554 - DNA, 22 bp, Homo sapiens
tcacatttgtgttttattagag

SEQ ID NO: 8545555 - DNA, 22 bp, Homo sapiens
tcacatttgttcctctgcactt

SEQ ID NO: 8545556 - DNA, 22 bp, Homo sapiens
tcacatttgttcctctgcactt

SEQ ID NO: 8545557 - DNA, 22 bp, Homo sapiens
tcacatttgttcttgaatctaa

SEQ ID NO: 8545558 - DNA, 22 bp, Homo sapiens
tcacattttagtaccatgattt

SEQ ID NO: 8545559 - DNA, 22 bp, Homo sapiens
tcactgcaacctccacctcccg

SEQ ID NO: 8545560 - DNA, 22 bp, Homo sapiens
tcactgcaacctccacctcccg

SEQ ID NO: 8545561 - DNA, 22 bp, Homo sapiens
tcactgcaacctccacctcccg

SEQ ID NO: 8545562 - DNA, 22 bp, Homo sapiens
tcactgcaacctccacctcccg

SEQ ID NO: 8545563 - DNA, 22 bp, Homo sapiens
tcactgcaacctccacctcccg

SEQ ID NO: 8545564 - DNA, 22 bp, Homo sapiens
tcactgcaacctccacctcccg

SEQ ID NO: 8545565 - DNA, 22 bp, Homo sapiens
tcactgcaacctccacctcccg

SEQ ID NO: 8545566 - DNA, 22 bp, Homo sapiens
tcactgcaacctccacctcccg

SEQ ID NO: 8545567 - DNA, 22 bp, Homo sapiens
tcacattttatctattttaagt

SEQ ID NO: 8545568 - DNA, 22 bp, Homo sapiens
tcactgattatgaaaatgaagg

SEQ ID NO: 8545569 - DNA, 22 bp, Homo sapiens
tcactgattatgaaaatgaagg

SEQ ID NO: 8545570 - DNA, 22 bp, Homo sapiens
tcactgcaacctccacctcccg

SEQ ID NO: 8545571 - DNA, 22 bp, Homo sapiens
tcactgcaacctccacctcccg

SEQ ID NO: 8545572 - DNA, 22 bp, Homo sapiens
tcactgcaacctccacctcccg

SEQ ID NO: 8545573 - DNA, 22 bp, Homo sapiens
tcactgctctgaaagtacaggg

SEQ ID NO: 8545574 - DNA, 22 bp, Homo sapiens
tcactgctctctaagcatcgcc

SEQ ID NO: 8545575 - DNA, 22 bp, Homo sapiens
tcactgctgctgccatgatgga

SEQ ID NO: 8545576 - DNA, 22 bp, Homo sapiens
tcactgctgctgccatgatgga

SEQ ID NO: 8545577 - DNA, 22 bp, Homo sapiens
tcactgctctgaaagtacaggg

SEQ ID NO: 8545578 - DNA, 22 bp, Homo sapiens
tcactgcttaactcaagatctc

SEQ ID NO: 8545579 - DNA, 22 bp, Homo sapiens
tcactgctatattggatactga

SEQ ID NO: 8545580 - DNA, 22 bp, Homo sapiens
tcactgctatattggatactga

SEQ ID NO: 8545581 - DNA, 23 bp, Homo sapiens
tcactgctactcagcctgagatt

SEQ ID NO: 8545582 - DNA, 23 bp, Homo sapiens
tcactgctactcagcctgagatt

SEQ ID NO: 8545583 - DNA, 23 bp, Homo sapiens
tcactgctactcagcctgagatt

SEQ ID NO: 8545584 - DNA, 22 bp, Homo sapiens
tcactgctctctaagcatcgcc

SEQ ID NO: 8545585 - DNA, 22 bp, Homo sapiens
tcactgctctccaatgtggagt

SEQ ID NO: 8545586 - DNA, 22 bp, Homo sapiens
tcactgctctccaatgtggagt

SEQ ID NO: 8545587 - DNA, 22 bp, Homo sapiens
tcactgctcgataacatgatta

SEQ ID NO: 8545588 - DNA, 22 bp, Homo sapiens
tcactgctcagtctgtactaca

SEQ ID NO: 8545589 - DNA, 22 bp, Homo sapiens
tcactgctcagtctgtactaca

SEQ ID NO: 8545590 - DNA, 22 bp, Homo sapiens
tcactgcaacctccacctcctg

SEQ ID NO: 8545591 - DNA, 22 bp, Homo sapiens
tcactgcaacctccacctcctg

SEQ ID NO: 8545592 - DNA, 22 bp, Homo sapiens
tcactgcaacctccacctcctg

SEQ ID NO: 8545593 - DNA, 22 bp, Homo sapiens
tcactgcaacctccacctcctg

SEQ ID NO: 8545594 - DNA, 22 bp, Homo sapiens
tcactgcaacctccacctcctg

SEQ ID NO: 8545595 - DNA, 22 bp, Homo sapiens
tcactgcaacctccacctcctg

SEQ ID NO: 8545596 - DNA, 22 bp, Homo sapiens
tcactgcaacctccacctcccg

SEQ ID NO: 8545597 - DNA, 22 bp, Homo sapiens
tcactgcaacctccacctcctg

SEQ ID NO: 8545598 - DNA, 22 bp, Homo sapiens
tcactgcaacctccacctcccg

SEQ ID NO: 8545599 - DNA, 22 bp, Homo sapiens
tcactgcaacctccacctcctg

SEQ ID NO: 8545600 - DNA, 22 bp, Homo sapiens
tcactgcaacctccacctcctg

SEQ ID NO: 8545601 - DNA, 22 bp, Homo sapiens
tcactgcaacctccacctcctg

SEQ ID NO: 8545602 - DNA, 22 bp, Homo sapiens
tcactgcaacctccacctcctg

SEQ ID NO: 8545603 - DNA, 22 bp, Homo sapiens
tcacagtgcacccctcacaggg

SEQ ID NO: 8545604 - DNA, 22 bp, Homo sapiens
tcacagtgcacccctcacaggg

SEQ ID NO: 8545605 - DNA, 18 bp, Homo sapiens
tcacagtgctcttgccta

SEQ ID NO: 8545606 - DNA, 18 bp, Homo sapiens
tcacagtgctcttgccta

SEQ ID NO: 8545607 - DNA, 22 bp, Homo sapiens
tcacagtgcacagcaggcgtgg

SEQ ID NO: 8545608 - DNA, 22 bp, Homo sapiens
tcacagtgatgacgtgggagca

SEQ ID NO: 8545609 - DNA, 22 bp, Homo sapiens
tcacagtgatgacgtgggagca

SEQ ID NO: 8545610 - DNA, 22 bp, Homo sapiens
tcacagtgaggagttacagttt

SEQ ID NO: 8545611 - DNA, 22 bp, Homo sapiens
tcacagtgaggcagttcttgta

SEQ ID NO: 8545612 - DNA, 22 bp, Homo sapiens
tcacagtgaggagttacagttt

SEQ ID NO: 8545613 - DNA, 22 bp, Homo sapiens
tcacagtgagccatgtcagaga

SEQ ID NO: 8545614 - DNA, 22 bp, Homo sapiens
tcacataaatttaccagatgat

SEQ ID NO: 8545615 - DNA, 22 bp, Homo sapiens
tcacatacactaggatattttt

SEQ ID NO: 8545616 - DNA, 22 bp, Homo sapiens
tcacatacactaggatattttt

SEQ ID NO: 8545617 - DNA, 22 bp, Homo sapiens
tcacatacactaggatattttt

SEQ ID NO: 8545618 - DNA, 23 bp, Homo sapiens
tcacataatccttcatccacagg

SEQ ID NO: 8545619 - DNA, 23 bp, Homo sapiens
tcacataatccttcatccacagg

SEQ ID NO: 8545620 - DNA, 23 bp, Homo sapiens
tcacataatccttcatccacagg

SEQ ID NO: 8545621 - DNA, 22 bp, Homo sapiens
tcacatttctcagcactgatga

SEQ ID NO: 8545622 - DNA, 22 bp, Homo sapiens
tcacatttctcagcactgatga

SEQ ID NO: 8545623 - DNA, 22 bp, Homo sapiens
tcacatttatttcaaagttact

SEQ ID NO: 8545624 - DNA, 22 bp, Homo sapiens
tcacatttctcagcactgatga

SEQ ID NO: 8545625 - DNA, 22 bp, Homo sapiens
tcacatttctgattataccaaa

SEQ ID NO: 8545626 - DNA, 22 bp, Homo sapiens
tcacatttgataatgcccattg

SEQ ID NO: 8545627 - DNA, 22 bp, Homo sapiens
tcacatttctgattataccaaa

SEQ ID NO: 8545628 - DNA, 23 bp, Homo sapiens
tcacatttaacccctcagacctc

SEQ ID NO: 8545629 - DNA, 22 bp, Homo sapiens
tcacatttatttcaaagttact

SEQ ID NO: 8545630 - DNA, 22 bp, Homo sapiens
tcacattgttcttagtttacct

SEQ ID NO: 8545631 - DNA, 22 bp, Homo sapiens
tcacattgccgtctgtgcactt

SEQ ID NO: 8545632 - DNA, 22 bp, Homo sapiens
tcacattgtaggtcatttgcaa

SEQ ID NO: 8545633 - DNA, 21 bp, Homo sapiens
tcacatgcttattcctggaat

SEQ ID NO: 8545634 - DNA, 22 bp, Homo sapiens
tcacatgctcacctaagccaca

SEQ ID NO: 8545635 - DNA, 22 bp, Homo sapiens
tcacatgctgtgggatctgtat

SEQ ID NO: 8545636 - DNA, 22 bp, Homo sapiens
tcacatgctgtgtgtggagatc

SEQ ID NO: 8545637 - DNA, 22 bp, Homo sapiens
tcacatactgaaagtccagtga

SEQ ID NO: 8545638 - DNA, 22 bp, Homo sapiens
tcacatgctactgagccagacc

SEQ ID NO: 8545639 - DNA, 22 bp, Homo sapiens
tcacatgctactgagccagacc

SEQ ID NO: 8545640 - DNA, 22 bp, Homo sapiens
tcaacaatgggtctgtaatgga

SEQ ID NO: 8545641 - DNA, 22 bp, Homo sapiens
tcaacaataggatatagcaggt

SEQ ID NO: 8545642 - DNA, 22 bp, Homo sapiens
tcaacaataggatatagcaggt

SEQ ID NO: 8545643 - DNA, 22 bp, Homo sapiens
tcaaatgcacgtagagaaaata

SEQ ID NO: 8545644 - DNA, 22 bp, Homo sapiens
tcaaatgcaggtctggtcttgg

SEQ ID NO: 8545645 - DNA, 22 bp, Homo sapiens
tcaaatgcaggtctggtcttgg

SEQ ID NO: 8545646 - DNA, 22 bp, Homo sapiens
tcaaatgcacctctcatttgtt

SEQ ID NO: 8545647 - DNA, 22 bp, Homo sapiens
tcaacagttgcactggagaggt

SEQ ID NO: 8545648 - DNA, 22 bp, Homo sapiens
tcaacatacatacatggtcagg

SEQ ID NO: 8545649 - DNA, 19 bp, Homo sapiens
tcaacagtggtgctgtgga

SEQ ID NO: 8545650 - DNA, 22 bp, Homo sapiens
tcaaccagagtttttcttaata

SEQ ID NO: 8545651 - DNA, 22 bp, Homo sapiens
tcaacacttttgtctttgtccc

SEQ ID NO: 8545652 - DNA, 22 bp, Homo sapiens
tcaacagaagtgatagctatta

SEQ ID NO: 8545653 - DNA, 22 bp, Homo sapiens
tcaagaaagggcttcaccagga

SEQ ID NO: 8545654 - DNA, 22 bp, Homo sapiens
tcaagaaagggcttcaccagga

SEQ ID NO: 8545655 - DNA, 22 bp, Homo sapiens
tcaactttagtgtagctattta

SEQ ID NO: 8545656 - DNA, 22 bp, Homo sapiens
tcaacctctggagaaatcagga

SEQ ID NO: 8545657 - DNA, 22 bp, Homo sapiens
tcaacctctggagaaatcagga

SEQ ID NO: 8545658 - DNA, 22 bp, Homo sapiens
tcaacccttcctccatatttcc

SEQ ID NO: 8545659 - DNA, 21 bp, Homo sapiens
tcaacccttgcgtcaccaagc

SEQ ID NO: 8545660 - DNA, 22 bp, Homo sapiens
tcaactgcaagtttgcttagtt

SEQ ID NO: 8545661 - DNA, 22 bp, Homo sapiens
tcaactgatttagtctgtgcca

SEQ ID NO: 8545662 - DNA, 22 bp, Homo sapiens
tcaagaagataatgtctagggt

SEQ ID NO: 8545663 - DNA, 22 bp, Homo sapiens
tcacagtatctagaaatgaggg

SEQ ID NO: 8545664 - DNA, 22 bp, Homo sapiens
tcacagtatcaggtggagtgga

SEQ ID NO: 8545665 - DNA, 22 bp, Homo sapiens
tcacagtatcaggtggagtgga

SEQ ID NO: 8545666 - DNA, 22 bp, Homo sapiens
tcaagaaggagactccactgtg

SEQ ID NO: 8545667 - DNA, 22 bp, Homo sapiens
tcacagtatcacacaaggatta

SEQ ID NO: 8545668 - DNA, 22 bp, Homo sapiens
tcacagtgacttacagagattg

SEQ ID NO: 8545669 - DNA, 22 bp, Homo sapiens
tcacagtcggtgacttcttgct

SEQ ID NO: 8545670 - DNA, 22 bp, Homo sapiens
tcacagtgacagccaatgtttt

SEQ ID NO: 8545671 - DNA, 23 bp, Homo sapiens
tcacagtatctctggagccatag

SEQ ID NO: 8545672 - DNA, 22 bp, Homo sapiens
tcacagtattcatgaacatgga

SEQ ID NO: 8545673 - DNA, 22 bp, Homo sapiens
tcagagttctctgtccagatga

SEQ ID NO: 8545674 - DNA, 20 bp, Homo sapiens
tcagatgggagtgagccatc

SEQ ID NO: 8545675 - DNA, 20 bp, Homo sapiens
tcagattaaatgttctgtct

SEQ ID NO: 8545676 - DNA, 18 bp, Homo sapiens
tcagatttaactgtatcc

SEQ ID NO: 8545677 - DNA, 22 bp, Homo sapiens
tcagatttactgcagagcagat

SEQ ID NO: 8545678 - DNA, 22 bp, Homo sapiens
tcagattttattttcctgttac

SEQ ID NO: 8545679 - DNA, 22 bp, Homo sapiens
tcagattttccacagactggaa

SEQ ID NO: 8545680 - DNA, 22 bp, Homo sapiens
tcagattttccagcctttctct

SEQ ID NO: 8545681 - DNA, 20 bp, Homo sapiens
tcagattttgggtcactgat

SEQ ID NO: 8545682 - DNA, 22 bp, Homo sapiens
tcagattttgcacgaggttttg

SEQ ID NO: 8545683 - DNA, 22 bp, Homo sapiens
tcagattttgcacgaggttttg

SEQ ID NO: 8545684 - DNA, 22 bp, Homo sapiens
tcagatttgtcctactaggcac

SEQ ID NO: 8545685 - DNA, 22 bp, Homo sapiens
tcagatttggacacaggaactt

SEQ ID NO: 8545686 - DNA, 22 bp, Homo sapiens
tcagattttattttcctgttac

SEQ ID NO: 8545687 - DNA, 22 bp, Homo sapiens
tcagatttggacacaggaactt

SEQ ID NO: 8545688 - DNA, 22 bp, Homo sapiens
tcagatttgatgtggttttcta

SEQ ID NO: 8545689 - DNA, 22 bp, Homo sapiens
tcagatttgaatattcctttcg

SEQ ID NO: 8545690 - DNA, 22 bp, Homo sapiens
tcagatttcttcttgcaacggc

SEQ ID NO: 8545691 - DNA, 22 bp, Homo sapiens
tcagatttatgtggctaggctc

SEQ ID NO: 8545692 - DNA, 22 bp, Homo sapiens
tcagatttcagctaaagggatg

SEQ ID NO: 8545693 - DNA, 22 bp, Homo sapiens
tcagatttatgaatatactatg

SEQ ID NO: 8545694 - DNA, 22 bp, Homo sapiens
tcagatttagggtgattacctt

SEQ ID NO: 8545695 - DNA, 22 bp, Homo sapiens
tcagatttccttgcagtttgga

SEQ ID NO: 8545696 - DNA, 22 bp, Homo sapiens
tcagatttcctgttgaagaagt

SEQ ID NO: 8545697 - DNA, 22 bp, Homo sapiens
tcagatttctgaaagccctctc

SEQ ID NO: 8545698 - DNA, 22 bp, Homo sapiens
tcagatttctagcgtttggcca

SEQ ID NO: 8545699 - DNA, 22 bp, Homo sapiens
tcagatttctagcgtttggcca

SEQ ID NO: 8545700 - DNA, 22 bp, Homo sapiens
tcagacaagtaaaataatgtaa

SEQ ID NO: 8545701 - DNA, 22 bp, Homo sapiens
tcagacagaaggactatttgaa

SEQ ID NO: 8545702 - DNA, 22 bp, Homo sapiens
tcagagttcctcatagatccag

SEQ ID NO: 8545703 - DNA, 21 bp, Homo sapiens
tcagagtgtgttacagcaagc

SEQ ID NO: 8545704 - DNA, 22 bp, Homo sapiens
tcagagtgtggtgagatgtgca

SEQ ID NO: 8545705 - DNA, 22 bp, Homo sapiens
tcagacagagaagtacaatgag

SEQ ID NO: 8545706 - DNA, 22 bp, Homo sapiens
tcagaatttaaaatgtgtagat

SEQ ID NO: 8545707 - DNA, 22 bp, Homo sapiens
tcagaatttaaaatgtgtagat

SEQ ID NO: 8545708 - DNA, 22 bp, Homo sapiens
tcagaattgattttcaaaacag

SEQ ID NO: 8545709 - DNA, 22 bp, Homo sapiens
tcagcagggctgtggtgtggct

SEQ ID NO: 8545710 - DNA, 22 bp, Homo sapiens
tcagcagtgtagtttatcattc

SEQ ID NO: 8545711 - DNA, 17 bp, Homo sapiens
tcagcaggggccaagct

SEQ ID NO: 8545712 - DNA, 17 bp, Homo sapiens
tcagcaggggccaagct

SEQ ID NO: 8545713 - DNA, 22 bp, Homo sapiens
tcagcagggcctccttgtgcag

SEQ ID NO: 8545714 - DNA, 22 bp, Homo sapiens
tcagcaggctgtcagcaggggc

SEQ ID NO: 8545715 - DNA, 22 bp, Homo sapiens
tcagcagggagaggagaatgca

SEQ ID NO: 8545716 - DNA, 22 bp, Homo sapiens
tcagcagggagaggagaatgca

SEQ ID NO: 8545717 - DNA, 22 bp, Homo sapiens
tcagcagggaggctctgtgccc

SEQ ID NO: 8545718 - DNA, 22 bp, Homo sapiens
tcagcagggaggctctgtgccc

SEQ ID NO: 8545719 - DNA, 22 bp, Homo sapiens
tcagcaggcccatcctccaggc

SEQ ID NO: 8545720 - DNA, 22 bp, Homo sapiens
tcagcaggcccatcctccaggc

SEQ ID NO: 8545721 - DNA, 22 bp, Homo sapiens
tcagcaggctgtcagcaggggc

SEQ ID NO: 8545722 - DNA, 22 bp, Homo sapiens
tcagcaggcggttccttgtggg

SEQ ID NO: 8545723 - DNA, 22 bp, Homo sapiens
tcagcaaaatgtggctagtgct

SEQ ID NO: 8545724 - DNA, 21 bp, Homo sapiens
tcagcaaaataagcaaatgga

SEQ ID NO: 8545725 - DNA, 22 bp, Homo sapiens
tcagatttttgagatgtctgtt

SEQ ID NO: 8545726 - DNA, 22 bp, Homo sapiens
tcagatttttgagatgtctgtt

SEQ ID NO: 8545727 - DNA, 20 bp, Homo sapiens
tcagatttttctaactttga

SEQ ID NO: 8545728 - DNA, 17 bp, Homo sapiens
tcagcaaagacaaagga

SEQ ID NO: 8545729 - DNA, 17 bp, Homo sapiens
tcagcaaagacaaagga

SEQ ID NO: 8545730 - DNA, 22 bp, Homo sapiens
tcagcaaaggaccagcacaggc

SEQ ID NO: 8545731 - DNA, 22 bp, Homo sapiens
tcagcaactatttatcaaattc

SEQ ID NO: 8545732 - DNA, 22 bp, Homo sapiens
tcagcaagaagctgtgggcttc

SEQ ID NO: 8545733 - DNA, 19 bp, Homo sapiens
tcagctctggggtcagtgg

SEQ ID NO: 8545734 - DNA, 22 bp, Homo sapiens
tcagctgccccgggcactgccc

SEQ ID NO: 8545735 - DNA, 22 bp, Homo sapiens
tcagctgcctctccctggaaga

SEQ ID NO: 8545736 - DNA, 22 bp, Homo sapiens
tcagctgcctttcccatgctag

SEQ ID NO: 8545737 - DNA, 22 bp, Homo sapiens
tcagctgcctttcccatgctag

SEQ ID NO: 8545738 - DNA, 22 bp, Homo sapiens
tcagctgcctttcccatgctag

SEQ ID NO: 8545739 - DNA, 23 bp, Homo sapiens
tcagctgcttcctcctgcctgcc

SEQ ID NO: 8545740 - DNA, 23 bp, Homo sapiens
tcagctgcttcctcctgcctgcc

SEQ ID NO: 8545741 - DNA, 22 bp, Homo sapiens
tcagctgctctgttgagctgaa

SEQ ID NO: 8545742 - DNA, 22 bp, Homo sapiens
tcagctgctcaaatttatgtca

SEQ ID NO: 8545743 - DNA, 22 bp, Homo sapiens
tcagccagccagctacaggctt

SEQ ID NO: 8545744 - DNA, 20 bp, Homo sapiens
tcagccagctaacatgggga

SEQ ID NO: 8545745 - DNA, 20 bp, Homo sapiens
tcagccagctaacatgggga

SEQ ID NO: 8545746 - DNA, 22 bp, Homo sapiens
tcagccagctcttggactctga

SEQ ID NO: 8545747 - DNA, 22 bp, Homo sapiens
tcagccaggcacaatggcagct

SEQ ID NO: 8545748 - DNA, 22 bp, Homo sapiens
tcagccagctgtgtgcttctgc

SEQ ID NO: 8545749 - DNA, 22 bp, Homo sapiens
tcagctctgcactccactgtgg

SEQ ID NO: 8545750 - DNA, 22 bp, Homo sapiens
tcagctctgcactccactgtgg

SEQ ID NO: 8545751 - DNA, 22 bp, Homo sapiens
tcagctctgcctgtggaggcac

SEQ ID NO: 8545752 - DNA, 22 bp, Homo sapiens
tcagccaggccaccttcagctt

SEQ ID NO: 8545753 - DNA, 22 bp, Homo sapiens
tcagccaggcagccccctggtc

SEQ ID NO: 8545754 - DNA, 22 bp, Homo sapiens
tcagccaggcacaatggcagct

SEQ ID NO: 8545755 - DNA, 22 bp, Homo sapiens
tcagccaggcacaatggcagct

SEQ ID NO: 8545756 - DNA, 22 bp, Homo sapiens
tcagccaggcagccccctggtc

SEQ ID NO: 8545757 - DNA, 22 bp, Homo sapiens
tcagcatttcagaagtggcata

SEQ ID NO: 8545758 - DNA, 22 bp, Homo sapiens
tcagcattgtggcagagaatgg

SEQ ID NO: 8545759 - DNA, 22 bp, Homo sapiens
tcagccagaaagtgattttcag

SEQ ID NO: 8545760 - DNA, 22 bp, Homo sapiens
tcagccagaggcttcttggttt

SEQ ID NO: 8545761 - DNA, 22 bp, Homo sapiens
tcagccagagggggcaaaggaa

SEQ ID NO: 8545762 - DNA, 22 bp, Homo sapiens
tcagccagaggtggatgagtca

SEQ ID NO: 8545763 - DNA, 22 bp, Homo sapiens
tcagccagagggggcaaaggaa

SEQ ID NO: 8545764 - DNA, 22 bp, Homo sapiens
tcagccagcattacccctgact

SEQ ID NO: 8545765 - DNA, 22 bp, Homo sapiens
tcagccagcatcagctaagtgc

SEQ ID NO: 8545766 - DNA, 22 bp, Homo sapiens
tcagccagcatcagctaagtgc

SEQ ID NO: 8545767 - DNA, 22 bp, Homo sapiens
tcagcatgttcttaggtcacag

SEQ ID NO: 8545768 - DNA, 22 bp, Homo sapiens
tcagcattcctgaagacaagca

SEQ ID NO: 8545769 - DNA, 22 bp, Homo sapiens
tcagcattctttacaaggatga

SEQ ID NO: 8545770 - DNA, 22 bp, Homo sapiens
tcagcatgtacttctcctccat

SEQ ID NO: 8545771 - DNA, 22 bp, Homo sapiens
tcagcatcttcagcatggggaa

SEQ ID NO: 8545772 - DNA, 22 bp, Homo sapiens
tcagcatctcaaccttctctac

SEQ ID NO: 8545773 - DNA, 20 bp, Homo sapiens
tcagcatgctcctcagacat

SEQ ID NO: 8545774 - DNA, 22 bp, Homo sapiens
tcagcatctacagctttgctat

SEQ ID NO: 8545775 - DNA, 22 bp, Homo sapiens
tcagcatctacagctttgctat

SEQ ID NO: 8545776 - DNA, 21 bp, Homo sapiens
tcagcatcctgagctgtcctc

SEQ ID NO: 8545777 - DNA, 22 bp, Homo sapiens
tcagcatcagtattgtttagga

SEQ ID NO: 8545778 - DNA, 22 bp, Homo sapiens
tcagcatcaggttgtctgaatt

SEQ ID NO: 8545779 - DNA, 22 bp, Homo sapiens
tcagcatcagtattgtttagga

SEQ ID NO: 8545780 - DNA, 22 bp, Homo sapiens
tcagcagttttatatgcagctt

SEQ ID NO: 8545781 - DNA, 22 bp, Homo sapiens
tcagcatatgtttggagtgtcc

SEQ ID NO: 8545782 - DNA, 19 bp, Homo sapiens
tcagcatcaatttggtcct

SEQ ID NO: 8545783 - DNA, 23 bp, Homo sapiens
tcagcatcacctgggaacttact

SEQ ID NO: 8545784 - DNA, 19 bp, Homo sapiens
tcagcatcaatttggtcct

SEQ ID NO: 8545785 - DNA, 22 bp, Homo sapiens
tcagcatcacgtggtccgagaa

SEQ ID NO: 8545786 - DNA, 22 bp, Homo sapiens
tcagcagtgtgcccagaggctg

SEQ ID NO: 8545787 - DNA, 22 bp, Homo sapiens
tcagcagtgtgcttggaatgga

SEQ ID NO: 8545788 - DNA, 22 bp, Homo sapiens
tcaggacacttggcacaaggtc

SEQ ID NO: 8545789 - DNA, 22 bp, Homo sapiens
tcaggacacttggcacaaggtc

SEQ ID NO: 8545790 - DNA, 22 bp, Homo sapiens
tcaggacacttggcacaaggtc

SEQ ID NO: 8545791 - DNA, 22 bp, Homo sapiens
tcaggacagagatcagaacttc

SEQ ID NO: 8545792 - DNA, 22 bp, Homo sapiens
tcaggacagccagggtgcagac

SEQ ID NO: 8545793 - DNA, 22 bp, Homo sapiens
tcaggacagccagggtgcagac

SEQ ID NO: 8545794 - DNA, 22 bp, Homo sapiens
tcaggacagccagggtgcagac

SEQ ID NO: 8545795 - DNA, 22 bp, Homo sapiens
tcaggacatttgtcagcaggag

SEQ ID NO: 8545796 - DNA, 22 bp, Homo sapiens
tcaggacaggttcgggtgggta

SEQ ID NO: 8545797 - DNA, 22 bp, Homo sapiens
tcaggacatttgtcagcaggag

SEQ ID NO: 8545798 - DNA, 22 bp, Homo sapiens
tcaggagaacttccttctaccc

SEQ ID NO: 8545799 - DNA, 22 bp, Homo sapiens
tcaggagaacttccttctaccc

SEQ ID NO: 8545800 - DNA, 22 bp, Homo sapiens
tcaggagaatcagggctgtcct

SEQ ID NO: 8545801 - DNA, 18 bp, Homo sapiens
tcaggagacacagacgca

SEQ ID NO: 8545802 - DNA, 22 bp, Homo sapiens
tcaggaagtataatcagattca

SEQ ID NO: 8545803 - DNA, 22 bp, Homo sapiens
tcaggaagggtggtccacaggg

SEQ ID NO: 8545804 - DNA, 22 bp, Homo sapiens
tcaggaattttgttctgtatcc

SEQ ID NO: 8545805 - DNA, 22 bp, Homo sapiens
tcagctggtgagtggatagaca

SEQ ID NO: 8545806 - DNA, 18 bp, Homo sapiens
tcagctgggtttctgggt

SEQ ID NO: 8545807 - DNA, 22 bp, Homo sapiens
tcagctggcagttcagaggctg

SEQ ID NO: 8545808 - DNA, 18 bp, Homo sapiens
tcagctggggctgcagcc

SEQ ID NO: 8545809 - DNA, 18 bp, Homo sapiens
tcagctggggctgcagcc

SEQ ID NO: 8545810 - DNA, 22 bp, Homo sapiens
tcagctggagatgagaaccgaa

SEQ ID NO: 8545811 - DNA, 19 bp, Homo sapiens
tcagctggcaggcctcctc

SEQ ID NO: 8545812 - DNA, 22 bp, Homo sapiens
tccaataacatctaaaaactta

SEQ ID NO: 8545813 - DNA, 22 bp, Homo sapiens
tccaataaccacaatcagatag

SEQ ID NO: 8545814 - DNA, 23 bp, Homo sapiens
tccaattcaattgggtcaggaag

SEQ ID NO: 8545815 - DNA, 23 bp, Homo sapiens
tccaagggctacaaacacagacc

SEQ ID NO: 8545816 - DNA, 22 bp, Homo sapiens
tccaagggcagccatagaactt

SEQ ID NO: 8545817 - DNA, 22 bp, Homo sapiens
tccaaggctccggccctggcgt

SEQ ID NO: 8545818 - DNA, 20 bp, Homo sapiens
tccaagggcagcagaatcag

SEQ ID NO: 8545819 - DNA, 22 bp, Homo sapiens
tccaagctactgaaggtttggg

SEQ ID NO: 8545820 - DNA, 22 bp, Homo sapiens
tccaagcttgctttagccacag

SEQ ID NO: 8545821 - DNA, 22 bp, Homo sapiens
tccaagctgtatgttcctagag

SEQ ID NO: 8545822 - DNA, 22 bp, Homo sapiens
tccaagaagctcagcaaacatc

SEQ ID NO: 8545823 - DNA, 22 bp, Homo sapiens
tccaagaagcttacaatctaat

SEQ ID NO: 8545824 - DNA, 22 bp, Homo sapiens
tccaagcttgctttagccacag

SEQ ID NO: 8545825 - DNA, 22 bp, Homo sapiens
tccaaattgacagtagtgatta

SEQ ID NO: 8545826 - DNA, 22 bp, Homo sapiens
tccaactaggcacacagctggt

SEQ ID NO: 8545827 - DNA, 21 bp, Homo sapiens
tccaacatgcctgatggtgcc

SEQ ID NO: 8545828 - DNA, 22 bp, Homo sapiens
tccaactttctcctccggcttg

SEQ ID NO: 8545829 - DNA, 22 bp, Homo sapiens
tccaactttctcctccggcttg

SEQ ID NO: 8545830 - DNA, 22 bp, Homo sapiens
tcatttttgaccatgggtagga

SEQ ID NO: 8545831 - DNA, 22 bp, Homo sapiens
tcatttttgaccatgggtagga

SEQ ID NO: 8545832 - DNA, 22 bp, Homo sapiens
tcatttttgtctccggtttgtg

SEQ ID NO: 8545833 - DNA, 22 bp, Homo sapiens
tcatttttcacacagggtcacc

SEQ ID NO: 8545834 - DNA, 22 bp, Homo sapiens
tcatttttcacacagggtcacc

SEQ ID NO: 8545835 - DNA, 22 bp, Homo sapiens
tcatttttctcttacacgtaga

SEQ ID NO: 8545836 - DNA, 22 bp, Homo sapiens
tcatttttctcttacacgtaga

SEQ ID NO: 8545837 - DNA, 22 bp, Homo sapiens
tcatttttttccggtaggaata

SEQ ID NO: 8545838 - DNA, 22 bp, Homo sapiens
tcatttttttccggtaggaata

SEQ ID NO: 8545839 - DNA, 22 bp, Homo sapiens
tcattttttgcatacctgtgtc

SEQ ID NO: 8545840 - DNA, 21 bp, Homo sapiens
tccaaaaaggagcgtccttct

SEQ ID NO: 8545841 - DNA, 22 bp, Homo sapiens
tccaaaaaacgtttgaatagtt

SEQ ID NO: 8545842 - DNA, 18 bp, Homo sapiens
tccaaaatcatgtatttt

SEQ ID NO: 8545843 - DNA, 21 bp, Homo sapiens
tcatttttattgctaccttgc

SEQ ID NO: 8545844 - DNA, 21 bp, Homo sapiens
tcatttttattgctaccttgc

SEQ ID NO: 8545845 - DNA, 22 bp, Homo sapiens
tcatttttagcgcgcaaaagtt

SEQ ID NO: 8545846 - DNA, 19 bp, Homo sapiens
tcatttgttagtagaagtt

SEQ ID NO: 8545847 - DNA, 19 bp, Homo sapiens
tcatttgttagtagaagtt

SEQ ID NO: 8545848 - DNA, 21 bp, Homo sapiens
tcatttgtgatctgatttcca

SEQ ID NO: 8545849 - DNA, 22 bp, Homo sapiens
tcatttgtacttgtgtgcttgt

SEQ ID NO: 8545850 - DNA, 22 bp, Homo sapiens
tccaaacaccctccatgctgca

SEQ ID NO: 8545851 - DNA, 22 bp, Homo sapiens
tccaaacaccctccatgctgca

SEQ ID NO: 8545852 - DNA, 22 bp, Homo sapiens
tccaaacaccctccatgctgca

SEQ ID NO: 8545853 - DNA, 21 bp, Homo sapiens
tccaaacctgtctctggctct

SEQ ID NO: 8545854 - DNA, 22 bp, Homo sapiens
tccaaagaacattgctgagacc

SEQ ID NO: 8545855 - DNA, 22 bp, Homo sapiens
tccaaagaacctggctactgtc

SEQ ID NO: 8545856 - DNA, 22 bp, Homo sapiens
tccaaagccgactgacatctga

SEQ ID NO: 8545857 - DNA, 22 bp, Homo sapiens
tccaaagcatctgagtgtgcat

SEQ ID NO: 8545858 - DNA, 22 bp, Homo sapiens
tccaaagagcttaggagagaaa

SEQ ID NO: 8545859 - DNA, 22 bp, Homo sapiens
tccaaagagcttaggagagaaa

SEQ ID NO: 8545860 - DNA, 19 bp, Homo sapiens
tccaaagaagttcacattt

SEQ ID NO: 8545861 - DNA, 22 bp, Homo sapiens
tccaaatacatttactgtattt

SEQ ID NO: 8545862 - DNA, 19 bp, Homo sapiens
tccaaaggacccacctcca

SEQ ID NO: 8545863 - DNA, 22 bp, Homo sapiens
tccaaagtaatttcacttctgt

SEQ ID NO: 8545864 - DNA, 22 bp, Homo sapiens
tccaaaggcaaaactgtggtgt

SEQ ID NO: 8545865 - DNA, 22 bp, Homo sapiens
tccaaagtaatttcacttctgt

SEQ ID NO: 8545866 - DNA, 20 bp, Homo sapiens
tcatttcttggggttccaag

SEQ ID NO: 8545867 - DNA, 20 bp, Homo sapiens
tcatttcttggggttccaag

SEQ ID NO: 8545868 - DNA, 22 bp, Homo sapiens
tcatttcttaactagagtgaac

SEQ ID NO: 8545869 - DNA, 22 bp, Homo sapiens
tcatttggagccttcctgtttt

SEQ ID NO: 8545870 - DNA, 22 bp, Homo sapiens
tcatttctctgagtctgataat

SEQ ID NO: 8545871 - DNA, 22 bp, Homo sapiens
tcatttctctgagtctgataat

SEQ ID NO: 8545872 - DNA, 22 bp, Homo sapiens
tcatttctgttgtgcatcactg

SEQ ID NO: 8545873 - DNA, 22 bp, Homo sapiens
tcatttctgttgtgcatcactg

SEQ ID NO: 8545874 - DNA, 22 bp, Homo sapiens
tcatttctgttgtgcatcactg

SEQ ID NO: 8545875 - DNA, 22 bp, Homo sapiens
tcatttctattgctactgtctg

SEQ ID NO: 8545876 - DNA, 22 bp, Homo sapiens
tcatttctattgctactgtctg

SEQ ID NO: 8545877 - DNA, 22 bp, Homo sapiens
tcatttctcccggccaaaaact

SEQ ID NO: 8545878 - DNA, 22 bp, Homo sapiens
tcatttctcccggccaaaaact

SEQ ID NO: 8545879 - DNA, 22 bp, Homo sapiens
tcatttctcccggccaaaaact

SEQ ID NO: 8545880 - DNA, 22 bp, Homo sapiens
tcatttctccgacctgctgtcc

SEQ ID NO: 8545881 - DNA, 22 bp, Homo sapiens
tcatttctccgacctgctgtcc

SEQ ID NO: 8545882 - DNA, 22 bp, Homo sapiens
tcatttctcccggccaaaaact

SEQ ID NO: 8545883 - DNA, 22 bp, Homo sapiens
tcatttctccgacctgctgtcc

SEQ ID NO: 8545884 - DNA, 22 bp, Homo sapiens
tcatttctctgagtctgataat

SEQ ID NO: 8545885 - DNA, 22 bp, Homo sapiens
tcatttctctgagtctgataat

SEQ ID NO: 8545886 - DNA, 22 bp, Homo sapiens
tcatttctctgagtctgataat

SEQ ID NO: 8545887 - DNA, 21 bp, Homo sapiens
tcatttctctatgtatttcac

SEQ ID NO: 8545888 - DNA, 22 bp, Homo sapiens
tcatttctcctaagtgaaatat

SEQ ID NO: 8545889 - DNA, 22 bp, Homo sapiens
tcatttctcctaagtgaaatat

SEQ ID NO: 8545890 - DNA, 22 bp, Homo sapiens
tcatttctatctatgcagcttc

SEQ ID NO: 8545891 - DNA, 22 bp, Homo sapiens
tcatttctatctatgcagcttc

SEQ ID NO: 8545892 - DNA, 22 bp, Homo sapiens
tcatttccctcctacaaagagg

SEQ ID NO: 8545893 - DNA, 22 bp, Homo sapiens
tcatttcatgtctcaggcactg

SEQ ID NO: 8545894 - DNA, 23 bp, Homo sapiens
tcatttcatccagccttgagagt

SEQ ID NO: 8545895 - DNA, 23 bp, Homo sapiens
tcatttcatccagccttgagagt

SEQ ID NO: 8545896 - DNA, 22 bp, Homo sapiens
tcatttcatgtctcaggcactg

SEQ ID NO: 8545897 - DNA, 22 bp, Homo sapiens
tcatttcagtcctctgtgtgag

SEQ ID NO: 8545898 - DNA, 22 bp, Homo sapiens
tcatttcagtcctctgtgtgag

SEQ ID NO: 8545899 - DNA, 17 bp, Homo sapiens
tcatttcagtaaatcca

SEQ ID NO: 8545900 - DNA, 17 bp, Homo sapiens
tcatttcagtaaatcca

SEQ ID NO: 8545901 - DNA, 23 bp, Homo sapiens
tcatttcatccagccttgagagt

SEQ ID NO: 8545902 - DNA, 23 bp, Homo sapiens
tcatttcatccagccttgagagt

SEQ ID NO: 8545903 - DNA, 22 bp, Homo sapiens
tcatttcagtggcacagaagat

SEQ ID NO: 8545904 - DNA, 22 bp, Homo sapiens
tcatttcagtggcacagaagat

SEQ ID NO: 8545905 - DNA, 22 bp, Homo sapiens
tcatttatattgtattctgtag

SEQ ID NO: 8545906 - DNA, 22 bp, Homo sapiens
tcatttcaatgatactactaag

SEQ ID NO: 8545907 - DNA, 23 bp, Homo sapiens
tcatttcacagtgagcttcctag

SEQ ID NO: 8545908 - DNA, 23 bp, Homo sapiens
tcatttcaggttgcatggtacca

SEQ ID NO: 8545909 - DNA, 22 bp, Homo sapiens
tcatttcagccatttttaaatg

SEQ ID NO: 8545910 - DNA, 22 bp, Homo sapiens
tcatttcacttctctagggaga

SEQ ID NO: 8545911 - DNA, 22 bp, Homo sapiens
tcatttcagatgcatttagaat

SEQ ID NO: 8545912 - DNA, 22 bp, Homo sapiens
tcatttcagatgcatttagaat

SEQ ID NO: 8545913 - DNA, 22 bp, Homo sapiens
tcatttacatagaaacaatata

SEQ ID NO: 8545914 - DNA, 22 bp, Homo sapiens
tcatttaatagcttttgtcttt

SEQ ID NO: 8545915 - DNA, 22 bp, Homo sapiens
tcatttaatagcttttgtcttt

SEQ ID NO: 8545916 - DNA, 22 bp, Homo sapiens
tcatttaataatttttgagtag

SEQ ID NO: 8545917 - DNA, 22 bp, Homo sapiens
tcatttacacttcacaaatgga

SEQ ID NO: 8545918 - DNA, 22 bp, Homo sapiens
tcatttaattggttttgctcgt

SEQ ID NO: 8545919 - DNA, 22 bp, Homo sapiens
tcattgttgcgttaatgtcttc

SEQ ID NO: 8545920 - DNA, 21 bp, Homo sapiens
tcattgttgcatggtaggggg

SEQ ID NO: 8545921 - DNA, 19 bp, Homo sapiens
tcattgttggtttgtcggg

SEQ ID NO: 8545922 - DNA, 22 bp, Homo sapiens
tcatttaataatttttgagtag

SEQ ID NO: 8545923 - DNA, 22 bp, Homo sapiens
tcatttaaaatgtaccaggatt

SEQ ID NO: 8545924 - DNA, 22 bp, Homo sapiens
tcatttacatgtctttctctga

SEQ ID NO: 8545925 - DNA, 22 bp, Homo sapiens
tcatttactgtaggcaaaaatt

SEQ ID NO: 8545926 - DNA, 19 bp, Homo sapiens
tcatttacggttttgatga

SEQ ID NO: 8545927 - DNA, 22 bp, Homo sapiens
tcatttacttggttttaatctt

SEQ ID NO: 8545928 - DNA, 22 bp, Homo sapiens
tcatttatagctaaccttgaat

SEQ ID NO: 8545929 - DNA, 22 bp, Homo sapiens
tcatttatagctaaccttgaat

SEQ ID NO: 8545930 - DNA, 22 bp, Homo sapiens
tcattgtatactttatttatga

SEQ ID NO: 8545931 - DNA, 22 bp, Homo sapiens
tcattgccatggcatttgcaga

SEQ ID NO: 8545932 - DNA, 22 bp, Homo sapiens
tcattgctctaggttccttgga

SEQ ID NO: 8545933 - DNA, 23 bp, Homo sapiens
tcattgtgactgtgccacataac

SEQ ID NO: 8545934 - DNA, 20 bp, Homo sapiens
tcattgtgttgccaattccc

SEQ ID NO: 8545935 - DNA, 22 bp, Homo sapiens
tcattgtattcagaactgaaga

SEQ ID NO: 8545936 - DNA, 22 bp, Homo sapiens
tcattgttatgttttgctgtct

SEQ ID NO: 8545937 - DNA, 22 bp, Homo sapiens
tcatgcatatttgtagtagttc

SEQ ID NO: 8545938 - DNA, 22 bp, Homo sapiens
tcattgccatggcatttgcaga

SEQ ID NO: 8545939 - DNA, 22 bp, Homo sapiens
tcatgcatctgggctggctggt

SEQ ID NO: 8545940 - DNA, 22 bp, Homo sapiens
tcatgcaggtttccagccagat

SEQ ID NO: 8545941 - DNA, 22 bp, Homo sapiens
tcatgcaggtttccagccagat

SEQ ID NO: 8545942 - DNA, 22 bp, Homo sapiens
tcatgcaggaccaccccagcat

SEQ ID NO: 8545943 - DNA, 22 bp, Homo sapiens
tcatgcagcttttccattcagc

SEQ ID NO: 8545944 - DNA, 22 bp, Homo sapiens
tcagtctcctttcctctagaca

SEQ ID NO: 8545945 - DNA, 22 bp, Homo sapiens
tcagtctcatcaactctattcc

SEQ ID NO: 8545946 - DNA, 22 bp, Homo sapiens
tcagtgttctggatttggggca

SEQ ID NO: 8545947 - DNA, 22 bp, Homo sapiens
tcagtgttcttatttaattagg

SEQ ID NO: 8545948 - DNA, 22 bp, Homo sapiens
tcagtgttgaattttttgcaaa

SEQ ID NO: 8545949 - DNA, 22 bp, Homo sapiens
tcagtgttggagataattgcac

SEQ ID NO: 8545950 - DNA, 22 bp, Homo sapiens
tcagtgttggcattcagaaatg

SEQ ID NO: 8545951 - DNA, 22 bp, Homo sapiens
tcagtgtttattgcggtgtgta

SEQ ID NO: 8545952 - DNA, 22 bp, Homo sapiens
tcagtgtttcagtttggaaatg

SEQ ID NO: 8545953 - DNA, 22 bp, Homo sapiens
tcagtgtttaccgtatgttgtt

SEQ ID NO: 8545954 - DNA, 22 bp, Homo sapiens
tcagtgtttattcaatgttatt

SEQ ID NO: 8545955 - DNA, 22 bp, Homo sapiens
tcagtgttggctacatctgcct

SEQ ID NO: 8545956 - DNA, 22 bp, Homo sapiens
tcagtgttggtcaagaatcagt

SEQ ID NO: 8545957 - DNA, 22 bp, Homo sapiens
tcagtgttggcattcagaaatg

SEQ ID NO: 8545958 - DNA, 22 bp, Homo sapiens
tcagtgttggctacatctgcct

SEQ ID NO: 8545959 - DNA, 22 bp, Homo sapiens
tcagtgttgtgcacatacaaaa

SEQ ID NO: 8545960 - DNA, 22 bp, Homo sapiens
tcagtgtttacatgcatccttg

SEQ ID NO: 8545961 - DNA, 22 bp, Homo sapiens
tcagtatccacaaatgctcaaa

SEQ ID NO: 8545962 - DNA, 22 bp, Homo sapiens
tcagtatctactatcttgatga

SEQ ID NO: 8545963 - DNA, 22 bp, Homo sapiens
tcagtatccacaaatgctcaaa

SEQ ID NO: 8545964 - DNA, 22 bp, Homo sapiens
tcagtcctacacgctcagggac

SEQ ID NO: 8545965 - DNA, 22 bp, Homo sapiens
tcagtcctacacgctcagggac

SEQ ID NO: 8545966 - DNA, 22 bp, Homo sapiens
tcagtcctacacgctcagggac

SEQ ID NO: 8545967 - DNA, 22 bp, Homo sapiens
tcagtcctccacacaggcaccc

SEQ ID NO: 8545968 - DNA, 22 bp, Homo sapiens
tcagtcctccacacaggcaccc

SEQ ID NO: 8545969 - DNA, 21 bp, Homo sapiens
tcagtcctgttagcctttggg

SEQ ID NO: 8545970 - DNA, 23 bp, Homo sapiens
tcagtcctgtaggggctccaggt

SEQ ID NO: 8545971 - DNA, 22 bp, Homo sapiens
tcagtcctgatgacaggcccaa

SEQ ID NO: 8545972 - DNA, 22 bp, Homo sapiens
tcagtcctgatgacaggcccaa

SEQ ID NO: 8545973 - DNA, 23 bp, Homo sapiens
tcagtcctgtaggggctccaggt

SEQ ID NO: 8545974 - DNA, 22 bp, Homo sapiens
tcagtgtttcctagagcatata

SEQ ID NO: 8545975 - DNA, 22 bp, Homo sapiens
tcagtgtttcctgtggtacagc

SEQ ID NO: 8545976 - DNA, 22 bp, Homo sapiens
tcagtgtttgaacccagggtta

SEQ ID NO: 8545977 - DNA, 22 bp, Homo sapiens
tcagtgtttggtttcagaattg

SEQ ID NO: 8545978 - DNA, 22 bp, Homo sapiens
tcagtgttttaactgtctttta

SEQ ID NO: 8545979 - DNA, 22 bp, Homo sapiens
tcagtgtttgtggcaaatgtta

SEQ ID NO: 8545980 - DNA, 22 bp, Homo sapiens
tcagtgttttccagggtctact

SEQ ID NO: 8545981 - DNA, 22 bp, Homo sapiens
tcagtgtttttaaagcaatata

SEQ ID NO: 8545982 - DNA, 23 bp, Homo sapiens
tcataaatattagcacagtagga

SEQ ID NO: 8545983 - DNA, 23 bp, Homo sapiens
tcataaatattagcacagtagga

SEQ ID NO: 8545984 - DNA, 23 bp, Homo sapiens
tcataaatattagcacagtagga

SEQ ID NO: 8545985 - DNA, 22 bp, Homo sapiens
tcataaagcttgcctgcagtgt

SEQ ID NO: 8545986 - DNA, 22 bp, Homo sapiens
tcataaagcttgcctgcagtgt

SEQ ID NO: 8545987 - DNA, 22 bp, Homo sapiens
tcataaagcttgcctgcagtgt

SEQ ID NO: 8545988 - DNA, 22 bp, Homo sapiens
tcataaagtgaaggatgatggg

SEQ ID NO: 8545989 - DNA, 22 bp, Homo sapiens
tcataaagttacccaaatttta

SEQ ID NO: 8545990 - DNA, 22 bp, Homo sapiens
tcataaagttctaagaattgta

SEQ ID NO: 8545991 - DNA, 22 bp, Homo sapiens
tcataaagttctaagaattgta

SEQ ID NO: 8545992 - DNA, 22 bp, Homo sapiens
tcataaagttgttttaatggga

SEQ ID NO: 8545993 - DNA, 22 bp, Homo sapiens
tcataaagttatcaccaaatcc

SEQ ID NO: 8545994 - DNA, 22 bp, Homo sapiens
tcataaagttatcaccaaatcc

SEQ ID NO: 8545995 - DNA, 22 bp, Homo sapiens
tcatgaaaatagatcagaaatt

SEQ ID NO: 8545996 - DNA, 22 bp, Homo sapiens
tcatgaaaatagatcagaaatt

SEQ ID NO: 8545997 - DNA, 22 bp, Homo sapiens
tcatgcagataagaataagtaa

SEQ ID NO: 8545998 - DNA, 22 bp, Homo sapiens
tcatctttcctcaaaagatcca

SEQ ID NO: 8545999 - DNA, 22 bp, Homo sapiens
tcatctttcctcaaaagatcca

SEQ ID NO: 8546000 - DNA, 22 bp, Homo sapiens
tcatctttaccccttgcttcaa

SEQ ID NO: 8546001 - DNA, 22 bp, Homo sapiens
tcatctttcctcaaaagatcca

SEQ ID NO: 8546002 - DNA, 22 bp, Homo sapiens
tcatgaaaaattttccatgtca

SEQ ID NO: 8546003 - DNA, 22 bp, Homo sapiens
tcatgaaaatagatcagaaatt

SEQ ID NO: 8546004 - DNA, 22 bp, Homo sapiens
tcatcttgctgccattgcttta

SEQ ID NO: 8546005 - DNA, 22 bp, Homo sapiens
tcatcttctattaatagggaga

SEQ ID NO: 8546006 - DNA, 22 bp, Homo sapiens
tcatcttcctcatttctccagg

SEQ ID NO: 8546007 - DNA, 22 bp, Homo sapiens
tcatctgttcatacacatgcgt

SEQ ID NO: 8546008 - DNA, 22 bp, Homo sapiens
tcatctgaccccatctattctc

SEQ ID NO: 8546009 - DNA, 22 bp, Homo sapiens
tcatctgaccccatctattctc

SEQ ID NO: 8546010 - DNA, 22 bp, Homo sapiens
tcatctgaccccatctattctc

SEQ ID NO: 8546011 - DNA, 22 bp, Homo sapiens
tcatctgggagcttgttagaaa

SEQ ID NO: 8546012 - DNA, 20 bp, Homo sapiens
tcatctgattaacctcgaag

SEQ ID NO: 8546013 - DNA, 22 bp, Homo sapiens
tcatctgtctgagagacttctg

SEQ ID NO: 8546014 - DNA, 22 bp, Homo sapiens
tcatctgtcccaggcttttttc

SEQ ID NO: 8546015 - DNA, 22 bp, Homo sapiens
tcatctgtcatccacaaagctg

SEQ ID NO: 8546016 - DNA, 23 bp, Homo sapiens
tcatctgtaagtatctgtggagt

SEQ ID NO: 8546017 - DNA, 22 bp, Homo sapiens
tcataaatgcagtgtcataaat

SEQ ID NO: 8546018 - DNA, 22 bp, Homo sapiens
tcataaatgcagtgtcataaat

SEQ ID NO: 8546019 - DNA, 22 bp, Homo sapiens
tcataaattctggtgctgtgag

SEQ ID NO: 8546020 - DNA, 22 bp, Homo sapiens
tcataaattgattatgtgcttt

SEQ ID NO: 8546021 - DNA, 22 bp, Homo sapiens
tcataaattgattatgtgcttt

SEQ ID NO: 8546022 - DNA, 22 bp, Homo sapiens
tcatacatcttgtatatctatc

SEQ ID NO: 8546023 - DNA, 22 bp, Homo sapiens
tcatacatcttgtatatctatc

SEQ ID NO: 8546024 - DNA, 22 bp, Homo sapiens
tcatacattcagcagatatttg

SEQ ID NO: 8546025 - DNA, 22 bp, Homo sapiens
tcatacatcttgtatatctatc

SEQ ID NO: 8546026 - DNA, 22 bp, Homo sapiens
tcatctgaagattgctgttcaa

SEQ ID NO: 8546027 - DNA, 22 bp, Homo sapiens
tcatctgaacatgcagcctgtg

SEQ ID NO: 8546028 - DNA, 22 bp, Homo sapiens
tcatctgaccactttatctctc

SEQ ID NO: 8546029 - DNA, 22 bp, Homo sapiens
tcatctgaccactttatctctc

SEQ ID NO: 8546030 - DNA, 22 bp, Homo sapiens
tcatctgaccactttatctctc

SEQ ID NO: 8546031 - DNA, 22 bp, Homo sapiens
tcatctgaaattgtatatgtag

SEQ ID NO: 8546032 - DNA, 22 bp, Homo sapiens
tcatagaagtagtatccacatt

SEQ ID NO: 8546033 - DNA, 22 bp, Homo sapiens
tcatagaagtagtatccacatt

SEQ ID NO: 8546034 - DNA, 22 bp, Homo sapiens
tcatagaaatgtggccagaaac

SEQ ID NO: 8546035 - DNA, 22 bp, Homo sapiens
tcatagaaatatcacgtctttt

SEQ ID NO: 8546036 - DNA, 22 bp, Homo sapiens
tcatagaaatggaaagtatatt

SEQ ID NO: 8546037 - DNA, 22 bp, Homo sapiens
tcatagaaatatcacgtctttt

SEQ ID NO: 8546038 - DNA, 22 bp, Homo sapiens
tcaggagacttatgtcacagtg

SEQ ID NO: 8546039 - DNA, 22 bp, Homo sapiens
tcaggagagaaagaatacaatt

SEQ ID NO: 8546040 - DNA, 22 bp, Homo sapiens
tcaggagagaaagaatacaatt

SEQ ID NO: 8546041 - DNA, 22 bp, Homo sapiens
tcaggagagaaagaatacaatt

SEQ ID NO: 8546042 - DNA, 17 bp, Homo sapiens
tcaggctgggtgcagtg

SEQ ID NO: 8546043 - DNA, 17 bp, Homo sapiens
tcaggctgggtgcagtg

SEQ ID NO: 8546044 - DNA, 17 bp, Homo sapiens
tcaggctgggtgcagtg

SEQ ID NO: 8546045 - DNA, 17 bp, Homo sapiens
tcaggctgggtgcagtg

SEQ ID NO: 8546046 - DNA, 21 bp, Homo sapiens
tcaggagagcccatctacaaa

SEQ ID NO: 8546047 - DNA, 21 bp, Homo sapiens
tcaggagagcccatctacaaa

SEQ ID NO: 8546048 - DNA, 17 bp, Homo sapiens
tcaggctgggtgcagtg

SEQ ID NO: 8546049 - DNA, 22 bp, Homo sapiens
tcaggctgtagggcccctggag

SEQ ID NO: 8546050 - DNA, 22 bp, Homo sapiens
tcaggctgtaaatggtgtgggt

SEQ ID NO: 8546051 - DNA, 22 bp, Homo sapiens
tcaggctgtaaatggtgtgggt

SEQ ID NO: 8546052 - DNA, 22 bp, Homo sapiens
tcaggctgtaaatggtgtgggt

SEQ ID NO: 8546053 - DNA, 22 bp, Homo sapiens
tcaggctggtggtcagatggct

SEQ ID NO: 8546054 - DNA, 22 bp, Homo sapiens
tcaggctggtggtcagatggct

SEQ ID NO: 8546055 - DNA, 22 bp, Homo sapiens
tcaggctggtggtcagatggct

SEQ ID NO: 8546056 - DNA, 22 bp, Homo sapiens
tcaggctggtccccacagtgga

SEQ ID NO: 8546057 - DNA, 22 bp, Homo sapiens
tcaggctggtccccacagtgga

SEQ ID NO: 8546058 - DNA, 22 bp, Homo sapiens
tcaggctggtccccacagtgga

SEQ ID NO: 8546059 - DNA, 22 bp, Homo sapiens
tcaggctggtccccacagtgga

SEQ ID NO: 8546060 - DNA, 20 bp, Homo sapiens
tcaggctggtgggctttccc

SEQ ID NO: 8546061 - DNA, 22 bp, Homo sapiens
tcaggctggtggtcagatggct

SEQ ID NO: 8546062 - DNA, 22 bp, Homo sapiens
tcaggctggtggtcagatggct

SEQ ID NO: 8546063 - DNA, 20 bp, Homo sapiens
tcaggctggtgggctttccc

SEQ ID NO: 8546064 - DNA, 22 bp, Homo sapiens
tcaggctgttcctgtccaaaat

SEQ ID NO: 8546065 - DNA, 22 bp, Homo sapiens
tcaggctgttcctgtccaaaat

SEQ ID NO: 8546066 - DNA, 22 bp, Homo sapiens
tcaggctgtagggcccctggag

SEQ ID NO: 8546067 - DNA, 22 bp, Homo sapiens
tcaggctgtatatcttgcactc

SEQ ID NO: 8546068 - DNA, 22 bp, Homo sapiens
tcaggctgtagggcccctggag

SEQ ID NO: 8546069 - DNA, 22 bp, Homo sapiens
tcaggctgttagccacctcctc

SEQ ID NO: 8546070 - DNA, 22 bp, Homo sapiens
tcaggcttggtgctccagtgcc

SEQ ID NO: 8546071 - DNA, 22 bp, Homo sapiens
tcaggcttccaggctctgctga

SEQ ID NO: 8546072 - DNA, 21 bp, Homo sapiens
tcagggcagctgctcttcaga

SEQ ID NO: 8546073 - DNA, 22 bp, Homo sapiens
tcaggcttttcctgcctcctac

SEQ ID NO: 8546074 - DNA, 22 bp, Homo sapiens
tcagggcaggacagtgtaggcc

SEQ ID NO: 8546075 - DNA, 22 bp, Homo sapiens
tcagggcaggacagtgtaggcc

SEQ ID NO: 8546076 - DNA, 22 bp, Homo sapiens
tcagggcaggacagtgtaggcc

SEQ ID NO: 8546077 - DNA, 21 bp, Homo sapiens
tcagggcagctgctcttcaga

SEQ ID NO: 8546078 - DNA, 22 bp, Homo sapiens
tcagggcaggcgagcagctgct

SEQ ID NO: 8546079 - DNA, 22 bp, Homo sapiens
tcagggcaggcgagcagctgct

SEQ ID NO: 8546080 - DNA, 22 bp, Homo sapiens
tcagggcaggcgagcagctgct

SEQ ID NO: 8546081 - DNA, 22 bp, Homo sapiens
tcagggcaggttaacttgggtg

SEQ ID NO: 8546082 - DNA, 19 bp, Homo sapiens
tcagggcagtccggtcccc

SEQ ID NO: 8546083 - DNA, 22 bp, Homo sapiens
tcagggcaggttaacttgggtg

SEQ ID NO: 8546084 - DNA, 21 bp, Homo sapiens
tcagggcagtgggaggttcct

SEQ ID NO: 8546085 - DNA, 22 bp, Homo sapiens
tcagtaaatgaatgaatatatg

SEQ ID NO: 8546086 - DNA, 22 bp, Homo sapiens
tcagtaaagttctttcttgctg

SEQ ID NO: 8546087 - DNA, 22 bp, Homo sapiens
tcagtaaccctgctgttcagag

SEQ ID NO: 8546088 - DNA, 22 bp, Homo sapiens
tcagtaacttacttattcacct

SEQ ID NO: 8546089 - DNA, 19 bp, Homo sapiens
tcagtaacttttaagagga

SEQ ID NO: 8546090 - DNA, 22 bp, Homo sapiens
tcagtaacttcatgaccaagca

SEQ ID NO: 8546091 - DNA, 22 bp, Homo sapiens
tcagtaaacaggtttaagtcct

SEQ ID NO: 8546092 - DNA, 22 bp, Homo sapiens
tcagtaaatgaatgaatatatg

SEQ ID NO: 8546093 - DNA, 22 bp, Homo sapiens
tcagtaaatgaatgaatatatg

SEQ ID NO: 8546094 - DNA, 22 bp, Homo sapiens
tcagtaaatgagcaaaaatttc

SEQ ID NO: 8546095 - DNA, 22 bp, Homo sapiens
tcagtagcagaaagcaatgagt

SEQ ID NO: 8546096 - DNA, 23 bp, Homo sapiens
tcagtactctgctgggtatagag

SEQ ID NO: 8546097 - DNA, 22 bp, Homo sapiens
tcagtagcccttgagttcatgt

SEQ ID NO: 8546098 - DNA, 22 bp, Homo sapiens
tcagtagcccttgagttcatgt

SEQ ID NO: 8546099 - DNA, 22 bp, Homo sapiens
tcagtaatattctttaaaatac

SEQ ID NO: 8546100 - DNA, 22 bp, Homo sapiens
tcagtaattacctatgactcga

SEQ ID NO: 8546101 - DNA, 22 bp, Homo sapiens
tcagtacaaaggtgctctcaag

SEQ ID NO: 8546102 - DNA, 22 bp, Homo sapiens
tcagtatcaggctggaattaag

SEQ ID NO: 8546103 - DNA, 22 bp, Homo sapiens
tcagtatagcttctaaactaac

SEQ ID NO: 8546104 - DNA, 19 bp, Homo sapiens
tcagtatataattacacca

SEQ ID NO: 8546105 - DNA, 22 bp, Homo sapiens
tcagtatcatgcggtagccatg

SEQ ID NO: 8546106 - DNA, 22 bp, Homo sapiens
tcagtataattgctggcactga

SEQ ID NO: 8546107 - DNA, 22 bp, Homo sapiens
tcagtatagctaaaagtttgtc

SEQ ID NO: 8546108 - DNA, 22 bp, Homo sapiens
tcagggcatctcttaagtggtg

SEQ ID NO: 8546109 - DNA, 21 bp, Homo sapiens
tcagggcagtgggaggttcct

SEQ ID NO: 8546110 - DNA, 22 bp, Homo sapiens
tcagggcatactcttcaaggtc

SEQ ID NO: 8546111 - DNA, 22 bp, Homo sapiens
tcagggcatactcttcaaggtc

SEQ ID NO: 8546112 - DNA, 22 bp, Homo sapiens
tcagggcatactcttcaaggtc

SEQ ID NO: 8546113 - DNA, 22 bp, Homo sapiens
tcagggcatccattgcctgttg

SEQ ID NO: 8546114 - DNA, 22 bp, Homo sapiens
tcagggcatccattgcctgttg

SEQ ID NO: 8546115 - DNA, 22 bp, Homo sapiens
tcagggcatcatcatgaatata

SEQ ID NO: 8546116 - DNA, 22 bp, Homo sapiens
tcagggcatcatcatgaatata

SEQ ID NO: 8546117 - DNA, 22 bp, Homo sapiens
tcagggcatcatcatgaatata

SEQ ID NO: 8546118 - DNA, 22 bp, Homo sapiens
tcagtaaaagggtgctttactc

SEQ ID NO: 8546119 - DNA, 22 bp, Homo sapiens
tcagggctgcatacaggagata

SEQ ID NO: 8546120 - DNA, 22 bp, Homo sapiens
tcagggctgcatacaggagata

SEQ ID NO: 8546121 - DNA, 22 bp, Homo sapiens
tcagggctgcatacaggagata

SEQ ID NO: 8546122 - DNA, 22 bp, Homo sapiens
tcagggctgcagaagaggcagg

SEQ ID NO: 8546123 - DNA, 22 bp, Homo sapiens
tcagggctgcagaagaggcagg

SEQ ID NO: 8546124 - DNA, 22 bp, Homo sapiens
tcagggctgcagaagaggcagg

SEQ ID NO: 8546125 - DNA, 22 bp, Homo sapiens
tcagggctcaccagcctctgcc

SEQ ID NO: 8546126 - DNA, 22 bp, Homo sapiens
tatggaaagtgttttcttctgt

SEQ ID NO: 8546127 - DNA, 22 bp, Homo sapiens
tatggaaagggagtttaatttg

SEQ ID NO: 8546128 - DNA, 22 bp, Homo sapiens
tatggaaagctctttttgattg

SEQ ID NO: 8546129 - DNA, 22 bp, Homo sapiens
tatggaaaaatgtatcttgtca

SEQ ID NO: 8546130 - DNA, 22 bp, Homo sapiens
tatggaaaaatgtatcttgtca

SEQ ID NO: 8546131 - DNA, 22 bp, Homo sapiens
tatggaaactaattcatttttc

SEQ ID NO: 8546132 - DNA, 22 bp, Homo sapiens
tatggcttctgggccaaattta

SEQ ID NO: 8546133 - DNA, 22 bp, Homo sapiens
tatggcttcttttgcaactact

SEQ ID NO: 8546134 - DNA, 22 bp, Homo sapiens
tatggcttcttgtgttactgtg

SEQ ID NO: 8546135 - DNA, 20 bp, Homo sapiens
tatggcttgcagccaccctt

SEQ ID NO: 8546136 - DNA, 22 bp, Homo sapiens
tatggcttgagtttcagactat

SEQ ID NO: 8546137 - DNA, 20 bp, Homo sapiens
tatggcttggcaaagcttca

SEQ ID NO: 8546138 - DNA, 22 bp, Homo sapiens
tatggcttgacttgcaccggca

SEQ ID NO: 8546139 - DNA, 22 bp, Homo sapiens
tatggaaataattagacaagtg

SEQ ID NO: 8546140 - DNA, 22 bp, Homo sapiens
tatggaaataattagacaagtg

SEQ ID NO: 8546141 - DNA, 22 bp, Homo sapiens
tatggaatggctattttctagg

SEQ ID NO: 8546142 - DNA, 22 bp, Homo sapiens
tatgctttacttttcattgtga

SEQ ID NO: 8546143 - DNA, 22 bp, Homo sapiens
tatgctttacttttcattgtga

SEQ ID NO: 8546144 - DNA, 22 bp, Homo sapiens
tatgctttcattcatatgtgag

SEQ ID NO: 8546145 - DNA, 22 bp, Homo sapiens
tatgctttcattcatatgtgag

SEQ ID NO: 8546146 - DNA, 22 bp, Homo sapiens
tatgctttaaccctcttatatt

SEQ ID NO: 8546147 - DNA, 22 bp, Homo sapiens
tatgctttaaccctcttatatt

SEQ ID NO: 8546148 - DNA, 22 bp, Homo sapiens
tatgcttttaacctgtaactga

SEQ ID NO: 8546149 - DNA, 22 bp, Homo sapiens
tatgctttggtagagagttgtg

SEQ ID NO: 8546150 - DNA, 22 bp, Homo sapiens
tatgctttgcaattggaaaagg

SEQ ID NO: 8546151 - DNA, 17 bp, Homo sapiens
tatgcttttcttctcca

SEQ ID NO: 8546152 - DNA, 20 bp, Homo sapiens
tatgctttttataagattga

SEQ ID NO: 8546153 - DNA, 20 bp, Homo sapiens
tatgctttttataagattga

SEQ ID NO: 8546154 - DNA, 22 bp, Homo sapiens
tatgcttttaacctgtaactga

SEQ ID NO: 8546155 - DNA, 22 bp, Homo sapiens
tatgtacatacatgtgcatacg

SEQ ID NO: 8546156 - DNA, 22 bp, Homo sapiens
tatgtactcatcaactattgaa

SEQ ID NO: 8546157 - DNA, 22 bp, Homo sapiens
tatgtactctaatttgtctcat

SEQ ID NO: 8546158 - DNA, 22 bp, Homo sapiens
tatgtagacaggctgcttttcc

SEQ ID NO: 8546159 - DNA, 22 bp, Homo sapiens
tatgtagaagctgctcaaagaa

SEQ ID NO: 8546160 - DNA, 22 bp, Homo sapiens
tatgtacatacatgtgcatacg

SEQ ID NO: 8546161 - DNA, 22 bp, Homo sapiens
tatgtacaagcacacatgtgac

SEQ ID NO: 8546162 - DNA, 22 bp, Homo sapiens
tatgtaaagtagatggcaggta

SEQ ID NO: 8546163 - DNA, 22 bp, Homo sapiens
tatgtaaagtagatggcaggta

SEQ ID NO: 8546164 - DNA, 22 bp, Homo sapiens
tatggttatcctcaaaagagga

SEQ ID NO: 8546165 - DNA, 22 bp, Homo sapiens
tatgggtattttatacataacc

SEQ ID NO: 8546166 - DNA, 22 bp, Homo sapiens
tatgggtctggaaaatggcttg

SEQ ID NO: 8546167 - DNA, 22 bp, Homo sapiens
tatgggtattattggtaagaat

SEQ ID NO: 8546168 - DNA, 22 bp, Homo sapiens
tatgggtatctgtactgattgt

SEQ ID NO: 8546169 - DNA, 22 bp, Homo sapiens
tatgggtatcaatgacaaacat

SEQ ID NO: 8546170 - DNA, 22 bp, Homo sapiens
tatgggtataaacaggtcctaa

SEQ ID NO: 8546171 - DNA, 22 bp, Homo sapiens
tatgggtagggtttgataagat

SEQ ID NO: 8546172 - DNA, 22 bp, Homo sapiens
tatgggtaggcctgccgcctgt

SEQ ID NO: 8546173 - DNA, 22 bp, Homo sapiens
tatggtagaaaaactgagtccc

SEQ ID NO: 8546174 - DNA, 22 bp, Homo sapiens
tatggctttttattcatcttac

SEQ ID NO: 8546175 - DNA, 22 bp, Homo sapiens
tatgggtaaataataattttag

SEQ ID NO: 8546176 - DNA, 22 bp, Homo sapiens
tatgggtaaagggctagggttt

SEQ ID NO: 8546177 - DNA, 22 bp, Homo sapiens
tatgggtagagatgggggttag

SEQ ID NO: 8546178 - DNA, 22 bp, Homo sapiens
tatgggtagaagtggcccaagc

SEQ ID NO: 8546179 - DNA, 22 bp, Homo sapiens
tatgggtactttgatttagaaa

SEQ ID NO: 8546180 - DNA, 22 bp, Homo sapiens
tatgggtaagatcttttgtatt

SEQ ID NO: 8546181 - DNA, 22 bp, Homo sapiens
tatggcttttcattcctatgtg

SEQ ID NO: 8546182 - DNA, 22 bp, Homo sapiens
tatggcttttcttcctccccca

SEQ ID NO: 8546183 - DNA, 22 bp, Homo sapiens
tatggcttttggcttctctctg

SEQ ID NO: 8546184 - DNA, 22 bp, Homo sapiens
tatggcttttctttcctagtgt

SEQ ID NO: 8546185 - DNA, 22 bp, Homo sapiens
tatggctttaaacttttcattt

SEQ ID NO: 8546186 - DNA, 22 bp, Homo sapiens
tatggctttaaacaacttaggt

SEQ ID NO: 8546187 - DNA, 22 bp, Homo sapiens
tatggctttaaattgaaggagt

SEQ ID NO: 8546188 - DNA, 22 bp, Homo sapiens
tatggcttgtggagagttgtag

SEQ ID NO: 8546189 - DNA, 22 bp, Homo sapiens
tatggcttgtctttataccagg

SEQ ID NO: 8546190 - DNA, 22 bp, Homo sapiens
tatggcttgtccctggtcagtc

SEQ ID NO: 8546191 - DNA, 21 bp, Homo sapiens
tatggctttactaagctgcac

SEQ ID NO: 8546192 - DNA, 22 bp, Homo sapiens
tatggctttgaaagggcttttc

SEQ ID NO: 8546193 - DNA, 22 bp, Homo sapiens
tatggctttctccatagggcag

SEQ ID NO: 8546194 - DNA, 22 bp, Homo sapiens
tatggctttcaaaggaactcgg

SEQ ID NO: 8546195 - DNA, 22 bp, Homo sapiens
tatggcttttaaggagatctga

SEQ ID NO: 8546196 - DNA, 22 bp, Homo sapiens
tatggcttttaactgtcgtatg

SEQ ID NO: 8546197 - DNA, 22 bp, Homo sapiens
tatggctttgggccaaatctac

SEQ ID NO: 8546198 - DNA, 22 bp, Homo sapiens
tatgtaggtaaacacagacata

SEQ ID NO: 8546199 - DNA, 22 bp, Homo sapiens
tatgtagtacttagtgcataca

SEQ ID NO: 8546200 - DNA, 17 bp, Homo sapiens
tatgtagtacttataaa

SEQ ID NO: 8546201 - DNA, 17 bp, Homo sapiens
tatgtagtacttataaa

SEQ ID NO: 8546202 - DNA, 22 bp, Homo sapiens
tatgtagtgttgagaatgcttg

SEQ ID NO: 8546203 - DNA, 22 bp, Homo sapiens
tatgtagcaatagcatcatact

SEQ ID NO: 8546204 - DNA, 22 bp, Homo sapiens
tatgtagatttctctgtttttc

SEQ ID NO: 8546205 - DNA, 22 bp, Homo sapiens
tatgtagagataaaatccaaat

SEQ ID NO: 8546206 - DNA, 22 bp, Homo sapiens
tatgtataaatgcatgtgtgga

SEQ ID NO: 8546207 - DNA, 22 bp, Homo sapiens
tatgtataatcacagagtgtca

SEQ ID NO: 8546208 - DNA, 22 bp, Homo sapiens
tatgtatccgtgtgtgtacaga

SEQ ID NO: 8546209 - DNA, 22 bp, Homo sapiens
tatgtatatggtagaagtatgt

SEQ ID NO: 8546210 - DNA, 22 bp, Homo sapiens
tatgtatatggtagaagtatgt

SEQ ID NO: 8546211 - DNA, 22 bp, Homo sapiens
tatgtattctgagtacaagttc

SEQ ID NO: 8546212 - DNA, 23 bp, Homo sapiens
tatgtatgtatgtttgtatggaa

SEQ ID NO: 8546213 - DNA, 22 bp, Homo sapiens
tatgtcatgggtcaaaatgaag

SEQ ID NO: 8546214 - DNA, 22 bp, Homo sapiens
tatgtcatgggtcaaaatgaag

SEQ ID NO: 8546215 - DNA, 23 bp, Homo sapiens
tatgtcatgagcatattgaatgt

SEQ ID NO: 8546216 - DNA, 19 bp, Homo sapiens
tatgtccctttcccccatt

SEQ ID NO: 8546217 - DNA, 22 bp, Homo sapiens
tatgtttcatcaggcatggagt

SEQ ID NO: 8546218 - DNA, 22 bp, Homo sapiens
tatgtttcattcttttctggta

SEQ ID NO: 8546219 - DNA, 22 bp, Homo sapiens
tatgtttcctgagcttacacca

SEQ ID NO: 8546220 - DNA, 22 bp, Homo sapiens
tattaacacgtataaagtgttt

SEQ ID NO: 8546221 - DNA, 22 bp, Homo sapiens
tattaacacgtataaagtgttt

SEQ ID NO: 8546222 - DNA, 22 bp, Homo sapiens
tattaaattatggatttaggag

SEQ ID NO: 8546223 - DNA, 22 bp, Homo sapiens
tattaaattatggatttaggag

SEQ ID NO: 8546224 - DNA, 22 bp, Homo sapiens
tatgtttcttccttttcataca

SEQ ID NO: 8546225 - DNA, 22 bp, Homo sapiens
tattaataagtgactactagct

SEQ ID NO: 8546226 - DNA, 22 bp, Homo sapiens
tattaacatgaactgacttttc

SEQ ID NO: 8546227 - DNA, 22 bp, Homo sapiens
tattaacattttatgaaaataa

SEQ ID NO: 8546228 - DNA, 22 bp, Homo sapiens
tattaagatacgtagttgtaaa

SEQ ID NO: 8546229 - DNA, 22 bp, Homo sapiens
tataaagagtctatctggtggc

SEQ ID NO: 8546230 - DNA, 22 bp, Homo sapiens
tataaagagtctcaaagaagtt

SEQ ID NO: 8546231 - DNA, 22 bp, Homo sapiens
tataaagagtctcaaagaagtt

SEQ ID NO: 8546232 - DNA, 22 bp, Homo sapiens
tataaagaagtgtaaacaggaa

SEQ ID NO: 8546233 - DNA, 22 bp, Homo sapiens
tataaagaaggcacagcaagac

SEQ ID NO: 8546234 - DNA, 22 bp, Homo sapiens
tataaagaatccagaagagaca

SEQ ID NO: 8546235 - DNA, 22 bp, Homo sapiens
tataaagaatccagaagagaca

SEQ ID NO: 8546236 - DNA, 22 bp, Homo sapiens
tataaagaagtgtaaacaggaa

SEQ ID NO: 8546237 - DNA, 22 bp, Homo sapiens
tataaagtgtgaactgtgagta

SEQ ID NO: 8546238 - DNA, 22 bp, Homo sapiens
tataaagagtctcaaagaagtt

SEQ ID NO: 8546239 - DNA, 22 bp, Homo sapiens
tataaagagtctcaaagaagtt

SEQ ID NO: 8546240 - DNA, 22 bp, Homo sapiens
tataaagctgactcatgaaact

SEQ ID NO: 8546241 - DNA, 22 bp, Homo sapiens
tataaagttggggctgaagtaa

SEQ ID NO: 8546242 - DNA, 22 bp, Homo sapiens
tataaagtttcgaaagatgtat

SEQ ID NO: 8546243 - DNA, 22 bp, Homo sapiens
tataaagtttcgaaagatgtat

SEQ ID NO: 8546244 - DNA, 22 bp, Homo sapiens
tataaaacagaaagcactacct

SEQ ID NO: 8546245 - DNA, 22 bp, Homo sapiens
tataaaatggcatcagctccaa

SEQ ID NO: 8546246 - DNA, 22 bp, Homo sapiens
tataaaacagaaagcactacct

SEQ ID NO: 8546247 - DNA, 22 bp, Homo sapiens
tataaaatggcatcagctccaa

SEQ ID NO: 8546248 - DNA, 22 bp, Homo sapiens
tataaaatggcatcagctccaa

SEQ ID NO: 8546249 - DNA, 22 bp, Homo sapiens
tataaaattctcagtttggggt

SEQ ID NO: 8546250 - DNA, 18 bp, Homo sapiens
tataaacacacttaggtt

SEQ ID NO: 8546251 - DNA, 18 bp, Homo sapiens
tataaacacacttaggtt

SEQ ID NO: 8546252 - DNA, 22 bp, Homo sapiens
tataaactcctcttgcattcct

SEQ ID NO: 8546253 - DNA, 22 bp, Homo sapiens
tataaagaaggcacagcaagac

SEQ ID NO: 8546254 - DNA, 22 bp, Homo sapiens
tataaagaaatgatttccagaa

SEQ ID NO: 8546255 - DNA, 22 bp, Homo sapiens
tatcagaacacatgttttgcag

SEQ ID NO: 8546256 - DNA, 22 bp, Homo sapiens
tatcagaagacttacagtatcg

SEQ ID NO: 8546257 - DNA, 22 bp, Homo sapiens
tatcagaagacttacagtatcg

SEQ ID NO: 8546258 - DNA, 22 bp, Homo sapiens
tatcagaagacttacagtatcg

SEQ ID NO: 8546259 - DNA, 22 bp, Homo sapiens
tatcagaaatgccttaaattgg

SEQ ID NO: 8546260 - DNA, 22 bp, Homo sapiens
tatcagaaatgccttaaattgg

SEQ ID NO: 8546261 - DNA, 22 bp, Homo sapiens
tatcagaaatgccttaaattgg

SEQ ID NO: 8546262 - DNA, 18 bp, Homo sapiens
tatcactgctgaacaaga

SEQ ID NO: 8546263 - DNA, 19 bp, Homo sapiens
tatcactgggcactgagga

SEQ ID NO: 8546264 - DNA, 22 bp, Homo sapiens
tatcacatagtgtttagtaaat

SEQ ID NO: 8546265 - DNA, 22 bp, Homo sapiens
tatcacaggtgtgatttacatt

SEQ ID NO: 8546266 - DNA, 21 bp, Homo sapiens
tatcacagtagaataggatct

SEQ ID NO: 8546267 - DNA, 22 bp, Homo sapiens
tatcaccctacataagaaataa

SEQ ID NO: 8546268 - DNA, 22 bp, Homo sapiens
tatcactacacctggctaatta

SEQ ID NO: 8546269 - DNA, 22 bp, Homo sapiens
tatcacatcaatgttttaaaat

SEQ ID NO: 8546270 - DNA, 22 bp, Homo sapiens
tatcacatcaatgttttaaaat

SEQ ID NO: 8546271 - DNA, 22 bp, Homo sapiens
tatcagcgtgcaaatctttgga

SEQ ID NO: 8546272 - DNA, 22 bp, Homo sapiens
tatcagctcggaatctgttgaa

SEQ ID NO: 8546273 - DNA, 22 bp, Homo sapiens
tatcatttaacagaatcattgc

SEQ ID NO: 8546274 - DNA, 22 bp, Homo sapiens
tatcagcaactcagagcagtct

SEQ ID NO: 8546275 - DNA, 22 bp, Homo sapiens
tatcagcaagatggcagtatag

SEQ ID NO: 8546276 - DNA, 17 bp, Homo sapiens
tatcagaatgtgtttac

SEQ ID NO: 8546277 - DNA, 21 bp, Homo sapiens
tatcagaagagaaagaatgat

SEQ ID NO: 8546278 - DNA, 21 bp, Homo sapiens
tatcagaagagaaagaatgat

SEQ ID NO: 8546279 - DNA, 22 bp, Homo sapiens
tatcagaaggcacatggagtct

SEQ ID NO: 8546280 - DNA, 22 bp, Homo sapiens
tatcagaaggcacatggagtct

SEQ ID NO: 8546281 - DNA, 22 bp, Homo sapiens
tatgaaatttaaacacagatca

SEQ ID NO: 8546282 - DNA, 22 bp, Homo sapiens
tatgaaatttaaacacagatca

SEQ ID NO: 8546283 - DNA, 22 bp, Homo sapiens
tatgaaatttctagttctgctt

SEQ ID NO: 8546284 - DNA, 20 bp, Homo sapiens
tatgaagatatgtgaacagc

SEQ ID NO: 8546285 - DNA, 22 bp, Homo sapiens
tatgaagattgcggtctggaat

SEQ ID NO: 8546286 - DNA, 22 bp, Homo sapiens
tatgaaatgatggggaaaatag

SEQ ID NO: 8546287 - DNA, 22 bp, Homo sapiens
tatgaaatgatggggaaaatag

SEQ ID NO: 8546288 - DNA, 22 bp, Homo sapiens
tatgaaattgccatttttatgg

SEQ ID NO: 8546289 - DNA, 22 bp, Homo sapiens
tatgaaattgccatttttatgg

SEQ ID NO: 8546290 - DNA, 22 bp, Homo sapiens
tatgaaatggtagtaggaaggg

SEQ ID NO: 8546291 - DNA, 22 bp, Homo sapiens
tatgaaattgccatttttatgg

SEQ ID NO: 8546292 - DNA, 22 bp, Homo sapiens
tatgacaagaaatacagaggta

SEQ ID NO: 8546293 - DNA, 22 bp, Homo sapiens
tatgaagtgagttatggttgct

SEQ ID NO: 8546294 - DNA, 20 bp, Homo sapiens
tatgaagtgttcttctggta

SEQ ID NO: 8546295 - DNA, 22 bp, Homo sapiens
tatgaagtgtctgttgtatctg

SEQ ID NO: 8546296 - DNA, 22 bp, Homo sapiens
tatgaatataccacaatttagg

SEQ ID NO: 8546297 - DNA, 22 bp, Homo sapiens
tatgaaaatttagctgaagcat

SEQ ID NO: 8546298 - DNA, 22 bp, Homo sapiens
tatgaaagaatctcagagcaca

SEQ ID NO: 8546299 - DNA, 22 bp, Homo sapiens
tatgaaaaggtggccaatgtag

SEQ ID NO: 8546300 - DNA, 22 bp, Homo sapiens
tatgaaaaggtggccaatgtag

SEQ ID NO: 8546301 - DNA, 22 bp, Homo sapiens
tatgaaaatttagctgaagcat

SEQ ID NO: 8546302 - DNA, 22 bp, Homo sapiens
tatgaaaatttagctgaagcat

SEQ ID NO: 8546303 - DNA, 22 bp, Homo sapiens
tatgaaaatttagctgaagcat

SEQ ID NO: 8546304 - DNA, 22 bp, Homo sapiens
tatcttttgagttctcaagatg

SEQ ID NO: 8546305 - DNA, 18 bp, Homo sapiens
tatcttttccagtggtat

SEQ ID NO: 8546306 - DNA, 18 bp, Homo sapiens
tatcttttccagtggtat

SEQ ID NO: 8546307 - DNA, 18 bp, Homo sapiens
tatcttttccagtggtat

SEQ ID NO: 8546308 - DNA, 22 bp, Homo sapiens
tatgaaaaggtggccaatgtag

SEQ ID NO: 8546309 - DNA, 22 bp, Homo sapiens
tatcatttagagtatttcttca

SEQ ID NO: 8546310 - DNA, 23 bp, Homo sapiens
tatcatttcagctctctgcctgg

SEQ ID NO: 8546311 - DNA, 23 bp, Homo sapiens
tatcatttcagctctctgcctgg

SEQ ID NO: 8546312 - DNA, 23 bp, Homo sapiens
tatcatttcagctctctgcctgg

SEQ ID NO: 8546313 - DNA, 22 bp, Homo sapiens
tatcatttgttattattagtgg

SEQ ID NO: 8546314 - DNA, 22 bp, Homo sapiens
tatcatttgttattattagtgg

SEQ ID NO: 8546315 - DNA, 22 bp, Homo sapiens
tatcattttactgtgacatttt

SEQ ID NO: 8546316 - DNA, 22 bp, Homo sapiens
tatcattttactgtgacatttt

SEQ ID NO: 8546317 - DNA, 22 bp, Homo sapiens
tatcattttactgtgacatttt

SEQ ID NO: 8546318 - DNA, 22 bp, Homo sapiens
tatccaaagagattcatgttct

SEQ ID NO: 8546319 - DNA, 22 bp, Homo sapiens
tattttctgtggaggaccagat

SEQ ID NO: 8546320 - DNA, 22 bp, Homo sapiens
tattttctgtggaggaccagat

SEQ ID NO: 8546321 - DNA, 22 bp, Homo sapiens
tattttctgtggaggaccagat

SEQ ID NO: 8546322 - DNA, 22 bp, Homo sapiens
tattttgaaagtctgttttgaa

SEQ ID NO: 8546323 - DNA, 22 bp, Homo sapiens
tattttctggacagtcttgctt

SEQ ID NO: 8546324 - DNA, 22 bp, Homo sapiens
tattttctggacagtcttgctt

SEQ ID NO: 8546325 - DNA, 22 bp, Homo sapiens
tattttctggggagagtgaacc

SEQ ID NO: 8546326 - DNA, 22 bp, Homo sapiens
tattttctggggagagtgaacc

SEQ ID NO: 8546327 - DNA, 19 bp, Homo sapiens
tattttcgtggaggcctat

SEQ ID NO: 8546328 - DNA, 22 bp, Homo sapiens
tatttggagcctatccatagat

SEQ ID NO: 8546329 - DNA, 23 bp, Homo sapiens
tattttccaaatgatgactacat

SEQ ID NO: 8546330 - DNA, 22 bp, Homo sapiens
tatttggagatgggatcttcaa

SEQ ID NO: 8546331 - DNA, 22 bp, Homo sapiens
tatttggacaccaagtagaagt

SEQ ID NO: 8546332 - DNA, 22 bp, Homo sapiens
tatttgctgtgcttattccatt

SEQ ID NO: 8546333 - DNA, 22 bp, Homo sapiens
tatttgctgacagtgctggagc

SEQ ID NO: 8546334 - DNA, 21 bp, Homo sapiens
tatttgctgccatctttgagg

SEQ ID NO: 8546335 - DNA, 21 bp, Homo sapiens
tatttgctgccatctttgagg

SEQ ID NO: 8546336 - DNA, 22 bp, Homo sapiens
tatttgctgaatctgattcaga

SEQ ID NO: 8546337 - DNA, 22 bp, Homo sapiens
tatttgctccttaggcatattt

SEQ ID NO: 8546338 - DNA, 22 bp, Homo sapiens
tatttgctgaatctgattcaga

SEQ ID NO: 8546339 - DNA, 22 bp, Homo sapiens
tatttgctgacagtgctggagc

SEQ ID NO: 8546340 - DNA, 22 bp, Homo sapiens
tatttgctttgctttatagaga

SEQ ID NO: 8546341 - DNA, 22 bp, Homo sapiens
tatttggaaacaattcacatgc

SEQ ID NO: 8546342 - DNA, 22 bp, Homo sapiens
tatttgcttttgtgccacagat

SEQ ID NO: 8546343 - DNA, 22 bp, Homo sapiens
tatttggaaaggacatgtaagt

SEQ ID NO: 8546344 - DNA, 23 bp, Homo sapiens
tatttggaaagagggaagaagac

SEQ ID NO: 8546345 - DNA, 22 bp, Homo sapiens
tatttggaaagtttatctatct

SEQ ID NO: 8546346 - DNA, 22 bp, Homo sapiens
tatttggaaaggacatgtaagt

SEQ ID NO: 8546347 - DNA, 22 bp, Homo sapiens
tatttggaaatagggctttgta

SEQ ID NO: 8546348 - DNA, 22 bp, Homo sapiens
tatttggaatagcttgctaatg

SEQ ID NO: 8546349 - DNA, 22 bp, Homo sapiens
tatttcttgttattctcgttga

SEQ ID NO: 8546350 - DNA, 22 bp, Homo sapiens
tatttcttgttattctcgttga

SEQ ID NO: 8546351 - DNA, 22 bp, Homo sapiens
tatttgaaggcatacattttga

SEQ ID NO: 8546352 - DNA, 22 bp, Homo sapiens
tatttgaaggcatacattttga

SEQ ID NO: 8546353 - DNA, 22 bp, Homo sapiens
tatttgatagagataaatgata

SEQ ID NO: 8546354 - DNA, 22 bp, Homo sapiens
tatttgatagagataaatgata

SEQ ID NO: 8546355 - DNA, 22 bp, Homo sapiens
tatttgagcgaagcagtgtttt

SEQ ID NO: 8546356 - DNA, 22 bp, Homo sapiens
tatttgcaggacatagatatgg

SEQ ID NO: 8546357 - DNA, 22 bp, Homo sapiens
tatttgctcaataatagtttta

SEQ ID NO: 8546358 - DNA, 22 bp, Homo sapiens
tatttgatggttctaaaacagc

SEQ ID NO: 8546359 - DNA, 22 bp, Homo sapiens
tatttgcaacataaaactctga

SEQ ID NO: 8546360 - DNA, 22 bp, Homo sapiens
tatttgatagagataaatgata

SEQ ID NO: 8546361 - DNA, 22 bp, Homo sapiens
tatttgatagagataaatgata

SEQ ID NO: 8546362 - DNA, 22 bp, Homo sapiens
tatttgatagagataaatgata

SEQ ID NO: 8546363 - DNA, 22 bp, Homo sapiens
tatttgatgaaggtaaagtctt

SEQ ID NO: 8546364 - DNA, 22 bp, Homo sapiens
tatttgatgaaggtaaagtctt

SEQ ID NO: 8546365 - DNA, 22 bp, Homo sapiens
tatttgatgaaggtaaagtctt

SEQ ID NO: 8546366 - DNA, 22 bp, Homo sapiens
tatttgatggttctaaaacagc

SEQ ID NO: 8546367 - DNA, 22 bp, Homo sapiens
tatttgatggttctaaaacagc

SEQ ID NO: 8546368 - DNA, 22 bp, Homo sapiens
tattgtttctggctgtggcagc

SEQ ID NO: 8546369 - DNA, 22 bp, Homo sapiens
tattgttcttcactggtcttat

SEQ ID NO: 8546370 - DNA, 22 bp, Homo sapiens
tatttaaaaagaggccagctgg

SEQ ID NO: 8546371 - DNA, 22 bp, Homo sapiens
tatttaaaaagaggccagctgg

SEQ ID NO: 8546372 - DNA, 22 bp, Homo sapiens
tatttaaaaagaggccagctgg

SEQ ID NO: 8546373 - DNA, 22 bp, Homo sapiens
tatttaaaaagaggccagctgg

SEQ ID NO: 8546374 - DNA, 22 bp, Homo sapiens
tattgtcttcaactctactttt

SEQ ID NO: 8546375 - DNA, 22 bp, Homo sapiens
tattgtgagttcagactaaaaa

SEQ ID NO: 8546376 - DNA, 20 bp, Homo sapiens
tattgtgataggtgttaatc

SEQ ID NO: 8546377 - DNA, 22 bp, Homo sapiens
tattgtgagtataactgcattt

SEQ ID NO: 8546378 - DNA, 22 bp, Homo sapiens
tatttaaaatagtgctccagca

SEQ ID NO: 8546379 - DNA, 22 bp, Homo sapiens
tatttaaaatagtgctccagca

SEQ ID NO: 8546380 - DNA, 22 bp, Homo sapiens
tatttaaaatagtgctccagca

SEQ ID NO: 8546381 - DNA, 22 bp, Homo sapiens
tatttaaaataagccccagtgg

SEQ ID NO: 8546382 - DNA, 22 bp, Homo sapiens
tatttaaaataagccccagtgg

SEQ ID NO: 8546383 - DNA, 22 bp, Homo sapiens
tatttaaaataagccccagtgg

SEQ ID NO: 8546384 - DNA, 22 bp, Homo sapiens
tatttaataaaactatggcatg

SEQ ID NO: 8546385 - DNA, 22 bp, Homo sapiens
tatttaataaaactatggcatg

SEQ ID NO: 8546386 - DNA, 22 bp, Homo sapiens
tatttaactggaaacacaatga

SEQ ID NO: 8546387 - DNA, 22 bp, Homo sapiens
tattacaagaaagggcatgaat

SEQ ID NO: 8546388 - DNA, 22 bp, Homo sapiens
tattacaaattataatgggaga

SEQ ID NO: 8546389 - DNA, 22 bp, Homo sapiens
tattaatttaatctccatggta

SEQ ID NO: 8546390 - DNA, 21 bp, Homo sapiens
tattaatttttcttcccacta

SEQ ID NO: 8546391 - DNA, 22 bp, Homo sapiens
tattaatttaatctccatggta

SEQ ID NO: 8546392 - DNA, 22 bp, Homo sapiens
tattacaatttacattgcactt

SEQ ID NO: 8546393 - DNA, 22 bp, Homo sapiens
tattacaatttacattgcactt

SEQ ID NO: 8546394 - DNA, 23 bp, Homo sapiens
tattacaattggtcttattaaga

SEQ ID NO: 8546395 - DNA, 23 bp, Homo sapiens
tattacaattggtcttattaaga

SEQ ID NO: 8546396 - DNA, 23 bp, Homo sapiens
tattacaattggtcttattaaga

SEQ ID NO: 8546397 - DNA, 22 bp, Homo sapiens
tattgtattaaggattcaagta

SEQ ID NO: 8546398 - DNA, 22 bp, Homo sapiens
tattgtcaagaagtttatagtg

SEQ ID NO: 8546399 - DNA, 21 bp, Homo sapiens
tattgtcaatctgctttcaga

SEQ ID NO: 8546400 - DNA, 22 bp, Homo sapiens
tattgtcacgtcttaattctag

SEQ ID NO: 8546401 - DNA, 22 bp, Homo sapiens
tattgtcaagaagtttatagtg

SEQ ID NO: 8546402 - DNA, 22 bp, Homo sapiens
tattacaatttacattgcactt

SEQ ID NO: 8546403 - DNA, 22 bp, Homo sapiens
tattgtatcttaccacatgtat

SEQ ID NO: 8546404 - DNA, 22 bp, Homo sapiens
tattgtatcttctgtttagaag

SEQ ID NO: 8546405 - DNA, 22 bp, Homo sapiens
tattgtctgtccgggtcaaagc

SEQ ID NO: 8546406 - DNA, 22 bp, Homo sapiens
tattgtctatcgctgctttcat

SEQ ID NO: 8546407 - DNA, 22 bp, Homo sapiens
tattgtctaggaattgtttaaa

SEQ ID NO: 8546408 - DNA, 22 bp, Homo sapiens
tattgtccaataggatgttcct

SEQ ID NO: 8546409 - DNA, 22 bp, Homo sapiens
tcaaagggtaatgtaatagtct

SEQ ID NO: 8546410 - DNA, 19 bp, Homo sapiens
tcaaaggcttttaggagac

SEQ ID NO: 8546411 - DNA, 22 bp, Homo sapiens
tcaaagtaaaagtatagagttt

SEQ ID NO: 8546412 - DNA, 22 bp, Homo sapiens
tcaaagggtagcccagggaaga

SEQ ID NO: 8546413 - DNA, 22 bp, Homo sapiens
tcaaagggtccttaacatgaga

SEQ ID NO: 8546414 - DNA, 22 bp, Homo sapiens
tcaaaggttaactctgttgttc

SEQ ID NO: 8546415 - DNA, 22 bp, Homo sapiens
tcaaagtaggggtaagccaggc

SEQ ID NO: 8546416 - DNA, 22 bp, Homo sapiens
tcaaagtcacaactctctaatt

SEQ ID NO: 8546417 - DNA, 22 bp, Homo sapiens
tcaaagtcatggcaggctcaga

SEQ ID NO: 8546418 - DNA, 22 bp, Homo sapiens
tcaaagtcatggcaggctcaga

SEQ ID NO: 8546419 - DNA, 19 bp, Homo sapiens
tcaaagtctgagtcacttt

SEQ ID NO: 8546420 - DNA, 22 bp, Homo sapiens
tcaaagtctctgcttctgtaac

SEQ ID NO: 8546421 - DNA, 22 bp, Homo sapiens
tcaaagtctatctgtaattact

SEQ ID NO: 8546422 - DNA, 22 bp, Homo sapiens
tcaaagtccttgctttttctgt

SEQ ID NO: 8546423 - DNA, 22 bp, Homo sapiens
tcaaagtcatggctagtaatga

SEQ ID NO: 8546424 - DNA, 22 bp, Homo sapiens
tcaaagtttttgagaattacat

SEQ ID NO: 8546425 - DNA, 22 bp, Homo sapiens
tcaaagtttgtggcaatttatt

SEQ ID NO: 8546426 - DNA, 18 bp, Homo sapiens
tcaaagtctggctccact

SEQ ID NO: 8546427 - DNA, 22 bp, Homo sapiens
tcaaagttacttgtggttttct

SEQ ID NO: 8546428 - DNA, 22 bp, Homo sapiens
tcaaagtcatggctagtaatga

SEQ ID NO: 8546429 - DNA, 22 bp, Homo sapiens
tcaaataaggagtcatgaccat

SEQ ID NO: 8546430 - DNA, 22 bp, Homo sapiens
tcaaataatgccattcatcatc

SEQ ID NO: 8546431 - DNA, 22 bp, Homo sapiens
tcaaataatgccattcatcatc

SEQ ID NO: 8546432 - DNA, 22 bp, Homo sapiens
tcaaatcaccaaactcactggc

SEQ ID NO: 8546433 - DNA, 22 bp, Homo sapiens
tcaaatcagcaagcagcttccc

SEQ ID NO: 8546434 - DNA, 21 bp, Homo sapiens
tcaaatcaggtatcactattg

SEQ ID NO: 8546435 - DNA, 22 bp, Homo sapiens
tcaaatcagcaagcagcttccc

SEQ ID NO: 8546436 - DNA, 22 bp, Homo sapiens
tcaaatcaccaaactcactggc

SEQ ID NO: 8546437 - DNA, 22 bp, Homo sapiens
tcaaatcaccaaactcactggc

SEQ ID NO: 8546438 - DNA, 21 bp, Homo sapiens
tcaaatcaggtatcactattg

SEQ ID NO: 8546439 - DNA, 21 bp, Homo sapiens
tcaaatcaggtatcactattg

SEQ ID NO: 8546440 - DNA, 21 bp, Homo sapiens
tcaaatcatgtactgaccaca

SEQ ID NO: 8546441 - DNA, 21 bp, Homo sapiens
tcaaatcatgtactgaccaca

SEQ ID NO: 8546442 - DNA, 22 bp, Homo sapiens
tcaaatagttgacattaacttg

SEQ ID NO: 8546443 - DNA, 22 bp, Homo sapiens
tcaaatatgtgatagaagctaa

SEQ ID NO: 8546444 - DNA, 22 bp, Homo sapiens
tcaaatatgtgatagaagctaa

SEQ ID NO: 8546445 - DNA, 22 bp, Homo sapiens
tcaaataatgccattcatcatc

SEQ ID NO: 8546446 - DNA, 22 bp, Homo sapiens
tcaaataatgccattcatcatc

SEQ ID NO: 8546447 - DNA, 22 bp, Homo sapiens
tcaaataccagcaatttcatgt

SEQ ID NO: 8546448 - DNA, 22 bp, Homo sapiens
tcaaagaagtgcaaacctcatc

SEQ ID NO: 8546449 - DNA, 17 bp, Homo sapiens
tcaaagaatgcatgcag

SEQ ID NO: 8546450 - DNA, 22 bp, Homo sapiens
tcaaagaatgttatgagggtag

SEQ ID NO: 8546451 - DNA, 20 bp, Homo sapiens
tcaaagacaagctctcatcc

SEQ ID NO: 8546452 - DNA, 22 bp, Homo sapiens
tcaaagaacatcatctgaaatg

SEQ ID NO: 8546453 - DNA, 20 bp, Homo sapiens
tcaaagaagattcagctcaa

SEQ ID NO: 8546454 - DNA, 22 bp, Homo sapiens
tcaaagaagattaccctcccat

SEQ ID NO: 8546455 - DNA, 22 bp, Homo sapiens
tcaaacttggtaagagaaatac

SEQ ID NO: 8546456 - DNA, 22 bp, Homo sapiens
tcaaacttggtaagagaaatac

SEQ ID NO: 8546457 - DNA, 22 bp, Homo sapiens
tcaaactgttcagaactccttt

SEQ ID NO: 8546458 - DNA, 23 bp, Homo sapiens
tcaaactgttatattgccagagt

SEQ ID NO: 8546459 - DNA, 22 bp, Homo sapiens
tcaaactgtttacagtgagata

SEQ ID NO: 8546460 - DNA, 18 bp, Homo sapiens
tcaaactgtcattggtga

SEQ ID NO: 8546461 - DNA, 22 bp, Homo sapiens
tcaaaggcggtccaggaataaa

SEQ ID NO: 8546462 - DNA, 22 bp, Homo sapiens
tcaaagagctattcagttgtgg

SEQ ID NO: 8546463 - DNA, 21 bp, Homo sapiens
tcaaagactggggctgtgtgc

SEQ ID NO: 8546464 - DNA, 22 bp, Homo sapiens
tcaaagactatatattttattt

SEQ ID NO: 8546465 - DNA, 22 bp, Homo sapiens
tcaaagacatggggaagctgag

SEQ ID NO: 8546466 - DNA, 22 bp, Homo sapiens
tcaaagagctctatcttcaaaa

SEQ ID NO: 8546467 - DNA, 22 bp, Homo sapiens
tcaaagagctctatcttcaaaa

SEQ ID NO: 8546468 - DNA, 22 bp, Homo sapiens
tcaaagatagatgttgagaaat

SEQ ID NO: 8546469 - DNA, 22 bp, Homo sapiens
tattttgaggtatttttgagct

SEQ ID NO: 8546470 - DNA, 22 bp, Homo sapiens
tattttgcaaacctgagtttga

SEQ ID NO: 8546471 - DNA, 22 bp, Homo sapiens
tattttgaggtatttttgagct

SEQ ID NO: 8546472 - DNA, 22 bp, Homo sapiens
tattttgacgattttatgcaaa

SEQ ID NO: 8546473 - DNA, 22 bp, Homo sapiens
tattttgacgattttatgcaaa

SEQ ID NO: 8546474 - DNA, 22 bp, Homo sapiens
tattttgactattaaaccaaca

SEQ ID NO: 8546475 - DNA, 22 bp, Homo sapiens
tattttgactattaaaccaaca

SEQ ID NO: 8546476 - DNA, 22 bp, Homo sapiens
tattttgtaattggtcatagct

SEQ ID NO: 8546477 - DNA, 22 bp, Homo sapiens
tattttgtaattggtcatagct

SEQ ID NO: 8546478 - DNA, 22 bp, Homo sapiens
tattttgcgttgagtcagattt

SEQ ID NO: 8546479 - DNA, 22 bp, Homo sapiens
tattttgctttagctgactgtt

SEQ ID NO: 8546480 - DNA, 20 bp, Homo sapiens
tattttgcaattatggttca

SEQ ID NO: 8546481 - DNA, 22 bp, Homo sapiens
tattttgcaaacctgagtttga

SEQ ID NO: 8546482 - DNA, 20 bp, Homo sapiens
tattttgcaattatggttca

SEQ ID NO: 8546483 - DNA, 22 bp, Homo sapiens
tatttttgcctctcagataaaa

SEQ ID NO: 8546484 - DNA, 22 bp, Homo sapiens
tatttttgcctctcagataaaa

SEQ ID NO: 8546485 - DNA, 22 bp, Homo sapiens
tcaaaaataagatattctggac

SEQ ID NO: 8546486 - DNA, 22 bp, Homo sapiens
tattttgtatttatgcaagaaa

SEQ ID NO: 8546487 - DNA, 22 bp, Homo sapiens
tattttgtatttatgcaagaaa

SEQ ID NO: 8546488 - DNA, 22 bp, Homo sapiens
tattttgttaataatccagtcc

SEQ ID NO: 8546489 - DNA, 22 bp, Homo sapiens
tattttgttttgtatccactgt

SEQ ID NO: 8546490 - DNA, 22 bp, Homo sapiens
tattttgttaataatccagtcc

SEQ ID NO: 8546491 - DNA, 22 bp, Homo sapiens
tattttgttaataatccagtcc

SEQ ID NO: 8546492 - DNA, 22 bp, Homo sapiens
tagggctgtgtctccaggacca

SEQ ID NO: 8546493 - DNA, 19 bp, Homo sapiens
tagggctggccgggcggtg

SEQ ID NO: 8546494 - DNA, 22 bp, Homo sapiens
taggccattgatttttataagt

SEQ ID NO: 8546495 - DNA, 22 bp, Homo sapiens
taggccagttggtggccctgga

SEQ ID NO: 8546496 - DNA, 22 bp, Homo sapiens
tagggcagagtccaggatgggc

SEQ ID NO: 8546497 - DNA, 22 bp, Homo sapiens
taggccattgatttttataagt

SEQ ID NO: 8546498 - DNA, 22 bp, Homo sapiens
tagggcagagtccaggatgggc

SEQ ID NO: 8546499 - DNA, 22 bp, Homo sapiens
tagggcagagtccaggatgggc

SEQ ID NO: 8546500 - DNA, 22 bp, Homo sapiens
tagggcagattcggtggagttt

SEQ ID NO: 8546501 - DNA, 22 bp, Homo sapiens
tagggcagattcggtggagttt

SEQ ID NO: 8546502 - DNA, 22 bp, Homo sapiens
tagggcagccacccaggctgct

SEQ ID NO: 8546503 - DNA, 22 bp, Homo sapiens
tagggcagccacccaggctgct

SEQ ID NO: 8546504 - DNA, 21 bp, Homo sapiens
tagggctctatttttatttca

SEQ ID NO: 8546505 - DNA, 21 bp, Homo sapiens
tagggctctctgtgtcaggtg

SEQ ID NO: 8546506 - DNA, 22 bp, Homo sapiens
tagggctctgagagttcagcct

SEQ ID NO: 8546507 - DNA, 18 bp, Homo sapiens
tagggctctagggagtga

SEQ ID NO: 8546508 - DNA, 22 bp, Homo sapiens
tagggctctgctcatcagttgt

SEQ ID NO: 8546509 - DNA, 22 bp, Homo sapiens
tagggctctggtgggctctgtt

SEQ ID NO: 8546510 - DNA, 23 bp, Homo sapiens
tagggcagctgggagggacatgc

SEQ ID NO: 8546511 - DNA, 23 bp, Homo sapiens
tagggcagctgggagggacatgc

SEQ ID NO: 8546512 - DNA, 23 bp, Homo sapiens
tagggcagctgggagggacatgc

SEQ ID NO: 8546513 - DNA, 23 bp, Homo sapiens
tagggcagctgggagggacatgc

SEQ ID NO: 8546514 - DNA, 23 bp, Homo sapiens
tagggcagctgggagggacatgc

SEQ ID NO: 8546515 - DNA, 22 bp, Homo sapiens
tagggcagctgcatcaggcact

SEQ ID NO: 8546516 - DNA, 22 bp, Homo sapiens
tagggcagctgcatcaggcact

SEQ ID NO: 8546517 - DNA, 22 bp, Homo sapiens
tagggcagctgcatcaggcact

SEQ ID NO: 8546518 - DNA, 22 bp, Homo sapiens
tagggcagccttatagctccca

SEQ ID NO: 8546519 - DNA, 22 bp, Homo sapiens
tagggcagccttatagctccca

SEQ ID NO: 8546520 - DNA, 20 bp, Homo sapiens
taggcagagctgtgcagcct

SEQ ID NO: 8546521 - DNA, 20 bp, Homo sapiens
taggcagagctgtgcagcct

SEQ ID NO: 8546522 - DNA, 20 bp, Homo sapiens
taggcagagctgtgcagcct

SEQ ID NO: 8546523 - DNA, 22 bp, Homo sapiens
tagctgttaagttgtttggaaa

SEQ ID NO: 8546524 - DNA, 22 bp, Homo sapiens
tagctgttacccataaaagcca

SEQ ID NO: 8546525 - DNA, 22 bp, Homo sapiens
taggcagaaaggaaggcaagtt

SEQ ID NO: 8546526 - DNA, 17 bp, Homo sapiens
tagctgtgtttcagcta

SEQ ID NO: 8546527 - DNA, 22 bp, Homo sapiens
tagctgtgtaagcttggtaaga

SEQ ID NO: 8546528 - DNA, 22 bp, Homo sapiens
tagctgtgaaacagcagaagag

SEQ ID NO: 8546529 - DNA, 22 bp, Homo sapiens
tagctggttctccaggagctag

SEQ ID NO: 8546530 - DNA, 22 bp, Homo sapiens
tagctgtcaccagaaatggcca

SEQ ID NO: 8546531 - DNA, 22 bp, Homo sapiens
tagctgtcagcaatcaagtggt

SEQ ID NO: 8546532 - DNA, 22 bp, Homo sapiens
tagctgtcagcaatcaagtggt

SEQ ID NO: 8546533 - DNA, 22 bp, Homo sapiens
tagctgggagtgtctgatgggt

SEQ ID NO: 8546534 - DNA, 22 bp, Homo sapiens
tagctgggactactggccctgc

SEQ ID NO: 8546535 - DNA, 22 bp, Homo sapiens
tagctggtctttaagcatgtaa

SEQ ID NO: 8546536 - DNA, 22 bp, Homo sapiens
taggcagctgcaaacttcggtc

SEQ ID NO: 8546537 - DNA, 22 bp, Homo sapiens
taggcagatgttaacaggaaaa

SEQ ID NO: 8546538 - DNA, 22 bp, Homo sapiens
taggcagatgttaacaggaaaa

SEQ ID NO: 8546539 - DNA, 22 bp, Homo sapiens
taggcagaggtatggtaaggac

SEQ ID NO: 8546540 - DNA, 21 bp, Homo sapiens
taggcagaggagcaggtatct

SEQ ID NO: 8546541 - DNA, 23 bp, Homo sapiens
taggccagggtgacctggggaga

SEQ ID NO: 8546542 - DNA, 22 bp, Homo sapiens
taggccagtaaaatgtttcagt

SEQ ID NO: 8546543 - DNA, 22 bp, Homo sapiens
taggccagtggcaggttgtgtg

SEQ ID NO: 8546544 - DNA, 22 bp, Homo sapiens
taggccagtggcaggttgtgtg

SEQ ID NO: 8546545 - DNA, 23 bp, Homo sapiens
taggccagggtgacctggggaga

SEQ ID NO: 8546546 - DNA, 22 bp, Homo sapiens
taggccaggacagagcttccag

SEQ ID NO: 8546547 - DNA, 22 bp, Homo sapiens
taggccaggacagagcttccag

SEQ ID NO: 8546548 - DNA, 22 bp, Homo sapiens
taggccagcccttagtcctgtc

SEQ ID NO: 8546549 - DNA, 22 bp, Homo sapiens
taggccagcccttagtcctgtc

SEQ ID NO: 8546550 - DNA, 22 bp, Homo sapiens
tagttacagtgcatagcaagat

SEQ ID NO: 8546551 - DNA, 23 bp, Homo sapiens
tagttacattattgtcagagctg

SEQ ID NO: 8546552 - DNA, 22 bp, Homo sapiens
tagttaggaaagtccagggagc

SEQ ID NO: 8546553 - DNA, 22 bp, Homo sapiens
tagttaggaatagcagcgactc

SEQ ID NO: 8546554 - DNA, 22 bp, Homo sapiens
tagttagggttctgcagagaca

SEQ ID NO: 8546555 - DNA, 22 bp, Homo sapiens
tagttaggggaaaaacgacagg

SEQ ID NO: 8546556 - DNA, 22 bp, Homo sapiens
tagttcaggaagagaaacaaca

SEQ ID NO: 8546557 - DNA, 23 bp, Homo sapiens
tagttattttctctgtaatttgc

SEQ ID NO: 8546558 - DNA, 22 bp, Homo sapiens
tagttattattgttactatcag

SEQ ID NO: 8546559 - DNA, 22 bp, Homo sapiens
tagttattattgttactatcag

SEQ ID NO: 8546560 - DNA, 22 bp, Homo sapiens
tagttgaagagatgaatgacca

SEQ ID NO: 8546561 - DNA, 22 bp, Homo sapiens
tagttgaagagatgaatgacca

SEQ ID NO: 8546562 - DNA, 22 bp, Homo sapiens
tagtttaatggtcaactaatga

SEQ ID NO: 8546563 - DNA, 22 bp, Homo sapiens
tagtttaatggtcaactaatga

SEQ ID NO: 8546564 - DNA, 22 bp, Homo sapiens
tagttgctaaaaagtgcctaac

SEQ ID NO: 8546565 - DNA, 22 bp, Homo sapiens
tagtttcatatgcaaaatagta

SEQ ID NO: 8546566 - DNA, 22 bp, Homo sapiens
tagtttatgctgctgcagtgag

SEQ ID NO: 8546567 - DNA, 22 bp, Homo sapiens
tagtttcctaggctgtattgtt

SEQ ID NO: 8546568 - DNA, 22 bp, Homo sapiens
tagtttcatctccaccctgccc

SEQ ID NO: 8546569 - DNA, 22 bp, Homo sapiens
tagtttatgattttttggaagg

SEQ ID NO: 8546570 - DNA, 22 bp, Homo sapiens
tagtttatgctgctgcagtgag

SEQ ID NO: 8546571 - DNA, 22 bp, Homo sapiens
tagtttatgattttttggaagg

SEQ ID NO: 8546572 - DNA, 18 bp, Homo sapiens
tagtttctaatggccttt

SEQ ID NO: 8546573 - DNA, 22 bp, Homo sapiens
tagtttctaaagcttcctaggt

SEQ ID NO: 8546574 - DNA, 22 bp, Homo sapiens
tagtttctaaagcttcctaggt

SEQ ID NO: 8546575 - DNA, 22 bp, Homo sapiens
tagtttctaaactgaactgtca

SEQ ID NO: 8546576 - DNA, 22 bp, Homo sapiens
tagttttataatgttaacatct

SEQ ID NO: 8546577 - DNA, 22 bp, Homo sapiens
tagttttataatgttaacatct

SEQ ID NO: 8546578 - DNA, 22 bp, Homo sapiens
tagttttataatgttaacatct

SEQ ID NO: 8546579 - DNA, 22 bp, Homo sapiens
tagttttatgaattggtataat

SEQ ID NO: 8546580 - DNA, 22 bp, Homo sapiens
tagtttttaagtgtacaatttc

SEQ ID NO: 8546581 - DNA, 22 bp, Homo sapiens
tagtttttaagtgtacaatttc

SEQ ID NO: 8546582 - DNA, 22 bp, Homo sapiens
tagttttatgaattggtataat

SEQ ID NO: 8546583 - DNA, 22 bp, Homo sapiens
tagttttatgaattggtataat

SEQ ID NO: 8546584 - DNA, 22 bp, Homo sapiens
tagttacagcaggcaggatata

SEQ ID NO: 8546585 - DNA, 22 bp, Homo sapiens
tagtggaggggatgcaaagctt

SEQ ID NO: 8546586 - DNA, 22 bp, Homo sapiens
tagtggaggtggtctgtgaact

SEQ ID NO: 8546587 - DNA, 22 bp, Homo sapiens
tagtgcttaacacaaagtgatt

SEQ ID NO: 8546588 - DNA, 22 bp, Homo sapiens
tagtgcttaataaatttcagaa

SEQ ID NO: 8546589 - DNA, 22 bp, Homo sapiens
tagtgcttaataaatttcagaa

SEQ ID NO: 8546590 - DNA, 22 bp, Homo sapiens
tagtgcttaaaagtggaagaga

SEQ ID NO: 8546591 - DNA, 22 bp, Homo sapiens
tagtgcttattactgtgctgtc

SEQ ID NO: 8546592 - DNA, 22 bp, Homo sapiens
tagtgcttgagtctctccgtac

SEQ ID NO: 8546593 - DNA, 22 bp, Homo sapiens
tagtgcttctaccctaggcagg

SEQ ID NO: 8546594 - DNA, 22 bp, Homo sapiens
tagtgcttggtggagatggaga

SEQ ID NO: 8546595 - DNA, 22 bp, Homo sapiens
tagtgcttggccctaccagata

SEQ ID NO: 8546596 - DNA, 22 bp, Homo sapiens
tagtgcttggccctaccagata

SEQ ID NO: 8546597 - DNA, 22 bp, Homo sapiens
tagtgcttgagtctctccgtac

SEQ ID NO: 8546598 - DNA, 22 bp, Homo sapiens
tagtgctttaggcctgagtgtc

SEQ ID NO: 8546599 - DNA, 22 bp, Homo sapiens
tagtgctttaagtttacagaga

SEQ ID NO: 8546600 - DNA, 22 bp, Homo sapiens
tagtgctttattgttcctgaaa

SEQ ID NO: 8546601 - DNA, 22 bp, Homo sapiens
tagtgctttaggcctgagtgtc

SEQ ID NO: 8546602 - DNA, 22 bp, Homo sapiens
tagtgctttggagctttctcct

SEQ ID NO: 8546603 - DNA, 18 bp, Homo sapiens
tagtggaactgctctggg

SEQ ID NO: 8546604 - DNA, 21 bp, Homo sapiens
tagggggcagtgggatgctta

SEQ ID NO: 8546605 - DNA, 21 bp, Homo sapiens
tagggggcagtgggatgctta

SEQ ID NO: 8546606 - DNA, 22 bp, Homo sapiens
taggggcttgtaatttaataga

SEQ ID NO: 8546607 - DNA, 22 bp, Homo sapiens
tagggggctttgctgcttgaca

SEQ ID NO: 8546608 - DNA, 22 bp, Homo sapiens
tagggggctgtcctgtgcatta

SEQ ID NO: 8546609 - DNA, 22 bp, Homo sapiens
taggggctcagaacatgtcctt

SEQ ID NO: 8546610 - DNA, 22 bp, Homo sapiens
taggggctcagaacatgtcctt

SEQ ID NO: 8546611 - DNA, 23 bp, Homo sapiens
taggggctggcgtggagcctgcg

SEQ ID NO: 8546612 - DNA, 21 bp, Homo sapiens
taggggctggggctccagctg

SEQ ID NO: 8546613 - DNA, 22 bp, Homo sapiens
taggggaggggatcatgtgctg

SEQ ID NO: 8546614 - DNA, 22 bp, Homo sapiens
taggggaggggatcatgtgctg

SEQ ID NO: 8546615 - DNA, 22 bp, Homo sapiens
taggggagctcgggtgcaatcg

SEQ ID NO: 8546616 - DNA, 23 bp, Homo sapiens
taggggaaaaatcttctgcaatt

SEQ ID NO: 8546617 - DNA, 22 bp, Homo sapiens
tagtgcatacctaacatttttg

SEQ ID NO: 8546618 - DNA, 22 bp, Homo sapiens
tagtgcataacatttaaaggtc

SEQ ID NO: 8546619 - DNA, 22 bp, Homo sapiens
tagtgcagggttttaagcactg

SEQ ID NO: 8546620 - DNA, 22 bp, Homo sapiens
tagtgcacacgcatgtagcagt

SEQ ID NO: 8546621 - DNA, 22 bp, Homo sapiens
tagggggctttgctgcttgaca

SEQ ID NO: 8546622 - DNA, 22 bp, Homo sapiens
tagatacatacattttaaaatg

SEQ ID NO: 8546623 - DNA, 22 bp, Homo sapiens
tagagtggttaacagtttagaa

SEQ ID NO: 8546624 - DNA, 22 bp, Homo sapiens
tagagtctagtgtatacaaagt

SEQ ID NO: 8546625 - DNA, 22 bp, Homo sapiens
tagagtccttcattctgtgcag

SEQ ID NO: 8546626 - DNA, 23 bp, Homo sapiens
tagatactgcatataggtggaat

SEQ ID NO: 8546627 - DNA, 22 bp, Homo sapiens
tagatacttataatcttccaag

SEQ ID NO: 8546628 - DNA, 22 bp, Homo sapiens
tagatcattagcgggggtgaga

SEQ ID NO: 8546629 - DNA, 22 bp, Homo sapiens
tagatcatttgaattgaggtag

SEQ ID NO: 8546630 - DNA, 20 bp, Homo sapiens
tagatccgcagtaaaacttt

SEQ ID NO: 8546631 - DNA, 22 bp, Homo sapiens
tagatcctgagccctatctact

SEQ ID NO: 8546632 - DNA, 22 bp, Homo sapiens
tagatcatgggtactgcatatg

SEQ ID NO: 8546633 - DNA, 21 bp, Homo sapiens
tagatcatggtattctttggc

SEQ ID NO: 8546634 - DNA, 21 bp, Homo sapiens
tagatcatggtattctttggc

SEQ ID NO: 8546635 - DNA, 22 bp, Homo sapiens
tagatcatgggtactgcatatg

SEQ ID NO: 8546636 - DNA, 22 bp, Homo sapiens
tagatcatggagtaaaatggaa

SEQ ID NO: 8546637 - DNA, 22 bp, Homo sapiens
tagatcaggctgcttagataga

SEQ ID NO: 8546638 - DNA, 22 bp, Homo sapiens
tagatcaagaatgtccacttgt

SEQ ID NO: 8546639 - DNA, 22 bp, Homo sapiens
tagatcatggagtaaaatggaa

SEQ ID NO: 8546640 - DNA, 22 bp, Homo sapiens
tagatcatatttgtggagaaaa

SEQ ID NO: 8546641 - DNA, 22 bp, Homo sapiens
tagatcatcagtgggctcttat

SEQ ID NO: 8546642 - DNA, 22 bp, Homo sapiens
tagatcatatttgtggagaaaa

SEQ ID NO: 8546643 - DNA, 22 bp, Homo sapiens
tagatcataaatactatggtgc

SEQ ID NO: 8546644 - DNA, 22 bp, Homo sapiens
tagatcatatacttgccatgac

SEQ ID NO: 8546645 - DNA, 22 bp, Homo sapiens
tagatatatctgtcatactggt

SEQ ID NO: 8546646 - DNA, 22 bp, Homo sapiens
tagatataaggtccttagaaca

SEQ ID NO: 8546647 - DNA, 22 bp, Homo sapiens
tagatataaggtccttagaaca

SEQ ID NO: 8546648 - DNA, 22 bp, Homo sapiens
tagatataaggtccttagaaca

SEQ ID NO: 8546649 - DNA, 22 bp, Homo sapiens
tagatataaggtccttagaaca

SEQ ID NO: 8546650 - DNA, 22 bp, Homo sapiens
tagagagagctgtggtggctct

SEQ ID NO: 8546651 - DNA, 22 bp, Homo sapiens
tagagaatggccttgaagtagt

SEQ ID NO: 8546652 - DNA, 22 bp, Homo sapiens
tagagaggccgcgggtcccctc

SEQ ID NO: 8546653 - DNA, 16 bp, Homo sapiens
tagagagggcagggag

SEQ ID NO: 8546654 - DNA, 22 bp, Homo sapiens
tagagaggtttgaattggctgc

SEQ ID NO: 8546655 - DNA, 22 bp, Homo sapiens
tagagtcagagaatcattacag

SEQ ID NO: 8546656 - DNA, 22 bp, Homo sapiens
tagagtcagagaatcattacag

SEQ ID NO: 8546657 - DNA, 22 bp, Homo sapiens
tagagtatataggcctttgtgt

SEQ ID NO: 8546658 - DNA, 22 bp, Homo sapiens
tagagtatagctaactgtatta

SEQ ID NO: 8546659 - DNA, 22 bp, Homo sapiens
tagagaaataagctttgccttg

SEQ ID NO: 8546660 - DNA, 22 bp, Homo sapiens
tagagaaaagcagggatcagga

SEQ ID NO: 8546661 - DNA, 22 bp, Homo sapiens
tagagaaaagcagggatcagga

SEQ ID NO: 8546662 - DNA, 19 bp, Homo sapiens
tagacttttccagcaggca

SEQ ID NO: 8546663 - DNA, 22 bp, Homo sapiens
tagacttttaagtccctcttta

SEQ ID NO: 8546664 - DNA, 22 bp, Homo sapiens
tagacttttcaaaatctagacc

SEQ ID NO: 8546665 - DNA, 21 bp, Homo sapiens
tagagaaaagaagctgttcct

SEQ ID NO: 8546666 - DNA, 22 bp, Homo sapiens
tagacaggaaacattaggatgg

SEQ ID NO: 8546667 - DNA, 22 bp, Homo sapiens
tagacagatttcttgttagaca

SEQ ID NO: 8546668 - DNA, 22 bp, Homo sapiens
tagacagatttcttgttagaca

SEQ ID NO: 8546669 - DNA, 22 bp, Homo sapiens
tagacagatttcttgttagaca

SEQ ID NO: 8546670 - DNA, 22 bp, Homo sapiens
tagacaggagtcaggctagaat

SEQ ID NO: 8546671 - DNA, 22 bp, Homo sapiens
tagacaggaaacattaggatgg

SEQ ID NO: 8546672 - DNA, 22 bp, Homo sapiens
tagaccattttacaatagtgtg

SEQ ID NO: 8546673 - DNA, 22 bp, Homo sapiens
tagactggtgaattagggggaa

SEQ ID NO: 8546674 - DNA, 22 bp, Homo sapiens
tagactttactaaggctcattt

SEQ ID NO: 8546675 - DNA, 22 bp, Homo sapiens
tagactttccagcctgctgctt

SEQ ID NO: 8546676 - DNA, 22 bp, Homo sapiens
tagactggtgaattagggggaa

SEQ ID NO: 8546677 - DNA, 22 bp, Homo sapiens
tagactggtgaattagggggaa

SEQ ID NO: 8546678 - DNA, 22 bp, Homo sapiens
tagactatagctcacagtgctt

SEQ ID NO: 8546679 - DNA, 22 bp, Homo sapiens
tagactatttcttttgcatagg

SEQ ID NO: 8546680 - DNA, 22 bp, Homo sapiens
tagactatagctcacagtgctt

SEQ ID NO: 8546681 - DNA, 22 bp, Homo sapiens
tagaagaaagtgaagctgggga

SEQ ID NO: 8546682 - DNA, 22 bp, Homo sapiens
tagaagagacatagcctgtggt

SEQ ID NO: 8546683 - DNA, 22 bp, Homo sapiens
tagaagaacatgtcaaactata

SEQ ID NO: 8546684 - DNA, 22 bp, Homo sapiens
tagaagattcatttcctctgaa

SEQ ID NO: 8546685 - DNA, 22 bp, Homo sapiens
tagaagatcttaaaagctgact

SEQ ID NO: 8546686 - DNA, 22 bp, Homo sapiens
tagaagattctaaagtggagag

SEQ ID NO: 8546687 - DNA, 23 bp, Homo sapiens
tagaacatcggtgtcttggagca

SEQ ID NO: 8546688 - DNA, 22 bp, Homo sapiens
tagaacatgggatagagttttt

SEQ ID NO: 8546689 - DNA, 22 bp, Homo sapiens
tagaacatgctcatgtataaat

SEQ ID NO: 8546690 - DNA, 22 bp, Homo sapiens
tagaacatgtgaaaatatagcc

SEQ ID NO: 8546691 - DNA, 22 bp, Homo sapiens
tacttacattagcaaacaaggt

SEQ ID NO: 8546692 - DNA, 22 bp, Homo sapiens
tagaacttcttacagctaagtt

SEQ ID NO: 8546693 - DNA, 22 bp, Homo sapiens
tagaacttagcactagacttgt

SEQ ID NO: 8546694 - DNA, 22 bp, Homo sapiens
tagaactaaagaacaactttga

SEQ ID NO: 8546695 - DNA, 22 bp, Homo sapiens
tagaactctggtcttctcatcc

SEQ ID NO: 8546696 - DNA, 22 bp, Homo sapiens
tagaactagaacaaggatttga

SEQ ID NO: 8546697 - DNA, 22 bp, Homo sapiens
tagaactagaacaaggatttga

SEQ ID NO: 8546698 - DNA, 21 bp, Homo sapiens
tagcaggatttggtttatttt

SEQ ID NO: 8546699 - DNA, 22 bp, Homo sapiens
tagcaggaggcagttcctcgct

SEQ ID NO: 8546700 - DNA, 21 bp, Homo sapiens
tagcaggaggcccctgcttgc

SEQ ID NO: 8546701 - DNA, 21 bp, Homo sapiens
tagcaggagcgaattttgatg

SEQ ID NO: 8546702 - DNA, 22 bp, Homo sapiens
tagcagggccaggctgggaacc

SEQ ID NO: 8546703 - DNA, 22 bp, Homo sapiens
tagcagggccaggctgggaacc

SEQ ID NO: 8546704 - DNA, 22 bp, Homo sapiens
tagcagggatacaaggtcgcct

SEQ ID NO: 8546705 - DNA, 22 bp, Homo sapiens
tagcagggagggccagtgtcaa

SEQ ID NO: 8546706 - DNA, 22 bp, Homo sapiens
tagcagggatacaaggtcgcct

SEQ ID NO: 8546707 - DNA, 22 bp, Homo sapiens
tagcagggaagatgatcagaat

SEQ ID NO: 8546708 - DNA, 22 bp, Homo sapiens
tagcagggaaggtgtgctgagc

SEQ ID NO: 8546709 - DNA, 22 bp, Homo sapiens
tagcagggagggccagtgtcaa

SEQ ID NO: 8546710 - DNA, 22 bp, Homo sapiens
tagcagcttccagagagggcag

SEQ ID NO: 8546711 - DNA, 22 bp, Homo sapiens
tagcaggaaacctgtgttgagg

SEQ ID NO: 8546712 - DNA, 22 bp, Homo sapiens
tagctgcctttgggctcctgct

SEQ ID NO: 8546713 - DNA, 22 bp, Homo sapiens
tagctgcctttgggctcctgct

SEQ ID NO: 8546714 - DNA, 19 bp, Homo sapiens
tagctgcctgttacctcca

SEQ ID NO: 8546715 - DNA, 22 bp, Homo sapiens
tagctgcctatgtgataagaga

SEQ ID NO: 8546716 - DNA, 22 bp, Homo sapiens
tagctgccagaccattcttact

SEQ ID NO: 8546717 - DNA, 22 bp, Homo sapiens
tagctgccattgctccaggaag

SEQ ID NO: 8546718 - DNA, 22 bp, Homo sapiens
tagctgccattgctccaggaag

SEQ ID NO: 8546719 - DNA, 22 bp, Homo sapiens
tagctgcctagacagctatagc

SEQ ID NO: 8546720 - DNA, 22 bp, Homo sapiens
tagctgcccatctttcctttag

SEQ ID NO: 8546721 - DNA, 17 bp, Homo sapiens
tagctgccccgaatgct

SEQ ID NO: 8546722 - DNA, 22 bp, Homo sapiens
tagctgctgcagcacagggagg

SEQ ID NO: 8546723 - DNA, 22 bp, Homo sapiens
tagctggcttatataaaagggc

SEQ ID NO: 8546724 - DNA, 22 bp, Homo sapiens
tagcagggttttgaagagggtt

SEQ ID NO: 8546725 - DNA, 22 bp, Homo sapiens
tagcagggtctcaggagtcagg

SEQ ID NO: 8546726 - DNA, 22 bp, Homo sapiens
tagctgacgctaaataaatgtt

SEQ ID NO: 8546727 - DNA, 22 bp, Homo sapiens
tagcagggtctcaggagtcagg

SEQ ID NO: 8546728 - DNA, 22 bp, Homo sapiens
tagcagggtctcaggagtcagg

SEQ ID NO: 8546729 - DNA, 22 bp, Homo sapiens
tagctgccaaaagggtgggcta

SEQ ID NO: 8546730 - DNA, 22 bp, Homo sapiens
tagcagggtccaatgtgaggca

SEQ ID NO: 8546731 - DNA, 22 bp, Homo sapiens
tagcagggtctcaggagtcagg

SEQ ID NO: 8546732 - DNA, 22 bp, Homo sapiens
tagcagggtccaatgtgaggca

SEQ ID NO: 8546733 - DNA, 22 bp, Homo sapiens
tagcagggtccaatgtgaggca

SEQ ID NO: 8546734 - DNA, 22 bp, Homo sapiens
tagcagggtccaatgtgaggca

SEQ ID NO: 8546735 - DNA, 22 bp, Homo sapiens
tagcaggggtagatagagtgtg

SEQ ID NO: 8546736 - DNA, 22 bp, Homo sapiens
tagcaggggtagatagagtgtg

SEQ ID NO: 8546737 - DNA, 22 bp, Homo sapiens
tagcagggtaaatgtagatgga

SEQ ID NO: 8546738 - DNA, 22 bp, Homo sapiens
tagcaaaatgtggatgtagttg

SEQ ID NO: 8546739 - DNA, 22 bp, Homo sapiens
tagcaaagaacctgatacccca

SEQ ID NO: 8546740 - DNA, 22 bp, Homo sapiens
tagcaaagaagatattattgca

SEQ ID NO: 8546741 - DNA, 22 bp, Homo sapiens
tagcaaagctccgtagttattt

SEQ ID NO: 8546742 - DNA, 21 bp, Homo sapiens
tagcaaagccagatgtatatt

SEQ ID NO: 8546743 - DNA, 22 bp, Homo sapiens
tagcaaagaccaaagctagttg

SEQ ID NO: 8546744 - DNA, 22 bp, Homo sapiens
tagcaaagaggagacctaggca

SEQ ID NO: 8546745 - DNA, 18 bp, Homo sapiens
tagcaaagatgtggattg

SEQ ID NO: 8546746 - DNA, 22 bp, Homo sapiens
tagatctgatacaattcatctg

SEQ ID NO: 8546747 - DNA, 22 bp, Homo sapiens
tagatctgatacaattcatctg

SEQ ID NO: 8546748 - DNA, 22 bp, Homo sapiens
tagatctgatacaattcatctg

SEQ ID NO: 8546749 - DNA, 20 bp, Homo sapiens
tagatcctggggatttattg

SEQ ID NO: 8546750 - DNA, 22 bp, Homo sapiens
tagatgaaggggttcagcatgg

SEQ ID NO: 8546751 - DNA, 22 bp, Homo sapiens
tagatgaattagcaattatctt

SEQ ID NO: 8546752 - DNA, 22 bp, Homo sapiens
tagatgaccttgtgttaggcaa

SEQ ID NO: 8546753 - DNA, 22 bp, Homo sapiens
tagcaacaagtgactatctata

SEQ ID NO: 8546754 - DNA, 22 bp, Homo sapiens
tagcaacaagtgactatctata

SEQ ID NO: 8546755 - DNA, 21 bp, Homo sapiens
tagcaaattgctattaaggca

SEQ ID NO: 8546756 - DNA, 22 bp, Homo sapiens
tagcaacataagaaacattttg

SEQ ID NO: 8546757 - DNA, 22 bp, Homo sapiens
tagcaacaatggaagtaacttc

SEQ ID NO: 8546758 - DNA, 22 bp, Homo sapiens
tagcaacaatggaagtaacttc

SEQ ID NO: 8546759 - DNA, 22 bp, Homo sapiens
tagcaacctatggatagagaag

SEQ ID NO: 8546760 - DNA, 22 bp, Homo sapiens
tagcaacggtatgcaatctgtc

SEQ ID NO: 8546761 - DNA, 22 bp, Homo sapiens
tagcaacgtgtataaactcaag

SEQ ID NO: 8546762 - DNA, 22 bp, Homo sapiens
tagcaacatggttatcacatta

SEQ ID NO: 8546763 - DNA, 22 bp, Homo sapiens
tagcaaccagaacagcactcta

SEQ ID NO: 8546764 - DNA, 22 bp, Homo sapiens
tagcaaaggatgactatgtacc

SEQ ID NO: 8546765 - DNA, 22 bp, Homo sapiens
tagcaaaggatgactatgtacc

SEQ ID NO: 8546766 - DNA, 22 bp, Homo sapiens
tagcaaaggccttggacacgct

SEQ ID NO: 8546767 - DNA, 23 bp, Homo sapiens
tagcaaagttgtttgggaaattt

SEQ ID NO: 8546768 - DNA, 22 bp, Homo sapiens
tagcaaagggaaagaagggcct

SEQ ID NO: 8546769 - DNA, 22 bp, Homo sapiens
tagcaaagttttgtggtgatta

SEQ ID NO: 8546770 - DNA, 21 bp, Homo sapiens
tagcaaatggagagtaagaga

SEQ ID NO: 8546771 - DNA, 22 bp, Homo sapiens
tagcaaatacatgatgtaattt

SEQ ID NO: 8546772 - DNA, 22 bp, Homo sapiens
taaggaaagtgccatgatttct

SEQ ID NO: 8546773 - DNA, 22 bp, Homo sapiens
taaggaagagcttggtaatagg

SEQ ID NO: 8546774 - DNA, 22 bp, Homo sapiens
taaggaaggggaaagacatgtc

SEQ ID NO: 8546775 - DNA, 22 bp, Homo sapiens
taaggaagtcacaagaatcgct

SEQ ID NO: 8546776 - DNA, 22 bp, Homo sapiens
taaggaaacaacttgtattttt

SEQ ID NO: 8546777 - DNA, 22 bp, Homo sapiens
taaggaaagtacatgttttgac

SEQ ID NO: 8546778 - DNA, 22 bp, Homo sapiens
taaggaaagtacatgttttgac

SEQ ID NO: 8546779 - DNA, 22 bp, Homo sapiens
taaggaaaatggacatcaaaca

SEQ ID NO: 8546780 - DNA, 22 bp, Homo sapiens
taaggaaacaacttgtattttt

SEQ ID NO: 8546781 - DNA, 22 bp, Homo sapiens
taaggaaacaacttgtattttt

SEQ ID NO: 8546782 - DNA, 22 bp, Homo sapiens
taagcattatggtaaagaagta

SEQ ID NO: 8546783 - DNA, 22 bp, Homo sapiens
taagcattaactctgctgcaag

SEQ ID NO: 8546784 - DNA, 22 bp, Homo sapiens
taagcattatggtaaagaagta

SEQ ID NO: 8546785 - DNA, 22 bp, Homo sapiens
taagcatggtggtaaaagaggt

SEQ ID NO: 8546786 - DNA, 22 bp, Homo sapiens
taagcattgtttctgaggatgg

SEQ ID NO: 8546787 - DNA, 22 bp, Homo sapiens
taagcattcaatgcttagcact

SEQ ID NO: 8546788 - DNA, 22 bp, Homo sapiens
taagctaacgtccatggaaatg

SEQ ID NO: 8546789 - DNA, 22 bp, Homo sapiens
taagctcactgtaagaactgat

SEQ ID NO: 8546790 - DNA, 21 bp, Homo sapiens
taagctaaacattcagttaac

SEQ ID NO: 8546791 - DNA, 22 bp, Homo sapiens
taagctattcctgaagaaggtt

SEQ ID NO: 8546792 - DNA, 22 bp, Homo sapiens
taagcctgcatgaaccatgaga

SEQ ID NO: 8546793 - DNA, 22 bp, Homo sapiens
taagcctgcatgaaccatgaga

SEQ ID NO: 8546794 - DNA, 22 bp, Homo sapiens
taagcctgcatgaaccatgaga

SEQ ID NO: 8546795 - DNA, 22 bp, Homo sapiens
taagctgtgggagattggcata

SEQ ID NO: 8546796 - DNA, 22 bp, Homo sapiens
taagcttcaaagaacatattgg

SEQ ID NO: 8546797 - DNA, 22 bp, Homo sapiens
taatagtcattgtataccttgg

SEQ ID NO: 8546798 - DNA, 22 bp, Homo sapiens
taaggaatgcttgaatgttcct

SEQ ID NO: 8546799 - DNA, 22 bp, Homo sapiens
taaggaatagtgctatgaaaaa

SEQ ID NO: 8546800 - DNA, 22 bp, Homo sapiens
taaggaatatcataagaagtag

SEQ ID NO: 8546801 - DNA, 22 bp, Homo sapiens
taaggaatatcataagaagtag

SEQ ID NO: 8546802 - DNA, 22 bp, Homo sapiens
taatatacttcccatagtttga

SEQ ID NO: 8546803 - DNA, 22 bp, Homo sapiens
taatatatacctttgttaggaa

SEQ ID NO: 8546804 - DNA, 21 bp, Homo sapiens
taatataggttcacaactagt

SEQ ID NO: 8546805 - DNA, 22 bp, Homo sapiens
taatatatacctttgttaggaa

SEQ ID NO: 8546806 - DNA, 22 bp, Homo sapiens
taatatatacctttgttaggaa

SEQ ID NO: 8546807 - DNA, 22 bp, Homo sapiens
taatatatacctttgttaggaa

SEQ ID NO: 8546808 - DNA, 22 bp, Homo sapiens
taatatacttcccatagtttga

SEQ ID NO: 8546809 - DNA, 22 bp, Homo sapiens
taatatacttcccatagtttga

SEQ ID NO: 8546810 - DNA, 22 bp, Homo sapiens
taatataccaaactgtaatttt

SEQ ID NO: 8546811 - DNA, 22 bp, Homo sapiens
taatataccaaactgtaatttt

SEQ ID NO: 8546812 - DNA, 22 bp, Homo sapiens
taatagttgtgactttgtaaag

SEQ ID NO: 8546813 - DNA, 19 bp, Homo sapiens
taatatacagacccatctg

SEQ ID NO: 8546814 - DNA, 22 bp, Homo sapiens
taattcatgggcccagtgatat

SEQ ID NO: 8546815 - DNA, 22 bp, Homo sapiens
taattcctagaaattattctca

SEQ ID NO: 8546816 - DNA, 22 bp, Homo sapiens
taattgaaatcatttcaattca

SEQ ID NO: 8546817 - DNA, 22 bp, Homo sapiens
taattcagctgaacaactgtgt

SEQ ID NO: 8546818 - DNA, 22 bp, Homo sapiens
taattcatgggcccagtgatat

SEQ ID NO: 8546819 - DNA, 22 bp, Homo sapiens
taattgaactaacatgcaaaca

SEQ ID NO: 8546820 - DNA, 22 bp, Homo sapiens
taattgcagaactttgggaggc

SEQ ID NO: 8546821 - DNA, 22 bp, Homo sapiens
taattgcagggagcctgggggc

SEQ ID NO: 8546822 - DNA, 22 bp, Homo sapiens
taatttacttgcaaataacaat

SEQ ID NO: 8546823 - DNA, 22 bp, Homo sapiens
taatttacttgcaaataacaat

SEQ ID NO: 8546824 - DNA, 22 bp, Homo sapiens
taatttatgatgcaaagaaaag

SEQ ID NO: 8546825 - DNA, 22 bp, Homo sapiens
taatttatgatgcaaagaaaag

SEQ ID NO: 8546826 - DNA, 22 bp, Homo sapiens
taatttatgatgcaaagaaaag

SEQ ID NO: 8546827 - DNA, 22 bp, Homo sapiens
taatttatatggaattgttgct

SEQ ID NO: 8546828 - DNA, 22 bp, Homo sapiens
taatttacttgcaaataacaat

SEQ ID NO: 8546829 - DNA, 22 bp, Homo sapiens
taattattatgacaacaattgc

SEQ ID NO: 8546830 - DNA, 22 bp, Homo sapiens
taattattatgacaacaattgc

SEQ ID NO: 8546831 - DNA, 22 bp, Homo sapiens
taattattatgacaacaattgc

SEQ ID NO: 8546832 - DNA, 22 bp, Homo sapiens
taattattctagtcacatagca

SEQ ID NO: 8546833 - DNA, 22 bp, Homo sapiens
taatcttagcaacctccagtgt

SEQ ID NO: 8546834 - DNA, 22 bp, Homo sapiens
taatctgtttcccaaggtgata

SEQ ID NO: 8546835 - DNA, 22 bp, Homo sapiens
taatgaacacagaatttcactt

SEQ ID NO: 8546836 - DNA, 22 bp, Homo sapiens
taatgaacaatatatcaatagc

SEQ ID NO: 8546837 - DNA, 22 bp, Homo sapiens
taatctgtaatttttgcaatag

SEQ ID NO: 8546838 - DNA, 22 bp, Homo sapiens
taatctgtaatttttgcaatag

SEQ ID NO: 8546839 - DNA, 22 bp, Homo sapiens
taatctgtattcctactttgca

SEQ ID NO: 8546840 - DNA, 22 bp, Homo sapiens
taatctgttgactaacttggga

SEQ ID NO: 8546841 - DNA, 22 bp, Homo sapiens
taatctgttgactaacttggga

SEQ ID NO: 8546842 - DNA, 22 bp, Homo sapiens
taatctgtgtaccttcatcgga

SEQ ID NO: 8546843 - DNA, 22 bp, Homo sapiens
taatctgttgttaatattgact

SEQ ID NO: 8546844 - DNA, 22 bp, Homo sapiens
taatctgttgttaatattgact

SEQ ID NO: 8546845 - DNA, 22 bp, Homo sapiens
taatatatttctgctaagctca

SEQ ID NO: 8546846 - DNA, 22 bp, Homo sapiens
taatatatttctgctaagctca

SEQ ID NO: 8546847 - DNA, 22 bp, Homo sapiens
taatatatttctgctaagctca

SEQ ID NO: 8546848 - DNA, 22 bp, Homo sapiens
taatccagggtattctagtttc

SEQ ID NO: 8546849 - DNA, 22 bp, Homo sapiens
taatccagggtattctagtttc

SEQ ID NO: 8546850 - DNA, 22 bp, Homo sapiens
taatcctgatcaattttagctt

SEQ ID NO: 8546851 - DNA, 22 bp, Homo sapiens
taatccgtacattattctgaac

SEQ ID NO: 8546852 - DNA, 22 bp, Homo sapiens
taatcctgcttcttctcccttt

SEQ ID NO: 8546853 - DNA, 22 bp, Homo sapiens
taatatctacttcatagagttt

SEQ ID NO: 8546854 - DNA, 22 bp, Homo sapiens
taatcctgtgctgtgtaagtac

SEQ ID NO: 8546855 - DNA, 22 bp, Homo sapiens
taatcctggtgagtttgaaaaa

SEQ ID NO: 8546856 - DNA, 22 bp, Homo sapiens
taatcctgtgctgtgtaagtac

SEQ ID NO: 8546857 - DNA, 22 bp, Homo sapiens
taatccttcttgtgttcattag

SEQ ID NO: 8546858 - DNA, 22 bp, Homo sapiens
taatcctttaggttaaaagagg

SEQ ID NO: 8546859 - DNA, 22 bp, Homo sapiens
taatctctagcccatgcaaaga

SEQ ID NO: 8546860 - DNA, 22 bp, Homo sapiens
taatctctttatgagaagaagg

SEQ ID NO: 8546861 - DNA, 22 bp, Homo sapiens
taatctctttatgagaagaagg

SEQ ID NO: 8546862 - DNA, 21 bp, Homo sapiens
tacaagaccggattcgggccc

SEQ ID NO: 8546863 - DNA, 22 bp, Homo sapiens
tacaagaatgtcttaaaagctc

SEQ ID NO: 8546864 - DNA, 22 bp, Homo sapiens
tacaagacgagggaagttcttt

SEQ ID NO: 8546865 - DNA, 22 bp, Homo sapiens
tacaagacgagggaagttcttt

SEQ ID NO: 8546866 - DNA, 21 bp, Homo sapiens
tacaagaccggattcgggccc

SEQ ID NO: 8546867 - DNA, 22 bp, Homo sapiens
tacaagagacaccagggaggct

SEQ ID NO: 8546868 - DNA, 22 bp, Homo sapiens
tacaagaatgtcttaaaagctc

SEQ ID NO: 8546869 - DNA, 22 bp, Homo sapiens
tacaagaatgtcttaaaagctc

SEQ ID NO: 8546870 - DNA, 22 bp, Homo sapiens
tacaagaagaggcagagctgga

SEQ ID NO: 8546871 - DNA, 22 bp, Homo sapiens
tacaagaaggaaaactagcaat

SEQ ID NO: 8546872 - DNA, 22 bp, Homo sapiens
tacaagatgacaggtgcatgat

SEQ ID NO: 8546873 - DNA, 22 bp, Homo sapiens
tacaagatgtactaaaaattat

SEQ ID NO: 8546874 - DNA, 21 bp, Homo sapiens
tacaagatagaggtaatatat

SEQ ID NO: 8546875 - DNA, 22 bp, Homo sapiens
tacaagataagaattggcaagg

SEQ ID NO: 8546876 - DNA, 22 bp, Homo sapiens
tacaagaggtatatagaaacag

SEQ ID NO: 8546877 - DNA, 22 bp, Homo sapiens
tacacaactgacaaccattctg

SEQ ID NO: 8546878 - DNA, 22 bp, Homo sapiens
tacacaactgacaaccattctg

SEQ ID NO: 8546879 - DNA, 22 bp, Homo sapiens
tacacaactgacaaccattctg

SEQ ID NO: 8546880 - DNA, 22 bp, Homo sapiens
tacaagattaaaacttatacca

SEQ ID NO: 8546881 - DNA, 22 bp, Homo sapiens
tacacaatgacttaagatgtca

SEQ ID NO: 8546882 - DNA, 22 bp, Homo sapiens
taatttatttcaactgccaagg

SEQ ID NO: 8546883 - DNA, 22 bp, Homo sapiens
taatttatttcaactgccaagg

SEQ ID NO: 8546884 - DNA, 22 bp, Homo sapiens
tacaacataacgggcattcagt

SEQ ID NO: 8546885 - DNA, 22 bp, Homo sapiens
tacaacataacgggcattcagt

SEQ ID NO: 8546886 - DNA, 22 bp, Homo sapiens
tacaacatgtggtcctttatga

SEQ ID NO: 8546887 - DNA, 21 bp, Homo sapiens
taatttattcagcacagtgtt

SEQ ID NO: 8546888 - DNA, 22 bp, Homo sapiens
tacaagaaactacatgaatgca

SEQ ID NO: 8546889 - DNA, 22 bp, Homo sapiens
tacaagaaactacatgaatgca

SEQ ID NO: 8546890 - DNA, 22 bp, Homo sapiens
tacaacttccagctttcagccc

SEQ ID NO: 8546891 - DNA, 22 bp, Homo sapiens
tacaagaaatttctgcatatat

SEQ ID NO: 8546892 - DNA, 22 bp, Homo sapiens
tacaagaaatttctgcatatat

SEQ ID NO: 8546893 - DNA, 22 bp, Homo sapiens
tacaactgtgtgaaggaatctg

SEQ ID NO: 8546894 - DNA, 22 bp, Homo sapiens
tacaactgcacatctgaatcac

SEQ ID NO: 8546895 - DNA, 22 bp, Homo sapiens
tacaaccagatcctctaagtca

SEQ ID NO: 8546896 - DNA, 22 bp, Homo sapiens
tacaaccatagacatatactag

SEQ ID NO: 8546897 - DNA, 22 bp, Homo sapiens
tacaacatttacgttaggctgt

SEQ ID NO: 8546898 - DNA, 22 bp, Homo sapiens
tacaacatttacgttaggctgt

SEQ ID NO: 8546899 - DNA, 20 bp, Homo sapiens
tacagaatgcaataaaatgg

SEQ ID NO: 8546900 - DNA, 20 bp, Homo sapiens
tacagaatgcaataaaatgg

SEQ ID NO: 8546901 - DNA, 22 bp, Homo sapiens
tacagaatgatgtgtttaaata

SEQ ID NO: 8546902 - DNA, 22 bp, Homo sapiens
tacagaatgatgtgtttaaata

SEQ ID NO: 8546903 - DNA, 22 bp, Homo sapiens
tacagaatctatgcttcacagt

SEQ ID NO: 8546904 - DNA, 22 bp, Homo sapiens
tacagaatgatgtgtttaaata

SEQ ID NO: 8546905 - DNA, 22 bp, Homo sapiens
tacagaatctatgcttcacagt

SEQ ID NO: 8546906 - DNA, 22 bp, Homo sapiens
tacagaatatagaagctggaag

SEQ ID NO: 8546907 - DNA, 22 bp, Homo sapiens
tacagaatatagaagctggaag

SEQ ID NO: 8546908 - DNA, 22 bp, Homo sapiens
tacagaatagaatagggacagg

SEQ ID NO: 8546909 - DNA, 22 bp, Homo sapiens
tacagaatatttctgccctgag

SEQ ID NO: 8546910 - DNA, 22 bp, Homo sapiens
tacagaatatttctgccctgag

SEQ ID NO: 8546911 - DNA, 22 bp, Homo sapiens
tacagaatagaatagggacagg

SEQ ID NO: 8546912 - DNA, 22 bp, Homo sapiens
tacagaataaagcgtgaagctt

SEQ ID NO: 8546913 - DNA, 22 bp, Homo sapiens
tacagaataaagcgtgaagctt

SEQ ID NO: 8546914 - DNA, 22 bp, Homo sapiens
tacacataggtctgaataaaaa

SEQ ID NO: 8546915 - DNA, 22 bp, Homo sapiens
tacagaataaagcgtgaagctt

SEQ ID NO: 8546916 - DNA, 22 bp, Homo sapiens
tacacatacattgcttacaagg

SEQ ID NO: 8546917 - DNA, 22 bp, Homo sapiens
tacacataggagggtaataaaa

SEQ ID NO: 8546918 - DNA, 22 bp, Homo sapiens
tacacataggagggtaataaaa

SEQ ID NO: 8546919 - DNA, 22 bp, Homo sapiens
tacagaattagattattagaga

SEQ ID NO: 8546920 - DNA, 22 bp, Homo sapiens
tacagaatgtgtatcattacca

SEQ ID NO: 8546921 - DNA, 22 bp, Homo sapiens
tacagaatgtgtatcattacca

SEQ ID NO: 8546922 - DNA, 21 bp, Homo sapiens
tacagaatgcgcttcagtctg

SEQ ID NO: 8546923 - DNA, 21 bp, Homo sapiens
tacagaatgcgcttcagtctg

SEQ ID NO: 8546924 - DNA, 21 bp, Homo sapiens
tacagaatgcgcttcagtctg

SEQ ID NO: 8546925 - DNA, 21 bp, Homo sapiens
tacagaatgcgcttcagtctg

SEQ ID NO: 8546926 - DNA, 22 bp, Homo sapiens
tacagaattagattattagaga

SEQ ID NO: 8546927 - DNA, 22 bp, Homo sapiens
tacagaattagattattagaga

SEQ ID NO: 8546928 - DNA, 22 bp, Homo sapiens
tacagaatgttatgaagcatag

SEQ ID NO: 8546929 - DNA, 22 bp, Homo sapiens
tacagaatgttatgaagcatag

SEQ ID NO: 8546930 - DNA, 22 bp, Homo sapiens
tacacacttactggagatgaag

SEQ ID NO: 8546931 - DNA, 22 bp, Homo sapiens
tacacacatgcatttgccttat

SEQ ID NO: 8546932 - DNA, 22 bp, Homo sapiens
tacacacatgcatttgccttat

SEQ ID NO: 8546933 - DNA, 22 bp, Homo sapiens
tacacacatgcatttgccttat

SEQ ID NO: 8546934 - DNA, 22 bp, Homo sapiens
tacacacatgcatttgccttat

SEQ ID NO: 8546935 - DNA, 22 bp, Homo sapiens
tacacacatgcatttgccttat

SEQ ID NO: 8546936 - DNA, 22 bp, Homo sapiens
tacacacatgcatttgccttat

SEQ ID NO: 8546937 - DNA, 22 bp, Homo sapiens
tacacacagaggccatgggatt

SEQ ID NO: 8546938 - DNA, 22 bp, Homo sapiens
tacacacatgcatttgccttat

SEQ ID NO: 8546939 - DNA, 22 bp, Homo sapiens
tacacacagaggccatgggatt

SEQ ID NO: 8546940 - DNA, 22 bp, Homo sapiens
tacacacagaggccatgggatt

SEQ ID NO: 8546941 - DNA, 22 bp, Homo sapiens
tacacacagaggccatgggatt

SEQ ID NO: 8546942 - DNA, 22 bp, Homo sapiens
tacacacagaggccatgggatt

SEQ ID NO: 8546943 - DNA, 22 bp, Homo sapiens
tacacacagaggccatgggatt

SEQ ID NO: 8546944 - DNA, 22 bp, Homo sapiens
tacacaattagttgcaaagtga

SEQ ID NO: 8546945 - DNA, 22 bp, Homo sapiens
tacacaattagttgcaaagtga

SEQ ID NO: 8546946 - DNA, 22 bp, Homo sapiens
tacacacagaggccatgggatt

SEQ ID NO: 8546947 - DNA, 22 bp, Homo sapiens
tacacaattctggatgcatgtc

SEQ ID NO: 8546948 - DNA, 22 bp, Homo sapiens
tacacagtagagtataatgcgt

SEQ ID NO: 8546949 - DNA, 22 bp, Homo sapiens
tacacagtagagtataatgcgt

SEQ ID NO: 8546950 - DNA, 22 bp, Homo sapiens
tacacagtatatgggatcacag

SEQ ID NO: 8546951 - DNA, 22 bp, Homo sapiens
tacacagtaaatggtaaataca

SEQ ID NO: 8546952 - DNA, 22 bp, Homo sapiens
tacacagtaaatggtaaataca

SEQ ID NO: 8546953 - DNA, 22 bp, Homo sapiens
tacacagaaattgtgtagggat

SEQ ID NO: 8546954 - DNA, 22 bp, Homo sapiens
tacacagaacctggtgtacagt

SEQ ID NO: 8546955 - DNA, 22 bp, Homo sapiens
tacacagaaattgtgtagggat

SEQ ID NO: 8546956 - DNA, 22 bp, Homo sapiens
tacacagaacctggtgtacagt

SEQ ID NO: 8546957 - DNA, 22 bp, Homo sapiens
tacacagaacctggtgtacagt

SEQ ID NO: 8546958 - DNA, 22 bp, Homo sapiens
tacacataaaatgctcatggta

SEQ ID NO: 8546959 - DNA, 22 bp, Homo sapiens
tacacagtgagtcctctctgcc

SEQ ID NO: 8546960 - DNA, 22 bp, Homo sapiens
tacacatacaccaatgtggtca

SEQ ID NO: 8546961 - DNA, 22 bp, Homo sapiens
tacacatacattgcttacaagg

SEQ ID NO: 8546962 - DNA, 22 bp, Homo sapiens
tacacatacattgcttacaagg

SEQ ID NO: 8546963 - DNA, 22 bp, Homo sapiens
tacacatacattgcttacaagg

SEQ ID NO: 8546964 - DNA, 20 bp, Homo sapiens
tacagtcagggcacaggcag

SEQ ID NO: 8546965 - DNA, 22 bp, Homo sapiens
tacagtcaagcataagaagtca

SEQ ID NO: 8546966 - DNA, 22 bp, Homo sapiens
tacagtcagagtgcctttctaa

SEQ ID NO: 8546967 - DNA, 21 bp, Homo sapiens
tacagtctcccctgttgtcca

SEQ ID NO: 8546968 - DNA, 18 bp, Homo sapiens
tacagtattttctcgcct

SEQ ID NO: 8546969 - DNA, 22 bp, Homo sapiens
tacagtatttgaagaatatgag

SEQ ID NO: 8546970 - DNA, 22 bp, Homo sapiens
tacagtcaacattgatgatgat

SEQ ID NO: 8546971 - DNA, 22 bp, Homo sapiens
tacagtcaatactaggaccata

SEQ ID NO: 8546972 - DNA, 22 bp, Homo sapiens
tacagtgactggactttgtcat

SEQ ID NO: 8546973 - DNA, 22 bp, Homo sapiens
tacagtgaggtggtttccttta

SEQ ID NO: 8546974 - DNA, 22 bp, Homo sapiens
tacagtgacctagaataaatac

SEQ ID NO: 8546975 - DNA, 22 bp, Homo sapiens
tacagtgactggactttgtcat

SEQ ID NO: 8546976 - DNA, 22 bp, Homo sapiens
tacagtgaggtggtttccttta

SEQ ID NO: 8546977 - DNA, 22 bp, Homo sapiens
tacagtgatagagagtagctat

SEQ ID NO: 8546978 - DNA, 22 bp, Homo sapiens
tacagtctttggaaagagatag

SEQ ID NO: 8546979 - DNA, 22 bp, Homo sapiens
tacagtgaatgaatggctgtgc

SEQ ID NO: 8546980 - DNA, 22 bp, Homo sapiens
tacagtgcttggtatctagtaa

SEQ ID NO: 8546981 - DNA, 22 bp, Homo sapiens
tacagtgatagagagtagctat

SEQ ID NO: 8546982 - DNA, 22 bp, Homo sapiens
tacagtgatttctactggtgtt

SEQ ID NO: 8546983 - DNA, 22 bp, Homo sapiens
tacagtgtatgtatttgtaggt

SEQ ID NO: 8546984 - DNA, 22 bp, Homo sapiens
tacagtgtccctttttcagaca

SEQ ID NO: 8546985 - DNA, 20 bp, Homo sapiens
tacagtgtatgtatttaggc

SEQ ID NO: 8546986 - DNA, 22 bp, Homo sapiens
tacagtggggagctcaggagag

SEQ ID NO: 8546987 - DNA, 22 bp, Homo sapiens
tacagaggctgggttttcaggg

SEQ ID NO: 8546988 - DNA, 22 bp, Homo sapiens
tacagaggcacatgcaattttc

SEQ ID NO: 8546989 - DNA, 22 bp, Homo sapiens
tacagagggattatctaagggt

SEQ ID NO: 8546990 - DNA, 22 bp, Homo sapiens
tacagaggctgggttttcaggg

SEQ ID NO: 8546991 - DNA, 22 bp, Homo sapiens
tacagagggattatctaagggt

SEQ ID NO: 8546992 - DNA, 22 bp, Homo sapiens
tacagaggggacatggaagaca

SEQ ID NO: 8546993 - DNA, 22 bp, Homo sapiens
tacagaggggacatggaagaca

SEQ ID NO: 8546994 - DNA, 22 bp, Homo sapiens
tacagagggtaattgatcaagg

SEQ ID NO: 8546995 - DNA, 22 bp, Homo sapiens
tacagagggtaattgatcaagg

SEQ ID NO: 8546996 - DNA, 22 bp, Homo sapiens
tacagtagtaagaatgccttat

SEQ ID NO: 8546997 - DNA, 22 bp, Homo sapiens
tacagtagtcgtcttattttga

SEQ ID NO: 8546998 - DNA, 22 bp, Homo sapiens
tacagtagtatcttcatttgtt

SEQ ID NO: 8546999 - DNA, 22 bp, Homo sapiens
tacagtaggattttcagggtct

SEQ ID NO: 8547000 - DNA, 22 bp, Homo sapiens
tacagtatggaaaatgtatagt

SEQ ID NO: 8547001 - DNA, 22 bp, Homo sapiens
tacagtatggaaaatgtatagt

SEQ ID NO: 8547002 - DNA, 22 bp, Homo sapiens
tacagtatatactgtgtgtaga

SEQ ID NO: 8547003 - DNA, 22 bp, Homo sapiens
tacagtagtcgtcttattttga

SEQ ID NO: 8547004 - DNA, 22 bp, Homo sapiens
tacagtatagaatgtgtattaa

SEQ ID NO: 8547005 - DNA, 22 bp, Homo sapiens
tacagtatcttctggcaagcat

SEQ ID NO: 8547006 - DNA, 22 bp, Homo sapiens
tacagtatcttctggcaagcat

SEQ ID NO: 8547007 - DNA, 22 bp, Homo sapiens
tacagtattatgagtgattgaa

SEQ ID NO: 8547008 - DNA, 22 bp, Homo sapiens
tacagtattatgagtgattgaa

SEQ ID NO: 8547009 - DNA, 22 bp, Homo sapiens
tacagtattactgtgttgtttt

SEQ ID NO: 8547010 - DNA, 22 bp, Homo sapiens
tacagtatggaaaatgtatagt

SEQ ID NO: 8547011 - DNA, 22 bp, Homo sapiens
tacagtatgttcttgaatttgg

SEQ ID NO: 8547012 - DNA, 22 bp, Homo sapiens
tacagaggaggtggttgggagt

SEQ ID NO: 8547013 - DNA, 22 bp, Homo sapiens
tacagaggaggggattttaata

SEQ ID NO: 8547014 - DNA, 22 bp, Homo sapiens
tacagaggcacatgcaattttc

SEQ ID NO: 8547015 - DNA, 22 bp, Homo sapiens
tacagaggaggtggttgggagt

SEQ ID NO: 8547016 - DNA, 22 bp, Homo sapiens
tacagaggagaccaaggctcag

SEQ ID NO: 8547017 - DNA, 22 bp, Homo sapiens
tacagaggaggggattttaata

SEQ ID NO: 8547018 - DNA, 22 bp, Homo sapiens
tacagaggagaccaaggctcag

SEQ ID NO: 8547019 - DNA, 22 bp, Homo sapiens
tacagaggagaccaaggctcag

SEQ ID NO: 8547020 - DNA, 22 bp, Homo sapiens
tacagagatttattgctaaggc

SEQ ID NO: 8547021 - DNA, 22 bp, Homo sapiens
tacagagatttattgctaaggc

SEQ ID NO: 8547022 - DNA, 22 bp, Homo sapiens
tacagagatgtgaaaagctcta

SEQ ID NO: 8547023 - DNA, 22 bp, Homo sapiens
tacagagatgccgaagagtgaa

SEQ ID NO: 8547024 - DNA, 22 bp, Homo sapiens
tacagagagtacagcatccaca

SEQ ID NO: 8547025 - DNA, 22 bp, Homo sapiens
tacagacagtttttcagatatt

SEQ ID NO: 8547026 - DNA, 18 bp, Homo sapiens
tacatgcataaatgaagc

SEQ ID NO: 8547027 - DNA, 22 bp, Homo sapiens
tacatgcatgatacaaagttgc

SEQ ID NO: 8547028 - DNA, 18 bp, Homo sapiens
tacatgcataaatgaagc

SEQ ID NO: 8547029 - DNA, 22 bp, Homo sapiens
tacatgaatttgagtcagagga

SEQ ID NO: 8547030 - DNA, 22 bp, Homo sapiens
tacatgaatttgagtcagagga

SEQ ID NO: 8547031 - DNA, 22 bp, Homo sapiens
tacatgacatttctttctgttc

SEQ ID NO: 8547032 - DNA, 21 bp, Homo sapiens
tacatgagtgtatgagcatat

SEQ ID NO: 8547033 - DNA, 22 bp, Homo sapiens
tacatgcaattaagagggtgaa

SEQ ID NO: 8547034 - DNA, 22 bp, Homo sapiens
tacatgcacatgaacatgtgtg

SEQ ID NO: 8547035 - DNA, 22 bp, Homo sapiens
tacagttaaaaagttcaatggt

SEQ ID NO: 8547036 - DNA, 22 bp, Homo sapiens
tacagttaaaaagttcaatggt

SEQ ID NO: 8547037 - DNA, 22 bp, Homo sapiens
tacatgaacaaaatagcagaaa

SEQ ID NO: 8547038 - DNA, 22 bp, Homo sapiens
tacatgaacaaaatagcagaaa

SEQ ID NO: 8547039 - DNA, 22 bp, Homo sapiens
tacatgaacaaaatagcagaaa

SEQ ID NO: 8547040 - DNA, 22 bp, Homo sapiens
tacatgaacaaaatagcagaaa

SEQ ID NO: 8547041 - DNA, 22 bp, Homo sapiens
tacagtgtgacatttctacaaa

SEQ ID NO: 8547042 - DNA, 22 bp, Homo sapiens
tacagtgtctggatatcaaagg

SEQ ID NO: 8547043 - DNA, 22 bp, Homo sapiens
tacatgaagttgtctaaactgg

SEQ ID NO: 8547044 - DNA, 22 bp, Homo sapiens
tacatgaatgtttcaatattgt

SEQ ID NO: 8547045 - DNA, 21 bp, Homo sapiens
tacatgaagctggtgtttgtc

SEQ ID NO: 8547046 - DNA, 22 bp, Homo sapiens
tacatgaagatgaatgtatggc

SEQ ID NO: 8547047 - DNA, 22 bp, Homo sapiens
tacatgaagaaaattaagcagt

SEQ ID NO: 8547048 - DNA, 22 bp, Homo sapiens
tacatgaacctttatgtgtgat

SEQ ID NO: 8547049 - DNA, 22 bp, Homo sapiens
tacatgctccactttctcctgt

SEQ ID NO: 8547050 - DNA, 22 bp, Homo sapiens
tacatgctccttatgagaatct

SEQ ID NO: 8547051 - DNA, 22 bp, Homo sapiens
tacatgctcagtaactttcagt

SEQ ID NO: 8547052 - DNA, 23 bp, Homo sapiens
tacatgctataatttcaccctca

SEQ ID NO: 8547053 - DNA, 22 bp, Homo sapiens
tacatgcatgtgtgtaaatata

SEQ ID NO: 8547054 - DNA, 22 bp, Homo sapiens
tacatgcattggatggcaatag

SEQ ID NO: 8547055 - DNA, 22 bp, Homo sapiens
tacatgcatgtcacagaatgaa

SEQ ID NO: 8547056 - DNA, 22 bp, Homo sapiens
tacatgctggtgactgtagaca

SEQ ID NO: 8547057 - DNA, 22 bp, Homo sapiens
tacatgcttctatatgtgaagt

SEQ ID NO: 8547058 - DNA, 22 bp, Homo sapiens
tacatggatgttatccttactg

SEQ ID NO: 8547059 - DNA, 22 bp, Homo sapiens
tacatggtggtggcacttgact

SEQ ID NO: 8547060 - DNA, 22 bp, Homo sapiens
tacatgtaagacatgagactct

SEQ ID NO: 8547061 - DNA, 22 bp, Homo sapiens
tacatgtaagacatgagactct

SEQ ID NO: 8547062 - DNA, 22 bp, Homo sapiens
taccaaagattaaatagcaaca

SEQ ID NO: 8547063 - DNA, 22 bp, Homo sapiens
taccaaggtagtggagacagaa

SEQ ID NO: 8547064 - DNA, 22 bp, Homo sapiens
taccaagtgtattatgctttgt

SEQ ID NO: 8547065 - DNA, 22 bp, Homo sapiens
tacatgtaattttcatagtaag

SEQ ID NO: 8547066 - DNA, 22 bp, Homo sapiens
tacatgtaggtgacattttaat

SEQ ID NO: 8547067 - DNA, 22 bp, Homo sapiens
tacatgtagttcactggtggca

SEQ ID NO: 8547068 - DNA, 22 bp, Homo sapiens
tacatgtaggtgacattttaat

SEQ ID NO: 8547069 - DNA, 22 bp, Homo sapiens
tacatgtatgtgttaatatctg

SEQ ID NO: 8547070 - DNA, 22 bp, Homo sapiens
taccactacatttgctaatggc

SEQ ID NO: 8547071 - DNA, 22 bp, Homo sapiens
taccactgctccctgcctgtga

SEQ ID NO: 8547072 - DNA, 22 bp, Homo sapiens
taccagcaatgtatgagtgttt

SEQ ID NO: 8547073 - DNA, 22 bp, Homo sapiens
taccacctcaacctcatctgac

SEQ ID NO: 8547074 - DNA, 22 bp, Homo sapiens
taccacagtctgccattagatg

SEQ ID NO: 8547075 - DNA, 19 bp, Homo sapiens
taccagcctcctgcctgat

SEQ ID NO: 8547076 - DNA, 22 bp, Homo sapiens
taccagcatcacagcatgttgg

SEQ ID NO: 8547077 - DNA, 22 bp, Homo sapiens
taccagcatcacagcatgttgg

SEQ ID NO: 8547078 - DNA, 22 bp, Homo sapiens
taccagctcacacaatctttgt

SEQ ID NO: 8547079 - DNA, 15 bp, Homo sapiens
taccagctgatccgt

SEQ ID NO: 8547080 - DNA, 22 bp, Homo sapiens
taccagcttccttcaagatgtg

SEQ ID NO: 8547081 - DNA, 22 bp, Homo sapiens
taccaggcagctgcacagaggc

SEQ ID NO: 8547082 - DNA, 22 bp, Homo sapiens
taccaggaattattttacattt

SEQ ID NO: 8547083 - DNA, 22 bp, Homo sapiens
taccattgtaccaaggtaattt

SEQ ID NO: 8547084 - DNA, 22 bp, Homo sapiens
taccatgatgtttgagttacta

SEQ ID NO: 8547085 - DNA, 22 bp, Homo sapiens
taccatgatgtttgagttacta

SEQ ID NO: 8547086 - DNA, 22 bp, Homo sapiens
taccatttacttgaaaataaaa

SEQ ID NO: 8547087 - DNA, 22 bp, Homo sapiens
taccatttcagtaaaaacttag

SEQ ID NO: 8547088 - DNA, 22 bp, Homo sapiens
taccagtaatagtatgtgagat

SEQ ID NO: 8547089 - DNA, 22 bp, Homo sapiens
taccagggaacagggatattaa

SEQ ID NO: 8547090 - DNA, 22 bp, Homo sapiens
taccaggtctgtgcaggtgtca

SEQ ID NO: 8547091 - DNA, 22 bp, Homo sapiens
taccataacgtaatgaacttga

SEQ ID NO: 8547092 - DNA, 22 bp, Homo sapiens
taccagtaattgcttgtgctgt

SEQ ID NO: 8547093 - DNA, 22 bp, Homo sapiens
taccagtaatgtaactttgcaa

SEQ ID NO: 8547094 - DNA, 22 bp, Homo sapiens
taccatgatcaggctcatcctt

SEQ ID NO: 8547095 - DNA, 22 bp, Homo sapiens
tactataaagtcttaatgagtc

SEQ ID NO: 8547096 - DNA, 23 bp, Homo sapiens
tactataacgctgtgtcagctcc

SEQ ID NO: 8547097 - DNA, 22 bp, Homo sapiens
tactatactctccattttatag

SEQ ID NO: 8547098 - DNA, 22 bp, Homo sapiens
tactagaacctcacaacaatcc

SEQ ID NO: 8547099 - DNA, 22 bp, Homo sapiens
tactagtttctaccttacagaa

SEQ ID NO: 8547100 - DNA, 22 bp, Homo sapiens
tactaggcaattatgtaaataa

SEQ ID NO: 8547101 - DNA, 22 bp, Homo sapiens
tactaggaagcagctgcattgg

SEQ ID NO: 8547102 - DNA, 22 bp, Homo sapiens
tactagctaacattctcaccaa

SEQ ID NO: 8547103 - DNA, 22 bp, Homo sapiens
taccatttcattctttcctcat

SEQ ID NO: 8547104 - DNA, 22 bp, Homo sapiens
taccatttctacatatcttgtc

SEQ ID NO: 8547105 - DNA, 22 bp, Homo sapiens
taccatttgagagagaacataa

SEQ ID NO: 8547106 - DNA, 22 bp, Homo sapiens
taccatttgagagagaacataa

SEQ ID NO: 8547107 - DNA, 23 bp, Homo sapiens
tactacagggtcttgctatgaat

SEQ ID NO: 8547108 - DNA, 22 bp, Homo sapiens
taccattttgaaacatttcatc

SEQ ID NO: 8547109 - DNA, 22 bp, Homo sapiens
taccattttgaaacatttcatc

SEQ ID NO: 8547110 - DNA, 22 bp, Homo sapiens
tactacatacagaatttagaga

SEQ ID NO: 8547111 - DNA, 22 bp, Homo sapiens
tactacatacagaatttagaga

SEQ ID NO: 8547112 - DNA, 22 bp, Homo sapiens
tactacattaataaaacattca

SEQ ID NO: 8547113 - DNA, 22 bp, Homo sapiens
tactacagtatgtgtgttatac

SEQ ID NO: 8547114 - DNA, 21 bp, Homo sapiens
tactacagtctctttatcagt

SEQ ID NO: 8547115 - DNA, 22 bp, Homo sapiens
tactacatacagaatttagaga

SEQ ID NO: 8547116 - DNA, 22 bp, Homo sapiens
tactgtacattccgtttgttgc

SEQ ID NO: 8547117 - DNA, 22 bp, Homo sapiens
tactgaaagaatacataatttc

SEQ ID NO: 8547118 - DNA, 22 bp, Homo sapiens
tactgaaagaatacataatttc

SEQ ID NO: 8547119 - DNA, 22 bp, Homo sapiens
tactgtactgcagttctgcaaa

SEQ ID NO: 8547120 - DNA, 22 bp, Homo sapiens
tactgtactgtcttttttgctg

SEQ ID NO: 8547121 - DNA, 22 bp, Homo sapiens
tactgtactcaacatgtgagtt

SEQ ID NO: 8547122 - DNA, 22 bp, Homo sapiens
tactgtgtggtgagctgtctcc

SEQ ID NO: 8547123 - DNA, 22 bp, Homo sapiens
tactgtgtggtgagctgtctcc

SEQ ID NO: 8547124 - DNA, 22 bp, Homo sapiens
tactgttaatgttaaattcagg

SEQ ID NO: 8547125 - DNA, 22 bp, Homo sapiens
tactgtgttgtgctgaaaggga

SEQ ID NO: 8547126 - DNA, 22 bp, Homo sapiens
tactgtgtgcccagccgagctg

SEQ ID NO: 8547127 - DNA, 22 bp, Homo sapiens
tactgtgtgattccatttacgt

SEQ ID NO: 8547128 - DNA, 22 bp, Homo sapiens
tactgtgtgaccctgggtaggt

SEQ ID NO: 8547129 - DNA, 22 bp, Homo sapiens
tactgtgtcttaggatgtggaa

SEQ ID NO: 8547130 - DNA, 22 bp, Homo sapiens
tactgtgtcttaggatgtggaa

SEQ ID NO: 8547131 - DNA, 22 bp, Homo sapiens
tactgaaactcttgtaaatatc

SEQ ID NO: 8547132 - DNA, 22 bp, Homo sapiens
tactgaaactcttgtaaatatc

SEQ ID NO: 8547133 - DNA, 22 bp, Homo sapiens
tactcttttagccccacagaga

SEQ ID NO: 8547134 - DNA, 22 bp, Homo sapiens
tactccagacattctgtcctcg

SEQ ID NO: 8547135 - DNA, 22 bp, Homo sapiens
tactccaggactccatttgaaa

SEQ ID NO: 8547136 - DNA, 22 bp, Homo sapiens
tactcctgctgatcctgccagc

SEQ ID NO: 8547137 - DNA, 22 bp, Homo sapiens
tactccaggactccatttgaaa

SEQ ID NO: 8547138 - DNA, 22 bp, Homo sapiens
tactcctgctgatcctgccagc

SEQ ID NO: 8547139 - DNA, 22 bp, Homo sapiens
tactctcagggttagtacagga

SEQ ID NO: 8547140 - DNA, 22 bp, Homo sapiens
tactctctggaaattatagtga

SEQ ID NO: 8547141 - DNA, 22 bp, Homo sapiens
tactctcagggttagtacagga

SEQ ID NO: 8547142 - DNA, 22 bp, Homo sapiens
tactgttttttagactcatggt

SEQ ID NO: 8547143 - DNA, 22 bp, Homo sapiens
tactgttttctttatagtacag

SEQ ID NO: 8547144 - DNA, 22 bp, Homo sapiens
tactgtttcaagccctcacaga

SEQ ID NO: 8547145 - DNA, 20 bp, Homo sapiens
tactgttgttgctgttgcca

SEQ ID NO: 8547146 - DNA, 22 bp, Homo sapiens
tactgttatatatagcagcagt

SEQ ID NO: 8547147 - DNA, 22 bp, Homo sapiens
tactgttttctataatggctgt

SEQ ID NO: 8547148 - DNA, 22 bp, Homo sapiens
tactgttttctataatggctgt

SEQ ID NO: 8547149 - DNA, 22 bp, Homo sapiens
tacttaatgccactgaattgta

SEQ ID NO: 8547150 - DNA, 22 bp, Homo sapiens
tacttaaaactgatagaatctc

SEQ ID NO: 8547151 - DNA, 22 bp, Homo sapiens
tacttaaaactgatagaatctc

SEQ ID NO: 8547152 - DNA, 22 bp, Homo sapiens
tacttaaaaattatcaaagtgg

SEQ ID NO: 8547153 - DNA, 22 bp, Homo sapiens
tacttaaaactgatagaatctc

SEQ ID NO: 8547154 - DNA, 22 bp, Homo sapiens
tacttaaaactgatagaatctc

SEQ ID NO: 8547155 - DNA, 22 bp, Homo sapiens
tacttacacagctgtagaaggt

SEQ ID NO: 8547156 - DNA, 22 bp, Homo sapiens
tacttacactgaagcaaagata

SEQ ID NO: 8547157 - DNA, 22 bp, Homo sapiens
tacttaatgccactgaattgta

SEQ ID NO: 8547158 - DNA, 22 bp, Homo sapiens
tacttacagagcttataagtta

SEQ ID NO: 8547159 - DNA, 22 bp, Homo sapiens
tacttacagagcttataagtta

SEQ ID NO: 8547160 - DNA, 22 bp, Homo sapiens
tacttacataaaaactgaatgt

SEQ ID NO: 8547161 - DNA, 22 bp, Homo sapiens
taacagctggcgttataggaat

SEQ ID NO: 8547162 - DNA, 22 bp, Homo sapiens
taacagctggcgttataggaat

SEQ ID NO: 8547163 - DNA, 22 bp, Homo sapiens
taacaggctgatcatatatcct

SEQ ID NO: 8547164 - DNA, 22 bp, Homo sapiens
taacaggcaaggtcacaccttg

SEQ ID NO: 8547165 - DNA, 22 bp, Homo sapiens
taacagctctgtgtggctgtaa

SEQ ID NO: 8547166 - DNA, 22 bp, Homo sapiens
taacagctctgtgtggctgtaa

SEQ ID NO: 8547167 - DNA, 22 bp, Homo sapiens
taaatgttgtaagtacatctaa

SEQ ID NO: 8547168 - DNA, 22 bp, Homo sapiens
taaatgtgttagtcatggtttt

SEQ ID NO: 8547169 - DNA, 22 bp, Homo sapiens
taaatgtgtgtagccatctgtg

SEQ ID NO: 8547170 - DNA, 22 bp, Homo sapiens
taaatgtgtctatggacccgcc

SEQ ID NO: 8547171 - DNA, 22 bp, Homo sapiens
taaatgtgtctttttaaggcct

SEQ ID NO: 8547172 - DNA, 22 bp, Homo sapiens
taaatgtgtctttttaaggcct

SEQ ID NO: 8547173 - DNA, 22 bp, Homo sapiens
taaatgtgtaaacctccattac

SEQ ID NO: 8547174 - DNA, 22 bp, Homo sapiens
taaatgtgggggccacgggctt

SEQ ID NO: 8547175 - DNA, 22 bp, Homo sapiens
taaatgtgtaaacctccattac

SEQ ID NO: 8547176 - DNA, 22 bp, Homo sapiens
taaatgttatgcccatcatcca

SEQ ID NO: 8547177 - DNA, 22 bp, Homo sapiens
taaatgtgttgtggatgaagtt

SEQ ID NO: 8547178 - DNA, 22 bp, Homo sapiens
taaatgtggagactcaggagtc

SEQ ID NO: 8547179 - DNA, 22 bp, Homo sapiens
taaatgtgcactttacttttca

SEQ ID NO: 8547180 - DNA, 22 bp, Homo sapiens
taaatgtgcacaggttagaagg

SEQ ID NO: 8547181 - DNA, 22 bp, Homo sapiens
taaatgtgcactttacttttca

SEQ ID NO: 8547182 - DNA, 22 bp, Homo sapiens
taaatgctccatacatacacca

SEQ ID NO: 8547183 - DNA, 22 bp, Homo sapiens
taaatgctcagaccttattcca

SEQ ID NO: 8547184 - DNA, 22 bp, Homo sapiens
taaatgctcagaccttattcca

SEQ ID NO: 8547185 - DNA, 18 bp, Homo sapiens
taaatgcatgttaataac

SEQ ID NO: 8547186 - DNA, 22 bp, Homo sapiens
taaatgctatcgcataaaacct

SEQ ID NO: 8547187 - DNA, 22 bp, Homo sapiens
taacagtatccccatttgcaag

SEQ ID NO: 8547188 - DNA, 22 bp, Homo sapiens
taacagtattgaagataaacta

SEQ ID NO: 8547189 - DNA, 22 bp, Homo sapiens
taacagtatagcctaacatttc

SEQ ID NO: 8547190 - DNA, 22 bp, Homo sapiens
taacagtatatttaccaaacct

SEQ ID NO: 8547191 - DNA, 22 bp, Homo sapiens
taacagtattgaagataaacta

SEQ ID NO: 8547192 - DNA, 22 bp, Homo sapiens
taacagtattgaagataaacta

SEQ ID NO: 8547193 - DNA, 22 bp, Homo sapiens
taacagtgtggacttgagatct

SEQ ID NO: 8547194 - DNA, 22 bp, Homo sapiens
taacagtatagcctaacatttc

SEQ ID NO: 8547195 - DNA, 22 bp, Homo sapiens
taacagtatagcctaacatttc

SEQ ID NO: 8547196 - DNA, 22 bp, Homo sapiens
taacagtagccttatgtggtct

SEQ ID NO: 8547197 - DNA, 20 bp, Homo sapiens
taacagtaagtgatgttaca

SEQ ID NO: 8547198 - DNA, 20 bp, Homo sapiens
taacagtaagtgatgttaca

SEQ ID NO: 8547199 - DNA, 22 bp, Homo sapiens
taacagtacatccttttctctt

SEQ ID NO: 8547200 - DNA, 22 bp, Homo sapiens
taacagtaaagtaagttagctt

SEQ ID NO: 8547201 - DNA, 22 bp, Homo sapiens
taacatgagagctaagacatta

SEQ ID NO: 8547202 - DNA, 22 bp, Homo sapiens
taacatgagagctaagacatta

SEQ ID NO: 8547203 - DNA, 22 bp, Homo sapiens
taacatgagagctaagacatta

SEQ ID NO: 8547204 - DNA, 22 bp, Homo sapiens
taacatctttagcagctcgaac

SEQ ID NO: 8547205 - DNA, 22 bp, Homo sapiens
taacatgaaactccaaatggta

SEQ ID NO: 8547206 - DNA, 22 bp, Homo sapiens
taacatctttagcagctcgaac

SEQ ID NO: 8547207 - DNA, 22 bp, Homo sapiens
taacatcttgcagtagcagaac

SEQ ID NO: 8547208 - DNA, 22 bp, Homo sapiens
taacatcttaactggatacttc

SEQ ID NO: 8547209 - DNA, 22 bp, Homo sapiens
taacatcaaacatgttttaaag

SEQ ID NO: 8547210 - DNA, 22 bp, Homo sapiens
taacatcaaacatgttttaaag

SEQ ID NO: 8547211 - DNA, 22 bp, Homo sapiens
taacatcaaactgcattttcta

SEQ ID NO: 8547212 - DNA, 22 bp, Homo sapiens
taacatcaaactgcattttcta

SEQ ID NO: 8547213 - DNA, 18 bp, Homo sapiens
taacatcggctatgcatc

SEQ ID NO: 8547214 - DNA, 22 bp, Homo sapiens
taagacaattcttcagtcacaa

SEQ ID NO: 8547215 - DNA, 22 bp, Homo sapiens
taagacaattcttcagtcacaa

SEQ ID NO: 8547216 - DNA, 22 bp, Homo sapiens
taagacagggtctattcttagt

SEQ ID NO: 8547217 - DNA, 22 bp, Homo sapiens
taagacaattcttcagtcacaa

SEQ ID NO: 8547218 - DNA, 22 bp, Homo sapiens
taagacaaatactatttcaaga

SEQ ID NO: 8547219 - DNA, 18 bp, Homo sapiens
taacatgttttcattaag

SEQ ID NO: 8547220 - DNA, 22 bp, Homo sapiens
taacatgtttgtacactgaaac

SEQ ID NO: 8547221 - DNA, 22 bp, Homo sapiens
taacatgttcagactacctgtg

SEQ ID NO: 8547222 - DNA, 22 bp, Homo sapiens
taacatgttcagactacctgtg

SEQ ID NO: 8547223 - DNA, 22 bp, Homo sapiens
taacatgtgtattggtttccta

SEQ ID NO: 8547224 - DNA, 22 bp, Homo sapiens
taacatgttaagaaattagata

SEQ ID NO: 8547225 - DNA, 22 bp, Homo sapiens
taacatgctaatttgcagatag

SEQ ID NO: 8547226 - DNA, 22 bp, Homo sapiens
taagacataaataggcttttta

SEQ ID NO: 8547227 - DNA, 21 bp, Homo sapiens
taagacagtatgaatactttc

SEQ ID NO: 8547228 - DNA, 22 bp, Homo sapiens
taagacataccaagttgtgtga

SEQ ID NO: 8547229 - DNA, 22 bp, Homo sapiens
taagacatccgttgcttataat

SEQ ID NO: 8547230 - DNA, 22 bp, Homo sapiens
taagacatcctggatgttcaaa

SEQ ID NO: 8547231 - DNA, 22 bp, Homo sapiens
taagacatcctggatgttcaaa

SEQ ID NO: 8547232 - DNA, 22 bp, Homo sapiens
taagacatcctggatgttcaaa

SEQ ID NO: 8547233 - DNA, 22 bp, Homo sapiens
taagacatgagactcagccagt

SEQ ID NO: 8547234 - DNA, 22 bp, Homo sapiens
taagacatcctggatgttcaaa

SEQ ID NO: 8547235 - DNA, 22 bp, Homo sapiens
taagcatattccagtcatgtcc

SEQ ID NO: 8547236 - DNA, 21 bp, Homo sapiens
taagcatatcagatagactct

SEQ ID NO: 8547237 - DNA, 22 bp, Homo sapiens
taagcatattccagtcatgtcc

SEQ ID NO: 8547238 - DNA, 22 bp, Homo sapiens
taagcatggtggtaaaagaggt

SEQ ID NO: 8547239 - DNA, 21 bp, Homo sapiens
taagcatatcagatagactct

SEQ ID NO: 8547240 - DNA, 20 bp, Homo sapiens
taagcatagttgtcagggtc

SEQ ID NO: 8547241 - DNA, 22 bp, Homo sapiens
taagaggcaaaagatactcaga

SEQ ID NO: 8547242 - DNA, 22 bp, Homo sapiens
taagaggatatttggccagaag

SEQ ID NO: 8547243 - DNA, 22 bp, Homo sapiens
taagaggatatttggccagaag

SEQ ID NO: 8547244 - DNA, 22 bp, Homo sapiens
taagagctcccttctccttgca

SEQ ID NO: 8547245 - DNA, 22 bp, Homo sapiens
taagagctccaatatttgtggc

SEQ ID NO: 8547246 - DNA, 22 bp, Homo sapiens
taagagcagaggttgaataaat

SEQ ID NO: 8547247 - DNA, 22 bp, Homo sapiens
taagagcataggcttgaaaata

SEQ ID NO: 8547248 - DNA, 22 bp, Homo sapiens
taagagctaggattttaaatca

SEQ ID NO: 8547249 - DNA, 21 bp, Homo sapiens
taagagctattattgcaaacc

SEQ ID NO: 8547250 - DNA, 22 bp, Homo sapiens
taagagaatgttgtggctaggt

SEQ ID NO: 8547251 - DNA, 22 bp, Homo sapiens
taagagattctaaagctactgg

SEQ ID NO: 8547252 - DNA, 22 bp, Homo sapiens
taagagatggttatcaaaagca

SEQ ID NO: 8547253 - DNA, 22 bp, Homo sapiens
taagagatgcttttctaaataa

SEQ ID NO: 8547254 - DNA, 21 bp, Homo sapiens
taaaactgtaactttgtcctg

SEQ ID NO: 8547255 - DNA, 21 bp, Homo sapiens
taaaactgtaactttgtcctg

SEQ ID NO: 8547256 - DNA, 22 bp, Homo sapiens
taaaacttaactatccagatta

SEQ ID NO: 8547257 - DNA, 22 bp, Homo sapiens
taaaacttctcatttttatggt

SEQ ID NO: 8547258 - DNA, 22 bp, Homo sapiens
taaaacttctcatttttatggt

SEQ ID NO: 8547259 - DNA, 22 bp, Homo sapiens
taaaactttgaaggtgctcagt

SEQ ID NO: 8547260 - DNA, 22 bp, Homo sapiens
taaaacttctcatttttatggt

SEQ ID NO: 8547261 - DNA, 22 bp, Homo sapiens
taaaactgcttggtatggtcta

SEQ ID NO: 8547262 - DNA, 22 bp, Homo sapiens
taaaactgaatacatactgagg

SEQ ID NO: 8547263 - DNA, 22 bp, Homo sapiens
taaaactgaatacatactgagg

SEQ ID NO: 8547264 - DNA, 21 bp, Homo sapiens
gttttaagggagaaaacctag

SEQ ID NO: 8547265 - DNA, 21 bp, Homo sapiens
gttttaagggagaaaacctag

SEQ ID NO: 8547266 - DNA, 22 bp, Homo sapiens
taaaagaccctctagagtccca

SEQ ID NO: 8547267 - DNA, 22 bp, Homo sapiens
taaaagaccctctagagtccca

SEQ ID NO: 8547268 - DNA, 22 bp, Homo sapiens
taaaagagaatggataacagag

SEQ ID NO: 8547269 - DNA, 22 bp, Homo sapiens
taaaagacatataactgtagga

SEQ ID NO: 8547270 - DNA, 22 bp, Homo sapiens
taaaagacatataactgtagga

SEQ ID NO: 8547271 - DNA, 22 bp, Homo sapiens
taaaagatatcttagggatttg

SEQ ID NO: 8547272 - DNA, 22 bp, Homo sapiens
taaaagagaatggataacagag

SEQ ID NO: 8547273 - DNA, 21 bp, Homo sapiens
taaaagatgacaagacagctc

SEQ ID NO: 8547274 - DNA, 22 bp, Homo sapiens
taaaagtaggaatgaaacgcat

SEQ ID NO: 8547275 - DNA, 22 bp, Homo sapiens
taaaaggaggttgaagctgtca

SEQ ID NO: 8547276 - DNA, 22 bp, Homo sapiens
taaagacatgcaaagtctaatt

SEQ ID NO: 8547277 - DNA, 22 bp, Homo sapiens
taaaagtggataagctgtagga

SEQ ID NO: 8547278 - DNA, 22 bp, Homo sapiens
taaaagtggataagctgtagga

SEQ ID NO: 8547279 - DNA, 22 bp, Homo sapiens
taaaagtggataagctgtagga

SEQ ID NO: 8547280 - DNA, 22 bp, Homo sapiens
taaagacactggttttaatcat

SEQ ID NO: 8547281 - DNA, 22 bp, Homo sapiens
taaagcaaggaatagagtagtc

SEQ ID NO: 8547282 - DNA, 22 bp, Homo sapiens
taaagcaaggcaaattgttggt

SEQ ID NO: 8547283 - DNA, 22 bp, Homo sapiens
taaagcaaggcaaattgttggt

SEQ ID NO: 8547284 - DNA, 22 bp, Homo sapiens
taaagagccattgtatggtttt

SEQ ID NO: 8547285 - DNA, 17 bp, Homo sapiens
taaagatcagccatgta

SEQ ID NO: 8547286 - DNA, 22 bp, Homo sapiens
taaagagcacgcttttctctct

SEQ ID NO: 8547287 - DNA, 22 bp, Homo sapiens
taaagacatggtgtaggtgaac

SEQ ID NO: 8547288 - DNA, 22 bp, Homo sapiens
taaagacatggtgtaggtgaac

SEQ ID NO: 8547289 - DNA, 22 bp, Homo sapiens
taaagatgttctcatttcatag

SEQ ID NO: 8547290 - DNA, 23 bp, Homo sapiens
taaagcaaagtcaagtgcactcc

SEQ ID NO: 8547291 - DNA, 22 bp, Homo sapiens
taaatgcaagtgctcctgggag

SEQ ID NO: 8547292 - DNA, 22 bp, Homo sapiens
taaatgcaatgtgctttaccag

SEQ ID NO: 8547293 - DNA, 22 bp, Homo sapiens
taaatgatttatgtatgtgaaa

SEQ ID NO: 8547294 - DNA, 22 bp, Homo sapiens
taaatgatttatgtatgtgaaa

SEQ ID NO: 8547295 - DNA, 22 bp, Homo sapiens
taaatgatttatgtatgtgaaa

SEQ ID NO: 8547296 - DNA, 22 bp, Homo sapiens
taaagcagccagggtctaagcc

SEQ ID NO: 8547297 - DNA, 22 bp, Homo sapiens
taaagcacgtctatttaatgat

SEQ ID NO: 8547298 - DNA, 22 bp, Homo sapiens
taaagcacatatcttacaataa

SEQ ID NO: 8547299 - DNA, 19 bp, Homo sapiens
taaagcacatagcaaaagt

SEQ ID NO: 8547300 - DNA, 22 bp, Homo sapiens
taaatgataataatgctagtgt

SEQ ID NO: 8547301 - DNA, 22 bp, Homo sapiens
taaatgcagttagtacttgcca

SEQ ID NO: 8547302 - DNA, 22 bp, Homo sapiens
taaatgcagttagtacttgcca

SEQ ID NO: 8547303 - DNA, 20 bp, Homo sapiens
taaatgcatctgttcaactg

SEQ ID NO: 8547304 - DNA, 20 bp, Homo sapiens
taaatgcatgaatgtaaggc

SEQ ID NO: 8547305 - DNA, 20 bp, Homo sapiens
taaatgcatgaatgtaaggc

SEQ ID NO: 8547306 - DNA, 18 bp, Homo sapiens
taaatgcatgttaataac

SEQ ID NO: 8547307 - DNA, 22 bp, Homo sapiens
taaatgcagattcctgagccta

SEQ ID NO: 8547308 - DNA, 22 bp, Homo sapiens
taaatgcagcagtttctgttct

SEQ ID NO: 8547309 - DNA, 22 bp, Homo sapiens
taaatgcaatgtgctttaccag

SEQ ID NO: 8547310 - DNA, 22 bp, Homo sapiens
taaatgcagtacaaattgttct

SEQ ID NO: 8547311 - DNA, 22 bp, Homo sapiens
taaatgcagcagtttctgttct

SEQ ID NO: 8547312 - DNA, 22 bp, Homo sapiens
taaatgcagcagtttctgttct

SEQ ID NO: 8547313 - DNA, 22 bp, Homo sapiens
taaatgcagtacaaattgttct

SEQ ID NO: 8547314 - DNA, 22 bp, Homo sapiens
taaatgcagttagtacttgcca

SEQ ID NO: 8547315 - DNA, 22 bp, Homo sapiens
gttatatatagtatttctctga

SEQ ID NO: 8547316 - DNA, 22 bp, Homo sapiens
gttatatatagtatttctctga

SEQ ID NO: 8547317 - DNA, 22 bp, Homo sapiens
gttatattcaaaatgaggctgt

SEQ ID NO: 8547318 - DNA, 22 bp, Homo sapiens
gttatattcaaaatgaggctgt

SEQ ID NO: 8547319 - DNA, 22 bp, Homo sapiens
gttatataattcctgtggtagt

SEQ ID NO: 8547320 - DNA, 22 bp, Homo sapiens
gttatataagacaaatcagagt

SEQ ID NO: 8547321 - DNA, 22 bp, Homo sapiens
gttataaatgactgcaaaagtt

SEQ ID NO: 8547322 - DNA, 22 bp, Homo sapiens
gttataaatgactgcaaaagtt

SEQ ID NO: 8547323 - DNA, 22 bp, Homo sapiens
gttataaatgactgcaaaagtt

SEQ ID NO: 8547324 - DNA, 22 bp, Homo sapiens
gttataaatgactgcaaaagtt

SEQ ID NO: 8547325 - DNA, 22 bp, Homo sapiens
gttatacacattcctggtgagg

SEQ ID NO: 8547326 - DNA, 22 bp, Homo sapiens
gttatacatatgtgttaacaaa

SEQ ID NO: 8547327 - DNA, 22 bp, Homo sapiens
gttatacagttttgggtctgct

SEQ ID NO: 8547328 - DNA, 22 bp, Homo sapiens
gttatacatatgtgttaacaaa

SEQ ID NO: 8547329 - DNA, 22 bp, Homo sapiens
gttatacttatgtgcaaaaata

SEQ ID NO: 8547330 - DNA, 21 bp, Homo sapiens
gttatacattctatggatttg

SEQ ID NO: 8547331 - DNA, 19 bp, Homo sapiens
gttatcaaggggctacttt

SEQ ID NO: 8547332 - DNA, 22 bp, Homo sapiens
gttatcttctatttctcatact

SEQ ID NO: 8547333 - DNA, 22 bp, Homo sapiens
gttatcttccctttgatgattt

SEQ ID NO: 8547334 - DNA, 22 bp, Homo sapiens
gttatattggcagaagagaaga

SEQ ID NO: 8547335 - DNA, 22 bp, Homo sapiens
gttatattggcagaagagaaga

SEQ ID NO: 8547336 - DNA, 22 bp, Homo sapiens
gttatattgccaagtatattgt

SEQ ID NO: 8547337 - DNA, 22 bp, Homo sapiens
gttatattgccaagtatattgt

SEQ ID NO: 8547338 - DNA, 22 bp, Homo sapiens
gttatgaagtcattcacaaata

SEQ ID NO: 8547339 - DNA, 22 bp, Homo sapiens
gttatgaaataaatatagatca

SEQ ID NO: 8547340 - DNA, 22 bp, Homo sapiens
gttatgtaatctaacactcagt

SEQ ID NO: 8547341 - DNA, 22 bp, Homo sapiens
gttatgtatgagggaatgatta

SEQ ID NO: 8547342 - DNA, 22 bp, Homo sapiens
gttattgcagtatagaggtcta

SEQ ID NO: 8547343 - DNA, 22 bp, Homo sapiens
gttatgtactttttaaatcttg

SEQ ID NO: 8547344 - DNA, 22 bp, Homo sapiens
gttatgtatcttgattgggtgg

SEQ ID NO: 8547345 - DNA, 22 bp, Homo sapiens
gttatgtatgagggaatgatta

SEQ ID NO: 8547346 - DNA, 22 bp, Homo sapiens
gttatttcagccacagagtgca

SEQ ID NO: 8547347 - DNA, 22 bp, Homo sapiens
gttattgtccatttatttagca

SEQ ID NO: 8547348 - DNA, 22 bp, Homo sapiens
gttattgtttatcctgcacccc

SEQ ID NO: 8547349 - DNA, 22 bp, Homo sapiens
gttattgtttatcctgcacccc

SEQ ID NO: 8547350 - DNA, 22 bp, Homo sapiens
gttatttaactttgtagcatgg

SEQ ID NO: 8547351 - DNA, 22 bp, Homo sapiens
gttattgctggatagatacatc

SEQ ID NO: 8547352 - DNA, 22 bp, Homo sapiens
gttattgtccagcacagttggg

SEQ ID NO: 8547353 - DNA, 22 bp, Homo sapiens
gttctgctgtgtctcagcaggt

SEQ ID NO: 8547354 - DNA, 22 bp, Homo sapiens
gttctgctgtaatatctctgct

SEQ ID NO: 8547355 - DNA, 22 bp, Homo sapiens
gttctgcttccttgcttgcgca

SEQ ID NO: 8547356 - DNA, 22 bp, Homo sapiens
gttctggagtggtgccaggcct

SEQ ID NO: 8547357 - DNA, 22 bp, Homo sapiens
gttcttcagtcacatcacagaa

SEQ ID NO: 8547358 - DNA, 22 bp, Homo sapiens
gtgttcattgctagtgaggtgt

SEQ ID NO: 8547359 - DNA, 22 bp, Homo sapiens
gtgttcctggacagcaagtgag

SEQ ID NO: 8547360 - DNA, 22 bp, Homo sapiens
gtgttctctagagctgtacaaa

SEQ ID NO: 8547361 - DNA, 22 bp, Homo sapiens
gtgttctgcagaccagcatcat

SEQ ID NO: 8547362 - DNA, 22 bp, Homo sapiens
gtgttcatgccccagtgcagga

SEQ ID NO: 8547363 - DNA, 22 bp, Homo sapiens
gtgttcatcccaatgctgatag

SEQ ID NO: 8547364 - DNA, 22 bp, Homo sapiens
gtgttatttgagtgggagcgtg

SEQ ID NO: 8547365 - DNA, 22 bp, Homo sapiens
gtgttgatgacattttagaaac

SEQ ID NO: 8547366 - DNA, 22 bp, Homo sapiens
gtgttgatgacattttagaaac

SEQ ID NO: 8547367 - DNA, 22 bp, Homo sapiens
gtgttgatgacattttagaaac

SEQ ID NO: 8547368 - DNA, 22 bp, Homo sapiens
gtgttgctctgtttgggggttg

SEQ ID NO: 8547369 - DNA, 22 bp, Homo sapiens
gtgtttaacatctggtttatac

SEQ ID NO: 8547370 - DNA, 21 bp, Homo sapiens
gtgttggcatatggtggttga

SEQ ID NO: 8547371 - DNA, 22 bp, Homo sapiens
gtgttgtggagcttgtcagggg

SEQ ID NO: 8547372 - DNA, 22 bp, Homo sapiens
gtgttgtggagcttgtcagggg

SEQ ID NO: 8547373 - DNA, 22 bp, Homo sapiens
gtgttattagagcattaatttt

SEQ ID NO: 8547374 - DNA, 21 bp, Homo sapiens
gtgctgggacacagccaggct

SEQ ID NO: 8547375 - DNA, 22 bp, Homo sapiens
gttaacaaatgtaaagcaatta

SEQ ID NO: 8547376 - DNA, 22 bp, Homo sapiens
gttaaattcgatgatggataaa

SEQ ID NO: 8547377 - DNA, 22 bp, Homo sapiens
gttaaattcgatgatggataaa

SEQ ID NO: 8547378 - DNA, 22 bp, Homo sapiens
gttaaatgcattttccaagcac

SEQ ID NO: 8547379 - DNA, 22 bp, Homo sapiens
gttaaatgcactattgaaagct

SEQ ID NO: 8547380 - DNA, 22 bp, Homo sapiens
gttaaatgcagattctgactca

SEQ ID NO: 8547381 - DNA, 22 bp, Homo sapiens
gttaaataacctcatgtccgtt

SEQ ID NO: 8547382 - DNA, 18 bp, Homo sapiens
gttaacaattactaacgc

SEQ ID NO: 8547383 - DNA, 22 bp, Homo sapiens
gttaacacatgcaattgcactt

SEQ ID NO: 8547384 - DNA, 22 bp, Homo sapiens
gttaacattcaattaaacagtc

SEQ ID NO: 8547385 - DNA, 22 bp, Homo sapiens
gttataaatacctaataggatt

SEQ ID NO: 8547386 - DNA, 22 bp, Homo sapiens
gttataaatacctaataggatt

SEQ ID NO: 8547387 - DNA, 23 bp, Homo sapiens
gttaacatggtccatggaagagc

SEQ ID NO: 8547388 - DNA, 23 bp, Homo sapiens
gttaacatggtccatggaagagc

SEQ ID NO: 8547389 - DNA, 22 bp, Homo sapiens
gttaacataggagtttgttgta

SEQ ID NO: 8547390 - DNA, 22 bp, Homo sapiens
gttaacataggcttaggggttt

SEQ ID NO: 8547391 - DNA, 22 bp, Homo sapiens
gttaaataacctcatgtccgtt

SEQ ID NO: 8547392 - DNA, 22 bp, Homo sapiens
gttaaataacctcatgtccgtt

SEQ ID NO: 8547393 - DNA, 22 bp, Homo sapiens
gttaaataacctcatgtccgtt

SEQ ID NO: 8547394 - DNA, 22 bp, Homo sapiens
gttaaataacctcatgtccgtt

SEQ ID NO: 8547395 - DNA, 22 bp, Homo sapiens
gtgtttgctggagctctgggtc

SEQ ID NO: 8547396 - DNA, 21 bp, Homo sapiens
gtgtttcctgtttatggcttg

SEQ ID NO: 8547397 - DNA, 22 bp, Homo sapiens
gtgtttagtgtgcagacatgca

SEQ ID NO: 8547398 - DNA, 22 bp, Homo sapiens
gtgtttaatgcagatgtgggtg

SEQ ID NO: 8547399 - DNA, 22 bp, Homo sapiens
gtgtttaataggtagctgaatc

SEQ ID NO: 8547400 - DNA, 20 bp, Homo sapiens
gtgtttcatgtgatacaatg

SEQ ID NO: 8547401 - DNA, 22 bp, Homo sapiens
gtttcttttgtgatcaccaacc

SEQ ID NO: 8547402 - DNA, 22 bp, Homo sapiens
gtttgaaaaaagcagtatgtaa

SEQ ID NO: 8547403 - DNA, 22 bp, Homo sapiens
gtttcttttaaaatatgtagac

SEQ ID NO: 8547404 - DNA, 22 bp, Homo sapiens
gtttcttttaaaatatgtagac

SEQ ID NO: 8547405 - DNA, 22 bp, Homo sapiens
gtttcttttaaaatatgtagac

SEQ ID NO: 8547406 - DNA, 22 bp, Homo sapiens
gtttctttctattgactgaaca

SEQ ID NO: 8547407 - DNA, 22 bp, Homo sapiens
gtttctttctattgactgaaca

SEQ ID NO: 8547408 - DNA, 22 bp, Homo sapiens
gtttcttatttgcaggttgctt

SEQ ID NO: 8547409 - DNA, 22 bp, Homo sapiens
gtttcttatttcaactggaaca

SEQ ID NO: 8547410 - DNA, 22 bp, Homo sapiens
gtttcttaggtaaattctttga

SEQ ID NO: 8547411 - DNA, 22 bp, Homo sapiens
gtttcttagacatatgccatga

SEQ ID NO: 8547412 - DNA, 22 bp, Homo sapiens
gtttcagaaatggtttatgcaa

SEQ ID NO: 8547413 - DNA, 22 bp, Homo sapiens
gtttcttagacagacattatct

SEQ ID NO: 8547414 - DNA, 22 bp, Homo sapiens
gtttcacagatggggagacacg

SEQ ID NO: 8547415 - DNA, 22 bp, Homo sapiens
gtttcaatttgaatgcgaggct

SEQ ID NO: 8547416 - DNA, 22 bp, Homo sapiens
gtttcacagggccatggaggaa

SEQ ID NO: 8547417 - DNA, 22 bp, Homo sapiens
gtttcacagggccatggaggaa

SEQ ID NO: 8547418 - DNA, 22 bp, Homo sapiens
gtttcacagatggtgttcatat

SEQ ID NO: 8547419 - DNA, 22 bp, Homo sapiens
gtttgcatatttgcacaggaat

SEQ ID NO: 8547420 - DNA, 22 bp, Homo sapiens
gtttgcagttgtcatcctcctg

SEQ ID NO: 8547421 - DNA, 22 bp, Homo sapiens
gtttgatttgatccggagagat

SEQ ID NO: 8547422 - DNA, 22 bp, Homo sapiens
gtttgattcaagaacaaagagt

SEQ ID NO: 8547423 - DNA, 22 bp, Homo sapiens
gtttgaaagttcaacaggaaaa

SEQ ID NO: 8547424 - DNA, 22 bp, Homo sapiens
gtttgaaagttcaacaggaaaa

SEQ ID NO: 8547425 - DNA, 22 bp, Homo sapiens
gtttgaaatgtctgcaagggaa

SEQ ID NO: 8547426 - DNA, 22 bp, Homo sapiens
gtttgaaatgtctgcaagggaa

SEQ ID NO: 8547427 - DNA, 22 bp, Homo sapiens
gtttgaaagtggcaagtccttg

SEQ ID NO: 8547428 - DNA, 22 bp, Homo sapiens
gtttgaaagtggcaagtccttg

SEQ ID NO: 8547429 - DNA, 22 bp, Homo sapiens
gtttgaaagaccaattagattt

SEQ ID NO: 8547430 - DNA, 22 bp, Homo sapiens
gtttgaaagaccaattagattt

SEQ ID NO: 8547431 - DNA, 22 bp, Homo sapiens
gtttgaaagaccaattagattt

SEQ ID NO: 8547432 - DNA, 22 bp, Homo sapiens
gtttgtcaggaggttgaagtca

SEQ ID NO: 8547433 - DNA, 22 bp, Homo sapiens
gtttgtgtaacatgatgatgat

SEQ ID NO: 8547434 - DNA, 22 bp, Homo sapiens
gtttgtgtaacatgatgatgat

SEQ ID NO: 8547435 - DNA, 22 bp, Homo sapiens
gtttgtgtaacatgatgatgat

SEQ ID NO: 8547436 - DNA, 22 bp, Homo sapiens
gtttgtgtcaatgacttctgca

SEQ ID NO: 8547437 - DNA, 22 bp, Homo sapiens
gtttgtttatacaaaagatcct

SEQ ID NO: 8547438 - DNA, 22 bp, Homo sapiens
gtttgtttatacaaaagatcct

SEQ ID NO: 8547439 - DNA, 20 bp, Homo sapiens
gttttaaggcacaggccttt

SEQ ID NO: 8547440 - DNA, 20 bp, Homo sapiens
gttttaaggcacaggccttt

SEQ ID NO: 8547441 - DNA, 21 bp, Homo sapiens
gttttaagggagaaaacctag

SEQ ID NO: 8547442 - DNA, 22 bp, Homo sapiens
gtttgtttgtagggaagccgtg

SEQ ID NO: 8547443 - DNA, 22 bp, Homo sapiens
gtttgttttaagataggatgga

SEQ ID NO: 8547444 - DNA, 22 bp, Homo sapiens
gtttatgaaatttcaggcattt

SEQ ID NO: 8547445 - DNA, 22 bp, Homo sapiens
gttgagcaaggccagagaagcc

SEQ ID NO: 8547446 - DNA, 22 bp, Homo sapiens
gtttatgcacttggtttgtgtc

SEQ ID NO: 8547447 - DNA, 22 bp, Homo sapiens
gtttatgagttacgtaggggtt

SEQ ID NO: 8547448 - DNA, 22 bp, Homo sapiens
gtttatgaggaaaagttatgat

SEQ ID NO: 8547449 - DNA, 22 bp, Homo sapiens
gtttatgaattgcattcccttt

SEQ ID NO: 8547450 - DNA, 21 bp, Homo sapiens
gtttatgaatcttgtcctgct

SEQ ID NO: 8547451 - DNA, 22 bp, Homo sapiens
gtttatgaatgtgtcagacata

SEQ ID NO: 8547452 - DNA, 22 bp, Homo sapiens
gtttatgaatgttactatagag

SEQ ID NO: 8547453 - DNA, 22 bp, Homo sapiens
gtttcaaagcacagctcacatt

SEQ ID NO: 8547454 - DNA, 22 bp, Homo sapiens
gtttcaaagggaagacgctgga

SEQ ID NO: 8547455 - DNA, 22 bp, Homo sapiens
gtttattatacaacaaaagcta

SEQ ID NO: 8547456 - DNA, 22 bp, Homo sapiens
gtttattaactgtcaagtgatt

SEQ ID NO: 8547457 - DNA, 22 bp, Homo sapiens
gtttattagagttttctgtctg

SEQ ID NO: 8547458 - DNA, 22 bp, Homo sapiens
gttctttaagtggagaaggaaa

SEQ ID NO: 8547459 - DNA, 21 bp, Homo sapiens
gttcttgcaggatttccttcc

SEQ ID NO: 8547460 - DNA, 22 bp, Homo sapiens
gttgaaaatacagattcctagg

SEQ ID NO: 8547461 - DNA, 22 bp, Homo sapiens
gttcttttggtagagtgtgcat

SEQ ID NO: 8547462 - DNA, 19 bp, Homo sapiens
gttcttttcacctctgtgc

SEQ ID NO: 8547463 - DNA, 22 bp, Homo sapiens
gttctttgactccaagaaagta

SEQ ID NO: 8547464 - DNA, 19 bp, Homo sapiens
gttcttttcacctctgtgc

SEQ ID NO: 8547465 - DNA, 22 bp, Homo sapiens
gttgaaaatgactttataccat

SEQ ID NO: 8547466 - DNA, 22 bp, Homo sapiens
gttgaaacttagttgaaattta

SEQ ID NO: 8547467 - DNA, 22 bp, Homo sapiens
gttgaaagatgtcttggttccc

SEQ ID NO: 8547468 - DNA, 22 bp, Homo sapiens
gttgaaagtagatgctatttgg

SEQ ID NO: 8547469 - DNA, 22 bp, Homo sapiens
gttgaaatcctaaccccctagt

SEQ ID NO: 8547470 - DNA, 22 bp, Homo sapiens
gttgaaatcctaaccccctagt

SEQ ID NO: 8547471 - DNA, 22 bp, Homo sapiens
gttgaactatgttttatctgac

SEQ ID NO: 8547472 - DNA, 22 bp, Homo sapiens
gttgaactatgttttatctgac

SEQ ID NO: 8547473 - DNA, 22 bp, Homo sapiens
ggagctgttgcgcatgcgctcg

SEQ ID NO: 8547474 - DNA, 22 bp, Homo sapiens
ggagctgttgcgcatgcgctcg

SEQ ID NO: 8547475 - DNA, 22 bp, Homo sapiens
ggagctgttggcagctatcttg

SEQ ID NO: 8547476 - DNA, 22 bp, Homo sapiens
ggagctgttggcagctatcttg

SEQ ID NO: 8547477 - DNA, 22 bp, Homo sapiens
ggagctgttggcagctatcttg

SEQ ID NO: 8547478 - DNA, 22 bp, Homo sapiens
ggagctgttgattgtttgagga

SEQ ID NO: 8547479 - DNA, 22 bp, Homo sapiens
ggagctgttgattgtttgagga

SEQ ID NO: 8547480 - DNA, 22 bp, Homo sapiens
ggagctgttcaggactgcttca

SEQ ID NO: 8547481 - DNA, 22 bp, Homo sapiens
ggagctgttatggcataagcat

SEQ ID NO: 8547482 - DNA, 22 bp, Homo sapiens
ggagctgttcaggactgcttca

SEQ ID NO: 8547483 - DNA, 19 bp, Homo sapiens
ggagcttggtggctgtggc

SEQ ID NO: 8547484 - DNA, 21 bp, Homo sapiens
ggaggaaaaaggaatgacttg

SEQ ID NO: 8547485 - DNA, 22 bp, Homo sapiens
ggaggaggcggcagaagttcct

SEQ ID NO: 8547486 - DNA, 22 bp, Homo sapiens
ggaggaggggcgctttgtctat

SEQ ID NO: 8547487 - DNA, 22 bp, Homo sapiens
ggaggaggcggcagaagttcct

SEQ ID NO: 8547488 - DNA, 22 bp, Homo sapiens
ggaggaggcggcagaagttcct

SEQ ID NO: 8547489 - DNA, 22 bp, Homo sapiens
ggaggaggggtgactgaatgct

SEQ ID NO: 8547490 - DNA, 22 bp, Homo sapiens
ggaggaggggtgactgaatgct

SEQ ID NO: 8547491 - DNA, 22 bp, Homo sapiens
ggagctgtaacgagccattgct

SEQ ID NO: 8547492 - DNA, 22 bp, Homo sapiens
ggagctggtcagccttgagcat

SEQ ID NO: 8547493 - DNA, 21 bp, Homo sapiens
ggagctggggagctggcccca

SEQ ID NO: 8547494 - DNA, 22 bp, Homo sapiens
ggagctggggttggcatcttcc

SEQ ID NO: 8547495 - DNA, 22 bp, Homo sapiens
ggagctgtgcagtgactacaga

SEQ ID NO: 8547496 - DNA, 22 bp, Homo sapiens
ggagctgtgcagtgactacaga

SEQ ID NO: 8547497 - DNA, 22 bp, Homo sapiens
ggagctgtgcagtgactacaga

SEQ ID NO: 8547498 - DNA, 22 bp, Homo sapiens
ggagctgtctgtagggcacagg

SEQ ID NO: 8547499 - DNA, 22 bp, Homo sapiens
ggagctgtctgtagggcacagg

SEQ ID NO: 8547500 - DNA, 22 bp, Homo sapiens
ggagctgtaacgagccattgct

SEQ ID NO: 8547501 - DNA, 22 bp, Homo sapiens
ggagctgtaacgagccattgct

SEQ ID NO: 8547502 - DNA, 22 bp, Homo sapiens
ggagctgtagatcagctaatct

SEQ ID NO: 8547503 - DNA, 22 bp, Homo sapiens
ggagctgtagatcagctaatct

SEQ ID NO: 8547504 - DNA, 22 bp, Homo sapiens
ggagctgtgctgggtgatcagg

SEQ ID NO: 8547505 - DNA, 22 bp, Homo sapiens
ggagctgtgttatccattccca

SEQ ID NO: 8547506 - DNA, 22 bp, Homo sapiens
ggagctgtgggacgctgtccca

SEQ ID NO: 8547507 - DNA, 22 bp, Homo sapiens
ggagctgttaaatgcagaattt

SEQ ID NO: 8547508 - DNA, 22 bp, Homo sapiens
ggagctgttaaatgcagaattt

SEQ ID NO: 8547509 - DNA, 22 bp, Homo sapiens
ggagctgtgggacgctgtccca

SEQ ID NO: 8547510 - DNA, 22 bp, Homo sapiens
ggagctgtgttatccattccca

SEQ ID NO: 8547511 - DNA, 22 bp, Homo sapiens
ggagctgggaccctgtcatctg

SEQ ID NO: 8547512 - DNA, 22 bp, Homo sapiens
ggagctgggaattggatcatct

SEQ ID NO: 8547513 - DNA, 22 bp, Homo sapiens
ggagctgggaattggatcatct

SEQ ID NO: 8547514 - DNA, 22 bp, Homo sapiens
ggagctgggaccctgtcatctg

SEQ ID NO: 8547515 - DNA, 20 bp, Homo sapiens
ggagctgccctgggctggag

SEQ ID NO: 8547516 - DNA, 22 bp, Homo sapiens
ggagctgcatttagggagcctt

SEQ ID NO: 8547517 - DNA, 22 bp, Homo sapiens
ggagctgcatttagggagcctt

SEQ ID NO: 8547518 - DNA, 22 bp, Homo sapiens
ggagctgcatttagggagcctt

SEQ ID NO: 8547519 - DNA, 22 bp, Homo sapiens
ggagctggctacagagaactcc

SEQ ID NO: 8547520 - DNA, 22 bp, Homo sapiens
ggagctggctacagagaactcc

SEQ ID NO: 8547521 - DNA, 22 bp, Homo sapiens
ggagctggctacagagaactcc

SEQ ID NO: 8547522 - DNA, 22 bp, Homo sapiens
ggagcctgggcctcctgccctt

SEQ ID NO: 8547523 - DNA, 22 bp, Homo sapiens
ggagcctggcctggctctgtgt

SEQ ID NO: 8547524 - DNA, 22 bp, Homo sapiens
ggagcctgggcattagtaattt

SEQ ID NO: 8547525 - DNA, 22 bp, Homo sapiens
ggagcctggcctggctctgtgt

SEQ ID NO: 8547526 - DNA, 22 bp, Homo sapiens
ggagcctggcccggcccttggc

SEQ ID NO: 8547527 - DNA, 23 bp, Homo sapiens
ggagcctggcatatgagacgcat

SEQ ID NO: 8547528 - DNA, 23 bp, Homo sapiens
ggagcctggcatatgagacgcat

SEQ ID NO: 8547529 - DNA, 23 bp, Homo sapiens
ggagcctggcatatgagacgcat

SEQ ID NO: 8547530 - DNA, 22 bp, Homo sapiens
ggagcctggcaatgctgcgtcc

SEQ ID NO: 8547531 - DNA, 22 bp, Homo sapiens
ggagcctggcaatgctgcgtcc

SEQ ID NO: 8547532 - DNA, 22 bp, Homo sapiens
ggagcctggcaatgctgcgtcc

SEQ ID NO: 8547533 - DNA, 22 bp, Homo sapiens
ggagcctggcaatgctgcgtcc

SEQ ID NO: 8547534 - DNA, 22 bp, Homo sapiens
ggagcctggcaatgctgcgtcc

SEQ ID NO: 8547535 - DNA, 19 bp, Homo sapiens
ggagcctggagcacgtgcc

SEQ ID NO: 8547536 - DNA, 19 bp, Homo sapiens
ggagcctggagcacgtgcc

SEQ ID NO: 8547537 - DNA, 22 bp, Homo sapiens
ggagccctcaccggcgagtgcc

SEQ ID NO: 8547538 - DNA, 18 bp, Homo sapiens
ggagcccagaggtgagtt

SEQ ID NO: 8547539 - DNA, 18 bp, Homo sapiens
ggagcccagaggtgagtt

SEQ ID NO: 8547540 - DNA, 22 bp, Homo sapiens
ggagccctagctgtgcatcaga

SEQ ID NO: 8547541 - DNA, 18 bp, Homo sapiens
ggagcccagaggacagga

SEQ ID NO: 8547542 - DNA, 18 bp, Homo sapiens
ggagcccagaggacagga

SEQ ID NO: 8547543 - DNA, 18 bp, Homo sapiens
ggagcccagaggtgagtt

SEQ ID NO: 8547544 - DNA, 18 bp, Homo sapiens
ggagcccagaggacagga

SEQ ID NO: 8547545 - DNA, 22 bp, Homo sapiens
ggagcccaagtctgcactcggc

SEQ ID NO: 8547546 - DNA, 22 bp, Homo sapiens
ggagccagtatttagtggtctt

SEQ ID NO: 8547547 - DNA, 18 bp, Homo sapiens
ggagccagtctgtctctg

SEQ ID NO: 8547548 - DNA, 18 bp, Homo sapiens
ggagccagtctgtctctg

SEQ ID NO: 8547549 - DNA, 22 bp, Homo sapiens
ggagccagtgccctctggtgga

SEQ ID NO: 8547550 - DNA, 22 bp, Homo sapiens
ggagccagtgccctctggtgga

SEQ ID NO: 8547551 - DNA, 22 bp, Homo sapiens
ggagccagtttagacctcagtt

SEQ ID NO: 8547552 - DNA, 22 bp, Homo sapiens
ggagccagtgccctctggtgga

SEQ ID NO: 8547553 - DNA, 22 bp, Homo sapiens
ggagccagtatttagtggtctt

SEQ ID NO: 8547554 - DNA, 22 bp, Homo sapiens
ggagccagtatttagtggtctt

SEQ ID NO: 8547555 - DNA, 22 bp, Homo sapiens
ggagccagtatttagtggtctt

SEQ ID NO: 8547556 - DNA, 22 bp, Homo sapiens
ggagccagtatttagtggtctt

SEQ ID NO: 8547557 - DNA, 22 bp, Homo sapiens
ggagccaggggaccttcacaga

SEQ ID NO: 8547558 - DNA, 22 bp, Homo sapiens
ggagccagtatttagtggtctt

SEQ ID NO: 8547559 - DNA, 22 bp, Homo sapiens
ggagccaggggaccttcacaga

SEQ ID NO: 8547560 - DNA, 22 bp, Homo sapiens
ggagccagggaagctgcttcct

SEQ ID NO: 8547561 - DNA, 22 bp, Homo sapiens
ggagccaggcatatcggggcac

SEQ ID NO: 8547562 - DNA, 22 bp, Homo sapiens
ggagccaggcaatctgtacttt

SEQ ID NO: 8547563 - DNA, 22 bp, Homo sapiens
ggagccaggcaatctgtacttt

SEQ ID NO: 8547564 - DNA, 17 bp, Homo sapiens
ggagccaggagcccacc

SEQ ID NO: 8547565 - DNA, 22 bp, Homo sapiens
ggagaagaggagctggaagcct

SEQ ID NO: 8547566 - DNA, 22 bp, Homo sapiens
ggagaagaggagctggaagcct

SEQ ID NO: 8547567 - DNA, 22 bp, Homo sapiens
ggagaagaggagctggaagcct

SEQ ID NO: 8547568 - DNA, 22 bp, Homo sapiens
ggagaagaggagctggaagcct

SEQ ID NO: 8547569 - DNA, 22 bp, Homo sapiens
ggagaagaggagctggaagcct

SEQ ID NO: 8547570 - DNA, 22 bp, Homo sapiens
ggaagggaatccatctggttag

SEQ ID NO: 8547571 - DNA, 22 bp, Homo sapiens
ggaagggaatccatctggttag

SEQ ID NO: 8547572 - DNA, 22 bp, Homo sapiens
ggacagagggttgacagagtat

SEQ ID NO: 8547573 - DNA, 22 bp, Homo sapiens
ggacagagggttgacagagtat

SEQ ID NO: 8547574 - DNA, 22 bp, Homo sapiens
ggacaggatgctgaagatgaag

SEQ ID NO: 8547575 - DNA, 22 bp, Homo sapiens
ggacaggataagagacactgcc

SEQ ID NO: 8547576 - DNA, 18 bp, Homo sapiens
ggacaggagacatgggtg

SEQ ID NO: 8547577 - DNA, 22 bp, Homo sapiens
ggacagagggttgacagagtat

SEQ ID NO: 8547578 - DNA, 22 bp, Homo sapiens
ggacaggagtgaggcgggttcc

SEQ ID NO: 8547579 - DNA, 22 bp, Homo sapiens
ggacaggataagagacactgcc

SEQ ID NO: 8547580 - DNA, 19 bp, Homo sapiens
ggaaggcagaggggctgtg

SEQ ID NO: 8547581 - DNA, 22 bp, Homo sapiens
ggaaggcagtgaaggggctgat

SEQ ID NO: 8547582 - DNA, 22 bp, Homo sapiens
ggaaggcagaggtgtcgtgggg

SEQ ID NO: 8547583 - DNA, 22 bp, Homo sapiens
ggaaggcagtgaaggggctgat

SEQ ID NO: 8547584 - DNA, 22 bp, Homo sapiens
ggaaggcagtgaaggggctgat

SEQ ID NO: 8547585 - DNA, 22 bp, Homo sapiens
ggaaggctttgtagaagtgcca

SEQ ID NO: 8547586 - DNA, 20 bp, Homo sapiens
ggaaggctgtttttccacca

SEQ ID NO: 8547587 - DNA, 22 bp, Homo sapiens
ggaaggctgtgcagtgtttgca

SEQ ID NO: 8547588 - DNA, 22 bp, Homo sapiens
ggaaggagggcggcaatgatga

SEQ ID NO: 8547589 - DNA, 22 bp, Homo sapiens
ggaaggaggatgctctggcctt

SEQ ID NO: 8547590 - DNA, 22 bp, Homo sapiens
ggaaggaggatgctctggcctt

SEQ ID NO: 8547591 - DNA, 22 bp, Homo sapiens
ggaaggagcatttgccagttta

SEQ ID NO: 8547592 - DNA, 22 bp, Homo sapiens
ggaaggaggggcaaagcagttc

SEQ ID NO: 8547593 - DNA, 19 bp, Homo sapiens
ggaaggcagaggggctgtg

SEQ ID NO: 8547594 - DNA, 19 bp, Homo sapiens
ggaaggcagaggggctgtg

SEQ ID NO: 8547595 - DNA, 22 bp, Homo sapiens
ggaaggagcatttgccagttta

SEQ ID NO: 8547596 - DNA, 22 bp, Homo sapiens
ggaaggagcatttgccagttta

SEQ ID NO: 8547597 - DNA, 22 bp, Homo sapiens
ggaaaaatgacacatatctcaa

SEQ ID NO: 8547598 - DNA, 22 bp, Homo sapiens
ggaaaaatgacacatatctcaa

SEQ ID NO: 8547599 - DNA, 22 bp, Homo sapiens
ggaaaaatagagtatactttaa

SEQ ID NO: 8547600 - DNA, 22 bp, Homo sapiens
ggaaaaatagagtatactttaa

SEQ ID NO: 8547601 - DNA, 22 bp, Homo sapiens
ggaaaaatgacacatatctcaa

SEQ ID NO: 8547602 - DNA, 22 bp, Homo sapiens
ggaaaaatgacacatatctcaa

SEQ ID NO: 8547603 - DNA, 22 bp, Homo sapiens
ggaaggaagtgcagactttaaa

SEQ ID NO: 8547604 - DNA, 23 bp, Homo sapiens
ggaaaaacactgtgtcttggcag

SEQ ID NO: 8547605 - DNA, 22 bp, Homo sapiens
ggaaaaacagtctttattattt

SEQ ID NO: 8547606 - DNA, 22 bp, Homo sapiens
ggaaaaacagtctttattattt

SEQ ID NO: 8547607 - DNA, 22 bp, Homo sapiens
ggaaaaacagtctttattattt

SEQ ID NO: 8547608 - DNA, 22 bp, Homo sapiens
ggaaaaatagagtatactttaa

SEQ ID NO: 8547609 - DNA, 23 bp, Homo sapiens
ggacagggccctgccctatggcc

SEQ ID NO: 8547610 - DNA, 22 bp, Homo sapiens
ggacagggctcttggcactcct

SEQ ID NO: 8547611 - DNA, 22 bp, Homo sapiens
ggacaggggcgtggggattgtt

SEQ ID NO: 8547612 - DNA, 22 bp, Homo sapiens
ggacaggggcgtggggattgtt

SEQ ID NO: 8547613 - DNA, 22 bp, Homo sapiens
ggacagggctcttggcactcct

SEQ ID NO: 8547614 - DNA, 22 bp, Homo sapiens
ggacagggctcttggcactcct

SEQ ID NO: 8547615 - DNA, 22 bp, Homo sapiens
ggacaggggcgtggggattgtt

SEQ ID NO: 8547616 - DNA, 22 bp, Homo sapiens
ggacaggggcgtggggattgtt

SEQ ID NO: 8547617 - DNA, 22 bp, Homo sapiens
ggacaggccctctggtcagctt

SEQ ID NO: 8547618 - DNA, 22 bp, Homo sapiens
ggacaggccctctggtcagctt

SEQ ID NO: 8547619 - DNA, 22 bp, Homo sapiens
ggacaggccgcctcggtggggg

SEQ ID NO: 8547620 - DNA, 22 bp, Homo sapiens
ggacaggcccggggagcctgga

SEQ ID NO: 8547621 - DNA, 22 bp, Homo sapiens
ggacaggcctggcacagtactg

SEQ ID NO: 8547622 - DNA, 22 bp, Homo sapiens
ggacaggccgcctcggtggggg

SEQ ID NO: 8547623 - DNA, 22 bp, Homo sapiens
ggacaggccgcctcggtggggg

SEQ ID NO: 8547624 - DNA, 22 bp, Homo sapiens
ggacaggctgcatctgagcatg

SEQ ID NO: 8547625 - DNA, 22 bp, Homo sapiens
ggacaggctgcatctgagcatg

SEQ ID NO: 8547626 - DNA, 22 bp, Homo sapiens
ggacaggctgcatctgagcatg

SEQ ID NO: 8547627 - DNA, 22 bp, Homo sapiens
ggactggccggcgctgaggccc

SEQ ID NO: 8547628 - DNA, 22 bp, Homo sapiens
ggactggactctcaggctcaca

SEQ ID NO: 8547629 - DNA, 22 bp, Homo sapiens
ggactggactctcaggctcaca

SEQ ID NO: 8547630 - DNA, 22 bp, Homo sapiens
ggacttgcctttagttaaaata

SEQ ID NO: 8547631 - DNA, 22 bp, Homo sapiens
ggacttgctaaggtggctgaac

SEQ ID NO: 8547632 - DNA, 22 bp, Homo sapiens
ggactgtgaggtctgggtgagg

SEQ ID NO: 8547633 - DNA, 22 bp, Homo sapiens
ggagaaaggcatagcagaacct

SEQ ID NO: 8547634 - DNA, 22 bp, Homo sapiens
ggagaaagctgtagtggaatgt

SEQ ID NO: 8547635 - DNA, 22 bp, Homo sapiens
gctttaaacctctactctgtcc

SEQ ID NO: 8547636 - DNA, 22 bp, Homo sapiens
gcttgtttgtgatttctccaga

SEQ ID NO: 8547637 - DNA, 22 bp, Homo sapiens
gcttgtttctatttatcaagta

SEQ ID NO: 8547638 - DNA, 22 bp, Homo sapiens
gctttacataaacatttattat

SEQ ID NO: 8547639 - DNA, 22 bp, Homo sapiens
gctttacagggcacaaagggag

SEQ ID NO: 8547640 - DNA, 22 bp, Homo sapiens
gctttacacagatgaatatttc

SEQ ID NO: 8547641 - DNA, 22 bp, Homo sapiens
gctttacacagctggttcttgt

SEQ ID NO: 8547642 - DNA, 22 bp, Homo sapiens
gctttacagagaaagtttgcct

SEQ ID NO: 8547643 - DNA, 22 bp, Homo sapiens
gctttacatgagatgaggacaa

SEQ ID NO: 8547644 - DNA, 22 bp, Homo sapiens
gctttacatgatttctcaccct

SEQ ID NO: 8547645 - DNA, 22 bp, Homo sapiens
gctttacatgtttccctttaag

SEQ ID NO: 8547646 - DNA, 22 bp, Homo sapiens
gctttacaagtggtgcagatta

SEQ ID NO: 8547647 - DNA, 22 bp, Homo sapiens
gctttacacagatgaatatttc

SEQ ID NO: 8547648 - DNA, 22 bp, Homo sapiens
gctttacaacaaattgaatatg

SEQ ID NO: 8547649 - DNA, 22 bp, Homo sapiens
gctttacaagtggtgcagatta

SEQ ID NO: 8547650 - DNA, 22 bp, Homo sapiens
gctttacaacaaattgaatatg

SEQ ID NO: 8547651 - DNA, 22 bp, Homo sapiens
gctttacaagtggtgcagatta

SEQ ID NO: 8547652 - DNA, 20 bp, Homo sapiens
gcttggaccttctgctctgt

SEQ ID NO: 8547653 - DNA, 22 bp, Homo sapiens
gcttggagatgggggatgagcc

SEQ ID NO: 8547654 - DNA, 22 bp, Homo sapiens
gcttggagatgggggatgagcc

SEQ ID NO: 8547655 - DNA, 22 bp, Homo sapiens
gcttaaatcccaatgctagacc

SEQ ID NO: 8547656 - DNA, 22 bp, Homo sapiens
gcttaaattgtttgtggatagt

SEQ ID NO: 8547657 - DNA, 22 bp, Homo sapiens
gcttggtttctaacttttcata

SEQ ID NO: 8547658 - DNA, 21 bp, Homo sapiens
gcttggttttggttacttgcc

SEQ ID NO: 8547659 - DNA, 22 bp, Homo sapiens
gcttggttactgatggaaagga

SEQ ID NO: 8547660 - DNA, 22 bp, Homo sapiens
gcttggggtcatgaggctgctg

SEQ ID NO: 8547661 - DNA, 22 bp, Homo sapiens
gcttggggtcatgaggctgctg

SEQ ID NO: 8547662 - DNA, 22 bp, Homo sapiens
gctgtgtgctctggtctttctt

SEQ ID NO: 8547663 - DNA, 22 bp, Homo sapiens
gctgtgtgctcacgtagtggaa

SEQ ID NO: 8547664 - DNA, 22 bp, Homo sapiens
gctgtgtgctgggcatggcact

SEQ ID NO: 8547665 - DNA, 22 bp, Homo sapiens
gctgtgtgctctggtctttctt

SEQ ID NO: 8547666 - DNA, 22 bp, Homo sapiens
gctgtgtgctgggcatggcact

SEQ ID NO: 8547667 - DNA, 22 bp, Homo sapiens
gctgtgtgctgggcatggcact

SEQ ID NO: 8547668 - DNA, 22 bp, Homo sapiens
gctgtgtggcaaagggattaca

SEQ ID NO: 8547669 - DNA, 22 bp, Homo sapiens
gctgtgtgctgggcatggcact

SEQ ID NO: 8547670 - DNA, 22 bp, Homo sapiens
gctgtgtgctgggcatggcact

SEQ ID NO: 8547671 - DNA, 22 bp, Homo sapiens
gctgtgtggctgtgccgtcacg

SEQ ID NO: 8547672 - DNA, 22 bp, Homo sapiens
gctgtgtgttcaataatgtgat

SEQ ID NO: 8547673 - DNA, 22 bp, Homo sapiens
gctgtgtggctgtgccgtcacg

SEQ ID NO: 8547674 - DNA, 22 bp, Homo sapiens
gctgtgtggcaaagggattaca

SEQ ID NO: 8547675 - DNA, 22 bp, Homo sapiens
gctgtgtggctgtgccgtcacg

SEQ ID NO: 8547676 - DNA, 22 bp, Homo sapiens
gctgtgtgttcaataatgtgat

SEQ ID NO: 8547677 - DNA, 22 bp, Homo sapiens
gctgtgttgggaatcatgtggg

SEQ ID NO: 8547678 - DNA, 22 bp, Homo sapiens
gctgtgtgttcaataatgtgat

SEQ ID NO: 8547679 - DNA, 22 bp, Homo sapiens
gctgtgtgttcaataatgtgat

SEQ ID NO: 8547680 - DNA, 22 bp, Homo sapiens
gctgtgtgttcaataatgtgat

SEQ ID NO: 8547681 - DNA, 22 bp, Homo sapiens
gctgtgttttatgttaggttaa

SEQ ID NO: 8547682 - DNA, 22 bp, Homo sapiens
gctgtgtttgacagtagcagac

SEQ ID NO: 8547683 - DNA, 22 bp, Homo sapiens
gctgtgtttgacagtagcagac

SEQ ID NO: 8547684 - DNA, 22 bp, Homo sapiens
gctgtgttcattttgcatatgt

SEQ ID NO: 8547685 - DNA, 22 bp, Homo sapiens
gctgtgttggtgaagctgtagc

SEQ ID NO: 8547686 - DNA, 22 bp, Homo sapiens
gctgtgttggtgaagctgtagc

SEQ ID NO: 8547687 - DNA, 22 bp, Homo sapiens
gcttaaaagccacttagtctat

SEQ ID NO: 8547688 - DNA, 22 bp, Homo sapiens
gctgtttctttggcaaactgat

SEQ ID NO: 8547689 - DNA, 22 bp, Homo sapiens
gctgtttctgagtagctaggct

SEQ ID NO: 8547690 - DNA, 22 bp, Homo sapiens
gctgtttccccttcacagtggc

SEQ ID NO: 8547691 - DNA, 22 bp, Homo sapiens
gctgtttccagacaatgtcttt

SEQ ID NO: 8547692 - DNA, 22 bp, Homo sapiens
gcttttattgtctttacgacga

SEQ ID NO: 8547693 - DNA, 22 bp, Homo sapiens
gcttttatttcttcacaaaagt

SEQ ID NO: 8547694 - DNA, 19 bp, Homo sapiens
gcttttattgctcaggtgc

SEQ ID NO: 8547695 - DNA, 23 bp, Homo sapiens
gcttttaaacctgtgactgccgc

SEQ ID NO: 8547696 - DNA, 22 bp, Homo sapiens
gctttgtgtagaaggaggatgg

SEQ ID NO: 8547697 - DNA, 22 bp, Homo sapiens
gctttgtgtgaagtccatggcg

SEQ ID NO: 8547698 - DNA, 22 bp, Homo sapiens
gcttttctagctagaacatccg

SEQ ID NO: 8547699 - DNA, 22 bp, Homo sapiens
gcttttatttcttcacaaaagt

SEQ ID NO: 8547700 - DNA, 19 bp, Homo sapiens
gcttttctccttcaagcca

SEQ ID NO: 8547701 - DNA, 22 bp, Homo sapiens
gcttttctccttagtgtccctg

SEQ ID NO: 8547702 - DNA, 22 bp, Homo sapiens
gcttttctccttagtgtccctg

SEQ ID NO: 8547703 - DNA, 22 bp, Homo sapiens
gcttttctataagaactttcaa

SEQ ID NO: 8547704 - DNA, 22 bp, Homo sapiens
gcttttctagctagaacatccg

SEQ ID NO: 8547705 - DNA, 22 bp, Homo sapiens
gcttttcttcagcagcctgatg

SEQ ID NO: 8547706 - DNA, 22 bp, Homo sapiens
gcttttgaggtcctgctcagcc

SEQ ID NO: 8547707 - DNA, 22 bp, Homo sapiens
gcttttggacctctgatgtttc

SEQ ID NO: 8547708 - DNA, 22 bp, Homo sapiens
gcttttggccagatggggaaac

SEQ ID NO: 8547709 - DNA, 22 bp, Homo sapiens
gctttttcaaatgaaagctggt

SEQ ID NO: 8547710 - DNA, 18 bp, Homo sapiens
gctttttagtgcatcttc

SEQ ID NO: 8547711 - DNA, 21 bp, Homo sapiens
gctttttgtatggcccaggaa

SEQ ID NO: 8547712 - DNA, 20 bp, Homo sapiens
gctttttctaatagcagtcc

SEQ ID NO: 8547713 - DNA, 22 bp, Homo sapiens
gcttttttgggatgcctgcctt

SEQ ID NO: 8547714 - DNA, 22 bp, Homo sapiens
gcttttttgctattgaagtggt

SEQ ID NO: 8547715 - DNA, 22 bp, Homo sapiens
gcttttttaggtaagacccagg

SEQ ID NO: 8547716 - DNA, 19 bp, Homo sapiens
gctttttgttgtcaaaggt

SEQ ID NO: 8547717 - DNA, 19 bp, Homo sapiens
gctttagtttactcatcta

SEQ ID NO: 8547718 - DNA, 22 bp, Homo sapiens
gctttagatactcccaatgtcc

SEQ ID NO: 8547719 - DNA, 22 bp, Homo sapiens
gctttagaaatatcactgtgga

SEQ ID NO: 8547720 - DNA, 22 bp, Homo sapiens
gctttacattttggaaaggtga

SEQ ID NO: 8547721 - DNA, 22 bp, Homo sapiens
gctttactgagatgacacaggg

SEQ ID NO: 8547722 - DNA, 22 bp, Homo sapiens
gctttacattttggaaaggtga

SEQ ID NO: 8547723 - DNA, 22 bp, Homo sapiens
gctttactgtctggaaagtttg

SEQ ID NO: 8547724 - DNA, 22 bp, Homo sapiens
gctttgtgaattattactcaca

SEQ ID NO: 8547725 - DNA, 22 bp, Homo sapiens
gctttgtgaattattactcaca

SEQ ID NO: 8547726 - DNA, 22 bp, Homo sapiens
gctttggatgtgtgcctgaggt

SEQ ID NO: 8547727 - DNA, 22 bp, Homo sapiens
gctgtacagggttatcctttcc

SEQ ID NO: 8547728 - DNA, 23 bp, Homo sapiens
gctgtacaggaaccagtttggag

SEQ ID NO: 8547729 - DNA, 19 bp, Homo sapiens
gctgtacagtaaggagaca

SEQ ID NO: 8547730 - DNA, 22 bp, Homo sapiens
gctgtacagtttactaggtggg

SEQ ID NO: 8547731 - DNA, 22 bp, Homo sapiens
gctgtacatcacaatttgctgt

SEQ ID NO: 8547732 - DNA, 22 bp, Homo sapiens
gctgtacattctgtgggtttgg

SEQ ID NO: 8547733 - DNA, 22 bp, Homo sapiens
gctgtacattctgcacaggccc

SEQ ID NO: 8547734 - DNA, 22 bp, Homo sapiens
gctgtacatttgtgtacacttg

SEQ ID NO: 8547735 - DNA, 22 bp, Homo sapiens
gctggtccagggcctctgtggg

SEQ ID NO: 8547736 - DNA, 22 bp, Homo sapiens
gctggtccactccctggaggct

SEQ ID NO: 8547737 - DNA, 22 bp, Homo sapiens
gctggccacactgctgatggag

SEQ ID NO: 8547738 - DNA, 22 bp, Homo sapiens
gctggccacactgctgatggag

SEQ ID NO: 8547739 - DNA, 22 bp, Homo sapiens
gctggccacactgctgatggag

SEQ ID NO: 8547740 - DNA, 22 bp, Homo sapiens
gctggccacagatccccaggga

SEQ ID NO: 8547741 - DNA, 22 bp, Homo sapiens
gctggccacagatccccaggga

SEQ ID NO: 8547742 - DNA, 22 bp, Homo sapiens
gctggccacagatccccaggga

SEQ ID NO: 8547743 - DNA, 19 bp, Homo sapiens
gctggccacgccccagttg

SEQ ID NO: 8547744 - DNA, 22 bp, Homo sapiens
gctggccagccctcttcctcca

SEQ ID NO: 8547745 - DNA, 19 bp, Homo sapiens
gctggccacgccccagttg

SEQ ID NO: 8547746 - DNA, 22 bp, Homo sapiens
gctggccacattgtgccgtcct

SEQ ID NO: 8547747 - DNA, 22 bp, Homo sapiens
gctgtagtgaatggccgcgttc

SEQ ID NO: 8547748 - DNA, 17 bp, Homo sapiens
gctgtagtttgataaga

SEQ ID NO: 8547749 - DNA, 22 bp, Homo sapiens
gctgtatgtgaggccacagtga

SEQ ID NO: 8547750 - DNA, 22 bp, Homo sapiens
gctgtatgagttcatgtgtaga

SEQ ID NO: 8547751 - DNA, 22 bp, Homo sapiens
gctgtagatggactggcatcca

SEQ ID NO: 8547752 - DNA, 22 bp, Homo sapiens
gctgtaggtaaggatggcaaag

SEQ ID NO: 8547753 - DNA, 22 bp, Homo sapiens
gctgtcacaaatatttctcagc

SEQ ID NO: 8547754 - DNA, 22 bp, Homo sapiens
gctgtatttatatgaaggcatg

SEQ ID NO: 8547755 - DNA, 22 bp, Homo sapiens
gctgtatttattttctagggtt

SEQ ID NO: 8547756 - DNA, 22 bp, Homo sapiens
gctgtatttaacaactggctca

SEQ ID NO: 8547757 - DNA, 22 bp, Homo sapiens
gctgtatttaacaactggctca

SEQ ID NO: 8547758 - DNA, 22 bp, Homo sapiens
gctgtattggaacacatccatg

SEQ ID NO: 8547759 - DNA, 22 bp, Homo sapiens
gctgtattcctgcactgtatag

SEQ ID NO: 8547760 - DNA, 22 bp, Homo sapiens
gctgtattcctgcactgtatag

SEQ ID NO: 8547761 - DNA, 19 bp, Homo sapiens
gctgtattaaagatacatg

SEQ ID NO: 8547762 - DNA, 22 bp, Homo sapiens
gctgtcaccaaagcaggcactg

SEQ ID NO: 8547763 - DNA, 22 bp, Homo sapiens
gctgtcacatttggagcactgg

SEQ ID NO: 8547764 - DNA, 22 bp, Homo sapiens
gctgtcacatcaaggcactaaa

SEQ ID NO: 8547765 - DNA, 22 bp, Homo sapiens
gctgtcacaagcatctggggca

SEQ ID NO: 8547766 - DNA, 22 bp, Homo sapiens
gctgtcacaagcatctggggca

SEQ ID NO: 8547767 - DNA, 22 bp, Homo sapiens
gctgtcacacatggccccagct

SEQ ID NO: 8547768 - DNA, 22 bp, Homo sapiens
gctgtcacacatgggatctcag

SEQ ID NO: 8547769 - DNA, 22 bp, Homo sapiens
gctgtcagtgaggtgagacatg

SEQ ID NO: 8547770 - DNA, 23 bp, Homo sapiens
gctgtcagttgtttttgtctcta

SEQ ID NO: 8547771 - DNA, 22 bp, Homo sapiens
gctgtcaggaacatgccttggt

SEQ ID NO: 8547772 - DNA, 22 bp, Homo sapiens
gctgtcaggccatgtgggcctt

SEQ ID NO: 8547773 - DNA, 22 bp, Homo sapiens
gctgtcagaaggtgaagggtaa

SEQ ID NO: 8547774 - DNA, 22 bp, Homo sapiens
gctgtcagcgcccaaggagctc

SEQ ID NO: 8547775 - DNA, 22 bp, Homo sapiens
gctgtcactctccggccttccc

SEQ ID NO: 8547776 - DNA, 22 bp, Homo sapiens
gctgtcactcaccaggcctgca

SEQ ID NO: 8547777 - DNA, 23 bp, Homo sapiens
gctgtctgtcatctctgcgggag

SEQ ID NO: 8547778 - DNA, 22 bp, Homo sapiens
gctgtctgtctctgtcccacca

SEQ ID NO: 8547779 - DNA, 22 bp, Homo sapiens
gctgtctgggttgagggccctg

SEQ ID NO: 8547780 - DNA, 23 bp, Homo sapiens
gctgtctgtcatctctgcgggag

SEQ ID NO: 8547781 - DNA, 22 bp, Homo sapiens
gctgtctgggttgagggccctg

SEQ ID NO: 8547782 - DNA, 22 bp, Homo sapiens
gctgtctgggttgagggccctg

SEQ ID NO: 8547783 - DNA, 22 bp, Homo sapiens
gctgtctgttcgagcgtgtgtt

SEQ ID NO: 8547784 - DNA, 22 bp, Homo sapiens
gctgtctgtggtgtcagctgac

SEQ ID NO: 8547785 - DNA, 22 bp, Homo sapiens
gctgtctgtcttcacatctcgc

SEQ ID NO: 8547786 - DNA, 22 bp, Homo sapiens
gctgtctgtcttcacatctcgc

SEQ ID NO: 8547787 - DNA, 22 bp, Homo sapiens
gctgtctgtctctgtgacttaa

SEQ ID NO: 8547788 - DNA, 22 bp, Homo sapiens
gctgtctgtctctgtcccacca

SEQ ID NO: 8547789 - DNA, 22 bp, Homo sapiens
gctgtctgggaggcctccactt

SEQ ID NO: 8547790 - DNA, 22 bp, Homo sapiens
gctgtctggcatggcgtggctg

SEQ ID NO: 8547791 - DNA, 22 bp, Homo sapiens
gctgtctgggatgtcactgctg

SEQ ID NO: 8547792 - DNA, 20 bp, Homo sapiens
gctgtctggattagaagcct

SEQ ID NO: 8547793 - DNA, 20 bp, Homo sapiens
gctgtctggattagaagcct

SEQ ID NO: 8547794 - DNA, 22 bp, Homo sapiens
gctgtctgctgtgcactgagca

SEQ ID NO: 8547795 - DNA, 22 bp, Homo sapiens
gctgtctggaggctctgaggga

SEQ ID NO: 8547796 - DNA, 22 bp, Homo sapiens
gctgtctggaggctctgaggga

SEQ ID NO: 8547797 - DNA, 22 bp, Homo sapiens
gctgtctggaggctctgaggga

SEQ ID NO: 8547798 - DNA, 22 bp, Homo sapiens
gctgtgtgctaggatatgtttt

SEQ ID NO: 8547799 - DNA, 22 bp, Homo sapiens
gctgtgtgctaggatatgtttt

SEQ ID NO: 8547800 - DNA, 22 bp, Homo sapiens
gctgtgtgctcacgtagtggaa

SEQ ID NO: 8547801 - DNA, 22 bp, Homo sapiens
gctgtgtgctaggatatgtttt

SEQ ID NO: 8547802 - DNA, 22 bp, Homo sapiens
gctgtgtgctcacgtagtggaa

SEQ ID NO: 8547803 - DNA, 22 bp, Homo sapiens
gctgtgtgctcacgtagtggaa

SEQ ID NO: 8547804 - DNA, 22 bp, Homo sapiens
gctgtgtgctcacgtagtggaa

SEQ ID NO: 8547805 - DNA, 22 bp, Homo sapiens
gctgtgtgctaggatatgtttt

SEQ ID NO: 8547806 - DNA, 22 bp, Homo sapiens
gctgtgtgccaggggaaggctg

SEQ ID NO: 8547807 - DNA, 22 bp, Homo sapiens
gctgtgtgccaggggaaggctg

SEQ ID NO: 8547808 - DNA, 22 bp, Homo sapiens
gctgtgtgccaggggaaggctg

SEQ ID NO: 8547809 - DNA, 18 bp, Homo sapiens
gctgtgtgcacctgataa

SEQ ID NO: 8547810 - DNA, 22 bp, Homo sapiens
gctgtgtgccaggggaaggctg

SEQ ID NO: 8547811 - DNA, 18 bp, Homo sapiens
gctgtgtgcacctgataa

SEQ ID NO: 8547812 - DNA, 19 bp, Homo sapiens
gctgtgtgaccttgggcaa

SEQ ID NO: 8547813 - DNA, 22 bp, Homo sapiens
gctgtgtgactgagagcctggc

SEQ ID NO: 8547814 - DNA, 22 bp, Homo sapiens
gctgtgtgactgagagcctggc

SEQ ID NO: 8547815 - DNA, 22 bp, Homo sapiens
gctgtgtgactgagagcctggc

SEQ ID NO: 8547816 - DNA, 22 bp, Homo sapiens
gctgtgtgactgagagcctggc

SEQ ID NO: 8547817 - DNA, 22 bp, Homo sapiens
gctgtgtgactgagagcctggc

SEQ ID NO: 8547818 - DNA, 19 bp, Homo sapiens
gctgtgtgaccttgggcaa

SEQ ID NO: 8547819 - DNA, 19 bp, Homo sapiens
gctgtgtgaccttgggcaa

SEQ ID NO: 8547820 - DNA, 19 bp, Homo sapiens
gctgtgtgaccttgggcaa

SEQ ID NO: 8547821 - DNA, 22 bp, Homo sapiens
gctgtgtgacctgggcaagtct

SEQ ID NO: 8547822 - DNA, 19 bp, Homo sapiens
gctgtgtgaccttgggcaa

SEQ ID NO: 8547823 - DNA, 22 bp, Homo sapiens
gctgtctgtggtgtcagctgac

SEQ ID NO: 8547824 - DNA, 22 bp, Homo sapiens
gctgtgtgacctgggcaagtct

SEQ ID NO: 8547825 - DNA, 22 bp, Homo sapiens
gctgtgtgacctgggcaagtct

SEQ ID NO: 8547826 - DNA, 22 bp, Homo sapiens
gctgtccagagcatgggagcaa

SEQ ID NO: 8547827 - DNA, 22 bp, Homo sapiens
gctgtccaggttgtggagcaac

SEQ ID NO: 8547828 - DNA, 22 bp, Homo sapiens
gctgtcagttttacccacagac

SEQ ID NO: 8547829 - DNA, 22 bp, Homo sapiens
gctgtcccgaacccctggtaat

SEQ ID NO: 8547830 - DNA, 23 bp, Homo sapiens
gctgtccccatgctccatccctg

SEQ ID NO: 8547831 - DNA, 22 bp, Homo sapiens
gctgtcccatggttgcaagatg

SEQ ID NO: 8547832 - DNA, 22 bp, Homo sapiens
gctgtcccatggttgcaagatg

SEQ ID NO: 8547833 - DNA, 20 bp, Homo sapiens
gctgtcccaggccaaagggc

SEQ ID NO: 8547834 - DNA, 22 bp, Homo sapiens
gctgtccatgtctggcctcagt

SEQ ID NO: 8547835 - DNA, 22 bp, Homo sapiens
gctgtccatccacttcccagcg

SEQ ID NO: 8547836 - DNA, 22 bp, Homo sapiens
gctgtctgctgtgcactgagca

SEQ ID NO: 8547837 - DNA, 22 bp, Homo sapiens
gctgtctcatacaaggccctgc

SEQ ID NO: 8547838 - DNA, 22 bp, Homo sapiens
gctgtctgctgggtcgctcagg

SEQ ID NO: 8547839 - DNA, 22 bp, Homo sapiens
gctgtctcatacaaggccctgc

SEQ ID NO: 8547840 - DNA, 22 bp, Homo sapiens
gctgtcgtgtgcaagtgacaga

SEQ ID NO: 8547841 - DNA, 22 bp, Homo sapiens
gctgtcgtgtgcaagtgacaga

SEQ ID NO: 8547842 - DNA, 22 bp, Homo sapiens
gctgtcctgggaacaggcacta

SEQ ID NO: 8547843 - DNA, 22 bp, Homo sapiens
gctgtcctcttggactcagggc

SEQ ID NO: 8547844 - DNA, 22 bp, Homo sapiens
gctgtcctctgatctctggagg

SEQ ID NO: 8547845 - DNA, 22 bp, Homo sapiens
gctgtcccttgtcccaccttgc

SEQ ID NO: 8547846 - DNA, 22 bp, Homo sapiens
gctgtccctttcacaaggtttt

SEQ ID NO: 8547847 - DNA, 22 bp, Homo sapiens
gctgtcccgctgacttccagct

SEQ ID NO: 8547848 - DNA, 22 bp, Homo sapiens
gctggccaaagtgtacctggag

SEQ ID NO: 8547849 - DNA, 22 bp, Homo sapiens
gctggcagtcccatcagctggg

SEQ ID NO: 8547850 - DNA, 22 bp, Homo sapiens
gctggagttggcaaggcatgta

SEQ ID NO: 8547851 - DNA, 22 bp, Homo sapiens
gctggagttggcaaggcatgta

SEQ ID NO: 8547852 - DNA, 22 bp, Homo sapiens
gctggcagggtggttgagagag

SEQ ID NO: 8547853 - DNA, 22 bp, Homo sapiens
gctggcaggtccaagatagagc

SEQ ID NO: 8547854 - DNA, 22 bp, Homo sapiens
gctggcaggtccaagatagagc

SEQ ID NO: 8547855 - DNA, 22 bp, Homo sapiens
gctggcaggtccaagatagagc

SEQ ID NO: 8547856 - DNA, 22 bp, Homo sapiens
gctggcaggtaaagccccgggg

SEQ ID NO: 8547857 - DNA, 22 bp, Homo sapiens
gctggcaggtaaagccccgggg

SEQ ID NO: 8547858 - DNA, 22 bp, Homo sapiens
gctggcaggtaaagccccgggg

SEQ ID NO: 8547859 - DNA, 22 bp, Homo sapiens
gctggagtctggaggtgtgcca

SEQ ID NO: 8547860 - DNA, 16 bp, Homo sapiens
gctggagtcctggagc

SEQ ID NO: 8547861 - DNA, 22 bp, Homo sapiens
gctggagtccagtggcatgatc

SEQ ID NO: 8547862 - DNA, 22 bp, Homo sapiens
gctggagtatctggggaaggag

SEQ ID NO: 8547863 - DNA, 22 bp, Homo sapiens
gctggaggtttcacctgagttt

SEQ ID NO: 8547864 - DNA, 22 bp, Homo sapiens
gctggaggtttcacctgagttt

SEQ ID NO: 8547865 - DNA, 22 bp, Homo sapiens
gctggaggtagggaggtcctgt

SEQ ID NO: 8547866 - DNA, 22 bp, Homo sapiens
gctggaggtagggaggtcctgt

SEQ ID NO: 8547867 - DNA, 22 bp, Homo sapiens
gctgctggaacaaatcacccca

SEQ ID NO: 8547868 - DNA, 22 bp, Homo sapiens
gctgctgcttgaaggctcggag

SEQ ID NO: 8547869 - DNA, 22 bp, Homo sapiens
gctgcctgaagtgtctacactg

SEQ ID NO: 8547870 - DNA, 22 bp, Homo sapiens
gctgctggcgctgggcgtccgg

SEQ ID NO: 8547871 - DNA, 22 bp, Homo sapiens
gctgcctctgtagctttggacc

SEQ ID NO: 8547872 - DNA, 22 bp, Homo sapiens
gctgcctctgtagctttggacc

SEQ ID NO: 8547873 - DNA, 23 bp, Homo sapiens
gctgcctctgttggtcttcagtt

SEQ ID NO: 8547874 - DNA, 23 bp, Homo sapiens
gctgcctctgttggtcttcagtt

SEQ ID NO: 8547875 - DNA, 23 bp, Homo sapiens
gctgcctctgttggtcttcagtt

SEQ ID NO: 8547876 - DNA, 22 bp, Homo sapiens
gctgcctgaagtgtctacactg

SEQ ID NO: 8547877 - DNA, 22 bp, Homo sapiens
gctgcctgaagtgtctacactg

SEQ ID NO: 8547878 - DNA, 22 bp, Homo sapiens
gctgcctgaaatgttgcctagc

SEQ ID NO: 8547879 - DNA, 22 bp, Homo sapiens
gctgctggggccttccctcggg

SEQ ID NO: 8547880 - DNA, 22 bp, Homo sapiens
gctgctgggaatgaacagtgtt

SEQ ID NO: 8547881 - DNA, 22 bp, Homo sapiens
gctgctgggaatgaacagtgtt

SEQ ID NO: 8547882 - DNA, 19 bp, Homo sapiens
gctgctggctctggctgga

SEQ ID NO: 8547883 - DNA, 22 bp, Homo sapiens
gctgctggtcctcagagctcat

SEQ ID NO: 8547884 - DNA, 22 bp, Homo sapiens
gctgctgtcacggtgctaaggg

SEQ ID NO: 8547885 - DNA, 22 bp, Homo sapiens
gctgctgtacttggggggtgct

SEQ ID NO: 8547886 - DNA, 18 bp, Homo sapiens
gctgctggtggagggagc

SEQ ID NO: 8547887 - DNA, 22 bp, Homo sapiens
gctggagctgcagcctgggcct

SEQ ID NO: 8547888 - DNA, 22 bp, Homo sapiens
gctggagctgcagcctgggcct

SEQ ID NO: 8547889 - DNA, 22 bp, Homo sapiens
gctgctgtctcatgcgatgcgg

SEQ ID NO: 8547890 - DNA, 22 bp, Homo sapiens
gctgctgtccttcaagtctgcg

SEQ ID NO: 8547891 - DNA, 22 bp, Homo sapiens
gctgctgtccttagggagttct

SEQ ID NO: 8547892 - DNA, 22 bp, Homo sapiens
gctgctgtcagtggtggcagtt

SEQ ID NO: 8547893 - DNA, 22 bp, Homo sapiens
gctgctgtcagtggtggcagtt

SEQ ID NO: 8547894 - DNA, 22 bp, Homo sapiens
gctgctgtcagtggtggcagtt

SEQ ID NO: 8547895 - DNA, 22 bp, Homo sapiens
gctggagcttgagaggacaggg

SEQ ID NO: 8547896 - DNA, 22 bp, Homo sapiens
gctggagcttgagaggacaggg

SEQ ID NO: 8547897 - DNA, 22 bp, Homo sapiens
gctggagcttgagaggacaggg

SEQ ID NO: 8547898 - DNA, 22 bp, Homo sapiens
gctgcctcccagagccctgcag

SEQ ID NO: 8547899 - DNA, 22 bp, Homo sapiens
gctgcctcccagagccctgcag

SEQ ID NO: 8547900 - DNA, 22 bp, Homo sapiens
gctgcctcccagagccctgcag

SEQ ID NO: 8547901 - DNA, 22 bp, Homo sapiens
gctgcctccactggctcccagt

SEQ ID NO: 8547902 - DNA, 22 bp, Homo sapiens
gctgcctccactggctcccagt

SEQ ID NO: 8547903 - DNA, 22 bp, Homo sapiens
gctgcctccgccggctccacag

SEQ ID NO: 8547904 - DNA, 22 bp, Homo sapiens
gctgcctccgccggctccacag

SEQ ID NO: 8547905 - DNA, 22 bp, Homo sapiens
gctgcctcccccatggctggaa

SEQ ID NO: 8547906 - DNA, 22 bp, Homo sapiens
gctgcctcccccatggctggaa

SEQ ID NO: 8547907 - DNA, 22 bp, Homo sapiens
gctgcctccgccggctccacag

SEQ ID NO: 8547908 - DNA, 22 bp, Homo sapiens
gctgcctcctgagatttgggca

SEQ ID NO: 8547909 - DNA, 22 bp, Homo sapiens
gctgcctctcctgagttgacag

SEQ ID NO: 8547910 - DNA, 22 bp, Homo sapiens
gctgcctctcctgagttgacag

SEQ ID NO: 8547911 - DNA, 22 bp, Homo sapiens
gctgcctcctgaaagcgctctg

SEQ ID NO: 8547912 - DNA, 22 bp, Homo sapiens
gctgcctcctgaaagcgctctg

SEQ ID NO: 8547913 - DNA, 22 bp, Homo sapiens
gctgcctcctgaaagcgctctg

SEQ ID NO: 8547914 - DNA, 23 bp, Homo sapiens
gctgcctcctacaaaagcccagc

SEQ ID NO: 8547915 - DNA, 23 bp, Homo sapiens
gctgcctcctacaaaagcccagc

SEQ ID NO: 8547916 - DNA, 22 bp, Homo sapiens
gctgcctctgcgactctgggcg

SEQ ID NO: 8547917 - DNA, 22 bp, Homo sapiens
gctgcctctgcgactctgggcg

SEQ ID NO: 8547918 - DNA, 22 bp, Homo sapiens
gctgcctctgcgactctgggcg

SEQ ID NO: 8547919 - DNA, 22 bp, Homo sapiens
gctgcctctgcgactctgggcg

SEQ ID NO: 8547920 - DNA, 22 bp, Homo sapiens
gctgcctctgcacagctcactc

SEQ ID NO: 8547921 - DNA, 22 bp, Homo sapiens
gctgcctctgcacagctcactc

SEQ ID NO: 8547922 - DNA, 22 bp, Homo sapiens
gctgcctctgcacagctcactc

SEQ ID NO: 8547923 - DNA, 22 bp, Homo sapiens
gctgcctctgcacagctcactc

SEQ ID NO: 8547924 - DNA, 22 bp, Homo sapiens
gctgcaggcggccgtggtggcg

SEQ ID NO: 8547925 - DNA, 22 bp, Homo sapiens
gctgcaggctctgcaggaattg

SEQ ID NO: 8547926 - DNA, 22 bp, Homo sapiens
gctgcaggctctgcaggaattg

SEQ ID NO: 8547927 - DNA, 22 bp, Homo sapiens
gctgcaggctgtggcaggggag

SEQ ID NO: 8547928 - DNA, 22 bp, Homo sapiens
gctgcaggctgtggcaggggag

SEQ ID NO: 8547929 - DNA, 22 bp, Homo sapiens
gctgcagggaatgtatggattt

SEQ ID NO: 8547930 - DNA, 21 bp, Homo sapiens
gctgcagggcccagggcaccc

SEQ ID NO: 8547931 - DNA, 22 bp, Homo sapiens
gctgcagggagctggaaggctc

SEQ ID NO: 8547932 - DNA, 22 bp, Homo sapiens
gctgcagggagctggaaggctc

SEQ ID NO: 8547933 - DNA, 22 bp, Homo sapiens
gctgcagggagctggaaggctc

SEQ ID NO: 8547934 - DNA, 18 bp, Homo sapiens
gctgcaggcgcctgcggt

SEQ ID NO: 8547935 - DNA, 22 bp, Homo sapiens
gctgcaggcagaatctcccaat

SEQ ID NO: 8547936 - DNA, 22 bp, Homo sapiens
gctgcaggcattttcctgggca

SEQ ID NO: 8547937 - DNA, 22 bp, Homo sapiens
gctgcaggcattttcctgggca

SEQ ID NO: 8547938 - DNA, 22 bp, Homo sapiens
gctgataaatagttgatgtacc

SEQ ID NO: 8547939 - DNA, 22 bp, Homo sapiens
gctgagtgaggtccagagcttg

SEQ ID NO: 8547940 - DNA, 22 bp, Homo sapiens
gctgagtgattgatattttagt

SEQ ID NO: 8547941 - DNA, 22 bp, Homo sapiens
gctgagtgattcatacgctgct

SEQ ID NO: 8547942 - DNA, 22 bp, Homo sapiens
gctgagtgaggtccagagcttg

SEQ ID NO: 8547943 - DNA, 22 bp, Homo sapiens
gctgagtgaaagtttgctgtgt

SEQ ID NO: 8547944 - DNA, 22 bp, Homo sapiens
gctgagtggagcagtcagcgct

SEQ ID NO: 8547945 - DNA, 17 bp, Homo sapiens
gctgagtgcagggagtc

SEQ ID NO: 8547946 - DNA, 17 bp, Homo sapiens
gctgagtgcagggagtc

SEQ ID NO: 8547947 - DNA, 22 bp, Homo sapiens
gctgagtgtaatgatggcagag

SEQ ID NO: 8547948 - DNA, 22 bp, Homo sapiens
gctgagtgtaatgatggcagag

SEQ ID NO: 8547949 - DNA, 22 bp, Homo sapiens
gctgagttgaaagcagaggata

SEQ ID NO: 8547950 - DNA, 22 bp, Homo sapiens
gctgagggggaaggaaagctga

SEQ ID NO: 8547951 - DNA, 20 bp, Homo sapiens
gctgaggggtctatggcata

SEQ ID NO: 8547952 - DNA, 22 bp, Homo sapiens
gctctgtgtatgtggcaggtgc

SEQ ID NO: 8547953 - DNA, 22 bp, Homo sapiens
gctctgtgtccacagctggaaa

SEQ ID NO: 8547954 - DNA, 22 bp, Homo sapiens
gctgagggctgtaacagcagag

SEQ ID NO: 8547955 - DNA, 23 bp, Homo sapiens
gctgaggtacatttacaggaaga

SEQ ID NO: 8547956 - DNA, 23 bp, Homo sapiens
gctgaggtacatttacaggaaga

SEQ ID NO: 8547957 - DNA, 22 bp, Homo sapiens
gctgagggtaacacttcgggat

SEQ ID NO: 8547958 - DNA, 22 bp, Homo sapiens
gctctgtgtaaatgtagggtcc

SEQ ID NO: 8547959 - DNA, 22 bp, Homo sapiens
gctctgtgtaaatgtagggtcc

SEQ ID NO: 8547960 - DNA, 20 bp, Homo sapiens
gctctgtggtttgagtctcc

SEQ ID NO: 8547961 - DNA, 20 bp, Homo sapiens
gctctgtggtttgagtctcc

SEQ ID NO: 8547962 - DNA, 20 bp, Homo sapiens
gctctgtggtttgagtctcc

SEQ ID NO: 8547963 - DNA, 20 bp, Homo sapiens
gctctgtggtttgagtctcc

SEQ ID NO: 8547964 - DNA, 22 bp, Homo sapiens
gctctgtggtggggcagagttt

SEQ ID NO: 8547965 - DNA, 22 bp, Homo sapiens
gctctgtgggtgagtagaatct

SEQ ID NO: 8547966 - DNA, 22 bp, Homo sapiens
gctctgtgggtgagtagaatct

SEQ ID NO: 8547967 - DNA, 22 bp, Homo sapiens
gctctgtgggtgagtagaatct

SEQ ID NO: 8547968 - DNA, 22 bp, Homo sapiens
gctctgtggcattcatgggcag

SEQ ID NO: 8547969 - DNA, 22 bp, Homo sapiens
gctctgtggcattcatgggcag

SEQ ID NO: 8547970 - DNA, 18 bp, Homo sapiens
gctgaggtggtgtcagag

SEQ ID NO: 8547971 - DNA, 18 bp, Homo sapiens
gctgaggtggtgtcagag

SEQ ID NO: 8547972 - DNA, 22 bp, Homo sapiens
gctgaggtggtgatggttcatc

SEQ ID NO: 8547973 - DNA, 22 bp, Homo sapiens
gctgaggtggctgccttagtaa

SEQ ID NO: 8547974 - DNA, 22 bp, Homo sapiens
gctgaggtggctgccttagtaa

SEQ ID NO: 8547975 - DNA, 22 bp, Homo sapiens
gctgaggtgtcaccttgctggg

SEQ ID NO: 8547976 - DNA, 22 bp, Homo sapiens
gctgaggtgtcaccttgctggg

SEQ ID NO: 8547977 - DNA, 18 bp, Homo sapiens
gctgaggtggtgtcagag

SEQ ID NO: 8547978 - DNA, 20 bp, Homo sapiens
gctgaggtttcttcctatat

SEQ ID NO: 8547979 - DNA, 20 bp, Homo sapiens
gctgaggtttcttcctatat

SEQ ID NO: 8547980 - DNA, 22 bp, Homo sapiens
gctgaggtttcaggagtggcag

SEQ ID NO: 8547981 - DNA, 22 bp, Homo sapiens
gctgagtcagattgcagtcttg

SEQ ID NO: 8547982 - DNA, 22 bp, Homo sapiens
gctgaggttttctgcctgctca

SEQ ID NO: 8547983 - DNA, 22 bp, Homo sapiens
gctgagtcttgagcactgagca

SEQ ID NO: 8547984 - DNA, 22 bp, Homo sapiens
gctgagtcagattgcagtcttg

SEQ ID NO: 8547985 - DNA, 22 bp, Homo sapiens
gctcagttatccgtgtgtgact

SEQ ID NO: 8547986 - DNA, 20 bp, Homo sapiens
gctcagtggagaaatgcacc

SEQ ID NO: 8547987 - DNA, 19 bp, Homo sapiens
gctcagtgatgccagacca

SEQ ID NO: 8547988 - DNA, 22 bp, Homo sapiens
gctcagggcgcgagggacgtgg

SEQ ID NO: 8547989 - DNA, 22 bp, Homo sapiens
gctcccagcaattgaggcagcc

SEQ ID NO: 8547990 - DNA, 22 bp, Homo sapiens
gctcccagcaattgaggcagcc

SEQ ID NO: 8547991 - DNA, 22 bp, Homo sapiens
gctcccagcaattgaggcagcc

SEQ ID NO: 8547992 - DNA, 22 bp, Homo sapiens
gctcccagcaattgaggcagcc

SEQ ID NO: 8547993 - DNA, 22 bp, Homo sapiens
gctcccagatttcagccttgtg

SEQ ID NO: 8547994 - DNA, 22 bp, Homo sapiens
gctcccagatttcagccttgtg

SEQ ID NO: 8547995 - DNA, 22 bp, Homo sapiens
gctcccagatttcagccttgtg

SEQ ID NO: 8547996 - DNA, 22 bp, Homo sapiens
gctcccagatttcagccttgtg

SEQ ID NO: 8547997 - DNA, 22 bp, Homo sapiens
gctcccagactgaccagaggtg

SEQ ID NO: 8547998 - DNA, 22 bp, Homo sapiens
gctcccagactgaccagaggtg

SEQ ID NO: 8547999 - DNA, 22 bp, Homo sapiens
gctcccagactgaccagaggtg

SEQ ID NO: 8548000 - DNA, 22 bp, Homo sapiens
gctcccagactgaccagaggtg

SEQ ID NO: 8548001 - DNA, 22 bp, Homo sapiens
gctcatccagcaagccagggcc

SEQ ID NO: 8548002 - DNA, 23 bp, Homo sapiens
gctcatccacggagaggggctcc

SEQ ID NO: 8548003 - DNA, 22 bp, Homo sapiens
gctcccagactgaccagaggtg

SEQ ID NO: 8548004 - DNA, 22 bp, Homo sapiens
gctcagggaatgagaagatgtt

SEQ ID NO: 8548005 - DNA, 22 bp, Homo sapiens
gctcagggaaggccacgtgaga

SEQ ID NO: 8548006 - DNA, 22 bp, Homo sapiens
gctcagggaactttttgcaggc

SEQ ID NO: 8548007 - DNA, 21 bp, Homo sapiens
gctatacagaatggccagagg

SEQ ID NO: 8548008 - DNA, 20 bp, Homo sapiens
gctcagggaattcaggaagc

SEQ ID NO: 8548009 - DNA, 22 bp, Homo sapiens
gctaggttggggaagttctcct

SEQ ID NO: 8548010 - DNA, 22 bp, Homo sapiens
gctagtgcagggaaatctttgg

SEQ ID NO: 8548011 - DNA, 22 bp, Homo sapiens
gctagtttcttgaatactctaa

SEQ ID NO: 8548012 - DNA, 22 bp, Homo sapiens
gctatacaagtgtagaatagag

SEQ ID NO: 8548013 - DNA, 22 bp, Homo sapiens
gctatacacatttcttggtagt

SEQ ID NO: 8548014 - DNA, 22 bp, Homo sapiens
gctatacaagtgtagaatagag

SEQ ID NO: 8548015 - DNA, 22 bp, Homo sapiens
gctcagggcctggctgcggact

SEQ ID NO: 8548016 - DNA, 22 bp, Homo sapiens
gctcagggccatggaccagcag

SEQ ID NO: 8548017 - DNA, 20 bp, Homo sapiens
gctcagggcctgggtctgga

SEQ ID NO: 8548018 - DNA, 20 bp, Homo sapiens
gctcagggcctgggtctgga

SEQ ID NO: 8548019 - DNA, 22 bp, Homo sapiens
gctcagggagtttcacagtgta

SEQ ID NO: 8548020 - DNA, 22 bp, Homo sapiens
gctcagggagagagggcagccg

SEQ ID NO: 8548021 - DNA, 22 bp, Homo sapiens
gctcagggagcgatttaccatg

SEQ ID NO: 8548022 - DNA, 16 bp, Homo sapiens
gcctggagtggcaggg

SEQ ID NO: 8548023 - DNA, 22 bp, Homo sapiens
gcctggagtggtcctgctgccc

SEQ ID NO: 8548024 - DNA, 22 bp, Homo sapiens
gcctggagtggtcctgctgccc

SEQ ID NO: 8548025 - DNA, 22 bp, Homo sapiens
gcctggagtggtcctgctgccc

SEQ ID NO: 8548026 - DNA, 22 bp, Homo sapiens
gcctggagtggtcctgctgccc

SEQ ID NO: 8548027 - DNA, 22 bp, Homo sapiens
gcctggagtggtcctgctgccc

SEQ ID NO: 8548028 - DNA, 22 bp, Homo sapiens
gcctggagtgttggtatttctc

SEQ ID NO: 8548029 - DNA, 22 bp, Homo sapiens
gcctggagtgttggtatttctc

SEQ ID NO: 8548030 - DNA, 22 bp, Homo sapiens
gcctggagtgttggtatttctc

SEQ ID NO: 8548031 - DNA, 20 bp, Homo sapiens
gcctggagttagttttcctt

SEQ ID NO: 8548032 - DNA, 20 bp, Homo sapiens
gcctggagttagttttcctt

SEQ ID NO: 8548033 - DNA, 20 bp, Homo sapiens
gcctggagttagttttcctt

SEQ ID NO: 8548034 - DNA, 22 bp, Homo sapiens
gcctggagttcagccaagtccc

SEQ ID NO: 8548035 - DNA, 22 bp, Homo sapiens
gcctggagttcagccaagtccc

SEQ ID NO: 8548036 - DNA, 22 bp, Homo sapiens
gcctggagttcagccaagtccc

SEQ ID NO: 8548037 - DNA, 22 bp, Homo sapiens
gcctggagttcagccaagtccc

SEQ ID NO: 8548038 - DNA, 22 bp, Homo sapiens
gcctggagttcagccaagtccc

SEQ ID NO: 8548039 - DNA, 20 bp, Homo sapiens
gcctggcacccggggctggc

SEQ ID NO: 8548040 - DNA, 20 bp, Homo sapiens
gcctggcacccggggctggc

SEQ ID NO: 8548041 - DNA, 20 bp, Homo sapiens
gcctggcacccggggctggc

SEQ ID NO: 8548042 - DNA, 22 bp, Homo sapiens
gcctggcaggcctcatgagggg

SEQ ID NO: 8548043 - DNA, 22 bp, Homo sapiens
gcctggcaggcctcatgagggg

SEQ ID NO: 8548044 - DNA, 22 bp, Homo sapiens
gctagaaactgtttaatctctt

SEQ ID NO: 8548045 - DNA, 22 bp, Homo sapiens
gcctggcactcactgaagaggc

SEQ ID NO: 8548046 - DNA, 22 bp, Homo sapiens
gctaggcttcaaaatctccctg

SEQ ID NO: 8548047 - DNA, 18 bp, Homo sapiens
gctagggcatgcatggtg

SEQ ID NO: 8548048 - DNA, 19 bp, Homo sapiens
gctagggttggtggcgtgc

SEQ ID NO: 8548049 - DNA, 22 bp, Homo sapiens
gctaggtctgtgcgcagccgct

SEQ ID NO: 8548050 - DNA, 20 bp, Homo sapiens
gctaggctggtgattgtcaa

SEQ ID NO: 8548051 - DNA, 22 bp, Homo sapiens
gctaggctgtgtttcagaccct

SEQ ID NO: 8548052 - DNA, 22 bp, Homo sapiens
gctaggctgtgtttcagaccct

SEQ ID NO: 8548053 - DNA, 19 bp, Homo sapiens
gctaggctggccttgaggg

SEQ ID NO: 8548054 - DNA, 22 bp, Homo sapiens
gctaggctcggaagcagcaggg

SEQ ID NO: 8548055 - DNA, 22 bp, Homo sapiens
gctaggagattgagctctgaag

SEQ ID NO: 8548056 - DNA, 22 bp, Homo sapiens
gctaggaggaagaatgtgaatt

SEQ ID NO: 8548057 - DNA, 22 bp, Homo sapiens
gctagctttataatgctgggcg

SEQ ID NO: 8548058 - DNA, 22 bp, Homo sapiens
gctagctttataatgctgggcg

SEQ ID NO: 8548059 - DNA, 22 bp, Homo sapiens
gctagaaatcgacttcagaatt

SEQ ID NO: 8548060 - DNA, 22 bp, Homo sapiens
gctctgtcaacagctagctgtg

SEQ ID NO: 8548061 - DNA, 22 bp, Homo sapiens
gctctgtcaacagctagctgtg

SEQ ID NO: 8548062 - DNA, 22 bp, Homo sapiens
gctctgtcaacagctagctgtg

SEQ ID NO: 8548063 - DNA, 22 bp, Homo sapiens
gctctgtcattttgcagacact

SEQ ID NO: 8548064 - DNA, 22 bp, Homo sapiens
gctctgtccagcgtgcacagaa

SEQ ID NO: 8548065 - DNA, 22 bp, Homo sapiens
gctctgtccagcgtgcacagaa

SEQ ID NO: 8548066 - DNA, 21 bp, Homo sapiens
gctctgtccctgctgtgtgtc

SEQ ID NO: 8548067 - DNA, 20 bp, Homo sapiens
gctctgtctggcctactttt

SEQ ID NO: 8548068 - DNA, 22 bp, Homo sapiens
gctctgtcttcagcacacagta

SEQ ID NO: 8548069 - DNA, 22 bp, Homo sapiens
gctctgtgaagggtgttgctca

SEQ ID NO: 8548070 - DNA, 22 bp, Homo sapiens
gctctgtgaagggtgttgctca

SEQ ID NO: 8548071 - DNA, 22 bp, Homo sapiens
gctctgtgagtattggccctgg

SEQ ID NO: 8548072 - DNA, 22 bp, Homo sapiens
gctctgtgagccacttgatgta

SEQ ID NO: 8548073 - DNA, 22 bp, Homo sapiens
gctctgtgagccacttgatgta

SEQ ID NO: 8548074 - DNA, 22 bp, Homo sapiens
gctctgtgagccacttgatgta

SEQ ID NO: 8548075 - DNA, 18 bp, Homo sapiens
gctctgtgaccttgagca

SEQ ID NO: 8548076 - DNA, 22 bp, Homo sapiens
gctctgtgcagttcagggacac

SEQ ID NO: 8548077 - DNA, 22 bp, Homo sapiens
gctctgtgcagttcagggacac

SEQ ID NO: 8548078 - DNA, 22 bp, Homo sapiens
gctctgtgccacatgcagtgtt

SEQ ID NO: 8548079 - DNA, 22 bp, Homo sapiens
gctctgtgccacatgcagtgtt

SEQ ID NO: 8548080 - DNA, 22 bp, Homo sapiens
gctctgtgccacatgcagtgtt

SEQ ID NO: 8548081 - DNA, 22 bp, Homo sapiens
gctctgtgccacatgcagtgtt

SEQ ID NO: 8548082 - DNA, 19 bp, Homo sapiens
gctctgtgatgctgagggg

SEQ ID NO: 8548083 - DNA, 19 bp, Homo sapiens
gctctgtgatgctgagggg

SEQ ID NO: 8548084 - DNA, 19 bp, Homo sapiens
gctctgtgatgctgagggg

SEQ ID NO: 8548085 - DNA, 22 bp, Homo sapiens
gctctgtgcccctgccgtggac

SEQ ID NO: 8548086 - DNA, 22 bp, Homo sapiens
gctctgtgccacatgcagtgtt

SEQ ID NO: 8548087 - DNA, 22 bp, Homo sapiens
gctctgtgccagggctgggcca

SEQ ID NO: 8548088 - DNA, 22 bp, Homo sapiens
gctctgtggcaggaggtcttgt

SEQ ID NO: 8548089 - DNA, 22 bp, Homo sapiens
gctctgtggcaggaggtcttgt

SEQ ID NO: 8548090 - DNA, 22 bp, Homo sapiens
gctctgtggcaggaggtcttgt

SEQ ID NO: 8548091 - DNA, 20 bp, Homo sapiens
gctctgtgctggcggaggct

SEQ ID NO: 8548092 - DNA, 22 bp, Homo sapiens
gctctgtgctagaactaagaat

SEQ ID NO: 8548093 - DNA, 22 bp, Homo sapiens
gctctctgggtgtgtctagata

SEQ ID NO: 8548094 - DNA, 22 bp, Homo sapiens
gctctctggttccagtcaggaa

SEQ ID NO: 8548095 - DNA, 22 bp, Homo sapiens
gctctctggttccagtcaggaa

SEQ ID NO: 8548096 - DNA, 22 bp, Homo sapiens
gctctctgggtggtgggcaaca

SEQ ID NO: 8548097 - DNA, 22 bp, Homo sapiens
gctctctgggtggtgggcaaca

SEQ ID NO: 8548098 - DNA, 22 bp, Homo sapiens
gctctctggaaggtatcattat

SEQ ID NO: 8548099 - DNA, 22 bp, Homo sapiens
gctctctggctagtccatcggg

SEQ ID NO: 8548100 - DNA, 22 bp, Homo sapiens
gctctctgccatatgaggatac

SEQ ID NO: 8548101 - DNA, 22 bp, Homo sapiens
gctctctgccatatgaggatac

SEQ ID NO: 8548102 - DNA, 22 bp, Homo sapiens
gctctctgcctttctcaatgac

SEQ ID NO: 8548103 - DNA, 22 bp, Homo sapiens
gctctctgcctttctcaatgac

SEQ ID NO: 8548104 - DNA, 22 bp, Homo sapiens
gctctctggaggccatggacag

SEQ ID NO: 8548105 - DNA, 22 bp, Homo sapiens
gctctctggaggccatggacag

SEQ ID NO: 8548106 - DNA, 22 bp, Homo sapiens
gctctctgcctttctcaatgac

SEQ ID NO: 8548107 - DNA, 22 bp, Homo sapiens
gctctctgcctttctcaatgac

SEQ ID NO: 8548108 - DNA, 22 bp, Homo sapiens
gctctctggaaggtatcattat

SEQ ID NO: 8548109 - DNA, 22 bp, Homo sapiens
gctctctggaaggtatcattat

SEQ ID NO: 8548110 - DNA, 22 bp, Homo sapiens
gctctggggttggaaagtgatc

SEQ ID NO: 8548111 - DNA, 22 bp, Homo sapiens
gctctcttgacagcttgctgtt

SEQ ID NO: 8548112 - DNA, 22 bp, Homo sapiens
gctctcttgacagcttgctgtt

SEQ ID NO: 8548113 - DNA, 22 bp, Homo sapiens
gctctcttggtggctgtcctgg

SEQ ID NO: 8548114 - DNA, 22 bp, Homo sapiens
gctctcttggtggctgtcctgg

SEQ ID NO: 8548115 - DNA, 22 bp, Homo sapiens
gctctctgtcgttatgcttcat

SEQ ID NO: 8548116 - DNA, 22 bp, Homo sapiens
gctctctgtcgttatgcttcat

SEQ ID NO: 8548117 - DNA, 22 bp, Homo sapiens
gctctctgtcgttatgcttcat

SEQ ID NO: 8548118 - DNA, 22 bp, Homo sapiens
gctctctgttattaagatcttt

SEQ ID NO: 8548119 - DNA, 22 bp, Homo sapiens
gctctcttgacagcttgctgtt

SEQ ID NO: 8548120 - DNA, 22 bp, Homo sapiens
gctctgtacgcaggatgagggg

SEQ ID NO: 8548121 - DNA, 22 bp, Homo sapiens
gctctgtaaagaagagaaatgc

SEQ ID NO: 8548122 - DNA, 22 bp, Homo sapiens
gctctgggtagccactgcctgg

SEQ ID NO: 8548123 - DNA, 22 bp, Homo sapiens
gctctgggtagccactgcctgg

SEQ ID NO: 8548124 - DNA, 22 bp, Homo sapiens
gctctgggtagccactgcctgg

SEQ ID NO: 8548125 - DNA, 22 bp, Homo sapiens
gctcccaggaagagaagggcca

SEQ ID NO: 8548126 - DNA, 22 bp, Homo sapiens
gctcccaggaagagaagggcca

SEQ ID NO: 8548127 - DNA, 20 bp, Homo sapiens
gctcccagcctgcagtcccc

SEQ ID NO: 8548128 - DNA, 20 bp, Homo sapiens
gctcccagcctgcagtcccc

SEQ ID NO: 8548129 - DNA, 22 bp, Homo sapiens
gctcccagctggagcctcaaca

SEQ ID NO: 8548130 - DNA, 22 bp, Homo sapiens
gctcccaggaagagaagggcca

SEQ ID NO: 8548131 - DNA, 22 bp, Homo sapiens
gctcccagctggagcctcaaca

SEQ ID NO: 8548132 - DNA, 22 bp, Homo sapiens
gctcccagctggagcctcaaca

SEQ ID NO: 8548133 - DNA, 22 bp, Homo sapiens
gctcccagctggagcctcaaca

SEQ ID NO: 8548134 - DNA, 22 bp, Homo sapiens
gctcccagcattgctgctgaat

SEQ ID NO: 8548135 - DNA, 22 bp, Homo sapiens
gctcccagcattgcttcccagg

SEQ ID NO: 8548136 - DNA, 22 bp, Homo sapiens
gctcccagcattgctgctgaat

SEQ ID NO: 8548137 - DNA, 22 bp, Homo sapiens
gctcccagcattgctgctgaat

SEQ ID NO: 8548138 - DNA, 22 bp, Homo sapiens
gctcccagcattgctgctgaat

SEQ ID NO: 8548139 - DNA, 22 bp, Homo sapiens
gctcccagcattgctgctgaat

SEQ ID NO: 8548140 - DNA, 20 bp, Homo sapiens
gctcccagcctgcagtcccc

SEQ ID NO: 8548141 - DNA, 20 bp, Homo sapiens
gctcccagcctgcagtcccc

SEQ ID NO: 8548142 - DNA, 22 bp, Homo sapiens
gctcccagcattgcttcccagg

SEQ ID NO: 8548143 - DNA, 22 bp, Homo sapiens
gctcccagcattgcttcccagg

SEQ ID NO: 8548144 - DNA, 22 bp, Homo sapiens
gctcccagcattgcttcccagg

SEQ ID NO: 8548145 - DNA, 22 bp, Homo sapiens
gctcccaggatgaggagccagg

SEQ ID NO: 8548146 - DNA, 22 bp, Homo sapiens
gctcccaggatgaggagccagg

SEQ ID NO: 8548147 - DNA, 22 bp, Homo sapiens
gctccccttggtcctcctggga

SEQ ID NO: 8548148 - DNA, 22 bp, Homo sapiens
gctccctccatgaggcagaccg

SEQ ID NO: 8548149 - DNA, 22 bp, Homo sapiens
gctccctcccaccagcctgcag

SEQ ID NO: 8548150 - DNA, 22 bp, Homo sapiens
gctctctgaggtgctggcagag

SEQ ID NO: 8548151 - DNA, 22 bp, Homo sapiens
gctctctgaggtgctggcagag

SEQ ID NO: 8548152 - DNA, 22 bp, Homo sapiens
gctctctgaggtgctggcagag

SEQ ID NO: 8548153 - DNA, 22 bp, Homo sapiens
gctctctgcagcctccttggag

SEQ ID NO: 8548154 - DNA, 21 bp, Homo sapiens
gctctctgcatggtggctcag

SEQ ID NO: 8548155 - DNA, 21 bp, Homo sapiens
gctctctgcatggtggctcag

SEQ ID NO: 8548156 - DNA, 22 bp, Homo sapiens
gctctctgccatatgaggatac

SEQ ID NO: 8548157 - DNA, 21 bp, Homo sapiens
gctctctgcatggtggctcag

SEQ ID NO: 8548158 - DNA, 22 bp, Homo sapiens
gctctctgcaagtcagcagcct

SEQ ID NO: 8548159 - DNA, 22 bp, Homo sapiens
gctctctgcagcctccttggag

SEQ ID NO: 8548160 - DNA, 22 bp, Homo sapiens
gctctctgaggtgctggcagag

SEQ ID NO: 8548161 - DNA, 22 bp, Homo sapiens
gctctcccgcagcctggtgggc

SEQ ID NO: 8548162 - DNA, 22 bp, Homo sapiens
gctctccaggtctcatgcactg

SEQ ID NO: 8548163 - DNA, 22 bp, Homo sapiens
gctctccaggtctcatgcactg

SEQ ID NO: 8548164 - DNA, 19 bp, Homo sapiens
gctctccctctcagttgag

SEQ ID NO: 8548165 - DNA, 22 bp, Homo sapiens
gctctcctgtgcagatgctgct

SEQ ID NO: 8548166 - DNA, 22 bp, Homo sapiens
gctccctctgctcaggcacttg

SEQ ID NO: 8548167 - DNA, 22 bp, Homo sapiens
gctccctctgctcaggcacttg

SEQ ID NO: 8548168 - DNA, 22 bp, Homo sapiens
gctccctctgctcaggcacttg

SEQ ID NO: 8548169 - DNA, 22 bp, Homo sapiens
gctccctcccaccagcctgcag

SEQ ID NO: 8548170 - DNA, 21 bp, Homo sapiens
gctctccagggccagcccagg

SEQ ID NO: 8548171 - DNA, 22 bp, Homo sapiens
gccagctgtaagctggggtgat

SEQ ID NO: 8548172 - DNA, 22 bp, Homo sapiens
gccagctgtaagcagtgattct

SEQ ID NO: 8548173 - DNA, 22 bp, Homo sapiens
gccagctgtaagcagtgattct

SEQ ID NO: 8548174 - DNA, 22 bp, Homo sapiens
gccagctgtaagcagtgattct

SEQ ID NO: 8548175 - DNA, 20 bp, Homo sapiens
gccagctggtcccaattatg

SEQ ID NO: 8548176 - DNA, 22 bp, Homo sapiens
gccagctgtatctttggccagc

SEQ ID NO: 8548177 - DNA, 22 bp, Homo sapiens
gccagctgtctaagagagtaaa

SEQ ID NO: 8548178 - DNA, 22 bp, Homo sapiens
gccagctgtctaagagagtaaa

SEQ ID NO: 8548179 - DNA, 22 bp, Homo sapiens
gccagctgtaggtggtgggttg

SEQ ID NO: 8548180 - DNA, 22 bp, Homo sapiens
gccagctgggccttagggctgg

SEQ ID NO: 8548181 - DNA, 22 bp, Homo sapiens
gccagctggctgcaggtcccag

SEQ ID NO: 8548182 - DNA, 22 bp, Homo sapiens
gccagctgcaaagtatgttgaa

SEQ ID NO: 8548183 - DNA, 21 bp, Homo sapiens
gccagctgggtcttgcaggag

SEQ ID NO: 8548184 - DNA, 22 bp, Homo sapiens
gccagctggtaggcacctagcc

SEQ ID NO: 8548185 - DNA, 22 bp, Homo sapiens
gccagctggtaggcacctagcc

SEQ ID NO: 8548186 - DNA, 22 bp, Homo sapiens
gccagctggtaggcacctagcc

SEQ ID NO: 8548187 - DNA, 22 bp, Homo sapiens
gccagaaacatacacatcactt

SEQ ID NO: 8548188 - DNA, 22 bp, Homo sapiens
gccagaaagaggaggacctggg

SEQ ID NO: 8548189 - DNA, 22 bp, Homo sapiens
gccagaaggggtggatccaggc

SEQ ID NO: 8548190 - DNA, 22 bp, Homo sapiens
gccagctgaggccgtgcaggct

SEQ ID NO: 8548191 - DNA, 22 bp, Homo sapiens
gccagctgagcaaattccagct

SEQ ID NO: 8548192 - DNA, 22 bp, Homo sapiens
gccagctgagaaatcattgata

SEQ ID NO: 8548193 - DNA, 22 bp, Homo sapiens
gccagagaatgaaaatcagatt

SEQ ID NO: 8548194 - DNA, 22 bp, Homo sapiens
gccagacactcccctgggcagg

SEQ ID NO: 8548195 - DNA, 22 bp, Homo sapiens
gccagctgagaaatcattgata

SEQ ID NO: 8548196 - DNA, 22 bp, Homo sapiens
gccagagacacttggaggtaga

SEQ ID NO: 8548197 - DNA, 22 bp, Homo sapiens
gccaggaaaaagggtggccaat

SEQ ID NO: 8548198 - DNA, 22 bp, Homo sapiens
gccaggaaaagaagctggtgct

SEQ ID NO: 8548199 - DNA, 22 bp, Homo sapiens
gccagctgtttcagagcccagt

SEQ ID NO: 8548200 - DNA, 22 bp, Homo sapiens
gccagctgttcagacattcttt

SEQ ID NO: 8548201 - DNA, 22 bp, Homo sapiens
gccagctgtgcttttcctaaaa

SEQ ID NO: 8548202 - DNA, 22 bp, Homo sapiens
gccagctgttcagacattcttt

SEQ ID NO: 8548203 - DNA, 22 bp, Homo sapiens
gccagctgtgcttttcctaaaa

SEQ ID NO: 8548204 - DNA, 22 bp, Homo sapiens
gccagctgtgcttttcctaaaa

SEQ ID NO: 8548205 - DNA, 22 bp, Homo sapiens
gccagcttggccagtggccagt

SEQ ID NO: 8548206 - DNA, 22 bp, Homo sapiens
gccaggaaggctgaagccagaa

SEQ ID NO: 8548207 - DNA, 22 bp, Homo sapiens
gccaggcatgtcctctgcagaa

SEQ ID NO: 8548208 - DNA, 20 bp, Homo sapiens
gcccaaggtccagaaggggg

SEQ ID NO: 8548209 - DNA, 20 bp, Homo sapiens
gcccaaggtccagaaggggg

SEQ ID NO: 8548210 - DNA, 20 bp, Homo sapiens
gcccaaggtccagaaggggg

SEQ ID NO: 8548211 - DNA, 20 bp, Homo sapiens
gcccaaggtccagaaggggg

SEQ ID NO: 8548212 - DNA, 20 bp, Homo sapiens
gcccaaggtccagaaggggg

SEQ ID NO: 8548213 - DNA, 22 bp, Homo sapiens
gcccaaggtcacacacaggaag

SEQ ID NO: 8548214 - DNA, 22 bp, Homo sapiens
gcccaaggtcacacacaggaag

SEQ ID NO: 8548215 - DNA, 22 bp, Homo sapiens
gcccaagggcatcaagttctac

SEQ ID NO: 8548216 - DNA, 22 bp, Homo sapiens
gcccaaggtatatcagagacag

SEQ ID NO: 8548217 - DNA, 22 bp, Homo sapiens
gcccaaggtatatcagagacag

SEQ ID NO: 8548218 - DNA, 22 bp, Homo sapiens
gcccaaggtatatcagagacag

SEQ ID NO: 8548219 - DNA, 22 bp, Homo sapiens
gcccaaggtcacacacaggaag

SEQ ID NO: 8548220 - DNA, 20 bp, Homo sapiens
gcccaagcgccggccgcaga

SEQ ID NO: 8548221 - DNA, 22 bp, Homo sapiens
gcccaagccggagctgggagag

SEQ ID NO: 8548222 - DNA, 22 bp, Homo sapiens
gcccaagccggagctgggagag

SEQ ID NO: 8548223 - DNA, 22 bp, Homo sapiens
gcccaagccgccttccagagac

SEQ ID NO: 8548224 - DNA, 20 bp, Homo sapiens
gcccaagcgccggccgcaga

SEQ ID NO: 8548225 - DNA, 22 bp, Homo sapiens
gcccaagatcagtggggcagat

SEQ ID NO: 8548226 - DNA, 22 bp, Homo sapiens
gcccaagatctggagctgcagg

SEQ ID NO: 8548227 - DNA, 22 bp, Homo sapiens
gcccaagagttaagtctctgct

SEQ ID NO: 8548228 - DNA, 22 bp, Homo sapiens
gcccaagagagcgaaggttggc

SEQ ID NO: 8548229 - DNA, 22 bp, Homo sapiens
gcccaagatcagtggggcagat

SEQ ID NO: 8548230 - DNA, 22 bp, Homo sapiens
gcccaagatcacactggaaatc

SEQ ID NO: 8548231 - DNA, 22 bp, Homo sapiens
gcccaaagccagtgtgctctcc

SEQ ID NO: 8548232 - DNA, 22 bp, Homo sapiens
gcccaaagtcactcagctagga

SEQ ID NO: 8548233 - DNA, 22 bp, Homo sapiens
gccaggctctcagtgactgccc

SEQ ID NO: 8548234 - DNA, 22 bp, Homo sapiens
gcccaaagagctttgatctcag

SEQ ID NO: 8548235 - DNA, 22 bp, Homo sapiens
gccatttggcaaaactgacttc

SEQ ID NO: 8548236 - DNA, 22 bp, Homo sapiens
gccattttctgtcttgtttatt

SEQ ID NO: 8548237 - DNA, 22 bp, Homo sapiens
gccaggctccaggccctcctga

SEQ ID NO: 8548238 - DNA, 22 bp, Homo sapiens
gccaggctccaggccctcctga

SEQ ID NO: 8548239 - DNA, 22 bp, Homo sapiens
gccaggctccaggccctcctga

SEQ ID NO: 8548240 - DNA, 22 bp, Homo sapiens
gccaggctccaggccctcctga

SEQ ID NO: 8548241 - DNA, 19 bp, Homo sapiens
gccaggctccatagccggc

SEQ ID NO: 8548242 - DNA, 19 bp, Homo sapiens
gccaggctccatagccggc

SEQ ID NO: 8548243 - DNA, 22 bp, Homo sapiens
gccaggctccccggatccctgg

SEQ ID NO: 8548244 - DNA, 22 bp, Homo sapiens
gccaggctccccggatccctgg

SEQ ID NO: 8548245 - DNA, 22 bp, Homo sapiens
gccaggctccccggatccctgg

SEQ ID NO: 8548246 - DNA, 23 bp, Homo sapiens
gccaggctccggtctgtggccac

SEQ ID NO: 8548247 - DNA, 23 bp, Homo sapiens
gccaggctccggtctgtggccac

SEQ ID NO: 8548248 - DNA, 23 bp, Homo sapiens
gccaggctccggtctgtggccac

SEQ ID NO: 8548249 - DNA, 22 bp, Homo sapiens
gccaggctaagaaaggtgtgat

SEQ ID NO: 8548250 - DNA, 22 bp, Homo sapiens
gccaggctcagcagtcaacctg

SEQ ID NO: 8548251 - DNA, 22 bp, Homo sapiens
gccaggctaagaaaggtgtgat

SEQ ID NO: 8548252 - DNA, 22 bp, Homo sapiens
gccaggctcagtagcgattcct

SEQ ID NO: 8548253 - DNA, 22 bp, Homo sapiens
gccaggctcagtagcgattcct

SEQ ID NO: 8548254 - DNA, 22 bp, Homo sapiens
gccaggctcagcagtcaacctg

SEQ ID NO: 8548255 - DNA, 22 bp, Homo sapiens
gccaggcgggtctcaaactcct

SEQ ID NO: 8548256 - DNA, 22 bp, Homo sapiens
gccaggctaagaaaggtgtgat

SEQ ID NO: 8548257 - DNA, 22 bp, Homo sapiens
gccaggctaagaaaggtgtgat

SEQ ID NO: 8548258 - DNA, 22 bp, Homo sapiens
gccaggcatgtcctctgcagaa

SEQ ID NO: 8548259 - DNA, 22 bp, Homo sapiens
gcatttaaatttgaacttcaga

SEQ ID NO: 8548260 - DNA, 22 bp, Homo sapiens
gcatttaaatttgaacttcaga

SEQ ID NO: 8548261 - DNA, 22 bp, Homo sapiens
gcattgatttaaacatctctct

SEQ ID NO: 8548262 - DNA, 22 bp, Homo sapiens
gcattgattctgaagtgaaatg

SEQ ID NO: 8548263 - DNA, 22 bp, Homo sapiens
gcattggttaagagctttgggg

SEQ ID NO: 8548264 - DNA, 22 bp, Homo sapiens
gcattggtttacacagggtgaa

SEQ ID NO: 8548265 - DNA, 22 bp, Homo sapiens
gcattggcatttctccagcgga

SEQ ID NO: 8548266 - DNA, 22 bp, Homo sapiens
gcattggttcaaggttgtgcag

SEQ ID NO: 8548267 - DNA, 22 bp, Homo sapiens
gcattgtcaaaagtggtatgac

SEQ ID NO: 8548268 - DNA, 22 bp, Homo sapiens
gccaccctgcaaatgcccagga

SEQ ID NO: 8548269 - DNA, 22 bp, Homo sapiens
gccaccctgacgccgcagaccc

SEQ ID NO: 8548270 - DNA, 18 bp, Homo sapiens
gccaccctcctcgtctcc

SEQ ID NO: 8548271 - DNA, 22 bp, Homo sapiens
gcatttcagagaaaatctgctt

SEQ ID NO: 8548272 - DNA, 19 bp, Homo sapiens
gcatttcaggcatgtttgc

SEQ ID NO: 8548273 - DNA, 22 bp, Homo sapiens
gcatttatttctttactgcatc

SEQ ID NO: 8548274 - DNA, 22 bp, Homo sapiens
gcatttattatctgccaggcac

SEQ ID NO: 8548275 - DNA, 22 bp, Homo sapiens
gcatttagctttaaaatatttc

SEQ ID NO: 8548276 - DNA, 22 bp, Homo sapiens
gccacctcggctttctctgctc

SEQ ID NO: 8548277 - DNA, 22 bp, Homo sapiens
gccacctcggctttctctgctc

SEQ ID NO: 8548278 - DNA, 21 bp, Homo sapiens
gccacctcgtctcggagcagc

SEQ ID NO: 8548279 - DNA, 21 bp, Homo sapiens
gccacctcgtctcggagcagc

SEQ ID NO: 8548280 - DNA, 22 bp, Homo sapiens
gccacctctttgtctctgccgc

SEQ ID NO: 8548281 - DNA, 22 bp, Homo sapiens
gccacctctttgtctctgccgc

SEQ ID NO: 8548282 - DNA, 22 bp, Homo sapiens
gccacctctttgtctctgccgc

SEQ ID NO: 8548283 - DNA, 22 bp, Homo sapiens
gccacctctctcttgactcgag

SEQ ID NO: 8548284 - DNA, 20 bp, Homo sapiens
gccacctctctagcagtaga

SEQ ID NO: 8548285 - DNA, 22 bp, Homo sapiens
gccacctccttattccacctgt

SEQ ID NO: 8548286 - DNA, 22 bp, Homo sapiens
gccacccttatcccatgcttct

SEQ ID NO: 8548287 - DNA, 22 bp, Homo sapiens
gccacccttgcgtcactgacat

SEQ ID NO: 8548288 - DNA, 21 bp, Homo sapiens
gccacctcaatcttctagcgc

SEQ ID NO: 8548289 - DNA, 22 bp, Homo sapiens
gccacctggacagctgtgccct

SEQ ID NO: 8548290 - DNA, 22 bp, Homo sapiens
gccacctggactcagagccagg

SEQ ID NO: 8548291 - DNA, 22 bp, Homo sapiens
gccacctggtggcatcttctgg

SEQ ID NO: 8548292 - DNA, 22 bp, Homo sapiens
gccacctggactcagagccagg

SEQ ID NO: 8548293 - DNA, 22 bp, Homo sapiens
gccacctgtttcgcttgcccag

SEQ ID NO: 8548294 - DNA, 22 bp, Homo sapiens
gcattaatgtaagacccactcc

SEQ ID NO: 8548295 - DNA, 19 bp, Homo sapiens
gcataaaatgtcaatgtgt

SEQ ID NO: 8548296 - DNA, 19 bp, Homo sapiens
gcataaaatgtcaatgtgt

SEQ ID NO: 8548297 - DNA, 21 bp, Homo sapiens
gcattaaaagcagttgttggt

SEQ ID NO: 8548298 - DNA, 22 bp, Homo sapiens
gcattagaaactattgctgcaa

SEQ ID NO: 8548299 - DNA, 21 bp, Homo sapiens
gcagtttatgtaatatgcact

SEQ ID NO: 8548300 - DNA, 19 bp, Homo sapiens
gcataaaatgtcaatgtgt

SEQ ID NO: 8548301 - DNA, 22 bp, Homo sapiens
gcagttttattatgatggaaat

SEQ ID NO: 8548302 - DNA, 22 bp, Homo sapiens
gcattcttcacagtattcctcc

SEQ ID NO: 8548303 - DNA, 22 bp, Homo sapiens
gcattctttccacgaggaggta

SEQ ID NO: 8548304 - DNA, 22 bp, Homo sapiens
gcattcttgtttttcctaccct

SEQ ID NO: 8548305 - DNA, 22 bp, Homo sapiens
gcattcttgaggtgtggactca

SEQ ID NO: 8548306 - DNA, 22 bp, Homo sapiens
gcattcttcgaagtaagtagtg

SEQ ID NO: 8548307 - DNA, 22 bp, Homo sapiens
gcattgaaatggcaaaaagaga

SEQ ID NO: 8548308 - DNA, 22 bp, Homo sapiens
gcattctttgaatgcttctaat

SEQ ID NO: 8548309 - DNA, 22 bp, Homo sapiens
gcattgaaccatctagatttct

SEQ ID NO: 8548310 - DNA, 22 bp, Homo sapiens
gcattgaagatcttagactagg

SEQ ID NO: 8548311 - DNA, 23 bp, Homo sapiens
gcattgaacaaaagaggggagta

SEQ ID NO: 8548312 - DNA, 20 bp, Homo sapiens
gcattgagtatagacagatg

SEQ ID NO: 8548313 - DNA, 22 bp, Homo sapiens
gcattgaaggacttccattata

SEQ ID NO: 8548314 - DNA, 22 bp, Homo sapiens
gcattgaatcctatcaggcaaa

SEQ ID NO: 8548315 - DNA, 22 bp, Homo sapiens
gcattgaaggcattttatctac

SEQ ID NO: 8548316 - DNA, 22 bp, Homo sapiens
gcagtgttttacagaccagcat

SEQ ID NO: 8548317 - DNA, 22 bp, Homo sapiens
gcagtgtttttcaatgcttcca

SEQ ID NO: 8548318 - DNA, 22 bp, Homo sapiens
gcagtgtttttcaatgcttcca

SEQ ID NO: 8548319 - DNA, 22 bp, Homo sapiens
gcagtgtttgtgttctcacatg

SEQ ID NO: 8548320 - DNA, 22 bp, Homo sapiens
gcagtgtttgtgttctcacatg

SEQ ID NO: 8548321 - DNA, 22 bp, Homo sapiens
gcagttgtaatatgatgtgagg

SEQ ID NO: 8548322 - DNA, 22 bp, Homo sapiens
gcagtgttgttaaaagattaga

SEQ ID NO: 8548323 - DNA, 22 bp, Homo sapiens
gcagtgttgtgatccaggtctt

SEQ ID NO: 8548324 - DNA, 22 bp, Homo sapiens
gcagtgttgtgatccaggtctt

SEQ ID NO: 8548325 - DNA, 22 bp, Homo sapiens
gcagtgtttacatattagaaac

SEQ ID NO: 8548326 - DNA, 22 bp, Homo sapiens
gcagtgtttcaaatcaaaggca

SEQ ID NO: 8548327 - DNA, 22 bp, Homo sapiens
gcagtgtttcccagagatggaa

SEQ ID NO: 8548328 - DNA, 22 bp, Homo sapiens
gcagtgtttcagtgctttttct

SEQ ID NO: 8548329 - DNA, 23 bp, Homo sapiens
gcagtgtttgcttcatcttatcc

SEQ ID NO: 8548330 - DNA, 22 bp, Homo sapiens
gcagtgtttggatccatagcga

SEQ ID NO: 8548331 - DNA, 18 bp, Homo sapiens
gcaggtgccactgctgtt

SEQ ID NO: 8548332 - DNA, 18 bp, Homo sapiens
gcaggtgccactgctgtt

SEQ ID NO: 8548333 - DNA, 22 bp, Homo sapiens
gcagtgttggtttgctctgcag

SEQ ID NO: 8548334 - DNA, 22 bp, Homo sapiens
gcagtgttggcaggatggggct

SEQ ID NO: 8548335 - DNA, 22 bp, Homo sapiens
gcctccaccgaacgctctcttg

SEQ ID NO: 8548336 - DNA, 22 bp, Homo sapiens
gcctccctggcccacagcagcg

SEQ ID NO: 8548337 - DNA, 22 bp, Homo sapiens
gcctccctggcccacagcagcg

SEQ ID NO: 8548338 - DNA, 22 bp, Homo sapiens
gcctccctggcccacagcagcg

SEQ ID NO: 8548339 - DNA, 22 bp, Homo sapiens
gcctccctgagtcacccaagca

SEQ ID NO: 8548340 - DNA, 22 bp, Homo sapiens
gcctccctggcccacagcagcg

SEQ ID NO: 8548341 - DNA, 22 bp, Homo sapiens
gcctccctgagtcacccaagca

SEQ ID NO: 8548342 - DNA, 22 bp, Homo sapiens
gcctcccctgcaattgtccttg

SEQ ID NO: 8548343 - DNA, 22 bp, Homo sapiens
gcctcccctgcaattgtccttg

SEQ ID NO: 8548344 - DNA, 22 bp, Homo sapiens
gcctccctccaccactgcaggt

SEQ ID NO: 8548345 - DNA, 22 bp, Homo sapiens
gcctccctccaccactgcaggt

SEQ ID NO: 8548346 - DNA, 22 bp, Homo sapiens
gcctccctgtttcctgctccaa

SEQ ID NO: 8548347 - DNA, 22 bp, Homo sapiens
gcctccctgttcttccacaata

SEQ ID NO: 8548348 - DNA, 22 bp, Homo sapiens
gcctccctgtagaggccagcct

SEQ ID NO: 8548349 - DNA, 22 bp, Homo sapiens
gcctgaggaattgagggggtaa

SEQ ID NO: 8548350 - DNA, 22 bp, Homo sapiens
gcctgaggaatgctcctgactt

SEQ ID NO: 8548351 - DNA, 22 bp, Homo sapiens
gcctgaggaatgctcctgactt

SEQ ID NO: 8548352 - DNA, 22 bp, Homo sapiens
gcctccctgttcttccacaata

SEQ ID NO: 8548353 - DNA, 22 bp, Homo sapiens
gcctccctgtttcctgctccaa

SEQ ID NO: 8548354 - DNA, 22 bp, Homo sapiens
gcctgagggctcctagcaggct

SEQ ID NO: 8548355 - DNA, 22 bp, Homo sapiens
gcctgagggctcctagcaggct

SEQ ID NO: 8548356 - DNA, 22 bp, Homo sapiens
gcctgagggctcctagcaggct

SEQ ID NO: 8548357 - DNA, 22 bp, Homo sapiens
gcctgagggctcctagcaggct

SEQ ID NO: 8548358 - DNA, 18 bp, Homo sapiens
gcctgagggtcaagtgtg

SEQ ID NO: 8548359 - DNA, 22 bp, Homo sapiens
gcctgcagaggtgctgctagct

SEQ ID NO: 8548360 - DNA, 20 bp, Homo sapiens
gcctgcagagaaggtcagag

SEQ ID NO: 8548361 - DNA, 22 bp, Homo sapiens
gcctgcagaactgtgaggcaat

SEQ ID NO: 8548362 - DNA, 21 bp, Homo sapiens
gcctgcagaccccaccaggct

SEQ ID NO: 8548363 - DNA, 21 bp, Homo sapiens
gcctgcagaccccaccaggct

SEQ ID NO: 8548364 - DNA, 19 bp, Homo sapiens
gcctgcagaaaaggcaggg

SEQ ID NO: 8548365 - DNA, 19 bp, Homo sapiens
gcctgcagaaaaggcaggg

SEQ ID NO: 8548366 - DNA, 22 bp, Homo sapiens
gcctgagtgcatctgcagacat

SEQ ID NO: 8548367 - DNA, 21 bp, Homo sapiens
gcctgcacacagtaggtgcac

SEQ ID NO: 8548368 - DNA, 22 bp, Homo sapiens
gcctgcaagatggctggtcact

SEQ ID NO: 8548369 - DNA, 22 bp, Homo sapiens
gcctgcagatatataggatggt

SEQ ID NO: 8548370 - DNA, 22 bp, Homo sapiens
gcctgcagatatataggatggt

SEQ ID NO: 8548371 - DNA, 22 bp, Homo sapiens
gcctgcagcccctctgcagtag

SEQ ID NO: 8548372 - DNA, 18 bp, Homo sapiens
gcctgcaggcacgggggt

SEQ ID NO: 8548373 - DNA, 22 bp, Homo sapiens
gcctgcagggcctgggcctacc

SEQ ID NO: 8548374 - DNA, 22 bp, Homo sapiens
gcctgcagggcctgggcctacc

SEQ ID NO: 8548375 - DNA, 22 bp, Homo sapiens
gcctggagacagcagaggcggc

SEQ ID NO: 8548376 - DNA, 22 bp, Homo sapiens
gcctggagacctgctcctctac

SEQ ID NO: 8548377 - DNA, 22 bp, Homo sapiens
gcctggagacctgctcctctac

SEQ ID NO: 8548378 - DNA, 22 bp, Homo sapiens
gcctggagagcactgtgcgctt

SEQ ID NO: 8548379 - DNA, 22 bp, Homo sapiens
gcctggagacctgctcctctac

SEQ ID NO: 8548380 - DNA, 22 bp, Homo sapiens
gcctggagacctgctcctctac

SEQ ID NO: 8548381 - DNA, 22 bp, Homo sapiens
gcctggagagcactgtgcgctt

SEQ ID NO: 8548382 - DNA, 22 bp, Homo sapiens
gcctggagagcactgtgcgctt

SEQ ID NO: 8548383 - DNA, 22 bp, Homo sapiens
gcctggagagcactgtgcgctt

SEQ ID NO: 8548384 - DNA, 22 bp, Homo sapiens
gcctggagagcactgtgcgctt

SEQ ID NO: 8548385 - DNA, 22 bp, Homo sapiens
gcctggagagcactgtgcgctt

SEQ ID NO: 8548386 - DNA, 22 bp, Homo sapiens
gcctggagaggaagccggtgga

SEQ ID NO: 8548387 - DNA, 22 bp, Homo sapiens
gcctggagaggaagccggtgga

SEQ ID NO: 8548388 - DNA, 22 bp, Homo sapiens
gcctggagaggaagccggtgga

SEQ ID NO: 8548389 - DNA, 22 bp, Homo sapiens
gcctggagaggaagccggtgga

SEQ ID NO: 8548390 - DNA, 22 bp, Homo sapiens
gcctggagaggaagccggtgga

SEQ ID NO: 8548391 - DNA, 22 bp, Homo sapiens
gcctggagaggaagccggtgga

SEQ ID NO: 8548392 - DNA, 22 bp, Homo sapiens
gcctggagagcactgtgcgctt

SEQ ID NO: 8548393 - DNA, 22 bp, Homo sapiens
gcctggagaggaagccggtgga

SEQ ID NO: 8548394 - DNA, 22 bp, Homo sapiens
gcctggagcagacgtgtcccgg

SEQ ID NO: 8548395 - DNA, 22 bp, Homo sapiens
gcctggagcagacgtgtcccgg

SEQ ID NO: 8548396 - DNA, 22 bp, Homo sapiens
gcctggagcagacgtgtcccgg

SEQ ID NO: 8548397 - DNA, 22 bp, Homo sapiens
gcctggagcccagtgtggggct

SEQ ID NO: 8548398 - DNA, 22 bp, Homo sapiens
gcctggagcagacgtgtcccgg

SEQ ID NO: 8548399 - DNA, 22 bp, Homo sapiens
gcctggagtgcagtggcgtgat

SEQ ID NO: 8548400 - DNA, 22 bp, Homo sapiens
gcctggagtgcagtggcgtgat

SEQ ID NO: 8548401 - DNA, 22 bp, Homo sapiens
gcctggagtgcagtggcgtgat

SEQ ID NO: 8548402 - DNA, 22 bp, Homo sapiens
gcctggagtgcagtggcgtgat

SEQ ID NO: 8548403 - DNA, 22 bp, Homo sapiens
gcctggagtgcagtggcgtgat

SEQ ID NO: 8548404 - DNA, 22 bp, Homo sapiens
gcctggagtggacttggcccct

SEQ ID NO: 8548405 - DNA, 22 bp, Homo sapiens
gcctggagtggacttggcccct

SEQ ID NO: 8548406 - DNA, 16 bp, Homo sapiens
gcctggagtggcaggg

SEQ ID NO: 8548407 - DNA, 16 bp, Homo sapiens
gcctggagtggcaggg

SEQ ID NO: 8548408 - DNA, 16 bp, Homo sapiens
gcctggagtggcaggg

SEQ ID NO: 8548409 - DNA, 16 bp, Homo sapiens
gcctggagtggcaggg

SEQ ID NO: 8548410 - DNA, 16 bp, Homo sapiens
gcctggagtggcaggg

SEQ ID NO: 8548411 - DNA, 22 bp, Homo sapiens
gcctggagtggacttggcccct

SEQ ID NO: 8548412 - DNA, 22 bp, Homo sapiens
gcctggagtggacttggcccct

SEQ ID NO: 8548413 - DNA, 22 bp, Homo sapiens
gcctggagtggacttggcccct

SEQ ID NO: 8548414 - DNA, 22 bp, Homo sapiens
gcctggagcccagtgtggggct

SEQ ID NO: 8548415 - DNA, 22 bp, Homo sapiens
gcctggagcccagtgtggggct

SEQ ID NO: 8548416 - DNA, 22 bp, Homo sapiens
gcctggagcccagtgtggggct

SEQ ID NO: 8548417 - DNA, 22 bp, Homo sapiens
gcctggagcccagtgtggggct

SEQ ID NO: 8548418 - DNA, 22 bp, Homo sapiens
gcctggagcccagtgtggggct

SEQ ID NO: 8548419 - DNA, 22 bp, Homo sapiens
gcctggagcccagtgtggggct

SEQ ID NO: 8548420 - DNA, 22 bp, Homo sapiens
gcctggagcccagtgtggggct

SEQ ID NO: 8548421 - DNA, 22 bp, Homo sapiens
gcctggagtagcatggcaagcc

SEQ ID NO: 8548422 - DNA, 22 bp, Homo sapiens
gcctggagtgcagtggcgtgat

SEQ ID NO: 8548423 - DNA, 22 bp, Homo sapiens
gcctggagtagcatggcaagcc

SEQ ID NO: 8548424 - DNA, 22 bp, Homo sapiens
gcctggagtagcatggcaagcc

SEQ ID NO: 8548425 - DNA, 22 bp, Homo sapiens
gcctggagtagcatggcaagcc

SEQ ID NO: 8548426 - DNA, 22 bp, Homo sapiens
gcctggagaattaaaaggaagg

SEQ ID NO: 8548427 - DNA, 22 bp, Homo sapiens
gcctggagaattaaaaggaagg

SEQ ID NO: 8548428 - DNA, 22 bp, Homo sapiens
gcctggagaattaaaaggaagg

SEQ ID NO: 8548429 - DNA, 22 bp, Homo sapiens
gcctggagacaaggacaaaggg

SEQ ID NO: 8548430 - DNA, 22 bp, Homo sapiens
gcctggagacaaggacaaaggg

SEQ ID NO: 8548431 - DNA, 22 bp, Homo sapiens
gcctggagacaaggacaaaggg

SEQ ID NO: 8548432 - DNA, 22 bp, Homo sapiens
gcctggagacaaggacaaaggg

SEQ ID NO: 8548433 - DNA, 22 bp, Homo sapiens
gcctggagacagcagaggcggc

SEQ ID NO: 8548434 - DNA, 22 bp, Homo sapiens
gcctggagacagcagaggcggc

SEQ ID NO: 8548435 - DNA, 22 bp, Homo sapiens
gcctggagacagcagaggcggc

SEQ ID NO: 8548436 - DNA, 22 bp, Homo sapiens
gcctggagacagcagaggcggc

SEQ ID NO: 8548437 - DNA, 22 bp, Homo sapiens
gcctggagaagatggaactagc

SEQ ID NO: 8548438 - DNA, 22 bp, Homo sapiens
gcctggagaagatggaactagc

SEQ ID NO: 8548439 - DNA, 22 bp, Homo sapiens
gcctggagaattaaaaggaagg

SEQ ID NO: 8548440 - DNA, 22 bp, Homo sapiens
gcctggagaagatggaactagc

SEQ ID NO: 8548441 - DNA, 22 bp, Homo sapiens
gcctggagaagatggaactagc

SEQ ID NO: 8548442 - DNA, 22 bp, Homo sapiens
gcctggagaagatggaactagc

SEQ ID NO: 8548443 - DNA, 22 bp, Homo sapiens
gcctggagaaaggaaggtggga

SEQ ID NO: 8548444 - DNA, 22 bp, Homo sapiens
gcctggagaaaggaaggtggga

SEQ ID NO: 8548445 - DNA, 22 bp, Homo sapiens
gcctggagaaaggaaggtggga

SEQ ID NO: 8548446 - DNA, 22 bp, Homo sapiens
gcctggagaaaggaaggtggga

SEQ ID NO: 8548447 - DNA, 22 bp, Homo sapiens
gcctggagaaaggaaggtggga

SEQ ID NO: 8548448 - DNA, 22 bp, Homo sapiens
gcctggagaaaggaaggtggga

SEQ ID NO: 8548449 - DNA, 22 bp, Homo sapiens
gcctggagaaaggaaggtggga

SEQ ID NO: 8548450 - DNA, 22 bp, Homo sapiens
gcctggagaaaggaaggtggga

SEQ ID NO: 8548451 - DNA, 22 bp, Homo sapiens
gcctgcagggcctgggcctacc

SEQ ID NO: 8548452 - DNA, 22 bp, Homo sapiens
gcctgcagggtgatgggctgcc

SEQ ID NO: 8548453 - DNA, 22 bp, Homo sapiens
gcctgcagggtgatgggctgcc

SEQ ID NO: 8548454 - DNA, 22 bp, Homo sapiens
gcctgcagggtgatgggctgcc

SEQ ID NO: 8548455 - DNA, 20 bp, Homo sapiens
gcctgcaggttggatgggat

SEQ ID NO: 8548456 - DNA, 22 bp, Homo sapiens
gcctgcagtgagtgcagaaggt

SEQ ID NO: 8548457 - DNA, 22 bp, Homo sapiens
gcctgcagtgagtgcagaaggt

SEQ ID NO: 8548458 - DNA, 22 bp, Homo sapiens
gcctgcagttctgtgctaggca

SEQ ID NO: 8548459 - DNA, 21 bp, Homo sapiens
gcctgcagttttgaagccctt

SEQ ID NO: 8548460 - DNA, 22 bp, Homo sapiens
gcctgcagtgagtgcagaaggt

SEQ ID NO: 8548461 - DNA, 23 bp, Homo sapiens
gcctggagaaaagctgcagttca

SEQ ID NO: 8548462 - DNA, 23 bp, Homo sapiens
gcctggagaaaagctgcagttca

SEQ ID NO: 8548463 - DNA, 23 bp, Homo sapiens
gcctggagaaaagctgcagttca

SEQ ID NO: 8548464 - DNA, 23 bp, Homo sapiens
gcctggagaaaagctgcagttca

SEQ ID NO: 8548465 - DNA, 23 bp, Homo sapiens
gcctggagaaaagctgcagttca

SEQ ID NO: 8548466 - DNA, 23 bp, Homo sapiens
gcctggagaaaagctgcagttca

SEQ ID NO: 8548467 - DNA, 22 bp, Homo sapiens
gccctgctgtcttcagagtata

SEQ ID NO: 8548468 - DNA, 22 bp, Homo sapiens
gccctgctgtttagagagctac

SEQ ID NO: 8548469 - DNA, 22 bp, Homo sapiens
gccctgctgctggcagaggcgc

SEQ ID NO: 8548470 - DNA, 22 bp, Homo sapiens
gccctgctctggtctctgcccg

SEQ ID NO: 8548471 - DNA, 23 bp, Homo sapiens
gccctgctcctggctgggaggga

SEQ ID NO: 8548472 - DNA, 17 bp, Homo sapiens
gccctgcctgctgccct

SEQ ID NO: 8548473 - DNA, 22 bp, Homo sapiens
gccctggacagtgacggtgacc

SEQ ID NO: 8548474 - DNA, 22 bp, Homo sapiens
gccctggaatctctccatggga

SEQ ID NO: 8548475 - DNA, 22 bp, Homo sapiens
gccctggaatctctccatggga

SEQ ID NO: 8548476 - DNA, 22 bp, Homo sapiens
gcctcaggtaaaacttgagttt

SEQ ID NO: 8548477 - DNA, 22 bp, Homo sapiens
gcctcaggtaaaacttgagttt

SEQ ID NO: 8548478 - DNA, 22 bp, Homo sapiens
gccctggagagggatatggcat

SEQ ID NO: 8548479 - DNA, 20 bp, Homo sapiens
gccctggacgtggcctcggc

SEQ ID NO: 8548480 - DNA, 22 bp, Homo sapiens
gcctcagggggagaggccagct

SEQ ID NO: 8548481 - DNA, 22 bp, Homo sapiens
gcctcagggggagaggccagct

SEQ ID NO: 8548482 - DNA, 22 bp, Homo sapiens
gcctcagggggagaggccagct

SEQ ID NO: 8548483 - DNA, 22 bp, Homo sapiens
gcctcagttgatctgtgtgagc

SEQ ID NO: 8548484 - DNA, 22 bp, Homo sapiens
gcctcaggtgcatctctcattc

SEQ ID NO: 8548485 - DNA, 18 bp, Homo sapiens
gcctccaccatggagggt

SEQ ID NO: 8548486 - DNA, 19 bp, Homo sapiens
gcctcatttccacctcccc

SEQ ID NO: 8548487 - DNA, 22 bp, Homo sapiens
gcccctggctggccagctcctc

SEQ ID NO: 8548488 - DNA, 22 bp, Homo sapiens
gcccctgggagcagagccacca

SEQ ID NO: 8548489 - DNA, 22 bp, Homo sapiens
gcccctctccttgtgcacctgc

SEQ ID NO: 8548490 - DNA, 22 bp, Homo sapiens
gcccctctccttgtgcacctgc

SEQ ID NO: 8548491 - DNA, 22 bp, Homo sapiens
gcccctctccttgtgcacctgc

SEQ ID NO: 8548492 - DNA, 22 bp, Homo sapiens
gcccctccatccatcaccgggg

SEQ ID NO: 8548493 - DNA, 22 bp, Homo sapiens
gcccctccatccatcaccgggg

SEQ ID NO: 8548494 - DNA, 22 bp, Homo sapiens
gccccaggttgcctgtcccagg

SEQ ID NO: 8548495 - DNA, 22 bp, Homo sapiens
gccccaggtggtaaacctaaga

SEQ ID NO: 8548496 - DNA, 22 bp, Homo sapiens
gcccctcccagtcaggagcact

SEQ ID NO: 8548497 - DNA, 22 bp, Homo sapiens
gcccctcccagtcaggagcact

SEQ ID NO: 8548498 - DNA, 22 bp, Homo sapiens
gcccctcccagtcaggagcact

SEQ ID NO: 8548499 - DNA, 22 bp, Homo sapiens
gcccctccatccatcaccgggg

SEQ ID NO: 8548500 - DNA, 22 bp, Homo sapiens
gcccctcccagtcaggagcact

SEQ ID NO: 8548501 - DNA, 22 bp, Homo sapiens
gcccaaggtcccatggcagcac

SEQ ID NO: 8548502 - DNA, 20 bp, Homo sapiens
gcccaaggtccagaaggggg

SEQ ID NO: 8548503 - DNA, 22 bp, Homo sapiens
gcccaaggtcccatggcagcac

SEQ ID NO: 8548504 - DNA, 22 bp, Homo sapiens
gcccaaggtcccatggcagcac

SEQ ID NO: 8548505 - DNA, 22 bp, Homo sapiens
gcccacacaccagctcaggagg

SEQ ID NO: 8548506 - DNA, 22 bp, Homo sapiens
gcccacacaccagctcaggagg

SEQ ID NO: 8548507 - DNA, 22 bp, Homo sapiens
gcccacaccatttattctttgt

SEQ ID NO: 8548508 - DNA, 22 bp, Homo sapiens
gcccacacagcagatcctttgg

SEQ ID NO: 8548509 - DNA, 22 bp, Homo sapiens
gcccacacaccagctcaggagg

SEQ ID NO: 8548510 - DNA, 22 bp, Homo sapiens
gcccacaggggacctggtggct

SEQ ID NO: 8548511 - DNA, 22 bp, Homo sapiens
gccccaggggaggtgccctgca

SEQ ID NO: 8548512 - DNA, 22 bp, Homo sapiens
gcccacagaggcaccaccaggc

SEQ ID NO: 8548513 - DNA, 22 bp, Homo sapiens
gcccacagaggcaccaccaggc

SEQ ID NO: 8548514 - DNA, 22 bp, Homo sapiens
gcccacagctcgttcctctcct

SEQ ID NO: 8548515 - DNA, 22 bp, Homo sapiens
gcccacagctcgttcctctcct

SEQ ID NO: 8548516 - DNA, 22 bp, Homo sapiens
gcccacagctcgttcctctcct

SEQ ID NO: 8548517 - DNA, 22 bp, Homo sapiens
gccctcagaggacagctgactt

SEQ ID NO: 8548518 - DNA, 22 bp, Homo sapiens
gccctcagaatgggctctaatc

SEQ ID NO: 8548519 - DNA, 22 bp, Homo sapiens
gccctagggcttttgggcctgt

SEQ ID NO: 8548520 - DNA, 22 bp, Homo sapiens
gccctgagtgcctgtgtaagaa

SEQ ID NO: 8548521 - DNA, 22 bp, Homo sapiens
gccctgagtggtacctgtgggt

SEQ ID NO: 8548522 - DNA, 22 bp, Homo sapiens
gccctcagagttccccacagtg

SEQ ID NO: 8548523 - DNA, 19 bp, Homo sapiens
gccctgagtaagctaggag

SEQ ID NO: 8548524 - DNA, 22 bp, Homo sapiens
gccctcagaggacagctgactt

SEQ ID NO: 8548525 - DNA, 22 bp, Homo sapiens
gccctcagaggacagctgactt

SEQ ID NO: 8548526 - DNA, 18 bp, Homo sapiens
gcccgtgtggagaccatg

SEQ ID NO: 8548527 - DNA, 22 bp, Homo sapiens
gcccgcgccagcctctccatct

SEQ ID NO: 8548528 - DNA, 17 bp, Homo sapiens
gcccgcggcccggggtg

SEQ ID NO: 8548529 - DNA, 22 bp, Homo sapiens
gcccgcagagatctttaacaaa

SEQ ID NO: 8548530 - DNA, 22 bp, Homo sapiens
gcccgcgccagcctctccatct

SEQ ID NO: 8548531 - DNA, 22 bp, Homo sapiens
gccccttctctgaggaacctgc

SEQ ID NO: 8548532 - DNA, 22 bp, Homo sapiens
gcccctgggagcagagccacca

SEQ ID NO: 8548533 - DNA, 22 bp, Homo sapiens
gcccctgttgtggctttgtcta

SEQ ID NO: 8548534 - DNA, 22 bp, Homo sapiens
gcagcccaaaaaagaggtagat

SEQ ID NO: 8548535 - DNA, 22 bp, Homo sapiens
gcagcccaaaaaagaggtagat

SEQ ID NO: 8548536 - DNA, 22 bp, Homo sapiens
gcagcccaaaaaagaggtagat

SEQ ID NO: 8548537 - DNA, 22 bp, Homo sapiens
gcagcccaagagactctgttga

SEQ ID NO: 8548538 - DNA, 22 bp, Homo sapiens
gcagcccaagcctgagcatcct

SEQ ID NO: 8548539 - DNA, 22 bp, Homo sapiens
gcagccagtgggatgagaaaga

SEQ ID NO: 8548540 - DNA, 22 bp, Homo sapiens
gcagccattgagcgaaaaaatc

SEQ ID NO: 8548541 - DNA, 17 bp, Homo sapiens
gcagccagtgcagcagg

SEQ ID NO: 8548542 - DNA, 17 bp, Homo sapiens
gcagccagtgcagcagg

SEQ ID NO: 8548543 - DNA, 17 bp, Homo sapiens
gcagccagtgcagcagg

SEQ ID NO: 8548544 - DNA, 22 bp, Homo sapiens
gcagccaggaaagctggaccct

SEQ ID NO: 8548545 - DNA, 22 bp, Homo sapiens
gcagccaggtttgaggaccact

SEQ ID NO: 8548546 - DNA, 22 bp, Homo sapiens
gcagccaggtttgaggaccact

SEQ ID NO: 8548547 - DNA, 22 bp, Homo sapiens
gcagccaggaagcccaggacac

SEQ ID NO: 8548548 - DNA, 17 bp, Homo sapiens
gcagccagtgcagcagg

SEQ ID NO: 8548549 - DNA, 22 bp, Homo sapiens
gcagccagtatcctctgagatt

SEQ ID NO: 8548550 - DNA, 22 bp, Homo sapiens
gcagcccaatggactgagacag

SEQ ID NO: 8548551 - DNA, 22 bp, Homo sapiens
gcagcccaatggactgagacag

SEQ ID NO: 8548552 - DNA, 22 bp, Homo sapiens
gcagcccaatggactgagacag

SEQ ID NO: 8548553 - DNA, 22 bp, Homo sapiens
gcagcccacaccactctgctca

SEQ ID NO: 8548554 - DNA, 22 bp, Homo sapiens
gcagcccacagctggaggccta

SEQ ID NO: 8548555 - DNA, 22 bp, Homo sapiens
gcagctggctcagagaggtggg

SEQ ID NO: 8548556 - DNA, 22 bp, Homo sapiens
gcagctggctcagagaggtggg

SEQ ID NO: 8548557 - DNA, 22 bp, Homo sapiens
gcagctggctctgggaaaaact

SEQ ID NO: 8548558 - DNA, 22 bp, Homo sapiens
gcagctgggacactgaggccag

SEQ ID NO: 8548559 - DNA, 22 bp, Homo sapiens
gcagctgggacactgaggccag

SEQ ID NO: 8548560 - DNA, 22 bp, Homo sapiens
gcagctggtctggcctagagta

SEQ ID NO: 8548561 - DNA, 22 bp, Homo sapiens
gcagctggtgcaaatgtcactc

SEQ ID NO: 8548562 - DNA, 21 bp, Homo sapiens
gcagctggtctcagagcttgc

SEQ ID NO: 8548563 - DNA, 22 bp, Homo sapiens
gcagctggtctggcctagagta

SEQ ID NO: 8548564 - DNA, 22 bp, Homo sapiens
gcagctggtctggcctagagta

SEQ ID NO: 8548565 - DNA, 22 bp, Homo sapiens
gcagctggttaatgggagaatt

SEQ ID NO: 8548566 - DNA, 22 bp, Homo sapiens
gcagctggttaatgggagaatt

SEQ ID NO: 8548567 - DNA, 23 bp, Homo sapiens
gcagctggttagaagggaaggag

SEQ ID NO: 8548568 - DNA, 23 bp, Homo sapiens
gcagctggttagaagggaaggag

SEQ ID NO: 8548569 - DNA, 23 bp, Homo sapiens
gcagctggttagaagggaaggag

SEQ ID NO: 8548570 - DNA, 23 bp, Homo sapiens
gcagctggttagaagggaaggag

SEQ ID NO: 8548571 - DNA, 22 bp, Homo sapiens
gcagctgggtctgtgtgggctg

SEQ ID NO: 8548572 - DNA, 22 bp, Homo sapiens
gcagctgggtctgtgtgggctg

SEQ ID NO: 8548573 - DNA, 21 bp, Homo sapiens
gcagctggtctcagagcttgc

SEQ ID NO: 8548574 - DNA, 22 bp, Homo sapiens
gcagctgggtctgtgtgggctg

SEQ ID NO: 8548575 - DNA, 22 bp, Homo sapiens
gcagctggggccacacttaggc

SEQ ID NO: 8548576 - DNA, 22 bp, Homo sapiens
gcagctggggccacacttaggc

SEQ ID NO: 8548577 - DNA, 22 bp, Homo sapiens
gcagctggggaggtcgtgggga

SEQ ID NO: 8548578 - DNA, 22 bp, Homo sapiens
gcagctggggaggtcgtgggga

SEQ ID NO: 8548579 - DNA, 22 bp, Homo sapiens
gcagctggggaggtcgtgggga

SEQ ID NO: 8548580 - DNA, 22 bp, Homo sapiens
gcagctggggaggtcgtgggga

SEQ ID NO: 8548581 - DNA, 22 bp, Homo sapiens
gcagctgggccccagcctctcc

SEQ ID NO: 8548582 - DNA, 22 bp, Homo sapiens
gcagctgggccccagcctctcc

SEQ ID NO: 8548583 - DNA, 22 bp, Homo sapiens
gcagctgggccccagcctctcc

SEQ ID NO: 8548584 - DNA, 22 bp, Homo sapiens
gcagctgggccccagcctctcc

SEQ ID NO: 8548585 - DNA, 21 bp, Homo sapiens
gcagccagacgggattcagtt

SEQ ID NO: 8548586 - DNA, 21 bp, Homo sapiens
gcagccagacgggattcagtt

SEQ ID NO: 8548587 - DNA, 22 bp, Homo sapiens
gcagccagaagactcagaacaa

SEQ ID NO: 8548588 - DNA, 22 bp, Homo sapiens
gcagccagcccctctgacctct

SEQ ID NO: 8548589 - DNA, 22 bp, Homo sapiens
gcagccagcccctctgacctct

SEQ ID NO: 8548590 - DNA, 22 bp, Homo sapiens
gcagccagcccctctgacctct

SEQ ID NO: 8548591 - DNA, 22 bp, Homo sapiens
gcagccaggaaagctggaccct

SEQ ID NO: 8548592 - DNA, 22 bp, Homo sapiens
gcagccaggaaagctggaccct

SEQ ID NO: 8548593 - DNA, 21 bp, Homo sapiens
gcagccagccgagaccatgcc

SEQ ID NO: 8548594 - DNA, 21 bp, Homo sapiens
gcagccagccgagaccatgcc

SEQ ID NO: 8548595 - DNA, 21 bp, Homo sapiens
gcagccagccgagaccatgcc

SEQ ID NO: 8548596 - DNA, 21 bp, Homo sapiens
gcagccagccgagaccatgcc

SEQ ID NO: 8548597 - DNA, 22 bp, Homo sapiens
gcagccagcccctctgacctct

SEQ ID NO: 8548598 - DNA, 22 bp, Homo sapiens
gcagccagccctagtcccactt

SEQ ID NO: 8548599 - DNA, 22 bp, Homo sapiens
gcagccagccctagtcccactt

SEQ ID NO: 8548600 - DNA, 22 bp, Homo sapiens
gcagcagcccagggctctcaga

SEQ ID NO: 8548601 - DNA, 22 bp, Homo sapiens
gcagcagcccagggctctcaga

SEQ ID NO: 8548602 - DNA, 21 bp, Homo sapiens
gcagccacagccaccaagcta

SEQ ID NO: 8548603 - DNA, 22 bp, Homo sapiens
gcagcagcccagggctctcaga

SEQ ID NO: 8548604 - DNA, 22 bp, Homo sapiens
gcagccactagttttcctgttt

SEQ ID NO: 8548605 - DNA, 22 bp, Homo sapiens
gcagccagaagactcagaacaa

SEQ ID NO: 8548606 - DNA, 22 bp, Homo sapiens
gcagccagaagactcagaacaa

SEQ ID NO: 8548607 - DNA, 22 bp, Homo sapiens
gcagcagatgtgggcccagagc

SEQ ID NO: 8548608 - DNA, 22 bp, Homo sapiens
gcagcagaaggccaaggggagc

SEQ ID NO: 8548609 - DNA, 22 bp, Homo sapiens
gcagcagaagtagaagtacagg

SEQ ID NO: 8548610 - DNA, 22 bp, Homo sapiens
gcagcagcaggcgctcggccgt

SEQ ID NO: 8548611 - DNA, 22 bp, Homo sapiens
gcagcagcaggcgctcggccgt

SEQ ID NO: 8548612 - DNA, 22 bp, Homo sapiens
gcagcaagaggtttctgttgac

SEQ ID NO: 8548613 - DNA, 22 bp, Homo sapiens
gcagcaagtctagtttgtaggc

SEQ ID NO: 8548614 - DNA, 22 bp, Homo sapiens
gcagcaatcttcacagtgtcat

SEQ ID NO: 8548615 - DNA, 22 bp, Homo sapiens
gcagcacaaagtccccagggac

SEQ ID NO: 8548616 - DNA, 22 bp, Homo sapiens
gcagcacacggtggtgccctgg

SEQ ID NO: 8548617 - DNA, 22 bp, Homo sapiens
gcagcacatataaacaaagaga

SEQ ID NO: 8548618 - DNA, 22 bp, Homo sapiens
gcagcaccaaccagggcctgtt

SEQ ID NO: 8548619 - DNA, 22 bp, Homo sapiens
gcagcacatataaacaaagaga

SEQ ID NO: 8548620 - DNA, 22 bp, Homo sapiens
gcagcagaaggccaaggggagc

SEQ ID NO: 8548621 - DNA, 22 bp, Homo sapiens
gcagcagaaggccaaggggagc

SEQ ID NO: 8548622 - DNA, 19 bp, Homo sapiens
gcaggtcattaggctaggt

SEQ ID NO: 8548623 - DNA, 19 bp, Homo sapiens
gcaggtcattaggctaggt

SEQ ID NO: 8548624 - DNA, 22 bp, Homo sapiens
gcaggtctagaagctgcctctg

SEQ ID NO: 8548625 - DNA, 19 bp, Homo sapiens
gcaggtagagacagcagcc

SEQ ID NO: 8548626 - DNA, 19 bp, Homo sapiens
gcaggtagagacagcagcc

SEQ ID NO: 8548627 - DNA, 22 bp, Homo sapiens
gcaggtagtgatcgagggtgac

SEQ ID NO: 8548628 - DNA, 22 bp, Homo sapiens
gcaggtagtgatcgagggtgac

SEQ ID NO: 8548629 - DNA, 22 bp, Homo sapiens
gcaggtaagagaggctggcttc

SEQ ID NO: 8548630 - DNA, 21 bp, Homo sapiens
gcagggtttgtgctgtgagtt

SEQ ID NO: 8548631 - DNA, 19 bp, Homo sapiens
gcagggtgttgactgtccc

SEQ ID NO: 8548632 - DNA, 19 bp, Homo sapiens
gcagggtgttgactgtccc

SEQ ID NO: 8548633 - DNA, 22 bp, Homo sapiens
gcaggtctcaatctgagcaggc

SEQ ID NO: 8548634 - DNA, 22 bp, Homo sapiens
gcaggtctgttgattacagtca

SEQ ID NO: 8548635 - DNA, 22 bp, Homo sapiens
gcaggtgaaagtgagtagtgag

SEQ ID NO: 8548636 - DNA, 22 bp, Homo sapiens
gcagggtgtgtctcatacagtt

SEQ ID NO: 8548637 - DNA, 19 bp, Homo sapiens
gcagggtggcagagctctt

SEQ ID NO: 8548638 - DNA, 22 bp, Homo sapiens
gcagggtgtgtctcatacagtt

SEQ ID NO: 8548639 - DNA, 22 bp, Homo sapiens
gcagggccagtgcagagaggaa

SEQ ID NO: 8548640 - DNA, 22 bp, Homo sapiens
gcagggccagtgcagagaggaa

SEQ ID NO: 8548641 - DNA, 22 bp, Homo sapiens
gcagggccagtgcagagaggaa

SEQ ID NO: 8548642 - DNA, 22 bp, Homo sapiens
gcagggccaggtacaagaagca

SEQ ID NO: 8548643 - DNA, 22 bp, Homo sapiens
gcagggccaggtacaagaagca

SEQ ID NO: 8548644 - DNA, 22 bp, Homo sapiens
gcagggccagggctcaggctgt

SEQ ID NO: 8548645 - DNA, 22 bp, Homo sapiens
gcagggccagggctcaggctgt

SEQ ID NO: 8548646 - DNA, 22 bp, Homo sapiens
gcagggcatgggccctgtctgc

SEQ ID NO: 8548647 - DNA, 22 bp, Homo sapiens
gcagggcatgggccctgtctgc

SEQ ID NO: 8548648 - DNA, 22 bp, Homo sapiens
gcagggcaggatttgaacccag

SEQ ID NO: 8548649 - DNA, 22 bp, Homo sapiens
gcagggcaggatttgaacccag

SEQ ID NO: 8548650 - DNA, 22 bp, Homo sapiens
gcagggcagggcaagaactggg

SEQ ID NO: 8548651 - DNA, 22 bp, Homo sapiens
gcagggcagggcaagaactggg

SEQ ID NO: 8548652 - DNA, 22 bp, Homo sapiens
gcaggccacagtggagtctctg

SEQ ID NO: 8548653 - DNA, 22 bp, Homo sapiens
gcaggccacagtggagtctctg

SEQ ID NO: 8548654 - DNA, 22 bp, Homo sapiens
gcaggccactgtctcctctggg

SEQ ID NO: 8548655 - DNA, 22 bp, Homo sapiens
gcaggccacagtggagtctctg

SEQ ID NO: 8548656 - DNA, 22 bp, Homo sapiens
gcaggccagctgtgcagatggg

SEQ ID NO: 8548657 - DNA, 22 bp, Homo sapiens
gcaggccagctgtgcagatggg

SEQ ID NO: 8548658 - DNA, 22 bp, Homo sapiens
gcaggccagctgtgcagatggg

SEQ ID NO: 8548659 - DNA, 22 bp, Homo sapiens
gcaggcccagagtcgctggcct

SEQ ID NO: 8548660 - DNA, 22 bp, Homo sapiens
gcaggccattcaggagatgtgc

SEQ ID NO: 8548661 - DNA, 22 bp, Homo sapiens
gcaggccattcaggagatgtgc

SEQ ID NO: 8548662 - DNA, 19 bp, Homo sapiens
gcaggccaggaggcggagg

SEQ ID NO: 8548663 - DNA, 22 bp, Homo sapiens
gcaggccaggctaggggctgtc

SEQ ID NO: 8548664 - DNA, 22 bp, Homo sapiens
gcagctgtactggcagcattgt

SEQ ID NO: 8548665 - DNA, 22 bp, Homo sapiens
gcagctgtcactttcacaatgc

SEQ ID NO: 8548666 - DNA, 22 bp, Homo sapiens
gcaggcagttgcagttttctag

SEQ ID NO: 8548667 - DNA, 22 bp, Homo sapiens
gcaggcagttgcagttttctag

SEQ ID NO: 8548668 - DNA, 22 bp, Homo sapiens
gcaggccaagccctcgcagaga

SEQ ID NO: 8548669 - DNA, 22 bp, Homo sapiens
gcaggccaagccctcgcagaga

SEQ ID NO: 8548670 - DNA, 22 bp, Homo sapiens
gcaggcatggtcgctgccaggt

SEQ ID NO: 8548671 - DNA, 22 bp, Homo sapiens
gcaggcagtttgcttttccctc

SEQ ID NO: 8548672 - DNA, 22 bp, Homo sapiens
gcagggcagccacaggccccct

SEQ ID NO: 8548673 - DNA, 22 bp, Homo sapiens
gcagggcagccacaggccccct

SEQ ID NO: 8548674 - DNA, 22 bp, Homo sapiens
gcagggcagctcactgtggttc

SEQ ID NO: 8548675 - DNA, 22 bp, Homo sapiens
gcagggcagctcactgtggttc

SEQ ID NO: 8548676 - DNA, 22 bp, Homo sapiens
gcagggcagctcactgtggttc

SEQ ID NO: 8548677 - DNA, 22 bp, Homo sapiens
gcagggcagctgaagctaggtg

SEQ ID NO: 8548678 - DNA, 22 bp, Homo sapiens
gcagggcagcttagtccctgtc

SEQ ID NO: 8548679 - DNA, 22 bp, Homo sapiens
gcagggcagctgaagctaggtg

SEQ ID NO: 8548680 - DNA, 22 bp, Homo sapiens
gcagggcagcttagtccctgtc

SEQ ID NO: 8548681 - DNA, 22 bp, Homo sapiens
gcagggcagcttagtccctgtc

SEQ ID NO: 8548682 - DNA, 22 bp, Homo sapiens
gcagggcagcttagtccctgtc

SEQ ID NO: 8548683 - DNA, 20 bp, Homo sapiens
gcaggccctctctctagtct

SEQ ID NO: 8548684 - DNA, 19 bp, Homo sapiens
gcaggcccagtcgggctgg

SEQ ID NO: 8548685 - DNA, 19 bp, Homo sapiens
gcaggcccagtcgggctgg

SEQ ID NO: 8548686 - DNA, 22 bp, Homo sapiens
gcaggcctcccctgctggagct

SEQ ID NO: 8548687 - DNA, 22 bp, Homo sapiens
gcaggcctcccctgctggagct

SEQ ID NO: 8548688 - DNA, 22 bp, Homo sapiens
gcaggcctaagagaaggcattg

SEQ ID NO: 8548689 - DNA, 22 bp, Homo sapiens
gcaggcctaagagaaggcattg

SEQ ID NO: 8548690 - DNA, 18 bp, Homo sapiens
gcaggcctagaacttggt

SEQ ID NO: 8548691 - DNA, 22 bp, Homo sapiens
gcaggcccttagccttggtggg

SEQ ID NO: 8548692 - DNA, 22 bp, Homo sapiens
gcagagtgaagcagtatggaaa

SEQ ID NO: 8548693 - DNA, 23 bp, Homo sapiens
gcagaggtttttcagtatggttt

SEQ ID NO: 8548694 - DNA, 22 bp, Homo sapiens
gcagaggtgctcagtggcagaa

SEQ ID NO: 8548695 - DNA, 22 bp, Homo sapiens
gcagaggtgctcagtggcagaa

SEQ ID NO: 8548696 - DNA, 22 bp, Homo sapiens
gcagaggtggcatctgggctct

SEQ ID NO: 8548697 - DNA, 22 bp, Homo sapiens
gcagaggtgtagccccctccat

SEQ ID NO: 8548698 - DNA, 22 bp, Homo sapiens
gcagacaggcccagtggaggga

SEQ ID NO: 8548699 - DNA, 22 bp, Homo sapiens
gcagacagggctacagaggtac

SEQ ID NO: 8548700 - DNA, 18 bp, Homo sapiens
gcagagtgcgtctctgtg

SEQ ID NO: 8548701 - DNA, 22 bp, Homo sapiens
gcagagtgggagcccagggctg

SEQ ID NO: 8548702 - DNA, 22 bp, Homo sapiens
gcagagtgccgagatggaagcg

SEQ ID NO: 8548703 - DNA, 22 bp, Homo sapiens
gcagagtgagccgaggctgctc

SEQ ID NO: 8548704 - DNA, 22 bp, Homo sapiens
gcagagtgaagggagaggtgtg

SEQ ID NO: 8548705 - DNA, 22 bp, Homo sapiens
gcagagtgagatatgaacccag

SEQ ID NO: 8548706 - DNA, 22 bp, Homo sapiens
gcagagtgggagcccagggctg

SEQ ID NO: 8548707 - DNA, 22 bp, Homo sapiens
gcagagtgggagcccagggctg

SEQ ID NO: 8548708 - DNA, 19 bp, Homo sapiens
gcagagtggggtggagggt

SEQ ID NO: 8548709 - DNA, 22 bp, Homo sapiens
gcagcaacgcggccctactgct

SEQ ID NO: 8548710 - DNA, 22 bp, Homo sapiens
gcagcaagaataatttgggtag

SEQ ID NO: 8548711 - DNA, 22 bp, Homo sapiens
gcagacacagggaaggcaagga

SEQ ID NO: 8548712 - DNA, 22 bp, Homo sapiens
gcagaagggaataaggagcttt

SEQ ID NO: 8548713 - DNA, 22 bp, Homo sapiens
gcagacacttgaggtgggcttt

SEQ ID NO: 8548714 - DNA, 17 bp, Homo sapiens
gcagacacttctattga

SEQ ID NO: 8548715 - DNA, 22 bp, Homo sapiens
gcagacacttttattctgcata

SEQ ID NO: 8548716 - DNA, 23 bp, Homo sapiens
gcagacagagcagactaagacaa

SEQ ID NO: 8548717 - DNA, 23 bp, Homo sapiens
gcagacagagcagactaagacaa

SEQ ID NO: 8548718 - DNA, 22 bp, Homo sapiens
gcagacagactgcagtgatttt

SEQ ID NO: 8548719 - DNA, 22 bp, Homo sapiens
gcagacagaagctaagtagaca

SEQ ID NO: 8548720 - DNA, 22 bp, Homo sapiens
gcagacagatgagggtgctggg

SEQ ID NO: 8548721 - DNA, 22 bp, Homo sapiens
gcagacagatgagggtgctggg

SEQ ID NO: 8548722 - DNA, 22 bp, Homo sapiens
gcagacagcatgttgggctatt

SEQ ID NO: 8548723 - DNA, 22 bp, Homo sapiens
gcagacagcatgttgggctatt

SEQ ID NO: 8548724 - DNA, 22 bp, Homo sapiens
gcagacagcatgttgggctatt

SEQ ID NO: 8548725 - DNA, 22 bp, Homo sapiens
gcagacagccagactgcactgg

SEQ ID NO: 8548726 - DNA, 22 bp, Homo sapiens
gcagacagccagactgcactgg

SEQ ID NO: 8548727 - DNA, 22 bp, Homo sapiens
gcagacagccagactgcactgg

SEQ ID NO: 8548728 - DNA, 22 bp, Homo sapiens
gcagacaggcccagtggaggga

SEQ ID NO: 8548729 - DNA, 22 bp, Homo sapiens
gcagacaggcccagtggaggga

SEQ ID NO: 8548730 - DNA, 22 bp, Homo sapiens
gcagacaggcccagtggaggga

SEQ ID NO: 8548731 - DNA, 22 bp, Homo sapiens
gcaccagcctgagcctcttgca

SEQ ID NO: 8548732 - DNA, 22 bp, Homo sapiens
gcaccagcctgagcctcttgca

SEQ ID NO: 8548733 - DNA, 22 bp, Homo sapiens
gcaccagctgcagggtggctga

SEQ ID NO: 8548734 - DNA, 22 bp, Homo sapiens
gcaccacatcaatgaggggagc

SEQ ID NO: 8548735 - DNA, 22 bp, Homo sapiens
gcaccaccaccatcggcacctc

SEQ ID NO: 8548736 - DNA, 22 bp, Homo sapiens
gcaccagctgctgggttctaga

SEQ ID NO: 8548737 - DNA, 22 bp, Homo sapiens
gcaccagctgccttctgtgccc

SEQ ID NO: 8548738 - DNA, 22 bp, Homo sapiens
gcaccagctgccttctgtgccc

SEQ ID NO: 8548739 - DNA, 22 bp, Homo sapiens
gcacccagagggcagggtctcc

SEQ ID NO: 8548740 - DNA, 20 bp, Homo sapiens
gcacccagcttcttgttcta

SEQ ID NO: 8548741 - DNA, 22 bp, Homo sapiens
gcagaaggatccgcaggtgcaa

SEQ ID NO: 8548742 - DNA, 22 bp, Homo sapiens
gcagaaggatccgcaggtgcaa

SEQ ID NO: 8548743 - DNA, 22 bp, Homo sapiens
gcacccagcccagggcgtgatg

SEQ ID NO: 8548744 - DNA, 22 bp, Homo sapiens
gcacccagcccagggcgtgatg

SEQ ID NO: 8548745 - DNA, 21 bp, Homo sapiens
gcacccagccggttctcccag

SEQ ID NO: 8548746 - DNA, 21 bp, Homo sapiens
gcacccagccggttctcccag

SEQ ID NO: 8548747 - DNA, 22 bp, Homo sapiens
gcacccagaggtcagcagtgct

SEQ ID NO: 8548748 - DNA, 22 bp, Homo sapiens
gcacccagaggtcagcagtgct

SEQ ID NO: 8548749 - DNA, 22 bp, Homo sapiens
gcacccagatagcaaggattag

SEQ ID NO: 8548750 - DNA, 22 bp, Homo sapiens
gcacccagccagcatctcagag

SEQ ID NO: 8548751 - DNA, 22 bp, Homo sapiens
gcacccagccagcatctcagag

SEQ ID NO: 8548752 - DNA, 22 bp, Homo sapiens
gcacccagccagcatctcagag

SEQ ID NO: 8548753 - DNA, 22 bp, Homo sapiens
gcacccagatattgccttgacc

SEQ ID NO: 8548754 - DNA, 22 bp, Homo sapiens
gcacagaagagctttggaatga

SEQ ID NO: 8548755 - DNA, 22 bp, Homo sapiens
gcacagaacttctcttagtagg

SEQ ID NO: 8548756 - DNA, 22 bp, Homo sapiens
gcacagaacttctcttagtagg

SEQ ID NO: 8548757 - DNA, 22 bp, Homo sapiens
gcacagactttgattgcagtca

SEQ ID NO: 8548758 - DNA, 22 bp, Homo sapiens
gcacagaataacactctgggct

SEQ ID NO: 8548759 - DNA, 22 bp, Homo sapiens
gcacagaagtaaaatacaagtc

SEQ ID NO: 8548760 - DNA, 22 bp, Homo sapiens
gcacagaagtaaaatacaagtc

SEQ ID NO: 8548761 - DNA, 22 bp, Homo sapiens
gcacagagagcagtgggggaca

SEQ ID NO: 8548762 - DNA, 22 bp, Homo sapiens
gcacagagagcagtgggggaca

SEQ ID NO: 8548763 - DNA, 22 bp, Homo sapiens
gcacagagaggctgtgagcgcc

SEQ ID NO: 8548764 - DNA, 22 bp, Homo sapiens
gcacagagacagtcctgagatc

SEQ ID NO: 8548765 - DNA, 22 bp, Homo sapiens
gcacagagacagtcctgagatc

SEQ ID NO: 8548766 - DNA, 22 bp, Homo sapiens
gcacagagagcagtgggggaca

SEQ ID NO: 8548767 - DNA, 22 bp, Homo sapiens
gcacagagacagtcctgagatc

SEQ ID NO: 8548768 - DNA, 20 bp, Homo sapiens
gcacagagatgagcaaagta

SEQ ID NO: 8548769 - DNA, 22 bp, Homo sapiens
gcacagagggcagtgagcctct

SEQ ID NO: 8548770 - DNA, 22 bp, Homo sapiens
gcacagagggcagtgagcctct

SEQ ID NO: 8548771 - DNA, 22 bp, Homo sapiens
gcacagagggcagtgagcctct

SEQ ID NO: 8548772 - DNA, 22 bp, Homo sapiens
gcacagagagtcccgggtgccc

SEQ ID NO: 8548773 - DNA, 20 bp, Homo sapiens
gcacagagatgagcaaagta

SEQ ID NO: 8548774 - DNA, 22 bp, Homo sapiens
gcacagagagtcccgggtgccc

SEQ ID NO: 8548775 - DNA, 22 bp, Homo sapiens
gcacagagagggaaggtaactt

SEQ ID NO: 8548776 - DNA, 22 bp, Homo sapiens
gcacagagagggaaggtaactt

SEQ ID NO: 8548777 - DNA, 22 bp, Homo sapiens
gcacagcacagcaacatgtttt

SEQ ID NO: 8548778 - DNA, 22 bp, Homo sapiens
gcacagcacagcaacatgtttt

SEQ ID NO: 8548779 - DNA, 22 bp, Homo sapiens
gcacagcaatttctataagctc

SEQ ID NO: 8548780 - DNA, 22 bp, Homo sapiens
gcacagcagccgaaatgccctt

SEQ ID NO: 8548781 - DNA, 22 bp, Homo sapiens
gcacagcagacttggtggggct

SEQ ID NO: 8548782 - DNA, 22 bp, Homo sapiens
gcacagcagctgctcagttgct

SEQ ID NO: 8548783 - DNA, 20 bp, Homo sapiens
gcacatgcaacttttattta

SEQ ID NO: 8548784 - DNA, 22 bp, Homo sapiens
gcacagcaatttctataagctc

SEQ ID NO: 8548785 - DNA, 22 bp, Homo sapiens
gcacagagtgggtgagatgtgg

SEQ ID NO: 8548786 - DNA, 22 bp, Homo sapiens
gcacagagtgggtgagatgtgg

SEQ ID NO: 8548787 - DNA, 22 bp, Homo sapiens
gcacagagtcactagctaagca

SEQ ID NO: 8548788 - DNA, 22 bp, Homo sapiens
gcacagagtcactagctaagca

SEQ ID NO: 8548789 - DNA, 22 bp, Homo sapiens
gcacagaggtggaggacaaata

SEQ ID NO: 8548790 - DNA, 22 bp, Homo sapiens
gcacagaggtggaggacaaata

SEQ ID NO: 8548791 - DNA, 22 bp, Homo sapiens
gcacatgttgctagttacttgc

SEQ ID NO: 8548792 - DNA, 17 bp, Homo sapiens
gcacatgtgttctttta

SEQ ID NO: 8548793 - DNA, 22 bp, Homo sapiens
gcacatgtcttattcactgtta

SEQ ID NO: 8548794 - DNA, 22 bp, Homo sapiens
gcacatgtcttattcactgtta

SEQ ID NO: 8548795 - DNA, 22 bp, Homo sapiens
gcacatgtgagagtagaggcct

SEQ ID NO: 8548796 - DNA, 22 bp, Homo sapiens
gcacatggtaggcatttgatgt

SEQ ID NO: 8548797 - DNA, 18 bp, Homo sapiens
gcacatgtaagagtaaag

SEQ ID NO: 8548798 - DNA, 22 bp, Homo sapiens
gcacatggcggccagcaggtga

SEQ ID NO: 8548799 - DNA, 20 bp, Homo sapiens
gcaaggcacagtgaggaggg

SEQ ID NO: 8548800 - DNA, 20 bp, Homo sapiens
gcaaggcacagtgaggaggg

SEQ ID NO: 8548801 - DNA, 22 bp, Homo sapiens
gcaaggcagcgcggagtagcta

SEQ ID NO: 8548802 - DNA, 18 bp, Homo sapiens
gcaaggctcaggccaggc

SEQ ID NO: 8548803 - DNA, 22 bp, Homo sapiens
gcaaggcctgaggtgggtgctc

SEQ ID NO: 8548804 - DNA, 21 bp, Homo sapiens
gcaaggcctatcatggcagct

SEQ ID NO: 8548805 - DNA, 22 bp, Homo sapiens
gcaataaacatgtttgatgcgc

SEQ ID NO: 8548806 - DNA, 22 bp, Homo sapiens
gcaaggctcccgcagcccaggg

SEQ ID NO: 8548807 - DNA, 17 bp, Homo sapiens
gcaaggcctgtttgttc

SEQ ID NO: 8548808 - DNA, 22 bp, Homo sapiens
gcaatacagtaagagtactgta

SEQ ID NO: 8548809 - DNA, 22 bp, Homo sapiens
gcaatacagttgaagagattga

SEQ ID NO: 8548810 - DNA, 22 bp, Homo sapiens
gcaatacagtaggtttattggt

SEQ ID NO: 8548811 - DNA, 22 bp, Homo sapiens
gcaataaataacatggaagaca

SEQ ID NO: 8548812 - DNA, 23 bp, Homo sapiens
gcaatacaagactggtcatgagc

SEQ ID NO: 8548813 - DNA, 22 bp, Homo sapiens
gcaatacagaagagtggcaagg

SEQ ID NO: 8548814 - DNA, 22 bp, Homo sapiens
gcaataaagtagcagctcatca

SEQ ID NO: 8548815 - DNA, 22 bp, Homo sapiens
gcaataaataacatggaagaca

SEQ ID NO: 8548816 - DNA, 22 bp, Homo sapiens
gagtcacaaaagatgcccaggg

SEQ ID NO: 8548817 - DNA, 22 bp, Homo sapiens
gcaaggaagagcaggtggtgct

SEQ ID NO: 8548818 - DNA, 22 bp, Homo sapiens
gagtcaacaagtcagatctcac

SEQ ID NO: 8548819 - DNA, 22 bp, Homo sapiens
gcaaggacctttgagcgtgcca

SEQ ID NO: 8548820 - DNA, 17 bp, Homo sapiens
gcaaggaagttctttgc

SEQ ID NO: 8548821 - DNA, 22 bp, Homo sapiens
gcaaggaagcagagttgctatc

SEQ ID NO: 8548822 - DNA, 22 bp, Homo sapiens
gcaaggagactgtagggccaag

SEQ ID NO: 8548823 - DNA, 22 bp, Homo sapiens
gcaaggacctttgagcgtgcca

SEQ ID NO: 8548824 - DNA, 22 bp, Homo sapiens
gcaaggagactgtagggccaag

SEQ ID NO: 8548825 - DNA, 22 bp, Homo sapiens
gcaaggagactgtagggccaag

SEQ ID NO: 8548826 - DNA, 22 bp, Homo sapiens
gcaaggagactgtagggccaag

SEQ ID NO: 8548827 - DNA, 22 bp, Homo sapiens
gcaaggagcctggaggtgagtg

SEQ ID NO: 8548828 - DNA, 22 bp, Homo sapiens
gcaaggagcctggaggtgagtg

SEQ ID NO: 8548829 - DNA, 21 bp, Homo sapiens
gcaaggcaatgccatgatttc

SEQ ID NO: 8548830 - DNA, 22 bp, Homo sapiens
gcaaggatgtactgcaatagga

SEQ ID NO: 8548831 - DNA, 22 bp, Homo sapiens
gagtatataattaattggtctg

SEQ ID NO: 8548832 - DNA, 22 bp, Homo sapiens
gagtatatatagacatgtcaca

SEQ ID NO: 8548833 - DNA, 20 bp, Homo sapiens
gagtatatttcttcctttgc

SEQ ID NO: 8548834 - DNA, 22 bp, Homo sapiens
gagtatatttctctctcttaag

SEQ ID NO: 8548835 - DNA, 22 bp, Homo sapiens
gagtatatgactttcttttgca

SEQ ID NO: 8548836 - DNA, 22 bp, Homo sapiens
gagtagaaagtaaagtacgaat

SEQ ID NO: 8548837 - DNA, 22 bp, Homo sapiens
gagtagaactagaattcttcaa

SEQ ID NO: 8548838 - DNA, 22 bp, Homo sapiens
gagtagaactggttatctaata

SEQ ID NO: 8548839 - DNA, 22 bp, Homo sapiens
gagtagacattaaattacactg

SEQ ID NO: 8548840 - DNA, 22 bp, Homo sapiens
gagtagaaggaagttatctacc

SEQ ID NO: 8548841 - DNA, 22 bp, Homo sapiens
gagtagaactggttatctaata

SEQ ID NO: 8548842 - DNA, 22 bp, Homo sapiens
gagtagacattaaattacactg

SEQ ID NO: 8548843 - DNA, 22 bp, Homo sapiens
gagtagcattctagagtatgct

SEQ ID NO: 8548844 - DNA, 17 bp, Homo sapiens
ggttcagttctgcattc

SEQ ID NO: 8548845 - DNA, 22 bp, Homo sapiens
ggttcagtggaatgtgttgacc

SEQ ID NO: 8548846 - DNA, 22 bp, Homo sapiens
ggttcactctcaagtctgccta

SEQ ID NO: 8548847 - DNA, 22 bp, Homo sapiens
ggttcactccgatctctgcctc

SEQ ID NO: 8548848 - DNA, 22 bp, Homo sapiens
ggttcactctcaagtctgccta

SEQ ID NO: 8548849 - DNA, 22 bp, Homo sapiens
ggttcattctgaagtcttcagc

SEQ ID NO: 8548850 - DNA, 22 bp, Homo sapiens
ggttcagtttacattaaaatct

SEQ ID NO: 8548851 - DNA, 17 bp, Homo sapiens
ggttcagttctgcattc

SEQ ID NO: 8548852 - DNA, 22 bp, Homo sapiens
ggttggaggtgggaatagctag

SEQ ID NO: 8548853 - DNA, 19 bp, Homo sapiens
ggttggagaagagcggccc

SEQ ID NO: 8548854 - DNA, 23 bp, Homo sapiens
ggttggctgtacccaggctccct

SEQ ID NO: 8548855 - DNA, 22 bp, Homo sapiens
ggttggggcgagctggaggccc

SEQ ID NO: 8548856 - DNA, 22 bp, Homo sapiens
ggttggggcgagctggaggccc

SEQ ID NO: 8548857 - DNA, 22 bp, Homo sapiens
ggttggggcgagctggaggccc

SEQ ID NO: 8548858 - DNA, 22 bp, Homo sapiens
ggttggggcgagctggaggccc

SEQ ID NO: 8548859 - DNA, 22 bp, Homo sapiens
ggttggtgagtgcagggtgtta

SEQ ID NO: 8548860 - DNA, 22 bp, Homo sapiens
gtaattgaaattgccttgggtt

SEQ ID NO: 8548861 - DNA, 22 bp, Homo sapiens
gtaattgaacattaagttgaag

SEQ ID NO: 8548862 - DNA, 22 bp, Homo sapiens
gtaattgactcagctctgttca

SEQ ID NO: 8548863 - DNA, 22 bp, Homo sapiens
gtaattgagttacctggaccag

SEQ ID NO: 8548864 - DNA, 22 bp, Homo sapiens
ggtttaatgggtgaaggcatga

SEQ ID NO: 8548865 - DNA, 22 bp, Homo sapiens
gtaatgcttttgatacagggac

SEQ ID NO: 8548866 - DNA, 22 bp, Homo sapiens
ggtttaatggagatatttcaga

SEQ ID NO: 8548867 - DNA, 17 bp, Homo sapiens
ggtttaatccttacctg

SEQ ID NO: 8548868 - DNA, 22 bp, Homo sapiens
ggtttaaaagccatgcatgggg

SEQ ID NO: 8548869 - DNA, 22 bp, Homo sapiens
ggtttaaaagccatgcatgggg

SEQ ID NO: 8548870 - DNA, 22 bp, Homo sapiens
ggtttaagacaggcttcacagt

SEQ ID NO: 8548871 - DNA, 21 bp, Homo sapiens
ggttggtgtgtccagtggcca

SEQ ID NO: 8548872 - DNA, 21 bp, Homo sapiens
ggttggtgtgtccagtggcca

SEQ ID NO: 8548873 - DNA, 22 bp, Homo sapiens
ggttgtagttggaggttgtata

SEQ ID NO: 8548874 - DNA, 21 bp, Homo sapiens
ggttggtgtgtccagtggcca

SEQ ID NO: 8548875 - DNA, 22 bp, Homo sapiens
ggttcacactaagcttaagtgg

SEQ ID NO: 8548876 - DNA, 22 bp, Homo sapiens
ggttcacactttcatgatttca

SEQ ID NO: 8548877 - DNA, 22 bp, Homo sapiens
ggttcacatattgagagtattc

SEQ ID NO: 8548878 - DNA, 22 bp, Homo sapiens
ggtggtggagccagctgggagt

SEQ ID NO: 8548879 - DNA, 22 bp, Homo sapiens
ggtggtggagccagctgggagt

SEQ ID NO: 8548880 - DNA, 22 bp, Homo sapiens
ggtggtggagccagctgggagt

SEQ ID NO: 8548881 - DNA, 22 bp, Homo sapiens
ggtgggtttggaagagcaggct

SEQ ID NO: 8548882 - DNA, 22 bp, Homo sapiens
ggtgggtttggaagagcaggct

SEQ ID NO: 8548883 - DNA, 19 bp, Homo sapiens
ggttaatgttaggatactt

SEQ ID NO: 8548884 - DNA, 22 bp, Homo sapiens
ggttaaacactttggaagtggc

SEQ ID NO: 8548885 - DNA, 22 bp, Homo sapiens
ggttaaaactgatattatgggt

SEQ ID NO: 8548886 - DNA, 21 bp, Homo sapiens
ggttaaaagacacatctgttt

SEQ ID NO: 8548887 - DNA, 19 bp, Homo sapiens
ggtgtttcttcattttcca

SEQ ID NO: 8548888 - DNA, 19 bp, Homo sapiens
ggtgtttcttcattttcca

SEQ ID NO: 8548889 - DNA, 22 bp, Homo sapiens
ggttaaaaataatttacttggc

SEQ ID NO: 8548890 - DNA, 22 bp, Homo sapiens
ggtggggccagggctccaacct

SEQ ID NO: 8548891 - DNA, 22 bp, Homo sapiens
ggtggggccagggctccaacct

SEQ ID NO: 8548892 - DNA, 22 bp, Homo sapiens
ggtggggattcctgatcactgt

SEQ ID NO: 8548893 - DNA, 22 bp, Homo sapiens
ggtggggccctggcactggtat

SEQ ID NO: 8548894 - DNA, 22 bp, Homo sapiens
ggtggggagtcaggcattcttg

SEQ ID NO: 8548895 - DNA, 22 bp, Homo sapiens
ggtgggcaggtcactctgcctc

SEQ ID NO: 8548896 - DNA, 22 bp, Homo sapiens
ggtgggcgactgagaggggttt

SEQ ID NO: 8548897 - DNA, 22 bp, Homo sapiens
ggtgggccaggaaggccgccag

SEQ ID NO: 8548898 - DNA, 22 bp, Homo sapiens
ggtgggtgagccctgggagctg

SEQ ID NO: 8548899 - DNA, 19 bp, Homo sapiens
ggtgggtgacctccccacc

SEQ ID NO: 8548900 - DNA, 19 bp, Homo sapiens
ggtgggttggtggttccct

SEQ ID NO: 8548901 - DNA, 22 bp, Homo sapiens
ggtgggtgcagggggcttctta

SEQ ID NO: 8548902 - DNA, 22 bp, Homo sapiens
ggtggggcctgctccagcggcc

SEQ ID NO: 8548903 - DNA, 22 bp, Homo sapiens
ggtggggccctggcactggtat

SEQ ID NO: 8548904 - DNA, 22 bp, Homo sapiens
ggtggggcctgctccagcggcc

SEQ ID NO: 8548905 - DNA, 22 bp, Homo sapiens
ggtggggcctgctccagcggcc

SEQ ID NO: 8548906 - DNA, 22 bp, Homo sapiens
ggtggggcctgctccagcggcc

SEQ ID NO: 8548907 - DNA, 22 bp, Homo sapiens
ggtggggcctgctccagcggcc

SEQ ID NO: 8548908 - DNA, 22 bp, Homo sapiens
ggtggcagaataattgaaggtc

SEQ ID NO: 8548909 - DNA, 22 bp, Homo sapiens
ggtggcagaataattgaaggtc

SEQ ID NO: 8548910 - DNA, 22 bp, Homo sapiens
ggtggcagaataattgaaggtc

SEQ ID NO: 8548911 - DNA, 19 bp, Homo sapiens
ggtggcagaacgtgggtcc

SEQ ID NO: 8548912 - DNA, 22 bp, Homo sapiens
ggtggcagagaggaggtagttt

SEQ ID NO: 8548913 - DNA, 22 bp, Homo sapiens
ggtggcagagacataggacata

SEQ ID NO: 8548914 - DNA, 22 bp, Homo sapiens
ggtgggcaggcgaggcccaggt

SEQ ID NO: 8548915 - DNA, 22 bp, Homo sapiens
ggtgggcaggcgaggcccaggt

SEQ ID NO: 8548916 - DNA, 22 bp, Homo sapiens
ggtggagagctggatgagaggt

SEQ ID NO: 8548917 - DNA, 22 bp, Homo sapiens
ggtggacagtgttagctctggg

SEQ ID NO: 8548918 - DNA, 22 bp, Homo sapiens
ggtggagctggaccaggagagg

SEQ ID NO: 8548919 - DNA, 22 bp, Homo sapiens
ggtggagctggaccaggagagg

SEQ ID NO: 8548920 - DNA, 22 bp, Homo sapiens
ggtggcacactggggagctcgg

SEQ ID NO: 8548921 - DNA, 22 bp, Homo sapiens
ggtggcaccttaccctgcgcag

SEQ ID NO: 8548922 - DNA, 22 bp, Homo sapiens
ggtggcaccttgatcttggact

SEQ ID NO: 8548923 - DNA, 22 bp, Homo sapiens
ggtggagtaattcgcagaggtt

SEQ ID NO: 8548924 - DNA, 22 bp, Homo sapiens
ggtggagctgtggacaggaagg

SEQ ID NO: 8548925 - DNA, 22 bp, Homo sapiens
ggtgaggaaagatggtgacagt

SEQ ID NO: 8548926 - DNA, 22 bp, Homo sapiens
ggtgaggaattggggactgacc

SEQ ID NO: 8548927 - DNA, 22 bp, Homo sapiens
ggtgaggaattggggactgacc

SEQ ID NO: 8548928 - DNA, 22 bp, Homo sapiens
ggtgaggaattggggactgacc

SEQ ID NO: 8548929 - DNA, 22 bp, Homo sapiens
ggtgaggaattggggactgacc

SEQ ID NO: 8548930 - DNA, 22 bp, Homo sapiens
ggtgagcactgccctgggtctc

SEQ ID NO: 8548931 - DNA, 22 bp, Homo sapiens
ggtgagcactgccctgggtctc

SEQ ID NO: 8548932 - DNA, 22 bp, Homo sapiens
ggtgagcagctgtctgtatgga

SEQ ID NO: 8548933 - DNA, 19 bp, Homo sapiens
ggtgagccctcgcctgcct

SEQ ID NO: 8548934 - DNA, 22 bp, Homo sapiens
ggtgagcagctgtctgtatgga

SEQ ID NO: 8548935 - DNA, 22 bp, Homo sapiens
ggtgaggaaagatggtgacagt

SEQ ID NO: 8548936 - DNA, 21 bp, Homo sapiens
ggtgacacgtggccccgctct

SEQ ID NO: 8548937 - DNA, 22 bp, Homo sapiens
ggtccctgctgaagccttggtg

SEQ ID NO: 8548938 - DNA, 22 bp, Homo sapiens
ggtgagaggcagtgctgtggaa

SEQ ID NO: 8548939 - DNA, 22 bp, Homo sapiens
ggtgagcaaagcttcatctgta

SEQ ID NO: 8548940 - DNA, 18 bp, Homo sapiens
ggtgagggagctggaagc

SEQ ID NO: 8548941 - DNA, 18 bp, Homo sapiens
ggtgagggagctggaagc

SEQ ID NO: 8548942 - DNA, 18 bp, Homo sapiens
ggtgagggagctggaagc

SEQ ID NO: 8548943 - DNA, 18 bp, Homo sapiens
ggtgagggagctggaagc

SEQ ID NO: 8548944 - DNA, 18 bp, Homo sapiens
ggtgagggagctggaagc

SEQ ID NO: 8548945 - DNA, 22 bp, Homo sapiens
ggtgaggctaagtgacacaggg

SEQ ID NO: 8548946 - DNA, 22 bp, Homo sapiens
ggtgagggacatcactcagcca

SEQ ID NO: 8548947 - DNA, 22 bp, Homo sapiens
ggtgaggcaggtggctgctgag

SEQ ID NO: 8548948 - DNA, 22 bp, Homo sapiens
ggtgaggcccagtgatctgtgt

SEQ ID NO: 8548949 - DNA, 18 bp, Homo sapiens
ggtgaggcggcggccagc

SEQ ID NO: 8548950 - DNA, 22 bp, Homo sapiens
ggtggacagtgttagctctggg

SEQ ID NO: 8548951 - DNA, 22 bp, Homo sapiens
ggtggacagtgttagctctggg

SEQ ID NO: 8548952 - DNA, 22 bp, Homo sapiens
ggtggaaggcctggaaggaggc

SEQ ID NO: 8548953 - DNA, 21 bp, Homo sapiens
ggtgctcgctgatgaggagtg

SEQ ID NO: 8548954 - DNA, 22 bp, Homo sapiens
ggtgctcaaggtgacaggacat

SEQ ID NO: 8548955 - DNA, 21 bp, Homo sapiens
ggtgctcctccatgctgctct

SEQ ID NO: 8548956 - DNA, 22 bp, Homo sapiens
ggtgagggagtggaacgaggtg

SEQ ID NO: 8548957 - DNA, 22 bp, Homo sapiens
ggtgagggagtggaacgaggtg

SEQ ID NO: 8548958 - DNA, 20 bp, Homo sapiens
ggtccctgccctctgtcatc

SEQ ID NO: 8548959 - DNA, 22 bp, Homo sapiens
ggtccctgcctgaggctggcct

SEQ ID NO: 8548960 - DNA, 22 bp, Homo sapiens
ggtccctgaagaggcctggggt

SEQ ID NO: 8548961 - DNA, 22 bp, Homo sapiens
ggtccctgaagaggcctggggt

SEQ ID NO: 8548962 - DNA, 22 bp, Homo sapiens
ggtccctagagtgggatgactt

SEQ ID NO: 8548963 - DNA, 22 bp, Homo sapiens
ggtccccgtggaggctggagcg

SEQ ID NO: 8548964 - DNA, 22 bp, Homo sapiens
ggtccccgtggaggctggagcg

SEQ ID NO: 8548965 - DNA, 22 bp, Homo sapiens
ggtccccgtggaggctggagcg

SEQ ID NO: 8548966 - DNA, 22 bp, Homo sapiens
ggtccccgtggaggctggagcg

SEQ ID NO: 8548967 - DNA, 22 bp, Homo sapiens
ggtcccaggctgcgggctggtg

SEQ ID NO: 8548968 - DNA, 22 bp, Homo sapiens
ggtcccaggttgacagggagac

SEQ ID NO: 8548969 - DNA, 22 bp, Homo sapiens
ggtcccaggttgacagggagac

SEQ ID NO: 8548970 - DNA, 22 bp, Homo sapiens
ggtcccaggctgcgggctggtg

SEQ ID NO: 8548971 - DNA, 22 bp, Homo sapiens
ggtcccagtcctctccctgcta

SEQ ID NO: 8548972 - DNA, 22 bp, Homo sapiens
ggtccccagcagtggctgcttc

SEQ ID NO: 8548973 - DNA, 21 bp, Homo sapiens
ggtcccattgtgaggcttgaa

SEQ ID NO: 8548974 - DNA, 22 bp, Homo sapiens
ggtcccatgaaagagggaggcc

SEQ ID NO: 8548975 - DNA, 23 bp, Homo sapiens
ggtcccagtggagaggcctcacc

SEQ ID NO: 8548976 - DNA, 22 bp, Homo sapiens
ggtcccagttgcccaggtcagg

SEQ ID NO: 8548977 - DNA, 22 bp, Homo sapiens
gggttgaggcggatgtcggcgg

SEQ ID NO: 8548978 - DNA, 22 bp, Homo sapiens
gggtgtgcaggtcatggcgtct

SEQ ID NO: 8548979 - DNA, 22 bp, Homo sapiens
gggtgtcctgtgccaagctggg

SEQ ID NO: 8548980 - DNA, 22 bp, Homo sapiens
gggtgtagaaagaaccctctgg

SEQ ID NO: 8548981 - DNA, 18 bp, Homo sapiens
gggtggtgtgctcttcgc

SEQ ID NO: 8548982 - DNA, 22 bp, Homo sapiens
gggtggtgtattagagctgcag

SEQ ID NO: 8548983 - DNA, 22 bp, Homo sapiens
gggttggatcctggtggctgcc

SEQ ID NO: 8548984 - DNA, 22 bp, Homo sapiens
gggttggattacttagggagaa

SEQ ID NO: 8548985 - DNA, 22 bp, Homo sapiens
gggttggattacttagggagaa

SEQ ID NO: 8548986 - DNA, 22 bp, Homo sapiens
gggttgaggcggatgtcggcgg

SEQ ID NO: 8548987 - DNA, 22 bp, Homo sapiens
gggttggattacttagggagaa

SEQ ID NO: 8548988 - DNA, 22 bp, Homo sapiens
gggttggcatcagggttctgtg

SEQ ID NO: 8548989 - DNA, 22 bp, Homo sapiens
gggttgggactgtcatctggag

SEQ ID NO: 8548990 - DNA, 22 bp, Homo sapiens
gggttggggcccagcagtctgc

SEQ ID NO: 8548991 - DNA, 22 bp, Homo sapiens
ggtcccagctggtcactgtcag

SEQ ID NO: 8548992 - DNA, 22 bp, Homo sapiens
ggtcccagctggtcactgtcag

SEQ ID NO: 8548993 - DNA, 22 bp, Homo sapiens
ggtcccagctgctcaagaggct

SEQ ID NO: 8548994 - DNA, 22 bp, Homo sapiens
ggtcccaggaatctgtgttcta

SEQ ID NO: 8548995 - DNA, 22 bp, Homo sapiens
ggtcccaggaatctgtgttcta

SEQ ID NO: 8548996 - DNA, 22 bp, Homo sapiens
ggtcccaggaagtgcggcggcg

SEQ ID NO: 8548997 - DNA, 22 bp, Homo sapiens
ggtcccaggagaataggtgcaa

SEQ ID NO: 8548998 - DNA, 22 bp, Homo sapiens
ggtcccaggctccctcttgtcc

SEQ ID NO: 8548999 - DNA, 22 bp, Homo sapiens
ggtcccaggattggttgcgcag

SEQ ID NO: 8549000 - DNA, 22 bp, Homo sapiens
gggttttatggttcacttgcaa

SEQ ID NO: 8549001 - DNA, 22 bp, Homo sapiens
gggttggggcccagcagtctgc

SEQ ID NO: 8549002 - DNA, 22 bp, Homo sapiens
gggttggggcccagcagtctgc

SEQ ID NO: 8549003 - DNA, 22 bp, Homo sapiens
ggtcccagctgctcaagaggct

SEQ ID NO: 8549004 - DNA, 22 bp, Homo sapiens
ggtaaaaatcacaaatacttta

SEQ ID NO: 8549005 - DNA, 22 bp, Homo sapiens
ggtaaaaatcacaaatacttta

SEQ ID NO: 8549006 - DNA, 22 bp, Homo sapiens
ggtaaaaatcacaaatacttta

SEQ ID NO: 8549007 - DNA, 20 bp, Homo sapiens
ggggcccaagccctcttgcc

SEQ ID NO: 8549008 - DNA, 22 bp, Homo sapiens
ggggccagtaggagtgatgtac

SEQ ID NO: 8549009 - DNA, 22 bp, Homo sapiens
ggggccagtaggagtgatgtac

SEQ ID NO: 8549010 - DNA, 22 bp, Homo sapiens
ggggccaggtccagcttccaaa

SEQ ID NO: 8549011 - DNA, 22 bp, Homo sapiens
ggggccagcttcgcgtgctctt

SEQ ID NO: 8549012 - DNA, 22 bp, Homo sapiens
ggggccaggtccagcttccaaa

SEQ ID NO: 8549013 - DNA, 22 bp, Homo sapiens
ggggccaggtccagcttccaaa

SEQ ID NO: 8549014 - DNA, 22 bp, Homo sapiens
ggggccagcttcgcgtgctctt

SEQ ID NO: 8549015 - DNA, 22 bp, Homo sapiens
ggggccagcttcgcgtgctctt

SEQ ID NO: 8549016 - DNA, 22 bp, Homo sapiens
ggggccagcactgtgcctttgt

SEQ ID NO: 8549017 - DNA, 22 bp, Homo sapiens
ggggccagcaatgttgaggaat

SEQ ID NO: 8549018 - DNA, 22 bp, Homo sapiens
ggggccagcaatgttgaggaat

SEQ ID NO: 8549019 - DNA, 22 bp, Homo sapiens
ggggccagatatcactaaggtt

SEQ ID NO: 8549020 - DNA, 22 bp, Homo sapiens
ggggcccagggcagcagtgcag

SEQ ID NO: 8549021 - DNA, 22 bp, Homo sapiens
ggggcccagcacccctcctcgc

SEQ ID NO: 8549022 - DNA, 22 bp, Homo sapiens
ggggcccagcacccctcctcgc

SEQ ID NO: 8549023 - DNA, 22 bp, Homo sapiens
ggggcccctcggacacgtgcgg

SEQ ID NO: 8549024 - DNA, 22 bp, Homo sapiens
ggggcccttgtggctgcaggcc

SEQ ID NO: 8549025 - DNA, 22 bp, Homo sapiens
ggggtgagtgctcagccccgga

SEQ ID NO: 8549026 - DNA, 22 bp, Homo sapiens
ggggtagggcgattgctgcttt

SEQ ID NO: 8549027 - DNA, 22 bp, Homo sapiens
ggggtgggagtgccatccttga

SEQ ID NO: 8549028 - DNA, 19 bp, Homo sapiens
ggggtggctggggctccag

SEQ ID NO: 8549029 - DNA, 22 bp, Homo sapiens
ggggtgggagtgccatccttga

SEQ ID NO: 8549030 - DNA, 22 bp, Homo sapiens
ggggtgggagtgccatccttga

SEQ ID NO: 8549031 - DNA, 22 bp, Homo sapiens
ggggtgggcgtgcagggacacc

SEQ ID NO: 8549032 - DNA, 22 bp, Homo sapiens
ggggtgggagtgccatccttga

SEQ ID NO: 8549033 - DNA, 22 bp, Homo sapiens
ggggtgggagtgccatccttga

SEQ ID NO: 8549034 - DNA, 19 bp, Homo sapiens
ggggtggctggggctccag

SEQ ID NO: 8549035 - DNA, 22 bp, Homo sapiens
ggggtggctggcacctcctggt

SEQ ID NO: 8549036 - DNA, 22 bp, Homo sapiens
ggggtggcctgtaggcagcatg

SEQ ID NO: 8549037 - DNA, 22 bp, Homo sapiens
ggggtggccctaccctctggaa

SEQ ID NO: 8549038 - DNA, 22 bp, Homo sapiens
ggggtggattcctacaggtcca

SEQ ID NO: 8549039 - DNA, 22 bp, Homo sapiens
ggggtggattcctacaggtcca

SEQ ID NO: 8549040 - DNA, 22 bp, Homo sapiens
ggggtggatcaggcaggcccag

SEQ ID NO: 8549041 - DNA, 22 bp, Homo sapiens
ggggtggatcaggcaggcccag

SEQ ID NO: 8549042 - DNA, 22 bp, Homo sapiens
gggtgcaggcagcccaggcagg

SEQ ID NO: 8549043 - DNA, 21 bp, Homo sapiens
gggtgctgtggtcatgcagga

SEQ ID NO: 8549044 - DNA, 22 bp, Homo sapiens
gggtgctttggctcacgcctgt

SEQ ID NO: 8549045 - DNA, 22 bp, Homo sapiens
gggtgcagctttgaaagcatgt

SEQ ID NO: 8549046 - DNA, 22 bp, Homo sapiens
gggtgcaggcagcccaggcagg

SEQ ID NO: 8549047 - DNA, 22 bp, Homo sapiens
gggtgcaggcagcccaggcagg

SEQ ID NO: 8549048 - DNA, 22 bp, Homo sapiens
gggtgcaggcagcccaggcagg

SEQ ID NO: 8549049 - DNA, 22 bp, Homo sapiens
gggtgcaactaagaagaggtga

SEQ ID NO: 8549050 - DNA, 22 bp, Homo sapiens
gggtgcaagcaagtggcacaga

SEQ ID NO: 8549051 - DNA, 22 bp, Homo sapiens
gggtgaggccttgctgccatca

SEQ ID NO: 8549052 - DNA, 22 bp, Homo sapiens
gggtgagggatgagccttcttc

SEQ ID NO: 8549053 - DNA, 22 bp, Homo sapiens
gggtgagggatgagccttcttc

SEQ ID NO: 8549054 - DNA, 20 bp, Homo sapiens
gggtgaggatggagaatttg

SEQ ID NO: 8549055 - DNA, 22 bp, Homo sapiens
gggtgaggagctgccagtcatg

SEQ ID NO: 8549056 - DNA, 22 bp, Homo sapiens
gggtgaggagctgccagtcatg

SEQ ID NO: 8549057 - DNA, 22 bp, Homo sapiens
gggtgaggcccatttgaggcca

SEQ ID NO: 8549058 - DNA, 22 bp, Homo sapiens
gggtgaggcccatttgaggcca

SEQ ID NO: 8549059 - DNA, 22 bp, Homo sapiens
gggtggtgtattagagctgcag

SEQ ID NO: 8549060 - DNA, 22 bp, Homo sapiens
gggtggtgtattagagctgcag

SEQ ID NO: 8549061 - DNA, 22 bp, Homo sapiens
gggtggtgggcacagaatctgg

SEQ ID NO: 8549062 - DNA, 22 bp, Homo sapiens
gggtggtggcggaggctccagg

SEQ ID NO: 8549063 - DNA, 22 bp, Homo sapiens
gggtggtggcggaggctccagg

SEQ ID NO: 8549064 - DNA, 22 bp, Homo sapiens
gggtggtggccagcagtgggca

SEQ ID NO: 8549065 - DNA, 22 bp, Homo sapiens
gggtggtggccagcagtgggca

SEQ ID NO: 8549066 - DNA, 16 bp, Homo sapiens
gggtggtcttggagac

SEQ ID NO: 8549067 - DNA, 22 bp, Homo sapiens
gggtggtgagatgtagctgatg

SEQ ID NO: 8549068 - DNA, 22 bp, Homo sapiens
gggtggtctggcaggctggaaa

SEQ ID NO: 8549069 - DNA, 22 bp, Homo sapiens
gggtgggtggtccgcagacata

SEQ ID NO: 8549070 - DNA, 21 bp, Homo sapiens
gggtggtctgctgaagaggga

SEQ ID NO: 8549071 - DNA, 22 bp, Homo sapiens
gggtggagaggctaagtccagt

SEQ ID NO: 8549072 - DNA, 22 bp, Homo sapiens
gggtggagaggctaagtccagt

SEQ ID NO: 8549073 - DNA, 22 bp, Homo sapiens
gggtggaagccagagaggtcat

SEQ ID NO: 8549074 - DNA, 22 bp, Homo sapiens
gggtggagagaaagaaacgtga

SEQ ID NO: 8549075 - DNA, 22 bp, Homo sapiens
gggtggagccagttgactctgt

SEQ ID NO: 8549076 - DNA, 22 bp, Homo sapiens
gggtggagaggctaagtccagt

SEQ ID NO: 8549077 - DNA, 21 bp, Homo sapiens
gggtgggtggaattaggagtg

SEQ ID NO: 8549078 - DNA, 21 bp, Homo sapiens
gggtgggtggaattaggagtg

SEQ ID NO: 8549079 - DNA, 21 bp, Homo sapiens
gggtggggttccagccttttc

SEQ ID NO: 8549080 - DNA, 21 bp, Homo sapiens
gggtggggttccagccttttc

SEQ ID NO: 8549081 - DNA, 21 bp, Homo sapiens
gggtgggtggaattaggagtg

SEQ ID NO: 8549082 - DNA, 22 bp, Homo sapiens
gggtgggtggcagcaccgaggc

SEQ ID NO: 8549083 - DNA, 22 bp, Homo sapiens
gggtgggtggcagcaccgaggc

SEQ ID NO: 8549084 - DNA, 22 bp, Homo sapiens
gggtgggtggtccgcagacata

SEQ ID NO: 8549085 - DNA, 22 bp, Homo sapiens
gggctctgggattcagagcaag

SEQ ID NO: 8549086 - DNA, 22 bp, Homo sapiens
gggctctggggtcagacagcct

SEQ ID NO: 8549087 - DNA, 22 bp, Homo sapiens
gggctctgggattcagagcaag

SEQ ID NO: 8549088 - DNA, 22 bp, Homo sapiens
gggctctgggatgctcttagag

SEQ ID NO: 8549089 - DNA, 19 bp, Homo sapiens
gggctctggcctcagtggg

SEQ ID NO: 8549090 - DNA, 19 bp, Homo sapiens
gggctctggcctcagtggg

SEQ ID NO: 8549091 - DNA, 22 bp, Homo sapiens
gggctgtgtgcccacttcccat

SEQ ID NO: 8549092 - DNA, 22 bp, Homo sapiens
gggctgtgtgcccacttcccat

SEQ ID NO: 8549093 - DNA, 18 bp, Homo sapiens
gggctgtgttcatgccca

SEQ ID NO: 8549094 - DNA, 18 bp, Homo sapiens
gggctgtgttcatgccca

SEQ ID NO: 8549095 - DNA, 22 bp, Homo sapiens
gggctgtgttaggtgcggttac

SEQ ID NO: 8549096 - DNA, 22 bp, Homo sapiens
gggctgtgtgcccacttcccat

SEQ ID NO: 8549097 - DNA, 22 bp, Homo sapiens
gggctgtgtgcagtacgggtcc

SEQ ID NO: 8549098 - DNA, 22 bp, Homo sapiens
gggctggtctggcttagtcagg

SEQ ID NO: 8549099 - DNA, 22 bp, Homo sapiens
gggctggtgaggctgccctgca

SEQ ID NO: 8549100 - DNA, 16 bp, Homo sapiens
gggctgggggattctg

SEQ ID NO: 8549101 - DNA, 16 bp, Homo sapiens
gggctgggggattctg

SEQ ID NO: 8549102 - DNA, 16 bp, Homo sapiens
gggctgggggattctg

SEQ ID NO: 8549103 - DNA, 22 bp, Homo sapiens
gggctggtctggcttagtcagg

SEQ ID NO: 8549104 - DNA, 16 bp, Homo sapiens
gggctgggggattctg

SEQ ID NO: 8549105 - DNA, 16 bp, Homo sapiens
gggctgggggattctg

SEQ ID NO: 8549106 - DNA, 22 bp, Homo sapiens
gggcttctggctactgtatgag

SEQ ID NO: 8549107 - DNA, 19 bp, Homo sapiens
gggcttctgggatcaagag

SEQ ID NO: 8549108 - DNA, 22 bp, Homo sapiens
gggcttctgggcaccactccct

SEQ ID NO: 8549109 - DNA, 22 bp, Homo sapiens
gggcttctctttagtgagctga

SEQ ID NO: 8549110 - DNA, 22 bp, Homo sapiens
gggcttctctttagtgagctga

SEQ ID NO: 8549111 - DNA, 22 bp, Homo sapiens
gggcttctgctcttttggtgct

SEQ ID NO: 8549112 - DNA, 22 bp, Homo sapiens
gggcttctccctaaggactctg

SEQ ID NO: 8549113 - DNA, 22 bp, Homo sapiens
gggcttctccctaaggactctg

SEQ ID NO: 8549114 - DNA, 22 bp, Homo sapiens
gggcttctcttatgctaactgg

SEQ ID NO: 8549115 - DNA, 22 bp, Homo sapiens
gggcttctctgggagtcctggt

SEQ ID NO: 8549116 - DNA, 22 bp, Homo sapiens
gggcttctagaatttctgatat

SEQ ID NO: 8549117 - DNA, 22 bp, Homo sapiens
gggcttctagaccagcagtgag

SEQ ID NO: 8549118 - DNA, 22 bp, Homo sapiens
gggcttctattcaagtctgttt

SEQ ID NO: 8549119 - DNA, 22 bp, Homo sapiens
gggcttaaggccagtgtgcttt

SEQ ID NO: 8549120 - DNA, 22 bp, Homo sapiens
gggcttcaaaattggcactctt

SEQ ID NO: 8549121 - DNA, 22 bp, Homo sapiens
gggcttcagatccagggacctc

SEQ ID NO: 8549122 - DNA, 22 bp, Homo sapiens
ggggagtgttttcatgggcttg

SEQ ID NO: 8549123 - DNA, 22 bp, Homo sapiens
ggggagtgacgcagggccatag

SEQ ID NO: 8549124 - DNA, 22 bp, Homo sapiens
ggggagtgacgcagggccatag

SEQ ID NO: 8549125 - DNA, 19 bp, Homo sapiens
ggggaggtattgttttcat

SEQ ID NO: 8549126 - DNA, 22 bp, Homo sapiens
ggggcaggaggtgttctctttt

SEQ ID NO: 8549127 - DNA, 22 bp, Homo sapiens
ggggcaggaggtgttctctttt

SEQ ID NO: 8549128 - DNA, 22 bp, Homo sapiens
ggggcaggaggtgttctctttt

SEQ ID NO: 8549129 - DNA, 22 bp, Homo sapiens
ggggcattgtgtctgggttcct

SEQ ID NO: 8549130 - DNA, 22 bp, Homo sapiens
ggggccagagaggacccaggtg

SEQ ID NO: 8549131 - DNA, 22 bp, Homo sapiens
ggggccagagaggacccaggtg

SEQ ID NO: 8549132 - DNA, 22 bp, Homo sapiens
ggggcagggaggttatcgccga

SEQ ID NO: 8549133 - DNA, 20 bp, Homo sapiens
ggggcaggtttttatggcta

SEQ ID NO: 8549134 - DNA, 20 bp, Homo sapiens
ggggcaggtttttatggcta

SEQ ID NO: 8549135 - DNA, 22 bp, Homo sapiens
ggggcattgtgtctgggttcct

SEQ ID NO: 8549136 - DNA, 22 bp, Homo sapiens
ggggaggctgatgtgggcaaag

SEQ ID NO: 8549137 - DNA, 22 bp, Homo sapiens
ggggaggccagtggaccgtccc

SEQ ID NO: 8549138 - DNA, 22 bp, Homo sapiens
ggggaggagtgtacaggtttat

SEQ ID NO: 8549139 - DNA, 22 bp, Homo sapiens
ggggaggagccatgtaactagt

SEQ ID NO: 8549140 - DNA, 22 bp, Homo sapiens
ggggaggagccatgtaactagt

SEQ ID NO: 8549141 - DNA, 22 bp, Homo sapiens
ggggaggacctttccaaggctt

SEQ ID NO: 8549142 - DNA, 22 bp, Homo sapiens
ggggaggacctttccaaggctt

SEQ ID NO: 8549143 - DNA, 22 bp, Homo sapiens
ggggaggaagctggaacacggg

SEQ ID NO: 8549144 - DNA, 22 bp, Homo sapiens
ggggaggaagctggaacacggg

SEQ ID NO: 8549145 - DNA, 22 bp, Homo sapiens
ggggaggaagctggaacacggg

SEQ ID NO: 8549146 - DNA, 22 bp, Homo sapiens
ggggaggaagctggaacacggg

SEQ ID NO: 8549147 - DNA, 22 bp, Homo sapiens
ggggaggaagctggaacacggg

SEQ ID NO: 8549148 - DNA, 22 bp, Homo sapiens
ggggaggaagctggaacacggg

SEQ ID NO: 8549149 - DNA, 22 bp, Homo sapiens
ggggaggaagctctcagttcca

SEQ ID NO: 8549150 - DNA, 22 bp, Homo sapiens
ggggagaattaccaaaagcgct

SEQ ID NO: 8549151 - DNA, 22 bp, Homo sapiens
ggggaggaagctctcagttcca

SEQ ID NO: 8549152 - DNA, 22 bp, Homo sapiens
ggggagaattacatggcgtgga

SEQ ID NO: 8549153 - DNA, 22 bp, Homo sapiens
ggggagaataaatcagatttta

SEQ ID NO: 8549154 - DNA, 22 bp, Homo sapiens
ggggagaattaccaaaagcgct

SEQ ID NO: 8549155 - DNA, 19 bp, Homo sapiens
ggggagaactagagacagc

SEQ ID NO: 8549156 - DNA, 19 bp, Homo sapiens
ggggagaactagagacagc

SEQ ID NO: 8549157 - DNA, 22 bp, Homo sapiens
gtacaaaagttattgcggtttt

SEQ ID NO: 8549158 - DNA, 22 bp, Homo sapiens
gtacaaaagttattgcggtttt

SEQ ID NO: 8549159 - DNA, 22 bp, Homo sapiens
gtacaaaagttattgcggtttt

SEQ ID NO: 8549160 - DNA, 22 bp, Homo sapiens
gtacaaagtggacctgatagta

SEQ ID NO: 8549161 - DNA, 22 bp, Homo sapiens
gtacaaatgaaaatagaccact

SEQ ID NO: 8549162 - DNA, 22 bp, Homo sapiens
gtacaaatgagagttctgtttt

SEQ ID NO: 8549163 - DNA, 22 bp, Homo sapiens
gtacaaatgcaggtttgttaca

SEQ ID NO: 8549164 - DNA, 22 bp, Homo sapiens
gtacaaatgcaggtttgttaca

SEQ ID NO: 8549165 - DNA, 22 bp, Homo sapiens
gtacaaatgtacacttgtataa

SEQ ID NO: 8549166 - DNA, 22 bp, Homo sapiens
gtacaacatgattttactctct

SEQ ID NO: 8549167 - DNA, 22 bp, Homo sapiens
gtacaagaggagaaaatggagt

SEQ ID NO: 8549168 - DNA, 22 bp, Homo sapiens
gtacaataactagtcttatagt

SEQ ID NO: 8549169 - DNA, 22 bp, Homo sapiens
gtacaataactagtcttatagt

SEQ ID NO: 8549170 - DNA, 22 bp, Homo sapiens
gtacaataactagtcttatagt

SEQ ID NO: 8549171 - DNA, 22 bp, Homo sapiens
gtacaagttctactctataaat

SEQ ID NO: 8549172 - DNA, 22 bp, Homo sapiens
gtacaagtgtatttggcttgat

SEQ ID NO: 8549173 - DNA, 22 bp, Homo sapiens
gtacaacaggattgatgtacca

SEQ ID NO: 8549174 - DNA, 22 bp, Homo sapiens
gtacaaattgatacaggttttc

SEQ ID NO: 8549175 - DNA, 22 bp, Homo sapiens
gtacaaattgatacagatttga

SEQ ID NO: 8549176 - DNA, 22 bp, Homo sapiens
gtacaaattgatacagatttga

SEQ ID NO: 8549177 - DNA, 22 bp, Homo sapiens
gtacaaattgatacagatttga

SEQ ID NO: 8549178 - DNA, 22 bp, Homo sapiens
gtagtgcgcatggcctgtttgt

SEQ ID NO: 8549179 - DNA, 22 bp, Homo sapiens
gtagtgctttcatctggagtgt

SEQ ID NO: 8549180 - DNA, 22 bp, Homo sapiens
gtagtggagtctcctgtcctgg

SEQ ID NO: 8549181 - DNA, 22 bp, Homo sapiens
gtagtctgaacagtaattttgt

SEQ ID NO: 8549182 - DNA, 22 bp, Homo sapiens
gtagtcccagctaccccggagg

SEQ ID NO: 8549183 - DNA, 22 bp, Homo sapiens
gtagtattttctgtgatgtagg

SEQ ID NO: 8549184 - DNA, 22 bp, Homo sapiens
gtagtacatgaagcacttggca

SEQ ID NO: 8549185 - DNA, 18 bp, Homo sapiens
gtaggtcagtaccaagca

SEQ ID NO: 8549186 - DNA, 22 bp, Homo sapiens
gtaggtcagacataagaggaca

SEQ ID NO: 8549187 - DNA, 22 bp, Homo sapiens
gtaggtcagacataagaggaca

SEQ ID NO: 8549188 - DNA, 22 bp, Homo sapiens
gtaggtcagacataagaggaca

SEQ ID NO: 8549189 - DNA, 22 bp, Homo sapiens
gtagtaatagtacattagaatg

SEQ ID NO: 8549190 - DNA, 22 bp, Homo sapiens
gtagtaattgttttaagccacc

SEQ ID NO: 8549191 - DNA, 22 bp, Homo sapiens
gtaggcagataggagtgcagcc

SEQ ID NO: 8549192 - DNA, 22 bp, Homo sapiens
gtagggctcagtaaatactttg

SEQ ID NO: 8549193 - DNA, 22 bp, Homo sapiens
gtagggttggagagcacaacca

SEQ ID NO: 8549194 - DNA, 22 bp, Homo sapiens
gtacaatagtccctgtttggat

SEQ ID NO: 8549195 - DNA, 22 bp, Homo sapiens
gtacaatagcagttttcccttt

SEQ ID NO: 8549196 - DNA, 22 bp, Homo sapiens
gtacaatagcagttttcccttt

SEQ ID NO: 8549197 - DNA, 22 bp, Homo sapiens
gtacaattaagtgcacaaatag

SEQ ID NO: 8549198 - DNA, 22 bp, Homo sapiens
gtacaattcctgtcaagctggc

SEQ ID NO: 8549199 - DNA, 23 bp, Homo sapiens
gtaggaattttcacttcctcttg

SEQ ID NO: 8549200 - DNA, 22 bp, Homo sapiens
gtaggagctcatggggccagga

SEQ ID NO: 8549201 - DNA, 22 bp, Homo sapiens
gtcaaaaagtagtcatttctgt

SEQ ID NO: 8549202 - DNA, 22 bp, Homo sapiens
gtcaaaacaaagttaagaattc

SEQ ID NO: 8549203 - DNA, 22 bp, Homo sapiens
gtcaaaaagtagtcatttctgt

SEQ ID NO: 8549204 - DNA, 22 bp, Homo sapiens
gtcaaaaagtagtcatttctgt

SEQ ID NO: 8549205 - DNA, 22 bp, Homo sapiens
gtatttttcattccaagtgaga

SEQ ID NO: 8549206 - DNA, 22 bp, Homo sapiens
gtatttttcattccaagtgaga

SEQ ID NO: 8549207 - DNA, 22 bp, Homo sapiens
gtatttttcagttaggagctta

SEQ ID NO: 8549208 - DNA, 22 bp, Homo sapiens
gtatttttagtagagtcggggt

SEQ ID NO: 8549209 - DNA, 22 bp, Homo sapiens
gtcaaatatactaagaggtaaa

SEQ ID NO: 8549210 - DNA, 22 bp, Homo sapiens
gtcacccactccctgctgctgt

SEQ ID NO: 8549211 - DNA, 22 bp, Homo sapiens
gtcaaaacactggggaatgttg

SEQ ID NO: 8549212 - DNA, 22 bp, Homo sapiens
gtcaaacaaattaacatatcca

SEQ ID NO: 8549213 - DNA, 22 bp, Homo sapiens
gtcaaaacaaagttaagaattc

SEQ ID NO: 8549214 - DNA, 22 bp, Homo sapiens
gtcaaacaaattaacatatcca

SEQ ID NO: 8549215 - DNA, 22 bp, Homo sapiens
gtcaaacaaattaacatatcca

SEQ ID NO: 8549216 - DNA, 22 bp, Homo sapiens
gtcaaacatagggactttgtgg

SEQ ID NO: 8549217 - DNA, 22 bp, Homo sapiens
gtcaaacagcctcctgttctaa

SEQ ID NO: 8549218 - DNA, 22 bp, Homo sapiens
gtcaaacagcctcctgttctaa

SEQ ID NO: 8549219 - DNA, 22 bp, Homo sapiens
gtcaaacagcctcctgttctaa

SEQ ID NO: 8549220 - DNA, 22 bp, Homo sapiens
gtattttatggcatgcagtggc

SEQ ID NO: 8549221 - DNA, 22 bp, Homo sapiens
gtattttatggcatgcagtggc

SEQ ID NO: 8549222 - DNA, 22 bp, Homo sapiens
gtatttcctcgcttgtgggatt

SEQ ID NO: 8549223 - DNA, 22 bp, Homo sapiens
gtatttcctatagtgagggcct

SEQ ID NO: 8549224 - DNA, 22 bp, Homo sapiens
gtatacatagatgatgaacaag

SEQ ID NO: 8549225 - DNA, 22 bp, Homo sapiens
gtatacatacttctagattaaa

SEQ ID NO: 8549226 - DNA, 22 bp, Homo sapiens
gtatacatacttctagattaaa

SEQ ID NO: 8549227 - DNA, 22 bp, Homo sapiens
gtatacatagatgatgaacaag

SEQ ID NO: 8549228 - DNA, 22 bp, Homo sapiens
gtatacatagatgatgaacaag

SEQ ID NO: 8549229 - DNA, 22 bp, Homo sapiens
gtatttccctgagttctgtgag

SEQ ID NO: 8549230 - DNA, 22 bp, Homo sapiens
gtatacatagatgatgaacaag

SEQ ID NO: 8549231 - DNA, 22 bp, Homo sapiens
gtatttcccccagactccctgg

SEQ ID NO: 8549232 - DNA, 22 bp, Homo sapiens
gtattttcaagagcagtagtat

SEQ ID NO: 8549233 - DNA, 22 bp, Homo sapiens
gtattttatggcctggggccta

SEQ ID NO: 8549234 - DNA, 22 bp, Homo sapiens
gtattttatggcctggggccta

SEQ ID NO: 8549235 - DNA, 22 bp, Homo sapiens
gtattttcatgatttcagacca

SEQ ID NO: 8549236 - DNA, 22 bp, Homo sapiens
gtattttcatgatttcagacca

SEQ ID NO: 8549237 - DNA, 22 bp, Homo sapiens
gtattttcaagagcagtagtat

SEQ ID NO: 8549238 - DNA, 22 bp, Homo sapiens
gtattttcaagagcagtagtat

SEQ ID NO: 8549239 - DNA, 22 bp, Homo sapiens
gtatttttaggtaaggaaagta

SEQ ID NO: 8549240 - DNA, 22 bp, Homo sapiens
gtattttcatgatttcagacca

SEQ ID NO: 8549241 - DNA, 22 bp, Homo sapiens
gtatacaatacacaatgctctg

SEQ ID NO: 8549242 - DNA, 22 bp, Homo sapiens
gtatacaatacacaatgctctg

SEQ ID NO: 8549243 - DNA, 22 bp, Homo sapiens
gtatacaactattgttgggtaa

SEQ ID NO: 8549244 - DNA, 22 bp, Homo sapiens
gtatacagatacttagacgtgc

SEQ ID NO: 8549245 - DNA, 22 bp, Homo sapiens
gtataaagtataagcttgtttt

SEQ ID NO: 8549246 - DNA, 20 bp, Homo sapiens
gtataagatttcacacatta

SEQ ID NO: 8549247 - DNA, 22 bp, Homo sapiens
gtagtgggtgaggaaggaagga

SEQ ID NO: 8549248 - DNA, 22 bp, Homo sapiens
gtagtgtgtaggcactgtgctc

SEQ ID NO: 8549249 - DNA, 22 bp, Homo sapiens
gtagttagagttgtgctggaga

SEQ ID NO: 8549250 - DNA, 22 bp, Homo sapiens
gtagttagttaagatgagttta

SEQ ID NO: 8549251 - DNA, 22 bp, Homo sapiens
gtagtgtgtaggcactgtgctc

SEQ ID NO: 8549252 - DNA, 22 bp, Homo sapiens
gtataaacatggagtgcattct

SEQ ID NO: 8549253 - DNA, 22 bp, Homo sapiens
gtccagctgatcttgacccagc

SEQ ID NO: 8549254 - DNA, 22 bp, Homo sapiens
gtccagcccctgactcccaggc

SEQ ID NO: 8549255 - DNA, 22 bp, Homo sapiens
gtcagaggaatggatgagtgat

SEQ ID NO: 8549256 - DNA, 20 bp, Homo sapiens
gtcagaggaccctagagcga

SEQ ID NO: 8549257 - DNA, 20 bp, Homo sapiens
gtcagaggaccctagagcga

SEQ ID NO: 8549258 - DNA, 22 bp, Homo sapiens
gtcagagagggcacgtgcacac

SEQ ID NO: 8549259 - DNA, 22 bp, Homo sapiens
gtccagaaggaggtcaagttgg

SEQ ID NO: 8549260 - DNA, 22 bp, Homo sapiens
gtcagaggaggctgagtaggaa

SEQ ID NO: 8549261 - DNA, 22 bp, Homo sapiens
gtcagaggaggctgagtaggaa

SEQ ID NO: 8549262 - DNA, 22 bp, Homo sapiens
gtccagagaagggaggggactc

SEQ ID NO: 8549263 - DNA, 22 bp, Homo sapiens
gtccagagagatcttctgatag

SEQ ID NO: 8549264 - DNA, 22 bp, Homo sapiens
gtcagacacatttctttcagtg

SEQ ID NO: 8549265 - DNA, 22 bp, Homo sapiens
gtcagacacatttctttcagtg

SEQ ID NO: 8549266 - DNA, 22 bp, Homo sapiens
gtcagactgcactcaaggacag

SEQ ID NO: 8549267 - DNA, 22 bp, Homo sapiens
gtcagaagcatttgtggctgaa

SEQ ID NO: 8549268 - DNA, 22 bp, Homo sapiens
gtcagaaaccagtcaaacaaga

SEQ ID NO: 8549269 - DNA, 22 bp, Homo sapiens
gtcagaaaccagtcaaacaaga

SEQ ID NO: 8549270 - DNA, 22 bp, Homo sapiens
gtcagaaaccagtcaaacaaga

SEQ ID NO: 8549271 - DNA, 22 bp, Homo sapiens
gtcagaaaacttccctttgagt

SEQ ID NO: 8549272 - DNA, 22 bp, Homo sapiens
gtcagaaaaagcaaggctgggc

SEQ ID NO: 8549273 - DNA, 22 bp, Homo sapiens
gtcactgtttcctattatattt

SEQ ID NO: 8549274 - DNA, 18 bp, Homo sapiens
gtcactgtgtttctgagc

SEQ ID NO: 8549275 - DNA, 22 bp, Homo sapiens
gtcactttgaagctgtttttag

SEQ ID NO: 8549276 - DNA, 22 bp, Homo sapiens
gtcactttattaattttggtga

SEQ ID NO: 8549277 - DNA, 22 bp, Homo sapiens
gtcactttattaattttggtga

SEQ ID NO: 8549278 - DNA, 22 bp, Homo sapiens
gtcactttcacactttattgct

SEQ ID NO: 8549279 - DNA, 22 bp, Homo sapiens
gtcacctcgctgtcttcctgag

SEQ ID NO: 8549280 - DNA, 22 bp, Homo sapiens
gtcaccctgctgtttgtccatt

SEQ ID NO: 8549281 - DNA, 22 bp, Homo sapiens
gtcaccctgctggctgttcagc

SEQ ID NO: 8549282 - DNA, 22 bp, Homo sapiens
gtcaccttgaacaggctactca

SEQ ID NO: 8549283 - DNA, 18 bp, Homo sapiens
gtcacctggatcagatta

SEQ ID NO: 8549284 - DNA, 22 bp, Homo sapiens
gtcactcaggctggagttcagt

SEQ ID NO: 8549285 - DNA, 22 bp, Homo sapiens
gtcactggggccacatgcagaa

SEQ ID NO: 8549286 - DNA, 22 bp, Homo sapiens
gtcactggggccacatgcagaa

SEQ ID NO: 8549287 - DNA, 22 bp, Homo sapiens
gtcactggggccacatgcagaa

SEQ ID NO: 8549288 - DNA, 22 bp, Homo sapiens
gtcactggaattacaggcatgc

SEQ ID NO: 8549289 - DNA, 22 bp, Homo sapiens
gtcactggaattacaggcatgc

SEQ ID NO: 8549290 - DNA, 22 bp, Homo sapiens
gtcactgcctcttaactttttc

SEQ ID NO: 8549291 - DNA, 22 bp, Homo sapiens
gtcactgtatccaggttccagc

SEQ ID NO: 8549292 - DNA, 22 bp, Homo sapiens
gtcactgtatccaggttccagc

SEQ ID NO: 8549293 - DNA, 22 bp, Homo sapiens
gtccaggccatggtggacacag

SEQ ID NO: 8549294 - DNA, 20 bp, Homo sapiens
gtccaggacccagcaggagg

SEQ ID NO: 8549295 - DNA, 22 bp, Homo sapiens
gtccaggaatcaaaagatggaa

SEQ ID NO: 8549296 - DNA, 22 bp, Homo sapiens
gtcctctggcctttcccaggac

SEQ ID NO: 8549297 - DNA, 22 bp, Homo sapiens
gtcctctggcctttcccaggac

SEQ ID NO: 8549298 - DNA, 22 bp, Homo sapiens
gtcctctggcctttcccaggac

SEQ ID NO: 8549299 - DNA, 23 bp, Homo sapiens
gtcctctggagagaaaggcagta

SEQ ID NO: 8549300 - DNA, 22 bp, Homo sapiens
gtcctctggaggtttttaggtg

SEQ ID NO: 8549301 - DNA, 22 bp, Homo sapiens
gtcctctgggcagctgccccac

SEQ ID NO: 8549302 - DNA, 22 bp, Homo sapiens
gtcctctgggcagctgccccac

SEQ ID NO: 8549303 - DNA, 22 bp, Homo sapiens
gtcctctgggagccttgagcct

SEQ ID NO: 8549304 - DNA, 22 bp, Homo sapiens
gtcctctgggagccttgagcct

SEQ ID NO: 8549305 - DNA, 22 bp, Homo sapiens
gtcctctgggagccttgagcct

SEQ ID NO: 8549306 - DNA, 22 bp, Homo sapiens
gtcctctgggagccttgagcct

SEQ ID NO: 8549307 - DNA, 22 bp, Homo sapiens
gtcctctgcttcatgccctgat

SEQ ID NO: 8549308 - DNA, 22 bp, Homo sapiens
gtcctctgcttcatgccctgat

SEQ ID NO: 8549309 - DNA, 22 bp, Homo sapiens
gtcctctggaagatgagttctt

SEQ ID NO: 8549310 - DNA, 22 bp, Homo sapiens
gtcctctggaagatgagttctt

SEQ ID NO: 8549311 - DNA, 22 bp, Homo sapiens
gtcctctggaagatgagttctt

SEQ ID NO: 8549312 - DNA, 22 bp, Homo sapiens
gtccaggctgacccctagagga

SEQ ID NO: 8549313 - DNA, 22 bp, Homo sapiens
gtccaggctgacccctagagga

SEQ ID NO: 8549314 - DNA, 22 bp, Homo sapiens
gtcctggattgaacataggcag

SEQ ID NO: 8549315 - DNA, 22 bp, Homo sapiens
gtcctggagtggcatggcatgg

SEQ ID NO: 8549316 - DNA, 22 bp, Homo sapiens
gtcctggagtggcatggcatgg

SEQ ID NO: 8549317 - DNA, 22 bp, Homo sapiens
gtcctggaatcctagaacagtg

SEQ ID NO: 8549318 - DNA, 22 bp, Homo sapiens
gtcctggaatcctagaacagtg

SEQ ID NO: 8549319 - DNA, 22 bp, Homo sapiens
gtcctctgtgtaggctgcagac

SEQ ID NO: 8549320 - DNA, 22 bp, Homo sapiens
gtcctctgtagggctgggccac

SEQ ID NO: 8549321 - DNA, 22 bp, Homo sapiens
gtcctctgtagggctgggccac

SEQ ID NO: 8549322 - DNA, 22 bp, Homo sapiens
gtcctctgtccctggggcacgg

SEQ ID NO: 8549323 - DNA, 22 bp, Homo sapiens
gtcctctgtccctggggcacgg

SEQ ID NO: 8549324 - DNA, 22 bp, Homo sapiens
gtcctctggtgaaagcattccc

SEQ ID NO: 8549325 - DNA, 22 bp, Homo sapiens
gtcctctggtgaaagcattccc

SEQ ID NO: 8549326 - DNA, 22 bp, Homo sapiens
gtcctctggtgaaagcattccc

SEQ ID NO: 8549327 - DNA, 22 bp, Homo sapiens
gtcctctgggctttgagcagtc

SEQ ID NO: 8549328 - DNA, 22 bp, Homo sapiens
gtcctctgggctttgagcagtc

SEQ ID NO: 8549329 - DNA, 22 bp, Homo sapiens
gtcctggattgaacataggcag

SEQ ID NO: 8549330 - DNA, 22 bp, Homo sapiens
gtcctggattgaacataggcag

SEQ ID NO: 8549331 - DNA, 22 bp, Homo sapiens
gtcctggcttagttcgctgtaa

SEQ ID NO: 8549332 - DNA, 22 bp, Homo sapiens
gtcctgggaactggacagctaa

SEQ ID NO: 8549333 - DNA, 22 bp, Homo sapiens
gtcgtggagctcacagtgtgcc

SEQ ID NO: 8549334 - DNA, 22 bp, Homo sapiens
gtctaaacaaaaatgcaccttt

SEQ ID NO: 8549335 - DNA, 22 bp, Homo sapiens
gtgagctgggtgaatggtaggg

SEQ ID NO: 8549336 - DNA, 22 bp, Homo sapiens
gtgagctggaatagtggagaaa

SEQ ID NO: 8549337 - DNA, 22 bp, Homo sapiens
gtgagctggaatagtggagaaa

SEQ ID NO: 8549338 - DNA, 22 bp, Homo sapiens
gtgagctgggtgaatggtaggg

SEQ ID NO: 8549339 - DNA, 22 bp, Homo sapiens
gtgagctgttggagtggcagag

SEQ ID NO: 8549340 - DNA, 22 bp, Homo sapiens
gtgagccattctactcctaacc

SEQ ID NO: 8549341 - DNA, 22 bp, Homo sapiens
gtgagctggaatagtggagaaa

SEQ ID NO: 8549342 - DNA, 22 bp, Homo sapiens
gtgagcgtggtcttctgtgggt

SEQ ID NO: 8549343 - DNA, 22 bp, Homo sapiens
gtgagcagtggccagggtccta

SEQ ID NO: 8549344 - DNA, 22 bp, Homo sapiens
gtgagcagttgtataaagactt

SEQ ID NO: 8549345 - DNA, 22 bp, Homo sapiens
gtgagccagttcgactgtttct

SEQ ID NO: 8549346 - DNA, 19 bp, Homo sapiens
gtgagcttcttgtaagagg

SEQ ID NO: 8549347 - DNA, 22 bp, Homo sapiens
gtgagctttgtggtaatgaagt

SEQ ID NO: 8549348 - DNA, 22 bp, Homo sapiens
gtgagctgttttggacccatct

SEQ ID NO: 8549349 - DNA, 22 bp, Homo sapiens
gtgagctgttttggacccatct

SEQ ID NO: 8549350 - DNA, 22 bp, Homo sapiens
gtgagctgttggagtggcagag

SEQ ID NO: 8549351 - DNA, 22 bp, Homo sapiens
gtgaggaagtctgagagccaca

SEQ ID NO: 8549352 - DNA, 22 bp, Homo sapiens
gtgaggactggtaaggactgca

SEQ ID NO: 8549353 - DNA, 22 bp, Homo sapiens
gtgaggagctctttgactcacg

SEQ ID NO: 8549354 - DNA, 22 bp, Homo sapiens
gtgaggagctgacactggggtg

SEQ ID NO: 8549355 - DNA, 22 bp, Homo sapiens
gtgaggagctgacactggggtg

SEQ ID NO: 8549356 - DNA, 22 bp, Homo sapiens
gtgaggagtctgaagcacataa

SEQ ID NO: 8549357 - DNA, 22 bp, Homo sapiens
gtgaggagggctggtcccaggc

SEQ ID NO: 8549358 - DNA, 22 bp, Homo sapiens
gtgaaaaatgatttgttaactg

SEQ ID NO: 8549359 - DNA, 22 bp, Homo sapiens
gtgaaaaatgatttgttaactg

SEQ ID NO: 8549360 - DNA, 22 bp, Homo sapiens
gtgaaaaatcatcatgacttga

SEQ ID NO: 8549361 - DNA, 22 bp, Homo sapiens
gtgaaaaatcatcatgacttga

SEQ ID NO: 8549362 - DNA, 22 bp, Homo sapiens
gtgaaaaatcatcatgacttga

SEQ ID NO: 8549363 - DNA, 22 bp, Homo sapiens
gtcttttttacaccttacatca

SEQ ID NO: 8549364 - DNA, 22 bp, Homo sapiens
gtcttttttacaccttacatca

SEQ ID NO: 8549365 - DNA, 22 bp, Homo sapiens
gtcttttttacaccttacatca

SEQ ID NO: 8549366 - DNA, 22 bp, Homo sapiens
gtctttttgtctggcagaggtc

SEQ ID NO: 8549367 - DNA, 22 bp, Homo sapiens
gtctttttctacgatagcgcct

SEQ ID NO: 8549368 - DNA, 22 bp, Homo sapiens
gtctttttattatagagtggag

SEQ ID NO: 8549369 - DNA, 22 bp, Homo sapiens
gtctttatttgagattgtcatt

SEQ ID NO: 8549370 - DNA, 22 bp, Homo sapiens
gtctttctatgatgaactgttg

SEQ ID NO: 8549371 - DNA, 21 bp, Homo sapiens
gtctttctacctctatgtggc

SEQ ID NO: 8549372 - DNA, 22 bp, Homo sapiens
gtctttctatgcatagagcaga

SEQ ID NO: 8549373 - DNA, 22 bp, Homo sapiens
gtctttctatgcatagagcaga

SEQ ID NO: 8549374 - DNA, 21 bp, Homo sapiens
gtcttttaagtgaagagaggc

SEQ ID NO: 8549375 - DNA, 21 bp, Homo sapiens
gtctttttaattgcgatttcc

SEQ ID NO: 8549376 - DNA, 18 bp, Homo sapiens
gtcttttctcccttcctc

SEQ ID NO: 8549377 - DNA, 22 bp, Homo sapiens
gtcttttgctagccagagagct

SEQ ID NO: 8549378 - DNA, 22 bp, Homo sapiens
gtctagaatatctagaaagatc

SEQ ID NO: 8549379 - DNA, 22 bp, Homo sapiens
gtctagaaatgccatacgtgcc

SEQ ID NO: 8549380 - DNA, 22 bp, Homo sapiens
gtctactttttaatcttggcag

SEQ ID NO: 8549381 - DNA, 22 bp, Homo sapiens
gtctacactgaatttccacaga

SEQ ID NO: 8549382 - DNA, 22 bp, Homo sapiens
gtctacttttgtcatcattgca

SEQ ID NO: 8549383 - DNA, 22 bp, Homo sapiens
gtctacaaagcttcaagtctct

SEQ ID NO: 8549384 - DNA, 20 bp, Homo sapiens
gtctacacgggcagtgtaga

SEQ ID NO: 8549385 - DNA, 22 bp, Homo sapiens
gtctaaagcccttagaatagta

SEQ ID NO: 8549386 - DNA, 22 bp, Homo sapiens
gtctaaacttagggatcgaaca

SEQ ID NO: 8549387 - DNA, 22 bp, Homo sapiens
gtctaaacctcaaatcagtgtc

SEQ ID NO: 8549388 - DNA, 22 bp, Homo sapiens
gtctaaactttggcccagattt

SEQ ID NO: 8549389 - DNA, 22 bp, Homo sapiens
gtctaaactttacagagtcaag

SEQ ID NO: 8549390 - DNA, 22 bp, Homo sapiens
gtctataagcaggggaaaactt

SEQ ID NO: 8549391 - DNA, 22 bp, Homo sapiens
gtctatgatattttgttatagc

SEQ ID NO: 8549392 - DNA, 22 bp, Homo sapiens
gtctatgatattttgttatagc

SEQ ID NO: 8549393 - DNA, 22 bp, Homo sapiens
gtctatgtaaacgtctacatta

SEQ ID NO: 8549394 - DNA, 22 bp, Homo sapiens
gtctatgatattttgttatagc

SEQ ID NO: 8549395 - DNA, 22 bp, Homo sapiens
gtctccagccattctctgatca

SEQ ID NO: 8549396 - DNA, 22 bp, Homo sapiens
gtctccagatatcctacacaac

SEQ ID NO: 8549397 - DNA, 22 bp, Homo sapiens
gtctccagcccactctagatat

SEQ ID NO: 8549398 - DNA, 22 bp, Homo sapiens
gtctccagatatcctacacaac

SEQ ID NO: 8549399 - DNA, 22 bp, Homo sapiens
gtctccagaggttacatcctgt

SEQ ID NO: 8549400 - DNA, 22 bp, Homo sapiens
gtctccagaggttacatcctgt

SEQ ID NO: 8549401 - DNA, 22 bp, Homo sapiens
gtctccagaggttacatcctgt

SEQ ID NO: 8549402 - DNA, 22 bp, Homo sapiens
gtctatttgggatcatgatatg

SEQ ID NO: 8549403 - DNA, 22 bp, Homo sapiens
gtcttgatctcctgaccttgtg

SEQ ID NO: 8549404 - DNA, 22 bp, Homo sapiens
gtcttgcacttacctaagaact

SEQ ID NO: 8549405 - DNA, 19 bp, Homo sapiens
gtcttggctctcaaccatc

SEQ ID NO: 8549406 - DNA, 22 bp, Homo sapiens
gtctcccaaactctgatggtcc

SEQ ID NO: 8549407 - DNA, 22 bp, Homo sapiens
gtctccagtgttcaggtgactg

SEQ ID NO: 8549408 - DNA, 22 bp, Homo sapiens
gtctccagtgttcaggtgactg

SEQ ID NO: 8549409 - DNA, 22 bp, Homo sapiens
gtctccagttacagcagccagg

SEQ ID NO: 8549410 - DNA, 22 bp, Homo sapiens
gtctccagggacacactagccg

SEQ ID NO: 8549411 - DNA, 22 bp, Homo sapiens
gtctccagggctgctggcgcct

SEQ ID NO: 8549412 - DNA, 22 bp, Homo sapiens
gtcttgtccattccatgctgct

SEQ ID NO: 8549413 - DNA, 22 bp, Homo sapiens
gtcttgtcagtgttggcagctt

SEQ ID NO: 8549414 - DNA, 22 bp, Homo sapiens
gtcttgtttgggatgtggatgg

SEQ ID NO: 8549415 - DNA, 22 bp, Homo sapiens
gtctttagagctcctggcatct

SEQ ID NO: 8549416 - DNA, 22 bp, Homo sapiens
gtctttagttgaaacatgtggt

SEQ ID NO: 8549417 - DNA, 23 bp, Homo sapiens
gtctttatagtggggcactttgt

SEQ ID NO: 8549418 - DNA, 22 bp, Homo sapiens
gtctttatatttactaaagaat

SEQ ID NO: 8549419 - DNA, 20 bp, Homo sapiens
gtctttatgttttatgacct

SEQ ID NO: 8549420 - DNA, 22 bp, Homo sapiens
gtctttatggtatgaaaactga

SEQ ID NO: 8549421 - DNA, 22 bp, Homo sapiens
gtgcagcaaagtttgagatata

SEQ ID NO: 8549422 - DNA, 22 bp, Homo sapiens
gtgcagcaaagtttgagatata

SEQ ID NO: 8549423 - DNA, 22 bp, Homo sapiens
gtgcagcaaagtttgagatata

SEQ ID NO: 8549424 - DNA, 22 bp, Homo sapiens
gtgcagcaaactagtgcgaggg

SEQ ID NO: 8549425 - DNA, 22 bp, Homo sapiens
gtgcagcaaactagtgcgaggg

SEQ ID NO: 8549426 - DNA, 22 bp, Homo sapiens
gtgaggcagcaggagcctctgt

SEQ ID NO: 8549427 - DNA, 22 bp, Homo sapiens
gtgaggattgctctggagaatt

SEQ ID NO: 8549428 - DNA, 22 bp, Homo sapiens
gtgaggagtctgaagcacataa

SEQ ID NO: 8549429 - DNA, 19 bp, Homo sapiens
gtgaggatactgctcagag

SEQ ID NO: 8549430 - DNA, 22 bp, Homo sapiens
gtgaggatcaaatgaaatagca

SEQ ID NO: 8549431 - DNA, 22 bp, Homo sapiens
gtgcagggagcccagaaggtcc

SEQ ID NO: 8549432 - DNA, 22 bp, Homo sapiens
gtgcagggagcccagaaggtcc

SEQ ID NO: 8549433 - DNA, 22 bp, Homo sapiens
gtgcagggagcccagaaggtcc

SEQ ID NO: 8549434 - DNA, 22 bp, Homo sapiens
gtgcagggagcccagaaggtcc

SEQ ID NO: 8549435 - DNA, 22 bp, Homo sapiens
gtgcagggagcccagaaggtcc

SEQ ID NO: 8549436 - DNA, 22 bp, Homo sapiens
gtgcaggagtaggagagggctt

SEQ ID NO: 8549437 - DNA, 20 bp, Homo sapiens
gtgcagcacttgggggtagg

SEQ ID NO: 8549438 - DNA, 22 bp, Homo sapiens
gtgcaggatgttgggaatcagg

SEQ ID NO: 8549439 - DNA, 22 bp, Homo sapiens
gtgcaggatctcagaacaagtg

SEQ ID NO: 8549440 - DNA, 22 bp, Homo sapiens
gtgccagagatgacaggcctgc

SEQ ID NO: 8549441 - DNA, 22 bp, Homo sapiens
gtgccagagcaatcaggctctg

SEQ ID NO: 8549442 - DNA, 22 bp, Homo sapiens
gtgccagcagttatggtgattt

SEQ ID NO: 8549443 - DNA, 22 bp, Homo sapiens
gtgccagccgcaccccaggaga

SEQ ID NO: 8549444 - DNA, 22 bp, Homo sapiens
gtgcaggggatcaggttgcagc

SEQ ID NO: 8549445 - DNA, 22 bp, Homo sapiens
gtgcaggggatcaggttgcagc

SEQ ID NO: 8549446 - DNA, 22 bp, Homo sapiens
gtgcaggggatcaggttgcagc

SEQ ID NO: 8549447 - DNA, 22 bp, Homo sapiens
gtgcaggggcctccccttgctg

SEQ ID NO: 8549448 - DNA, 22 bp, Homo sapiens
gtgcagggtagcgacggcagga

SEQ ID NO: 8549449 - DNA, 22 bp, Homo sapiens
gtgccaccttcaaatcacattg

SEQ ID NO: 8549450 - DNA, 17 bp, Homo sapiens
gtgcagggatgaaggat

SEQ ID NO: 8549451 - DNA, 17 bp, Homo sapiens
gtgcagggatgaaggat

SEQ ID NO: 8549452 - DNA, 17 bp, Homo sapiens
gtgcagggatgaaggat

SEQ ID NO: 8549453 - DNA, 22 bp, Homo sapiens
gtgcagggcagccgaatgggct

SEQ ID NO: 8549454 - DNA, 22 bp, Homo sapiens
gtgcagggcagccgaatgggct

SEQ ID NO: 8549455 - DNA, 22 bp, Homo sapiens
gtgcagggcagccgaatgggct

SEQ ID NO: 8549456 - DNA, 22 bp, Homo sapiens
gtgcagggcaggtgtccttcca

SEQ ID NO: 8549457 - DNA, 22 bp, Homo sapiens
gtgcagggctggcaccggaggc

SEQ ID NO: 8549458 - DNA, 22 bp, Homo sapiens
gtgcagggctggcaccggaggc

SEQ ID NO: 8549459 - DNA, 22 bp, Homo sapiens
gtgctgacaggagcctggcggt

SEQ ID NO: 8549460 - DNA, 22 bp, Homo sapiens
gtgctgacaggagcctggcggt

SEQ ID NO: 8549461 - DNA, 22 bp, Homo sapiens
gtgctgaattgtgctctttaca

SEQ ID NO: 8549462 - DNA, 22 bp, Homo sapiens
gtgcccaggcccaaggcaccac

SEQ ID NO: 8549463 - DNA, 18 bp, Homo sapiens
gtgctgaataactacttt

SEQ ID NO: 8549464 - DNA, 22 bp, Homo sapiens
gtgctgagtgcagagtgcagag

SEQ ID NO: 8549465 - DNA, 22 bp, Homo sapiens
gtgctgagtgcagagtgcagag

SEQ ID NO: 8549466 - DNA, 22 bp, Homo sapiens
gtgctgagaacaaaagtggaca

SEQ ID NO: 8549467 - DNA, 22 bp, Homo sapiens
gtgctgagaacaaaagtggaca

SEQ ID NO: 8549468 - DNA, 22 bp, Homo sapiens
gtgctgcagagtctcgtgccgc

SEQ ID NO: 8549469 - DNA, 22 bp, Homo sapiens
gtgctgattgggagctgggatt

SEQ ID NO: 8549470 - DNA, 22 bp, Homo sapiens
gtgctgctcacatctggaggta

SEQ ID NO: 8549471 - DNA, 22 bp, Homo sapiens
gtgctgctgccagcaggatcct

SEQ ID NO: 8549472 - DNA, 22 bp, Homo sapiens
gtgctgcctgccagcttctggg

SEQ ID NO: 8549473 - DNA, 22 bp, Homo sapiens
gtgctgcctgccagcttctggg

SEQ ID NO: 8549474 - DNA, 21 bp, Homo sapiens
gtgctgctagcgggacgggag

SEQ ID NO: 8549475 - DNA, 22 bp, Homo sapiens
gtgctgctcaagggacaggaca

SEQ ID NO: 8549476 - DNA, 22 bp, Homo sapiens
gtgctgcctccatatccgtcag

SEQ ID NO: 8549477 - DNA, 22 bp, Homo sapiens
gtgctgcctgccagcttctggg

SEQ ID NO: 8549478 - DNA, 22 bp, Homo sapiens
gtgctgccggcatagcagtgaa

SEQ ID NO: 8549479 - DNA, 22 bp, Homo sapiens
gtgctggccctgtcctcgagct

SEQ ID NO: 8549480 - DNA, 22 bp, Homo sapiens
gtgctgcttgggggcagagcag

SEQ ID NO: 8549481 - DNA, 22 bp, Homo sapiens
gtgccagcctggtgcgcctggg

SEQ ID NO: 8549482 - DNA, 22 bp, Homo sapiens
gtgccagctctccccacatctg

SEQ ID NO: 8549483 - DNA, 22 bp, Homo sapiens
gtgccagctctccccacatctg

SEQ ID NO: 8549484 - DNA, 18 bp, Homo sapiens
gtgccaggaggcgcagcc

SEQ ID NO: 8549485 - DNA, 18 bp, Homo sapiens
gtgccaggaggcgcagcc

SEQ ID NO: 8549486 - DNA, 22 bp, Homo sapiens
gtgccagggagtggaggagctt

SEQ ID NO: 8549487 - DNA, 20 bp, Homo sapiens
gtgccaggcaagacaggtgg

SEQ ID NO: 8549488 - DNA, 22 bp, Homo sapiens
gtgccaggcccagggagcgggg

SEQ ID NO: 8549489 - DNA, 22 bp, Homo sapiens
gtgcccagctccacctcacaga

SEQ ID NO: 8549490 - DNA, 22 bp, Homo sapiens
gtgcccacgaggccaggctggt

SEQ ID NO: 8549491 - DNA, 22 bp, Homo sapiens
gtgcccacgaggccaggctggt

SEQ ID NO: 8549492 - DNA, 22 bp, Homo sapiens
gtgccaggtgctaagctgtgct

SEQ ID NO: 8549493 - DNA, 22 bp, Homo sapiens
gtgccaggtgctaagctgtgct

SEQ ID NO: 8549494 - DNA, 22 bp, Homo sapiens
gtgccatcattcaataaattca

SEQ ID NO: 8549495 - DNA, 22 bp, Homo sapiens
gtgccaggtgctaagctgtgct

SEQ ID NO: 8549496 - DNA, 22 bp, Homo sapiens
gtgccagggggcactgaacaga

SEQ ID NO: 8549497 - DNA, 21 bp, Homo sapiens
ggctgtggagccatgactcac

SEQ ID NO: 8549498 - DNA, 22 bp, Homo sapiens
ggctgtggcagctggaagtggt

SEQ ID NO: 8549499 - DNA, 22 bp, Homo sapiens
ggctgtggcagctggaagtggt

SEQ ID NO: 8549500 - DNA, 22 bp, Homo sapiens
ggctgtggcagctggaagtggt

SEQ ID NO: 8549501 - DNA, 22 bp, Homo sapiens
ggctgtggcagctggaagtggt

SEQ ID NO: 8549502 - DNA, 22 bp, Homo sapiens
ggctgtggcagctggaagtggt

SEQ ID NO: 8549503 - DNA, 22 bp, Homo sapiens
ggctgtggcattaggtgaggcc

SEQ ID NO: 8549504 - DNA, 22 bp, Homo sapiens
ggctggccagggccctcgctgg

SEQ ID NO: 8549505 - DNA, 18 bp, Homo sapiens
ggctgtgcgtggaggctg

SEQ ID NO: 8549506 - DNA, 22 bp, Homo sapiens
ggctgtggggaccaacaggact

SEQ ID NO: 8549507 - DNA, 22 bp, Homo sapiens
ggctgtggggccgggtacagtg

SEQ ID NO: 8549508 - DNA, 22 bp, Homo sapiens
gggaagagggagctggaatgat

SEQ ID NO: 8549509 - DNA, 22 bp, Homo sapiens
gggaagagggagctggaatgat

SEQ ID NO: 8549510 - DNA, 18 bp, Homo sapiens
gggaagaggatctggccc

SEQ ID NO: 8549511 - DNA, 22 bp, Homo sapiens
gggaagagggagctggaatgat

SEQ ID NO: 8549512 - DNA, 22 bp, Homo sapiens
ggctgtgggtgtgacaggcctc

SEQ ID NO: 8549513 - DNA, 22 bp, Homo sapiens
ggctgtgggtgtgacaggcctc

SEQ ID NO: 8549514 - DNA, 22 bp, Homo sapiens
gggaaggcaccatggtgttcca

SEQ ID NO: 8549515 - DNA, 22 bp, Homo sapiens
gggaagcatctgagggtccact

SEQ ID NO: 8549516 - DNA, 22 bp, Homo sapiens
gggaagcatctgagggtccact

SEQ ID NO: 8549517 - DNA, 22 bp, Homo sapiens
gggaaggcagtgtctggttgaa

SEQ ID NO: 8549518 - DNA, 22 bp, Homo sapiens
gggaaggcagtgggaggaactg

SEQ ID NO: 8549519 - DNA, 22 bp, Homo sapiens
gggaaggcaggattctctggtg

SEQ ID NO: 8549520 - DNA, 22 bp, Homo sapiens
gggaaggcagtgtctggttgaa

SEQ ID NO: 8549521 - DNA, 22 bp, Homo sapiens
gggaagcagacggcggggaaat

SEQ ID NO: 8549522 - DNA, 22 bp, Homo sapiens
gggaagatagtgttgagggccc

SEQ ID NO: 8549523 - DNA, 22 bp, Homo sapiens
gggaagatagtgttgagggccc

SEQ ID NO: 8549524 - DNA, 22 bp, Homo sapiens
gggaagatagtgttgagggccc

SEQ ID NO: 8549525 - DNA, 22 bp, Homo sapiens
gggaagatagtgttgagggccc

SEQ ID NO: 8549526 - DNA, 22 bp, Homo sapiens
gggaagagtaactagcccatgt

SEQ ID NO: 8549527 - DNA, 22 bp, Homo sapiens
gggaagagtaactagcccatgt

SEQ ID NO: 8549528 - DNA, 22 bp, Homo sapiens
gggaagagggagctggaatgat

SEQ ID NO: 8549529 - DNA, 22 bp, Homo sapiens
gggaaggccggtccagtcaggt

SEQ ID NO: 8549530 - DNA, 22 bp, Homo sapiens
gggaaggcatacctgagggaga

SEQ ID NO: 8549531 - DNA, 22 bp, Homo sapiens
gggagatgactcagtgacctcg

SEQ ID NO: 8549532 - DNA, 22 bp, Homo sapiens
gggagatggctcagaggccgcg

SEQ ID NO: 8549533 - DNA, 22 bp, Homo sapiens
gggagatgactcagtgacctcg

SEQ ID NO: 8549534 - DNA, 22 bp, Homo sapiens
gggagccacagtgaggtgcatg

SEQ ID NO: 8549535 - DNA, 22 bp, Homo sapiens
gggagccacagtttatagtgat

SEQ ID NO: 8549536 - DNA, 22 bp, Homo sapiens
gggagccacagtgaggtgcatg

SEQ ID NO: 8549537 - DNA, 23 bp, Homo sapiens
gggagatgggaaatgaaggctct

SEQ ID NO: 8549538 - DNA, 22 bp, Homo sapiens
gggagccagcagggcatggagc

SEQ ID NO: 8549539 - DNA, 22 bp, Homo sapiens
gggagccatgctggtcttcttt

SEQ ID NO: 8549540 - DNA, 22 bp, Homo sapiens
gggagccatgctggtcttcttt

SEQ ID NO: 8549541 - DNA, 23 bp, Homo sapiens
gggagccatgggtggtcatggag

SEQ ID NO: 8549542 - DNA, 23 bp, Homo sapiens
gggagccatgggtggtcatggag

SEQ ID NO: 8549543 - DNA, 23 bp, Homo sapiens
gggagccaggacctcgcgcccca

SEQ ID NO: 8549544 - DNA, 17 bp, Homo sapiens
ggctgcagtccaggagg

SEQ ID NO: 8549545 - DNA, 17 bp, Homo sapiens
ggctgcagtccaggagg

SEQ ID NO: 8549546 - DNA, 17 bp, Homo sapiens
ggctgcagtccaggagg

SEQ ID NO: 8549547 - DNA, 22 bp, Homo sapiens
ggctgcagggcagctggtgtgg

SEQ ID NO: 8549548 - DNA, 22 bp, Homo sapiens
ggctgcagggcagctggtgtgg

SEQ ID NO: 8549549 - DNA, 22 bp, Homo sapiens
ggctgcaggttggttggcagct

SEQ ID NO: 8549550 - DNA, 22 bp, Homo sapiens
ggctgcaggttggttggcagct

SEQ ID NO: 8549551 - DNA, 22 bp, Homo sapiens
ggctgcaggttggttggcagct

SEQ ID NO: 8549552 - DNA, 22 bp, Homo sapiens
ggctctgcgcggtaaagtgact

SEQ ID NO: 8549553 - DNA, 22 bp, Homo sapiens
ggctgcaggcagggtatccact

SEQ ID NO: 8549554 - DNA, 22 bp, Homo sapiens
ggctgcaggcagggtatccact

SEQ ID NO: 8549555 - DNA, 21 bp, Homo sapiens
ggctgcagggagccctggggt

SEQ ID NO: 8549556 - DNA, 21 bp, Homo sapiens
ggctgcagggagccctggggt

SEQ ID NO: 8549557 - DNA, 21 bp, Homo sapiens
ggctgcagggagccctggggt

SEQ ID NO: 8549558 - DNA, 22 bp, Homo sapiens
ggctgcaggcttccctccagca

SEQ ID NO: 8549559 - DNA, 21 bp, Homo sapiens
ggctgcagggagccctggggt

SEQ ID NO: 8549560 - DNA, 22 bp, Homo sapiens
ggctgcctcctgctgggctgga

SEQ ID NO: 8549561 - DNA, 22 bp, Homo sapiens
ggctgcctcctcgagacaggat

SEQ ID NO: 8549562 - DNA, 19 bp, Homo sapiens
ggctgcctcctgggagatt

SEQ ID NO: 8549563 - DNA, 20 bp, Homo sapiens
ggctgcctccttcctttcct

SEQ ID NO: 8549564 - DNA, 22 bp, Homo sapiens
ggctgcctcctcgagacaggat

SEQ ID NO: 8549565 - DNA, 22 bp, Homo sapiens
ggctgcctcccaggagaatctg

SEQ ID NO: 8549566 - DNA, 22 bp, Homo sapiens
ggctgccaggagggaggccagt

SEQ ID NO: 8549567 - DNA, 22 bp, Homo sapiens
ggctgccagtgagtgcagaccg

SEQ ID NO: 8549568 - DNA, 22 bp, Homo sapiens
ggctgcagtttgtcttttgctt

SEQ ID NO: 8549569 - DNA, 22 bp, Homo sapiens
ggctgcataggcagaagctgtg

SEQ ID NO: 8549570 - DNA, 22 bp, Homo sapiens
ggctgcagtttgtcttttgctt

SEQ ID NO: 8549571 - DNA, 22 bp, Homo sapiens
ggctgcagttgtgtgaaggccg

SEQ ID NO: 8549572 - DNA, 22 bp, Homo sapiens
ggctgcagttgtgtgaaggccg

SEQ ID NO: 8549573 - DNA, 22 bp, Homo sapiens
ggctgcagttgtgtgaaggccg

SEQ ID NO: 8549574 - DNA, 22 bp, Homo sapiens
ggctgccagcactggtgtagag

SEQ ID NO: 8549575 - DNA, 22 bp, Homo sapiens
ggctgccaggagaagctcagtg

SEQ ID NO: 8549576 - DNA, 22 bp, Homo sapiens
ggctgccaggagaagctcagtg

SEQ ID NO: 8549577 - DNA, 22 bp, Homo sapiens
ggctgccaggagaagctcagtg

SEQ ID NO: 8549578 - DNA, 22 bp, Homo sapiens
ggctgccaggagggaggccagt

SEQ ID NO: 8549579 - DNA, 22 bp, Homo sapiens
ggctgccacgtcgagggtccaa

SEQ ID NO: 8549580 - DNA, 22 bp, Homo sapiens
ggctgccagcactggtgtagag

SEQ ID NO: 8549581 - DNA, 22 bp, Homo sapiens
ggctgccacgtcgagggtccaa

SEQ ID NO: 8549582 - DNA, 22 bp, Homo sapiens
ggctggcatccagggaaatcca

SEQ ID NO: 8549583 - DNA, 22 bp, Homo sapiens
ggctggcagtgtgagagaggga

SEQ ID NO: 8549584 - DNA, 22 bp, Homo sapiens
ggctggaggtagaagaacactt

SEQ ID NO: 8549585 - DNA, 22 bp, Homo sapiens
ggctggaggtagaagaacactt

SEQ ID NO: 8549586 - DNA, 22 bp, Homo sapiens
ggctggaggtagaagaacactt

SEQ ID NO: 8549587 - DNA, 17 bp, Homo sapiens
ggctggaggggacccgg

SEQ ID NO: 8549588 - DNA, 22 bp, Homo sapiens
ggctggaggagaatgggtgtga

SEQ ID NO: 8549589 - DNA, 22 bp, Homo sapiens
ggctggaggagaatgggtgtga

SEQ ID NO: 8549590 - DNA, 22 bp, Homo sapiens
ggctggagtgggctccagagtt

SEQ ID NO: 8549591 - DNA, 22 bp, Homo sapiens
ggctggagtgggctccagagtt

SEQ ID NO: 8549592 - DNA, 19 bp, Homo sapiens
ggctggagtggccatctgt

SEQ ID NO: 8549593 - DNA, 19 bp, Homo sapiens
ggctggagtggccatctgt

SEQ ID NO: 8549594 - DNA, 22 bp, Homo sapiens
ggctggagtgggctccagagtt

SEQ ID NO: 8549595 - DNA, 22 bp, Homo sapiens
ggctggagtgggctccagagtt

SEQ ID NO: 8549596 - DNA, 22 bp, Homo sapiens
ggctgcctgaggctgaggcccg

SEQ ID NO: 8549597 - DNA, 22 bp, Homo sapiens
ggctgcctgaggctgaggcccg

SEQ ID NO: 8549598 - DNA, 22 bp, Homo sapiens
ggctgcctgccgcccacttggc

SEQ ID NO: 8549599 - DNA, 22 bp, Homo sapiens
ggctgcctgctcaggtgcggcg

SEQ ID NO: 8549600 - DNA, 22 bp, Homo sapiens
ggctgcctgcctccaagccggg

SEQ ID NO: 8549601 - DNA, 22 bp, Homo sapiens
ggctgcctgcctccaagccggg

SEQ ID NO: 8549602 - DNA, 22 bp, Homo sapiens
ggctgcctctggaagctggaga

SEQ ID NO: 8549603 - DNA, 22 bp, Homo sapiens
ggctgcctctggaagctggaga

SEQ ID NO: 8549604 - DNA, 22 bp, Homo sapiens
ggctgcctctgatgtgcagacg

SEQ ID NO: 8549605 - DNA, 22 bp, Homo sapiens
ggctgcctctatttaggatcaa

SEQ ID NO: 8549606 - DNA, 22 bp, Homo sapiens
ggctgcctctgatgtgcagacg

SEQ ID NO: 8549607 - DNA, 22 bp, Homo sapiens
ggctgcctctgatgtgcagacg

SEQ ID NO: 8549608 - DNA, 22 bp, Homo sapiens
ggctgcctgaggcagtgagaga

SEQ ID NO: 8549609 - DNA, 22 bp, Homo sapiens
ggctgcctgaggcagtgagaga

SEQ ID NO: 8549610 - DNA, 22 bp, Homo sapiens
ggctgcctgaggcagtgagaga

SEQ ID NO: 8549611 - DNA, 17 bp, Homo sapiens
ggctggagcagctcccc

SEQ ID NO: 8549612 - DNA, 22 bp, Homo sapiens
ggctggagatatgtctggaaca

SEQ ID NO: 8549613 - DNA, 17 bp, Homo sapiens
ggctggagcagctcccc

SEQ ID NO: 8549614 - DNA, 22 bp, Homo sapiens
ggctggaggagaatgggtgtga

SEQ ID NO: 8549615 - DNA, 22 bp, Homo sapiens
ggctggaggagaatgggtgtga

SEQ ID NO: 8549616 - DNA, 22 bp, Homo sapiens
ggctgcctggacctcctctttc

SEQ ID NO: 8549617 - DNA, 22 bp, Homo sapiens
ggctgcctgctcctcctgcacg

SEQ ID NO: 8549618 - DNA, 22 bp, Homo sapiens
ggctggagacaacgtcctgccc

SEQ ID NO: 8549619 - DNA, 22 bp, Homo sapiens
ggctggagacaacgtcctgccc

SEQ ID NO: 8549620 - DNA, 22 bp, Homo sapiens
ggctggagatatgtctggaaca

SEQ ID NO: 8549621 - DNA, 22 bp, Homo sapiens
ggctggagatatgtctggaaca

SEQ ID NO: 8549622 - DNA, 22 bp, Homo sapiens
ggctggagatatgtctggaaca

SEQ ID NO: 8549623 - DNA, 22 bp, Homo sapiens
gggagtggttgatggtgaaaat

SEQ ID NO: 8549624 - DNA, 20 bp, Homo sapiens
gggagtggtggtagcctgtg

SEQ ID NO: 8549625 - DNA, 20 bp, Homo sapiens
gggagtggtggtagcctgtg

SEQ ID NO: 8549626 - DNA, 20 bp, Homo sapiens
gggagtggtggtagcctgtg

SEQ ID NO: 8549627 - DNA, 22 bp, Homo sapiens
gggagtgggtttggcctaggcc

SEQ ID NO: 8549628 - DNA, 22 bp, Homo sapiens
gggagtgggtttggcctaggcc

SEQ ID NO: 8549629 - DNA, 22 bp, Homo sapiens
gggagtgggtttggcctaggcc

SEQ ID NO: 8549630 - DNA, 22 bp, Homo sapiens
gggagtgggtttggcctaggcc

SEQ ID NO: 8549631 - DNA, 22 bp, Homo sapiens
gggagtgggtttggcctaggcc

SEQ ID NO: 8549632 - DNA, 22 bp, Homo sapiens
gggagtggattatgtggaccca

SEQ ID NO: 8549633 - DNA, 22 bp, Homo sapiens
gggagtggattatgtggaccca

SEQ ID NO: 8549634 - DNA, 22 bp, Homo sapiens
gggagtggggcttaccttgaag

SEQ ID NO: 8549635 - DNA, 18 bp, Homo sapiens
gggatatatcagtgaaga

SEQ ID NO: 8549636 - DNA, 23 bp, Homo sapiens
gggatatggaccttggaggagtc

SEQ ID NO: 8549637 - DNA, 22 bp, Homo sapiens
gggatatgtttaggtgttggag

SEQ ID NO: 8549638 - DNA, 23 bp, Homo sapiens
gggatatggaccttggaggagtc

SEQ ID NO: 8549639 - DNA, 22 bp, Homo sapiens
gggatcagaaacatagccctga

SEQ ID NO: 8549640 - DNA, 19 bp, Homo sapiens
gggatcagcccagggctct

SEQ ID NO: 8549641 - DNA, 20 bp, Homo sapiens
gggatcaggaaaggaggcta

SEQ ID NO: 8549642 - DNA, 22 bp, Homo sapiens
gggataggagattgggagtgtt

SEQ ID NO: 8549643 - DNA, 22 bp, Homo sapiens
gggataggtttggaagaggtgg

SEQ ID NO: 8549644 - DNA, 22 bp, Homo sapiens
gggagtgttgagcgccctgcca

SEQ ID NO: 8549645 - DNA, 22 bp, Homo sapiens
gggagtggttgatggtgaaaat

SEQ ID NO: 8549646 - DNA, 22 bp, Homo sapiens
gggagctatttatagaggctga

SEQ ID NO: 8549647 - DNA, 22 bp, Homo sapiens
gggagctccactgcctctcatt

SEQ ID NO: 8549648 - DNA, 22 bp, Homo sapiens
gggagctcgtgcgcccaggtgc

SEQ ID NO: 8549649 - DNA, 22 bp, Homo sapiens
gggagctctccctgaggcctgg

SEQ ID NO: 8549650 - DNA, 22 bp, Homo sapiens
gggagcgggactgcgcaggctt

SEQ ID NO: 8549651 - DNA, 22 bp, Homo sapiens
gggagcgggactgcgcaggctt

SEQ ID NO: 8549652 - DNA, 22 bp, Homo sapiens
gggagccttgggagtgccagcc

SEQ ID NO: 8549653 - DNA, 22 bp, Homo sapiens
gggagctgaaggagccggcggg

SEQ ID NO: 8549654 - DNA, 22 bp, Homo sapiens
gggaggttgaggctgcagtgag

SEQ ID NO: 8549655 - DNA, 22 bp, Homo sapiens
gggagctgaatggcaatggaga

SEQ ID NO: 8549656 - DNA, 22 bp, Homo sapiens
gggaggttgaggctgcagtgag

SEQ ID NO: 8549657 - DNA, 22 bp, Homo sapiens
gggagtggagagcaatggatga

SEQ ID NO: 8549658 - DNA, 22 bp, Homo sapiens
gggagtggattatgtggaccca

SEQ ID NO: 8549659 - DNA, 22 bp, Homo sapiens
gggagtggagagcaatggatga

SEQ ID NO: 8549660 - DNA, 22 bp, Homo sapiens
gggagtcaggctccctcagaga

SEQ ID NO: 8549661 - DNA, 22 bp, Homo sapiens
gggagtcagtgaaggagtcaga

SEQ ID NO: 8549662 - DNA, 22 bp, Homo sapiens
gggagtccaaattggtacaata

SEQ ID NO: 8549663 - DNA, 22 bp, Homo sapiens
gggatccatccgtgcagcagag

SEQ ID NO: 8549664 - DNA, 22 bp, Homo sapiens
gggatccatccgtgcagcagag

SEQ ID NO: 8549665 - DNA, 22 bp, Homo sapiens
gggcactgtacactgtgcatgg

SEQ ID NO: 8549666 - DNA, 22 bp, Homo sapiens
gggcagagactcagaaacagaa

SEQ ID NO: 8549667 - DNA, 22 bp, Homo sapiens
gggcagagactcagaaacagaa

SEQ ID NO: 8549668 - DNA, 22 bp, Homo sapiens
gggcagagactcagaaacagaa

SEQ ID NO: 8549669 - DNA, 22 bp, Homo sapiens
gggcagagactcagaaacagaa

SEQ ID NO: 8549670 - DNA, 22 bp, Homo sapiens
gggcagagagctggaactcctt

SEQ ID NO: 8549671 - DNA, 22 bp, Homo sapiens
gggcagagagctggaactcctt

SEQ ID NO: 8549672 - DNA, 22 bp, Homo sapiens
gggcagagagctggaactcctt

SEQ ID NO: 8549673 - DNA, 22 bp, Homo sapiens
gggcagagagctggaactcctt

SEQ ID NO: 8549674 - DNA, 20 bp, Homo sapiens
gggcagagccagccagtccc

SEQ ID NO: 8549675 - DNA, 20 bp, Homo sapiens
gggcagagccagccagtccc

SEQ ID NO: 8549676 - DNA, 20 bp, Homo sapiens
gggcagagccagccagtccc

SEQ ID NO: 8549677 - DNA, 20 bp, Homo sapiens
gggcagagccagccagtccc

SEQ ID NO: 8549678 - DNA, 22 bp, Homo sapiens
gggcagaggctctggcccatcc

SEQ ID NO: 8549679 - DNA, 21 bp, Homo sapiens
gggcagaggggcctcctgggt

SEQ ID NO: 8549680 - DNA, 21 bp, Homo sapiens
gggcagaggggcctcctgggt

SEQ ID NO: 8549681 - DNA, 21 bp, Homo sapiens
gggcagaggggcctcctgggt

SEQ ID NO: 8549682 - DNA, 22 bp, Homo sapiens
gggcagaggctctggcccatcc

SEQ ID NO: 8549683 - DNA, 22 bp, Homo sapiens
gggcagaggctctggcccatcc

SEQ ID NO: 8549684 - DNA, 22 bp, Homo sapiens
gggcagaggctctggcccatcc

SEQ ID NO: 8549685 - DNA, 17 bp, Homo sapiens
gggcagggactcctggg

SEQ ID NO: 8549686 - DNA, 21 bp, Homo sapiens
gggcagaggggcctcctgggt

SEQ ID NO: 8549687 - DNA, 21 bp, Homo sapiens
gggcagaggggcctcctgggt

SEQ ID NO: 8549688 - DNA, 21 bp, Homo sapiens
gggcagaggggcctcctgggt

SEQ ID NO: 8549689 - DNA, 21 bp, Homo sapiens
gggcaggtctctgatgtcaac

SEQ ID NO: 8549690 - DNA, 21 bp, Homo sapiens
gggcaggtctctgatgtcaac

SEQ ID NO: 8549691 - DNA, 17 bp, Homo sapiens
gggcagggactcctggg

SEQ ID NO: 8549692 - DNA, 17 bp, Homo sapiens
gggcagggactcctggg

SEQ ID NO: 8549693 - DNA, 17 bp, Homo sapiens
gggcagggactcctggg

SEQ ID NO: 8549694 - DNA, 22 bp, Homo sapiens
gggcaggtctgggtcagcctga

SEQ ID NO: 8549695 - DNA, 22 bp, Homo sapiens
gggcaggtgacctcttgtcctg

SEQ ID NO: 8549696 - DNA, 22 bp, Homo sapiens
gggcaggtgccagctccctgtc

SEQ ID NO: 8549697 - DNA, 22 bp, Homo sapiens
gggcaggtgccagctccctgtc

SEQ ID NO: 8549698 - DNA, 22 bp, Homo sapiens
gggcaggtgcccagggccagag

SEQ ID NO: 8549699 - DNA, 22 bp, Homo sapiens
gggcaggtgcccagggccagag

SEQ ID NO: 8549700 - DNA, 22 bp, Homo sapiens
gggctcagttctgcttcatgct

SEQ ID NO: 8549701 - DNA, 22 bp, Homo sapiens
gggctcagctccttccttccta

SEQ ID NO: 8549702 - DNA, 21 bp, Homo sapiens
gggctcagcgctcggctcctc

SEQ ID NO: 8549703 - DNA, 22 bp, Homo sapiens
gggctcagctgggcgtgctggt

SEQ ID NO: 8549704 - DNA, 22 bp, Homo sapiens
gggctcagctgggcgtgctggt

SEQ ID NO: 8549705 - DNA, 22 bp, Homo sapiens
gggctcagctccttccttccta

SEQ ID NO: 8549706 - DNA, 22 bp, Homo sapiens
gggctcagaggagtggcctggg

SEQ ID NO: 8549707 - DNA, 22 bp, Homo sapiens
gggctcagaggagtggcctggg

SEQ ID NO: 8549708 - DNA, 22 bp, Homo sapiens
gggctcagaggagtggcctggg

SEQ ID NO: 8549709 - DNA, 22 bp, Homo sapiens
gggctcagacatccctcctgga

SEQ ID NO: 8549710 - DNA, 22 bp, Homo sapiens
gggctcagacatccctcctgga

SEQ ID NO: 8549711 - DNA, 22 bp, Homo sapiens
gggctcagacatccctcctgga

SEQ ID NO: 8549712 - DNA, 22 bp, Homo sapiens
gggctcagccccattgaaccag

SEQ ID NO: 8549713 - DNA, 22 bp, Homo sapiens
gggctctgaatcccaggtctgc

SEQ ID NO: 8549714 - DNA, 22 bp, Homo sapiens
gggctccaacggtgagcatgga

SEQ ID NO: 8549715 - DNA, 22 bp, Homo sapiens
gggctccaacggtgagcatgga

SEQ ID NO: 8549716 - DNA, 22 bp, Homo sapiens
gggctccaaccccagtgaactc

SEQ ID NO: 8549717 - DNA, 22 bp, Homo sapiens
gggctccaacggtgagcatgga

SEQ ID NO: 8549718 - DNA, 22 bp, Homo sapiens
gggctccaaaatcctgtagcct

SEQ ID NO: 8549719 - DNA, 22 bp, Homo sapiens
gggctctggagttctagaaaga

SEQ ID NO: 8549720 - DNA, 22 bp, Homo sapiens
gggctctggatggagcctgcag

SEQ ID NO: 8549721 - DNA, 22 bp, Homo sapiens
gggctctggaaggtgcaccatg

SEQ ID NO: 8549722 - DNA, 22 bp, Homo sapiens
gggctctggaaggtgcaccatg

SEQ ID NO: 8549723 - DNA, 22 bp, Homo sapiens
gggctctggaaatgggagctcc

SEQ ID NO: 8549724 - DNA, 22 bp, Homo sapiens
gggccccagtcctcccacgtgg

SEQ ID NO: 8549725 - DNA, 22 bp, Homo sapiens
gggccccactggggctgcctgc

SEQ ID NO: 8549726 - DNA, 22 bp, Homo sapiens
gggccccttgtatctctggctc

SEQ ID NO: 8549727 - DNA, 22 bp, Homo sapiens
gggcccagtaccctctgccaag

SEQ ID NO: 8549728 - DNA, 22 bp, Homo sapiens
gggccccaaaatgccaggctct

SEQ ID NO: 8549729 - DNA, 22 bp, Homo sapiens
gggccccaagaacctcctcctg

SEQ ID NO: 8549730 - DNA, 22 bp, Homo sapiens
gggcccagtaccctctgccaag

SEQ ID NO: 8549731 - DNA, 22 bp, Homo sapiens
gggcaggtgtgcagagctgttg

SEQ ID NO: 8549732 - DNA, 22 bp, Homo sapiens
gggcaggtggcctcttgtacta

SEQ ID NO: 8549733 - DNA, 22 bp, Homo sapiens
gggcaggtgtttccaaggtgag

SEQ ID NO: 8549734 - DNA, 22 bp, Homo sapiens
gggcaggtgtttccaaggtgag

SEQ ID NO: 8549735 - DNA, 22 bp, Homo sapiens
gggcaggtggagggcccagcca

SEQ ID NO: 8549736 - DNA, 22 bp, Homo sapiens
gggcaggtggagggcccagcca

SEQ ID NO: 8549737 - DNA, 22 bp, Homo sapiens
gggcaggtggcaaagccagagg

SEQ ID NO: 8549738 - DNA, 22 bp, Homo sapiens
gggccggagctgggtcccgcgc

SEQ ID NO: 8549739 - DNA, 22 bp, Homo sapiens
gggccctgtgatttcttgagga

SEQ ID NO: 8549740 - DNA, 22 bp, Homo sapiens
gggccctggggcctgatttgca

SEQ ID NO: 8549741 - DNA, 22 bp, Homo sapiens
gggccctggggcctgatttgca

SEQ ID NO: 8549742 - DNA, 22 bp, Homo sapiens
gggccctggggcctgatttgca

SEQ ID NO: 8549743 - DNA, 22 bp, Homo sapiens
gggccctggggcctgatttgca

SEQ ID NO: 8549744 - DNA, 18 bp, Homo sapiens
gggctcacacaggtcatc

SEQ ID NO: 8549745 - DNA, 18 bp, Homo sapiens
gggctcacacaggtcatc

SEQ ID NO: 8549746 - DNA, 22 bp, Homo sapiens
gggccctgatctgtgagcgcag

SEQ ID NO: 8549747 - DNA, 22 bp, Homo sapiens
gggccctgccccgtggctctga

SEQ ID NO: 8549748 - DNA, 22 bp, Homo sapiens
gggccctgccccgtggctctga

SEQ ID NO: 8549749 - DNA, 22 bp, Homo sapiens
gggccctgggattcagagcaag

SEQ ID NO: 8549750 - DNA, 22 bp, Homo sapiens
gggccctggggatgtggacgcg

SEQ ID NO: 8549751 - DNA, 22 bp, Homo sapiens
gggccctgcgactcgcggcgga

SEQ ID NO: 8549752 - DNA, 22 bp, Homo sapiens
gggccctgggattcagagcaag

SEQ ID NO: 8549753 - DNA, 22 bp, Homo sapiens
gggccctgcctaaggaacacac

SEQ ID NO: 8549754 - DNA, 22 bp, Homo sapiens
ggcacctgctcatctggactca

SEQ ID NO: 8549755 - DNA, 22 bp, Homo sapiens
ggcacctgctcatctggactca

SEQ ID NO: 8549756 - DNA, 22 bp, Homo sapiens
ggcacctggaggtttactggat

SEQ ID NO: 8549757 - DNA, 22 bp, Homo sapiens
ggcacctggatgtagcagtgaa

SEQ ID NO: 8549758 - DNA, 22 bp, Homo sapiens
ggcacctggatgtagcagtgaa

SEQ ID NO: 8549759 - DNA, 22 bp, Homo sapiens
ggcacctggatgtagcagtgaa

SEQ ID NO: 8549760 - DNA, 22 bp, Homo sapiens
ggcaccagggaaggaaggctgg

SEQ ID NO: 8549761 - DNA, 22 bp, Homo sapiens
ggcaccaggctgggcataggcc

SEQ ID NO: 8549762 - DNA, 22 bp, Homo sapiens
ggcaccagggacaatcctcttc

SEQ ID NO: 8549763 - DNA, 22 bp, Homo sapiens
ggcaccagggaaggaaggctgg

SEQ ID NO: 8549764 - DNA, 22 bp, Homo sapiens
ggcaccaggggatgtaatgtcc

SEQ ID NO: 8549765 - DNA, 22 bp, Homo sapiens
ggcaccagggcaagggtctttc

SEQ ID NO: 8549766 - DNA, 22 bp, Homo sapiens
ggcaccagggacaatcctcttc

SEQ ID NO: 8549767 - DNA, 22 bp, Homo sapiens
ggcaccagggcaagggtctttc

SEQ ID NO: 8549768 - DNA, 16 bp, Homo sapiens
ggcaccagtgaacaca

SEQ ID NO: 8549769 - DNA, 22 bp, Homo sapiens
ggcaccaggggatgtaatgtcc

SEQ ID NO: 8549770 - DNA, 22 bp, Homo sapiens
ggaggaggtgggttaagttgta

SEQ ID NO: 8549771 - DNA, 22 bp, Homo sapiens
ggaggaggggtttacattggaa

SEQ ID NO: 8549772 - DNA, 22 bp, Homo sapiens
ggaggatgagctacgaggagct

SEQ ID NO: 8549773 - DNA, 23 bp, Homo sapiens
ggaggagttcccagccctcctgg

SEQ ID NO: 8549774 - DNA, 22 bp, Homo sapiens
ggaggagtgtggggcactctgc

SEQ ID NO: 8549775 - DNA, 22 bp, Homo sapiens
ggaggaggggtgactgaatgct

SEQ ID NO: 8549776 - DNA, 22 bp, Homo sapiens
ggaggaggggtgactgaatgct

SEQ ID NO: 8549777 - DNA, 22 bp, Homo sapiens
ggaggaggggtgactgaatgct

SEQ ID NO: 8549778 - DNA, 22 bp, Homo sapiens
ggaggaggggtgactgaatgct

SEQ ID NO: 8549779 - DNA, 22 bp, Homo sapiens
ggaggatgccaagctgtgcaca

SEQ ID NO: 8549780 - DNA, 22 bp, Homo sapiens
ggaggatgccaagctgtgcaca

SEQ ID NO: 8549781 - DNA, 22 bp, Homo sapiens
ggaggatgagctacgaggagct

SEQ ID NO: 8549782 - DNA, 23 bp, Homo sapiens
ggaggcacttaggcagagcagag

SEQ ID NO: 8549783 - DNA, 23 bp, Homo sapiens
ggaggcacttaggcagagcagag

SEQ ID NO: 8549784 - DNA, 23 bp, Homo sapiens
ggaggcacttaggcagagcagag

SEQ ID NO: 8549785 - DNA, 22 bp, Homo sapiens
ggaggcacacctcagactggga

SEQ ID NO: 8549786 - DNA, 17 bp, Homo sapiens
ggaggcaacagacaggg

SEQ ID NO: 8549787 - DNA, 22 bp, Homo sapiens
ggcagaggtgaagttcacaagg

SEQ ID NO: 8549788 - DNA, 22 bp, Homo sapiens
ggcagaggtgaagttcacaagg

SEQ ID NO: 8549789 - DNA, 22 bp, Homo sapiens
ggcagaggtgacagtgtctttt

SEQ ID NO: 8549790 - DNA, 22 bp, Homo sapiens
ggcagaggtgacagtgtctttt

SEQ ID NO: 8549791 - DNA, 22 bp, Homo sapiens
ggcagatgttatatgatctgag

SEQ ID NO: 8549792 - DNA, 22 bp, Homo sapiens
ggcactgagcgggctctgagcg

SEQ ID NO: 8549793 - DNA, 22 bp, Homo sapiens
ggcactcaataaatgttgccaa

SEQ ID NO: 8549794 - DNA, 22 bp, Homo sapiens
ggcactagtgacaaggggacat

SEQ ID NO: 8549795 - DNA, 23 bp, Homo sapiens
ggcactgaagctacaatggtgag

SEQ ID NO: 8549796 - DNA, 22 bp, Homo sapiens
ggcagcactgcagcttgttggg

SEQ ID NO: 8549797 - DNA, 22 bp, Homo sapiens
ggcagcactgcagcttgttggg

SEQ ID NO: 8549798 - DNA, 22 bp, Homo sapiens
ggcagcagaactggccctgtat

SEQ ID NO: 8549799 - DNA, 22 bp, Homo sapiens
ggcagcagaactggccctgtat

SEQ ID NO: 8549800 - DNA, 22 bp, Homo sapiens
ggcagcagaactggccctgtat

SEQ ID NO: 8549801 - DNA, 22 bp, Homo sapiens
ggcagcagacccctaagtctac

SEQ ID NO: 8549802 - DNA, 22 bp, Homo sapiens
ggcagcagaactggccctgtat

SEQ ID NO: 8549803 - DNA, 22 bp, Homo sapiens
ggcagcactgcagcttgttggg

SEQ ID NO: 8549804 - DNA, 22 bp, Homo sapiens
ggcagcactgcagcttgttggg

SEQ ID NO: 8549805 - DNA, 22 bp, Homo sapiens
ggcagcactgcagcttgttggg

SEQ ID NO: 8549806 - DNA, 22 bp, Homo sapiens
ggcagcacgacaggagtggaag

SEQ ID NO: 8549807 - DNA, 22 bp, Homo sapiens
ggcagcaactcggagagaagag

SEQ ID NO: 8549808 - DNA, 22 bp, Homo sapiens
ggcagcaagtggtgggagactt

SEQ ID NO: 8549809 - DNA, 23 bp, Homo sapiens
ggcagcctctgactctgctttgc

SEQ ID NO: 8549810 - DNA, 22 bp, Homo sapiens
ggcagcctccagggcactggtg

SEQ ID NO: 8549811 - DNA, 22 bp, Homo sapiens
ggcagcctccagggcactggtg

SEQ ID NO: 8549812 - DNA, 22 bp, Homo sapiens
ggcagcctccagggcactggtg

SEQ ID NO: 8549813 - DNA, 22 bp, Homo sapiens
ggcagcctccagggcactggtg

SEQ ID NO: 8549814 - DNA, 21 bp, Homo sapiens
ggcagcctgacccccagagag

SEQ ID NO: 8549815 - DNA, 21 bp, Homo sapiens
ggcagcctgacccccagagag

SEQ ID NO: 8549816 - DNA, 23 bp, Homo sapiens
ggcagcctctgactctgctttgc

SEQ ID NO: 8549817 - DNA, 22 bp, Homo sapiens
ggcagccttctctcataggtga

SEQ ID NO: 8549818 - DNA, 22 bp, Homo sapiens
ggcagccttctctcataggtga

SEQ ID NO: 8549819 - DNA, 22 bp, Homo sapiens
ggcagccttctctcataggtga

SEQ ID NO: 8549820 - DNA, 22 bp, Homo sapiens
ggcagccttgactagtgactta

SEQ ID NO: 8549821 - DNA, 22 bp, Homo sapiens
ggcagccttgactagtgactta

SEQ ID NO: 8549822 - DNA, 18 bp, Homo sapiens
ggcagcctggacatgctc

SEQ ID NO: 8549823 - DNA, 19 bp, Homo sapiens
ggcagcctgcacgggctgc

SEQ ID NO: 8549824 - DNA, 22 bp, Homo sapiens
ggcagccctgtggagaggccca

SEQ ID NO: 8549825 - DNA, 21 bp, Homo sapiens
ggcagcccgccctctcctggc

SEQ ID NO: 8549826 - DNA, 22 bp, Homo sapiens
ggcagccctttctggccagctc

SEQ ID NO: 8549827 - DNA, 22 bp, Homo sapiens
ggcagcctcaggttttctttga

SEQ ID NO: 8549828 - DNA, 17 bp, Homo sapiens
ggcagcctcaggcgttt

SEQ ID NO: 8549829 - DNA, 18 bp, Homo sapiens
ggcagcctacccacttgt

SEQ ID NO: 8549830 - DNA, 21 bp, Homo sapiens
ggcagcccgccctctcctggc

SEQ ID NO: 8549831 - DNA, 22 bp, Homo sapiens
ggcagcccaccagcccacgtct

SEQ ID NO: 8549832 - DNA, 22 bp, Homo sapiens
ggcagccatgtgggcagcgagt

SEQ ID NO: 8549833 - DNA, 22 bp, Homo sapiens
ggcagccatgtcccagggcttc

SEQ ID NO: 8549834 - DNA, 22 bp, Homo sapiens
ggcagccatgtcccagggcttc

SEQ ID NO: 8549835 - DNA, 22 bp, Homo sapiens
ggcagccatgtcccagggcttc

SEQ ID NO: 8549836 - DNA, 22 bp, Homo sapiens
ggcagctaggggcagggaattc

SEQ ID NO: 8549837 - DNA, 22 bp, Homo sapiens
ggcagccttgagggaggcctgg

SEQ ID NO: 8549838 - DNA, 22 bp, Homo sapiens
ggcagcgcccgagtccgcagct

SEQ ID NO: 8549839 - DNA, 20 bp, Homo sapiens
ggcagctcactactttctgt

SEQ ID NO: 8549840 - DNA, 22 bp, Homo sapiens
ggcagctcctcctagtctgccc

SEQ ID NO: 8549841 - DNA, 22 bp, Homo sapiens
ggcagctcgatgacttctgcat

SEQ ID NO: 8549842 - DNA, 22 bp, Homo sapiens
ggcaggcttgatatggggggac

SEQ ID NO: 8549843 - DNA, 22 bp, Homo sapiens
ggcaggctgttcacctgctttt

SEQ ID NO: 8549844 - DNA, 22 bp, Homo sapiens
ggcaggctgttcacctgctttt

SEQ ID NO: 8549845 - DNA, 20 bp, Homo sapiens
ggcaggctttatatggaggg

SEQ ID NO: 8549846 - DNA, 18 bp, Homo sapiens
ggcagtgcagtctcaggg

SEQ ID NO: 8549847 - DNA, 22 bp, Homo sapiens
ggcagtgcaaggcagcctggat

SEQ ID NO: 8549848 - DNA, 22 bp, Homo sapiens
ggcagtgcaaggctggcacagt

SEQ ID NO: 8549849 - DNA, 22 bp, Homo sapiens
ggcagtgcctgatgctgcagga

SEQ ID NO: 8549850 - DNA, 22 bp, Homo sapiens
ggcagtggaggaccctgtgtct

SEQ ID NO: 8549851 - DNA, 22 bp, Homo sapiens
ggcagtggaggaccctgtgtct

SEQ ID NO: 8549852 - DNA, 22 bp, Homo sapiens
ggcagtgagtcccggagaggcc

SEQ ID NO: 8549853 - DNA, 22 bp, Homo sapiens
ggcagtgagtcccggagaggcc

SEQ ID NO: 8549854 - DNA, 22 bp, Homo sapiens
ggcagtgactgttcagacgtcc

SEQ ID NO: 8549855 - DNA, 22 bp, Homo sapiens
ggcagtgagaggtctcctggtc

SEQ ID NO: 8549856 - DNA, 22 bp, Homo sapiens
ggcaggggtcctggtgttgact

SEQ ID NO: 8549857 - DNA, 22 bp, Homo sapiens
ggcaggggtcctggtgttgact

SEQ ID NO: 8549858 - DNA, 22 bp, Homo sapiens
ggcagggcttgtctctgtgatg

SEQ ID NO: 8549859 - DNA, 22 bp, Homo sapiens
ggcaggggtcctggtgttgact

SEQ ID NO: 8549860 - DNA, 22 bp, Homo sapiens
ggcagggagagcatgctgataa

SEQ ID NO: 8549861 - DNA, 20 bp, Homo sapiens
ggcagggcatcaacagctct

SEQ ID NO: 8549862 - DNA, 22 bp, Homo sapiens
ggcagggccctgattcctgggg

SEQ ID NO: 8549863 - DNA, 22 bp, Homo sapiens
ggcagggagagcatgctgataa

SEQ ID NO: 8549864 - DNA, 22 bp, Homo sapiens
ggcagggaaacagctgatccca

SEQ ID NO: 8549865 - DNA, 22 bp, Homo sapiens
ggcagggaaacagctgatccca

SEQ ID NO: 8549866 - DNA, 22 bp, Homo sapiens
ggcagggaaacagctgatccca

SEQ ID NO: 8549867 - DNA, 22 bp, Homo sapiens
ggccagagtctatatgcagaca

SEQ ID NO: 8549868 - DNA, 22 bp, Homo sapiens
ggccagagttgatggcatcttg

SEQ ID NO: 8549869 - DNA, 22 bp, Homo sapiens
ggccagagtctatatgcagaca

SEQ ID NO: 8549870 - DNA, 19 bp, Homo sapiens
ggccacctctcttcccagg

SEQ ID NO: 8549871 - DNA, 22 bp, Homo sapiens
ggccacctaggagccacagtga

SEQ ID NO: 8549872 - DNA, 22 bp, Homo sapiens
ggccagaggtgtcctcagttct

SEQ ID NO: 8549873 - DNA, 22 bp, Homo sapiens
ggccagcagacctcagggactc

SEQ ID NO: 8549874 - DNA, 21 bp, Homo sapiens
ggccagcagcgtccactgtgg

SEQ ID NO: 8549875 - DNA, 22 bp, Homo sapiens
ggccagcagacctcagggactc

SEQ ID NO: 8549876 - DNA, 22 bp, Homo sapiens
ggccagcagacctcagggactc

SEQ ID NO: 8549877 - DNA, 19 bp, Homo sapiens
ggccagcacagggctctgt

SEQ ID NO: 8549878 - DNA, 19 bp, Homo sapiens
ggccagcacagggctctgt

SEQ ID NO: 8549879 - DNA, 22 bp, Homo sapiens
ggccagagttgatggcatcttg

SEQ ID NO: 8549880 - DNA, 22 bp, Homo sapiens
ggccagagttgatggcatcttg

SEQ ID NO: 8549881 - DNA, 22 bp, Homo sapiens
ggccacctaggagccacagtga

SEQ ID NO: 8549882 - DNA, 22 bp, Homo sapiens
ggccacagtgggaaatcctggg

SEQ ID NO: 8549883 - DNA, 21 bp, Homo sapiens
ggccacagttagggctcagga

SEQ ID NO: 8549884 - DNA, 22 bp, Homo sapiens
ggccacagtctctggaaggatg

SEQ ID NO: 8549885 - DNA, 20 bp, Homo sapiens
ggccacagggtgctggtgga

SEQ ID NO: 8549886 - DNA, 22 bp, Homo sapiens
ggccacagcaatgctgtgatgt

SEQ ID NO: 8549887 - DNA, 22 bp, Homo sapiens
ggccacagcaatgctgtgatgt

SEQ ID NO: 8549888 - DNA, 22 bp, Homo sapiens
ggccacagagggcgggatgctg

SEQ ID NO: 8549889 - DNA, 22 bp, Homo sapiens
ggccacagcagatgcttcagat

SEQ ID NO: 8549890 - DNA, 17 bp, Homo sapiens
ggccacagagcttgggg

SEQ ID NO: 8549891 - DNA, 22 bp, Homo sapiens
ggcagtgggtggatctcaggga

SEQ ID NO: 8549892 - DNA, 22 bp, Homo sapiens
ggcagtggctcctctctactcc

SEQ ID NO: 8549893 - DNA, 22 bp, Homo sapiens
ggcccatctcttgctctgggtt

SEQ ID NO: 8549894 - DNA, 22 bp, Homo sapiens
ggcccagtgtaccccaggcagt

SEQ ID NO: 8549895 - DNA, 22 bp, Homo sapiens
ggcccagtgtcccggtcgtggc

SEQ ID NO: 8549896 - DNA, 22 bp, Homo sapiens
ggcccagtgtgggtggatgttg

SEQ ID NO: 8549897 - DNA, 22 bp, Homo sapiens
ggcccaggctggagtgcggtgg

SEQ ID NO: 8549898 - DNA, 22 bp, Homo sapiens
ggcccaggtccagcgagtacct

SEQ ID NO: 8549899 - DNA, 20 bp, Homo sapiens
ggcccagtgaaccaggacgg

SEQ ID NO: 8549900 - DNA, 22 bp, Homo sapiens
ggcccagtctggggccctgtga

SEQ ID NO: 8549901 - DNA, 22 bp, Homo sapiens
ggcccaggctggagtgcagtgg

SEQ ID NO: 8549902 - DNA, 22 bp, Homo sapiens
ggcccagctttcattccttgct

SEQ ID NO: 8549903 - DNA, 22 bp, Homo sapiens
ggcccaggatgcaagaactgaa

SEQ ID NO: 8549904 - DNA, 22 bp, Homo sapiens
ggcccagctgtgcttccagccc

SEQ ID NO: 8549905 - DNA, 22 bp, Homo sapiens
ggcccagctgtgcttccagccc

SEQ ID NO: 8549906 - DNA, 22 bp, Homo sapiens
ggcccagctgtgcttccagccc

SEQ ID NO: 8549907 - DNA, 22 bp, Homo sapiens
ggcccagctgtgcttccagccc

SEQ ID NO: 8549908 - DNA, 22 bp, Homo sapiens
ggcccagctgtatattacagtt

SEQ ID NO: 8549909 - DNA, 22 bp, Homo sapiens
ggcccagctctattgaattaca

SEQ ID NO: 8549910 - DNA, 22 bp, Homo sapiens
ggcccagctgggcggggacacg

SEQ ID NO: 8549911 - DNA, 22 bp, Homo sapiens
ggcccagctgtatattacagtt

SEQ ID NO: 8549912 - DNA, 22 bp, Homo sapiens
ggccagcagtcacagggtcaga

SEQ ID NO: 8549913 - DNA, 22 bp, Homo sapiens
ggccagcagtatatagctaatt

SEQ ID NO: 8549914 - DNA, 22 bp, Homo sapiens
ggccagcaggccctgtgatcct

SEQ ID NO: 8549915 - DNA, 22 bp, Homo sapiens
ggccagcagtcacagggtcaga

SEQ ID NO: 8549916 - DNA, 22 bp, Homo sapiens
ggccagcagtcacagggtcaga

SEQ ID NO: 8549917 - DNA, 19 bp, Homo sapiens
ggccagccacctcgcctgg

SEQ ID NO: 8549918 - DNA, 22 bp, Homo sapiens
ggccagcatggcaagaccaact

SEQ ID NO: 8549919 - DNA, 22 bp, Homo sapiens
ggccagcatggcaagaccaact

SEQ ID NO: 8549920 - DNA, 22 bp, Homo sapiens
ggccagctctgcacagcagctg

SEQ ID NO: 8549921 - DNA, 22 bp, Homo sapiens
ggccagctctgcacagcagctg

SEQ ID NO: 8549922 - DNA, 22 bp, Homo sapiens
ggccagctcttgtccacggagg

SEQ ID NO: 8549923 - DNA, 22 bp, Homo sapiens
ggcccagcgaggccacctacag

SEQ ID NO: 8549924 - DNA, 22 bp, Homo sapiens
ggcccagcgaggccacctacag

SEQ ID NO: 8549925 - DNA, 22 bp, Homo sapiens
ggccagctgctcagtgtctctg

SEQ ID NO: 8549926 - DNA, 22 bp, Homo sapiens
ggccagctgccaccagccctat

SEQ ID NO: 8549927 - DNA, 22 bp, Homo sapiens
ggccagctcttgtccacggagg

SEQ ID NO: 8549928 - DNA, 22 bp, Homo sapiens
ggccagctgagctgctgcacag

SEQ ID NO: 8549929 - DNA, 19 bp, Homo sapiens
ggcctctgcaggccgcccc

SEQ ID NO: 8549930 - DNA, 22 bp, Homo sapiens
ggcctctgccccagccacacct

SEQ ID NO: 8549931 - DNA, 22 bp, Homo sapiens
ggcctctgccccagccacacct

SEQ ID NO: 8549932 - DNA, 22 bp, Homo sapiens
ggcctctgccccagccacacct

SEQ ID NO: 8549933 - DNA, 22 bp, Homo sapiens
ggcctctgccccagccacacct

SEQ ID NO: 8549934 - DNA, 19 bp, Homo sapiens
ggcctctgcaggccgcccc

SEQ ID NO: 8549935 - DNA, 19 bp, Homo sapiens
ggcctctgcaggccgcccc

SEQ ID NO: 8549936 - DNA, 19 bp, Homo sapiens
ggcctctgcaggccgcccc

SEQ ID NO: 8549937 - DNA, 22 bp, Homo sapiens
ggcctctgcaactggctgtggc

SEQ ID NO: 8549938 - DNA, 22 bp, Homo sapiens
ggcctctgccccagccacacct

SEQ ID NO: 8549939 - DNA, 22 bp, Homo sapiens
ggcctctgccctcactcctgtc

SEQ ID NO: 8549940 - DNA, 22 bp, Homo sapiens
ggcctctgccctcactcctgtc

SEQ ID NO: 8549941 - DNA, 21 bp, Homo sapiens
ggcctctgccttgccccactc

SEQ ID NO: 8549942 - DNA, 21 bp, Homo sapiens
ggcctctgccttgccccactc

SEQ ID NO: 8549943 - DNA, 21 bp, Homo sapiens
ggcctctgccttgccccactc

SEQ ID NO: 8549944 - DNA, 22 bp, Homo sapiens
ggcctctgcctcatctgggcac

SEQ ID NO: 8549945 - DNA, 22 bp, Homo sapiens
ggcctctgcctcatctgggcac

SEQ ID NO: 8549946 - DNA, 21 bp, Homo sapiens
ggcctcccggaccgcagcgcc

SEQ ID NO: 8549947 - DNA, 22 bp, Homo sapiens
ggcctctctgagagcagacgtt

SEQ ID NO: 8549948 - DNA, 22 bp, Homo sapiens
ggcctctgaggacagccttggc

SEQ ID NO: 8549949 - DNA, 22 bp, Homo sapiens
ggcctctgaggacagccttggc

SEQ ID NO: 8549950 - DNA, 20 bp, Homo sapiens
ggcctctgaggacaaggaga

SEQ ID NO: 8549951 - DNA, 20 bp, Homo sapiens
ggcctctgaggacaaggaga

SEQ ID NO: 8549952 - DNA, 22 bp, Homo sapiens
ggcctctcttgggacagctgtc

SEQ ID NO: 8549953 - DNA, 22 bp, Homo sapiens
ggcctctctgagagcagacgtt

SEQ ID NO: 8549954 - DNA, 22 bp, Homo sapiens
ggcctctctggcatggctgccc

SEQ ID NO: 8549955 - DNA, 22 bp, Homo sapiens
ggcctctcttgggacagctgtc

SEQ ID NO: 8549956 - DNA, 22 bp, Homo sapiens
ggcctctcttgggacagctgtc

SEQ ID NO: 8549957 - DNA, 22 bp, Homo sapiens
ggcctctggtcaagacaagcat

SEQ ID NO: 8549958 - DNA, 22 bp, Homo sapiens
ggcctctggtgcctgaagcgcc

SEQ ID NO: 8549959 - DNA, 22 bp, Homo sapiens
ggcctctggtgcctgaagcgcc

SEQ ID NO: 8549960 - DNA, 22 bp, Homo sapiens
ggcctctggggtcctgagccca

SEQ ID NO: 8549961 - DNA, 22 bp, Homo sapiens
ggcctctggtcaagacaagcat

SEQ ID NO: 8549962 - DNA, 22 bp, Homo sapiens
ggcctctggggtcctgagccca

SEQ ID NO: 8549963 - DNA, 22 bp, Homo sapiens
ggcctctggggtcctgagccca

SEQ ID NO: 8549964 - DNA, 22 bp, Homo sapiens
ggcctctggggtcctgagccca

SEQ ID NO: 8549965 - DNA, 18 bp, Homo sapiens
ggcctctggactggcagc

SEQ ID NO: 8549966 - DNA, 18 bp, Homo sapiens
ggcctctggactggcagc

SEQ ID NO: 8549967 - DNA, 22 bp, Homo sapiens
ggcctctgcttatgctgatgac

SEQ ID NO: 8549968 - DNA, 18 bp, Homo sapiens
ggcctctggactggcagc

SEQ ID NO: 8549969 - DNA, 18 bp, Homo sapiens
ggcctctggactggcagc

SEQ ID NO: 8549970 - DNA, 18 bp, Homo sapiens
ggcctctggactggcagc

SEQ ID NO: 8549971 - DNA, 18 bp, Homo sapiens
ggcctctggactggcagc

SEQ ID NO: 8549972 - DNA, 22 bp, Homo sapiens
ggcctctggcaggcaggccctc

SEQ ID NO: 8549973 - DNA, 22 bp, Homo sapiens
ggcctctggcaggcaggccctc

SEQ ID NO: 8549974 - DNA, 22 bp, Homo sapiens
ggcctctggcaggcaggccctc

SEQ ID NO: 8549975 - DNA, 22 bp, Homo sapiens
ggctagggaaaatgattggata

SEQ ID NO: 8549976 - DNA, 22 bp, Homo sapiens
ggctagggaaaatgattggata

SEQ ID NO: 8549977 - DNA, 22 bp, Homo sapiens
ggctcactgcaacttccgcctc

SEQ ID NO: 8549978 - DNA, 22 bp, Homo sapiens
ggctcactgcaacttccgcctc

SEQ ID NO: 8549979 - DNA, 22 bp, Homo sapiens
ggctcactgcaacctctgcctc

SEQ ID NO: 8549980 - DNA, 22 bp, Homo sapiens
ggctcacgcaattatcccggcc

SEQ ID NO: 8549981 - DNA, 22 bp, Homo sapiens
ggctcacgcaattatcccggcc

SEQ ID NO: 8549982 - DNA, 22 bp, Homo sapiens
ggctcacgcaattatcccggcc

SEQ ID NO: 8549983 - DNA, 22 bp, Homo sapiens
ggctcagaaactaaaggcgctg

SEQ ID NO: 8549984 - DNA, 22 bp, Homo sapiens
ggctcagaaacctctggtgtct

SEQ ID NO: 8549985 - DNA, 22 bp, Homo sapiens
ggctcagaaggccatgctctgc

SEQ ID NO: 8549986 - DNA, 22 bp, Homo sapiens
ggctcactgcaacttccgcctc

SEQ ID NO: 8549987 - DNA, 23 bp, Homo sapiens
ggctcagaaaaagtcctggcctc

SEQ ID NO: 8549988 - DNA, 22 bp, Homo sapiens
ggctcagacctcccagctccag

SEQ ID NO: 8549989 - DNA, 22 bp, Homo sapiens
ggctcagactcccaggccctct

SEQ ID NO: 8549990 - DNA, 22 bp, Homo sapiens
ggctcagaggccagcaggtaga

SEQ ID NO: 8549991 - DNA, 22 bp, Homo sapiens
ggctcagaggttgaggccggca

SEQ ID NO: 8549992 - DNA, 22 bp, Homo sapiens
ggctcagagacctgcgatctga

SEQ ID NO: 8549993 - DNA, 22 bp, Homo sapiens
ggctcagaggagctggaacggt

SEQ ID NO: 8549994 - DNA, 22 bp, Homo sapiens
ggctctctccttggctttcaga

SEQ ID NO: 8549995 - DNA, 22 bp, Homo sapiens
ggctcagattccgagtggccct

SEQ ID NO: 8549996 - DNA, 22 bp, Homo sapiens
ggctctctggaggagctcaccc

SEQ ID NO: 8549997 - DNA, 19 bp, Homo sapiens
ggctctcttaaagctgttt

SEQ ID NO: 8549998 - DNA, 22 bp, Homo sapiens
ggctctctgaggaaacccttcc

SEQ ID NO: 8549999 - DNA, 22 bp, Homo sapiens
ggctctgaaattctcactttta

SEQ ID NO: 8550000 - DNA, 22 bp, Homo sapiens
ggctctgaacatggggaggagt

SEQ ID NO: 8550001 - DNA, 22 bp, Homo sapiens
ggctctgcctgcccagcagcac

SEQ ID NO: 8550002 - DNA, 22 bp, Homo sapiens
ggctctgcccgcggctgcccac

SEQ ID NO: 8550003 - DNA, 22 bp, Homo sapiens
ggctctgcccaggtggacagca

SEQ ID NO: 8550004 - DNA, 22 bp, Homo sapiens
ggctctgccatttcctagctgc

SEQ ID NO: 8550005 - DNA, 22 bp, Homo sapiens
ggctctgcccagatgaagagga

SEQ ID NO: 8550006 - DNA, 22 bp, Homo sapiens
ggctctgccacttcttggctgt

SEQ ID NO: 8550007 - DNA, 22 bp, Homo sapiens
ggctctgcagtgacttgagggg

SEQ ID NO: 8550008 - DNA, 22 bp, Homo sapiens
ggctctgcagtgacttgagggg

SEQ ID NO: 8550009 - DNA, 22 bp, Homo sapiens
ggctctgcatgtgagtgggtgg

SEQ ID NO: 8550010 - DNA, 22 bp, Homo sapiens
ttctggaagtgttagaatctgg

SEQ ID NO: 8550011 - DNA, 22 bp, Homo sapiens
ttctggaagttggaaatagcag

SEQ ID NO: 8550012 - DNA, 22 bp, Homo sapiens
ttctggaagtgttagaatctgg

SEQ ID NO: 8550013 - DNA, 22 bp, Homo sapiens
ttctggaatatttgacacaatt

SEQ ID NO: 8550014 - DNA, 22 bp, Homo sapiens
ttctggaatatttgacacaatt

SEQ ID NO: 8550015 - DNA, 22 bp, Homo sapiens
ttctggaatatttgacacaatt

SEQ ID NO: 8550016 - DNA, 22 bp, Homo sapiens
ttctggaatactaagttccttt

SEQ ID NO: 8550017 - DNA, 22 bp, Homo sapiens
ttctggaagttttctcctgtgg

SEQ ID NO: 8550018 - DNA, 22 bp, Homo sapiens
ttctggaaatgcacaactaatt

SEQ ID NO: 8550019 - DNA, 22 bp, Homo sapiens
ttctggaacatagcaagaagtt

SEQ ID NO: 8550020 - DNA, 22 bp, Homo sapiens
ttctggaacatagcaagaagtt

SEQ ID NO: 8550021 - DNA, 22 bp, Homo sapiens
ttctggaacatagcaagaagtt

SEQ ID NO: 8550022 - DNA, 22 bp, Homo sapiens
ttctggaaatgggtatagagca

SEQ ID NO: 8550023 - DNA, 22 bp, Homo sapiens
ttctggaaatgttgctgaggcc

SEQ ID NO: 8550024 - DNA, 22 bp, Homo sapiens
ttctctggacagtgaagagagg

SEQ ID NO: 8550025 - DNA, 22 bp, Homo sapiens
ttctctggacagtgaagagagg

SEQ ID NO: 8550026 - DNA, 22 bp, Homo sapiens
ttctctgggatctggcaaaagg

SEQ ID NO: 8550027 - DNA, 22 bp, Homo sapiens
ttctctgggacaggaacagttt

SEQ ID NO: 8550028 - DNA, 22 bp, Homo sapiens
ttctggaattcttgcagccact

SEQ ID NO: 8550029 - DNA, 22 bp, Homo sapiens
ttctggaatcctcaaaacatga

SEQ ID NO: 8550030 - DNA, 22 bp, Homo sapiens
ttctggacttgccttgctgatg

SEQ ID NO: 8550031 - DNA, 22 bp, Homo sapiens
ttctggagagaaaccttacaaa

SEQ ID NO: 8550032 - DNA, 22 bp, Homo sapiens
ttctggagatctgcctatggga

SEQ ID NO: 8550033 - DNA, 22 bp, Homo sapiens
ttctgtgtcttcttgttctgtg

SEQ ID NO: 8550034 - DNA, 22 bp, Homo sapiens
ttctgtgtcttcttgttctgtg

SEQ ID NO: 8550035 - DNA, 22 bp, Homo sapiens
ttctgtgtcttcttgttctgtg

SEQ ID NO: 8550036 - DNA, 22 bp, Homo sapiens
ttctgtgtgccagagttgtgct

SEQ ID NO: 8550037 - DNA, 22 bp, Homo sapiens
ttctgtgtgccagagttgtgct

SEQ ID NO: 8550038 - DNA, 22 bp, Homo sapiens
ttctgtgggtaatacctcatac

SEQ ID NO: 8550039 - DNA, 22 bp, Homo sapiens
ttctgtggtctcccatgtctgt

SEQ ID NO: 8550040 - DNA, 22 bp, Homo sapiens
ttctgtggcagtttgggaggtg

SEQ ID NO: 8550041 - DNA, 22 bp, Homo sapiens
ttctgtggctgggagcctggct

SEQ ID NO: 8550042 - DNA, 22 bp, Homo sapiens
ttctgtgactcctcagagattt

SEQ ID NO: 8550043 - DNA, 22 bp, Homo sapiens
ttctgtgaggacttctcaagga

SEQ ID NO: 8550044 - DNA, 22 bp, Homo sapiens
ttctgtgaatggccatgacaag

SEQ ID NO: 8550045 - DNA, 22 bp, Homo sapiens
ttctgtgactcctcagagattt

SEQ ID NO: 8550046 - DNA, 22 bp, Homo sapiens
ttctgtgaatcttttttcccac

SEQ ID NO: 8550047 - DNA, 22 bp, Homo sapiens
ttctgtgactcctcagagattt

SEQ ID NO: 8550048 - DNA, 22 bp, Homo sapiens
ttctgtcttcccactgaggagc

SEQ ID NO: 8550049 - DNA, 22 bp, Homo sapiens
ttctgtcttcccactgaggagc

SEQ ID NO: 8550050 - DNA, 22 bp, Homo sapiens
ttctgtcttctcggttgtttac

SEQ ID NO: 8550051 - DNA, 22 bp, Homo sapiens
ttctgtgaaactaaagagagga

SEQ ID NO: 8550052 - DNA, 23 bp, Homo sapiens
ttctgtcttgctgtcagctttct

SEQ ID NO: 8550053 - DNA, 22 bp, Homo sapiens
ttctgtctgtaaacttctcaat

SEQ ID NO: 8550054 - DNA, 22 bp, Homo sapiens
ttctgtctgtaaacttctcaat

SEQ ID NO: 8550055 - DNA, 22 bp, Homo sapiens
ttctgtctgtaaacttctcaat

SEQ ID NO: 8550056 - DNA, 22 bp, Homo sapiens
ttctgtctgatggtgccagaac

SEQ ID NO: 8550057 - DNA, 22 bp, Homo sapiens
ttctgtctggaaaaggacatag

SEQ ID NO: 8550058 - DNA, 22 bp, Homo sapiens
ttctgtctggaaaaggacatag

SEQ ID NO: 8550059 - DNA, 22 bp, Homo sapiens
ttctgtctctgtgtttacatta

SEQ ID NO: 8550060 - DNA, 22 bp, Homo sapiens
ttctgtctgatggtgccagaac

SEQ ID NO: 8550061 - DNA, 22 bp, Homo sapiens
ttctgtctctgtgtttacatta

SEQ ID NO: 8550062 - DNA, 22 bp, Homo sapiens
ttctgtgtgcttactggtgttc

SEQ ID NO: 8550063 - DNA, 22 bp, Homo sapiens
ttctgtgtgcttactggtgttc

SEQ ID NO: 8550064 - DNA, 22 bp, Homo sapiens
ttctgtgtgggtagctcctgtt

SEQ ID NO: 8550065 - DNA, 22 bp, Homo sapiens
ttctgtgtgctgtcttggcttt

SEQ ID NO: 8550066 - DNA, 22 bp, Homo sapiens
ttctgtgtgccagagttgtgct

SEQ ID NO: 8550067 - DNA, 22 bp, Homo sapiens
ttctgtgtgccagagttgtgct

SEQ ID NO: 8550068 - DNA, 22 bp, Homo sapiens
ttctgtgtgccagagttgtgct

SEQ ID NO: 8550069 - DNA, 22 bp, Homo sapiens
ttctgtgtgggtagctcctgtt

SEQ ID NO: 8550070 - DNA, 22 bp, Homo sapiens
ttctgtgtgcttactggtgttc

SEQ ID NO: 8550071 - DNA, 22 bp, Homo sapiens
ttctgtgtgtctcagcaagctg

SEQ ID NO: 8550072 - DNA, 19 bp, Homo sapiens
ttctgtgttaattccttta

SEQ ID NO: 8550073 - DNA, 19 bp, Homo sapiens
ttctgtgttaattccttta

SEQ ID NO: 8550074 - DNA, 22 bp, Homo sapiens
ttcttacattactttacatgtg

SEQ ID NO: 8550075 - DNA, 22 bp, Homo sapiens
ttcttacattactttacatgtg

SEQ ID NO: 8550076 - DNA, 22 bp, Homo sapiens
ttcttacattactttacatgtg

SEQ ID NO: 8550077 - DNA, 22 bp, Homo sapiens
ttcttacattactttacatgtg

SEQ ID NO: 8550078 - DNA, 22 bp, Homo sapiens
ttctgttacaagtgaaaaaatg

SEQ ID NO: 8550079 - DNA, 22 bp, Homo sapiens
ttcttacattagtctgtgcttt

SEQ ID NO: 8550080 - DNA, 22 bp, Homo sapiens
ttcttactagtatgtttcagca

SEQ ID NO: 8550081 - DNA, 22 bp, Homo sapiens
ttctgtgttctgtgcaatgagc

SEQ ID NO: 8550082 - DNA, 19 bp, Homo sapiens
ttctgtgttaattccttta

SEQ ID NO: 8550083 - DNA, 22 bp, Homo sapiens
ttctgtgttgtgacattctaga

SEQ ID NO: 8550084 - DNA, 22 bp, Homo sapiens
ttctgtgttgtgacattctaga

SEQ ID NO: 8550085 - DNA, 22 bp, Homo sapiens
ttctgtgttgtgacattctaga

SEQ ID NO: 8550086 - DNA, 22 bp, Homo sapiens
ttcttagtggtagtcatctttg

SEQ ID NO: 8550087 - DNA, 19 bp, Homo sapiens
ttcttagtctcatgcatga

SEQ ID NO: 8550088 - DNA, 22 bp, Homo sapiens
ttcttaggactagtatagcatg

SEQ ID NO: 8550089 - DNA, 22 bp, Homo sapiens
ttcttagatgattaatgatggg

SEQ ID NO: 8550090 - DNA, 22 bp, Homo sapiens
ttcttataagttaatatttcca

SEQ ID NO: 8550091 - DNA, 22 bp, Homo sapiens
ttcttagttcaactaaaattta

SEQ ID NO: 8550092 - DNA, 22 bp, Homo sapiens
ttcttatgttcacataattcca

SEQ ID NO: 8550093 - DNA, 22 bp, Homo sapiens
ttcttattgggagaccttttct

SEQ ID NO: 8550094 - DNA, 22 bp, Homo sapiens
ttcttattttcctgaggaagaa

SEQ ID NO: 8550095 - DNA, 22 bp, Homo sapiens
ttcttatttcccccttcatcat

SEQ ID NO: 8550096 - DNA, 22 bp, Homo sapiens
ttcttattcttgaaatgtggga

SEQ ID NO: 8550097 - DNA, 22 bp, Homo sapiens
ttcttattgggagaccttttct

SEQ ID NO: 8550098 - DNA, 22 bp, Homo sapiens
ttcttattcttgaaatgtggga

SEQ ID NO: 8550099 - DNA, 22 bp, Homo sapiens
ttcttattatgtgctctgtgaa

SEQ ID NO: 8550100 - DNA, 22 bp, Homo sapiens
ttcttattatgtgctctgtgaa

SEQ ID NO: 8550101 - DNA, 22 bp, Homo sapiens
ttcttcaaaacaacactggcct

SEQ ID NO: 8550102 - DNA, 22 bp, Homo sapiens
ttcttcaaaatccagcatgatt

SEQ ID NO: 8550103 - DNA, 22 bp, Homo sapiens
ttcttcaaaatccagcatgatt

SEQ ID NO: 8550104 - DNA, 22 bp, Homo sapiens
ttcttcaaaacaacactggcct

SEQ ID NO: 8550105 - DNA, 22 bp, Homo sapiens
ttcttcaaagtaatagagacta

SEQ ID NO: 8550106 - DNA, 22 bp, Homo sapiens
ttcttcaaccatctacataaac

SEQ ID NO: 8550107 - DNA, 22 bp, Homo sapiens
ttcttcaacaaggacactgtta

SEQ ID NO: 8550108 - DNA, 22 bp, Homo sapiens
ttcttcaaagtaatagagacta

SEQ ID NO: 8550109 - DNA, 22 bp, Homo sapiens
ttcttcaattttccatatactg

SEQ ID NO: 8550110 - DNA, 22 bp, Homo sapiens
ttcttcaattattggaaagaaa

SEQ ID NO: 8550111 - DNA, 22 bp, Homo sapiens
ttcttcaataaattcccataag

SEQ ID NO: 8550112 - DNA, 22 bp, Homo sapiens
ttctttgttgtactttcctaca

SEQ ID NO: 8550113 - DNA, 22 bp, Homo sapiens
ttctttgtttgataagtatgct

SEQ ID NO: 8550114 - DNA, 20 bp, Homo sapiens
ttctttgttccttacatttg

SEQ ID NO: 8550115 - DNA, 22 bp, Homo sapiens
ttctttgtggcagtgagctggg

SEQ ID NO: 8550116 - DNA, 20 bp, Homo sapiens
ttctttgttccttacatttg

SEQ ID NO: 8550117 - DNA, 20 bp, Homo sapiens
ttctttgttccttacatttg

SEQ ID NO: 8550118 - DNA, 22 bp, Homo sapiens
ttctttgtaaagccacagtcct

SEQ ID NO: 8550119 - DNA, 22 bp, Homo sapiens
ttctttggtgttacccagctca

SEQ ID NO: 8550120 - DNA, 22 bp, Homo sapiens
ttctttggtgttacccagctca

SEQ ID NO: 8550121 - DNA, 22 bp, Homo sapiens
ttctttgtgcatccaattttct

SEQ ID NO: 8550122 - DNA, 22 bp, Homo sapiens
ttctttgtgctgaagaagccct

SEQ ID NO: 8550123 - DNA, 17 bp, Homo sapiens
ttcttttctgagccttg

SEQ ID NO: 8550124 - DNA, 22 bp, Homo sapiens
ttcttttctgcagctggtattt

SEQ ID NO: 8550125 - DNA, 22 bp, Homo sapiens
ttcttttctgcagctggtattt

SEQ ID NO: 8550126 - DNA, 22 bp, Homo sapiens
ttcttttctgcagctggtattt

SEQ ID NO: 8550127 - DNA, 22 bp, Homo sapiens
ttcttttcttggcaggagtaga

SEQ ID NO: 8550128 - DNA, 22 bp, Homo sapiens
ttcttttctgcagctggtattt

SEQ ID NO: 8550129 - DNA, 17 bp, Homo sapiens
ttcttttctgagccttg

SEQ ID NO: 8550130 - DNA, 22 bp, Homo sapiens
ttcttttaatgttctgaagttt

SEQ ID NO: 8550131 - DNA, 22 bp, Homo sapiens
ttcttttaatgttctgaagttt

SEQ ID NO: 8550132 - DNA, 22 bp, Homo sapiens
ttcttttaatgtctggctttca

SEQ ID NO: 8550133 - DNA, 22 bp, Homo sapiens
ttcttttaatgttctgaagttt

SEQ ID NO: 8550134 - DNA, 22 bp, Homo sapiens
ttcttttaatagagatcctgtg

SEQ ID NO: 8550135 - DNA, 22 bp, Homo sapiens
ttcttttaatgtctggctttca

SEQ ID NO: 8550136 - DNA, 22 bp, Homo sapiens
ttgaaatggaagtgaaaattct

SEQ ID NO: 8550137 - DNA, 22 bp, Homo sapiens
ttgaaatgctctttggaatcta

SEQ ID NO: 8550138 - DNA, 22 bp, Homo sapiens
ttgaaatgagcaaactgtcagc

SEQ ID NO: 8550139 - DNA, 22 bp, Homo sapiens
ttgaaatgagactaattgattg

SEQ ID NO: 8550140 - DNA, 22 bp, Homo sapiens
ttgaaatatggattgaccttga

SEQ ID NO: 8550141 - DNA, 22 bp, Homo sapiens
ttgaaatatttgggagtgtttg

SEQ ID NO: 8550142 - DNA, 22 bp, Homo sapiens
ttgaaagggatatatctttctg

SEQ ID NO: 8550143 - DNA, 22 bp, Homo sapiens
ttgaaagggttaaagtggtaaa

SEQ ID NO: 8550144 - DNA, 22 bp, Homo sapiens
ttgaaaggcctgtttatccagc

SEQ ID NO: 8550145 - DNA, 22 bp, Homo sapiens
ttgaaaggaatacagaggccta

SEQ ID NO: 8550146 - DNA, 22 bp, Homo sapiens
ttgaaaggcacaggcacctggg

SEQ ID NO: 8550147 - DNA, 22 bp, Homo sapiens
ttctttttaaagtgtgtatgca

SEQ ID NO: 8550148 - DNA, 22 bp, Homo sapiens
ttctttttaaagtgtgtatgca

SEQ ID NO: 8550149 - DNA, 22 bp, Homo sapiens
ttcttttgggaattacgtatgc

SEQ ID NO: 8550150 - DNA, 22 bp, Homo sapiens
ttcttttctttaggcattgtgt

SEQ ID NO: 8550151 - DNA, 22 bp, Homo sapiens
ttcttttcttggcaggagtaga

SEQ ID NO: 8550152 - DNA, 22 bp, Homo sapiens
ttcttttcttggcaggagtaga

SEQ ID NO: 8550153 - DNA, 22 bp, Homo sapiens
ttcttttctttaggcattgtgt

SEQ ID NO: 8550154 - DNA, 22 bp, Homo sapiens
ttcttttggactcaaagagaac

SEQ ID NO: 8550155 - DNA, 22 bp, Homo sapiens
ttgaacaatcaaaagaattcat

SEQ ID NO: 8550156 - DNA, 22 bp, Homo sapiens
ttgaacaatttggtatacaaac

SEQ ID NO: 8550157 - DNA, 22 bp, Homo sapiens
ttgaacaatttggtatacaaac

SEQ ID NO: 8550158 - DNA, 22 bp, Homo sapiens
ttgaacattaacttcagtctat

SEQ ID NO: 8550159 - DNA, 22 bp, Homo sapiens
ttgaacattaacttcagtctat

SEQ ID NO: 8550160 - DNA, 22 bp, Homo sapiens
ttgaacagttttgtcaggttca

SEQ ID NO: 8550161 - DNA, 22 bp, Homo sapiens
ttgaacagctgttacattgtta

SEQ ID NO: 8550162 - DNA, 22 bp, Homo sapiens
ttgaacagtcctaagagaccct

SEQ ID NO: 8550163 - DNA, 19 bp, Homo sapiens
ttgaacactttcttcaagg

SEQ ID NO: 8550164 - DNA, 22 bp, Homo sapiens
ttgaacactaagtttccaggct

SEQ ID NO: 8550165 - DNA, 22 bp, Homo sapiens
ttgaaatggcagcagctgacct

SEQ ID NO: 8550166 - DNA, 19 bp, Homo sapiens
ttgaaattgtttgatatgg

SEQ ID NO: 8550167 - DNA, 19 bp, Homo sapiens
ttgaaattgtttgatatgg

SEQ ID NO: 8550168 - DNA, 22 bp, Homo sapiens
ttgaattggcaaaactgcagct

SEQ ID NO: 8550169 - DNA, 21 bp, Homo sapiens
ttgaattgtatgattaaactg

SEQ ID NO: 8550170 - DNA, 21 bp, Homo sapiens
ttgaattgtatgattaaactg

SEQ ID NO: 8550171 - DNA, 19 bp, Homo sapiens
ttgaattgttttgagtagg

SEQ ID NO: 8550172 - DNA, 18 bp, Homo sapiens
ttgaattcttctacatgt

SEQ ID NO: 8550173 - DNA, 22 bp, Homo sapiens
ttgaattgaaacataccctggt

SEQ ID NO: 8550174 - DNA, 22 bp, Homo sapiens
ttgaactttgaaccattcctat

SEQ ID NO: 8550175 - DNA, 22 bp, Homo sapiens
ttgaactctggacccatgccag

SEQ ID NO: 8550176 - DNA, 22 bp, Homo sapiens
ttgaactaataggtatcttgta

SEQ ID NO: 8550177 - DNA, 22 bp, Homo sapiens
ttgaacattggcaatttcatat

SEQ ID NO: 8550178 - DNA, 18 bp, Homo sapiens
ttccttctgatgtatatg

SEQ ID NO: 8550179 - DNA, 22 bp, Homo sapiens
ttccttctggaagcttcagggg

SEQ ID NO: 8550180 - DNA, 22 bp, Homo sapiens
ttccttctggagcccggggagc

SEQ ID NO: 8550181 - DNA, 22 bp, Homo sapiens
ttccttcttcattgtgttacag

SEQ ID NO: 8550182 - DNA, 22 bp, Homo sapiens
ttccttctggaggctccagggg

SEQ ID NO: 8550183 - DNA, 22 bp, Homo sapiens
ttccttctggaggctccagggg

SEQ ID NO: 8550184 - DNA, 22 bp, Homo sapiens
ttccttcttccaaacccatcat

SEQ ID NO: 8550185 - DNA, 22 bp, Homo sapiens
ttccttcttccaaacccatcat

SEQ ID NO: 8550186 - DNA, 22 bp, Homo sapiens
ttccttcttccaaacccatcat

SEQ ID NO: 8550187 - DNA, 22 bp, Homo sapiens
ttccttcttccagaggctgccc

SEQ ID NO: 8550188 - DNA, 22 bp, Homo sapiens
ttccttcttccagaggctgccc

SEQ ID NO: 8550189 - DNA, 22 bp, Homo sapiens
ttccttcttcctttagtaacca

SEQ ID NO: 8550190 - DNA, 22 bp, Homo sapiens
ttccttcttgtaatgatctgcc

SEQ ID NO: 8550191 - DNA, 22 bp, Homo sapiens
ttccttgaccactgcataatga

SEQ ID NO: 8550192 - DNA, 22 bp, Homo sapiens
ttccttgaatgagtcatggaaa

SEQ ID NO: 8550193 - DNA, 22 bp, Homo sapiens
ttccttgaaagtttgaactgac

SEQ ID NO: 8550194 - DNA, 22 bp, Homo sapiens
ttccttcttttacaccataaat

SEQ ID NO: 8550195 - DNA, 22 bp, Homo sapiens
ttccttctttgtggtagaaagt

SEQ ID NO: 8550196 - DNA, 22 bp, Homo sapiens
ttccttggagttaagaccctgg

SEQ ID NO: 8550197 - DNA, 22 bp, Homo sapiens
ttcctggttggattctgattaa

SEQ ID NO: 8550198 - DNA, 22 bp, Homo sapiens
ttcctggtttatacctgtatca

SEQ ID NO: 8550199 - DNA, 22 bp, Homo sapiens
ttcctggtgacctcactggtag

SEQ ID NO: 8550200 - DNA, 22 bp, Homo sapiens
ttcctggtgagatttcgttctg

SEQ ID NO: 8550201 - DNA, 22 bp, Homo sapiens
ttcctggtgacctcactggtag

SEQ ID NO: 8550202 - DNA, 22 bp, Homo sapiens
ttcctggtgagatttcgttctg

SEQ ID NO: 8550203 - DNA, 22 bp, Homo sapiens
ttcctggtcctattatatacac

SEQ ID NO: 8550204 - DNA, 22 bp, Homo sapiens
ttcctggtcccgttcttcactg

SEQ ID NO: 8550205 - DNA, 22 bp, Homo sapiens
ttcctggtcccgttcttcactg

SEQ ID NO: 8550206 - DNA, 22 bp, Homo sapiens
ttcctggtctatttagaattgc

SEQ ID NO: 8550207 - DNA, 22 bp, Homo sapiens
ttcctggtctgtgccattcaga

SEQ ID NO: 8550208 - DNA, 22 bp, Homo sapiens
ttcctggtctgtgccattcaga

SEQ ID NO: 8550209 - DNA, 22 bp, Homo sapiens
ttcctggtaacaatctcaaagt

SEQ ID NO: 8550210 - DNA, 22 bp, Homo sapiens
ttcctggtaaattatgtccagg

SEQ ID NO: 8550211 - DNA, 22 bp, Homo sapiens
ttcctggtaaattatgtccagg

SEQ ID NO: 8550212 - DNA, 22 bp, Homo sapiens
ttcctggtagtaagacatctgg

SEQ ID NO: 8550213 - DNA, 22 bp, Homo sapiens
ttcctggtcactgctgttccct

SEQ ID NO: 8550214 - DNA, 22 bp, Homo sapiens
ttcctggtagtaagacatctgg

SEQ ID NO: 8550215 - DNA, 22 bp, Homo sapiens
ttcctggggggatagatttcac

SEQ ID NO: 8550216 - DNA, 22 bp, Homo sapiens
ttcctggggtgaagatattttt

SEQ ID NO: 8550217 - DNA, 22 bp, Homo sapiens
ttcctggggtactggagaaaat

SEQ ID NO: 8550218 - DNA, 22 bp, Homo sapiens
ttcctggggctccagctaccag

SEQ ID NO: 8550219 - DNA, 22 bp, Homo sapiens
ttcctgggggcagcagtcttga

SEQ ID NO: 8550220 - DNA, 22 bp, Homo sapiens
ttcctgggggcagcagtcttga

SEQ ID NO: 8550221 - DNA, 22 bp, Homo sapiens
ttcctgggttccctctcattct

SEQ ID NO: 8550222 - DNA, 22 bp, Homo sapiens
ttcctgggttgtgcattgtaca

SEQ ID NO: 8550223 - DNA, 19 bp, Homo sapiens
ttcctggggttccattgtg

SEQ ID NO: 8550224 - DNA, 19 bp, Homo sapiens
ttcctggggttccattgtg

SEQ ID NO: 8550225 - DNA, 22 bp, Homo sapiens
ttcctgggtggtcctggtagag

SEQ ID NO: 8550226 - DNA, 22 bp, Homo sapiens
ttcctggccccacccctggaga

SEQ ID NO: 8550227 - DNA, 22 bp, Homo sapiens
ttcctggccaagcagagtggaa

SEQ ID NO: 8550228 - DNA, 22 bp, Homo sapiens
ttcctggcctctctctgagcag

SEQ ID NO: 8550229 - DNA, 22 bp, Homo sapiens
ttcctggggcgactgtatctga

SEQ ID NO: 8550230 - DNA, 22 bp, Homo sapiens
ttcctgcttcctggcctcacaa

SEQ ID NO: 8550231 - DNA, 22 bp, Homo sapiens
ttcctgctccatttgctgagct

SEQ ID NO: 8550232 - DNA, 22 bp, Homo sapiens
ttcctgctccatttgctgagct

SEQ ID NO: 8550233 - DNA, 22 bp, Homo sapiens
ttcctgcctacatgccttatgc

SEQ ID NO: 8550234 - DNA, 22 bp, Homo sapiens
ttcctgcctacatgccttatgc

SEQ ID NO: 8550235 - DNA, 22 bp, Homo sapiens
ttcctggcaaagtgagcatcac

SEQ ID NO: 8550236 - DNA, 22 bp, Homo sapiens
ttcctggcacatagttagtgct

SEQ ID NO: 8550237 - DNA, 22 bp, Homo sapiens
ttcctggcaccaccacttctag

SEQ ID NO: 8550238 - DNA, 22 bp, Homo sapiens
ttcctggagagttttcccaaag

SEQ ID NO: 8550239 - DNA, 21 bp, Homo sapiens
ttcctggaggcagaaacgtga

SEQ ID NO: 8550240 - DNA, 21 bp, Homo sapiens
ttcctggaggcagaaacgtga

SEQ ID NO: 8550241 - DNA, 22 bp, Homo sapiens
ttcctggaaattatgctcacct

SEQ ID NO: 8550242 - DNA, 17 bp, Homo sapiens
ttcctggaagtcattcc

SEQ ID NO: 8550243 - DNA, 17 bp, Homo sapiens
ttcctggaagtcattcc

SEQ ID NO: 8550244 - DNA, 22 bp, Homo sapiens
ttcctgagtcgccgagtctatg

SEQ ID NO: 8550245 - DNA, 23 bp, Homo sapiens
ttcctgagtgctggagagagtgc

SEQ ID NO: 8550246 - DNA, 22 bp, Homo sapiens
ttcctgatcccccaggacaaag

SEQ ID NO: 8550247 - DNA, 22 bp, Homo sapiens
ttcctgatgcacacagtcattt

SEQ ID NO: 8550248 - DNA, 22 bp, Homo sapiens
ttcctgagggacttttgagatt

SEQ ID NO: 8550249 - DNA, 22 bp, Homo sapiens
ttcctgagggacttttgagatt

SEQ ID NO: 8550250 - DNA, 22 bp, Homo sapiens
ttcctgaggctcatcggagtcg

SEQ ID NO: 8550251 - DNA, 22 bp, Homo sapiens
ttcctgagggccccagaggagg

SEQ ID NO: 8550252 - DNA, 22 bp, Homo sapiens
ttcctgagggccccagaggagg

SEQ ID NO: 8550253 - DNA, 22 bp, Homo sapiens
ttcctgagtcccgggtaaagat

SEQ ID NO: 8550254 - DNA, 22 bp, Homo sapiens
ttcctgagtcccgggtaaagat

SEQ ID NO: 8550255 - DNA, 22 bp, Homo sapiens
ttcctgagtcccgggtaaagat

SEQ ID NO: 8550256 - DNA, 22 bp, Homo sapiens
ttcctgaggtgattctaatgtg

SEQ ID NO: 8550257 - DNA, 22 bp, Homo sapiens
ttcctgaggtgattctaatgtg

SEQ ID NO: 8550258 - DNA, 22 bp, Homo sapiens
ttccagttctggctttgccact

SEQ ID NO: 8550259 - DNA, 22 bp, Homo sapiens
ttccagttggagcctgccttta

SEQ ID NO: 8550260 - DNA, 17 bp, Homo sapiens
ttccagtttagtattgt

SEQ ID NO: 8550261 - DNA, 17 bp, Homo sapiens
ttccagtttagtattgt

SEQ ID NO: 8550262 - DNA, 22 bp, Homo sapiens
ttccagttggtagaatgtaagg

SEQ ID NO: 8550263 - DNA, 22 bp, Homo sapiens
ttcctgaatataaagacactag

SEQ ID NO: 8550264 - DNA, 22 bp, Homo sapiens
ttcctgaatgctgttgtgctgt

SEQ ID NO: 8550265 - DNA, 22 bp, Homo sapiens
ttcctgagaaatttgtacctgg

SEQ ID NO: 8550266 - DNA, 22 bp, Homo sapiens
ttcctgagaaatttgtacctgg

SEQ ID NO: 8550267 - DNA, 22 bp, Homo sapiens
ttcctgagaacatggcagctta

SEQ ID NO: 8550268 - DNA, 22 bp, Homo sapiens
ttcctgagaccctcacagtgat

SEQ ID NO: 8550269 - DNA, 22 bp, Homo sapiens
ttcctgagaccctcacagtgat

SEQ ID NO: 8550270 - DNA, 22 bp, Homo sapiens
ttcctgagcaccagacactgca

SEQ ID NO: 8550271 - DNA, 18 bp, Homo sapiens
ttctccagaaaacatagc

SEQ ID NO: 8550272 - DNA, 22 bp, Homo sapiens
ttctccacccactcttttgttg

SEQ ID NO: 8550273 - DNA, 22 bp, Homo sapiens
ttctccagacaacagagggtga

SEQ ID NO: 8550274 - DNA, 22 bp, Homo sapiens
ttctccaaggttcatatttatc

SEQ ID NO: 8550275 - DNA, 20 bp, Homo sapiens
ttctccacagggtggaggag

SEQ ID NO: 8550276 - DNA, 22 bp, Homo sapiens
ttctcagggtttgtgcaggctt

SEQ ID NO: 8550277 - DNA, 22 bp, Homo sapiens
ttctcaggtagtgctgatgctg

SEQ ID NO: 8550278 - DNA, 22 bp, Homo sapiens
ttctccagaccactgcctctgt

SEQ ID NO: 8550279 - DNA, 22 bp, Homo sapiens
ttctccagaccctcctgcagac

SEQ ID NO: 8550280 - DNA, 22 bp, Homo sapiens
ttctccagaccttgtgactatg

SEQ ID NO: 8550281 - DNA, 22 bp, Homo sapiens
ttctccagaccctcctgcagac

SEQ ID NO: 8550282 - DNA, 22 bp, Homo sapiens
ttctccagagggctctgcagga

SEQ ID NO: 8550283 - DNA, 22 bp, Homo sapiens
ttctccagaccttgtgactatg

SEQ ID NO: 8550284 - DNA, 22 bp, Homo sapiens
ttctccagaccttgtgactatg

SEQ ID NO: 8550285 - DNA, 22 bp, Homo sapiens
ttctccagagggctctgcagga

SEQ ID NO: 8550286 - DNA, 22 bp, Homo sapiens
ttctcctctgttggccttccct

SEQ ID NO: 8550287 - DNA, 22 bp, Homo sapiens
ttctcctctgttggccttccct

SEQ ID NO: 8550288 - DNA, 22 bp, Homo sapiens
ttctcctgagttcccaggtcta

SEQ ID NO: 8550289 - DNA, 23 bp, Homo sapiens
ttctcctgaggaagcagggactg

SEQ ID NO: 8550290 - DNA, 22 bp, Homo sapiens
ttctcctgagttcccaggtcta

SEQ ID NO: 8550291 - DNA, 22 bp, Homo sapiens
ttctctaagagttatatgaatt

SEQ ID NO: 8550292 - DNA, 22 bp, Homo sapiens
ttctcagatgattcagataaac

SEQ ID NO: 8550293 - DNA, 22 bp, Homo sapiens
ttctcagatgattcagataaac

SEQ ID NO: 8550294 - DNA, 22 bp, Homo sapiens
ttctcagattccccttttaata

SEQ ID NO: 8550295 - DNA, 22 bp, Homo sapiens
ttctcagattccccttttaata

SEQ ID NO: 8550296 - DNA, 22 bp, Homo sapiens
ttctcaggaactcagtgtcagc

SEQ ID NO: 8550297 - DNA, 22 bp, Homo sapiens
ttctcagggtctggatggcctg

SEQ ID NO: 8550298 - DNA, 22 bp, Homo sapiens
ttctcagctttccttgcagtta

SEQ ID NO: 8550299 - DNA, 22 bp, Homo sapiens
ttctcaggcctttgggatggga

SEQ ID NO: 8550300 - DNA, 21 bp, Homo sapiens
ttctcagatcgagtagtgaga

SEQ ID NO: 8550301 - DNA, 21 bp, Homo sapiens
ttctcagatcgagtagtgaga

SEQ ID NO: 8550302 - DNA, 22 bp, Homo sapiens
ttctcagatccatcagaagtcc

SEQ ID NO: 8550303 - DNA, 22 bp, Homo sapiens
ttctcagatccatcagaagtcc

SEQ ID NO: 8550304 - DNA, 22 bp, Homo sapiens
ttccttgtggaaactatggacg

SEQ ID NO: 8550305 - DNA, 22 bp, Homo sapiens
ttccttgttctacatccctgcc

SEQ ID NO: 8550306 - DNA, 22 bp, Homo sapiens
ttctctgagtacgtttcagtgt

SEQ ID NO: 8550307 - DNA, 17 bp, Homo sapiens
ttctctgagctgtattg

SEQ ID NO: 8550308 - DNA, 22 bp, Homo sapiens
ttctctgagatagactaagtgg

SEQ ID NO: 8550309 - DNA, 22 bp, Homo sapiens
ttctctgagatagactaagtgg

SEQ ID NO: 8550310 - DNA, 22 bp, Homo sapiens
ttctctgacccccttaaatatt

SEQ ID NO: 8550311 - DNA, 22 bp, Homo sapiens
ttctctgatcttgctagactga

SEQ ID NO: 8550312 - DNA, 22 bp, Homo sapiens
ttctctgatcttgctagactga

SEQ ID NO: 8550313 - DNA, 22 bp, Homo sapiens
ttctctgctctcacatacagaa

SEQ ID NO: 8550314 - DNA, 22 bp, Homo sapiens
ttctctgcctctagctatattc

SEQ ID NO: 8550315 - DNA, 22 bp, Homo sapiens
ttctctgcctcacaggtctaag

SEQ ID NO: 8550316 - DNA, 22 bp, Homo sapiens
ttctctggaaggctctacggga

SEQ ID NO: 8550317 - DNA, 22 bp, Homo sapiens
ttctctcttactgccatgctgt

SEQ ID NO: 8550318 - DNA, 22 bp, Homo sapiens
ttctctcttactgccatgctgt

SEQ ID NO: 8550319 - DNA, 22 bp, Homo sapiens
ttctctcttactgccatgctgt

SEQ ID NO: 8550320 - DNA, 22 bp, Homo sapiens
ttctctctgttatggattttac

SEQ ID NO: 8550321 - DNA, 22 bp, Homo sapiens
ttctctctgtgtcattatggac

SEQ ID NO: 8550322 - DNA, 22 bp, Homo sapiens
ttctctctgtgtcattatggac

SEQ ID NO: 8550323 - DNA, 22 bp, Homo sapiens
ttctctctgtggtcccattttg

SEQ ID NO: 8550324 - DNA, 22 bp, Homo sapiens
ttctctctgtggtcccattttg

SEQ ID NO: 8550325 - DNA, 22 bp, Homo sapiens
ttctctctggacctgggatgcg

SEQ ID NO: 8550326 - DNA, 22 bp, Homo sapiens
ttctctgaaggttgtggaacta

SEQ ID NO: 8550327 - DNA, 22 bp, Homo sapiens
ttctctgaaggccatgctcact

SEQ ID NO: 8550328 - DNA, 22 bp, Homo sapiens
ttctctgaaggccatgctcact

SEQ ID NO: 8550329 - DNA, 22 bp, Homo sapiens
ttctctcttttgggtaggaggt

SEQ ID NO: 8550330 - DNA, 22 bp, Homo sapiens
ttctctgaaggccatgctcact

SEQ ID NO: 8550331 - DNA, 22 bp, Homo sapiens
ttctctgaaggccatgctcact

SEQ ID NO: 8550332 - DNA, 22 bp, Homo sapiens
ttctctcttccagttcccactt

SEQ ID NO: 8550333 - DNA, 22 bp, Homo sapiens
ttctctcttactgccatgctgt

SEQ ID NO: 8550334 - DNA, 22 bp, Homo sapiens
ttctctcttccagttcccactt

SEQ ID NO: 8550335 - DNA, 22 bp, Homo sapiens
ttctctcctacccagtatccat

SEQ ID NO: 8550336 - DNA, 22 bp, Homo sapiens
ttctctcccatgaagcttctat

SEQ ID NO: 8550337 - DNA, 22 bp, Homo sapiens
ttctctctgagagcatctggaa

SEQ ID NO: 8550338 - DNA, 22 bp, Homo sapiens
ttctctctgagagcatctggaa

SEQ ID NO: 8550339 - DNA, 22 bp, Homo sapiens
ttctctcctcctagaggctttt

SEQ ID NO: 8550340 - DNA, 22 bp, Homo sapiens
ttctctctgagagcatctggaa

SEQ ID NO: 8550341 - DNA, 21 bp, Homo sapiens
ttctctccatatgcccagccc

SEQ ID NO: 8550342 - DNA, 22 bp, Homo sapiens
ttctctcattcaaattaaagtg

SEQ ID NO: 8550343 - DNA, 22 bp, Homo sapiens
ttctctcattcaaattaaagtg

SEQ ID NO: 8550344 - DNA, 22 bp, Homo sapiens
ttctctccagactgcagtgggt

SEQ ID NO: 8550345 - DNA, 22 bp, Homo sapiens
ttctctaggttttagatgaaga

SEQ ID NO: 8550346 - DNA, 22 bp, Homo sapiens
ttctctatgtgtgttgtagttt

SEQ ID NO: 8550347 - DNA, 19 bp, Homo sapiens
ttctctattatgtcttctc

SEQ ID NO: 8550348 - DNA, 22 bp, Homo sapiens
ttctctacttgagattttaatg

SEQ ID NO: 8550349 - DNA, 22 bp, Homo sapiens
ttctctaatggtgatgattaga

SEQ ID NO: 8550350 - DNA, 22 bp, Homo sapiens
ttattatagattatgcaagatt

SEQ ID NO: 8550351 - DNA, 22 bp, Homo sapiens
ttattataatgagggataaaaa

SEQ ID NO: 8550352 - DNA, 22 bp, Homo sapiens
ttattatggtatttctttgcag

SEQ ID NO: 8550353 - DNA, 22 bp, Homo sapiens
ttattatggtatttctttgcag

SEQ ID NO: 8550354 - DNA, 22 bp, Homo sapiens
ttattatggcagttttctaggt

SEQ ID NO: 8550355 - DNA, 22 bp, Homo sapiens
ttattatgccattacctccctg

SEQ ID NO: 8550356 - DNA, 22 bp, Homo sapiens
ttattctttaaacatatatgtt

SEQ ID NO: 8550357 - DNA, 22 bp, Homo sapiens
ttattatgtggatgaaagatgt

SEQ ID NO: 8550358 - DNA, 22 bp, Homo sapiens
ttattatgtgctagagaatgta

SEQ ID NO: 8550359 - DNA, 22 bp, Homo sapiens
ttattatgtggatgaaagatgt

SEQ ID NO: 8550360 - DNA, 22 bp, Homo sapiens
ttattatgtggatgaaagatgt

SEQ ID NO: 8550361 - DNA, 22 bp, Homo sapiens
ttattagtgttgatattaggat

SEQ ID NO: 8550362 - DNA, 22 bp, Homo sapiens
ttattataatgagggataaaaa

SEQ ID NO: 8550363 - DNA, 22 bp, Homo sapiens
ttattagatctgttagggatcc

SEQ ID NO: 8550364 - DNA, 22 bp, Homo sapiens
ttattactgtattaatccagag

SEQ ID NO: 8550365 - DNA, 22 bp, Homo sapiens
ttattagagtgctttgagaaag

SEQ ID NO: 8550366 - DNA, 22 bp, Homo sapiens
ttattacactgaaagaattgcg

SEQ ID NO: 8550367 - DNA, 22 bp, Homo sapiens
ttattacactgaaagaattgcg

SEQ ID NO: 8550368 - DNA, 22 bp, Homo sapiens
ttattacactgaaagaattgcg

SEQ ID NO: 8550369 - DNA, 22 bp, Homo sapiens
ttatatatcttgatttgttcca

SEQ ID NO: 8550370 - DNA, 20 bp, Homo sapiens
ttatatcataatgtgccaat

SEQ ID NO: 8550371 - DNA, 22 bp, Homo sapiens
ttatatcagaaggtgagattga

SEQ ID NO: 8550372 - DNA, 22 bp, Homo sapiens
ttattaaaatgcggatttggct

SEQ ID NO: 8550373 - DNA, 22 bp, Homo sapiens
ttatatgattgaagtgcataag

SEQ ID NO: 8550374 - DNA, 22 bp, Homo sapiens
ttatatgaactggactttagga

SEQ ID NO: 8550375 - DNA, 22 bp, Homo sapiens
ttatatgagtatcatatcactt

SEQ ID NO: 8550376 - DNA, 22 bp, Homo sapiens
ttatatgagtatcatatcactt

SEQ ID NO: 8550377 - DNA, 22 bp, Homo sapiens
ttatatgagtatcatatcactt

SEQ ID NO: 8550378 - DNA, 22 bp, Homo sapiens
ttattaagtgcgtactgtatgc

SEQ ID NO: 8550379 - DNA, 22 bp, Homo sapiens
ttattaagtgcctacaataaag

SEQ ID NO: 8550380 - DNA, 22 bp, Homo sapiens
ttattaagtgcctacaataaag

SEQ ID NO: 8550381 - DNA, 22 bp, Homo sapiens
ttattaaaatgcggatttggct

SEQ ID NO: 8550382 - DNA, 22 bp, Homo sapiens
ttattaataaagtggcatagcc

SEQ ID NO: 8550383 - DNA, 22 bp, Homo sapiens
ttattaatacatgcacctgcat

SEQ ID NO: 8550384 - DNA, 22 bp, Homo sapiens
ttattacaatgcagaaaataga

SEQ ID NO: 8550385 - DNA, 22 bp, Homo sapiens
ttattacaatgcagaaaataga

SEQ ID NO: 8550386 - DNA, 22 bp, Homo sapiens
ttattaatgagtacaagttatt

SEQ ID NO: 8550387 - DNA, 22 bp, Homo sapiens
ttattaatcttatctttggaaa

SEQ ID NO: 8550388 - DNA, 22 bp, Homo sapiens
ttattgagcacctactatgtgt

SEQ ID NO: 8550389 - DNA, 22 bp, Homo sapiens
ttattgctgctaacattttatg

SEQ ID NO: 8550390 - DNA, 22 bp, Homo sapiens
ttattgggtcccaacaagttgc

SEQ ID NO: 8550391 - DNA, 22 bp, Homo sapiens
ttattgtaggcctattgtagaa

SEQ ID NO: 8550392 - DNA, 22 bp, Homo sapiens
ttattgtaggcctattgtagaa

SEQ ID NO: 8550393 - DNA, 22 bp, Homo sapiens
ttattgtcaaaaacaggacact

SEQ ID NO: 8550394 - DNA, 17 bp, Homo sapiens
ttattgtcaaggttcca

SEQ ID NO: 8550395 - DNA, 22 bp, Homo sapiens
ttattgaaggaactgaaataaa

SEQ ID NO: 8550396 - DNA, 22 bp, Homo sapiens
ttattgaaggaactgaaataaa

SEQ ID NO: 8550397 - DNA, 22 bp, Homo sapiens
ttattgaaggaactgaaataaa

SEQ ID NO: 8550398 - DNA, 21 bp, Homo sapiens
ttattgaatgtttaccgtgtg

SEQ ID NO: 8550399 - DNA, 21 bp, Homo sapiens
ttattgaatgtttaccgtgtg

SEQ ID NO: 8550400 - DNA, 22 bp, Homo sapiens
ttattgaaggaactgaaataaa

SEQ ID NO: 8550401 - DNA, 22 bp, Homo sapiens
ttattgaagcaagcttttctga

SEQ ID NO: 8550402 - DNA, 22 bp, Homo sapiens
ttattgaagcaagcttttctga

SEQ ID NO: 8550403 - DNA, 22 bp, Homo sapiens
ttattcttttctccagaatccc

SEQ ID NO: 8550404 - DNA, 22 bp, Homo sapiens
ttattcttttctccagaatccc

SEQ ID NO: 8550405 - DNA, 22 bp, Homo sapiens
ttattgaaatggaagctataac

SEQ ID NO: 8550406 - DNA, 22 bp, Homo sapiens
ttattgacttgtttgtcctggt

SEQ ID NO: 8550407 - DNA, 22 bp, Homo sapiens
ttcaaacacagacagcagcatg

SEQ ID NO: 8550408 - DNA, 22 bp, Homo sapiens
ttattgtgtcttggtttatctt

SEQ ID NO: 8550409 - DNA, 22 bp, Homo sapiens
ttattgtggactactgttctgg

SEQ ID NO: 8550410 - DNA, 22 bp, Homo sapiens
ttcaaacagatgactctgctct

SEQ ID NO: 8550411 - DNA, 22 bp, Homo sapiens
ttcaaacagatgactctgctct

SEQ ID NO: 8550412 - DNA, 22 bp, Homo sapiens
ttcaaacaggggtcagggagat

SEQ ID NO: 8550413 - DNA, 22 bp, Homo sapiens
ttcaaacactgttggcactggg

SEQ ID NO: 8550414 - DNA, 22 bp, Homo sapiens
ttcaaacactgctttgagaggg

SEQ ID NO: 8550415 - DNA, 22 bp, Homo sapiens
ttcaaacagtgtagaatatatg

SEQ ID NO: 8550416 - DNA, 22 bp, Homo sapiens
ttcaaacagttgcacaacttat

SEQ ID NO: 8550417 - DNA, 22 bp, Homo sapiens
ttcaaacagttgcacaacttat

SEQ ID NO: 8550418 - DNA, 22 bp, Homo sapiens
ttcaaaccttcacttgcagagt

SEQ ID NO: 8550419 - DNA, 22 bp, Homo sapiens
ttcaaacattcaaataaaccgg

SEQ ID NO: 8550420 - DNA, 22 bp, Homo sapiens
ttcaaactcttgctctgctagt

SEQ ID NO: 8550421 - DNA, 22 bp, Homo sapiens
ttcaaactctgagtagttctgc

SEQ ID NO: 8550422 - DNA, 22 bp, Homo sapiens
ttagctcagaaaatttaaactt

SEQ ID NO: 8550423 - DNA, 22 bp, Homo sapiens
ttagctaaactgtaactagaat

SEQ ID NO: 8550424 - DNA, 22 bp, Homo sapiens
ttagccattttatacaagtgta

SEQ ID NO: 8550425 - DNA, 22 bp, Homo sapiens
ttagccattgtcagcacatggc

SEQ ID NO: 8550426 - DNA, 22 bp, Homo sapiens
ttagctgtggaagcttcagcca

SEQ ID NO: 8550427 - DNA, 22 bp, Homo sapiens
ttagctgaaaaaattcatgcaa

SEQ ID NO: 8550428 - DNA, 22 bp, Homo sapiens
ttagctgagattaagtgaactt

SEQ ID NO: 8550429 - DNA, 22 bp, Homo sapiens
ttagctgcattatcaaagttat

SEQ ID NO: 8550430 - DNA, 22 bp, Homo sapiens
ttagctttcagcctttctcacc

SEQ ID NO: 8550431 - DNA, 22 bp, Homo sapiens
ttagctttcagcctttctcacc

SEQ ID NO: 8550432 - DNA, 22 bp, Homo sapiens
ttagccattaatgtcctgtgca

SEQ ID NO: 8550433 - DNA, 22 bp, Homo sapiens
ttagccatggactgaattgact

SEQ ID NO: 8550434 - DNA, 22 bp, Homo sapiens
ttagccatgtgggaaaaacagc

SEQ ID NO: 8550435 - DNA, 22 bp, Homo sapiens
ttagccattaaattacaaggtg

SEQ ID NO: 8550436 - DNA, 19 bp, Homo sapiens
ttagccatccacagtgaaa

SEQ ID NO: 8550437 - DNA, 22 bp, Homo sapiens
ttagccatgccctagaagagga

SEQ ID NO: 8550438 - DNA, 22 bp, Homo sapiens
ttagccatgccctagaagagga

SEQ ID NO: 8550439 - DNA, 22 bp, Homo sapiens
ttagccagtgaaatggagaaat

SEQ ID NO: 8550440 - DNA, 22 bp, Homo sapiens
ttagccatatagaaaaagagct

SEQ ID NO: 8550441 - DNA, 22 bp, Homo sapiens
ttagccatatagaaaaagagct

SEQ ID NO: 8550442 - DNA, 21 bp, Homo sapiens
tcctgctgctcctgtcgtgtt

SEQ ID NO: 8550443 - DNA, 22 bp, Homo sapiens
ttagccaggggagcagcttgtc

SEQ ID NO: 8550444 - DNA, 22 bp, Homo sapiens
tcctgctggactctgagtacaa

SEQ ID NO: 8550445 - DNA, 22 bp, Homo sapiens
ttagccaggggagcagcttgtc

SEQ ID NO: 8550446 - DNA, 22 bp, Homo sapiens
tcctgctgagcgtctgtcattt

SEQ ID NO: 8550447 - DNA, 22 bp, Homo sapiens
tcctgccttagagcaaggaaaa

SEQ ID NO: 8550448 - DNA, 22 bp, Homo sapiens
tcctgcctgtttacctgtactt

SEQ ID NO: 8550449 - DNA, 19 bp, Homo sapiens
tcctgcctggggccgcctg

SEQ ID NO: 8550450 - DNA, 19 bp, Homo sapiens
tcctgcctggggccgcctg

SEQ ID NO: 8550451 - DNA, 18 bp, Homo sapiens
tcctgcctgcgggctccc

SEQ ID NO: 8550452 - DNA, 18 bp, Homo sapiens
tcctgcctgcgggctccc

SEQ ID NO: 8550453 - DNA, 18 bp, Homo sapiens
tcctgcctgcgggctccc

SEQ ID NO: 8550454 - DNA, 22 bp, Homo sapiens
tcctgcctgcaatcccagcact

SEQ ID NO: 8550455 - DNA, 22 bp, Homo sapiens
tcctgcctgtttacctgtactt

SEQ ID NO: 8550456 - DNA, 22 bp, Homo sapiens
tcctgcctgtttacctgtactt

SEQ ID NO: 8550457 - DNA, 22 bp, Homo sapiens
tcctgcctgtttacctgtactt

SEQ ID NO: 8550458 - DNA, 18 bp, Homo sapiens
tcctgcctgtgccccagg

SEQ ID NO: 8550459 - DNA, 18 bp, Homo sapiens
tcctgcctgtgccccagg

SEQ ID NO: 8550460 - DNA, 18 bp, Homo sapiens
tcctgcctgtgccccagg

SEQ ID NO: 8550461 - DNA, 22 bp, Homo sapiens
ttatactaaaacgcattgaatt

SEQ ID NO: 8550462 - DNA, 22 bp, Homo sapiens
ttatacatgtgttttgagatga

SEQ ID NO: 8550463 - DNA, 22 bp, Homo sapiens
ttaggaaaggaacattgaaacg

SEQ ID NO: 8550464 - DNA, 22 bp, Homo sapiens
ttaggaaagggttttctaacag

SEQ ID NO: 8550465 - DNA, 22 bp, Homo sapiens
ttaggaaagggttttctaacag

SEQ ID NO: 8550466 - DNA, 22 bp, Homo sapiens
ttaggaaagggttttctaacag

SEQ ID NO: 8550467 - DNA, 22 bp, Homo sapiens
ttaggaaacgctgctattgact

SEQ ID NO: 8550468 - DNA, 21 bp, Homo sapiens
ttagctttctagaatctttgt

SEQ ID NO: 8550469 - DNA, 22 bp, Homo sapiens
ttagctttcatgaacctggtcg

SEQ ID NO: 8550470 - DNA, 22 bp, Homo sapiens
ttagctttggattgcatttagt

SEQ ID NO: 8550471 - DNA, 22 bp, Homo sapiens
ttagctttctttggcagacgtg

SEQ ID NO: 8550472 - DNA, 22 bp, Homo sapiens
ttagcttttaagtgtgctacat

SEQ ID NO: 8550473 - DNA, 22 bp, Homo sapiens
ttagcttttgagaatgatttct

SEQ ID NO: 8550474 - DNA, 22 bp, Homo sapiens
ttagcttttgagaatgatttct

SEQ ID NO: 8550475 - DNA, 22 bp, Homo sapiens
ttagcttttctctatgttggct

SEQ ID NO: 8550476 - DNA, 22 bp, Homo sapiens
ttagcttttcacttgcattatc

SEQ ID NO: 8550477 - DNA, 22 bp, Homo sapiens
ttaggaaaagaagacatttcta

SEQ ID NO: 8550478 - DNA, 22 bp, Homo sapiens
ttaggaaaagaagacatttcta

SEQ ID NO: 8550479 - DNA, 22 bp, Homo sapiens
ttaggaaaatggagtcctttta

SEQ ID NO: 8550480 - DNA, 22 bp, Homo sapiens
ttaggaaacgctgctattgact

SEQ ID NO: 8550481 - DNA, 19 bp, Homo sapiens
ttaggaaaccactttcctt

SEQ ID NO: 8550482 - DNA, 19 bp, Homo sapiens
ttaggaaaccactttcctt

SEQ ID NO: 8550483 - DNA, 22 bp, Homo sapiens
ttatagatgccttgagtaaatg

SEQ ID NO: 8550484 - DNA, 22 bp, Homo sapiens
ttatagcagcatgatttacaat

SEQ ID NO: 8550485 - DNA, 22 bp, Homo sapiens
ttatataaagataacttttctt

SEQ ID NO: 8550486 - DNA, 22 bp, Homo sapiens
ttatataaagataacttttctt

SEQ ID NO: 8550487 - DNA, 22 bp, Homo sapiens
ttatataaagataacttttctt

SEQ ID NO: 8550488 - DNA, 22 bp, Homo sapiens
ttatataaagataacttttctt

SEQ ID NO: 8550489 - DNA, 22 bp, Homo sapiens
ttatagttatgaaagactgagg

SEQ ID NO: 8550490 - DNA, 22 bp, Homo sapiens
ttatataaagataacttttctt

SEQ ID NO: 8550491 - DNA, 22 bp, Homo sapiens
ttatataaagataacttttctt

SEQ ID NO: 8550492 - DNA, 22 bp, Homo sapiens
ttatataactcaggtgggctca

SEQ ID NO: 8550493 - DNA, 22 bp, Homo sapiens
ttataggaaaagttctagaaaa

SEQ ID NO: 8550494 - DNA, 22 bp, Homo sapiens
ttataggcttagttctgtgtgt

SEQ ID NO: 8550495 - DNA, 21 bp, Homo sapiens
ttataggctggggtttgcttt

SEQ ID NO: 8550496 - DNA, 22 bp, Homo sapiens
ttataggccatctaagtaattt

SEQ ID NO: 8550497 - DNA, 22 bp, Homo sapiens
ttatagtattaggtactcaaca

SEQ ID NO: 8550498 - DNA, 22 bp, Homo sapiens
ttatagtatgtgcatatgtgtg

SEQ ID NO: 8550499 - DNA, 22 bp, Homo sapiens
ttatagttagtaggtcattaaa

SEQ ID NO: 8550500 - DNA, 22 bp, Homo sapiens
ttatagtgcataattaacatgg

SEQ ID NO: 8550501 - DNA, 22 bp, Homo sapiens
ttcatttgcactggattactgg

SEQ ID NO: 8550502 - DNA, 22 bp, Homo sapiens
ttcatttgcactggattactgg

SEQ ID NO: 8550503 - DNA, 22 bp, Homo sapiens
ttcatttgccatcagtgtaatg

SEQ ID NO: 8550504 - DNA, 23 bp, Homo sapiens
ttcatttaggagttcataagagc

SEQ ID NO: 8550505 - DNA, 22 bp, Homo sapiens
ttcatttattcagcaggtattt

SEQ ID NO: 8550506 - DNA, 22 bp, Homo sapiens
ttcatttaatttgtgtattaac

SEQ ID NO: 8550507 - DNA, 22 bp, Homo sapiens
ttcatttaatttgtgtattaac

SEQ ID NO: 8550508 - DNA, 22 bp, Homo sapiens
ttcatttaatcagaatctctaa

SEQ ID NO: 8550509 - DNA, 22 bp, Homo sapiens
ttcatttaatcagaatctctaa

SEQ ID NO: 8550510 - DNA, 22 bp, Homo sapiens
ttcattgtactttaagagatgc

SEQ ID NO: 8550511 - DNA, 22 bp, Homo sapiens
ttcattgtactttaagagatgc

SEQ ID NO: 8550512 - DNA, 22 bp, Homo sapiens
ttcattgtagcttgactaatta

SEQ ID NO: 8550513 - DNA, 22 bp, Homo sapiens
ttcattgtctctgtttgccttc

SEQ ID NO: 8550514 - DNA, 22 bp, Homo sapiens
ttcattgtgaacacattctgcc

SEQ ID NO: 8550515 - DNA, 22 bp, Homo sapiens
ttcattgtgaacacattctgcc

SEQ ID NO: 8550516 - DNA, 22 bp, Homo sapiens
ttcattgtgattcttggctagc

SEQ ID NO: 8550517 - DNA, 22 bp, Homo sapiens
ttcattgatttccttggaataa

SEQ ID NO: 8550518 - DNA, 22 bp, Homo sapiens
ttcattgatttccttggaataa

SEQ ID NO: 8550519 - DNA, 22 bp, Homo sapiens
ttcattgcattccagcctgggt

SEQ ID NO: 8550520 - DNA, 22 bp, Homo sapiens
ttcataatcaccaaaaactgga

SEQ ID NO: 8550521 - DNA, 22 bp, Homo sapiens
ttcagtgtgtgatacctgctgt

SEQ ID NO: 8550522 - DNA, 22 bp, Homo sapiens
ttcagtgtggtgcacagttttg

SEQ ID NO: 8550523 - DNA, 22 bp, Homo sapiens
ttcagtgtggtgcacagttttg

SEQ ID NO: 8550524 - DNA, 22 bp, Homo sapiens
ttcagtgttcttttctgttagc

SEQ ID NO: 8550525 - DNA, 22 bp, Homo sapiens
ttcagttcacatgtatcatggc

SEQ ID NO: 8550526 - DNA, 22 bp, Homo sapiens
ttcagttccttgtgcgaattcc

SEQ ID NO: 8550527 - DNA, 22 bp, Homo sapiens
ttcagttggccatacccctaga

SEQ ID NO: 8550528 - DNA, 22 bp, Homo sapiens
ttcagttccttatcatagggtt

SEQ ID NO: 8550529 - DNA, 22 bp, Homo sapiens
ttcagttttattgtactgctat

SEQ ID NO: 8550530 - DNA, 22 bp, Homo sapiens
ttcagttttctttagaatgtag

SEQ ID NO: 8550531 - DNA, 21 bp, Homo sapiens
ttcataaaccattctcatgca

SEQ ID NO: 8550532 - DNA, 21 bp, Homo sapiens
ttcataaaccattctcatgca

SEQ ID NO: 8550533 - DNA, 21 bp, Homo sapiens
ttcataaaccattctcatgca

SEQ ID NO: 8550534 - DNA, 22 bp, Homo sapiens
ttccagggttaatttatatggt

SEQ ID NO: 8550535 - DNA, 22 bp, Homo sapiens
ttccaggggcagcagtgatggt

SEQ ID NO: 8550536 - DNA, 22 bp, Homo sapiens
ttccaggggcagcagtgatggt

SEQ ID NO: 8550537 - DNA, 22 bp, Homo sapiens
ttccagggctaggtaatgggta

SEQ ID NO: 8550538 - DNA, 22 bp, Homo sapiens
ttccagggctaattcctgtgga

SEQ ID NO: 8550539 - DNA, 22 bp, Homo sapiens
ttccagggcagcaagtgaatgg

SEQ ID NO: 8550540 - DNA, 22 bp, Homo sapiens
ttccagggaagagcaaggcagt

SEQ ID NO: 8550541 - DNA, 22 bp, Homo sapiens
ttccaggcatgtcagacatagg

SEQ ID NO: 8550542 - DNA, 22 bp, Homo sapiens
ttccaggctgatgggccacagg

SEQ ID NO: 8550543 - DNA, 22 bp, Homo sapiens
ttccagtgactaagcttctgct

SEQ ID NO: 8550544 - DNA, 22 bp, Homo sapiens
ttccagttcccatgaggattaa

SEQ ID NO: 8550545 - DNA, 22 bp, Homo sapiens
ttccagttcactccatttctgg

SEQ ID NO: 8550546 - DNA, 22 bp, Homo sapiens
ttccagttaaggaagctattct

SEQ ID NO: 8550547 - DNA, 22 bp, Homo sapiens
ttccagttcaaattggccaata

SEQ ID NO: 8550548 - DNA, 22 bp, Homo sapiens
ttccagtctagtacctggatgc

SEQ ID NO: 8550549 - DNA, 22 bp, Homo sapiens
ttccagtctggcctgtgcttag

SEQ ID NO: 8550550 - DNA, 22 bp, Homo sapiens
ttccagtgaaacatgaggtgtg

SEQ ID NO: 8550551 - DNA, 18 bp, Homo sapiens
ttccagtagctgtatcac

SEQ ID NO: 8550552 - DNA, 22 bp, Homo sapiens
ttccagtccagggctgtttcca

SEQ ID NO: 8550553 - DNA, 22 bp, Homo sapiens
ttccaggaacagatgaaggttg

SEQ ID NO: 8550554 - DNA, 22 bp, Homo sapiens
ttcattttctttcacgctgctg

SEQ ID NO: 8550555 - DNA, 22 bp, Homo sapiens
ttcattttctttcacgctgctg

SEQ ID NO: 8550556 - DNA, 22 bp, Homo sapiens
ttcattttataaaccctgctga

SEQ ID NO: 8550557 - DNA, 22 bp, Homo sapiens
ttcattttataaaccctgctga

SEQ ID NO: 8550558 - DNA, 22 bp, Homo sapiens
ttcatttgttgacagagacatg

SEQ ID NO: 8550559 - DNA, 22 bp, Homo sapiens
ttcatttgttgacagagacatg

SEQ ID NO: 8550560 - DNA, 21 bp, Homo sapiens
ttcatttgttatagacaaagt

SEQ ID NO: 8550561 - DNA, 22 bp, Homo sapiens
ttcatttgtctgctatagatcc

SEQ ID NO: 8550562 - DNA, 22 bp, Homo sapiens
ttcatttgtctgctatagatcc

SEQ ID NO: 8550563 - DNA, 22 bp, Homo sapiens
ttcatttgtggtgaatgaagtg

SEQ ID NO: 8550564 - DNA, 23 bp, Homo sapiens
ttcatttgtctacttcacttgtt

SEQ ID NO: 8550565 - DNA, 22 bp, Homo sapiens
ttcatttgtctgctatagatcc

SEQ ID NO: 8550566 - DNA, 22 bp, Homo sapiens
ttcatttgtccaaatactatgt

SEQ ID NO: 8550567 - DNA, 22 bp, Homo sapiens
ttcatttgtccaaatactatgt

SEQ ID NO: 8550568 - DNA, 22 bp, Homo sapiens
ttcatttgccatcagtgtaatg

SEQ ID NO: 8550569 - DNA, 22 bp, Homo sapiens
ttcatttgccatcagtgtaatg

SEQ ID NO: 8550570 - DNA, 22 bp, Homo sapiens
ttcatttggcctctgcttaaaa

SEQ ID NO: 8550571 - DNA, 22 bp, Homo sapiens
ttcatttgtaactctgttaggg

SEQ ID NO: 8550572 - DNA, 22 bp, Homo sapiens
ttcatttgggatgagtcagaag

SEQ ID NO: 8550573 - DNA, 22 bp, Homo sapiens
ttcagagagaaaccagtgggaa

SEQ ID NO: 8550574 - DNA, 22 bp, Homo sapiens
ttcagagacatgttctagatca

SEQ ID NO: 8550575 - DNA, 22 bp, Homo sapiens
ttcagagagtttgtgagtcctt

SEQ ID NO: 8550576 - DNA, 22 bp, Homo sapiens
ttcagagatgacacctggtgtt

SEQ ID NO: 8550577 - DNA, 22 bp, Homo sapiens
ttcagagccacttcaagtctaa

SEQ ID NO: 8550578 - DNA, 22 bp, Homo sapiens
ttcagagcatctctaaagccag

SEQ ID NO: 8550579 - DNA, 22 bp, Homo sapiens
ttcagagaacttcatggaagag

SEQ ID NO: 8550580 - DNA, 22 bp, Homo sapiens
ttcagagaacttcatggaagag

SEQ ID NO: 8550581 - DNA, 22 bp, Homo sapiens
ttcagactttgtggggccctcc

SEQ ID NO: 8550582 - DNA, 22 bp, Homo sapiens
ttcagagaagcaaaggcagatt

SEQ ID NO: 8550583 - DNA, 22 bp, Homo sapiens
ttcagactgctggtgcttccct

SEQ ID NO: 8550584 - DNA, 23 bp, Homo sapiens
ttcagactgccttcagcattgtc

SEQ ID NO: 8550585 - DNA, 22 bp, Homo sapiens
ttcagactagacacatttcaag

SEQ ID NO: 8550586 - DNA, 22 bp, Homo sapiens
ttcagactagacacatttcaag

SEQ ID NO: 8550587 - DNA, 22 bp, Homo sapiens
ttcagagaaactgaggtttaga

SEQ ID NO: 8550588 - DNA, 22 bp, Homo sapiens
ttcagacttaaaagatcccagc

SEQ ID NO: 8550589 - DNA, 22 bp, Homo sapiens
ttcagacttcttgactggcttt

SEQ ID NO: 8550590 - DNA, 22 bp, Homo sapiens
ttcagactggctacattttcat

SEQ ID NO: 8550591 - DNA, 22 bp, Homo sapiens
ttcagactggctacattttcat

SEQ ID NO: 8550592 - DNA, 22 bp, Homo sapiens
ttcacaggatatatgtgcaggg

SEQ ID NO: 8550593 - DNA, 22 bp, Homo sapiens
ttcacaggagggtggatgcatg

SEQ ID NO: 8550594 - DNA, 22 bp, Homo sapiens
ttcacaggagggtggatgcatg

SEQ ID NO: 8550595 - DNA, 22 bp, Homo sapiens
ttcacaggcttggaggtggggg

SEQ ID NO: 8550596 - DNA, 22 bp, Homo sapiens
ttcacaggatatatgtgcaggg

SEQ ID NO: 8550597 - DNA, 22 bp, Homo sapiens
ttcacaggtgactggggataac

SEQ ID NO: 8550598 - DNA, 22 bp, Homo sapiens
ttcacagggccactggcaggag

SEQ ID NO: 8550599 - DNA, 22 bp, Homo sapiens
ttcacagggccactggcaggag

SEQ ID NO: 8550600 - DNA, 22 bp, Homo sapiens
ttcacagggcagcagctgagcc

SEQ ID NO: 8550601 - DNA, 22 bp, Homo sapiens
ttcacagggcagcagctgagcc

SEQ ID NO: 8550602 - DNA, 22 bp, Homo sapiens
ttcacagggcagcagctgagcc

SEQ ID NO: 8550603 - DNA, 22 bp, Homo sapiens
ttcagcaaccagaaaggctggg

SEQ ID NO: 8550604 - DNA, 22 bp, Homo sapiens
ttcagcaaatggcttgagataa

SEQ ID NO: 8550605 - DNA, 22 bp, Homo sapiens
ttcagcaaatggactgttcagg

SEQ ID NO: 8550606 - DNA, 22 bp, Homo sapiens
ttcagcaagtgtctctactgtc

SEQ ID NO: 8550607 - DNA, 21 bp, Homo sapiens
ttcagcaagcactctggacac

SEQ ID NO: 8550608 - DNA, 22 bp, Homo sapiens
ttcagcaagtgtctctactgtc

SEQ ID NO: 8550609 - DNA, 22 bp, Homo sapiens
ttcagcaactcaaacctattag

SEQ ID NO: 8550610 - DNA, 22 bp, Homo sapiens
ttcagcaagaccaccatgtacc

SEQ ID NO: 8550611 - DNA, 22 bp, Homo sapiens
ttcagtgtcacaagagcaagcc

SEQ ID NO: 8550612 - DNA, 18 bp, Homo sapiens
ttcagcagcagacacact

SEQ ID NO: 8550613 - DNA, 18 bp, Homo sapiens
ttcagcagcagacacact

SEQ ID NO: 8550614 - DNA, 22 bp, Homo sapiens
ttcagcagagaaattacataat

SEQ ID NO: 8550615 - DNA, 22 bp, Homo sapiens
ttcacagatgagaaaattgagg

SEQ ID NO: 8550616 - DNA, 22 bp, Homo sapiens
ttcacagatgagaaaattgagg

SEQ ID NO: 8550617 - DNA, 22 bp, Homo sapiens
ttcacagatgagaaaattgagg

SEQ ID NO: 8550618 - DNA, 21 bp, Homo sapiens
ttcacagatgggaaaactgag

SEQ ID NO: 8550619 - DNA, 21 bp, Homo sapiens
ttcacagatgggaaaactgag

SEQ ID NO: 8550620 - DNA, 21 bp, Homo sapiens
ttcacagatgggaaaactgag

SEQ ID NO: 8550621 - DNA, 22 bp, Homo sapiens
ttcacagagagtatgcagagaa

SEQ ID NO: 8550622 - DNA, 22 bp, Homo sapiens
ttcacagagagtatgcagagaa

SEQ ID NO: 8550623 - DNA, 20 bp, Homo sapiens
ttcacagaggactcaggtca

SEQ ID NO: 8550624 - DNA, 20 bp, Homo sapiens
ttcacagaggactcaggtca

SEQ ID NO: 8550625 - DNA, 22 bp, Homo sapiens
ttcacagatgtattggaactcc

SEQ ID NO: 8550626 - DNA, 22 bp, Homo sapiens
ttcacagatgtattggaactcc

SEQ ID NO: 8550627 - DNA, 22 bp, Homo sapiens
ttcacagatgtattggaactcc

SEQ ID NO: 8550628 - DNA, 22 bp, Homo sapiens
ttcacagcctctgccccaggca

SEQ ID NO: 8550629 - DNA, 18 bp, Homo sapiens
ttcacaggaaatgtcttt

SEQ ID NO: 8550630 - DNA, 22 bp, Homo sapiens
ttcacaggaatgtaggggtctt

SEQ ID NO: 8550631 - DNA, 22 bp, Homo sapiens
ttcacagctaagagctaagtaa

SEQ ID NO: 8550632 - DNA, 22 bp, Homo sapiens
ttcacagctccttttactcaac

SEQ ID NO: 8550633 - DNA, 22 bp, Homo sapiens
ttcacagctccttttactcaac

SEQ ID NO: 8550634 - DNA, 22 bp, Homo sapiens
ttcaaagattttcccaaagctc

SEQ ID NO: 8550635 - DNA, 22 bp, Homo sapiens
ttcaaagctgcagactcctggg

SEQ ID NO: 8550636 - DNA, 23 bp, Homo sapiens
ttcaaagatcttctgaaatctgt

SEQ ID NO: 8550637 - DNA, 22 bp, Homo sapiens
ttcaaagataattaccaaacat

SEQ ID NO: 8550638 - DNA, 22 bp, Homo sapiens
ttcaaagataattaccaaacat

SEQ ID NO: 8550639 - DNA, 22 bp, Homo sapiens
ttcaaagataattaccaaacat

SEQ ID NO: 8550640 - DNA, 22 bp, Homo sapiens
ttcaaagatggagggatagatt

SEQ ID NO: 8550641 - DNA, 22 bp, Homo sapiens
ttcaaagattagcatacgcaat

SEQ ID NO: 8550642 - DNA, 23 bp, Homo sapiens
ttcaaagatcttctgaaatctgt

SEQ ID NO: 8550643 - DNA, 23 bp, Homo sapiens
ttcaaagatcttctgaaatctgt

SEQ ID NO: 8550644 - DNA, 22 bp, Homo sapiens
ttcacaataggagcatgcaaat

SEQ ID NO: 8550645 - DNA, 22 bp, Homo sapiens
ttcacaataggagcatgcaaat

SEQ ID NO: 8550646 - DNA, 22 bp, Homo sapiens
ttcacaatgccttgttgatggt

SEQ ID NO: 8550647 - DNA, 22 bp, Homo sapiens
ttcacaatggcaaaccattaaa

SEQ ID NO: 8550648 - DNA, 22 bp, Homo sapiens
ttcacaattaactttatactta

SEQ ID NO: 8550649 - DNA, 20 bp, Homo sapiens
ttcaaagaccctcaggtcca

SEQ ID NO: 8550650 - DNA, 22 bp, Homo sapiens
ttcaaagaattttgagacctga

SEQ ID NO: 8550651 - DNA, 22 bp, Homo sapiens
ttcaaacttaaggagcagcaga

SEQ ID NO: 8550652 - DNA, 22 bp, Homo sapiens
ttcaaagataatgtagcatttt

SEQ ID NO: 8550653 - DNA, 22 bp, Homo sapiens
tttatctgaaaaaactcttgga

SEQ ID NO: 8550654 - DNA, 22 bp, Homo sapiens
tttatctgagctgatagatagt

SEQ ID NO: 8550655 - DNA, 22 bp, Homo sapiens
tttatctgagctgatagatagt

SEQ ID NO: 8550656 - DNA, 22 bp, Homo sapiens
tttatctgagctgatagatagt

SEQ ID NO: 8550657 - DNA, 22 bp, Homo sapiens
tttatctgatattcagcgattt

SEQ ID NO: 8550658 - DNA, 22 bp, Homo sapiens
tttatctgaggaaagcagacaa

SEQ ID NO: 8550659 - DNA, 22 bp, Homo sapiens
tttattcaagatgaggttcatg

SEQ ID NO: 8550660 - DNA, 22 bp, Homo sapiens
tttattcaagatgaggttcatg

SEQ ID NO: 8550661 - DNA, 22 bp, Homo sapiens
tttattcaagatgaggttcatg

SEQ ID NO: 8550662 - DNA, 22 bp, Homo sapiens
tttatctattgtattgttgatg

SEQ ID NO: 8550663 - DNA, 22 bp, Homo sapiens
tttatctcttttgaccaagatt

SEQ ID NO: 8550664 - DNA, 22 bp, Homo sapiens
tttatccattcaccagttgaac

SEQ ID NO: 8550665 - DNA, 22 bp, Homo sapiens
tttatccatcatctgctgaagg

SEQ ID NO: 8550666 - DNA, 22 bp, Homo sapiens
tttatccatcatctgctgaagg

SEQ ID NO: 8550667 - DNA, 22 bp, Homo sapiens
tttatccatatcattaaaatct

SEQ ID NO: 8550668 - DNA, 22 bp, Homo sapiens
tttatcatcttgtttttaaagc

SEQ ID NO: 8550669 - DNA, 22 bp, Homo sapiens
tttatccagaatcaggattttt

SEQ ID NO: 8550670 - DNA, 22 bp, Homo sapiens
tttatcagaagttagagaaaga

SEQ ID NO: 8550671 - DNA, 22 bp, Homo sapiens
tttatcacagaataagaagtca

SEQ ID NO: 8550672 - DNA, 22 bp, Homo sapiens
tttatcaaacaaattatccagc

SEQ ID NO: 8550673 - DNA, 22 bp, Homo sapiens
tttatcaaacaaattatccagc

SEQ ID NO: 8550674 - DNA, 22 bp, Homo sapiens
tttatcagaggctatgtttcat

SEQ ID NO: 8550675 - DNA, 22 bp, Homo sapiens
tttatcagagatatgtgtggac

SEQ ID NO: 8550676 - DNA, 22 bp, Homo sapiens
tttatcagtagcaaagttttaa

SEQ ID NO: 8550677 - DNA, 22 bp, Homo sapiens
tttatatagagatttgtgcatg

SEQ ID NO: 8550678 - DNA, 22 bp, Homo sapiens
tttagcatccaaggttatgact

SEQ ID NO: 8550679 - DNA, 22 bp, Homo sapiens
tttagcatatcctataaaacta

SEQ ID NO: 8550680 - DNA, 22 bp, Homo sapiens
tttagcatccaaggttatgact

SEQ ID NO: 8550681 - DNA, 22 bp, Homo sapiens
tttagcagatctatgtatgtga

SEQ ID NO: 8550682 - DNA, 22 bp, Homo sapiens
tttagcagagcatatgatatcc

SEQ ID NO: 8550683 - DNA, 22 bp, Homo sapiens
tttagcagtgaagtgaagtgaa

SEQ ID NO: 8550684 - DNA, 22 bp, Homo sapiens
tttagcaagttctctgagagaa

SEQ ID NO: 8550685 - DNA, 22 bp, Homo sapiens
tttagcaattattaagggttga

SEQ ID NO: 8550686 - DNA, 22 bp, Homo sapiens
tttagcaatatcataaggaaga

SEQ ID NO: 8550687 - DNA, 22 bp, Homo sapiens
tttagcaatatcataaggaaga

SEQ ID NO: 8550688 - DNA, 22 bp, Homo sapiens
tttagcaatttctaaaagtgtt

SEQ ID NO: 8550689 - DNA, 20 bp, Homo sapiens
tttagcacattgtacaaaac

SEQ ID NO: 8550690 - DNA, 22 bp, Homo sapiens
tttagcacggtaacacataaag

SEQ ID NO: 8550691 - DNA, 22 bp, Homo sapiens
tttagcagagcatatgatatcc

SEQ ID NO: 8550692 - DNA, 22 bp, Homo sapiens
tttatatagagatttgtgcatg

SEQ ID NO: 8550693 - DNA, 22 bp, Homo sapiens
tttatattgggagtcgttttga

SEQ ID NO: 8550694 - DNA, 22 bp, Homo sapiens
tttatatttcccaggattggcc

SEQ ID NO: 8550695 - DNA, 22 bp, Homo sapiens
tttatattgtaaaaatggttct

SEQ ID NO: 8550696 - DNA, 22 bp, Homo sapiens
tttatattgggagtcgttttga

SEQ ID NO: 8550697 - DNA, 22 bp, Homo sapiens
tttatattgtaaaaatggttct

SEQ ID NO: 8550698 - DNA, 22 bp, Homo sapiens
tttatattgtaaaaatggttct

SEQ ID NO: 8550699 - DNA, 22 bp, Homo sapiens
tttaccacaattttaaacaatg

SEQ ID NO: 8550700 - DNA, 22 bp, Homo sapiens
tttaccacagaaaaaagtaact

SEQ ID NO: 8550701 - DNA, 22 bp, Homo sapiens
tttaccaagatagcatctggtt

SEQ ID NO: 8550702 - DNA, 22 bp, Homo sapiens
tttaccaaatgagactattgtt

SEQ ID NO: 8550703 - DNA, 20 bp, Homo sapiens
tttaccaactcaccagtatc

SEQ ID NO: 8550704 - DNA, 22 bp, Homo sapiens
tttaccaagctttaattacata

SEQ ID NO: 8550705 - DNA, 22 bp, Homo sapiens
tttaccaagagttgtcactgtt

SEQ ID NO: 8550706 - DNA, 22 bp, Homo sapiens
tttaccaagagttgtcactgtt

SEQ ID NO: 8550707 - DNA, 22 bp, Homo sapiens
tttagaagttcacacatttaaa

SEQ ID NO: 8550708 - DNA, 19 bp, Homo sapiens
tttagaagttgaaactctg

SEQ ID NO: 8550709 - DNA, 19 bp, Homo sapiens
tttagaagttgaaactctg

SEQ ID NO: 8550710 - DNA, 17 bp, Homo sapiens
tttagaatacaatgttt

SEQ ID NO: 8550711 - DNA, 22 bp, Homo sapiens
tttagaagttcacacatttaaa

SEQ ID NO: 8550712 - DNA, 22 bp, Homo sapiens
tttagaagacagatgcacagcc

SEQ ID NO: 8550713 - DNA, 22 bp, Homo sapiens
tttaccacaattttaaacaatg

SEQ ID NO: 8550714 - DNA, 22 bp, Homo sapiens
tttaccacagaaaaaagtaact

SEQ ID NO: 8550715 - DNA, 20 bp, Homo sapiens
tttacattttgaaacagtga

SEQ ID NO: 8550716 - DNA, 20 bp, Homo sapiens
tttacattttgaaacagtga

SEQ ID NO: 8550717 - DNA, 20 bp, Homo sapiens
tttacattttgaaacagtga

SEQ ID NO: 8550718 - DNA, 22 bp, Homo sapiens
tttacagtgtcttgttgactgt

SEQ ID NO: 8550719 - DNA, 22 bp, Homo sapiens
tttaccaaatagattatgtcag

SEQ ID NO: 8550720 - DNA, 20 bp, Homo sapiens
tttacattttgaaacagtga

SEQ ID NO: 8550721 - DNA, 20 bp, Homo sapiens
tttaccaaaggagttatgat

SEQ ID NO: 8550722 - DNA, 22 bp, Homo sapiens
tttacagtctgtctagcaatgt

SEQ ID NO: 8550723 - DNA, 22 bp, Homo sapiens
tttacagtctgtctagcaatgt

SEQ ID NO: 8550724 - DNA, 22 bp, Homo sapiens
tttacagtctgtctagcaatgt

SEQ ID NO: 8550725 - DNA, 22 bp, Homo sapiens
tttacagtctgtctagcaatgt

SEQ ID NO: 8550726 - DNA, 22 bp, Homo sapiens
tttacagtctgtctagcaatgt

SEQ ID NO: 8550727 - DNA, 22 bp, Homo sapiens
tttacagtgagagcttagtgag

SEQ ID NO: 8550728 - DNA, 22 bp, Homo sapiens
tttacatttccctctgtcagtt

SEQ ID NO: 8550729 - DNA, 22 bp, Homo sapiens
tttagcaagatgccctggcttt

SEQ ID NO: 8550730 - DNA, 21 bp, Homo sapiens
tttagcaagagtatagtgcat

SEQ ID NO: 8550731 - DNA, 22 bp, Homo sapiens
tttagcaaattagcacctctaa

SEQ ID NO: 8550732 - DNA, 22 bp, Homo sapiens
tttagcaaggtaggtccatgga

SEQ ID NO: 8550733 - DNA, 22 bp, Homo sapiens
tttagcaaaacattatgtctgt

SEQ ID NO: 8550734 - DNA, 22 bp, Homo sapiens
tttagcaaattactcacagggt

SEQ ID NO: 8550735 - DNA, 22 bp, Homo sapiens
tttagcaaatatttctgttgat

SEQ ID NO: 8550736 - DNA, 22 bp, Homo sapiens
tttagcaaaggtagggttcaga

SEQ ID NO: 8550737 - DNA, 22 bp, Homo sapiens
tttagattgtgacctcccccca

SEQ ID NO: 8550738 - DNA, 22 bp, Homo sapiens
tttagattgtgacctcccccca

SEQ ID NO: 8550739 - DNA, 22 bp, Homo sapiens
tttagataatgctcaagcaatt

SEQ ID NO: 8550740 - DNA, 22 bp, Homo sapiens
tttagagttgagtattcattgg

SEQ ID NO: 8550741 - DNA, 22 bp, Homo sapiens
tttagagttgagtattcattgg

SEQ ID NO: 8550742 - DNA, 22 bp, Homo sapiens
tttagagttggtcccctgtgag

SEQ ID NO: 8550743 - DNA, 22 bp, Homo sapiens
tttagagtccaagttcttcact

SEQ ID NO: 8550744 - DNA, 22 bp, Homo sapiens
tttagagaggctctgtaaaatg

SEQ ID NO: 8550745 - DNA, 22 bp, Homo sapiens
tttagagagaattttcaaagtg

SEQ ID NO: 8550746 - DNA, 22 bp, Homo sapiens
tttagagtaaaaactgtgacct

SEQ ID NO: 8550747 - DNA, 22 bp, Homo sapiens
tttagagtcattttatattgac

SEQ ID NO: 8550748 - DNA, 22 bp, Homo sapiens
tttagaggttagaggctgatag

SEQ ID NO: 8550749 - DNA, 22 bp, Homo sapiens
tttagaggggaaagtggctggt

SEQ ID NO: 8550750 - DNA, 22 bp, Homo sapiens
tttaaataggactcctgggggt

SEQ ID NO: 8550751 - DNA, 22 bp, Homo sapiens
tttaaatgcagacgttgattca

SEQ ID NO: 8550752 - DNA, 22 bp, Homo sapiens
tttaaataggactcctgggggt

SEQ ID NO: 8550753 - DNA, 22 bp, Homo sapiens
tttaaataggactcctgggggt

SEQ ID NO: 8550754 - DNA, 22 bp, Homo sapiens
tttaaatgcagacgttgattca

SEQ ID NO: 8550755 - DNA, 22 bp, Homo sapiens
tttaaatgctttaagcaagggt

SEQ ID NO: 8550756 - DNA, 19 bp, Homo sapiens
tttaaagtgactggtattt

SEQ ID NO: 8550757 - DNA, 19 bp, Homo sapiens
tttaaagtgactggtattt

SEQ ID NO: 8550758 - DNA, 22 bp, Homo sapiens
tttaaagtgctgctcctatcct

SEQ ID NO: 8550759 - DNA, 22 bp, Homo sapiens
tttaaagtggtccatttcagaa

SEQ ID NO: 8550760 - DNA, 22 bp, Homo sapiens
tttaaagtttttgcacattctg

SEQ ID NO: 8550761 - DNA, 22 bp, Homo sapiens
tttaaagtttttgcacattctg

SEQ ID NO: 8550762 - DNA, 22 bp, Homo sapiens
tttaaataggactcctgggggt

SEQ ID NO: 8550763 - DNA, 22 bp, Homo sapiens
tttaaataggactcctgggggt

SEQ ID NO: 8550764 - DNA, 22 bp, Homo sapiens
tttaaataggactcctgggggt

SEQ ID NO: 8550765 - DNA, 22 bp, Homo sapiens
tttaaatgtgttcttagtagct

SEQ ID NO: 8550766 - DNA, 22 bp, Homo sapiens
tttaaatgtgttcttagtagct

SEQ ID NO: 8550767 - DNA, 22 bp, Homo sapiens
tttaaatgttcatgatactgaa

SEQ ID NO: 8550768 - DNA, 22 bp, Homo sapiens
tttaaatggcattttcccagat

SEQ ID NO: 8550769 - DNA, 22 bp, Homo sapiens
tttaaatggcattttcccagat

SEQ ID NO: 8550770 - DNA, 22 bp, Homo sapiens
tttaaatgtttaaaactcgtga

SEQ ID NO: 8550771 - DNA, 22 bp, Homo sapiens
tttaaatgtttaaaactcgtga

SEQ ID NO: 8550772 - DNA, 22 bp, Homo sapiens
tttaagatggtattttataaag

SEQ ID NO: 8550773 - DNA, 22 bp, Homo sapiens
tttaagatggtattttataaag

SEQ ID NO: 8550774 - DNA, 22 bp, Homo sapiens
tttaaatgtttatagagagtac

SEQ ID NO: 8550775 - DNA, 22 bp, Homo sapiens
tttaaatgtttatagagagtac

SEQ ID NO: 8550776 - DNA, 17 bp, Homo sapiens
tttaaactactacaagg

SEQ ID NO: 8550777 - DNA, 22 bp, Homo sapiens
tttaaacctcctgattcagcta

SEQ ID NO: 8550778 - DNA, 22 bp, Homo sapiens
tttaaactaacagtacacgttg

SEQ ID NO: 8550779 - DNA, 22 bp, Homo sapiens
tttaaacctatctaagaaatag

SEQ ID NO: 8550780 - DNA, 22 bp, Homo sapiens
tttaaacctatctaagaaatag

SEQ ID NO: 8550781 - DNA, 17 bp, Homo sapiens
tttaaactactacaagg

SEQ ID NO: 8550782 - DNA, 22 bp, Homo sapiens
tttaaactgttgattttatgaa

SEQ ID NO: 8550783 - DNA, 22 bp, Homo sapiens
tttaaactgttgattttatgaa

SEQ ID NO: 8550784 - DNA, 22 bp, Homo sapiens
tttaaagaaattcctcatcttt

SEQ ID NO: 8550785 - DNA, 22 bp, Homo sapiens
tttaaagaaattcctcatcttt

SEQ ID NO: 8550786 - DNA, 19 bp, Homo sapiens
tttaaagtgactggtattt

SEQ ID NO: 8550787 - DNA, 22 bp, Homo sapiens
tttaaagagaatgtgaaggagt

SEQ ID NO: 8550788 - DNA, 22 bp, Homo sapiens
tttaaagaaattcctcatcttt

SEQ ID NO: 8550789 - DNA, 22 bp, Homo sapiens
ttgtgtggataatattacttga

SEQ ID NO: 8550790 - DNA, 22 bp, Homo sapiens
ttgtgtggtagcttcattgaac

SEQ ID NO: 8550791 - DNA, 22 bp, Homo sapiens
ttgtgtggtagcttcattgaac

SEQ ID NO: 8550792 - DNA, 22 bp, Homo sapiens
ttgtgtgtactggttatgggca

SEQ ID NO: 8550793 - DNA, 22 bp, Homo sapiens
ttgtgtgactcctagagtagag

SEQ ID NO: 8550794 - DNA, 22 bp, Homo sapiens
ttgtgtgcataaattctgatgt

SEQ ID NO: 8550795 - DNA, 22 bp, Homo sapiens
ttgtgtgctgagggcctgctgt

SEQ ID NO: 8550796 - DNA, 22 bp, Homo sapiens
ttgtgtgtactggttatgggca

SEQ ID NO: 8550797 - DNA, 22 bp, Homo sapiens
ttgtgtgtagactcagccattg

SEQ ID NO: 8550798 - DNA, 22 bp, Homo sapiens
ttgtgtgtactggttatgggca

SEQ ID NO: 8550799 - DNA, 22 bp, Homo sapiens
ttgtgtgtactggttatgggca

SEQ ID NO: 8550800 - DNA, 22 bp, Homo sapiens
ttgtgtgtagactcagccattg

SEQ ID NO: 8550801 - DNA, 22 bp, Homo sapiens
ttgtgtgtagactcagccattg

SEQ ID NO: 8550802 - DNA, 17 bp, Homo sapiens
ttgtgtgtagttctgat

SEQ ID NO: 8550803 - DNA, 22 bp, Homo sapiens
ttgtgtgtagactcagccattg

SEQ ID NO: 8550804 - DNA, 17 bp, Homo sapiens
ttgtgtgtagttctgat

SEQ ID NO: 8550805 - DNA, 22 bp, Homo sapiens
tttaaacatcttgttgccttaa

SEQ ID NO: 8550806 - DNA, 17 bp, Homo sapiens
ttgtgtgtagttctgat

SEQ ID NO: 8550807 - DNA, 17 bp, Homo sapiens
ttgtgtgtagttctgat

SEQ ID NO: 8550808 - DNA, 22 bp, Homo sapiens
tttaagcagagaaatgatgtat

SEQ ID NO: 8550809 - DNA, 22 bp, Homo sapiens
tttaagcacagggataaagtta

SEQ ID NO: 8550810 - DNA, 22 bp, Homo sapiens
tttaaggaaaaaatgtacttag

SEQ ID NO: 8550811 - DNA, 22 bp, Homo sapiens
tttaagctgtggcattaattct

SEQ ID NO: 8550812 - DNA, 22 bp, Homo sapiens
tttaaggatgatgtgatatata

SEQ ID NO: 8550813 - DNA, 22 bp, Homo sapiens
tttaaggaggggctcacgtggg

SEQ ID NO: 8550814 - DNA, 22 bp, Homo sapiens
tttaaggagctactcaccgtca

SEQ ID NO: 8550815 - DNA, 22 bp, Homo sapiens
tttaagattcagtaaggcaaac

SEQ ID NO: 8550816 - DNA, 22 bp, Homo sapiens
tttaagatggtattttataaag

SEQ ID NO: 8550817 - DNA, 23 bp, Homo sapiens
tttaatgaccaatagaaggaaca

SEQ ID NO: 8550818 - DNA, 22 bp, Homo sapiens
tttaatgaataattcaaatctg

SEQ ID NO: 8550819 - DNA, 22 bp, Homo sapiens
tttaatcttcaaaatagtctta

SEQ ID NO: 8550820 - DNA, 22 bp, Homo sapiens
tttaatctcccactctcagcct

SEQ ID NO: 8550821 - DNA, 22 bp, Homo sapiens
tttaaggcagtgaaactattct

SEQ ID NO: 8550822 - DNA, 22 bp, Homo sapiens
tttaaggatgtaaaggaagaag

SEQ ID NO: 8550823 - DNA, 19 bp, Homo sapiens
tttacagggaatggagacc

SEQ ID NO: 8550824 - DNA, 22 bp, Homo sapiens
tttacagggaatattttggctt

SEQ ID NO: 8550825 - DNA, 22 bp, Homo sapiens
tttacagcttctatactatgtg

SEQ ID NO: 8550826 - DNA, 22 bp, Homo sapiens
tttacagcttctatactatgtg

SEQ ID NO: 8550827 - DNA, 22 bp, Homo sapiens
tttaatgtgacatcttttagag

SEQ ID NO: 8550828 - DNA, 22 bp, Homo sapiens
tttaatgtattctttggaacca

SEQ ID NO: 8550829 - DNA, 22 bp, Homo sapiens
tttaatgtagcgtgaaatgatt

SEQ ID NO: 8550830 - DNA, 22 bp, Homo sapiens
tttaatgggatccatctggtta

SEQ ID NO: 8550831 - DNA, 22 bp, Homo sapiens
tttaatgtagcgtgaaatgatt

SEQ ID NO: 8550832 - DNA, 22 bp, Homo sapiens
tttaatgtagcgtgaaatgatt

SEQ ID NO: 8550833 - DNA, 22 bp, Homo sapiens
tttaatggcaagaaggctgcag

SEQ ID NO: 8550834 - DNA, 22 bp, Homo sapiens
tttaatgatagtcttacgaaaa

SEQ ID NO: 8550835 - DNA, 23 bp, Homo sapiens
tttaatgaccaatagaaggaaca

SEQ ID NO: 8550836 - DNA, 22 bp, Homo sapiens
tttaatgatagctgtttcacat

SEQ ID NO: 8550837 - DNA, 22 bp, Homo sapiens
tttacagtctctatagtcaaaa

SEQ ID NO: 8550838 - DNA, 22 bp, Homo sapiens
tttacagtctctatagtcaaaa

SEQ ID NO: 8550839 - DNA, 22 bp, Homo sapiens
tttacagtccccaggtgaggat

SEQ ID NO: 8550840 - DNA, 22 bp, Homo sapiens
tttacagtctatgttgaattaa

SEQ ID NO: 8550841 - DNA, 22 bp, Homo sapiens
tttacagtaaggtggatggtac

SEQ ID NO: 8550842 - DNA, 22 bp, Homo sapiens
tttacagtatagtaggactcat

SEQ ID NO: 8550843 - DNA, 22 bp, Homo sapiens
tttacagtcaccaaactttgct

SEQ ID NO: 8550844 - DNA, 22 bp, Homo sapiens
tttcacagcgtctttctcttgc

SEQ ID NO: 8550845 - DNA, 22 bp, Homo sapiens
tttcacagctagtgagcttcta

SEQ ID NO: 8550846 - DNA, 22 bp, Homo sapiens
tttcacagctgatacctcttcc

SEQ ID NO: 8550847 - DNA, 22 bp, Homo sapiens
tttcacagctgggaagagatat

SEQ ID NO: 8550848 - DNA, 22 bp, Homo sapiens
tttcacagctgtcttccgtctc

SEQ ID NO: 8550849 - DNA, 22 bp, Homo sapiens
tttcacagctgtcttccgtctc

SEQ ID NO: 8550850 - DNA, 22 bp, Homo sapiens
tttcacagctgggtggcagagt

SEQ ID NO: 8550851 - DNA, 22 bp, Homo sapiens
tttcacagctgggtggcagagt

SEQ ID NO: 8550852 - DNA, 22 bp, Homo sapiens
tttcacagctgggtggcagagt

SEQ ID NO: 8550853 - DNA, 22 bp, Homo sapiens
tttcacagctgggtggcagagt

SEQ ID NO: 8550854 - DNA, 22 bp, Homo sapiens
tttcacagcagaatttctgagg

SEQ ID NO: 8550855 - DNA, 18 bp, Homo sapiens
tttcacagattcatgact

SEQ ID NO: 8550856 - DNA, 22 bp, Homo sapiens
tttcacagcaacactgtctgca

SEQ ID NO: 8550857 - DNA, 22 bp, Homo sapiens
tttcacagcaacactgtctgca

SEQ ID NO: 8550858 - DNA, 22 bp, Homo sapiens
tttcacagcagtgtgctgcttt

SEQ ID NO: 8550859 - DNA, 22 bp, Homo sapiens
tttcacagcagtgtgctgcttt

SEQ ID NO: 8550860 - DNA, 22 bp, Homo sapiens
tttcacagcagaatttctgagg

SEQ ID NO: 8550861 - DNA, 22 bp, Homo sapiens
tttcacagcgtctttctcttgc

SEQ ID NO: 8550862 - DNA, 22 bp, Homo sapiens
tttcacagcatataggtgtact

SEQ ID NO: 8550863 - DNA, 22 bp, Homo sapiens
tttcacagcatataggtgtact

SEQ ID NO: 8550864 - DNA, 22 bp, Homo sapiens
tttcacattttatacttaagcc

SEQ ID NO: 8550865 - DNA, 22 bp, Homo sapiens
tttcacattttatacttaagcc

SEQ ID NO: 8550866 - DNA, 22 bp, Homo sapiens
tttcaccaaggtaacctttgat

SEQ ID NO: 8550867 - DNA, 22 bp, Homo sapiens
tttcacatttgttttaagaagt

SEQ ID NO: 8550868 - DNA, 23 bp, Homo sapiens
tttcacagcttttattctgcatc

SEQ ID NO: 8550869 - DNA, 22 bp, Homo sapiens
tttcacagcttccacttaagga

SEQ ID NO: 8550870 - DNA, 22 bp, Homo sapiens
tttcacagcttccacttaagga

SEQ ID NO: 8550871 - DNA, 20 bp, Homo sapiens
tttcactggcttgataaggt

SEQ ID NO: 8550872 - DNA, 22 bp, Homo sapiens
tttcactcagctctcattgtct

SEQ ID NO: 8550873 - DNA, 22 bp, Homo sapiens
tttcagaaaacttatcatcagt

SEQ ID NO: 8550874 - DNA, 22 bp, Homo sapiens
tttcactgttaggagtatgcta

SEQ ID NO: 8550875 - DNA, 22 bp, Homo sapiens
tttcagactccaaattcataag

SEQ ID NO: 8550876 - DNA, 19 bp, Homo sapiens
tttcagactcatctccagc

SEQ ID NO: 8550877 - DNA, 22 bp, Homo sapiens
tttcagactgctgtgtgaaact

SEQ ID NO: 8550878 - DNA, 22 bp, Homo sapiens
tttcagactgcccatgtttgcc

SEQ ID NO: 8550879 - DNA, 22 bp, Homo sapiens
tttcagactccaaattcataag

SEQ ID NO: 8550880 - DNA, 22 bp, Homo sapiens
tttcagagaaagcccaaagact

SEQ ID NO: 8550881 - DNA, 22 bp, Homo sapiens
tttcagagaactgagtccttgc

SEQ ID NO: 8550882 - DNA, 22 bp, Homo sapiens
tttcagagaactgagtccttgc

SEQ ID NO: 8550883 - DNA, 22 bp, Homo sapiens
tttcagactgtactttggggtt

SEQ ID NO: 8550884 - DNA, 19 bp, Homo sapiens
tttcagacatttcaaattt

SEQ ID NO: 8550885 - DNA, 21 bp, Homo sapiens
tttcagacctatctttgaagg

SEQ ID NO: 8550886 - DNA, 22 bp, Homo sapiens
tttcagactcatctcaagcttt

SEQ ID NO: 8550887 - DNA, 22 bp, Homo sapiens
tttcagacctgctgtgctatct

SEQ ID NO: 8550888 - DNA, 22 bp, Homo sapiens
tttcagacctggatgtgggggc

SEQ ID NO: 8550889 - DNA, 22 bp, Homo sapiens
tttcagactcatctcaagcttt

SEQ ID NO: 8550890 - DNA, 22 bp, Homo sapiens
tttcagactcagaacttagcaa

SEQ ID NO: 8550891 - DNA, 19 bp, Homo sapiens
tttcagacatttcaaattt

SEQ ID NO: 8550892 - DNA, 22 bp, Homo sapiens
tttcagacattaagtgatggga

SEQ ID NO: 8550893 - DNA, 22 bp, Homo sapiens
tttcagacatgggggcaaacag

SEQ ID NO: 8550894 - DNA, 22 bp, Homo sapiens
tttcagacatcacatgggtttg

SEQ ID NO: 8550895 - DNA, 22 bp, Homo sapiens
tttcagacatagcctgattctg

SEQ ID NO: 8550896 - DNA, 22 bp, Homo sapiens
tttcagacataccagttattga

SEQ ID NO: 8550897 - DNA, 22 bp, Homo sapiens
tttcagacagtgggtccatcca

SEQ ID NO: 8550898 - DNA, 22 bp, Homo sapiens
tttcagacaggctcagagccgt

SEQ ID NO: 8550899 - DNA, 22 bp, Homo sapiens
tttcagagatgtctagcctatt

SEQ ID NO: 8550900 - DNA, 22 bp, Homo sapiens
tttcagagatgcagaattcagg

SEQ ID NO: 8550901 - DNA, 22 bp, Homo sapiens
tttcagagatgtctagcctatt

SEQ ID NO: 8550902 - DNA, 22 bp, Homo sapiens
tttcagagcctgcaatcccaat

SEQ ID NO: 8550903 - DNA, 22 bp, Homo sapiens
tttcagagcctttatctctcta

SEQ ID NO: 8550904 - DNA, 22 bp, Homo sapiens
tttcagagaattagaagctgat

SEQ ID NO: 8550905 - DNA, 22 bp, Homo sapiens
tttcagagaattagaagctgat

SEQ ID NO: 8550906 - DNA, 22 bp, Homo sapiens
tttcagagaggcttcaaatctt

SEQ ID NO: 8550907 - DNA, 22 bp, Homo sapiens
tttcagagaggcttcaaatctt

SEQ ID NO: 8550908 - DNA, 22 bp, Homo sapiens
tttcagaaaacttatcatcagt

SEQ ID NO: 8550909 - DNA, 22 bp, Homo sapiens
tttcagaaaacttatcatcagt

SEQ ID NO: 8550910 - DNA, 22 bp, Homo sapiens
tttcagaaagcatcatcaaagt

SEQ ID NO: 8550911 - DNA, 22 bp, Homo sapiens
tttcagaaacgattatgaacac

SEQ ID NO: 8550912 - DNA, 22 bp, Homo sapiens
tttcagaaacgattatgaacac

SEQ ID NO: 8550913 - DNA, 22 bp, Homo sapiens
tttcagaaacgattatgaacac

SEQ ID NO: 8550914 - DNA, 22 bp, Homo sapiens
tttcagaaagcatcatcaaagt

SEQ ID NO: 8550915 - DNA, 22 bp, Homo sapiens
tttcagaaagctgaacatatga

SEQ ID NO: 8550916 - DNA, 22 bp, Homo sapiens
tttcagaaagcatcatcaaagt

SEQ ID NO: 8550917 - DNA, 22 bp, Homo sapiens
tttcagaaagcatcatcaaagt

SEQ ID NO: 8550918 - DNA, 22 bp, Homo sapiens
tttcagaaatggcactgaaatc

SEQ ID NO: 8550919 - DNA, 22 bp, Homo sapiens
tttcagaaatggcactgaaatc

SEQ ID NO: 8550920 - DNA, 22 bp, Homo sapiens
tttcagaaatggcactgaaatc

SEQ ID NO: 8550921 - DNA, 22 bp, Homo sapiens
tttcagacaggacttcatatgt

SEQ ID NO: 8550922 - DNA, 22 bp, Homo sapiens
tttcagacagattcttctcagt

SEQ ID NO: 8550923 - DNA, 22 bp, Homo sapiens
tttcagaaatggcactgaaatc

SEQ ID NO: 8550924 - DNA, 22 bp, Homo sapiens
tttcagaaagctgaacatatga

SEQ ID NO: 8550925 - DNA, 22 bp, Homo sapiens
tttcagaaagctgaacatatga

SEQ ID NO: 8550926 - DNA, 22 bp, Homo sapiens
tttcagaaagctgaacatatga

SEQ ID NO: 8550927 - DNA, 22 bp, Homo sapiens
tttcagaaatggcactgaaatc

SEQ ID NO: 8550928 - DNA, 22 bp, Homo sapiens
tttcatgtatttcccaaagctt

SEQ ID NO: 8550929 - DNA, 22 bp, Homo sapiens
tttcatgtgcaattagcaatat

SEQ ID NO: 8550930 - DNA, 22 bp, Homo sapiens
tttcatgtgcaattagcaatat

SEQ ID NO: 8550931 - DNA, 22 bp, Homo sapiens
tttcatgttacagtgtaaaagt

SEQ ID NO: 8550932 - DNA, 22 bp, Homo sapiens
tttcatgaggctgcataaggag

SEQ ID NO: 8550933 - DNA, 22 bp, Homo sapiens
tttcatgaggctgcataaggag

SEQ ID NO: 8550934 - DNA, 22 bp, Homo sapiens
tttcatgaggggcaaaatctca

SEQ ID NO: 8550935 - DNA, 22 bp, Homo sapiens
tttcagagctcagcagctagag

SEQ ID NO: 8550936 - DNA, 22 bp, Homo sapiens
tttcagagctctaggctctcag

SEQ ID NO: 8550937 - DNA, 22 bp, Homo sapiens
tttcagagctctaggctctcag

SEQ ID NO: 8550938 - DNA, 22 bp, Homo sapiens
tttcatcttccttggcataggt

SEQ ID NO: 8550939 - DNA, 22 bp, Homo sapiens
tttcatcttccttggcataggt

SEQ ID NO: 8550940 - DNA, 22 bp, Homo sapiens
tttcagagctgagatgccacag

SEQ ID NO: 8550941 - DNA, 22 bp, Homo sapiens
tttcatgctcatggaacacagc

SEQ ID NO: 8550942 - DNA, 22 bp, Homo sapiens
tttcatgattaacttagtgaat

SEQ ID NO: 8550943 - DNA, 22 bp, Homo sapiens
tttcatgcacaaatgagcaagg

SEQ ID NO: 8550944 - DNA, 22 bp, Homo sapiens
tttcatgatccatttacaaaat

SEQ ID NO: 8550945 - DNA, 22 bp, Homo sapiens
tttcatgatccatttacaaaat

SEQ ID NO: 8550946 - DNA, 22 bp, Homo sapiens
tttcattcattatacagtagag

SEQ ID NO: 8550947 - DNA, 22 bp, Homo sapiens
tttcattgaactaaagaatctg

SEQ ID NO: 8550948 - DNA, 22 bp, Homo sapiens
tttcattgaactaaagaatctg

SEQ ID NO: 8550949 - DNA, 22 bp, Homo sapiens
tttcattgaactaaagaatctg

SEQ ID NO: 8550950 - DNA, 21 bp, Homo sapiens
tttcattgaatgagataaggt

SEQ ID NO: 8550951 - DNA, 22 bp, Homo sapiens
tttcattgatgggtgatagaaa

SEQ ID NO: 8550952 - DNA, 22 bp, Homo sapiens
tttcattgacagttgggggaaa

SEQ ID NO: 8550953 - DNA, 19 bp, Homo sapiens
tttcccagcccttgctgtg

SEQ ID NO: 8550954 - DNA, 21 bp, Homo sapiens
tttcccagcagagatagctgg

SEQ ID NO: 8550955 - DNA, 22 bp, Homo sapiens
tttcattgcagagtctgtgtgc

SEQ ID NO: 8550956 - DNA, 22 bp, Homo sapiens
tttcattgatgggtgatagaaa

SEQ ID NO: 8550957 - DNA, 22 bp, Homo sapiens
tttcccagcctcagctcagcag

SEQ ID NO: 8550958 - DNA, 22 bp, Homo sapiens
tttcccagttccctgctctata

SEQ ID NO: 8550959 - DNA, 22 bp, Homo sapiens
tttcccagttccctgctctata

SEQ ID NO: 8550960 - DNA, 22 bp, Homo sapiens
tttccccaggtagatagataat

SEQ ID NO: 8550961 - DNA, 22 bp, Homo sapiens
tttcacagagaaatataacagg

SEQ ID NO: 8550962 - DNA, 22 bp, Homo sapiens
tttcacagagaaatataacagg

SEQ ID NO: 8550963 - DNA, 22 bp, Homo sapiens
tttcacagagaatattgccttg

SEQ ID NO: 8550964 - DNA, 22 bp, Homo sapiens
tttcacagagaatattgccttg

SEQ ID NO: 8550965 - DNA, 22 bp, Homo sapiens
tttcacagaggaggaagctgag

SEQ ID NO: 8550966 - DNA, 22 bp, Homo sapiens
tttcacagatcctacagcttgt

SEQ ID NO: 8550967 - DNA, 22 bp, Homo sapiens
tttcacagatgttttggagtct

SEQ ID NO: 8550968 - DNA, 22 bp, Homo sapiens
tttcacagatataagatttcac

SEQ ID NO: 8550969 - DNA, 22 bp, Homo sapiens
tttcacagatataagatttcac

SEQ ID NO: 8550970 - DNA, 22 bp, Homo sapiens
tttcacagaaaggataacatta

SEQ ID NO: 8550971 - DNA, 22 bp, Homo sapiens
tttcacagaaaggataacatta

SEQ ID NO: 8550972 - DNA, 23 bp, Homo sapiens
tttcacagaaggattgtagggcc

SEQ ID NO: 8550973 - DNA, 22 bp, Homo sapiens
tttcacagaactcactaaggag

SEQ ID NO: 8550974 - DNA, 22 bp, Homo sapiens
tttcacagaaagacaacagata

SEQ ID NO: 8550975 - DNA, 22 bp, Homo sapiens
tttcacagaaagaagctagttt

SEQ ID NO: 8550976 - DNA, 20 bp, Homo sapiens
tttcacaatgaacatgtctc

SEQ ID NO: 8550977 - DNA, 22 bp, Homo sapiens
tttcacaatgcaatcctacttc

SEQ ID NO: 8550978 - DNA, 23 bp, Homo sapiens
tttcacaatgagcattacagaat

SEQ ID NO: 8550979 - DNA, 23 bp, Homo sapiens
tttcacaatgagcattacagaat

SEQ ID NO: 8550980 - DNA, 22 bp, Homo sapiens
tttcacaatgcaatcctacttc

SEQ ID NO: 8550981 - DNA, 22 bp, Homo sapiens
tttcacaattttaaggagcaaa

SEQ ID NO: 8550982 - DNA, 22 bp, Homo sapiens
tttcacaattttaaggagcaaa

SEQ ID NO: 8550983 - DNA, 22 bp, Homo sapiens
tttcacacccactaggactgtt

SEQ ID NO: 8550984 - DNA, 22 bp, Homo sapiens
tttcacacccactaggactgtt

SEQ ID NO: 8550985 - DNA, 22 bp, Homo sapiens
tttcacacaacgtgaatatact

SEQ ID NO: 8550986 - DNA, 22 bp, Homo sapiens
tttcacactgcagcatcagaga

SEQ ID NO: 8550987 - DNA, 22 bp, Homo sapiens
tttcacactagtcagaatacca

SEQ ID NO: 8550988 - DNA, 22 bp, Homo sapiens
tttcacactagtcagaatacca

SEQ ID NO: 8550989 - DNA, 22 bp, Homo sapiens
tttcaagactcattgagtattg

SEQ ID NO: 8550990 - DNA, 22 bp, Homo sapiens
tttcaagagcaggaaaaaggtc

SEQ ID NO: 8550991 - DNA, 22 bp, Homo sapiens
tttcaagagaaaactaacctat

SEQ ID NO: 8550992 - DNA, 22 bp, Homo sapiens
tttcaagagcaggaaaaaggtc

SEQ ID NO: 8550993 - DNA, 22 bp, Homo sapiens
tttcaagaagcaaattaaagtc

SEQ ID NO: 8550994 - DNA, 22 bp, Homo sapiens
tttcaagaacaacattcattca

SEQ ID NO: 8550995 - DNA, 22 bp, Homo sapiens
tttcaactcatgctaaaggaag

SEQ ID NO: 8550996 - DNA, 23 bp, Homo sapiens
tttcaactcctgccattatttct

SEQ ID NO: 8550997 - DNA, 22 bp, Homo sapiens
tttcaacatcacctagcagttc

SEQ ID NO: 8550998 - DNA, 17 bp, Homo sapiens
tttcaacatcactcagc

SEQ ID NO: 8550999 - DNA, 22 bp, Homo sapiens
tttcaacagctctcaaatgatc

SEQ ID NO: 8551000 - DNA, 23 bp, Homo sapiens
tttcaacaggcagagaagactta

SEQ ID NO: 8551001 - DNA, 22 bp, Homo sapiens
tttattgacttcagtgagtctt

SEQ ID NO: 8551002 - DNA, 22 bp, Homo sapiens
tttattgacttcagtgagtctt

SEQ ID NO: 8551003 - DNA, 22 bp, Homo sapiens
tttattgagcacccgttgtgcg

SEQ ID NO: 8551004 - DNA, 22 bp, Homo sapiens
tttattgacccaaagcgagagt

SEQ ID NO: 8551005 - DNA, 22 bp, Homo sapiens
tttattgaattgtaaccctatt

SEQ ID NO: 8551006 - DNA, 22 bp, Homo sapiens
tttattgacccaaagcgagagt

SEQ ID NO: 8551007 - DNA, 22 bp, Homo sapiens
tttattgacccaaagcgagagt

SEQ ID NO: 8551008 - DNA, 22 bp, Homo sapiens
tttcaaagggaagttatgaagt

SEQ ID NO: 8551009 - DNA, 22 bp, Homo sapiens
tttcaaaggtggaagagtgaat

SEQ ID NO: 8551010 - DNA, 22 bp, Homo sapiens
tttattgcatacacaaatgtca

SEQ ID NO: 8551011 - DNA, 20 bp, Homo sapiens
tttattgagcacgtactgtg

SEQ ID NO: 8551012 - DNA, 22 bp, Homo sapiens
tttattgagtatctactatgtg

SEQ ID NO: 8551013 - DNA, 20 bp, Homo sapiens
tttattgagcacgtactgtg

SEQ ID NO: 8551014 - DNA, 23 bp, Homo sapiens
tttcaacaatgcttagagaaaac

SEQ ID NO: 8551015 - DNA, 22 bp, Homo sapiens
tttcaaaggttttgtcatgtct

SEQ ID NO: 8551016 - DNA, 22 bp, Homo sapiens
tttcaaaggtggaagagtgaat

SEQ ID NO: 8551017 - DNA, 22 bp, Homo sapiens
tttcaaaggttttgtcatgtct

SEQ ID NO: 8551018 - DNA, 22 bp, Homo sapiens
tttcaaagtaaggattttcatc

SEQ ID NO: 8551019 - DNA, 23 bp, Homo sapiens
tttcaacaatgcttagagaaaac

SEQ ID NO: 8551020 - DNA, 22 bp, Homo sapiens
tttcaacaccagagaccatgcg

SEQ ID NO: 8551021 - DNA, 22 bp, Homo sapiens
tttcaacaccagagaccatgcg

SEQ ID NO: 8551022 - DNA, 22 bp, Homo sapiens
tttcaacagaatatgatcagag

SEQ ID NO: 8551023 - DNA, 22 bp, Homo sapiens
tttcaacagaatatgatcagag

SEQ ID NO: 8551024 - DNA, 22 bp, Homo sapiens
tttattctgtgctacatgaaga

SEQ ID NO: 8551025 - DNA, 22 bp, Homo sapiens
tttattctgtgctacatgaaga

SEQ ID NO: 8551026 - DNA, 22 bp, Homo sapiens
tttattctgtgctacatgaaga

SEQ ID NO: 8551027 - DNA, 22 bp, Homo sapiens
tttattctgtgctacatgaaga

SEQ ID NO: 8551028 - DNA, 23 bp, Homo sapiens
tttattctcagatacataggtct

SEQ ID NO: 8551029 - DNA, 22 bp, Homo sapiens
tttattctctagttggtcagat

SEQ ID NO: 8551030 - DNA, 22 bp, Homo sapiens
tttattgaacacttgcactggc

SEQ ID NO: 8551031 - DNA, 22 bp, Homo sapiens
tttattgaacacttgcactggc

SEQ ID NO: 8551032 - DNA, 22 bp, Homo sapiens
tttattgaacacttgcactggc

SEQ ID NO: 8551033 - DNA, 22 bp, Homo sapiens
tttattgaattgtaaccctatt

SEQ ID NO: 8551034 - DNA, 22 bp, Homo sapiens
tttattcttgagagtgagaaga

SEQ ID NO: 8551035 - DNA, 22 bp, Homo sapiens
tttattcttgagagtgagaaga

SEQ ID NO: 8551036 - DNA, 22 bp, Homo sapiens
tttattcttgagagtgagaaga

SEQ ID NO: 8551037 - DNA, 22 bp, Homo sapiens
tttattcttgagagtgagaaga

SEQ ID NO: 8551038 - DNA, 22 bp, Homo sapiens
tttattcttgagagtgagaaga

SEQ ID NO: 8551039 - DNA, 22 bp, Homo sapiens
tttattcttgagagtgagaaga

SEQ ID NO: 8551040 - DNA, 22 bp, Homo sapiens
tttattctataggcattaagca

SEQ ID NO: 8551041 - DNA, 22 bp, Homo sapiens
tttattctataggcattaagca

SEQ ID NO: 8551042 - DNA, 21 bp, Homo sapiens
tttattctcagatacagggag

SEQ ID NO: 8551043 - DNA, 21 bp, Homo sapiens
tttattctcagatacagggag

SEQ ID NO: 8551044 - DNA, 22 bp, Homo sapiens
tttattctagctcagaatagtt

SEQ ID NO: 8551045 - DNA, 22 bp, Homo sapiens
tttattctagctcagaatagtt

SEQ ID NO: 8551046 - DNA, 22 bp, Homo sapiens
tttattctagctcagaatagtt

SEQ ID NO: 8551047 - DNA, 19 bp, Homo sapiens
tttattcacctttaccttg

SEQ ID NO: 8551048 - DNA, 20 bp, Homo sapiens
tttattcacagagaagagtt

SEQ ID NO: 8551049 - DNA, 20 bp, Homo sapiens
tttattcacagagaagagtt

SEQ ID NO: 8551050 - DNA, 20 bp, Homo sapiens
tttattcacagagaagagtt

SEQ ID NO: 8551051 - DNA, 23 bp, Homo sapiens
ttgcttagagacctcctcatcag

SEQ ID NO: 8551052 - DNA, 23 bp, Homo sapiens
ttgcttagagacctcctcatcag

SEQ ID NO: 8551053 - DNA, 22 bp, Homo sapiens
ttgcttatttgattaaatgtct

SEQ ID NO: 8551054 - DNA, 21 bp, Homo sapiens
ttgctgttttcccaatgcagt

SEQ ID NO: 8551055 - DNA, 22 bp, Homo sapiens
ttgctgttttacatctggtggg

SEQ ID NO: 8551056 - DNA, 22 bp, Homo sapiens
ttgctgtgtctgatggctgaga

SEQ ID NO: 8551057 - DNA, 22 bp, Homo sapiens
ttgctgtgtaactcctggcctg

SEQ ID NO: 8551058 - DNA, 22 bp, Homo sapiens
ttgctgtgtcatttgtttaatc

SEQ ID NO: 8551059 - DNA, 22 bp, Homo sapiens
ttgctgtgtcatttgtttaatc

SEQ ID NO: 8551060 - DNA, 22 bp, Homo sapiens
ttgctgaattgaatcctttggt

SEQ ID NO: 8551061 - DNA, 22 bp, Homo sapiens
ttgctgacctttgctctccgtt

SEQ ID NO: 8551062 - DNA, 22 bp, Homo sapiens
ttgctgtgaaaccatgggaagt

SEQ ID NO: 8551063 - DNA, 22 bp, Homo sapiens
ttgctgaagttaatgcttgcaa

SEQ ID NO: 8551064 - DNA, 22 bp, Homo sapiens
ttgctgaagtgaaggtatgttt

SEQ ID NO: 8551065 - DNA, 22 bp, Homo sapiens
ttgctgaaatctatgacatcct

SEQ ID NO: 8551066 - DNA, 22 bp, Homo sapiens
ttgctcttgaaaattgatgctg

SEQ ID NO: 8551067 - DNA, 22 bp, Homo sapiens
ttgctcttgaaaattgatgctg

SEQ ID NO: 8551068 - DNA, 22 bp, Homo sapiens
ttgctgaaaacagtgggtattg

SEQ ID NO: 8551069 - DNA, 22 bp, Homo sapiens
ttgctctgtcagggcctcagtc

SEQ ID NO: 8551070 - DNA, 22 bp, Homo sapiens
ttgctctgattaggtggaaaca

SEQ ID NO: 8551071 - DNA, 22 bp, Homo sapiens
ttgctctgtaataatctggggt

SEQ ID NO: 8551072 - DNA, 22 bp, Homo sapiens
ttgctctgactggagtgcagtg

SEQ ID NO: 8551073 - DNA, 22 bp, Homo sapiens
ttgctctgaacccagggcacca

SEQ ID NO: 8551074 - DNA, 22 bp, Homo sapiens
ttgcatttactgcaccgtgagt

SEQ ID NO: 8551075 - DNA, 22 bp, Homo sapiens
ttgctctccagaggctcacagc

SEQ ID NO: 8551076 - DNA, 22 bp, Homo sapiens
ttgctctgaacccagggcacca

SEQ ID NO: 8551077 - DNA, 22 bp, Homo sapiens
ttgcattacatttgctcagtct

SEQ ID NO: 8551078 - DNA, 22 bp, Homo sapiens
ttgcatgtgtaatttttctaaa

SEQ ID NO: 8551079 - DNA, 22 bp, Homo sapiens
ttgcatgtgtataaaagttgga

SEQ ID NO: 8551080 - DNA, 22 bp, Homo sapiens
ttgcatgttatttaatctgtat

SEQ ID NO: 8551081 - DNA, 20 bp, Homo sapiens
ttgcattggatgtgcaggtg

SEQ ID NO: 8551082 - DNA, 19 bp, Homo sapiens
ttgcattgtagttggactg

SEQ ID NO: 8551083 - DNA, 22 bp, Homo sapiens
ttgcatttaagtagatgttaca

SEQ ID NO: 8551084 - DNA, 22 bp, Homo sapiens
ttggaaaggagattctattgtg

SEQ ID NO: 8551085 - DNA, 22 bp, Homo sapiens
ttggaaagggaggaatgtagac

SEQ ID NO: 8551086 - DNA, 22 bp, Homo sapiens
ttggaaagaagggctgagcaag

SEQ ID NO: 8551087 - DNA, 22 bp, Homo sapiens
ttggaaagaccgaattcctgtt

SEQ ID NO: 8551088 - DNA, 22 bp, Homo sapiens
ttggaaacgtcaccttttcctt

SEQ ID NO: 8551089 - DNA, 23 bp, Homo sapiens
ttgctttcatcatgagatgctcc

SEQ ID NO: 8551090 - DNA, 23 bp, Homo sapiens
ttgctttcatcatgagatgctcc

SEQ ID NO: 8551091 - DNA, 22 bp, Homo sapiens
ttgctttattgggtttactgcc

SEQ ID NO: 8551092 - DNA, 22 bp, Homo sapiens
ttgctttattgggtttactgcc

SEQ ID NO: 8551093 - DNA, 22 bp, Homo sapiens
ttgcttatttgattaaatgtct

SEQ ID NO: 8551094 - DNA, 22 bp, Homo sapiens
ttgcttcagaagttctgcttgt

SEQ ID NO: 8551095 - DNA, 22 bp, Homo sapiens
ttggaaaatgtatttctagaag

SEQ ID NO: 8551096 - DNA, 23 bp, Homo sapiens
ttgctttcatcatgagatgctcc

SEQ ID NO: 8551097 - DNA, 22 bp, Homo sapiens
ttgctttccgtcatgtgctaat

SEQ ID NO: 8551098 - DNA, 22 bp, Homo sapiens
ttgctttccgtcatgtgctaat

SEQ ID NO: 8551099 - DNA, 22 bp, Homo sapiens
ttggaattgaggatttacatag

SEQ ID NO: 8551100 - DNA, 22 bp, Homo sapiens
ttggaattttccaggtacagtg

SEQ ID NO: 8551101 - DNA, 22 bp, Homo sapiens
ttggaatttgcttcagctaata

SEQ ID NO: 8551102 - DNA, 22 bp, Homo sapiens
ttggaatttgagaccaagaaaa

SEQ ID NO: 8551103 - DNA, 22 bp, Homo sapiens
ttggaaattgcaagtgatttgc

SEQ ID NO: 8551104 - DNA, 22 bp, Homo sapiens
ttggaacaatcacatccttgct

SEQ ID NO: 8551105 - DNA, 21 bp, Homo sapiens
ttggaacaagcagcagtttgc

SEQ ID NO: 8551106 - DNA, 22 bp, Homo sapiens
ttggaaatgcatttgttattat

SEQ ID NO: 8551107 - DNA, 22 bp, Homo sapiens
ttggaaatgatttctattatta

SEQ ID NO: 8551108 - DNA, 22 bp, Homo sapiens
ttgacaaaggctgagaggaaaa

SEQ ID NO: 8551109 - DNA, 22 bp, Homo sapiens
ttgacaaaggctgagaggaaaa

SEQ ID NO: 8551110 - DNA, 22 bp, Homo sapiens
ttgacaaaggctgagaggaaaa

SEQ ID NO: 8551111 - DNA, 22 bp, Homo sapiens
ttgacaaaggaccttgctattt

SEQ ID NO: 8551112 - DNA, 22 bp, Homo sapiens
ttgacaaaggaccttgctattt

SEQ ID NO: 8551113 - DNA, 22 bp, Homo sapiens
ttgacaaaggaattgaatctct

SEQ ID NO: 8551114 - DNA, 22 bp, Homo sapiens
ttgacaaaggaattgaatctct

SEQ ID NO: 8551115 - DNA, 22 bp, Homo sapiens
ttgacaaaggaattgaatctct

SEQ ID NO: 8551116 - DNA, 22 bp, Homo sapiens
ttgacaaagatatattcatgct

SEQ ID NO: 8551117 - DNA, 22 bp, Homo sapiens
ttgacaaaaataacacagcata

SEQ ID NO: 8551118 - DNA, 22 bp, Homo sapiens
ttgacaaaaacctcatttcacc

SEQ ID NO: 8551119 - DNA, 22 bp, Homo sapiens
ttgacaaaacaacacagatttc

SEQ ID NO: 8551120 - DNA, 22 bp, Homo sapiens
ttgacaaaacaacacagatttc

SEQ ID NO: 8551121 - DNA, 22 bp, Homo sapiens
ttgacaaaacaacacagatttc

SEQ ID NO: 8551122 - DNA, 22 bp, Homo sapiens
ttgacacagatcaatattcaac

SEQ ID NO: 8551123 - DNA, 22 bp, Homo sapiens
ttgacacaaacagtgatgtagt

SEQ ID NO: 8551124 - DNA, 22 bp, Homo sapiens
ttgacaatgtcctttgaatttc

SEQ ID NO: 8551125 - DNA, 22 bp, Homo sapiens
ttgacaatgtcctttgaatttc

SEQ ID NO: 8551126 - DNA, 22 bp, Homo sapiens
ttgacaatgtcctttgaatttc

SEQ ID NO: 8551127 - DNA, 22 bp, Homo sapiens
ttgacaatccctgttagaagtg

SEQ ID NO: 8551128 - DNA, 22 bp, Homo sapiens
ttgacaagaatcgttgccttgg

SEQ ID NO: 8551129 - DNA, 22 bp, Homo sapiens
ttgacaagcgaagtaccataat

SEQ ID NO: 8551130 - DNA, 22 bp, Homo sapiens
ttgacaaagtttagtaataatc

SEQ ID NO: 8551131 - DNA, 22 bp, Homo sapiens
ttgacaaagtttagtaataatc

SEQ ID NO: 8551132 - DNA, 22 bp, Homo sapiens
ttgacaaagtttagtaataatc

SEQ ID NO: 8551133 - DNA, 22 bp, Homo sapiens
ttgacaaagtttagtaataatc

SEQ ID NO: 8551134 - DNA, 22 bp, Homo sapiens
ttgacaaatacccattagacca

SEQ ID NO: 8551135 - DNA, 22 bp, Homo sapiens
ttgacaagaacaccggtttgag

SEQ ID NO: 8551136 - DNA, 22 bp, Homo sapiens
ttgacaaatacccattagacca

SEQ ID NO: 8551137 - DNA, 22 bp, Homo sapiens
ttgcagacagtgagagtgaaag

SEQ ID NO: 8551138 - DNA, 22 bp, Homo sapiens
ttgcagagaggttaggaactca

SEQ ID NO: 8551139 - DNA, 17 bp, Homo sapiens
ttgcagactttttatta

SEQ ID NO: 8551140 - DNA, 17 bp, Homo sapiens
ttgcagactttttatta

SEQ ID NO: 8551141 - DNA, 21 bp, Homo sapiens
ttgcacagaaaaccatagaga

SEQ ID NO: 8551142 - DNA, 22 bp, Homo sapiens
ttgcagagatcagcaggtttga

SEQ ID NO: 8551143 - DNA, 22 bp, Homo sapiens
ttgcagagatcagcaggtttga

SEQ ID NO: 8551144 - DNA, 22 bp, Homo sapiens
ttgcagagccatgaggctggct

SEQ ID NO: 8551145 - DNA, 22 bp, Homo sapiens
ttgcagagccatgaggctggct

SEQ ID NO: 8551146 - DNA, 22 bp, Homo sapiens
ttgcagagcagtaggaatatag

SEQ ID NO: 8551147 - DNA, 22 bp, Homo sapiens
ttgcagagtggttgtgaggatt

SEQ ID NO: 8551148 - DNA, 22 bp, Homo sapiens
ttgcagaggcaaaaatgaactc

SEQ ID NO: 8551149 - DNA, 22 bp, Homo sapiens
ttgacagatgtgaaagtgagca

SEQ ID NO: 8551150 - DNA, 22 bp, Homo sapiens
ttgacactaagatttccaaaca

SEQ ID NO: 8551151 - DNA, 22 bp, Homo sapiens
ttgcaattgctatggagagcgt

SEQ ID NO: 8551152 - DNA, 22 bp, Homo sapiens
ttgacaggatataaagacataa

SEQ ID NO: 8551153 - DNA, 23 bp, Homo sapiens
ttgacagtaggtggttttcattg

SEQ ID NO: 8551154 - DNA, 22 bp, Homo sapiens
ttgcagggaaacagtttaggaa

SEQ ID NO: 8551155 - DNA, 22 bp, Homo sapiens
ttgcagggaaatagaaataaac

SEQ ID NO: 8551156 - DNA, 22 bp, Homo sapiens
ttgcaggattttagagatgaca

SEQ ID NO: 8551157 - DNA, 22 bp, Homo sapiens
ttgcaggaaactgagtgtgagc

SEQ ID NO: 8551158 - DNA, 22 bp, Homo sapiens
ttgcagggacctgcagaaagct

SEQ ID NO: 8551159 - DNA, 22 bp, Homo sapiens
ttgcagggacctgcagaaagct

SEQ ID NO: 8551160 - DNA, 22 bp, Homo sapiens
ttgcagggaaatcagtgaggat

SEQ ID NO: 8551161 - DNA, 23 bp, Homo sapiens
ttgcagggatggagttcaaaatg

SEQ ID NO: 8551162 - DNA, 22 bp, Homo sapiens
ttgcagggataaaacaagtgaa

SEQ ID NO: 8551163 - DNA, 22 bp, Homo sapiens
ttgcagggattaccttattttt

SEQ ID NO: 8551164 - DNA, 22 bp, Homo sapiens
ttgcagcatattgatctcctgt

SEQ ID NO: 8551165 - DNA, 22 bp, Homo sapiens
ttgcagcatgcatagacactgc

SEQ ID NO: 8551166 - DNA, 19 bp, Homo sapiens
ttgcagcaaagttaggacc

SEQ ID NO: 8551167 - DNA, 22 bp, Homo sapiens
ttgcagattaaaacactgagct

SEQ ID NO: 8551168 - DNA, 22 bp, Homo sapiens
ttgcagcagggtgaattcactc

SEQ ID NO: 8551169 - DNA, 20 bp, Homo sapiens
ttgcagcagtgaggtgaagg

SEQ ID NO: 8551170 - DNA, 20 bp, Homo sapiens
ttgcagcagtgaggtgaagg

SEQ ID NO: 8551171 - DNA, 22 bp, Homo sapiens
ttgcagcagggtgaattcactc

SEQ ID NO: 8551172 - DNA, 22 bp, Homo sapiens
ttgcagcagctctttgaatgtt

SEQ ID NO: 8551173 - DNA, 23 bp, Homo sapiens
ttgcatgtagcccatgagtaact

SEQ ID NO: 8551174 - DNA, 22 bp, Homo sapiens
ttgcagtaggtggagtgaattt

SEQ ID NO: 8551175 - DNA, 22 bp, Homo sapiens
ttgcagggttgaccaataggct

SEQ ID NO: 8551176 - DNA, 22 bp, Homo sapiens
ttgcagggttgacactgcctgc

SEQ ID NO: 8551177 - DNA, 22 bp, Homo sapiens
ttgcagggttaaagtaaggtag

SEQ ID NO: 8551178 - DNA, 18 bp, Homo sapiens
ttgcaggtacctctatct

SEQ ID NO: 8551179 - DNA, 22 bp, Homo sapiens
ttgcaggtgagggaaatgactg

SEQ ID NO: 8551180 - DNA, 22 bp, Homo sapiens
ttgcagggccttggcttcttcc

SEQ ID NO: 8551181 - DNA, 22 bp, Homo sapiens
ttgcagggcttggggattacag

SEQ ID NO: 8551182 - DNA, 22 bp, Homo sapiens
ttgcagggctggaacatggaat

SEQ ID NO: 8551183 - DNA, 22 bp, Homo sapiens
ttgcagggcaggaccatggaca

SEQ ID NO: 8551184 - DNA, 22 bp, Homo sapiens
ttgcagggcaggaccatggaca

SEQ ID NO: 8551185 - DNA, 22 bp, Homo sapiens
ttgcagggcaaatggtcagata

SEQ ID NO: 8551186 - DNA, 22 bp, Homo sapiens
ttgcagggcatcgcgtacttct

SEQ ID NO: 8551187 - DNA, 22 bp, Homo sapiens
ttgcagggcatctatgtctggt

SEQ ID NO: 8551188 - DNA, 22 bp, Homo sapiens
ttgcaggggaaggagcagagct

SEQ ID NO: 8551189 - DNA, 22 bp, Homo sapiens
ttgcaggggaaggagcagagct

SEQ ID NO: 8551190 - DNA, 22 bp, Homo sapiens
ttgcaggggagaggaacaaaca

SEQ ID NO: 8551191 - DNA, 22 bp, Homo sapiens
ttgcagggtcctgtggctctcc

SEQ ID NO: 8551192 - DNA, 22 bp, Homo sapiens
ttgcagggtacattcttagaat

SEQ ID NO: 8551193 - DNA, 22 bp, Homo sapiens
ttgcagggtcccagaggcctgg

SEQ ID NO: 8551194 - DNA, 22 bp, Homo sapiens
ttggccatctaagcccagccac

SEQ ID NO: 8551195 - DNA, 22 bp, Homo sapiens
ttggccatctaagcccagccac

SEQ ID NO: 8551196 - DNA, 22 bp, Homo sapiens
ttggcccacagtaccatgctgt

SEQ ID NO: 8551197 - DNA, 22 bp, Homo sapiens
ttgggaaggcgtggaagcagaa

SEQ ID NO: 8551198 - DNA, 22 bp, Homo sapiens
ttggccagcagctctggcttag

SEQ ID NO: 8551199 - DNA, 22 bp, Homo sapiens
ttggccagcgacgaccttctta

SEQ ID NO: 8551200 - DNA, 22 bp, Homo sapiens
ttggccaggtccatttctccat

SEQ ID NO: 8551201 - DNA, 20 bp, Homo sapiens
ttggcagttaagaatcttac

SEQ ID NO: 8551202 - DNA, 22 bp, Homo sapiens
ttggcataccttagtggtggag

SEQ ID NO: 8551203 - DNA, 22 bp, Homo sapiens
ttggcattcatgggacaacaaa

SEQ ID NO: 8551204 - DNA, 22 bp, Homo sapiens
ttggccagtgaaccaggcctgg

SEQ ID NO: 8551205 - DNA, 22 bp, Homo sapiens
ttggccagtgaaccaggcctgg

SEQ ID NO: 8551206 - DNA, 22 bp, Homo sapiens
ttggccaggtgtccagcccagg

SEQ ID NO: 8551207 - DNA, 22 bp, Homo sapiens
ttggccagtggaaagaggagga

SEQ ID NO: 8551208 - DNA, 22 bp, Homo sapiens
ttgggacatctggcatacagtt

SEQ ID NO: 8551209 - DNA, 17 bp, Homo sapiens
ttgggagagaaaggtat

SEQ ID NO: 8551210 - DNA, 22 bp, Homo sapiens
ttgggaggtaatggagccaagt

SEQ ID NO: 8551211 - DNA, 22 bp, Homo sapiens
ttgggcaggtgtggctctcctt

SEQ ID NO: 8551212 - DNA, 22 bp, Homo sapiens
ttgggcagtgattagttcatga

SEQ ID NO: 8551213 - DNA, 22 bp, Homo sapiens
ttgggcagtgattagttcatga

SEQ ID NO: 8551214 - DNA, 22 bp, Homo sapiens
ttgggcccatggggctaagcta

SEQ ID NO: 8551215 - DNA, 22 bp, Homo sapiens
ttggagagtgatattcagatgc

SEQ ID NO: 8551216 - DNA, 22 bp, Homo sapiens
ttggagagtgatattcagatgc

SEQ ID NO: 8551217 - DNA, 22 bp, Homo sapiens
ttggagagtgatattcagatgc

SEQ ID NO: 8551218 - DNA, 22 bp, Homo sapiens
ttggagagggcttggatcacac

SEQ ID NO: 8551219 - DNA, 22 bp, Homo sapiens
ttggagagggcttggatcacac

SEQ ID NO: 8551220 - DNA, 23 bp, Homo sapiens
ttggagagggtgagtagtgtcag

SEQ ID NO: 8551221 - DNA, 23 bp, Homo sapiens
ttggagagggtgagtagtgtcag

SEQ ID NO: 8551222 - DNA, 22 bp, Homo sapiens
ttggagagatttaggtctcagt

SEQ ID NO: 8551223 - DNA, 22 bp, Homo sapiens
ttggagagatttaggtctcagt

SEQ ID NO: 8551224 - DNA, 22 bp, Homo sapiens
ttggagagcagtaaaccacact

SEQ ID NO: 8551225 - DNA, 22 bp, Homo sapiens
ttggagagcagtaaaccacact

SEQ ID NO: 8551226 - DNA, 22 bp, Homo sapiens
ttggagagggcttggatcacac

SEQ ID NO: 8551227 - DNA, 22 bp, Homo sapiens
ttggagaggcagtcttgctctg

SEQ ID NO: 8551228 - DNA, 22 bp, Homo sapiens
ttggagaggcagtcttgctctg

SEQ ID NO: 8551229 - DNA, 22 bp, Homo sapiens
ttggagaggcagtcttgctctg

SEQ ID NO: 8551230 - DNA, 22 bp, Homo sapiens
ttggagatatcacaccttcaca

SEQ ID NO: 8551231 - DNA, 22 bp, Homo sapiens
ttggagagttaattgacagtta

SEQ ID NO: 8551232 - DNA, 22 bp, Homo sapiens
ttggagagttaattgacagtta

SEQ ID NO: 8551233 - DNA, 22 bp, Homo sapiens
ttggagatatcacaccttcaca

SEQ ID NO: 8551234 - DNA, 22 bp, Homo sapiens
ttggagatatcacaccttcaca

SEQ ID NO: 8551235 - DNA, 22 bp, Homo sapiens
ttggagccatgcccagctctct

SEQ ID NO: 8551236 - DNA, 22 bp, Homo sapiens
ttggagccctgaggatctggat

SEQ ID NO: 8551237 - DNA, 22 bp, Homo sapiens
ttggagccctgaggatctggat

SEQ ID NO: 8551238 - DNA, 22 bp, Homo sapiens
ttggagatatcacaccttcaca

SEQ ID NO: 8551239 - DNA, 22 bp, Homo sapiens
ttggactcctctttcctcttgg

SEQ ID NO: 8551240 - DNA, 18 bp, Homo sapiens
ttggacctgtgtcagggc

SEQ ID NO: 8551241 - DNA, 22 bp, Homo sapiens
ttggagagaggctgctcaggct

SEQ ID NO: 8551242 - DNA, 22 bp, Homo sapiens
ttggagagaggctgctcaggct

SEQ ID NO: 8551243 - DNA, 22 bp, Homo sapiens
ttggagagaggctgctcaggct

SEQ ID NO: 8551244 - DNA, 22 bp, Homo sapiens
ttggagagattatcagaccagc

SEQ ID NO: 8551245 - DNA, 22 bp, Homo sapiens
ttggagagattatcagaccagc

SEQ ID NO: 8551246 - DNA, 22 bp, Homo sapiens
ttggagagattatcagaccagc

SEQ ID NO: 8551247 - DNA, 22 bp, Homo sapiens
ttggagagatttaggtctcagt

SEQ ID NO: 8551248 - DNA, 22 bp, Homo sapiens
ttggagaatgttttcctgcagt

SEQ ID NO: 8551249 - DNA, 22 bp, Homo sapiens
ttggagagaggctgctcaggct

SEQ ID NO: 8551250 - DNA, 22 bp, Homo sapiens
ttggactggtttacatttcaag

SEQ ID NO: 8551251 - DNA, 22 bp, Homo sapiens
ttggactgagagttccaccatt

SEQ ID NO: 8551252 - DNA, 22 bp, Homo sapiens
ttggactctgggattctggatt

SEQ ID NO: 8551253 - DNA, 22 bp, Homo sapiens
ttggactgaatctttctcacac

SEQ ID NO: 8551254 - DNA, 22 bp, Homo sapiens
ttggcagtagtggtagtacatt

SEQ ID NO: 8551255 - DNA, 21 bp, Homo sapiens
ttggcagtcagaaatgtgagg

SEQ ID NO: 8551256 - DNA, 22 bp, Homo sapiens
ttggcagtccaggattaatata

SEQ ID NO: 8551257 - DNA, 22 bp, Homo sapiens
ttggcagtgtctgcaaaatgga

SEQ ID NO: 8551258 - DNA, 22 bp, Homo sapiens
ttggcagtgtctgcaaaatgga

SEQ ID NO: 8551259 - DNA, 22 bp, Homo sapiens
ttggcagtgatgcagcttgttc

SEQ ID NO: 8551260 - DNA, 22 bp, Homo sapiens
ttggcagggcatcagacacgtg

SEQ ID NO: 8551261 - DNA, 22 bp, Homo sapiens
ttggcagggccaggctctctct

SEQ ID NO: 8551262 - DNA, 22 bp, Homo sapiens
ttggcagggcatcagacacgtg

SEQ ID NO: 8551263 - DNA, 22 bp, Homo sapiens
ttggcagtaaaagaaaatgctt

SEQ ID NO: 8551264 - DNA, 22 bp, Homo sapiens
ttggcagtaaaagaaaatgctt

SEQ ID NO: 8551265 - DNA, 22 bp, Homo sapiens
ttggaggaggcattggaggatt

SEQ ID NO: 8551266 - DNA, 23 bp, Homo sapiens
ttggcagcgggtcaggctgtggg

SEQ ID NO: 8551267 - DNA, 22 bp, Homo sapiens
ttgtcccaggacttgcatagat

SEQ ID NO: 8551268 - DNA, 22 bp, Homo sapiens
ttgtccctgcccctgcttgctt

SEQ ID NO: 8551269 - DNA, 22 bp, Homo sapiens
ttgtccagcagctcagtctacg

SEQ ID NO: 8551270 - DNA, 23 bp, Homo sapiens
ttgtccagctggtttgggccaca

SEQ ID NO: 8551271 - DNA, 22 bp, Homo sapiens
ttgtcctgattttgcaacttct

SEQ ID NO: 8551272 - DNA, 22 bp, Homo sapiens
ttgtcctgcaacctcacatggc

SEQ ID NO: 8551273 - DNA, 22 bp, Homo sapiens
ttgtcctgcaacctcacatggc

SEQ ID NO: 8551274 - DNA, 23 bp, Homo sapiens
ttgtcctgccgatctctgagaat

SEQ ID NO: 8551275 - DNA, 22 bp, Homo sapiens
ttgtcctggaggttaatagagt

SEQ ID NO: 8551276 - DNA, 23 bp, Homo sapiens
ttgtcctgccgatctctgagaat

SEQ ID NO: 8551277 - DNA, 20 bp, Homo sapiens
ttgtcacagctttccatcag

SEQ ID NO: 8551278 - DNA, 22 bp, Homo sapiens
ttgtcactagtgaagaatcagg

SEQ ID NO: 8551279 - DNA, 22 bp, Homo sapiens
ttgtcattggggttatttgtta

SEQ ID NO: 8551280 - DNA, 19 bp, Homo sapiens
ttgtccagaaaggcattgc

SEQ ID NO: 8551281 - DNA, 22 bp, Homo sapiens
ttgtccaaggtcccacagttag

SEQ ID NO: 8551282 - DNA, 22 bp, Homo sapiens
ttgtccaaggtcccacagttag

SEQ ID NO: 8551283 - DNA, 22 bp, Homo sapiens
ttgtcatcatcctctttggggt

SEQ ID NO: 8551284 - DNA, 22 bp, Homo sapiens
ttgtcatcaagatgcattggtc

SEQ ID NO: 8551285 - DNA, 22 bp, Homo sapiens
ttgtggctcatcttcagctccc

SEQ ID NO: 8551286 - DNA, 22 bp, Homo sapiens
ttgtcctgtgtctgtttggatt

SEQ ID NO: 8551287 - DNA, 22 bp, Homo sapiens
ttgtggcttctacgcccacagg

SEQ ID NO: 8551288 - DNA, 22 bp, Homo sapiens
ttgtggctgtgcaccgctgcct

SEQ ID NO: 8551289 - DNA, 22 bp, Homo sapiens
ttgtggctgtcgagaattgagg

SEQ ID NO: 8551290 - DNA, 22 bp, Homo sapiens
ttgtggctcttgaggctctcgt

SEQ ID NO: 8551291 - DNA, 22 bp, Homo sapiens
ttgtggctcgtgagatgttagg

SEQ ID NO: 8551292 - DNA, 22 bp, Homo sapiens
ttgtggctcgtgagatgttagg

SEQ ID NO: 8551293 - DNA, 22 bp, Homo sapiens
ttgtggctcgtgagatgttagg

SEQ ID NO: 8551294 - DNA, 22 bp, Homo sapiens
ttgtgggatctccctgttgctc

SEQ ID NO: 8551295 - DNA, 16 bp, Homo sapiens
ttgtggcttttgcaca

SEQ ID NO: 8551296 - DNA, 22 bp, Homo sapiens
ttgtgggatggctcttcccaaa

SEQ ID NO: 8551297 - DNA, 22 bp, Homo sapiens
ttgtgggatggctcttcccaaa

SEQ ID NO: 8551298 - DNA, 22 bp, Homo sapiens
ttgtgtattttttgatactaac

SEQ ID NO: 8551299 - DNA, 22 bp, Homo sapiens
ttgtgtatttcctgaaggtaag

SEQ ID NO: 8551300 - DNA, 22 bp, Homo sapiens
ttgtgtccccctttgagagcca

SEQ ID NO: 8551301 - DNA, 22 bp, Homo sapiens
ttgtgtcctgatttgacacaat

SEQ ID NO: 8551302 - DNA, 22 bp, Homo sapiens
ttgtgtctaaataaggagacct

SEQ ID NO: 8551303 - DNA, 22 bp, Homo sapiens
ttgtgtctaaataaggagacct

SEQ ID NO: 8551304 - DNA, 23 bp, Homo sapiens
ttgtgtctacttcctatctaggg

SEQ ID NO: 8551305 - DNA, 22 bp, Homo sapiens
ttgtgtctggaatgcgtggagc

SEQ ID NO: 8551306 - DNA, 22 bp, Homo sapiens
ttgtgtctatggtttgagcatc

SEQ ID NO: 8551307 - DNA, 22 bp, Homo sapiens
ttgtgtcttaaagattaaatgg

SEQ ID NO: 8551308 - DNA, 22 bp, Homo sapiens
ttgtgtctgggggagtgacatc

SEQ ID NO: 8551309 - DNA, 22 bp, Homo sapiens
ttgtgtctggatttcagctttc

SEQ ID NO: 8551310 - DNA, 22 bp, Homo sapiens
ttgtatttcctataacctttct

SEQ ID NO: 8551311 - DNA, 22 bp, Homo sapiens
ttgtatttcgatgcacgtgtag

SEQ ID NO: 8551312 - DNA, 22 bp, Homo sapiens
ttgtatttcgatgcacgtgtag

SEQ ID NO: 8551313 - DNA, 22 bp, Homo sapiens
ttgtatttctccactttctgtt

SEQ ID NO: 8551314 - DNA, 22 bp, Homo sapiens
ttgtatttctccactttctgtt

SEQ ID NO: 8551315 - DNA, 23 bp, Homo sapiens
ttgtatttttagtagagacaggg

SEQ ID NO: 8551316 - DNA, 22 bp, Homo sapiens
ttgtattttttcctggcggtgg

SEQ ID NO: 8551317 - DNA, 22 bp, Homo sapiens
ttgtattttttcctggcggtgg

SEQ ID NO: 8551318 - DNA, 23 bp, Homo sapiens
ttgtacagcccagattcctcttc

SEQ ID NO: 8551319 - DNA, 22 bp, Homo sapiens
ttgtacagggaagtaatacaag

SEQ ID NO: 8551320 - DNA, 22 bp, Homo sapiens
ttgtacagaaaaaattcttggt

SEQ ID NO: 8551321 - DNA, 22 bp, Homo sapiens
ttgtacacacaggaacaaacgt

SEQ ID NO: 8551322 - DNA, 22 bp, Homo sapiens
ttgtacaagttttgagcttaag

SEQ ID NO: 8551323 - DNA, 22 bp, Homo sapiens
ttgtacaagttttgagcttaag

SEQ ID NO: 8551324 - DNA, 22 bp, Homo sapiens
ttgtacaagtattatgtgaaca

SEQ ID NO: 8551325 - DNA, 22 bp, Homo sapiens
ttgtaacaggtactaaataact

SEQ ID NO: 8551326 - DNA, 22 bp, Homo sapiens
ttgtaacaggcactctgtgcca

SEQ ID NO: 8551327 - DNA, 22 bp, Homo sapiens
ttgtaacaggtactaaataact

SEQ ID NO: 8551328 - DNA, 22 bp, Homo sapiens
ttgtaacaggtactaaataact

SEQ ID NO: 8551329 - DNA, 22 bp, Homo sapiens
ttgtaacagtagctgtcagctc

SEQ ID NO: 8551330 - DNA, 22 bp, Homo sapiens
ttgtaacagtagctgtcagctc

SEQ ID NO: 8551331 - DNA, 22 bp, Homo sapiens
ttgtaacatcaccatcaaaatc

SEQ ID NO: 8551332 - DNA, 22 bp, Homo sapiens
ttgtaactctgaatacatccta

SEQ ID NO: 8551333 - DNA, 22 bp, Homo sapiens
ttgtaactctgaatacatccta

SEQ ID NO: 8551334 - DNA, 22 bp, Homo sapiens
ttgtaacttgtgattataatct

SEQ ID NO: 8551335 - DNA, 22 bp, Homo sapiens
ttgtaacttaagttttgcatat

SEQ ID NO: 8551336 - DNA, 22 bp, Homo sapiens
ttgtaactgtgggttgattaga

SEQ ID NO: 8551337 - DNA, 22 bp, Homo sapiens
ttgtaactttgcatactcctgt

SEQ ID NO: 8551338 - DNA, 22 bp, Homo sapiens
ttgtaactttgcatactcctgt

SEQ ID NO: 8551339 - DNA, 22 bp, Homo sapiens
ttgtaacaatctgtcataaatg

SEQ ID NO: 8551340 - DNA, 21 bp, Homo sapiens
ttgtaaatggctttttccttc

SEQ ID NO: 8551341 - DNA, 22 bp, Homo sapiens
ttgtaacaatctgtcataaatg

SEQ ID NO: 8551342 - DNA, 22 bp, Homo sapiens
ttgtaacacttttctattaata

SEQ ID NO: 8551343 - DNA, 22 bp, Homo sapiens
ttgtaacagctgtttatatagt

SEQ ID NO: 8551344 - DNA, 22 bp, Homo sapiens
ttgtaacagctgcttaatagag

SEQ ID NO: 8551345 - DNA, 22 bp, Homo sapiens
ttgtaacagctgtttatatagt

SEQ ID NO: 8551346 - DNA, 22 bp, Homo sapiens
ttgggccctgctctgagttgct

SEQ ID NO: 8551347 - DNA, 22 bp, Homo sapiens
ttgtaaactgctgcaggagtgc

SEQ ID NO: 8551348 - DNA, 22 bp, Homo sapiens
ttgtaaatagtagtaagatgcc

SEQ ID NO: 8551349 - DNA, 22 bp, Homo sapiens
ttgtaaatgaccttttctaatt

SEQ ID NO: 8551350 - DNA, 22 bp, Homo sapiens
ttttctgaagtttaagacattt

SEQ ID NO: 8551351 - DNA, 22 bp, Homo sapiens
ttttctgaagtttaagacattt

SEQ ID NO: 8551352 - DNA, 22 bp, Homo sapiens
ttttctgaagtttaagacattt

SEQ ID NO: 8551353 - DNA, 22 bp, Homo sapiens
ttttctcttgttaatgtactga

SEQ ID NO: 8551354 - DNA, 22 bp, Homo sapiens
ttttctcttgttaatgtactga

SEQ ID NO: 8551355 - DNA, 19 bp, Homo sapiens
ttttctcagcttctagcgg

SEQ ID NO: 8551356 - DNA, 22 bp, Homo sapiens
ttttctcagctgcactgtatta

SEQ ID NO: 8551357 - DNA, 22 bp, Homo sapiens
ttttctcagctgcactgtatta

SEQ ID NO: 8551358 - DNA, 22 bp, Homo sapiens
ttttctcagctgcactgtatta

SEQ ID NO: 8551359 - DNA, 22 bp, Homo sapiens
ttttctattcattgtctatggt

SEQ ID NO: 8551360 - DNA, 22 bp, Homo sapiens
ttttctattcattgtctatggt

SEQ ID NO: 8551361 - DNA, 22 bp, Homo sapiens
ttttcatttttgtagatgcaag

SEQ ID NO: 8551362 - DNA, 22 bp, Homo sapiens
ttttcatttacattagggaaga

SEQ ID NO: 8551363 - DNA, 22 bp, Homo sapiens
ttttcatttacattagggaaga

SEQ ID NO: 8551364 - DNA, 22 bp, Homo sapiens
ttttcatttttgtagatgcaag

SEQ ID NO: 8551365 - DNA, 22 bp, Homo sapiens
ttttcatttttgtagatgcaag

SEQ ID NO: 8551366 - DNA, 22 bp, Homo sapiens
ttttctgtaagaggactttaat

SEQ ID NO: 8551367 - DNA, 22 bp, Homo sapiens
ttttctgtattattgtgcttca

SEQ ID NO: 8551368 - DNA, 22 bp, Homo sapiens
ttttctgtattattgtgcttca

SEQ ID NO: 8551369 - DNA, 22 bp, Homo sapiens
ttttctgcggtgtgaatggcct

SEQ ID NO: 8551370 - DNA, 22 bp, Homo sapiens
ttttctgcctgcgtgtttagga

SEQ ID NO: 8551371 - DNA, 22 bp, Homo sapiens
ttttctgacctatctacattta

SEQ ID NO: 8551372 - DNA, 22 bp, Homo sapiens
ttttctgtgtgtccctcgacag

SEQ ID NO: 8551373 - DNA, 22 bp, Homo sapiens
ttttctgtgtatccaggcttcc

SEQ ID NO: 8551374 - DNA, 22 bp, Homo sapiens
ttttctgttacaaagtacagcg

SEQ ID NO: 8551375 - DNA, 22 bp, Homo sapiens
ttttctgtttacagagggacct

SEQ ID NO: 8551376 - DNA, 22 bp, Homo sapiens
ttttctgtgccctgctagctgg

SEQ ID NO: 8551377 - DNA, 22 bp, Homo sapiens
ttttctgtggtcagagcttgag

SEQ ID NO: 8551378 - DNA, 22 bp, Homo sapiens
ttttctgtgattctgaggttgg

SEQ ID NO: 8551379 - DNA, 20 bp, Homo sapiens
ttttctgtgccaagaaaact

SEQ ID NO: 8551380 - DNA, 22 bp, Homo sapiens
ttttcttactgtctgtgatcct

SEQ ID NO: 8551381 - DNA, 22 bp, Homo sapiens
ttttcttactgtctgtgatcct

SEQ ID NO: 8551382 - DNA, 22 bp, Homo sapiens
ttttctgtttgcttcaagacat

SEQ ID NO: 8551383 - DNA, 22 bp, Homo sapiens
ttttcttactgtctgtgatcct

SEQ ID NO: 8551384 - DNA, 22 bp, Homo sapiens
ttttcttaggtgctccaagtag

SEQ ID NO: 8551385 - DNA, 22 bp, Homo sapiens
ttttcttatagagcttaaagtt

SEQ ID NO: 8551386 - DNA, 22 bp, Homo sapiens
ttttcttatggtgaagcacaaa

SEQ ID NO: 8551387 - DNA, 22 bp, Homo sapiens
ttttcttatggtgaagcacaaa

SEQ ID NO: 8551388 - DNA, 22 bp, Homo sapiens
ttttcttatagagcttaaagtt

SEQ ID NO: 8551389 - DNA, 22 bp, Homo sapiens
ttttcttatgtgcagctatatg

SEQ ID NO: 8551390 - DNA, 22 bp, Homo sapiens
ttttcttatggtgaagcacaaa

SEQ ID NO: 8551391 - DNA, 22 bp, Homo sapiens
ttttattggagtgataccaagc

SEQ ID NO: 8551392 - DNA, 22 bp, Homo sapiens
ttttcacacaaggtgataagtt

SEQ ID NO: 8551393 - DNA, 22 bp, Homo sapiens
ttttattggagtgataccaagc

SEQ ID NO: 8551394 - DNA, 22 bp, Homo sapiens
ttttcacacaaggtgataagtt

SEQ ID NO: 8551395 - DNA, 22 bp, Homo sapiens
ttttcacacaaggtgataagtt

SEQ ID NO: 8551396 - DNA, 22 bp, Homo sapiens
ttttcacacaaggtgataagtt

SEQ ID NO: 8551397 - DNA, 19 bp, Homo sapiens
ttttcacatactggatcct

SEQ ID NO: 8551398 - DNA, 22 bp, Homo sapiens
ttttcacatgcttggggactta

SEQ ID NO: 8551399 - DNA, 22 bp, Homo sapiens
ttttcagtttgcactgcagtgc

SEQ ID NO: 8551400 - DNA, 22 bp, Homo sapiens
ttttcatagtaatggtgcatgt

SEQ ID NO: 8551401 - DNA, 22 bp, Homo sapiens
ttttcatctctgctttgtacct

SEQ ID NO: 8551402 - DNA, 22 bp, Homo sapiens
ttttcatctctgctttgtacct

SEQ ID NO: 8551403 - DNA, 22 bp, Homo sapiens
ttttcatgtgatgtgacatttc

SEQ ID NO: 8551404 - DNA, 22 bp, Homo sapiens
ttttcatgtcatgtccttgagg

SEQ ID NO: 8551405 - DNA, 22 bp, Homo sapiens
ttttcatgtcatgtccttgagg

SEQ ID NO: 8551406 - DNA, 22 bp, Homo sapiens
ttttcattgagcacctgagtaa

SEQ ID NO: 8551407 - DNA, 22 bp, Homo sapiens
ttttcattgagcacctgagtaa

SEQ ID NO: 8551408 - DNA, 22 bp, Homo sapiens
ttttcattgtaaatcaggaaac

SEQ ID NO: 8551409 - DNA, 22 bp, Homo sapiens
ttttcattagaatgactgagaa

SEQ ID NO: 8551410 - DNA, 22 bp, Homo sapiens
ttttcattagaatgactgagaa

SEQ ID NO: 8551411 - DNA, 22 bp, Homo sapiens
ttttcatgttccttgttaagtg

SEQ ID NO: 8551412 - DNA, 22 bp, Homo sapiens
ttttcattgttcctcgagcatt

SEQ ID NO: 8551413 - DNA, 22 bp, Homo sapiens
ttttcattgttactatgagcta

SEQ ID NO: 8551414 - DNA, 22 bp, Homo sapiens
ttttcattgttcctcgagcatt

SEQ ID NO: 8551415 - DNA, 22 bp, Homo sapiens
ttttcattgttcctcgagcatt

SEQ ID NO: 8551416 - DNA, 22 bp, Homo sapiens
ttttcattgttactatgagcta

SEQ ID NO: 8551417 - DNA, 22 bp, Homo sapiens
ttttcattgttactatgagcta

SEQ ID NO: 8551418 - DNA, 22 bp, Homo sapiens
ttttcattgtaaatcaggaaac

SEQ ID NO: 8551419 - DNA, 22 bp, Homo sapiens
ttttcattgttactatgagcta

SEQ ID NO: 8551420 - DNA, 22 bp, Homo sapiens
ttttattgcaataaagtgtgta

SEQ ID NO: 8551421 - DNA, 22 bp, Homo sapiens
ttttattgcaataaagtgtgta

SEQ ID NO: 8551422 - DNA, 22 bp, Homo sapiens
ttttattggagtgataccaagc

SEQ ID NO: 8551423 - DNA, 22 bp, Homo sapiens
ttttattggagtgataccaagc

SEQ ID NO: 8551424 - DNA, 22 bp, Homo sapiens
ttttattggagtgataccaagc

SEQ ID NO: 8551425 - DNA, 22 bp, Homo sapiens
ttttattggagtgataccaagc

SEQ ID NO: 8551426 - DNA, 22 bp, Homo sapiens
ttttattgcaataaagtgtgta

SEQ ID NO: 8551427 - DNA, 22 bp, Homo sapiens
ttttattgcaataaagtgtgta

SEQ ID NO: 8551428 - DNA, 22 bp, Homo sapiens
ttttatgtgtgaaatgctgtct

SEQ ID NO: 8551429 - DNA, 22 bp, Homo sapiens
ttttatgtgtcaaagcagtggt

SEQ ID NO: 8551430 - DNA, 22 bp, Homo sapiens
ttttatgtgtcaaagcagtggt

SEQ ID NO: 8551431 - DNA, 22 bp, Homo sapiens
ttttatgttcctctttatgcga

SEQ ID NO: 8551432 - DNA, 22 bp, Homo sapiens
ttttatgttcctctttatgcga

SEQ ID NO: 8551433 - DNA, 22 bp, Homo sapiens
ttttatgttcctgaagctatct

SEQ ID NO: 8551434 - DNA, 22 bp, Homo sapiens
ttttatgttgctataataggta

SEQ ID NO: 8551435 - DNA, 22 bp, Homo sapiens
ttttatgttgctataataggta

SEQ ID NO: 8551436 - DNA, 22 bp, Homo sapiens
ttttattagtggctagatgggg

SEQ ID NO: 8551437 - DNA, 22 bp, Homo sapiens
tttgtgtggtggatactgggta

SEQ ID NO: 8551438 - DNA, 22 bp, Homo sapiens
tttgtgtgcttggtattgaaga

SEQ ID NO: 8551439 - DNA, 22 bp, Homo sapiens
tttgtgtgcttggtattgaaga

SEQ ID NO: 8551440 - DNA, 22 bp, Homo sapiens
tttgtgtgtatatgtatataga

SEQ ID NO: 8551441 - DNA, 22 bp, Homo sapiens
tttgtgtgtatatccttccaga

SEQ ID NO: 8551442 - DNA, 22 bp, Homo sapiens
tttgtgtgcaacgcatggagtc

SEQ ID NO: 8551443 - DNA, 22 bp, Homo sapiens
tttgtgtgaaaatatttaagtt

SEQ ID NO: 8551444 - DNA, 22 bp, Homo sapiens
tttgtgtgcaacgcatggagtc

SEQ ID NO: 8551445 - DNA, 22 bp, Homo sapiens
tttgtgtgcgtctggcctgggg

SEQ ID NO: 8551446 - DNA, 22 bp, Homo sapiens
tttgtaactttagaattgatcc

SEQ ID NO: 8551447 - DNA, 22 bp, Homo sapiens
tttgtaactttagaattgatcc

SEQ ID NO: 8551448 - DNA, 22 bp, Homo sapiens
tttgtaactttagaattgatcc

SEQ ID NO: 8551449 - DNA, 22 bp, Homo sapiens
tttgtaactgagtgctcagagc

SEQ ID NO: 8551450 - DNA, 22 bp, Homo sapiens
tttgtaacctaaagcaccagat

SEQ ID NO: 8551451 - DNA, 22 bp, Homo sapiens
tttgtaacattatggactgctt

SEQ ID NO: 8551452 - DNA, 22 bp, Homo sapiens
tttgtaagagcatatgtaaagg

SEQ ID NO: 8551453 - DNA, 22 bp, Homo sapiens
tttgtaaaggcctgaatttcag

SEQ ID NO: 8551454 - DNA, 22 bp, Homo sapiens
tttgtaaagtctgttctgagtt

SEQ ID NO: 8551455 - DNA, 22 bp, Homo sapiens
tttgtaaagtctgttctgagtt

SEQ ID NO: 8551456 - DNA, 22 bp, Homo sapiens
tttgtaaatagcagtactcatg

SEQ ID NO: 8551457 - DNA, 22 bp, Homo sapiens
tttgtaaatagcagtactcatg

SEQ ID NO: 8551458 - DNA, 22 bp, Homo sapiens
tttgtaacaagttgatctggta

SEQ ID NO: 8551459 - DNA, 22 bp, Homo sapiens
tttgtaacatcccaacaaattt

SEQ ID NO: 8551460 - DNA, 22 bp, Homo sapiens
tttgtaaatagcagtactcatg

SEQ ID NO: 8551461 - DNA, 22 bp, Homo sapiens
tttgtaaaaggaggaagcatgg

SEQ ID NO: 8551462 - DNA, 22 bp, Homo sapiens
tttgtaaaaggaggaagcatgg

SEQ ID NO: 8551463 - DNA, 22 bp, Homo sapiens
tttgtaaaaggaggaagcatgg

SEQ ID NO: 8551464 - DNA, 22 bp, Homo sapiens
tttgtaaaggcctgaatttcag

SEQ ID NO: 8551465 - DNA, 22 bp, Homo sapiens
tttgtaaaattagggaattcaa

SEQ ID NO: 8551466 - DNA, 22 bp, Homo sapiens
tttgtaaaaggaggaagcatgg

SEQ ID NO: 8551467 - DNA, 22 bp, Homo sapiens
tttgtgtttatgaagttattct

SEQ ID NO: 8551468 - DNA, 22 bp, Homo sapiens
tttgtgttggaagaaatgctac

SEQ ID NO: 8551469 - DNA, 22 bp, Homo sapiens
tttgtgttgtacttctgtgcat

SEQ ID NO: 8551470 - DNA, 22 bp, Homo sapiens
tttgtgttgtacttctgtgcat

SEQ ID NO: 8551471 - DNA, 22 bp, Homo sapiens
tttgtgttgtacttctgtgcat

SEQ ID NO: 8551472 - DNA, 22 bp, Homo sapiens
tttgtgttttcccatactattg

SEQ ID NO: 8551473 - DNA, 22 bp, Homo sapiens
tttgttaaaatgcagattctgt

SEQ ID NO: 8551474 - DNA, 22 bp, Homo sapiens
tttgttaaaatgcagattctgt

SEQ ID NO: 8551475 - DNA, 22 bp, Homo sapiens
tttgttaaatatttattgagtg

SEQ ID NO: 8551476 - DNA, 22 bp, Homo sapiens
tttgttaaatatttattgagtg

SEQ ID NO: 8551477 - DNA, 22 bp, Homo sapiens
tttgttaattcttatgttagag

SEQ ID NO: 8551478 - DNA, 22 bp, Homo sapiens
tttgttaattcttatgttagag

SEQ ID NO: 8551479 - DNA, 22 bp, Homo sapiens
tttgttaaggagtattgcttct

SEQ ID NO: 8551480 - DNA, 22 bp, Homo sapiens
tttgttaaggagtattgcttct

SEQ ID NO: 8551481 - DNA, 22 bp, Homo sapiens
tttgttcaacaggtgaaataga

SEQ ID NO: 8551482 - DNA, 22 bp, Homo sapiens
tttgttcaaggaatagtaaatg

SEQ ID NO: 8551483 - DNA, 22 bp, Homo sapiens
tttgttcaaggaatagtaaatg

SEQ ID NO: 8551484 - DNA, 22 bp, Homo sapiens
tttgttataacaataaaaagtc

SEQ ID NO: 8551485 - DNA, 22 bp, Homo sapiens
tttgttataacaataaaaagtc

SEQ ID NO: 8551486 - DNA, 22 bp, Homo sapiens
tttgttcaaaaattataagata

SEQ ID NO: 8551487 - DNA, 22 bp, Homo sapiens
ttttatgtaatccttactgtcg

SEQ ID NO: 8551488 - DNA, 22 bp, Homo sapiens
ttttatgtaataaactgtacac

SEQ ID NO: 8551489 - DNA, 22 bp, Homo sapiens
ttttatgtgctggactggcagt

SEQ ID NO: 8551490 - DNA, 22 bp, Homo sapiens
ttttatgtgctggactggcagt

SEQ ID NO: 8551491 - DNA, 22 bp, Homo sapiens
ttttaattgcaattatggtccc

SEQ ID NO: 8551492 - DNA, 22 bp, Homo sapiens
ttttatgagaatgcgccacttg

SEQ ID NO: 8551493 - DNA, 18 bp, Homo sapiens
ttttaatttcaggggtgg

SEQ ID NO: 8551494 - DNA, 22 bp, Homo sapiens
ttttatgattgagctggctaca

SEQ ID NO: 8551495 - DNA, 22 bp, Homo sapiens
ttttatgagtgtccctctgtgg

SEQ ID NO: 8551496 - DNA, 22 bp, Homo sapiens
ttttatgcaagttatgattaaa

SEQ ID NO: 8551497 - DNA, 22 bp, Homo sapiens
ttttatgcaagttatgattaaa

SEQ ID NO: 8551498 - DNA, 21 bp, Homo sapiens
ttttatgcataggaaatatat

SEQ ID NO: 8551499 - DNA, 22 bp, Homo sapiens
ttttaatcctcttggtatctta

SEQ ID NO: 8551500 - DNA, 22 bp, Homo sapiens
ttttaatcatgcttctatgtcc

SEQ ID NO: 8551501 - DNA, 22 bp, Homo sapiens
ttttaagaaatgtatgactgtc

SEQ ID NO: 8551502 - DNA, 22 bp, Homo sapiens
ttttaattcaaagtgaatagtg

SEQ ID NO: 8551503 - DNA, 22 bp, Homo sapiens
ttttaattcaaagtgaatagtg

SEQ ID NO: 8551504 - DNA, 22 bp, Homo sapiens
ttttaatgtgctctgcaatgat

SEQ ID NO: 8551505 - DNA, 22 bp, Homo sapiens
ttttaatgtgctctgcaatgat

SEQ ID NO: 8551506 - DNA, 22 bp, Homo sapiens
ttttaatgtgctctgcaatgat

SEQ ID NO: 8551507 - DNA, 22 bp, Homo sapiens
ttttaaatctccagttgacccc

SEQ ID NO: 8551508 - DNA, 22 bp, Homo sapiens
ttttaaatctccagttgacccc

SEQ ID NO: 8551509 - DNA, 22 bp, Homo sapiens
ttttaaatctccagttgacccc

SEQ ID NO: 8551510 - DNA, 22 bp, Homo sapiens
ttttaaatctccagttgacccc

SEQ ID NO: 8551511 - DNA, 22 bp, Homo sapiens
ttttaaatctccagttgacccc

SEQ ID NO: 8551512 - DNA, 22 bp, Homo sapiens
ttttaaaggctgtatgaccaag

SEQ ID NO: 8551513 - DNA, 22 bp, Homo sapiens
ttttaaaggctgtatgaccaag

SEQ ID NO: 8551514 - DNA, 22 bp, Homo sapiens
ttttaacttaaaatacatagat

SEQ ID NO: 8551515 - DNA, 22 bp, Homo sapiens
ttttaacttaaaatacatagat

SEQ ID NO: 8551516 - DNA, 22 bp, Homo sapiens
ttttaagaaatgtatgactgtc

SEQ ID NO: 8551517 - DNA, 22 bp, Homo sapiens
ttttaagaaatgtatgactgtc

SEQ ID NO: 8551518 - DNA, 21 bp, Homo sapiens
ttttaacaaggatttccctag

SEQ ID NO: 8551519 - DNA, 21 bp, Homo sapiens
ttttaacaaggatttccctag

SEQ ID NO: 8551520 - DNA, 22 bp, Homo sapiens
ttttaacactcagcactatctc

SEQ ID NO: 8551521 - DNA, 22 bp, Homo sapiens
ttttaacactcagcactatctc

SEQ ID NO: 8551522 - DNA, 22 bp, Homo sapiens
tttgttcaatccagacaatagc

SEQ ID NO: 8551523 - DNA, 22 bp, Homo sapiens
ttttaaaggcagattatggctt

SEQ ID NO: 8551524 - DNA, 22 bp, Homo sapiens
ttttaaaggcagattatggctt

SEQ ID NO: 8551525 - DNA, 22 bp, Homo sapiens
ttttaaaggatactcttgtcta

SEQ ID NO: 8551526 - DNA, 22 bp, Homo sapiens
ttttaaagagatgctgtgcata

SEQ ID NO: 8551527 - DNA, 21 bp, Homo sapiens
tttgattcttcctctccccag

SEQ ID NO: 8551528 - DNA, 22 bp, Homo sapiens
tttgattctgtaaaataacagg

SEQ ID NO: 8551529 - DNA, 22 bp, Homo sapiens
tttgattctaagttctgtcaac

SEQ ID NO: 8551530 - DNA, 22 bp, Homo sapiens
tttgattctcaattgccctctg

SEQ ID NO: 8551531 - DNA, 22 bp, Homo sapiens
tttgattctggcctctgagaag

SEQ ID NO: 8551532 - DNA, 22 bp, Homo sapiens
tttgattcaatgtttatataaa

SEQ ID NO: 8551533 - DNA, 22 bp, Homo sapiens
tttgattctaagttctgtcaac

SEQ ID NO: 8551534 - DNA, 22 bp, Homo sapiens
tttgattcctggggcagggctg

SEQ ID NO: 8551535 - DNA, 22 bp, Homo sapiens
tttgattcaaaaaccactccac

SEQ ID NO: 8551536 - DNA, 22 bp, Homo sapiens
tttgattgtcacctaccttgca

SEQ ID NO: 8551537 - DNA, 22 bp, Homo sapiens
tttgattgtcacctaccttgca

SEQ ID NO: 8551538 - DNA, 22 bp, Homo sapiens
tttgatttactggatattctca

SEQ ID NO: 8551539 - DNA, 22 bp, Homo sapiens
tttgatgaacctatataatttg

SEQ ID NO: 8551540 - DNA, 19 bp, Homo sapiens
tttgatgagaatttaagca

SEQ ID NO: 8551541 - DNA, 22 bp, Homo sapiens
tttgatgatgatgataaagttt

SEQ ID NO: 8551542 - DNA, 22 bp, Homo sapiens
tttgatgctaagatttaataaa

SEQ ID NO: 8551543 - DNA, 22 bp, Homo sapiens
tttgatgagtttaataacagcc

SEQ ID NO: 8551544 - DNA, 22 bp, Homo sapiens
tttgatgagtttaataacagcc

SEQ ID NO: 8551545 - DNA, 22 bp, Homo sapiens
tttgatgatgatgataaagttt

SEQ ID NO: 8551546 - DNA, 22 bp, Homo sapiens
tttgctttgactgtcagcaagt

SEQ ID NO: 8551547 - DNA, 22 bp, Homo sapiens
tttgctttgactgtcagcaagt

SEQ ID NO: 8551548 - DNA, 22 bp, Homo sapiens
tttgctttgggaggttgtctgg

SEQ ID NO: 8551549 - DNA, 22 bp, Homo sapiens
tttgctttgggaggttgtctgg

SEQ ID NO: 8551550 - DNA, 18 bp, Homo sapiens
tttgctttccttcttcag

SEQ ID NO: 8551551 - DNA, 18 bp, Homo sapiens
tttgctttccttcttcag

SEQ ID NO: 8551552 - DNA, 22 bp, Homo sapiens
tttgcttgttcaagatttctgt

SEQ ID NO: 8551553 - DNA, 22 bp, Homo sapiens
tttgcttgttcaagatttctgt

SEQ ID NO: 8551554 - DNA, 22 bp, Homo sapiens
tttgcttgttcaagatttctgt

SEQ ID NO: 8551555 - DNA, 22 bp, Homo sapiens
tttgatttactggatattctca

SEQ ID NO: 8551556 - DNA, 22 bp, Homo sapiens
tttgatttactggatattctca

SEQ ID NO: 8551557 - DNA, 22 bp, Homo sapiens
tttgcttgttcaagatttctgt

SEQ ID NO: 8551558 - DNA, 22 bp, Homo sapiens
tttgatcagcaagataaataga

SEQ ID NO: 8551559 - DNA, 19 bp, Homo sapiens
tttgatatctgaattatgc

SEQ ID NO: 8551560 - DNA, 22 bp, Homo sapiens
tttgatccgttgctggtgagga

SEQ ID NO: 8551561 - DNA, 22 bp, Homo sapiens
tttgatccgttgctggtgagga

SEQ ID NO: 8551562 - DNA, 22 bp, Homo sapiens
tttgatccgttgctggtgagga

SEQ ID NO: 8551563 - DNA, 22 bp, Homo sapiens
tttgatcatgaagaggataaac

SEQ ID NO: 8551564 - DNA, 22 bp, Homo sapiens
tttgatgaaagctactatttac

SEQ ID NO: 8551565 - DNA, 22 bp, Homo sapiens
tttgatctatgcgtggtttccc

SEQ ID NO: 8551566 - DNA, 22 bp, Homo sapiens
tttgatactgagaaaaacaaat

SEQ ID NO: 8551567 - DNA, 22 bp, Homo sapiens
tttgatatcctatacaagtaaa

SEQ ID NO: 8551568 - DNA, 22 bp, Homo sapiens
tttgagtgcccatgtttcccag

SEQ ID NO: 8551569 - DNA, 22 bp, Homo sapiens
tttgagttgcttatttaatagg

SEQ ID NO: 8551570 - DNA, 22 bp, Homo sapiens
tttgataacagtgaatatcatg

SEQ ID NO: 8551571 - DNA, 22 bp, Homo sapiens
tttgataagagctgctgaaact

SEQ ID NO: 8551572 - DNA, 22 bp, Homo sapiens
tttgataatacacaagagaaag

SEQ ID NO: 8551573 - DNA, 22 bp, Homo sapiens
tttgaggttagctagcagatca

SEQ ID NO: 8551574 - DNA, 22 bp, Homo sapiens
tttgaggaagatcggagggaaa

SEQ ID NO: 8551575 - DNA, 22 bp, Homo sapiens
tttggtttagggtcatttaaca

SEQ ID NO: 8551576 - DNA, 22 bp, Homo sapiens
tttggtgatagtgcagagaaat

SEQ ID NO: 8551577 - DNA, 22 bp, Homo sapiens
tttggtcttttgtaagttatct

SEQ ID NO: 8551578 - DNA, 22 bp, Homo sapiens
tttggtcttggatttatcagtg

SEQ ID NO: 8551579 - DNA, 22 bp, Homo sapiens
tttgtaaaagcccaagctgtag

SEQ ID NO: 8551580 - DNA, 22 bp, Homo sapiens
tttgtaaaagcccaagctgtag

SEQ ID NO: 8551581 - DNA, 22 bp, Homo sapiens
tttggtttattaaattgtaggc

SEQ ID NO: 8551582 - DNA, 22 bp, Homo sapiens
tttggtttgaatgagcataaga

SEQ ID NO: 8551583 - DNA, 22 bp, Homo sapiens
tttggtccaagttttactcttt

SEQ ID NO: 8551584 - DNA, 22 bp, Homo sapiens
tttggtccaagttttactcttt

SEQ ID NO: 8551585 - DNA, 22 bp, Homo sapiens
tttggtcctaagctgctctcta

SEQ ID NO: 8551586 - DNA, 22 bp, Homo sapiens
tttggtccattatatgctgtca

SEQ ID NO: 8551587 - DNA, 22 bp, Homo sapiens
tttggtattgcacactgtcttc

SEQ ID NO: 8551588 - DNA, 22 bp, Homo sapiens
tttggtcactggatttggctgt

SEQ ID NO: 8551589 - DNA, 22 bp, Homo sapiens
tttggtattgcacactgtcttc

SEQ ID NO: 8551590 - DNA, 22 bp, Homo sapiens
tttggaaagttgtcactttaga

SEQ ID NO: 8551591 - DNA, 22 bp, Homo sapiens
tttggaaagtgtacaaatttga

SEQ ID NO: 8551592 - DNA, 22 bp, Homo sapiens
tttggaaagtgtacaaatttga

SEQ ID NO: 8551593 - DNA, 22 bp, Homo sapiens
tttgaaagggttatgagactga

SEQ ID NO: 8551594 - DNA, 22 bp, Homo sapiens
tttgaaaggtgtcgagatgtgt

SEQ ID NO: 8551595 - DNA, 22 bp, Homo sapiens
tttgaagagccacagtgaaatt

SEQ ID NO: 8551596 - DNA, 22 bp, Homo sapiens
tttgaagataaatatggagaaa

SEQ ID NO: 8551597 - DNA, 22 bp, Homo sapiens
tttgaatagcataggattacat

SEQ ID NO: 8551598 - DNA, 22 bp, Homo sapiens
tttgaatatacttcaaacaaag

SEQ ID NO: 8551599 - DNA, 22 bp, Homo sapiens
tttgaatatacttcaaacaaag

SEQ ID NO: 8551600 - DNA, 22 bp, Homo sapiens
tttgaatatacttcaaacaaag

SEQ ID NO: 8551601 - DNA, 22 bp, Homo sapiens
tttgaatatcacaaactttcaa

SEQ ID NO: 8551602 - DNA, 22 bp, Homo sapiens
tttgaatgacatgattcaggca

SEQ ID NO: 8551603 - DNA, 21 bp, Homo sapiens
tttgaaagccctatgttttca

SEQ ID NO: 8551604 - DNA, 22 bp, Homo sapiens
tttgaaagcctggcttttctct

SEQ ID NO: 8551605 - DNA, 21 bp, Homo sapiens
tttgaaagctacatctatagc

SEQ ID NO: 8551606 - DNA, 21 bp, Homo sapiens
tttgaaagctacatctatagc

SEQ ID NO: 8551607 - DNA, 22 bp, Homo sapiens
tttgaaaggaagttaatacttt

SEQ ID NO: 8551608 - DNA, 22 bp, Homo sapiens
tttgaaaggaattaggatgaca

SEQ ID NO: 8551609 - DNA, 22 bp, Homo sapiens
tttgaaaggagctttatccaga

SEQ ID NO: 8551610 - DNA, 19 bp, Homo sapiens
tttgaaaggattgttattt

SEQ ID NO: 8551611 - DNA, 22 bp, Homo sapiens
tttgaaagggaaataaactcct

SEQ ID NO: 8551612 - DNA, 22 bp, Homo sapiens
tttgaaagggacaaagtcactg

SEQ ID NO: 8551613 - DNA, 22 bp, Homo sapiens
tttgacaaaggaaaaatgcaca

SEQ ID NO: 8551614 - DNA, 22 bp, Homo sapiens
tttgacaaaggaaaaatgcaca

SEQ ID NO: 8551615 - DNA, 22 bp, Homo sapiens
tttgacaaataggggaataagg

SEQ ID NO: 8551616 - DNA, 22 bp, Homo sapiens
tttgacaaaggaaaaatgcaca

SEQ ID NO: 8551617 - DNA, 22 bp, Homo sapiens
tttgacaaatccttcagcaatg

SEQ ID NO: 8551618 - DNA, 22 bp, Homo sapiens
tttgacaaatatttattggcac

SEQ ID NO: 8551619 - DNA, 22 bp, Homo sapiens
tttgacaaatatttattggcac

SEQ ID NO: 8551620 - DNA, 22 bp, Homo sapiens
tttgacaaatccttcagcaatg

SEQ ID NO: 8551621 - DNA, 22 bp, Homo sapiens
tttgaatggactgagaatcttg

SEQ ID NO: 8551622 - DNA, 22 bp, Homo sapiens
tttgaatgagaattattgtcat

SEQ ID NO: 8551623 - DNA, 22 bp, Homo sapiens
tttgaatgattatctttcggca

SEQ ID NO: 8551624 - DNA, 22 bp, Homo sapiens
tttgaatgagggaaccacagtt

SEQ ID NO: 8551625 - DNA, 22 bp, Homo sapiens
tttgaatgcaggacatacagaa

SEQ ID NO: 8551626 - DNA, 22 bp, Homo sapiens
tttgaatgtgtgagttaacttt

SEQ ID NO: 8551627 - DNA, 22 bp, Homo sapiens
tttgaatgtaaatgctgcagct

SEQ ID NO: 8551628 - DNA, 20 bp, Homo sapiens
tttgaatgtaaagcatgtca

SEQ ID NO: 8551629 - DNA, 22 bp, Homo sapiens
tttgaatgttttaggtacttaa

SEQ ID NO: 8551630 - DNA, 22 bp, Homo sapiens
tttgaatgttggattgacttag

SEQ ID NO: 8551631 - DNA, 22 bp, Homo sapiens
tttgaatgttggattgacttag

SEQ ID NO: 8551632 - DNA, 22 bp, Homo sapiens
tttgaatgttttaggtacttaa

SEQ ID NO: 8551633 - DNA, 22 bp, Homo sapiens
tttgacactgggagtgtgggtg

SEQ ID NO: 8551634 - DNA, 22 bp, Homo sapiens
tttgacagaaagttattatttt

SEQ ID NO: 8551635 - DNA, 22 bp, Homo sapiens
tttgacaccaggagagaaaaca

SEQ ID NO: 8551636 - DNA, 22 bp, Homo sapiens
tttgacagagctcttagtctct

SEQ ID NO: 8551637 - DNA, 22 bp, Homo sapiens
tttgacaacgttgttgtgagga

SEQ ID NO: 8551638 - DNA, 22 bp, Homo sapiens
tttgacaactgtgcagtttgta

SEQ ID NO: 8551639 - DNA, 22 bp, Homo sapiens
tttgacaactgtgcagtttgta

SEQ ID NO: 8551640 - DNA, 22 bp, Homo sapiens
tttgacaagagggcatcttcag

SEQ ID NO: 8551641 - DNA, 22 bp, Homo sapiens
tttgacaattaggtagaaaaag

SEQ ID NO: 8551642 - DNA, 22 bp, Homo sapiens
tttgacaattaggtagaaaaag

SEQ ID NO: 8551643 - DNA, 19 bp, Homo sapiens
tttcctaaaaagctgtgct

SEQ ID NO: 8551644 - DNA, 22 bp, Homo sapiens
tttcctaacacaatgcatgaga

SEQ ID NO: 8551645 - DNA, 22 bp, Homo sapiens
tttccctctgtgccagcttctc

SEQ ID NO: 8551646 - DNA, 22 bp, Homo sapiens
tttccctctgtgccagcttctc

SEQ ID NO: 8551647 - DNA, 22 bp, Homo sapiens
tttccctctcatctctattatt

SEQ ID NO: 8551648 - DNA, 21 bp, Homo sapiens
tttccctcattgtgttggcac

SEQ ID NO: 8551649 - DNA, 22 bp, Homo sapiens
tttccctacttgtaactggaaa

SEQ ID NO: 8551650 - DNA, 22 bp, Homo sapiens
tttcctctgagtgagctgggag

SEQ ID NO: 8551651 - DNA, 22 bp, Homo sapiens
tttcctctgactgctcccctgc

SEQ ID NO: 8551652 - DNA, 22 bp, Homo sapiens
tttcctctccggggcctccagg

SEQ ID NO: 8551653 - DNA, 22 bp, Homo sapiens
tttcctcatttatctgctggga

SEQ ID NO: 8551654 - DNA, 22 bp, Homo sapiens
tttcctcagaagtgtctactat

SEQ ID NO: 8551655 - DNA, 22 bp, Homo sapiens
tttcctcatttatctgctggga

SEQ ID NO: 8551656 - DNA, 22 bp, Homo sapiens
tttcctcacttcatgagagttt

SEQ ID NO: 8551657 - DNA, 22 bp, Homo sapiens
tttcctcacttcatgagagttt

SEQ ID NO: 8551658 - DNA, 22 bp, Homo sapiens
tttcctcagaagtgtctactat

SEQ ID NO: 8551659 - DNA, 22 bp, Homo sapiens
tttcctcagaagtgtctactat

SEQ ID NO: 8551660 - DNA, 22 bp, Homo sapiens
tttcctctaaacgcatttgctt

SEQ ID NO: 8551661 - DNA, 22 bp, Homo sapiens
tttcctctaaacgcatttgctt

SEQ ID NO: 8551662 - DNA, 22 bp, Homo sapiens
tttcctctaaacgcatttgctt

SEQ ID NO: 8551663 - DNA, 22 bp, Homo sapiens
tttcctcctagcctccagccgc

SEQ ID NO: 8551664 - DNA, 22 bp, Homo sapiens
tttcttttgccctgtgggttag

SEQ ID NO: 8551665 - DNA, 22 bp, Homo sapiens
tttcttttgccctgtgggttag

SEQ ID NO: 8551666 - DNA, 22 bp, Homo sapiens
tttcttttgccctgtgggttag

SEQ ID NO: 8551667 - DNA, 22 bp, Homo sapiens
tttcttttgctgagaggggcac

SEQ ID NO: 8551668 - DNA, 22 bp, Homo sapiens
tttgaaagcaccatttgagtag

SEQ ID NO: 8551669 - DNA, 22 bp, Homo sapiens
tttgaaaaaggcctttggtatg

SEQ ID NO: 8551670 - DNA, 22 bp, Homo sapiens
tttcttttgctgagaggggcac

SEQ ID NO: 8551671 - DNA, 22 bp, Homo sapiens
tttcttttccaatatccctact

SEQ ID NO: 8551672 - DNA, 22 bp, Homo sapiens
tttcttttccaatatccctact

SEQ ID NO: 8551673 - DNA, 19 bp, Homo sapiens
tttcttttcccctcagcac

SEQ ID NO: 8551674 - DNA, 22 bp, Homo sapiens
tttcttttgaatagtgtgtggt

SEQ ID NO: 8551675 - DNA, 22 bp, Homo sapiens
tttcttttgaatagtgtgtggt

SEQ ID NO: 8551676 - DNA, 19 bp, Homo sapiens
tttcttttcccctcagcac

SEQ ID NO: 8551677 - DNA, 22 bp, Homo sapiens
tttctttgagtctcagtttgct

SEQ ID NO: 8551678 - DNA, 22 bp, Homo sapiens
tttctttgagtctcagtttgct

SEQ ID NO: 8551679 - DNA, 18 bp, Homo sapiens
tttctttctgcctggggc

SEQ ID NO: 8551680 - DNA, 21 bp, Homo sapiens
tttctttctggctctcacagt

SEQ ID NO: 8551681 - DNA, 21 bp, Homo sapiens
tttctttctggctctcacagt

SEQ ID NO: 8551682 - DNA, 22 bp, Homo sapiens
tttcttttacagtgtggctatt

SEQ ID NO: 8551683 - DNA, 22 bp, Homo sapiens
tttcttttccaatatccctact

SEQ ID NO: 8551684 - DNA, 22 bp, Homo sapiens
tttcttttacagtgtggctatt

SEQ ID NO: 8551685 - DNA, 22 bp, Homo sapiens
tttctttgttgttatcacatca

SEQ ID NO: 8551686 - DNA, 22 bp, Homo sapiens
tttctttgttgttatcacatca

SEQ ID NO: 8551687 - DNA, 22 bp, Homo sapiens
tttctttgtagtagcataatca

SEQ ID NO: 8551688 - DNA, 22 bp, Homo sapiens
tttctttgtagtagcataatca

SEQ ID NO: 8551689 - DNA, 22 bp, Homo sapiens
tttttatcttgtatgtgtctct

SEQ ID NO: 8551690 - DNA, 22 bp, Homo sapiens
tttttatcttgtatgtgtctct

SEQ ID NO: 8551691 - DNA, 22 bp, Homo sapiens
tttttatgcctacgctgaaaag

SEQ ID NO: 8551692 - DNA, 22 bp, Homo sapiens
tttttcaagacaacctgcatgt

SEQ ID NO: 8551693 - DNA, 22 bp, Homo sapiens
tttttcaagacaacctgcatgt

SEQ ID NO: 8551694 - DNA, 22 bp, Homo sapiens
tttttatctacagattctcagc

SEQ ID NO: 8551695 - DNA, 22 bp, Homo sapiens
tttttatcttgtatgtgtctct

SEQ ID NO: 8551696 - DNA, 22 bp, Homo sapiens
tttttatatgaaggatagtgcg

SEQ ID NO: 8551697 - DNA, 22 bp, Homo sapiens
tttttatctacagattctcagc

SEQ ID NO: 8551698 - DNA, 22 bp, Homo sapiens
tttttatatgaaggatagtgcg

SEQ ID NO: 8551699 - DNA, 22 bp, Homo sapiens
tttttatactttgctcaagatt

SEQ ID NO: 8551700 - DNA, 22 bp, Homo sapiens
tttttatactttgctcaagatt

SEQ ID NO: 8551701 - DNA, 22 bp, Homo sapiens
tttttcatctgattgataactc

SEQ ID NO: 8551702 - DNA, 22 bp, Homo sapiens
tttttcatattcccctctctgg

SEQ ID NO: 8551703 - DNA, 22 bp, Homo sapiens
tttttcatattcccctctctgg

SEQ ID NO: 8551704 - DNA, 22 bp, Homo sapiens
tttttcagccatgaattacact

SEQ ID NO: 8551705 - DNA, 23 bp, Homo sapiens
tttttagttacacctctgccacc

SEQ ID NO: 8551706 - DNA, 22 bp, Homo sapiens
tttttataactcttttgtgaca

SEQ ID NO: 8551707 - DNA, 22 bp, Homo sapiens
tttttataccacctctcactta

SEQ ID NO: 8551708 - DNA, 22 bp, Homo sapiens
tttttagattactcagccacca

SEQ ID NO: 8551709 - DNA, 22 bp, Homo sapiens
tttttagtagaggtgggtttca

SEQ ID NO: 8551710 - DNA, 22 bp, Homo sapiens
tttttagccaagccataggtct

SEQ ID NO: 8551711 - DNA, 22 bp, Homo sapiens
tttttagtagaggtgggtttca

SEQ ID NO: 8551712 - DNA, 22 bp, Homo sapiens
tttttacagtcatggtcactca

SEQ ID NO: 8551713 - DNA, 22 bp, Homo sapiens
ttttgtttaaaatcctggatgg

SEQ ID NO: 8551714 - DNA, 22 bp, Homo sapiens
ttttgtttaaaatcctggatgg

SEQ ID NO: 8551715 - DNA, 22 bp, Homo sapiens
ttttgttgtaatatacctatcc

SEQ ID NO: 8551716 - DNA, 22 bp, Homo sapiens
ttttgttggcttaagaaataca

SEQ ID NO: 8551717 - DNA, 22 bp, Homo sapiens
ttttcttcctggattttggcat

SEQ ID NO: 8551718 - DNA, 22 bp, Homo sapiens
tttttacacttagcattgagcg

SEQ ID NO: 8551719 - DNA, 22 bp, Homo sapiens
tttttacacttagcattgagcg

SEQ ID NO: 8551720 - DNA, 22 bp, Homo sapiens
tttttacacttagcattgagcg

SEQ ID NO: 8551721 - DNA, 19 bp, Homo sapiens
tttttacaagtaggtgtga

SEQ ID NO: 8551722 - DNA, 22 bp, Homo sapiens
ttttgtttgtgtccactgcagt

SEQ ID NO: 8551723 - DNA, 22 bp, Homo sapiens
ttttgtttgtgtccactgcagt

SEQ ID NO: 8551724 - DNA, 22 bp, Homo sapiens
tttttacacttagcattgagcg

SEQ ID NO: 8551725 - DNA, 22 bp, Homo sapiens
tttttacacttagcattgagcg

SEQ ID NO: 8551726 - DNA, 22 bp, Homo sapiens
agaactggtggtgatcagttat

SEQ ID NO: 8551727 - DNA, 22 bp, Homo sapiens
agaactgtcacgagtgacaaag

SEQ ID NO: 8551728 - DNA, 22 bp, Homo sapiens
agaactgtcacgagtgacaaag

SEQ ID NO: 8551729 - DNA, 17 bp, Homo sapiens
agaactgtagtagctcc

SEQ ID NO: 8551730 - DNA, 22 bp, Homo sapiens
agaactctcgctggatcagact

SEQ ID NO: 8551731 - DNA, 22 bp, Homo sapiens
agaacaattgccccaaagcttg

SEQ ID NO: 8551732 - DNA, 22 bp, Homo sapiens
agaacacacgtcagagtttcct

SEQ ID NO: 8551733 - DNA, 22 bp, Homo sapiens
agaacacactgggggaaacaag

SEQ ID NO: 8551734 - DNA, 22 bp, Homo sapiens
agaagaaagattgaaggttcct

SEQ ID NO: 8551735 - DNA, 22 bp, Homo sapiens
agaagaaagattgaaggttcct

SEQ ID NO: 8551736 - DNA, 22 bp, Homo sapiens
agaagaaagattgaaggttcct

SEQ ID NO: 8551737 - DNA, 22 bp, Homo sapiens
aatgaagaaatggacatcttta

SEQ ID NO: 8551738 - DNA, 22 bp, Homo sapiens
aatgaagaaatggacatcttta

SEQ ID NO: 8551739 - DNA, 22 bp, Homo sapiens
aatgaagaaatggacatcttta

SEQ ID NO: 8551740 - DNA, 22 bp, Homo sapiens
agaagaaatgaggccgttctgc

SEQ ID NO: 8551741 - DNA, 22 bp, Homo sapiens
aatgaactggagaacaatgacc

SEQ ID NO: 8551742 - DNA, 22 bp, Homo sapiens
aatgaactgtgttaactgaata

SEQ ID NO: 8551743 - DNA, 22 bp, Homo sapiens
agaacttaggaacaacagctta

SEQ ID NO: 8551744 - DNA, 22 bp, Homo sapiens
agaagaaactgtcggggatatt

SEQ ID NO: 8551745 - DNA, 20 bp, Homo sapiens
agaactgttgtttgggtcct

SEQ ID NO: 8551746 - DNA, 22 bp, Homo sapiens
agaactgtgaagtatgtgaaat

SEQ ID NO: 8551747 - DNA, 22 bp, Homo sapiens
agaactgtccccagagagcact

SEQ ID NO: 8551748 - DNA, 22 bp, Homo sapiens
agaactgtccttggaggagagt

SEQ ID NO: 8551749 - DNA, 22 bp, Homo sapiens
agaagccactgctcccagtgag

SEQ ID NO: 8551750 - DNA, 22 bp, Homo sapiens
agaagccactgctcccagtgag

SEQ ID NO: 8551751 - DNA, 22 bp, Homo sapiens
agaagccagaatattcatggat

SEQ ID NO: 8551752 - DNA, 22 bp, Homo sapiens
agaagccagaatattcatggat

SEQ ID NO: 8551753 - DNA, 22 bp, Homo sapiens
agaagccactggaggttgagat

SEQ ID NO: 8551754 - DNA, 22 bp, Homo sapiens
agaagcagctttcaaggtgatt

SEQ ID NO: 8551755 - DNA, 22 bp, Homo sapiens
agaagccaccagctgaggaaga

SEQ ID NO: 8551756 - DNA, 22 bp, Homo sapiens
agaagccaccagctgaggaaga

SEQ ID NO: 8551757 - DNA, 22 bp, Homo sapiens
agaagccaccagctgaggaaga

SEQ ID NO: 8551758 - DNA, 22 bp, Homo sapiens
agaagccaccagctgaggaaga

SEQ ID NO: 8551759 - DNA, 22 bp, Homo sapiens
aatgaatgaaccacatataaca

SEQ ID NO: 8551760 - DNA, 22 bp, Homo sapiens
aatgaatgaaccacatataaca

SEQ ID NO: 8551761 - DNA, 22 bp, Homo sapiens
aatgaatgggtttaatatttta

SEQ ID NO: 8551762 - DNA, 22 bp, Homo sapiens
aatgaagataaaatgggatgga

SEQ ID NO: 8551763 - DNA, 22 bp, Homo sapiens
aatgaagattatggtgattaag

SEQ ID NO: 8551764 - DNA, 22 bp, Homo sapiens
aatgaagccactgaagacaatc

SEQ ID NO: 8551765 - DNA, 22 bp, Homo sapiens
aatgaagccaggtagaagagaa

SEQ ID NO: 8551766 - DNA, 22 bp, Homo sapiens
aatgaagcagtccatctgctct

SEQ ID NO: 8551767 - DNA, 22 bp, Homo sapiens
aatgaagttctattcattttct

SEQ ID NO: 8551768 - DNA, 22 bp, Homo sapiens
aatgaataccgtttcactcagt

SEQ ID NO: 8551769 - DNA, 22 bp, Homo sapiens
aatgaataacaatcctctggag

SEQ ID NO: 8551770 - DNA, 20 bp, Homo sapiens
aatgaagttattaatgatgt

SEQ ID NO: 8551771 - DNA, 21 bp, Homo sapiens
aatgaagtggctattttgagg

SEQ ID NO: 8551772 - DNA, 21 bp, Homo sapiens
aatgaagtggctattttgagg

SEQ ID NO: 8551773 - DNA, 22 bp, Homo sapiens
agaagctgttgcattcctggcg

SEQ ID NO: 8551774 - DNA, 22 bp, Homo sapiens
agaagctgttgcattcctggcg

SEQ ID NO: 8551775 - DNA, 22 bp, Homo sapiens
agaagctgtggtatgaaatgtg

SEQ ID NO: 8551776 - DNA, 22 bp, Homo sapiens
agaagcttgaaggagcagtgac

SEQ ID NO: 8551777 - DNA, 22 bp, Homo sapiens
agaagcttgaaggagcagtgac

SEQ ID NO: 8551778 - DNA, 22 bp, Homo sapiens
agaaggaaaacctgtcttatgt

SEQ ID NO: 8551779 - DNA, 22 bp, Homo sapiens
agaaggaaaacctgtcttatgt

SEQ ID NO: 8551780 - DNA, 22 bp, Homo sapiens
agaagccagcttcagctgcccg

SEQ ID NO: 8551781 - DNA, 22 bp, Homo sapiens
aatgcacaaaaattgtatgtaa

SEQ ID NO: 8551782 - DNA, 22 bp, Homo sapiens
agaaggaaggctgagtgctgat

SEQ ID NO: 8551783 - DNA, 22 bp, Homo sapiens
agaaggaaggataactgcatta

SEQ ID NO: 8551784 - DNA, 22 bp, Homo sapiens
agaaggaaggataactgcatta

SEQ ID NO: 8551785 - DNA, 22 bp, Homo sapiens
agaaggaagccaggagggtgca

SEQ ID NO: 8551786 - DNA, 22 bp, Homo sapiens
agaaggaaggaagcattctgtt

SEQ ID NO: 8551787 - DNA, 22 bp, Homo sapiens
agaaggaaacagctgtgctttg

SEQ ID NO: 8551788 - DNA, 22 bp, Homo sapiens
agaaggaagccaggagggtgca

SEQ ID NO: 8551789 - DNA, 22 bp, Homo sapiens
agaaggaagccaggagggtgca

SEQ ID NO: 8551790 - DNA, 22 bp, Homo sapiens
aatgcattctttcatggacctg

SEQ ID NO: 8551791 - DNA, 22 bp, Homo sapiens
aatgcattccactgagatttgt

SEQ ID NO: 8551792 - DNA, 22 bp, Homo sapiens
aatgcattgttgatttggagtg

SEQ ID NO: 8551793 - DNA, 22 bp, Homo sapiens
aatgcattgattgctggaaata

SEQ ID NO: 8551794 - DNA, 22 bp, Homo sapiens
aatgcattctcggtttgtgtgt

SEQ ID NO: 8551795 - DNA, 22 bp, Homo sapiens
aatgcattctcggtttgtgtgt

SEQ ID NO: 8551796 - DNA, 21 bp, Homo sapiens
aatgcattaacataaagctga

SEQ ID NO: 8551797 - DNA, 21 bp, Homo sapiens
aatgcattaacataaagctga

SEQ ID NO: 8551798 - DNA, 22 bp, Homo sapiens
aatgcattagctacatatgtct

SEQ ID NO: 8551799 - DNA, 23 bp, Homo sapiens
aatgcattaatttgggagagtac

SEQ ID NO: 8551800 - DNA, 23 bp, Homo sapiens
aatgcattaatttgggagagtac

SEQ ID NO: 8551801 - DNA, 21 bp, Homo sapiens
aatgcattaacataaagctga

SEQ ID NO: 8551802 - DNA, 22 bp, Homo sapiens
aatgcacaaaaattgtatgtaa

SEQ ID NO: 8551803 - DNA, 22 bp, Homo sapiens
aatgcacaaaggtgtctattgc

SEQ ID NO: 8551804 - DNA, 22 bp, Homo sapiens
aatgcataccatgtcatctttg

SEQ ID NO: 8551805 - DNA, 22 bp, Homo sapiens
aatgcatacgtgtttgtggcaa

SEQ ID NO: 8551806 - DNA, 22 bp, Homo sapiens
aatgcatacgtgtttgtggcaa

SEQ ID NO: 8551807 - DNA, 22 bp, Homo sapiens
aatgcatgtattcattgtggaa

SEQ ID NO: 8551808 - DNA, 19 bp, Homo sapiens
aatgcatggaagttggaga

SEQ ID NO: 8551809 - DNA, 22 bp, Homo sapiens
aatgcatatgtaggcaagcagt

SEQ ID NO: 8551810 - DNA, 22 bp, Homo sapiens
aatgcattaaagttagagactt

SEQ ID NO: 8551811 - DNA, 22 bp, Homo sapiens
aatgcatgtttcctctcagcag

SEQ ID NO: 8551812 - DNA, 22 bp, Homo sapiens
aatgcattaaagttagagactt

SEQ ID NO: 8551813 - DNA, 19 bp, Homo sapiens
aatgcctcaaattgggaga

SEQ ID NO: 8551814 - DNA, 22 bp, Homo sapiens
aatgccgtagacttttacttat

SEQ ID NO: 8551815 - DNA, 22 bp, Homo sapiens
aatgccgtgtttcttacgttca

SEQ ID NO: 8551816 - DNA, 22 bp, Homo sapiens
aatgccttcaagtatctgagga

SEQ ID NO: 8551817 - DNA, 22 bp, Homo sapiens
aatgccagtgtgttgattccag

SEQ ID NO: 8551818 - DNA, 22 bp, Homo sapiens
aatgccatcagagaaaactctt

SEQ ID NO: 8551819 - DNA, 22 bp, Homo sapiens
aatgcattttattatatgtgac

SEQ ID NO: 8551820 - DNA, 18 bp, Homo sapiens
aatgcatttatggagatg

SEQ ID NO: 8551821 - DNA, 18 bp, Homo sapiens
aatgcatttatggagatg

SEQ ID NO: 8551822 - DNA, 22 bp, Homo sapiens
acttttatgataatcaatgttc

SEQ ID NO: 8551823 - DNA, 22 bp, Homo sapiens
acttttatgataatcaatgttc

SEQ ID NO: 8551824 - DNA, 22 bp, Homo sapiens
acttttatcaaggaagtgatct

SEQ ID NO: 8551825 - DNA, 22 bp, Homo sapiens
acttttaaggggccttgattta

SEQ ID NO: 8551826 - DNA, 22 bp, Homo sapiens
acttttaaggggccttgattta

SEQ ID NO: 8551827 - DNA, 22 bp, Homo sapiens
acttttatcaaggaagtgatct

SEQ ID NO: 8551828 - DNA, 22 bp, Homo sapiens
aatcacaaacgaattgatggaa

SEQ ID NO: 8551829 - DNA, 22 bp, Homo sapiens
acttttcaaatgggaaactcag

SEQ ID NO: 8551830 - DNA, 22 bp, Homo sapiens
acttttcaaatgggaaactcag

SEQ ID NO: 8551831 - DNA, 22 bp, Homo sapiens
actttgttcctttcacaaagaa

SEQ ID NO: 8551832 - DNA, 22 bp, Homo sapiens
actttgaaggggaacattttaa

SEQ ID NO: 8551833 - DNA, 22 bp, Homo sapiens
actttgttgaagaatatgttag

SEQ ID NO: 8551834 - DNA, 22 bp, Homo sapiens
actttgttgaagaatatgttag

SEQ ID NO: 8551835 - DNA, 22 bp, Homo sapiens
actttgttctaatagtatctct

SEQ ID NO: 8551836 - DNA, 22 bp, Homo sapiens
actttgttgatgaaatagtttt

SEQ ID NO: 8551837 - DNA, 22 bp, Homo sapiens
acttttaaatgagtttcagttg

SEQ ID NO: 8551838 - DNA, 22 bp, Homo sapiens
acttttaaatgagtttcagttg

SEQ ID NO: 8551839 - DNA, 22 bp, Homo sapiens
acttttaaatgagtttcagttg

SEQ ID NO: 8551840 - DNA, 22 bp, Homo sapiens
acttttaaatgagtttcagttg

SEQ ID NO: 8551841 - DNA, 22 bp, Homo sapiens
acttttaaatgagtttcagttg

SEQ ID NO: 8551842 - DNA, 22 bp, Homo sapiens
actttgtttccatatttgtagc

SEQ ID NO: 8551843 - DNA, 22 bp, Homo sapiens
actttgttgttccttgtctaaa

SEQ ID NO: 8551844 - DNA, 22 bp, Homo sapiens
actttgttttatagcacataag

SEQ ID NO: 8551845 - DNA, 22 bp, Homo sapiens
aatagcatgttcatgataaaat

SEQ ID NO: 8551846 - DNA, 22 bp, Homo sapiens
aatagcatgtaagtttaaaaga

SEQ ID NO: 8551847 - DNA, 22 bp, Homo sapiens
aatagcatgtaagtttaaaaga

SEQ ID NO: 8551848 - DNA, 22 bp, Homo sapiens
aatagcatgcatcctgcataga

SEQ ID NO: 8551849 - DNA, 22 bp, Homo sapiens
aatagcatgcatcctgcataga

SEQ ID NO: 8551850 - DNA, 22 bp, Homo sapiens
aatagcatgtaagtttaaaaga

SEQ ID NO: 8551851 - DNA, 22 bp, Homo sapiens
aatagcatttttaagggaatca

SEQ ID NO: 8551852 - DNA, 22 bp, Homo sapiens
aatagcatgttcatgataaaat

SEQ ID NO: 8551853 - DNA, 22 bp, Homo sapiens
aatagcatgttcatgataaaat

SEQ ID NO: 8551854 - DNA, 22 bp, Homo sapiens
aatagcttagtcctgattctgt

SEQ ID NO: 8551855 - DNA, 22 bp, Homo sapiens
aatagcttagtcctgattctgt

SEQ ID NO: 8551856 - DNA, 23 bp, Homo sapiens
aatagctggtaatgatagcacaa

SEQ ID NO: 8551857 - DNA, 22 bp, Homo sapiens
aatagctgggaggcacattcat

SEQ ID NO: 8551858 - DNA, 17 bp, Homo sapiens
aatagctgctcagagag

SEQ ID NO: 8551859 - DNA, 22 bp, Homo sapiens
aatagctcactgatttctcttt

SEQ ID NO: 8551860 - DNA, 22 bp, Homo sapiens
aatagcttggacccattgcttt

SEQ ID NO: 8551861 - DNA, 22 bp, Homo sapiens
aatagcttgcctaatcctcatg

SEQ ID NO: 8551862 - DNA, 22 bp, Homo sapiens
aatagctttggtcaccatctgg

SEQ ID NO: 8551863 - DNA, 22 bp, Homo sapiens
aatagctttctcatgacttcac

SEQ ID NO: 8551864 - DNA, 22 bp, Homo sapiens
aatagcttggacccattgcttt

SEQ ID NO: 8551865 - DNA, 22 bp, Homo sapiens
aatagcttggacccattgcttt

SEQ ID NO: 8551866 - DNA, 22 bp, Homo sapiens
aatagcttttactcctccgagg

SEQ ID NO: 8551867 - DNA, 22 bp, Homo sapiens
aataggaaaatatttaacaaga

SEQ ID NO: 8551868 - DNA, 22 bp, Homo sapiens
aataggaagcaccaaattctcc

SEQ ID NO: 8551869 - DNA, 22 bp, Homo sapiens
aataggaaaatatttaacaaga

SEQ ID NO: 8551870 - DNA, 22 bp, Homo sapiens
aataggaaaatatttaacaaga

SEQ ID NO: 8551871 - DNA, 22 bp, Homo sapiens
aataggcagttggatatgcaag

SEQ ID NO: 8551872 - DNA, 22 bp, Homo sapiens
aataggaagcaccaaattctcc

SEQ ID NO: 8551873 - DNA, 22 bp, Homo sapiens
aataggaagtcacatcaaggga

SEQ ID NO: 8551874 - DNA, 22 bp, Homo sapiens
aatagtaaaagatacagctaat

SEQ ID NO: 8551875 - DNA, 22 bp, Homo sapiens
aataggtagccagatatataaa

SEQ ID NO: 8551876 - DNA, 22 bp, Homo sapiens
aatctagtctccttaagtcttt

SEQ ID NO: 8551877 - DNA, 23 bp, Homo sapiens
aatctatacttaggctggtaata

SEQ ID NO: 8551878 - DNA, 22 bp, Homo sapiens
aatctagagttcccagcataaa

SEQ ID NO: 8551879 - DNA, 22 bp, Homo sapiens
aatctacatgcaatatttttag

SEQ ID NO: 8551880 - DNA, 22 bp, Homo sapiens
aatctacatgcaatatttttag

SEQ ID NO: 8551881 - DNA, 22 bp, Homo sapiens
aatctacatagagatcaaatga

SEQ ID NO: 8551882 - DNA, 21 bp, Homo sapiens
aatccttaatgaggagttggt

SEQ ID NO: 8551883 - DNA, 22 bp, Homo sapiens
aatcctgtgtgactctggggag

SEQ ID NO: 8551884 - DNA, 22 bp, Homo sapiens
aatcctgtagattctaattcct

SEQ ID NO: 8551885 - DNA, 22 bp, Homo sapiens
aatctaacttcatagctgattt

SEQ ID NO: 8551886 - DNA, 22 bp, Homo sapiens
aatcgcttggtaattttaaaag

SEQ ID NO: 8551887 - DNA, 22 bp, Homo sapiens
aatcgaaagctgagggagcatt

SEQ ID NO: 8551888 - DNA, 22 bp, Homo sapiens
aatcctggctgcgttggccagc

SEQ ID NO: 8551889 - DNA, 22 bp, Homo sapiens
aatcctggcctagctgggctca

SEQ ID NO: 8551890 - DNA, 20 bp, Homo sapiens
aatcctgggacagaggcagg

SEQ ID NO: 8551891 - DNA, 22 bp, Homo sapiens
agaaactgacaggaaatgaatt

SEQ ID NO: 8551892 - DNA, 22 bp, Homo sapiens
agaaactgacaggaaatgaatt

SEQ ID NO: 8551893 - DNA, 22 bp, Homo sapiens
agaaagctggagtcaagcagag

SEQ ID NO: 8551894 - DNA, 22 bp, Homo sapiens
agaaactgaattatttctgagg

SEQ ID NO: 8551895 - DNA, 22 bp, Homo sapiens
agaaagcttatgaatgggcaag

SEQ ID NO: 8551896 - DNA, 22 bp, Homo sapiens
agaaagcttatgaatgggcaag

SEQ ID NO: 8551897 - DNA, 22 bp, Homo sapiens
agaaaggaggaagaatgacctc

SEQ ID NO: 8551898 - DNA, 22 bp, Homo sapiens
agaaaggagaccagctctgccc

SEQ ID NO: 8551899 - DNA, 22 bp, Homo sapiens
agaaaggacatctccctttaag

SEQ ID NO: 8551900 - DNA, 22 bp, Homo sapiens
agaaaggagaccagctctgccc

SEQ ID NO: 8551901 - DNA, 22 bp, Homo sapiens
agaaaggagaccagctctgccc

SEQ ID NO: 8551902 - DNA, 22 bp, Homo sapiens
agaaaggagaccagctctgccc

SEQ ID NO: 8551903 - DNA, 22 bp, Homo sapiens
agaaaggagcaccgtgggggat

SEQ ID NO: 8551904 - DNA, 22 bp, Homo sapiens
agaaaggagcaccgtgggggat

SEQ ID NO: 8551905 - DNA, 22 bp, Homo sapiens
aatcacaattacttttgcacca

SEQ ID NO: 8551906 - DNA, 22 bp, Homo sapiens
aatcacaattacttttgcacca

SEQ ID NO: 8551907 - DNA, 23 bp, Homo sapiens
aatcacacgtttggccaggatgc

SEQ ID NO: 8551908 - DNA, 22 bp, Homo sapiens
aatcacacaaaggcaacttttg

SEQ ID NO: 8551909 - DNA, 22 bp, Homo sapiens
aatcacacaaaggcaacttttg

SEQ ID NO: 8551910 - DNA, 22 bp, Homo sapiens
aatcacaaatgcaagttgtcac

SEQ ID NO: 8551911 - DNA, 22 bp, Homo sapiens
aatcacaaatgcaagttgtcac

SEQ ID NO: 8551912 - DNA, 22 bp, Homo sapiens
aatcacaaatttagacagagct

SEQ ID NO: 8551913 - DNA, 22 bp, Homo sapiens
aatcacaaatttagacagagct

SEQ ID NO: 8551914 - DNA, 22 bp, Homo sapiens
aatcacatcactgagaatgagg

SEQ ID NO: 8551915 - DNA, 22 bp, Homo sapiens
aatcacatagccatctctttga

SEQ ID NO: 8551916 - DNA, 22 bp, Homo sapiens
aatcacagttagtaagggagaa

SEQ ID NO: 8551917 - DNA, 20 bp, Homo sapiens
aatcacagttaactctttct

SEQ ID NO: 8551918 - DNA, 22 bp, Homo sapiens
aatcacagtgggtactagattg

SEQ ID NO: 8551919 - DNA, 22 bp, Homo sapiens
aatcacagtgggtactagattg

SEQ ID NO: 8551920 - DNA, 22 bp, Homo sapiens
aatcacaggcatagattgctcc

SEQ ID NO: 8551921 - DNA, 22 bp, Homo sapiens
aatcacaggcatagattgctcc

SEQ ID NO: 8551922 - DNA, 22 bp, Homo sapiens
aagtgtttggggatcattttaa

SEQ ID NO: 8551923 - DNA, 22 bp, Homo sapiens
actctggcttgaggaccaggtc

SEQ ID NO: 8551924 - DNA, 22 bp, Homo sapiens
actcttcttgctgctcattaat

SEQ ID NO: 8551925 - DNA, 22 bp, Homo sapiens
actcttcttgctgctcattaat

SEQ ID NO: 8551926 - DNA, 22 bp, Homo sapiens
actctttacttaaactctaagt

SEQ ID NO: 8551927 - DNA, 22 bp, Homo sapiens
actctttagaggtacatctctt

SEQ ID NO: 8551928 - DNA, 22 bp, Homo sapiens
actcttgtttgtagagcccacc

SEQ ID NO: 8551929 - DNA, 22 bp, Homo sapiens
actctttaacagactttgatct

SEQ ID NO: 8551930 - DNA, 22 bp, Homo sapiens
actcttgtctcaacttttgtat

SEQ ID NO: 8551931 - DNA, 22 bp, Homo sapiens
actcttgaactgattaagaatg

SEQ ID NO: 8551932 - DNA, 22 bp, Homo sapiens
aagtgttaaaagattaaatgct

SEQ ID NO: 8551933 - DNA, 22 bp, Homo sapiens
aagtgtgtttccgtgattgagg

SEQ ID NO: 8551934 - DNA, 22 bp, Homo sapiens
aagtgttaaagacttgaacact

SEQ ID NO: 8551935 - DNA, 22 bp, Homo sapiens
aagtgtttacttaaagtcatgg

SEQ ID NO: 8551936 - DNA, 22 bp, Homo sapiens
acctgcctcagtgcagctggat

SEQ ID NO: 8551937 - DNA, 22 bp, Homo sapiens
acctgcctatggagccacatgg

SEQ ID NO: 8551938 - DNA, 22 bp, Homo sapiens
acctgcctatggagccacatgg

SEQ ID NO: 8551939 - DNA, 22 bp, Homo sapiens
acctgcctctaagcagcaggtg

SEQ ID NO: 8551940 - DNA, 22 bp, Homo sapiens
acctgcctctaagcagcaggtg

SEQ ID NO: 8551941 - DNA, 22 bp, Homo sapiens
acctgcctcagtgcagctggat

SEQ ID NO: 8551942 - DNA, 22 bp, Homo sapiens
acctgcctcagtgcagctggat

SEQ ID NO: 8551943 - DNA, 22 bp, Homo sapiens
aagtgtcttaactccttttggg

SEQ ID NO: 8551944 - DNA, 22 bp, Homo sapiens
aagtgtcttctgatggggtgtg

SEQ ID NO: 8551945 - DNA, 22 bp, Homo sapiens
aagtgtctgcaaaatgacagag

SEQ ID NO: 8551946 - DNA, 22 bp, Homo sapiens
aagtgtctgctggctctaccct

SEQ ID NO: 8551947 - DNA, 22 bp, Homo sapiens
aagtgtctgacacaaaatatgt

SEQ ID NO: 8551948 - DNA, 22 bp, Homo sapiens
aagtgtctgatggagcgaaatg

SEQ ID NO: 8551949 - DNA, 22 bp, Homo sapiens
aagtgtctgcaaaatgacagag

SEQ ID NO: 8551950 - DNA, 22 bp, Homo sapiens
aagtgtgttgactgaattgggg

SEQ ID NO: 8551951 - DNA, 19 bp, Homo sapiens
aagtgtgttgagccaggat

SEQ ID NO: 8551952 - DNA, 22 bp, Homo sapiens
aagtgtgtgggcaggcagtggt

SEQ ID NO: 8551953 - DNA, 22 bp, Homo sapiens
aagtgtgtgagcctgtcaggct

SEQ ID NO: 8551954 - DNA, 22 bp, Homo sapiens
aagtgtggtttaggcatctttt

SEQ ID NO: 8551955 - DNA, 22 bp, Homo sapiens
aagtgtgtattgtttatgctgc

SEQ ID NO: 8551956 - DNA, 22 bp, Homo sapiens
aagtgtgtattgtttatgctgc

SEQ ID NO: 8551957 - DNA, 22 bp, Homo sapiens
aagtgtgtatttttcttcagtg

SEQ ID NO: 8551958 - DNA, 22 bp, Homo sapiens
aagtgtgtcttgggaagggagg

SEQ ID NO: 8551959 - DNA, 22 bp, Homo sapiens
aagtgtgtctggcggcccagtg

SEQ ID NO: 8551960 - DNA, 22 bp, Homo sapiens
aagtgtgggactagggctccag

SEQ ID NO: 8551961 - DNA, 22 bp, Homo sapiens
aagtgtggggtctcagagctga

SEQ ID NO: 8551962 - DNA, 22 bp, Homo sapiens
aagtgtggggtctcagagctga

SEQ ID NO: 8551963 - DNA, 22 bp, Homo sapiens
aagtgtgggaagtaggtggcga

SEQ ID NO: 8551964 - DNA, 22 bp, Homo sapiens
aagtgtgggaagttgctaaaat

SEQ ID NO: 8551965 - DNA, 22 bp, Homo sapiens
aagtgtgggaagtaggtggcga

SEQ ID NO: 8551966 - DNA, 22 bp, Homo sapiens
aagtgtgggaagtaggtggcga

SEQ ID NO: 8551967 - DNA, 22 bp, Homo sapiens
aagtgtgggaagtaggtggcga

SEQ ID NO: 8551968 - DNA, 22 bp, Homo sapiens
aagtgtcttttagccactttta

SEQ ID NO: 8551969 - DNA, 22 bp, Homo sapiens
aagtgtctttatatttgagaaa

SEQ ID NO: 8551970 - DNA, 22 bp, Homo sapiens
aagtgtgatttgtagaatgcct

SEQ ID NO: 8551971 - DNA, 22 bp, Homo sapiens
aagtgtgagacacacaaaatta

SEQ ID NO: 8551972 - DNA, 22 bp, Homo sapiens
aagtgtgagccagccctttgca

SEQ ID NO: 8551973 - DNA, 22 bp, Homo sapiens
aagtgtgagacacacaaaatta

SEQ ID NO: 8551974 - DNA, 22 bp, Homo sapiens
actgaaaatgaattagaaacag

SEQ ID NO: 8551975 - DNA, 22 bp, Homo sapiens
actgaaaatgaattagaaacag

SEQ ID NO: 8551976 - DNA, 22 bp, Homo sapiens
actgaaaatgaattagaaacag

SEQ ID NO: 8551977 - DNA, 22 bp, Homo sapiens
aagttcaaggcaggtcctgagg

SEQ ID NO: 8551978 - DNA, 22 bp, Homo sapiens
aagttcaaggctctagagttcc

SEQ ID NO: 8551979 - DNA, 22 bp, Homo sapiens
aagttcaaggtgatagtggcag

SEQ ID NO: 8551980 - DNA, 22 bp, Homo sapiens
actgaaaatgaattagaaacag

SEQ ID NO: 8551981 - DNA, 22 bp, Homo sapiens
actgaaaaagtatgattcactg

SEQ ID NO: 8551982 - DNA, 22 bp, Homo sapiens
actgaaaaagacatcttggtaa

SEQ ID NO: 8551983 - DNA, 22 bp, Homo sapiens
actgaaaaagacatcttggtaa

SEQ ID NO: 8551984 - DNA, 22 bp, Homo sapiens
actgaaaaagtatgattcactg

SEQ ID NO: 8551985 - DNA, 22 bp, Homo sapiens
actgaaaaagacatcttggtaa

SEQ ID NO: 8551986 - DNA, 22 bp, Homo sapiens
actgaaaaagacatcttggtaa

SEQ ID NO: 8551987 - DNA, 22 bp, Homo sapiens
actcttttataaagcatcttga

SEQ ID NO: 8551988 - DNA, 22 bp, Homo sapiens
actcttttatgcattccttcag

SEQ ID NO: 8551989 - DNA, 22 bp, Homo sapiens
actctttagaggtacatctctt

SEQ ID NO: 8551990 - DNA, 22 bp, Homo sapiens
actctttattgtttgtggctag

SEQ ID NO: 8551991 - DNA, 18 bp, Homo sapiens
actctttctgcccacagg

SEQ ID NO: 8551992 - DNA, 18 bp, Homo sapiens
actctttctgcccacagg

SEQ ID NO: 8551993 - DNA, 18 bp, Homo sapiens
actctttctgcccacagg

SEQ ID NO: 8551994 - DNA, 18 bp, Homo sapiens
actctttctgcccacagg

SEQ ID NO: 8551995 - DNA, 18 bp, Homo sapiens
actctttctgcccacagg

SEQ ID NO: 8551996 - DNA, 22 bp, Homo sapiens
aagttcctgagctcatatagca

SEQ ID NO: 8551997 - DNA, 22 bp, Homo sapiens
aagttcctcttctctgcaggga

SEQ ID NO: 8551998 - DNA, 22 bp, Homo sapiens
aagttcaatggaaaagctttag

SEQ ID NO: 8551999 - DNA, 22 bp, Homo sapiens
aagttcatcaaagagtaaatat

SEQ ID NO: 8552000 - DNA, 22 bp, Homo sapiens
aagttcaagtctgcatcttttt

SEQ ID NO: 8552001 - DNA, 22 bp, Homo sapiens
aagttcaagtctcctgagtata

SEQ ID NO: 8552002 - DNA, 23 bp, Homo sapiens
aagttcaagtcacagcctgtctt

SEQ ID NO: 8552003 - DNA, 22 bp, Homo sapiens
aagttcaagtagtgttacatgg

SEQ ID NO: 8552004 - DNA, 22 bp, Homo sapiens
aagttcaatcagatgaaaaagc

SEQ ID NO: 8552005 - DNA, 22 bp, Homo sapiens
aagttcaagtgtaatctttatt

SEQ ID NO: 8552006 - DNA, 22 bp, Homo sapiens
actgcaggagacacagctgctg

SEQ ID NO: 8552007 - DNA, 22 bp, Homo sapiens
aagttcctgggccaagtccagg

SEQ ID NO: 8552008 - DNA, 22 bp, Homo sapiens
aagttcctgttactccccagaa

SEQ ID NO: 8552009 - DNA, 22 bp, Homo sapiens
aagttccttagccttagggctt

SEQ ID NO: 8552010 - DNA, 22 bp, Homo sapiens
actgcactccagcctgggtgac

SEQ ID NO: 8552011 - DNA, 22 bp, Homo sapiens
actgcagccttgaactctgggc

SEQ ID NO: 8552012 - DNA, 22 bp, Homo sapiens
actgcagcctttgggctcataa

SEQ ID NO: 8552013 - DNA, 22 bp, Homo sapiens
actgcagggcatcctggccaag

SEQ ID NO: 8552014 - DNA, 23 bp, Homo sapiens
actgcagtcttgatctcctgggc

SEQ ID NO: 8552015 - DNA, 20 bp, Homo sapiens
aagttttctccaaatacagt

SEQ ID NO: 8552016 - DNA, 22 bp, Homo sapiens
actgcatctgaactgtgaatgg

SEQ ID NO: 8552017 - DNA, 21 bp, Homo sapiens
actgcatctgaagtcccagga

SEQ ID NO: 8552018 - DNA, 22 bp, Homo sapiens
actgcatctgaaacatgggtca

SEQ ID NO: 8552019 - DNA, 22 bp, Homo sapiens
actgcatctgaaacatgggtca

SEQ ID NO: 8552020 - DNA, 22 bp, Homo sapiens
actgcatgctttacatgacatg

SEQ ID NO: 8552021 - DNA, 22 bp, Homo sapiens
actgtccataatattggtgaac

SEQ ID NO: 8552022 - DNA, 22 bp, Homo sapiens
actgtcccatttatgtagacat

SEQ ID NO: 8552023 - DNA, 22 bp, Homo sapiens
actgtacatgcatcttgtctat

SEQ ID NO: 8552024 - DNA, 22 bp, Homo sapiens
actgtcatgcattatggcatgt

SEQ ID NO: 8552025 - DNA, 21 bp, Homo sapiens
actgtcatttgcttagggagg

SEQ ID NO: 8552026 - DNA, 21 bp, Homo sapiens
actgtcatttgcttagggagg

SEQ ID NO: 8552027 - DNA, 22 bp, Homo sapiens
actgtcatgcattatggcatgt

SEQ ID NO: 8552028 - DNA, 22 bp, Homo sapiens
actgtcatgtgctaactgtcca

SEQ ID NO: 8552029 - DNA, 22 bp, Homo sapiens
actgtcattaatgaatgtaata

SEQ ID NO: 8552030 - DNA, 22 bp, Homo sapiens
actgtacacgtgtcatttacag

SEQ ID NO: 8552031 - DNA, 22 bp, Homo sapiens
actgtacacgtgtcatttacag

SEQ ID NO: 8552032 - DNA, 22 bp, Homo sapiens
actgtacacgtgtcatttacag

SEQ ID NO: 8552033 - DNA, 22 bp, Homo sapiens
actgtacatatggattctaaga

SEQ ID NO: 8552034 - DNA, 22 bp, Homo sapiens
actgtacatatggattctaaga

SEQ ID NO: 8552035 - DNA, 22 bp, Homo sapiens
actgtacatatggattctaaga

SEQ ID NO: 8552036 - DNA, 22 bp, Homo sapiens
actgtacatatggattctaaga

SEQ ID NO: 8552037 - DNA, 22 bp, Homo sapiens
actgtacacagtggtgtactgt

SEQ ID NO: 8552038 - DNA, 22 bp, Homo sapiens
actgtacacagtggtgtactgt

SEQ ID NO: 8552039 - DNA, 22 bp, Homo sapiens
actgtacacagtggtgtactgt

SEQ ID NO: 8552040 - DNA, 22 bp, Homo sapiens
actgtacacattcgtcaagact

SEQ ID NO: 8552041 - DNA, 22 bp, Homo sapiens
actgtacacattcgtcaagact

SEQ ID NO: 8552042 - DNA, 22 bp, Homo sapiens
actgtacaacctctgcccctgt

SEQ ID NO: 8552043 - DNA, 22 bp, Homo sapiens
actgtacaactgctgagcagaa

SEQ ID NO: 8552044 - DNA, 22 bp, Homo sapiens
actgtacaaatattgcaaaata

SEQ ID NO: 8552045 - DNA, 22 bp, Homo sapiens
actgtacaaatattgcaaaata

SEQ ID NO: 8552046 - DNA, 22 bp, Homo sapiens
actgtacaaatattgcaaaata

SEQ ID NO: 8552047 - DNA, 22 bp, Homo sapiens
actgtacacacttctctgtctt

SEQ ID NO: 8552048 - DNA, 22 bp, Homo sapiens
actgtacacacttctctgtctt

SEQ ID NO: 8552049 - DNA, 22 bp, Homo sapiens
actgtaaccagtgtggtgagag

SEQ ID NO: 8552050 - DNA, 22 bp, Homo sapiens
actgtaacctcaaactcctggg

SEQ ID NO: 8552051 - DNA, 22 bp, Homo sapiens
actgtaacgccagctttaaatg

SEQ ID NO: 8552052 - DNA, 22 bp, Homo sapiens
actggggagtggttttgggaag

SEQ ID NO: 8552053 - DNA, 22 bp, Homo sapiens
actgtaatattttaagatgtct

SEQ ID NO: 8552054 - DNA, 22 bp, Homo sapiens
actgtaatggtggatccatgtc

SEQ ID NO: 8552055 - DNA, 22 bp, Homo sapiens
actgtaattatctgaacgtgca

SEQ ID NO: 8552056 - DNA, 22 bp, Homo sapiens
actgtaattggattgtctgact

SEQ ID NO: 8552057 - DNA, 22 bp, Homo sapiens
actgtcctgaatactgcatgac

SEQ ID NO: 8552058 - DNA, 22 bp, Homo sapiens
actgtctcctcatcatgcctgg

SEQ ID NO: 8552059 - DNA, 22 bp, Homo sapiens
actgtctcctcatcatgcctgg

SEQ ID NO: 8552060 - DNA, 22 bp, Homo sapiens
actgtccttttaatgcagccgt

SEQ ID NO: 8552061 - DNA, 22 bp, Homo sapiens
actgtcgattatgatgagtcag

SEQ ID NO: 8552062 - DNA, 22 bp, Homo sapiens
aatagaatgtaatctaatacat

SEQ ID NO: 8552063 - DNA, 22 bp, Homo sapiens
aatagaatgtaatctaatacat

SEQ ID NO: 8552064 - DNA, 23 bp, Homo sapiens
actgtctgatatgttttccatca

SEQ ID NO: 8552065 - DNA, 18 bp, Homo sapiens
actgtctctgagagtggt

SEQ ID NO: 8552066 - DNA, 22 bp, Homo sapiens
actgtctctctagcagttcagg

SEQ ID NO: 8552067 - DNA, 22 bp, Homo sapiens
aatagcatagagttaaaatgca

SEQ ID NO: 8552068 - DNA, 22 bp, Homo sapiens
aatagcatcctaaaacatactt

SEQ ID NO: 8552069 - DNA, 22 bp, Homo sapiens
aatagcatcttccctggtaacc

SEQ ID NO: 8552070 - DNA, 22 bp, Homo sapiens
aatagcatcttctgagacaaag

SEQ ID NO: 8552071 - DNA, 22 bp, Homo sapiens
aatagcatcctgtatctcttcc

SEQ ID NO: 8552072 - DNA, 22 bp, Homo sapiens
aatagcagaagactagtagaca

SEQ ID NO: 8552073 - DNA, 22 bp, Homo sapiens
aatagcagttaaaaatcagccc

SEQ ID NO: 8552074 - DNA, 22 bp, Homo sapiens
aatagcatagagttaaaatgca

SEQ ID NO: 8552075 - DNA, 22 bp, Homo sapiens
aatagcataagatgtcaaatag

SEQ ID NO: 8552076 - DNA, 22 bp, Homo sapiens
aatagcataagatgtcaaatag

SEQ ID NO: 8552077 - DNA, 22 bp, Homo sapiens
aatagcaattacccttcaactc

SEQ ID NO: 8552078 - DNA, 22 bp, Homo sapiens
aatagcaaagttatcaaattaa

SEQ ID NO: 8552079 - DNA, 22 bp, Homo sapiens
actgggagggtcttgaagaggg

SEQ ID NO: 8552080 - DNA, 22 bp, Homo sapiens
actgggagggtcttgaagaggg

SEQ ID NO: 8552081 - DNA, 22 bp, Homo sapiens
actgggaggcatctggagctga

SEQ ID NO: 8552082 - DNA, 22 bp, Homo sapiens
actgggagtcatgaggaaggag

SEQ ID NO: 8552083 - DNA, 22 bp, Homo sapiens
actgggagtcatgaggaaggag

SEQ ID NO: 8552084 - DNA, 22 bp, Homo sapiens
actgggaggcaaagagcaagga

SEQ ID NO: 8552085 - DNA, 22 bp, Homo sapiens
actgggaggcatctggagctga

SEQ ID NO: 8552086 - DNA, 22 bp, Homo sapiens
actgggaggcatctggagctga

SEQ ID NO: 8552087 - DNA, 22 bp, Homo sapiens
actgggaggcaaagagcaagga

SEQ ID NO: 8552088 - DNA, 22 bp, Homo sapiens
actgggaggcaaagagcaagga

SEQ ID NO: 8552089 - DNA, 22 bp, Homo sapiens
aataaaatggtcagttttctca

SEQ ID NO: 8552090 - DNA, 22 bp, Homo sapiens
aagtttttcacattgctgttgt

SEQ ID NO: 8552091 - DNA, 22 bp, Homo sapiens
aagtttttcacattgctgttgt

SEQ ID NO: 8552092 - DNA, 22 bp, Homo sapiens
aagttttgaaatactgaagtgt

SEQ ID NO: 8552093 - DNA, 21 bp, Homo sapiens
aataaaacagttggtgtcaat

SEQ ID NO: 8552094 - DNA, 22 bp, Homo sapiens
aagtttttggtagagaaaagta

SEQ ID NO: 8552095 - DNA, 22 bp, Homo sapiens
aataaaatgaactggtagagtt

SEQ ID NO: 8552096 - DNA, 22 bp, Homo sapiens
aataaaatgaactggtagagtt

SEQ ID NO: 8552097 - DNA, 20 bp, Homo sapiens
aataaaagaagccttcaccc

SEQ ID NO: 8552098 - DNA, 20 bp, Homo sapiens
aataaaagaagccttcaccc

SEQ ID NO: 8552099 - DNA, 21 bp, Homo sapiens
aataaaacagttggtgtcaat

SEQ ID NO: 8552100 - DNA, 20 bp, Homo sapiens
aataaaagaagccttcaccc

SEQ ID NO: 8552101 - DNA, 22 bp, Homo sapiens
actgggcaaggatatgatgggt

SEQ ID NO: 8552102 - DNA, 22 bp, Homo sapiens
actgggagttctccatgtccct

SEQ ID NO: 8552103 - DNA, 22 bp, Homo sapiens
actgggagttctccatgtccct

SEQ ID NO: 8552104 - DNA, 22 bp, Homo sapiens
actgggagttctccatgtccct

SEQ ID NO: 8552105 - DNA, 22 bp, Homo sapiens
actgggcaccatcatgagatgg

SEQ ID NO: 8552106 - DNA, 22 bp, Homo sapiens
aataagcaagcctgtgtgcaag

SEQ ID NO: 8552107 - DNA, 22 bp, Homo sapiens
actgggcaccatcatgagatag

SEQ ID NO: 8552108 - DNA, 22 bp, Homo sapiens
aataagccagcccatgtgaccc

SEQ ID NO: 8552109 - DNA, 22 bp, Homo sapiens
aataagccagcccatgtgaccc

SEQ ID NO: 8552110 - DNA, 22 bp, Homo sapiens
aataagctgctaggaacttagt

SEQ ID NO: 8552111 - DNA, 19 bp, Homo sapiens
aataagcttgggtaaaact

SEQ ID NO: 8552112 - DNA, 22 bp, Homo sapiens
aataagttgcctgttgaatcat

SEQ ID NO: 8552113 - DNA, 22 bp, Homo sapiens
aataagttgcctgttgaatcat

SEQ ID NO: 8552114 - DNA, 22 bp, Homo sapiens
aataatacatgagattaatgtt

SEQ ID NO: 8552115 - DNA, 22 bp, Homo sapiens
aataatacatgagattaatgtt

SEQ ID NO: 8552116 - DNA, 22 bp, Homo sapiens
aataatacttcgtaaagttgtt

SEQ ID NO: 8552117 - DNA, 22 bp, Homo sapiens
aataatactgcatgtaaggtgc

SEQ ID NO: 8552118 - DNA, 22 bp, Homo sapiens
aataataagatactaagggagt

SEQ ID NO: 8552119 - DNA, 22 bp, Homo sapiens
aataagttgcttcagcttggtg

SEQ ID NO: 8552120 - DNA, 22 bp, Homo sapiens
aataataagatactaagggagt

SEQ ID NO: 8552121 - DNA, 22 bp, Homo sapiens
aataataagatactaagggagt

SEQ ID NO: 8552122 - DNA, 22 bp, Homo sapiens
aataatacatgagattaatgtt

SEQ ID NO: 8552123 - DNA, 22 bp, Homo sapiens
aataatacatgagattaatgtt

SEQ ID NO: 8552124 - DNA, 22 bp, Homo sapiens
actggggaatggaactgggaat

SEQ ID NO: 8552125 - DNA, 22 bp, Homo sapiens
actggggagagtcatgccagca

SEQ ID NO: 8552126 - DNA, 22 bp, Homo sapiens
aataatagcagagtttacaatc

SEQ ID NO: 8552127 - DNA, 22 bp, Homo sapiens
aataatacttcgtaaagttgtt

SEQ ID NO: 8552128 - DNA, 22 bp, Homo sapiens
aaggaagcagcaatgcatgatt

SEQ ID NO: 8552129 - DNA, 22 bp, Homo sapiens
aaggaagggaaatagtgatgtc

SEQ ID NO: 8552130 - DNA, 22 bp, Homo sapiens
aaggaagggaaatagtgatgtc

SEQ ID NO: 8552131 - DNA, 22 bp, Homo sapiens
aaggaaggaattgatcatgcgc

SEQ ID NO: 8552132 - DNA, 22 bp, Homo sapiens
aaggaattcaaattttctctgg

SEQ ID NO: 8552133 - DNA, 22 bp, Homo sapiens
aaggaattccctttctgacaga

SEQ ID NO: 8552134 - DNA, 22 bp, Homo sapiens
aaggaattctagaaggttttgt

SEQ ID NO: 8552135 - DNA, 19 bp, Homo sapiens
aaggaatggctttaagtag

SEQ ID NO: 8552136 - DNA, 22 bp, Homo sapiens
aaggaaggttcatagtcaaaga

SEQ ID NO: 8552137 - DNA, 22 bp, Homo sapiens
aaggaaggtactcagtgattct

SEQ ID NO: 8552138 - DNA, 22 bp, Homo sapiens
aaggaatcacttctttaaatga

SEQ ID NO: 8552139 - DNA, 22 bp, Homo sapiens
aaggacaggcacagtggtggag

SEQ ID NO: 8552140 - DNA, 22 bp, Homo sapiens
aaggacaggcacagtggtggag

SEQ ID NO: 8552141 - DNA, 22 bp, Homo sapiens
aaggacagagagccattccaga

SEQ ID NO: 8552142 - DNA, 22 bp, Homo sapiens
aaggacagagagccattccaga

SEQ ID NO: 8552143 - DNA, 22 bp, Homo sapiens
aaggacaggagaaaacgggatc

SEQ ID NO: 8552144 - DNA, 19 bp, Homo sapiens
aaggacacaacagagatag

SEQ ID NO: 8552145 - DNA, 22 bp, Homo sapiens
aaggacagaaacagattgctgg

SEQ ID NO: 8552146 - DNA, 22 bp, Homo sapiens
aaggcaaaagaggtgtcatcac

SEQ ID NO: 8552147 - DNA, 22 bp, Homo sapiens
aaggcaaatgtgttcttttagt

SEQ ID NO: 8552148 - DNA, 22 bp, Homo sapiens
aaggatttgtccaaagtcacac

SEQ ID NO: 8552149 - DNA, 22 bp, Homo sapiens
aaggatttgtccaaagtcacac

SEQ ID NO: 8552150 - DNA, 22 bp, Homo sapiens
aaggattgtctggctatttatg

SEQ ID NO: 8552151 - DNA, 22 bp, Homo sapiens
aaggatgtgactcagtcagcta

SEQ ID NO: 8552152 - DNA, 22 bp, Homo sapiens
aaggatgtggcatttttcatat

SEQ ID NO: 8552153 - DNA, 22 bp, Homo sapiens
aaggatctttctttttaccatt

SEQ ID NO: 8552154 - DNA, 22 bp, Homo sapiens
aaggatgattggtaatgacact

SEQ ID NO: 8552155 - DNA, 22 bp, Homo sapiens
aaggaggccctctccttctgga

SEQ ID NO: 8552156 - DNA, 20 bp, Homo sapiens
aagcttccaggatctggtgt

SEQ ID NO: 8552157 - DNA, 20 bp, Homo sapiens
aagcttccaggatctggtgt

SEQ ID NO: 8552158 - DNA, 21 bp, Homo sapiens
aagcttccaaactgctggact

SEQ ID NO: 8552159 - DNA, 21 bp, Homo sapiens
aagcttccctgctctccaggg

SEQ ID NO: 8552160 - DNA, 21 bp, Homo sapiens
aagcttccctgctctccaggg

SEQ ID NO: 8552161 - DNA, 22 bp, Homo sapiens
aagcttcctgaatgctcattta

SEQ ID NO: 8552162 - DNA, 22 bp, Homo sapiens
aagcttcctgaatgctcattta

SEQ ID NO: 8552163 - DNA, 23 bp, Homo sapiens
aagcttccttcacgtctcctggg

SEQ ID NO: 8552164 - DNA, 22 bp, Homo sapiens
aagcttcctgcatgggactgct

SEQ ID NO: 8552165 - DNA, 23 bp, Homo sapiens
aagcttctatctctgcagaagga

SEQ ID NO: 8552166 - DNA, 22 bp, Homo sapiens
aagcttcttagaatgcatgtgc

SEQ ID NO: 8552167 - DNA, 22 bp, Homo sapiens
aagcttcttagaatgcatgtgc

SEQ ID NO: 8552168 - DNA, 23 bp, Homo sapiens
aagcttccttcacgtctcctggg

SEQ ID NO: 8552169 - DNA, 23 bp, Homo sapiens
aagcttccttgactggcccctag

SEQ ID NO: 8552170 - DNA, 22 bp, Homo sapiens
aagcttgtagagtttgacttcc

SEQ ID NO: 8552171 - DNA, 22 bp, Homo sapiens
aagctgttgccctgctctttct

SEQ ID NO: 8552172 - DNA, 22 bp, Homo sapiens
aagctgttggcagatagctctg

SEQ ID NO: 8552173 - DNA, 22 bp, Homo sapiens
aagctgttgttcatcctgaatt

SEQ ID NO: 8552174 - DNA, 22 bp, Homo sapiens
aagctgttttggccttagttga

SEQ ID NO: 8552175 - DNA, 22 bp, Homo sapiens
aagctgttctctaagtttcatg

SEQ ID NO: 8552176 - DNA, 22 bp, Homo sapiens
aagcttcaatgagataattgtt

SEQ ID NO: 8552177 - DNA, 22 bp, Homo sapiens
aagcttcacattgaacttgggt

SEQ ID NO: 8552178 - DNA, 22 bp, Homo sapiens
aagcttcagttctggggcaatg

SEQ ID NO: 8552179 - DNA, 22 bp, Homo sapiens
aagcttcatctgatgccgaact

SEQ ID NO: 8552180 - DNA, 22 bp, Homo sapiens
aagcttcatatatgtgtgagtc

SEQ ID NO: 8552181 - DNA, 22 bp, Homo sapiens
aagcttcagtgtgagcatgtaa

SEQ ID NO: 8552182 - DNA, 22 bp, Homo sapiens
aagcttcagtgtgagcatgtaa

SEQ ID NO: 8552183 - DNA, 22 bp, Homo sapiens
aagcttcagtggactgtagtgt

SEQ ID NO: 8552184 - DNA, 22 bp, Homo sapiens
acagctggaggggctgcagagg

SEQ ID NO: 8552185 - DNA, 22 bp, Homo sapiens
acagctggaggggctgcagagg

SEQ ID NO: 8552186 - DNA, 22 bp, Homo sapiens
acagctggaggggctgcagagg

SEQ ID NO: 8552187 - DNA, 22 bp, Homo sapiens
acagctggaggtctgtgagcac

SEQ ID NO: 8552188 - DNA, 22 bp, Homo sapiens
acagctggaggccccattgtcc

SEQ ID NO: 8552189 - DNA, 22 bp, Homo sapiens
acagctggaggccccattgtcc

SEQ ID NO: 8552190 - DNA, 22 bp, Homo sapiens
acagctggacaggggagagttt

SEQ ID NO: 8552191 - DNA, 22 bp, Homo sapiens
acagctggacaggggagagttt

SEQ ID NO: 8552192 - DNA, 22 bp, Homo sapiens
acagctggagccctatggctgg

SEQ ID NO: 8552193 - DNA, 22 bp, Homo sapiens
acagctggagccctatggctgg

SEQ ID NO: 8552194 - DNA, 22 bp, Homo sapiens
acagctggaggtctgtgagcac

SEQ ID NO: 8552195 - DNA, 22 bp, Homo sapiens
acagctggagtgaggatggagt

SEQ ID NO: 8552196 - DNA, 22 bp, Homo sapiens
acagctggagtgaggatggagt

SEQ ID NO: 8552197 - DNA, 22 bp, Homo sapiens
acagctggagtgaggatggagt

SEQ ID NO: 8552198 - DNA, 22 bp, Homo sapiens
acagctggagtgttggtgaggt

SEQ ID NO: 8552199 - DNA, 22 bp, Homo sapiens
aagctggagtgcagtgcaatgg

SEQ ID NO: 8552200 - DNA, 22 bp, Homo sapiens
aagctggagagtttcacagatg

SEQ ID NO: 8552201 - DNA, 22 bp, Homo sapiens
aagctggaggctgagatcacca

SEQ ID NO: 8552202 - DNA, 22 bp, Homo sapiens
aagctggaggctgagatcacca

SEQ ID NO: 8552203 - DNA, 21 bp, Homo sapiens
aagctgtgttccactgatagc

SEQ ID NO: 8552204 - DNA, 22 bp, Homo sapiens
aagctgtgtattacagaatatt

SEQ ID NO: 8552205 - DNA, 22 bp, Homo sapiens
aagctgtgtaagttgcttggtt

SEQ ID NO: 8552206 - DNA, 22 bp, Homo sapiens
aagctgtgaaatctctagtgca

SEQ ID NO: 8552207 - DNA, 22 bp, Homo sapiens
aagctgtgaagagcaagtgagg

SEQ ID NO: 8552208 - DNA, 22 bp, Homo sapiens
aagctgtgagctggatgctcca

SEQ ID NO: 8552209 - DNA, 22 bp, Homo sapiens
aagctgtgaagagcaagtgagg

SEQ ID NO: 8552210 - DNA, 22 bp, Homo sapiens
aagctgtgcaggaactgcttgc

SEQ ID NO: 8552211 - DNA, 22 bp, Homo sapiens
aagctgtgcaggaactgcttgc

SEQ ID NO: 8552212 - DNA, 22 bp, Homo sapiens
aagctgtggcttggaggaaaca

SEQ ID NO: 8552213 - DNA, 22 bp, Homo sapiens
aaggcaccataggcaaatccag

SEQ ID NO: 8552214 - DNA, 22 bp, Homo sapiens
aaggccagagtactagaggctg

SEQ ID NO: 8552215 - DNA, 22 bp, Homo sapiens
aaggccagattctctctagggg

SEQ ID NO: 8552216 - DNA, 22 bp, Homo sapiens
aaggccagagtactagaggctg

SEQ ID NO: 8552217 - DNA, 22 bp, Homo sapiens
acatccatttgctttatttgct

SEQ ID NO: 8552218 - DNA, 22 bp, Homo sapiens
acatccattttgttcaaaagca

SEQ ID NO: 8552219 - DNA, 22 bp, Homo sapiens
acatcccacagaaacatacata

SEQ ID NO: 8552220 - DNA, 22 bp, Homo sapiens
acatccattttgttcaaaagca

SEQ ID NO: 8552221 - DNA, 22 bp, Homo sapiens
acatccatttgtcagctcttga

SEQ ID NO: 8552222 - DNA, 22 bp, Homo sapiens
aaggcaattggcttgtataaga

SEQ ID NO: 8552223 - DNA, 22 bp, Homo sapiens
aaggcacagaggcagggcactt

SEQ ID NO: 8552224 - DNA, 18 bp, Homo sapiens
aaggcacaggagaacatt

SEQ ID NO: 8552225 - DNA, 17 bp, Homo sapiens
aaggcacagggcactgg

SEQ ID NO: 8552226 - DNA, 22 bp, Homo sapiens
aaggcaatgtaaattacagctt

SEQ ID NO: 8552227 - DNA, 22 bp, Homo sapiens
aaggcaatgtaaattacagctt

SEQ ID NO: 8552228 - DNA, 22 bp, Homo sapiens
aaggcaatgactgatttagaat

SEQ ID NO: 8552229 - DNA, 22 bp, Homo sapiens
aaggcaaggccaagccatcagt

SEQ ID NO: 8552230 - DNA, 22 bp, Homo sapiens
aaggcaaggcttccagctcccc

SEQ ID NO: 8552231 - DNA, 22 bp, Homo sapiens
aaggcaaatgtgttcttttagt

SEQ ID NO: 8552232 - DNA, 22 bp, Homo sapiens
aaggcaactgtaaaacatgcac

SEQ ID NO: 8552233 - DNA, 22 bp, Homo sapiens
aaggcaactgtaaaacatgcac

SEQ ID NO: 8552234 - DNA, 22 bp, Homo sapiens
aaggcaatgactgatttagaat

SEQ ID NO: 8552235 - DNA, 22 bp, Homo sapiens
aaggcaatagtattaaactgga

SEQ ID NO: 8552236 - DNA, 22 bp, Homo sapiens
aaggcaaggttcaccgtgctat

SEQ ID NO: 8552237 - DNA, 22 bp, Homo sapiens
acatgactataattacttaaat

SEQ ID NO: 8552238 - DNA, 22 bp, Homo sapiens
acatgcatacacgtacatacct

SEQ ID NO: 8552239 - DNA, 22 bp, Homo sapiens
acatgcatacacgtacatacct

SEQ ID NO: 8552240 - DNA, 22 bp, Homo sapiens
acatgcatacgtgtgtttaaaa

SEQ ID NO: 8552241 - DNA, 22 bp, Homo sapiens
acatgcatacgtgtgtttaaaa

SEQ ID NO: 8552242 - DNA, 22 bp, Homo sapiens
acatgcatgtctatgggcaggt

SEQ ID NO: 8552243 - DNA, 22 bp, Homo sapiens
acatgcatgtctatgggcaggt

SEQ ID NO: 8552244 - DNA, 22 bp, Homo sapiens
acatgcatggtgttgggttgga

SEQ ID NO: 8552245 - DNA, 22 bp, Homo sapiens
acatgcatggctgcttaaatta

SEQ ID NO: 8552246 - DNA, 22 bp, Homo sapiens
acatgcatgctttggtgggtgt

SEQ ID NO: 8552247 - DNA, 22 bp, Homo sapiens
acatgcatggacatgtatatat

SEQ ID NO: 8552248 - DNA, 21 bp, Homo sapiens
acatgcatagagagatttctg

SEQ ID NO: 8552249 - DNA, 22 bp, Homo sapiens
acatgcatatacttaaatatgt

SEQ ID NO: 8552250 - DNA, 22 bp, Homo sapiens
acatgcatatacttaaatatgt

SEQ ID NO: 8552251 - DNA, 22 bp, Homo sapiens
acatgcatatacttaaatatgt

SEQ ID NO: 8552252 - DNA, 19 bp, Homo sapiens
acatgcatatggacagttg

SEQ ID NO: 8552253 - DNA, 22 bp, Homo sapiens
acatgcatatacttaaatatgt

SEQ ID NO: 8552254 - DNA, 19 bp, Homo sapiens
acatgcatatggacagttg

SEQ ID NO: 8552255 - DNA, 22 bp, Homo sapiens
acatcctcccgatctactggct

SEQ ID NO: 8552256 - DNA, 22 bp, Homo sapiens
acatcctcccgatctactggct

SEQ ID NO: 8552257 - DNA, 22 bp, Homo sapiens
acatcctgaagtcagtcatttg

SEQ ID NO: 8552258 - DNA, 22 bp, Homo sapiens
acatcctcccgatctactggct

SEQ ID NO: 8552259 - DNA, 22 bp, Homo sapiens
acatctatttttttctgtccat

SEQ ID NO: 8552260 - DNA, 22 bp, Homo sapiens
acatctcaaattccaggctcca

SEQ ID NO: 8552261 - DNA, 22 bp, Homo sapiens
acatctcacttctttgaaggct

SEQ ID NO: 8552262 - DNA, 22 bp, Homo sapiens
acatctcacttctttgaaggct

SEQ ID NO: 8552263 - DNA, 22 bp, Homo sapiens
acatcgatggatagagcttgct

SEQ ID NO: 8552264 - DNA, 22 bp, Homo sapiens
acatcgatggtcagccgaggag

SEQ ID NO: 8552265 - DNA, 22 bp, Homo sapiens
acatctaagccaattttgattt

SEQ ID NO: 8552266 - DNA, 22 bp, Homo sapiens
acatccttgattatgtaaggat

SEQ ID NO: 8552267 - DNA, 22 bp, Homo sapiens
acatgaatgcagccataacact

SEQ ID NO: 8552268 - DNA, 22 bp, Homo sapiens
acatgaatgcagccataacact

SEQ ID NO: 8552269 - DNA, 22 bp, Homo sapiens
acatgaatgcagccataacact

SEQ ID NO: 8552270 - DNA, 22 bp, Homo sapiens
acatgaagtggtcagatcaaac

SEQ ID NO: 8552271 - DNA, 22 bp, Homo sapiens
acatgaatatatgaagttcaac

SEQ ID NO: 8552272 - DNA, 22 bp, Homo sapiens
acatgaagtggtcagatcaaac

SEQ ID NO: 8552273 - DNA, 22 bp, Homo sapiens
acatgaagcaagaaagatgcta

SEQ ID NO: 8552274 - DNA, 22 bp, Homo sapiens
acatgaaattctagctgaaccc

SEQ ID NO: 8552275 - DNA, 22 bp, Homo sapiens
acatgaaattctagctgaaccc

SEQ ID NO: 8552276 - DNA, 22 bp, Homo sapiens
acatgaaattctagctgaaccc

SEQ ID NO: 8552277 - DNA, 22 bp, Homo sapiens
acatgaacattatatcagcaag

SEQ ID NO: 8552278 - DNA, 20 bp, Homo sapiens
acatgaacagggctacagca

SEQ ID NO: 8552279 - DNA, 22 bp, Homo sapiens
acatctcagaactgagtaaccg

SEQ ID NO: 8552280 - DNA, 22 bp, Homo sapiens
acatctcagaactgagtaaccg

SEQ ID NO: 8552281 - DNA, 22 bp, Homo sapiens
acatctcagaactgagtaaccg

SEQ ID NO: 8552282 - DNA, 22 bp, Homo sapiens
acatgaaatgcagcctgtaacc

SEQ ID NO: 8552283 - DNA, 22 bp, Homo sapiens
aagggttgcaaggtcagaggaa

SEQ ID NO: 8552284 - DNA, 22 bp, Homo sapiens
aagggtggtgtaggagatcaaa

SEQ ID NO: 8552285 - DNA, 22 bp, Homo sapiens
aagggttggggaagagcaaatt

SEQ ID NO: 8552286 - DNA, 22 bp, Homo sapiens
aagggtttgtctccctcaaggc

SEQ ID NO: 8552287 - DNA, 22 bp, Homo sapiens
aagggtttgtctccctcaaggc

SEQ ID NO: 8552288 - DNA, 22 bp, Homo sapiens
aaggtaatatttttctctctaa

SEQ ID NO: 8552289 - DNA, 22 bp, Homo sapiens
aaggtaatcagcctttccacaa

SEQ ID NO: 8552290 - DNA, 22 bp, Homo sapiens
aaggtaatgaaacagcagctaa

SEQ ID NO: 8552291 - DNA, 22 bp, Homo sapiens
aaggtacagttttaagaataag

SEQ ID NO: 8552292 - DNA, 22 bp, Homo sapiens
aaggtacagggtattagattat

SEQ ID NO: 8552293 - DNA, 22 bp, Homo sapiens
aaggtacaaagtattatttaaa

SEQ ID NO: 8552294 - DNA, 22 bp, Homo sapiens
aaggtacaaagtattatttaaa

SEQ ID NO: 8552295 - DNA, 22 bp, Homo sapiens
aaggtacaaagttatacagcgt

SEQ ID NO: 8552296 - DNA, 22 bp, Homo sapiens
aaggtacaccaaagttcaagtt

SEQ ID NO: 8552297 - DNA, 22 bp, Homo sapiens
aaggtacagaaattaacaagga

SEQ ID NO: 8552298 - DNA, 22 bp, Homo sapiens
aaggggtgggcattagagcagt

SEQ ID NO: 8552299 - DNA, 22 bp, Homo sapiens
aaggggtgggcattagagcagt

SEQ ID NO: 8552300 - DNA, 22 bp, Homo sapiens
aaggggtgggcattagagcagt

SEQ ID NO: 8552301 - DNA, 22 bp, Homo sapiens
aagggtgaagggtggtggccta

SEQ ID NO: 8552302 - DNA, 22 bp, Homo sapiens
aagggtgcaaagcactctagct

SEQ ID NO: 8552303 - DNA, 22 bp, Homo sapiens
aagggtgcattgcgcggggctg

SEQ ID NO: 8552304 - DNA, 22 bp, Homo sapiens
aagggtggtgtaggagatcaaa

SEQ ID NO: 8552305 - DNA, 22 bp, Homo sapiens
aagggtgggcaccgccaggtca

SEQ ID NO: 8552306 - DNA, 22 bp, Homo sapiens
aagggtgggccctggcagccat

SEQ ID NO: 8552307 - DNA, 22 bp, Homo sapiens
aagggtggatttctgagctcta

SEQ ID NO: 8552308 - DNA, 22 bp, Homo sapiens
aagggtgctgctatcaggaagc

SEQ ID NO: 8552309 - DNA, 22 bp, Homo sapiens
aagggtggatttctgagctcta

SEQ ID NO: 8552310 - DNA, 22 bp, Homo sapiens
aagggtgggcaccgccaggtca

SEQ ID NO: 8552311 - DNA, 22 bp, Homo sapiens
aagggtggatttctgagctcta

SEQ ID NO: 8552312 - DNA, 22 bp, Homo sapiens
aagggggcggcagccagtggaa

SEQ ID NO: 8552313 - DNA, 22 bp, Homo sapiens
aagggggcggcagccagtggaa

SEQ ID NO: 8552314 - DNA, 22 bp, Homo sapiens
aaggggtgagcagaggcttcgc

SEQ ID NO: 8552315 - DNA, 22 bp, Homo sapiens
aaggggtgcaagttaatcagca

SEQ ID NO: 8552316 - DNA, 22 bp, Homo sapiens
aaggggtgctgttggaaaccca

SEQ ID NO: 8552317 - DNA, 22 bp, Homo sapiens
aaggggtgagcagaggcttcgc

SEQ ID NO: 8552318 - DNA, 19 bp, Homo sapiens
aaggggtgagggaagcaga

SEQ ID NO: 8552319 - DNA, 22 bp, Homo sapiens
aagggggcccagcactaagttg

SEQ ID NO: 8552320 - DNA, 22 bp, Homo sapiens
aagggggccacacctggtgtga

SEQ ID NO: 8552321 - DNA, 22 bp, Homo sapiens
aagggggcgaagacgtgattga

SEQ ID NO: 8552322 - DNA, 22 bp, Homo sapiens
aagggggccacacctggtgtga

SEQ ID NO: 8552323 - DNA, 22 bp, Homo sapiens
aagggggccacacctggtgtga

SEQ ID NO: 8552324 - DNA, 22 bp, Homo sapiens
aagggggcacagtcactgtaat

SEQ ID NO: 8552325 - DNA, 22 bp, Homo sapiens
accagcacctgataggcagtaa

SEQ ID NO: 8552326 - DNA, 22 bp, Homo sapiens
aaggggaaaaagtgttaggagt

SEQ ID NO: 8552327 - DNA, 22 bp, Homo sapiens
accagcaagattttgctttgca

SEQ ID NO: 8552328 - DNA, 23 bp, Homo sapiens
accagcaaaaatgacagcccagg

SEQ ID NO: 8552329 - DNA, 22 bp, Homo sapiens
accagagttttattagttctaa

SEQ ID NO: 8552330 - DNA, 22 bp, Homo sapiens
accagagggagacttcctcttc

SEQ ID NO: 8552331 - DNA, 22 bp, Homo sapiens
accagagggcaaaccccagtgt

SEQ ID NO: 8552332 - DNA, 22 bp, Homo sapiens
accagaggaggaattaccttcc

SEQ ID NO: 8552333 - DNA, 22 bp, Homo sapiens
accagaggctctgccacctcca

SEQ ID NO: 8552334 - DNA, 22 bp, Homo sapiens
accagagctggctctgagcacc

SEQ ID NO: 8552335 - DNA, 22 bp, Homo sapiens
accagagctggctctgagcacc

SEQ ID NO: 8552336 - DNA, 22 bp, Homo sapiens
accagagctggctctgagcacc

SEQ ID NO: 8552337 - DNA, 22 bp, Homo sapiens
accagagctggctctgagcacc

SEQ ID NO: 8552338 - DNA, 22 bp, Homo sapiens
accagagcttacatgctagaaa

SEQ ID NO: 8552339 - DNA, 22 bp, Homo sapiens
accagagcttacatgctagaaa

SEQ ID NO: 8552340 - DNA, 20 bp, Homo sapiens
accagaggaaagagcagtga

SEQ ID NO: 8552341 - DNA, 22 bp, Homo sapiens
accagaggaagggaatctcaag

SEQ ID NO: 8552342 - DNA, 22 bp, Homo sapiens
aagggcacagggaaagagtgca

SEQ ID NO: 8552343 - DNA, 22 bp, Homo sapiens
aagggcagaaagggacgctttg

SEQ ID NO: 8552344 - DNA, 22 bp, Homo sapiens
aagggcagaatagagaagatgg

SEQ ID NO: 8552345 - DNA, 22 bp, Homo sapiens
aagggcagaaagggacgctttg

SEQ ID NO: 8552346 - DNA, 22 bp, Homo sapiens
aagggagacagttgtgtgagga

SEQ ID NO: 8552347 - DNA, 22 bp, Homo sapiens
acatgcatgtgaatatggacac

SEQ ID NO: 8552348 - DNA, 22 bp, Homo sapiens
acatgcatgttgtgtagggggg

SEQ ID NO: 8552349 - DNA, 22 bp, Homo sapiens
aagggaggtaaagctatttaaa

SEQ ID NO: 8552350 - DNA, 22 bp, Homo sapiens
acatttcagatgtaatgtgatg

SEQ ID NO: 8552351 - DNA, 22 bp, Homo sapiens
acatttcagattcatgaagtga

SEQ ID NO: 8552352 - DNA, 22 bp, Homo sapiens
aagggcagagggaatcccacat

SEQ ID NO: 8552353 - DNA, 22 bp, Homo sapiens
acatttcagatgtaatgtgatg

SEQ ID NO: 8552354 - DNA, 22 bp, Homo sapiens
acatttcagatgtaatgtgatg

SEQ ID NO: 8552355 - DNA, 20 bp, Homo sapiens
aagggcagagggaacagact

SEQ ID NO: 8552356 - DNA, 20 bp, Homo sapiens
aagggcagagggaacagact

SEQ ID NO: 8552357 - DNA, 20 bp, Homo sapiens
aagggcagagggaacagact

SEQ ID NO: 8552358 - DNA, 22 bp, Homo sapiens
aagggcagagggaatcccacat

SEQ ID NO: 8552359 - DNA, 22 bp, Homo sapiens
aagggcagaatagagaagatgg

SEQ ID NO: 8552360 - DNA, 22 bp, Homo sapiens
aagggcagaatagagaagatgg

SEQ ID NO: 8552361 - DNA, 22 bp, Homo sapiens
acatttcagattcatgaagtga

SEQ ID NO: 8552362 - DNA, 22 bp, Homo sapiens
acatttcagattcatgaagtga

SEQ ID NO: 8552363 - DNA, 22 bp, Homo sapiens
acatttcagcgtgcatgacatg

SEQ ID NO: 8552364 - DNA, 22 bp, Homo sapiens
acatttcagtaagtgttaattt

SEQ ID NO: 8552365 - DNA, 22 bp, Homo sapiens
acatttcagtaagtgttaattt

SEQ ID NO: 8552366 - DNA, 22 bp, Homo sapiens
acatttcagtaagtgttaattt

SEQ ID NO: 8552367 - DNA, 22 bp, Homo sapiens
acatttcagcgtgcatgacatg

SEQ ID NO: 8552368 - DNA, 22 bp, Homo sapiens
acatttcagtaagtgttaattt

SEQ ID NO: 8552369 - DNA, 22 bp, Homo sapiens
acatttcagtgagctattgaag

SEQ ID NO: 8552370 - DNA, 23 bp, Homo sapiens
acatttcatataaaagggatcag

SEQ ID NO: 8552371 - DNA, 22 bp, Homo sapiens
aagggctggagactgggtcttc

SEQ ID NO: 8552372 - DNA, 19 bp, Homo sapiens
aagggctgggcacctcact

SEQ ID NO: 8552373 - DNA, 18 bp, Homo sapiens
aagggctggcctttggag

SEQ ID NO: 8552374 - DNA, 22 bp, Homo sapiens
aagggctggccctgggaagagt

SEQ ID NO: 8552375 - DNA, 22 bp, Homo sapiens
aagggctggagaggaaaggttg

SEQ ID NO: 8552376 - DNA, 22 bp, Homo sapiens
aagggctggatctctctgagca

SEQ ID NO: 8552377 - DNA, 22 bp, Homo sapiens
aagggctggccacattctgggt

SEQ ID NO: 8552378 - DNA, 22 bp, Homo sapiens
acctctggacactgcatccttc

SEQ ID NO: 8552379 - DNA, 22 bp, Homo sapiens
acctctctgggcctgcttcctg

SEQ ID NO: 8552380 - DNA, 22 bp, Homo sapiens
acctctcaggtcttcctcatat

SEQ ID NO: 8552381 - DNA, 22 bp, Homo sapiens
acctagctgaggagtgtgagtg

SEQ ID NO: 8552382 - DNA, 22 bp, Homo sapiens
aaggtgtcaccagattggcagg

SEQ ID NO: 8552383 - DNA, 22 bp, Homo sapiens
acctcgagttctttcaattcac

SEQ ID NO: 8552384 - DNA, 22 bp, Homo sapiens
acccagggcagccagcggggag

SEQ ID NO: 8552385 - DNA, 22 bp, Homo sapiens
acccagggcagccagcggggag

SEQ ID NO: 8552386 - DNA, 22 bp, Homo sapiens
acccagggccacagcccgcagt

SEQ ID NO: 8552387 - DNA, 22 bp, Homo sapiens
acccagggcagccagcggggag

SEQ ID NO: 8552388 - DNA, 22 bp, Homo sapiens
acccagggagtgctcctgttct

SEQ ID NO: 8552389 - DNA, 22 bp, Homo sapiens
acccagggcttaaggcggtgca

SEQ ID NO: 8552390 - DNA, 22 bp, Homo sapiens
acccagggcttaaggcggtgca

SEQ ID NO: 8552391 - DNA, 22 bp, Homo sapiens
acccagggctcaagcgtaggca

SEQ ID NO: 8552392 - DNA, 22 bp, Homo sapiens
acccagggctcaagcgtaggca

SEQ ID NO: 8552393 - DNA, 22 bp, Homo sapiens
acccagggctcaagcgtaggca

SEQ ID NO: 8552394 - DNA, 22 bp, Homo sapiens
acccagggctcaagcgtaggca

SEQ ID NO: 8552395 - DNA, 21 bp, Homo sapiens
acccaggggaagcagaaactg

SEQ ID NO: 8552396 - DNA, 22 bp, Homo sapiens
acccaggggcgaagctggccac

SEQ ID NO: 8552397 - DNA, 22 bp, Homo sapiens
acccaggggcgaagctggccac

SEQ ID NO: 8552398 - DNA, 22 bp, Homo sapiens
acccaggggcagccttgctgtg

SEQ ID NO: 8552399 - DNA, 22 bp, Homo sapiens
acccagggtagaacctcagagc

SEQ ID NO: 8552400 - DNA, 19 bp, Homo sapiens
acccaggggtttatgtgtg

SEQ ID NO: 8552401 - DNA, 22 bp, Homo sapiens
aagtcccatctgcctccatgta

SEQ ID NO: 8552402 - DNA, 20 bp, Homo sapiens
aagtccctaagtctctggcc

SEQ ID NO: 8552403 - DNA, 22 bp, Homo sapiens
aagtcctgaaacttctttctga

SEQ ID NO: 8552404 - DNA, 22 bp, Homo sapiens
acctgcctatcagctgcctgct

SEQ ID NO: 8552405 - DNA, 22 bp, Homo sapiens
acctgcctagttggttctgccc

SEQ ID NO: 8552406 - DNA, 22 bp, Homo sapiens
acctgcctagttggttctgccc

SEQ ID NO: 8552407 - DNA, 22 bp, Homo sapiens
acctgcctatcagctgcctgct

SEQ ID NO: 8552408 - DNA, 22 bp, Homo sapiens
acctgcctatcagctgcctgct

SEQ ID NO: 8552409 - DNA, 22 bp, Homo sapiens
acctgcctatggagccacatgg

SEQ ID NO: 8552410 - DNA, 22 bp, Homo sapiens
acctgcctatggagccacatgg

SEQ ID NO: 8552411 - DNA, 22 bp, Homo sapiens
aagtccttaggaagcagtcgtt

SEQ ID NO: 8552412 - DNA, 22 bp, Homo sapiens
aagtccttgtatacagaatcaa

SEQ ID NO: 8552413 - DNA, 22 bp, Homo sapiens
acctgcccttaacactgtgtgc

SEQ ID NO: 8552414 - DNA, 22 bp, Homo sapiens
acctgcctagttggttctgccc

SEQ ID NO: 8552415 - DNA, 22 bp, Homo sapiens
aagtatatactaaatgttaatc

SEQ ID NO: 8552416 - DNA, 22 bp, Homo sapiens
aagtatatactaaatgttaatc

SEQ ID NO: 8552417 - DNA, 20 bp, Homo sapiens
aagtatatgtccgtgtactt

SEQ ID NO: 8552418 - DNA, 22 bp, Homo sapiens
aagtatatttagctgagcttgt

SEQ ID NO: 8552419 - DNA, 22 bp, Homo sapiens
aagtatattttttgaagcatat

SEQ ID NO: 8552420 - DNA, 22 bp, Homo sapiens
aagtatatttagctgagcttgt

SEQ ID NO: 8552421 - DNA, 22 bp, Homo sapiens
aagtcagtgctagctaatggct

SEQ ID NO: 8552422 - DNA, 22 bp, Homo sapiens
aagtcatagtcgggaaagacat

SEQ ID NO: 8552423 - DNA, 22 bp, Homo sapiens
aagtatattttttgaagcatat

SEQ ID NO: 8552424 - DNA, 22 bp, Homo sapiens
aagtatctcaaaaacagtaatc

SEQ ID NO: 8552425 - DNA, 22 bp, Homo sapiens
aagtcatcactcctctgaactt

SEQ ID NO: 8552426 - DNA, 22 bp, Homo sapiens
aagtccagtttcatttgaggtc

SEQ ID NO: 8552427 - DNA, 22 bp, Homo sapiens
aagtccatagtttgcattaggg

SEQ ID NO: 8552428 - DNA, 22 bp, Homo sapiens
aagtccatctctgccccacaca

SEQ ID NO: 8552429 - DNA, 22 bp, Homo sapiens
aagtccattcttccagccagct

SEQ ID NO: 8552430 - DNA, 22 bp, Homo sapiens
aagtaggaatccgaatgagtag

SEQ ID NO: 8552431 - DNA, 22 bp, Homo sapiens
aagtagcattccatggtataga

SEQ ID NO: 8552432 - DNA, 22 bp, Homo sapiens
aagtagcattccatggtataga

SEQ ID NO: 8552433 - DNA, 23 bp, Homo sapiens
aagtagataacactgttctgaga

SEQ ID NO: 8552434 - DNA, 22 bp, Homo sapiens
aagtatatactaaatgttaatc

SEQ ID NO: 8552435 - DNA, 22 bp, Homo sapiens
aagtatacttaggcataatggt

SEQ ID NO: 8552436 - DNA, 22 bp, Homo sapiens
aagtatactgaaggtatccagg

SEQ ID NO: 8552437 - DNA, 22 bp, Homo sapiens
aagtagtgtgctccagcggtga

SEQ ID NO: 8552438 - DNA, 20 bp, Homo sapiens
acagcagataccacaactat

SEQ ID NO: 8552439 - DNA, 22 bp, Homo sapiens
acagcagatctggctacaggtt

SEQ ID NO: 8552440 - DNA, 20 bp, Homo sapiens
acagcagataccacaactat

SEQ ID NO: 8552441 - DNA, 22 bp, Homo sapiens
acagcagatctggctacaggtt

SEQ ID NO: 8552442 - DNA, 22 bp, Homo sapiens
acagcagatctggctacaggtt

SEQ ID NO: 8552443 - DNA, 20 bp, Homo sapiens
acagcagataccacaactat

SEQ ID NO: 8552444 - DNA, 22 bp, Homo sapiens
acagcagagtgtgagatagcca

SEQ ID NO: 8552445 - DNA, 22 bp, Homo sapiens
acagcagagtgtgagatagcca

SEQ ID NO: 8552446 - DNA, 22 bp, Homo sapiens
acagcagagtgtgagatagcca

SEQ ID NO: 8552447 - DNA, 22 bp, Homo sapiens
acagcagaccccagtgccatgg

SEQ ID NO: 8552448 - DNA, 22 bp, Homo sapiens
acagcagaccactactagtagg

SEQ ID NO: 8552449 - DNA, 22 bp, Homo sapiens
acagcagagtggagatgagcac

SEQ ID NO: 8552450 - DNA, 22 bp, Homo sapiens
acagcagagtggagatgagcac

SEQ ID NO: 8552451 - DNA, 22 bp, Homo sapiens
acagcagagtgtgagatagcca

SEQ ID NO: 8552452 - DNA, 22 bp, Homo sapiens
acagcagagtgtgagatagcca

SEQ ID NO: 8552453 - DNA, 22 bp, Homo sapiens
acagcagagtgtgagatagcca

SEQ ID NO: 8552454 - DNA, 22 bp, Homo sapiens
acagatacaaatatacaaatac

SEQ ID NO: 8552455 - DNA, 22 bp, Homo sapiens
acagatacaaatatacaaatac

SEQ ID NO: 8552456 - DNA, 22 bp, Homo sapiens
acagataatttaattaatgcat

SEQ ID NO: 8552457 - DNA, 20 bp, Homo sapiens
acagataccagggacatggg

SEQ ID NO: 8552458 - DNA, 22 bp, Homo sapiens
acagatacagggacttggtatt

SEQ ID NO: 8552459 - DNA, 22 bp, Homo sapiens
acagatactcagctctatgctt

SEQ ID NO: 8552460 - DNA, 22 bp, Homo sapiens
acagatatgttgggttcttgtt

SEQ ID NO: 8552461 - DNA, 22 bp, Homo sapiens
acagatattatggtttctcctt

SEQ ID NO: 8552462 - DNA, 22 bp, Homo sapiens
acagatatttaagagcttttgt

SEQ ID NO: 8552463 - DNA, 22 bp, Homo sapiens
acagatatatgattgtgtaaat

SEQ ID NO: 8552464 - DNA, 22 bp, Homo sapiens
acagatatatgattgtgtaaat

SEQ ID NO: 8552465 - DNA, 22 bp, Homo sapiens
acagatatatgattgtgtaaat

SEQ ID NO: 8552466 - DNA, 22 bp, Homo sapiens
acagatatatgattgtgtaaat

SEQ ID NO: 8552467 - DNA, 22 bp, Homo sapiens
acagatagtatgtaaattaagc

SEQ ID NO: 8552468 - DNA, 22 bp, Homo sapiens
acagatataaactatagtagtg

SEQ ID NO: 8552469 - DNA, 22 bp, Homo sapiens
acagatataaactatagtagtg

SEQ ID NO: 8552470 - DNA, 22 bp, Homo sapiens
acagatataaactatagtagtg

SEQ ID NO: 8552471 - DNA, 22 bp, Homo sapiens
acagcagatctggctacaggtt

SEQ ID NO: 8552472 - DNA, 22 bp, Homo sapiens
acagcagcaatagcagtgacat

SEQ ID NO: 8552473 - DNA, 22 bp, Homo sapiens
acagcagcaatagcagtgacat

SEQ ID NO: 8552474 - DNA, 22 bp, Homo sapiens
acagcagcactattgacatttt

SEQ ID NO: 8552475 - DNA, 21 bp, Homo sapiens
acagcagcaatctgtctttcc

SEQ ID NO: 8552476 - DNA, 21 bp, Homo sapiens
acagcagcaatctgtctttcc

SEQ ID NO: 8552477 - DNA, 22 bp, Homo sapiens
acagcagcataaactgactaag

SEQ ID NO: 8552478 - DNA, 22 bp, Homo sapiens
acagcagcataaactgactaag

SEQ ID NO: 8552479 - DNA, 22 bp, Homo sapiens
acagcagcagaccagcatatgt

SEQ ID NO: 8552480 - DNA, 22 bp, Homo sapiens
acagcagccagccactgtgagc

SEQ ID NO: 8552481 - DNA, 22 bp, Homo sapiens
acagcagcctgcagccctgtgt

SEQ ID NO: 8552482 - DNA, 22 bp, Homo sapiens
acagcagccttgttggtttcga

SEQ ID NO: 8552483 - DNA, 22 bp, Homo sapiens
acagcagccttgttggtttcga

SEQ ID NO: 8552484 - DNA, 22 bp, Homo sapiens
acagcaggcccatactggaagg

SEQ ID NO: 8552485 - DNA, 22 bp, Homo sapiens
acagcaggcatgaatgacactg

SEQ ID NO: 8552486 - DNA, 17 bp, Homo sapiens
acagcaggcccggaggg

SEQ ID NO: 8552487 - DNA, 22 bp, Homo sapiens
acagcaggttttaactttgaag

SEQ ID NO: 8552488 - DNA, 22 bp, Homo sapiens
acagcagtcagtgaatatttaa

SEQ ID NO: 8552489 - DNA, 22 bp, Homo sapiens
acagcagtgcacagagaaccct

SEQ ID NO: 8552490 - DNA, 22 bp, Homo sapiens
acagcagtcttaacacattgca

SEQ ID NO: 8552491 - DNA, 22 bp, Homo sapiens
acagcagtgcacagagaaccct

SEQ ID NO: 8552492 - DNA, 22 bp, Homo sapiens
acagcagtggattagaggatgg

SEQ ID NO: 8552493 - DNA, 18 bp, Homo sapiens
acagcaggtttcattctt

SEQ ID NO: 8552494 - DNA, 22 bp, Homo sapiens
acagcaggttattgttatggca

SEQ ID NO: 8552495 - DNA, 21 bp, Homo sapiens
acagcagggctggcatgacag

SEQ ID NO: 8552496 - DNA, 22 bp, Homo sapiens
acagcaggttacagtggcacag

SEQ ID NO: 8552497 - DNA, 22 bp, Homo sapiens
acagcagccttgttggtttcga

SEQ ID NO: 8552498 - DNA, 22 bp, Homo sapiens
acagcagccttgttggtttcga

SEQ ID NO: 8552499 - DNA, 22 bp, Homo sapiens
acagcagcgtcaacttaaaatt

SEQ ID NO: 8552500 - DNA, 22 bp, Homo sapiens
acagcagcgtgaagtgtgttat

SEQ ID NO: 8552501 - DNA, 22 bp, Homo sapiens
acagcagcgtcaacttaaaatt

SEQ ID NO: 8552502 - DNA, 22 bp, Homo sapiens
agctgagcacattcaaacaggt

SEQ ID NO: 8552503 - DNA, 22 bp, Homo sapiens
agctgagcacattcaaacaggt

SEQ ID NO: 8552504 - DNA, 22 bp, Homo sapiens
agctgagattgtttccatttct

SEQ ID NO: 8552505 - DNA, 22 bp, Homo sapiens
agctgagattatgctcttctca

SEQ ID NO: 8552506 - DNA, 18 bp, Homo sapiens
agctgaggggactgaaga

SEQ ID NO: 8552507 - DNA, 22 bp, Homo sapiens
agctgagggcaggatggggtga

SEQ ID NO: 8552508 - DNA, 22 bp, Homo sapiens
agctgagggcaggatggggtga

SEQ ID NO: 8552509 - DNA, 22 bp, Homo sapiens
agctgagggttcggtgtccaca

SEQ ID NO: 8552510 - DNA, 22 bp, Homo sapiens
agctgagggttcggtgtccaca

SEQ ID NO: 8552511 - DNA, 22 bp, Homo sapiens
agctgagggttcggtgtccaca

SEQ ID NO: 8552512 - DNA, 22 bp, Homo sapiens
agctgaggttgaagagtgaacg

SEQ ID NO: 8552513 - DNA, 22 bp, Homo sapiens
agctgaggttgaagagtgaacg

SEQ ID NO: 8552514 - DNA, 22 bp, Homo sapiens
agctgatacatttcttgtagcc

SEQ ID NO: 8552515 - DNA, 22 bp, Homo sapiens
agctgagttaattcatcactta

SEQ ID NO: 8552516 - DNA, 22 bp, Homo sapiens
agctgatgccatgtggaacagt

SEQ ID NO: 8552517 - DNA, 21 bp, Homo sapiens
agctgaggtaaggcaagagag

SEQ ID NO: 8552518 - DNA, 21 bp, Homo sapiens
agctgaggtaaggcaagagag

SEQ ID NO: 8552519 - DNA, 21 bp, Homo sapiens
agctgaggtaaggcaagagag

SEQ ID NO: 8552520 - DNA, 23 bp, Homo sapiens
agctgaggtgcagatccaaagaa

SEQ ID NO: 8552521 - DNA, 23 bp, Homo sapiens
agctgaggtgcagatccaaagaa

SEQ ID NO: 8552522 - DNA, 23 bp, Homo sapiens
agctgaggtgcagatccaaagaa

SEQ ID NO: 8552523 - DNA, 22 bp, Homo sapiens
agctgaggttagtataaatgtg

SEQ ID NO: 8552524 - DNA, 22 bp, Homo sapiens
acagaggcctcggcctgcccag

SEQ ID NO: 8552525 - DNA, 22 bp, Homo sapiens
acagaggccgcctctctcacgg

SEQ ID NO: 8552526 - DNA, 22 bp, Homo sapiens
acagaggcctcggcctgcccag

SEQ ID NO: 8552527 - DNA, 22 bp, Homo sapiens
acagaggccccgtgggagagcc

SEQ ID NO: 8552528 - DNA, 22 bp, Homo sapiens
acagaggccgcctctctcacgg

SEQ ID NO: 8552529 - DNA, 22 bp, Homo sapiens
acagaggccccgtgggagagcc

SEQ ID NO: 8552530 - DNA, 22 bp, Homo sapiens
acagaggccgcctctctcacgg

SEQ ID NO: 8552531 - DNA, 22 bp, Homo sapiens
acagaggccccgtgggagagcc

SEQ ID NO: 8552532 - DNA, 22 bp, Homo sapiens
acagaggctgatcttcaagccc

SEQ ID NO: 8552533 - DNA, 22 bp, Homo sapiens
acagaggcctcgtaggtacaac

SEQ ID NO: 8552534 - DNA, 22 bp, Homo sapiens
acagaggctgatcttcaagccc

SEQ ID NO: 8552535 - DNA, 23 bp, Homo sapiens
acagaggcttaaatgagtggcag

SEQ ID NO: 8552536 - DNA, 23 bp, Homo sapiens
acagaggcttaaatgagtggcag

SEQ ID NO: 8552537 - DNA, 22 bp, Homo sapiens
acagaggctgcgcttgggaacg

SEQ ID NO: 8552538 - DNA, 22 bp, Homo sapiens
acagagggtctgggcacaggac

SEQ ID NO: 8552539 - DNA, 22 bp, Homo sapiens
acagaggggtcacagcctgaag

SEQ ID NO: 8552540 - DNA, 22 bp, Homo sapiens
acagaggggtcacagcctgaag

SEQ ID NO: 8552541 - DNA, 22 bp, Homo sapiens
acagagggggccttggagtgca

SEQ ID NO: 8552542 - DNA, 19 bp, Homo sapiens
acagagggcaactgagaaa

SEQ ID NO: 8552543 - DNA, 19 bp, Homo sapiens
acagagggcaactgagaaa

SEQ ID NO: 8552544 - DNA, 22 bp, Homo sapiens
acagagggggccttggagtgca

SEQ ID NO: 8552545 - DNA, 22 bp, Homo sapiens
acagagggggccttggagtgca

SEQ ID NO: 8552546 - DNA, 22 bp, Homo sapiens
acagaggtaggacatgagatat

SEQ ID NO: 8552547 - DNA, 22 bp, Homo sapiens
acagaggtaggacatgagatat

SEQ ID NO: 8552548 - DNA, 22 bp, Homo sapiens
acagaggtaggacatgagatat

SEQ ID NO: 8552549 - DNA, 22 bp, Homo sapiens
acagaggtaggacatgagatat

SEQ ID NO: 8552550 - DNA, 22 bp, Homo sapiens
acagaggtcacctttgtatctt

SEQ ID NO: 8552551 - DNA, 22 bp, Homo sapiens
acagagggtgtggaggaagacg

SEQ ID NO: 8552552 - DNA, 22 bp, Homo sapiens
acagagggtctgggcacaggac

SEQ ID NO: 8552553 - DNA, 22 bp, Homo sapiens
agcgtgaattagttggtacaca

SEQ ID NO: 8552554 - DNA, 22 bp, Homo sapiens
agcgtgtgtgcgggtcttcttt

SEQ ID NO: 8552555 - DNA, 22 bp, Homo sapiens
agcgtgtggagaactaagcaga

SEQ ID NO: 8552556 - DNA, 22 bp, Homo sapiens
agcgtgtgtgcgggtcttcttt

SEQ ID NO: 8552557 - DNA, 22 bp, Homo sapiens
agcgtgtgcctcggggtacacg

SEQ ID NO: 8552558 - DNA, 22 bp, Homo sapiens
acagataattagcataaatgct

SEQ ID NO: 8552559 - DNA, 22 bp, Homo sapiens
acagataattagcataaatgct

SEQ ID NO: 8552560 - DNA, 22 bp, Homo sapiens
acagataattagcataaatgct

SEQ ID NO: 8552561 - DNA, 22 bp, Homo sapiens
agcgggctcaagtggccagcag

SEQ ID NO: 8552562 - DNA, 22 bp, Homo sapiens
agcgggtgctgtgtcagccctc

SEQ ID NO: 8552563 - DNA, 22 bp, Homo sapiens
acagaggtcatggagagttctc

SEQ ID NO: 8552564 - DNA, 22 bp, Homo sapiens
acagaggtcatggagagttctc

SEQ ID NO: 8552565 - DNA, 22 bp, Homo sapiens
acagaggtcatggagagttctc

SEQ ID NO: 8552566 - DNA, 22 bp, Homo sapiens
agccttcactgggaccttggat

SEQ ID NO: 8552567 - DNA, 22 bp, Homo sapiens
agccttcaacctagctagagca

SEQ ID NO: 8552568 - DNA, 22 bp, Homo sapiens
acagaacttccagggaacatac

SEQ ID NO: 8552569 - DNA, 22 bp, Homo sapiens
acagaacttcctgctggagtgg

SEQ ID NO: 8552570 - DNA, 19 bp, Homo sapiens
acagaagcatagaaaagga

SEQ ID NO: 8552571 - DNA, 22 bp, Homo sapiens
acagaagcctttggccatttga

SEQ ID NO: 8552572 - DNA, 22 bp, Homo sapiens
acagaaggcggggacaaggcgg

SEQ ID NO: 8552573 - DNA, 22 bp, Homo sapiens
acagaaggacttgagaaagaca

SEQ ID NO: 8552574 - DNA, 22 bp, Homo sapiens
acagaataaggtttatctctcc

SEQ ID NO: 8552575 - DNA, 23 bp, Homo sapiens
acagaataccattgactaggtgt

SEQ ID NO: 8552576 - DNA, 22 bp, Homo sapiens
acagaatactacagactggtta

SEQ ID NO: 8552577 - DNA, 22 bp, Homo sapiens
acagaagttggaattagatact

SEQ ID NO: 8552578 - DNA, 20 bp, Homo sapiens
acagaatatgctggttgtgg

SEQ ID NO: 8552579 - DNA, 20 bp, Homo sapiens
acagaatatgctggttgtgg

SEQ ID NO: 8552580 - DNA, 22 bp, Homo sapiens
acagaatagtcagctgtaggcc

SEQ ID NO: 8552581 - DNA, 22 bp, Homo sapiens
acagaatagtagcttaaagtca

SEQ ID NO: 8552582 - DNA, 22 bp, Homo sapiens
acagaatactcataagaagggg

SEQ ID NO: 8552583 - DNA, 22 bp, Homo sapiens
acagaatactcataagaagggg

SEQ ID NO: 8552584 - DNA, 22 bp, Homo sapiens
acagaataggtacagtcagtca

SEQ ID NO: 8552585 - DNA, 22 bp, Homo sapiens
acagaatgcagagatgcccaga

SEQ ID NO: 8552586 - DNA, 22 bp, Homo sapiens
acagaatgcgtagtgcatgttg

SEQ ID NO: 8552587 - DNA, 22 bp, Homo sapiens
acagaatatttggcatgcgtct

SEQ ID NO: 8552588 - DNA, 22 bp, Homo sapiens
acagaatattggttactgttgc

SEQ ID NO: 8552589 - DNA, 22 bp, Homo sapiens
acagaatattggttactgttgc

SEQ ID NO: 8552590 - DNA, 22 bp, Homo sapiens
acagaatattgtaagtgccact

SEQ ID NO: 8552591 - DNA, 22 bp, Homo sapiens
acagaatattggttactgttgc

SEQ ID NO: 8552592 - DNA, 22 bp, Homo sapiens
acagaggccatgagctgccacc

SEQ ID NO: 8552593 - DNA, 22 bp, Homo sapiens
acagaggccatgagctgccacc

SEQ ID NO: 8552594 - DNA, 21 bp, Homo sapiens
acagaggcatacagcttaagg

SEQ ID NO: 8552595 - DNA, 22 bp, Homo sapiens
acagaggccatgagctgccacc

SEQ ID NO: 8552596 - DNA, 17 bp, Homo sapiens
acagaggcaggagtgga

SEQ ID NO: 8552597 - DNA, 22 bp, Homo sapiens
acagaggcagtgtgagatactg

SEQ ID NO: 8552598 - DNA, 22 bp, Homo sapiens
acagaggcagtgtgagatactg

SEQ ID NO: 8552599 - DNA, 22 bp, Homo sapiens
acagaggcagtgtgagatactg

SEQ ID NO: 8552600 - DNA, 22 bp, Homo sapiens
acagaattaaagtgtttgtgga

SEQ ID NO: 8552601 - DNA, 22 bp, Homo sapiens
acagaattaaagtgtttgtgga

SEQ ID NO: 8552602 - DNA, 22 bp, Homo sapiens
acagagctgtacatgtgccatg

SEQ ID NO: 8552603 - DNA, 22 bp, Homo sapiens
acagaattaacatttgatgaat

SEQ ID NO: 8552604 - DNA, 22 bp, Homo sapiens
acagaattaacatttgatgaat

SEQ ID NO: 8552605 - DNA, 22 bp, Homo sapiens
acagagctgtacatgtgccatg

SEQ ID NO: 8552606 - DNA, 22 bp, Homo sapiens
agccaaggtcgccccagggcaa

SEQ ID NO: 8552607 - DNA, 22 bp, Homo sapiens
agccaaggtcgccccagggcaa

SEQ ID NO: 8552608 - DNA, 22 bp, Homo sapiens
agccaaggcagctagagctctg

SEQ ID NO: 8552609 - DNA, 22 bp, Homo sapiens
agccaaggcagctagagctctg

SEQ ID NO: 8552610 - DNA, 22 bp, Homo sapiens
agccaaggcagctagagctctg

SEQ ID NO: 8552611 - DNA, 22 bp, Homo sapiens
agccaaggcagctagagctctg

SEQ ID NO: 8552612 - DNA, 22 bp, Homo sapiens
agccaagggtcagctgcacaga

SEQ ID NO: 8552613 - DNA, 22 bp, Homo sapiens
agccaaggtatcatgagaggca

SEQ ID NO: 8552614 - DNA, 22 bp, Homo sapiens
acacccagctgggccacctcca

SEQ ID NO: 8552615 - DNA, 22 bp, Homo sapiens
acacccagctgggccacctcca

SEQ ID NO: 8552616 - DNA, 22 bp, Homo sapiens
acacccagcttttgaatgccct

SEQ ID NO: 8552617 - DNA, 22 bp, Homo sapiens
acacccagcttttgaatgccct

SEQ ID NO: 8552618 - DNA, 22 bp, Homo sapiens
agccaaggacacggagcctcct

SEQ ID NO: 8552619 - DNA, 22 bp, Homo sapiens
agccaaggacacggagcctcct

SEQ ID NO: 8552620 - DNA, 22 bp, Homo sapiens
agccaaggacacggagcctcct

SEQ ID NO: 8552621 - DNA, 22 bp, Homo sapiens
agcatttacctcaatgcatctg

SEQ ID NO: 8552622 - DNA, 22 bp, Homo sapiens
agcatttacctcaatgcatctg

SEQ ID NO: 8552623 - DNA, 22 bp, Homo sapiens
agcatttaattacagtttaatt

SEQ ID NO: 8552624 - DNA, 22 bp, Homo sapiens
agccaaggagtgcaggtggctt

SEQ ID NO: 8552625 - DNA, 22 bp, Homo sapiens
agccaaggagtgcaggtggctt

SEQ ID NO: 8552626 - DNA, 22 bp, Homo sapiens
agccaaggagtgcaggtggctt

SEQ ID NO: 8552627 - DNA, 18 bp, Homo sapiens
agccaaggaggaggagga

SEQ ID NO: 8552628 - DNA, 22 bp, Homo sapiens
agccaaggactcagtggtaggc

SEQ ID NO: 8552629 - DNA, 18 bp, Homo sapiens
agccaaggaggaggagga

SEQ ID NO: 8552630 - DNA, 18 bp, Homo sapiens
agccaaggaggaggagga

SEQ ID NO: 8552631 - DNA, 22 bp, Homo sapiens
agcaggtggtaggcagtcagca

SEQ ID NO: 8552632 - DNA, 22 bp, Homo sapiens
agcaggtgagcacagccaggct

SEQ ID NO: 8552633 - DNA, 22 bp, Homo sapiens
agcaggtgtatcggtcacctac

SEQ ID NO: 8552634 - DNA, 22 bp, Homo sapiens
acacccagagcgccagtgccga

SEQ ID NO: 8552635 - DNA, 22 bp, Homo sapiens
acacccagagcgccagtgccga

SEQ ID NO: 8552636 - DNA, 22 bp, Homo sapiens
acacccagagcgccagtgccga

SEQ ID NO: 8552637 - DNA, 22 bp, Homo sapiens
acacccagagcgccagtgccga

SEQ ID NO: 8552638 - DNA, 22 bp, Homo sapiens
acacccagattatgcacacaaa

SEQ ID NO: 8552639 - DNA, 22 bp, Homo sapiens
acacccagagcgccagtgccga

SEQ ID NO: 8552640 - DNA, 22 bp, Homo sapiens
acaccatggttcccaaactgtg

SEQ ID NO: 8552641 - DNA, 22 bp, Homo sapiens
acaccatactcatgttggttcc

SEQ ID NO: 8552642 - DNA, 22 bp, Homo sapiens
acaccatgatgagtgatgtagc

SEQ ID NO: 8552643 - DNA, 22 bp, Homo sapiens
acaccagggcctagccagggcg

SEQ ID NO: 8552644 - DNA, 22 bp, Homo sapiens
acaccagggcctagccagggcg

SEQ ID NO: 8552645 - DNA, 22 bp, Homo sapiens
acaccagggcctagccagggcg

SEQ ID NO: 8552646 - DNA, 22 bp, Homo sapiens
agccagaggccagcctgcctca

SEQ ID NO: 8552647 - DNA, 22 bp, Homo sapiens
agccagaggccagcctgcctca

SEQ ID NO: 8552648 - DNA, 22 bp, Homo sapiens
agccagaggccagcctgcctca

SEQ ID NO: 8552649 - DNA, 22 bp, Homo sapiens
agccagagggatctttctaaga

SEQ ID NO: 8552650 - DNA, 22 bp, Homo sapiens
agccagaggtcatgagcacagg

SEQ ID NO: 8552651 - DNA, 22 bp, Homo sapiens
agccagaggtcatgagcacagg

SEQ ID NO: 8552652 - DNA, 22 bp, Homo sapiens
agccagaggtcatgagcacagg

SEQ ID NO: 8552653 - DNA, 22 bp, Homo sapiens
agccagaggtcatgagcacagg

SEQ ID NO: 8552654 - DNA, 22 bp, Homo sapiens
agccagctggagaccactgttt

SEQ ID NO: 8552655 - DNA, 22 bp, Homo sapiens
agccagctggagaccactgttt

SEQ ID NO: 8552656 - DNA, 22 bp, Homo sapiens
agccagctggtgggtcagctgg

SEQ ID NO: 8552657 - DNA, 22 bp, Homo sapiens
agccagctggtgggtcagctgg

SEQ ID NO: 8552658 - DNA, 22 bp, Homo sapiens
agccagctgcctttcacatctg

SEQ ID NO: 8552659 - DNA, 22 bp, Homo sapiens
agccagctggagaccactgttt

SEQ ID NO: 8552660 - DNA, 22 bp, Homo sapiens
agccagctgcctttcacatctg

SEQ ID NO: 8552661 - DNA, 19 bp, Homo sapiens
agccagagtggcccagggg

SEQ ID NO: 8552662 - DNA, 19 bp, Homo sapiens
agccagagtggcccagggg

SEQ ID NO: 8552663 - DNA, 22 bp, Homo sapiens
agccagctgtgggctcaggcgg

SEQ ID NO: 8552664 - DNA, 22 bp, Homo sapiens
agccagctgtgtggtcaggcaa

SEQ ID NO: 8552665 - DNA, 22 bp, Homo sapiens
agccaggaaccagctacagtct

SEQ ID NO: 8552666 - DNA, 22 bp, Homo sapiens
agccaggaaccagctacagtct

SEQ ID NO: 8552667 - DNA, 22 bp, Homo sapiens
agccaggaagaaggtcacacca

SEQ ID NO: 8552668 - DNA, 22 bp, Homo sapiens
agccaggaagagaggcctcacc

SEQ ID NO: 8552669 - DNA, 22 bp, Homo sapiens
agccaggaagagaggcctcacc

SEQ ID NO: 8552670 - DNA, 22 bp, Homo sapiens
acacttatttcttgtctaacca

SEQ ID NO: 8552671 - DNA, 22 bp, Homo sapiens
acacttcaaagggtgacttgat

SEQ ID NO: 8552672 - DNA, 22 bp, Homo sapiens
acacttatttttgtccacttcc

SEQ ID NO: 8552673 - DNA, 22 bp, Homo sapiens
acacttaatcttactgaggatc

SEQ ID NO: 8552674 - DNA, 22 bp, Homo sapiens
acacttaatcttactgaggatc

SEQ ID NO: 8552675 - DNA, 22 bp, Homo sapiens
acacttaagcatgaagtataaa

SEQ ID NO: 8552676 - DNA, 22 bp, Homo sapiens
acactgttctttgcactgagaa

SEQ ID NO: 8552677 - DNA, 22 bp, Homo sapiens
acactgttgctggcacagacag

SEQ ID NO: 8552678 - DNA, 22 bp, Homo sapiens
acactgttgctggcacagacag

SEQ ID NO: 8552679 - DNA, 22 bp, Homo sapiens
acactgttttagggaagaaaat

SEQ ID NO: 8552680 - DNA, 22 bp, Homo sapiens
acacttaagcatgaagtataaa

SEQ ID NO: 8552681 - DNA, 22 bp, Homo sapiens
acacttaagcatgaagtataaa

SEQ ID NO: 8552682 - DNA, 22 bp, Homo sapiens
acacttaacttctgagaataaa

SEQ ID NO: 8552683 - DNA, 20 bp, Homo sapiens
acactgttcttcacacattt

SEQ ID NO: 8552684 - DNA, 22 bp, Homo sapiens
acactgttcctgaaattgttat

SEQ ID NO: 8552685 - DNA, 22 bp, Homo sapiens
acactgttccacactaagaagg

SEQ ID NO: 8552686 - DNA, 22 bp, Homo sapiens
acactgttcctgaaattgttat

SEQ ID NO: 8552687 - DNA, 22 bp, Homo sapiens
acactgttctttgcactgagaa

SEQ ID NO: 8552688 - DNA, 22 bp, Homo sapiens
acactgtgtggtctctctcgga

SEQ ID NO: 8552689 - DNA, 22 bp, Homo sapiens
acactgttcctgaaattgttat

SEQ ID NO: 8552690 - DNA, 22 bp, Homo sapiens
acactgttccacactaagaagg

SEQ ID NO: 8552691 - DNA, 22 bp, Homo sapiens
acactgttccacactaagaagg

SEQ ID NO: 8552692 - DNA, 22 bp, Homo sapiens
agccagagattgagatgcaggc

SEQ ID NO: 8552693 - DNA, 22 bp, Homo sapiens
agccagagattgagatgcaggc

SEQ ID NO: 8552694 - DNA, 22 bp, Homo sapiens
agccacagtctgtagccagctt

SEQ ID NO: 8552695 - DNA, 22 bp, Homo sapiens
agccagagatccatccctagga

SEQ ID NO: 8552696 - DNA, 23 bp, Homo sapiens
acacttcacccattgtgatagga

SEQ ID NO: 8552697 - DNA, 22 bp, Homo sapiens
agccacagtctgatgcctgaga

SEQ ID NO: 8552698 - DNA, 22 bp, Homo sapiens
acacttcaaatggttggaaaat

SEQ ID NO: 8552699 - DNA, 22 bp, Homo sapiens
agccacagtctgatgcctgaga

SEQ ID NO: 8552700 - DNA, 23 bp, Homo sapiens
acacttcacccattgtgatagga

SEQ ID NO: 8552701 - DNA, 22 bp, Homo sapiens
agccagaggaagcctggccctc

SEQ ID NO: 8552702 - DNA, 22 bp, Homo sapiens
agccagaggaagcctggccctc

SEQ ID NO: 8552703 - DNA, 22 bp, Homo sapiens
agccagaggaacttgatgactg

SEQ ID NO: 8552704 - DNA, 22 bp, Homo sapiens
agccagagattgagatgcaggc

SEQ ID NO: 8552705 - DNA, 22 bp, Homo sapiens
agccagagattgagatgcaggc

SEQ ID NO: 8552706 - DNA, 22 bp, Homo sapiens
agccagagctgatgtcattctc

SEQ ID NO: 8552707 - DNA, 22 bp, Homo sapiens
agccagagctgatgtcattctc

SEQ ID NO: 8552708 - DNA, 22 bp, Homo sapiens
agccagagctgatgtcattctc

SEQ ID NO: 8552709 - DNA, 22 bp, Homo sapiens
acacatctcaggggacactctc

SEQ ID NO: 8552710 - DNA, 22 bp, Homo sapiens
acacatctatctctacacaagg

SEQ ID NO: 8552711 - DNA, 22 bp, Homo sapiens
acacatcctgaccaagttcagg

SEQ ID NO: 8552712 - DNA, 22 bp, Homo sapiens
acacatctatctctacacaagg

SEQ ID NO: 8552713 - DNA, 22 bp, Homo sapiens
acacatcatgccaagtttcacc

SEQ ID NO: 8552714 - DNA, 22 bp, Homo sapiens
acacatcatgccaagtttcacc

SEQ ID NO: 8552715 - DNA, 22 bp, Homo sapiens
acacatattcatatgtacttac

SEQ ID NO: 8552716 - DNA, 22 bp, Homo sapiens
acacatatgtggcaactgtaga

SEQ ID NO: 8552717 - DNA, 22 bp, Homo sapiens
acacatatgtggcaactgtaga

SEQ ID NO: 8552718 - DNA, 22 bp, Homo sapiens
acacatcagaaatatgaatgag

SEQ ID NO: 8552719 - DNA, 22 bp, Homo sapiens
acacatcagaaatatgaatgag

SEQ ID NO: 8552720 - DNA, 22 bp, Homo sapiens
acacatcagcctcagctttggg

SEQ ID NO: 8552721 - DNA, 22 bp, Homo sapiens
agcagggactgagccagtggga

SEQ ID NO: 8552722 - DNA, 22 bp, Homo sapiens
acacatatgtcattgaaaaatc

SEQ ID NO: 8552723 - DNA, 22 bp, Homo sapiens
agcagggactacgtgaaagtga

SEQ ID NO: 8552724 - DNA, 22 bp, Homo sapiens
agcaggcttggtccccagcctc

SEQ ID NO: 8552725 - DNA, 22 bp, Homo sapiens
agcaggcttgttatgtctgaga

SEQ ID NO: 8552726 - DNA, 22 bp, Homo sapiens
agcagggaagcctccagaacct

SEQ ID NO: 8552727 - DNA, 22 bp, Homo sapiens
agcaggctttcaagagtcttct

SEQ ID NO: 8552728 - DNA, 22 bp, Homo sapiens
agcaggctttcaagagtcttct

SEQ ID NO: 8552729 - DNA, 22 bp, Homo sapiens
acacagttgattgtcactcagg

SEQ ID NO: 8552730 - DNA, 22 bp, Homo sapiens
acacagttctttcactgttggt

SEQ ID NO: 8552731 - DNA, 22 bp, Homo sapiens
acacagttggtggctcagtctg

SEQ ID NO: 8552732 - DNA, 22 bp, Homo sapiens
acacagtttaaacgattagtac

SEQ ID NO: 8552733 - DNA, 22 bp, Homo sapiens
acacagttcaggatcaaatagc

SEQ ID NO: 8552734 - DNA, 22 bp, Homo sapiens
acacagttcttagcaggtgtct

SEQ ID NO: 8552735 - DNA, 23 bp, Homo sapiens
acacaatagagtactattcagcc

SEQ ID NO: 8552736 - DNA, 23 bp, Homo sapiens
acacaatagagtactattcagcc

SEQ ID NO: 8552737 - DNA, 23 bp, Homo sapiens
acacaatagagtactattcagcc

SEQ ID NO: 8552738 - DNA, 22 bp, Homo sapiens
acacaatacagggctcaaaata

SEQ ID NO: 8552739 - DNA, 22 bp, Homo sapiens
acacaatacagggctcaaaata

SEQ ID NO: 8552740 - DNA, 22 bp, Homo sapiens
acacaataaatttatcctttga

SEQ ID NO: 8552741 - DNA, 22 bp, Homo sapiens
acacaatacagggctcaaaata

SEQ ID NO: 8552742 - DNA, 22 bp, Homo sapiens
acacaatacagggctcaaaata

SEQ ID NO: 8552743 - DNA, 22 bp, Homo sapiens
acacaagtgaatattttaagga

SEQ ID NO: 8552744 - DNA, 22 bp, Homo sapiens
acacaagtccctccatactctc

SEQ ID NO: 8552745 - DNA, 21 bp, Homo sapiens
acacaagcactcgtacatacg

SEQ ID NO: 8552746 - DNA, 23 bp, Homo sapiens
acacaagggtaactgccagccat

SEQ ID NO: 8552747 - DNA, 22 bp, Homo sapiens
acacaagattgtgtattgaatt

SEQ ID NO: 8552748 - DNA, 22 bp, Homo sapiens
acacaagattgtgtattgaatt

SEQ ID NO: 8552749 - DNA, 22 bp, Homo sapiens
acacaagattgtgtattgaatt

SEQ ID NO: 8552750 - DNA, 17 bp, Homo sapiens
acacaagcaccttgagg

SEQ ID NO: 8552751 - DNA, 17 bp, Homo sapiens
acacaagcaccttgagg

SEQ ID NO: 8552752 - DNA, 22 bp, Homo sapiens
acacaagaataatgatgaaggt

SEQ ID NO: 8552753 - DNA, 22 bp, Homo sapiens
acacaagattgtgtattgaatt

SEQ ID NO: 8552754 - DNA, 22 bp, Homo sapiens
acacaatgtcatcataatgtca

SEQ ID NO: 8552755 - DNA, 22 bp, Homo sapiens
acacaatggcgtgtgccacaga

SEQ ID NO: 8552756 - DNA, 22 bp, Homo sapiens
acacaatgtaccatatctccaa

SEQ ID NO: 8552757 - DNA, 22 bp, Homo sapiens
acacaatgtcatcataatgtca

SEQ ID NO: 8552758 - DNA, 22 bp, Homo sapiens
acacaatgcatatttttccaga

SEQ ID NO: 8552759 - DNA, 22 bp, Homo sapiens
acacaatgcatatttttccaga

SEQ ID NO: 8552760 - DNA, 19 bp, Homo sapiens
acacaatgacacatatata

SEQ ID NO: 8552761 - DNA, 22 bp, Homo sapiens
acacacaattagttttatgctt

SEQ ID NO: 8552762 - DNA, 22 bp, Homo sapiens
acacacaattagttttatgctt

SEQ ID NO: 8552763 - DNA, 22 bp, Homo sapiens
acacacaactcattgtgtaata

SEQ ID NO: 8552764 - DNA, 22 bp, Homo sapiens
acacacaactcattgtgtaata

SEQ ID NO: 8552765 - DNA, 22 bp, Homo sapiens
acacacaactcattgtgtaata

SEQ ID NO: 8552766 - DNA, 22 bp, Homo sapiens
acacacaaatctattagtgaat

SEQ ID NO: 8552767 - DNA, 22 bp, Homo sapiens
acacacaaatctattagtgaat

SEQ ID NO: 8552768 - DNA, 18 bp, Homo sapiens
acacacacacctgtgtat

SEQ ID NO: 8552769 - DNA, 18 bp, Homo sapiens
acacacacacctgtgtat

SEQ ID NO: 8552770 - DNA, 22 bp, Homo sapiens
acacacacaagcaggttgtgga

SEQ ID NO: 8552771 - DNA, 22 bp, Homo sapiens
acacacacaagcaggttgtgga

SEQ ID NO: 8552772 - DNA, 22 bp, Homo sapiens
acacacacaagcaggttgtgga

SEQ ID NO: 8552773 - DNA, 19 bp, Homo sapiens
acacagggctagagttaca

SEQ ID NO: 8552774 - DNA, 19 bp, Homo sapiens
acacagggctagagttaca

SEQ ID NO: 8552775 - DNA, 18 bp, Homo sapiens
acacacacacctgtgtat

SEQ ID NO: 8552776 - DNA, 22 bp, Homo sapiens
acacagtatcaaatttcatctt

SEQ ID NO: 8552777 - DNA, 22 bp, Homo sapiens
acacagtatgaaaagtctagtt

SEQ ID NO: 8552778 - DNA, 22 bp, Homo sapiens
acacagtatgaaaagtctagtt

SEQ ID NO: 8552779 - DNA, 22 bp, Homo sapiens
acacagtatgcatctagaaatt

SEQ ID NO: 8552780 - DNA, 22 bp, Homo sapiens
acacagtatgacattggcagag

SEQ ID NO: 8552781 - DNA, 22 bp, Homo sapiens
acacagtattacaataggtgct

SEQ ID NO: 8552782 - DNA, 22 bp, Homo sapiens
acacagtattacaataggtgct

SEQ ID NO: 8552783 - DNA, 22 bp, Homo sapiens
acacagtatgcatctagaaatt

SEQ ID NO: 8552784 - DNA, 22 bp, Homo sapiens
acacagtgtcttaggtagtgtc

SEQ ID NO: 8552785 - DNA, 22 bp, Homo sapiens
acacagtggtgtttacaaaatt

SEQ ID NO: 8552786 - DNA, 22 bp, Homo sapiens
acacagtggtgtttacaaaatt

SEQ ID NO: 8552787 - DNA, 22 bp, Homo sapiens
acacagtggtgtttacaaaatt

SEQ ID NO: 8552788 - DNA, 22 bp, Homo sapiens
acacagtgtcagggcaggggcc

SEQ ID NO: 8552789 - DNA, 22 bp, Homo sapiens
acacagtgtcagggcaggggcc

SEQ ID NO: 8552790 - DNA, 18 bp, Homo sapiens
acacagtggatgcctggt

SEQ ID NO: 8552791 - DNA, 18 bp, Homo sapiens
acacagtggatgcctggt

SEQ ID NO: 8552792 - DNA, 22 bp, Homo sapiens
acacagtattgtgactataact

SEQ ID NO: 8552793 - DNA, 22 bp, Homo sapiens
acacagtattgtgactataact

SEQ ID NO: 8552794 - DNA, 22 bp, Homo sapiens
acacagtattacaataggtgct

SEQ ID NO: 8552795 - DNA, 22 bp, Homo sapiens
acacagtattgtgactataact

SEQ ID NO: 8552796 - DNA, 22 bp, Homo sapiens
agatgcatgtttatgtctttcc

SEQ ID NO: 8552797 - DNA, 22 bp, Homo sapiens
agatgcctaaatctgggcaagg

SEQ ID NO: 8552798 - DNA, 22 bp, Homo sapiens
agatgcatggaaatctcattac

SEQ ID NO: 8552799 - DNA, 22 bp, Homo sapiens
agatgcatgtttatgtctttcc

SEQ ID NO: 8552800 - DNA, 22 bp, Homo sapiens
agatgctgctccacaggccagg

SEQ ID NO: 8552801 - DNA, 22 bp, Homo sapiens
agatgctgcctctcctcacaag

SEQ ID NO: 8552802 - DNA, 22 bp, Homo sapiens
agatgctgccaggcccctcagt

SEQ ID NO: 8552803 - DNA, 22 bp, Homo sapiens
agatgctgaattattgtgcttt

SEQ ID NO: 8552804 - DNA, 22 bp, Homo sapiens
acaacagtaggaaaacatgtct

SEQ ID NO: 8552805 - DNA, 22 bp, Homo sapiens
acaacagagctggactgagagg

SEQ ID NO: 8552806 - DNA, 22 bp, Homo sapiens
acaacagggtaaggcaggccat

SEQ ID NO: 8552807 - DNA, 20 bp, Homo sapiens
acaaagtattgaggacaagt

SEQ ID NO: 8552808 - DNA, 22 bp, Homo sapiens
agagttccacgtacagcttttg

SEQ ID NO: 8552809 - DNA, 22 bp, Homo sapiens
acaaagtcaaattgcagccgcc

SEQ ID NO: 8552810 - DNA, 22 bp, Homo sapiens
acaaagtcacaataattaacct

SEQ ID NO: 8552811 - DNA, 22 bp, Homo sapiens
agagttcagctactgcaaatgt

SEQ ID NO: 8552812 - DNA, 22 bp, Homo sapiens
agagttccacgtacagcttttg

SEQ ID NO: 8552813 - DNA, 22 bp, Homo sapiens
agagttcagaaagtgcaggttt

SEQ ID NO: 8552814 - DNA, 22 bp, Homo sapiens
agagttcagaaagtgcaggttt

SEQ ID NO: 8552815 - DNA, 22 bp, Homo sapiens
agagttcacactcagtgcaccc

SEQ ID NO: 8552816 - DNA, 22 bp, Homo sapiens
agagttcacactcagtgcaccc

SEQ ID NO: 8552817 - DNA, 22 bp, Homo sapiens
acaaagtgctgacattacaggc

SEQ ID NO: 8552818 - DNA, 19 bp, Homo sapiens
acaaagtgcgtgctctttt

SEQ ID NO: 8552819 - DNA, 22 bp, Homo sapiens
acaaagtgcacaagatgagaac

SEQ ID NO: 8552820 - DNA, 22 bp, Homo sapiens
acaaagtgaattgcatcgagtt

SEQ ID NO: 8552821 - DNA, 22 bp, Homo sapiens
acaaagtcctggtgtatggcca

SEQ ID NO: 8552822 - DNA, 22 bp, Homo sapiens
acaaagtctctaataatcttct

SEQ ID NO: 8552823 - DNA, 22 bp, Homo sapiens
acaaagtctgaaacctgaggca

SEQ ID NO: 8552824 - DNA, 22 bp, Homo sapiens
acaaagtcttttacaacagtca

SEQ ID NO: 8552825 - DNA, 22 bp, Homo sapiens
acaaagtttgtggtattccaag

SEQ ID NO: 8552826 - DNA, 22 bp, Homo sapiens
acaaagttattctttcagagga

SEQ ID NO: 8552827 - DNA, 22 bp, Homo sapiens
acaaagtttcttctaacatctg

SEQ ID NO: 8552828 - DNA, 22 bp, Homo sapiens
acaaagtgtgcggagcccaggg

SEQ ID NO: 8552829 - DNA, 22 bp, Homo sapiens
acaaagtgttttctgaaggcct

SEQ ID NO: 8552830 - DNA, 22 bp, Homo sapiens
acaaagttaacagttggatagt

SEQ ID NO: 8552831 - DNA, 22 bp, Homo sapiens
acaaagttaacagttggatagt

SEQ ID NO: 8552832 - DNA, 22 bp, Homo sapiens
acaaatagagattcaaataaag

SEQ ID NO: 8552833 - DNA, 22 bp, Homo sapiens
acaaatagaaaatctggattgg

SEQ ID NO: 8552834 - DNA, 22 bp, Homo sapiens
agatctttagtgaagctaaatc

SEQ ID NO: 8552835 - DNA, 22 bp, Homo sapiens
agatgcagaaaaactaagtgat

SEQ ID NO: 8552836 - DNA, 22 bp, Homo sapiens
agatctttagtgaagctaaatc

SEQ ID NO: 8552837 - DNA, 22 bp, Homo sapiens
agagtgtgaagaaagtgcaatg

SEQ ID NO: 8552838 - DNA, 22 bp, Homo sapiens
agagtgtaccaaatatcctaca

SEQ ID NO: 8552839 - DNA, 22 bp, Homo sapiens
agagtgtggaaatgttcagagt

SEQ ID NO: 8552840 - DNA, 22 bp, Homo sapiens
agagtgttatttgctctgtatt

SEQ ID NO: 8552841 - DNA, 22 bp, Homo sapiens
agagtgtttttctgtcaaggac

SEQ ID NO: 8552842 - DNA, 22 bp, Homo sapiens
agagtgtgtggggctgaggtca

SEQ ID NO: 8552843 - DNA, 22 bp, Homo sapiens
agagttaagacgtacatgagtg

SEQ ID NO: 8552844 - DNA, 21 bp, Homo sapiens
agagttactgtcatcctaggt

SEQ ID NO: 8552845 - DNA, 22 bp, Homo sapiens
agagttatggacttaatgcagg

SEQ ID NO: 8552846 - DNA, 22 bp, Homo sapiens
agagttatcactccatgcagct

SEQ ID NO: 8552847 - DNA, 22 bp, Homo sapiens
agagttatattggttgagaatt

SEQ ID NO: 8552848 - DNA, 22 bp, Homo sapiens
agagtgaagtttttgaaagtga

SEQ ID NO: 8552849 - DNA, 22 bp, Homo sapiens
agagtgaagttcatcgtgcagc

SEQ ID NO: 8552850 - DNA, 22 bp, Homo sapiens
agagtgggttataggcagactt

SEQ ID NO: 8552851 - DNA, 22 bp, Homo sapiens
agagtgtaccaaatatcctaca

SEQ ID NO: 8552852 - DNA, 20 bp, Homo sapiens
agagtgggtgtcacaggctg

SEQ ID NO: 8552853 - DNA, 20 bp, Homo sapiens
agagtgggtgtcacaggctg

SEQ ID NO: 8552854 - DNA, 22 bp, Homo sapiens
agagtgacagccactgcagtaa

SEQ ID NO: 8552855 - DNA, 22 bp, Homo sapiens
aatttcttcagctctaaaatgg

SEQ ID NO: 8552856 - DNA, 22 bp, Homo sapiens
aatttcttcagctctaaaatgg

SEQ ID NO: 8552857 - DNA, 22 bp, Homo sapiens
aatttcttgggagctcagagaa

SEQ ID NO: 8552858 - DNA, 22 bp, Homo sapiens
aatttcttgggagctcagagaa

SEQ ID NO: 8552859 - DNA, 22 bp, Homo sapiens
aatttctctctcatgcttcatg

SEQ ID NO: 8552860 - DNA, 22 bp, Homo sapiens
aatttcttcagctctaaaatgg

SEQ ID NO: 8552861 - DNA, 22 bp, Homo sapiens
aatttctcaattgttacaggtg

SEQ ID NO: 8552862 - DNA, 22 bp, Homo sapiens
aatttctcatggattcagttat

SEQ ID NO: 8552863 - DNA, 22 bp, Homo sapiens
aatttctcactctcttgatcac

SEQ ID NO: 8552864 - DNA, 22 bp, Homo sapiens
aatttctcggttttgatattgt

SEQ ID NO: 8552865 - DNA, 22 bp, Homo sapiens
aatttgatgagtttgtaagtct

SEQ ID NO: 8552866 - DNA, 22 bp, Homo sapiens
aatttgattcagcaaatgttca

SEQ ID NO: 8552867 - DNA, 18 bp, Homo sapiens
aatttctttgacaactta

SEQ ID NO: 8552868 - DNA, 18 bp, Homo sapiens
aatttctttgacaactta

SEQ ID NO: 8552869 - DNA, 22 bp, Homo sapiens
aatttggagctttgtttctaga

SEQ ID NO: 8552870 - DNA, 22 bp, Homo sapiens
aatttggcagtgtcttgaagta

SEQ ID NO: 8552871 - DNA, 22 bp, Homo sapiens
aatttgcatgatgagaacaata

SEQ ID NO: 8552872 - DNA, 22 bp, Homo sapiens
aatttgattttcttaaaccata

SEQ ID NO: 8552873 - DNA, 22 bp, Homo sapiens
aatttgcatgatgagaacaata

SEQ ID NO: 8552874 - DNA, 22 bp, Homo sapiens
aatttgattccctgcacctgtt

SEQ ID NO: 8552875 - DNA, 22 bp, Homo sapiens
aatttgattttcttaaaccata

SEQ ID NO: 8552876 - DNA, 22 bp, Homo sapiens
agcacagaatggcttggaagcc

SEQ ID NO: 8552877 - DNA, 22 bp, Homo sapiens
agcacaggaacatggagatggg

SEQ ID NO: 8552878 - DNA, 22 bp, Homo sapiens
agcacaggaacatggagatggg

SEQ ID NO: 8552879 - DNA, 22 bp, Homo sapiens
agcacacagtcttccttcctcc

SEQ ID NO: 8552880 - DNA, 22 bp, Homo sapiens
agcacacatcacttctgctcat

SEQ ID NO: 8552881 - DNA, 22 bp, Homo sapiens
agcacacatcacttctgctcat

SEQ ID NO: 8552882 - DNA, 23 bp, Homo sapiens
agcacacttgtacaatgccctag

SEQ ID NO: 8552883 - DNA, 22 bp, Homo sapiens
agcacacaggccacctccactt

SEQ ID NO: 8552884 - DNA, 22 bp, Homo sapiens
agcacacagtattagccattgt

SEQ ID NO: 8552885 - DNA, 22 bp, Homo sapiens
agcacacagtattagccattgt

SEQ ID NO: 8552886 - DNA, 22 bp, Homo sapiens
agcacacaggacttgattcatg

SEQ ID NO: 8552887 - DNA, 22 bp, Homo sapiens
agcacacaggacttgattcatg

SEQ ID NO: 8552888 - DNA, 22 bp, Homo sapiens
agcacacaggacttgattcatg

SEQ ID NO: 8552889 - DNA, 22 bp, Homo sapiens
agcaaggccgagaggatgctat

SEQ ID NO: 8552890 - DNA, 22 bp, Homo sapiens
agcaaggccgagaggatgctat

SEQ ID NO: 8552891 - DNA, 22 bp, Homo sapiens
agcacaaatataaaaatgtctg

SEQ ID NO: 8552892 - DNA, 22 bp, Homo sapiens
agcacaggacgtagagcttgga

SEQ ID NO: 8552893 - DNA, 22 bp, Homo sapiens
agcacaggaccaaggaagctgt

SEQ ID NO: 8552894 - DNA, 22 bp, Homo sapiens
agcacaggaccaaggaagctgt

SEQ ID NO: 8552895 - DNA, 22 bp, Homo sapiens
agcacaggctttggtgtgaggg

SEQ ID NO: 8552896 - DNA, 22 bp, Homo sapiens
agcacaggacgtagagcttgga

SEQ ID NO: 8552897 - DNA, 22 bp, Homo sapiens
agcacagggcccagcctaggcc

SEQ ID NO: 8552898 - DNA, 22 bp, Homo sapiens
agcacagggacaatgccaggtg

SEQ ID NO: 8552899 - DNA, 22 bp, Homo sapiens
agcacagggacaatgccaggtg

SEQ ID NO: 8552900 - DNA, 22 bp, Homo sapiens
agcacaggctttggtgtgaggg

SEQ ID NO: 8552901 - DNA, 22 bp, Homo sapiens
agcacaggctttggtgtgaggg

SEQ ID NO: 8552902 - DNA, 22 bp, Homo sapiens
agcacagggcccagcctaggcc

SEQ ID NO: 8552903 - DNA, 22 bp, Homo sapiens
agcacagggcccagcctaggcc

SEQ ID NO: 8552904 - DNA, 22 bp, Homo sapiens
agcacaggtaatacagagtaac

SEQ ID NO: 8552905 - DNA, 22 bp, Homo sapiens
acaattttccccataggttatc

SEQ ID NO: 8552906 - DNA, 22 bp, Homo sapiens
acacaaattgtaggataattgc

SEQ ID NO: 8552907 - DNA, 22 bp, Homo sapiens
acacaaattgtaggataattgc

SEQ ID NO: 8552908 - DNA, 22 bp, Homo sapiens
acacaacagaagagcaattgca

SEQ ID NO: 8552909 - DNA, 21 bp, Homo sapiens
acacaacaggcagtcattttc

SEQ ID NO: 8552910 - DNA, 22 bp, Homo sapiens
acacaagaagttaatgggcaaa

SEQ ID NO: 8552911 - DNA, 22 bp, Homo sapiens
acacaagaagttaatgggcaaa

SEQ ID NO: 8552912 - DNA, 22 bp, Homo sapiens
acacaagaagttaatgggcaaa

SEQ ID NO: 8552913 - DNA, 22 bp, Homo sapiens
acaatacaggcttctggactta

SEQ ID NO: 8552914 - DNA, 22 bp, Homo sapiens
acaatacaggcttctggactta

SEQ ID NO: 8552915 - DNA, 22 bp, Homo sapiens
acaataatgtattgccaaaagt

SEQ ID NO: 8552916 - DNA, 22 bp, Homo sapiens
acaataatgtattgccaaaagt

SEQ ID NO: 8552917 - DNA, 22 bp, Homo sapiens
acaataaggatttttaggggca

SEQ ID NO: 8552918 - DNA, 22 bp, Homo sapiens
acaataagtattgggcttttga

SEQ ID NO: 8552919 - DNA, 20 bp, Homo sapiens
acaatacaggttgtgtctga

SEQ ID NO: 8552920 - DNA, 22 bp, Homo sapiens
acaatagaaataattaagcaca

SEQ ID NO: 8552921 - DNA, 22 bp, Homo sapiens
acaatagaaataattaagcaca

SEQ ID NO: 8552922 - DNA, 22 bp, Homo sapiens
agcaaggcagtcagctggctgg

SEQ ID NO: 8552923 - DNA, 22 bp, Homo sapiens
acaatagaaggaaactgacata

SEQ ID NO: 8552924 - DNA, 22 bp, Homo sapiens
acaatagaaggaaactgacata

SEQ ID NO: 8552925 - DNA, 22 bp, Homo sapiens
agcaaatacttgaataaaaaga

SEQ ID NO: 8552926 - DNA, 19 bp, Homo sapiens
agcaaatataatagtgttc

SEQ ID NO: 8552927 - DNA, 19 bp, Homo sapiens
acaataactcattgattgc

SEQ ID NO: 8552928 - DNA, 19 bp, Homo sapiens
acaataactcattgattgc

SEQ ID NO: 8552929 - DNA, 19 bp, Homo sapiens
acaataactcattgattgc

SEQ ID NO: 8552930 - DNA, 18 bp, Homo sapiens
agcaaatattaagtgcat

SEQ ID NO: 8552931 - DNA, 18 bp, Homo sapiens
agcaaatattaagtgcat

SEQ ID NO: 8552932 - DNA, 22 bp, Homo sapiens
agcaaagtcagtggaaccatcc

SEQ ID NO: 8552933 - DNA, 22 bp, Homo sapiens
agcaaagctgattaagagcaca

SEQ ID NO: 8552934 - DNA, 22 bp, Homo sapiens
agcaaagcttccataaagcagc

SEQ ID NO: 8552935 - DNA, 22 bp, Homo sapiens
agcaaagtagctgctgttctta

SEQ ID NO: 8552936 - DNA, 23 bp, Homo sapiens
agcaaagttgttgctaacctcat

SEQ ID NO: 8552937 - DNA, 22 bp, Homo sapiens
agcaaataaagacaattatgtc

SEQ ID NO: 8552938 - DNA, 22 bp, Homo sapiens
acaacagtccagtatagactgt

SEQ ID NO: 8552939 - DNA, 22 bp, Homo sapiens
acaacagtccagtatagactgt

SEQ ID NO: 8552940 - DNA, 22 bp, Homo sapiens
acaacattatacatagaaagct

SEQ ID NO: 8552941 - DNA, 22 bp, Homo sapiens
acaacattatacatagaaagct

SEQ ID NO: 8552942 - DNA, 22 bp, Homo sapiens
acaacattatacatagaaagct

SEQ ID NO: 8552943 - DNA, 18 bp, Homo sapiens
agattttgagaaatacaa

SEQ ID NO: 8552944 - DNA, 22 bp, Homo sapiens
acaacatttaaggaggcactga

SEQ ID NO: 8552945 - DNA, 22 bp, Homo sapiens
acaacattcttaaatacactga

SEQ ID NO: 8552946 - DNA, 22 bp, Homo sapiens
acaacattcttaaatacactga

SEQ ID NO: 8552947 - DNA, 22 bp, Homo sapiens
agagaaggggtaaagagtcctg

SEQ ID NO: 8552948 - DNA, 22 bp, Homo sapiens
agagaagggggaaagatctcac

SEQ ID NO: 8552949 - DNA, 22 bp, Homo sapiens
agagaagggggaaagatctcac

SEQ ID NO: 8552950 - DNA, 22 bp, Homo sapiens
aatgtgtactttttcatgctca

SEQ ID NO: 8552951 - DNA, 22 bp, Homo sapiens
aatgtgtactttttcatgctca

SEQ ID NO: 8552952 - DNA, 22 bp, Homo sapiens
aatgtgtacatgacagatagaa

SEQ ID NO: 8552953 - DNA, 22 bp, Homo sapiens
agagaaggggtaaagagtcctg

SEQ ID NO: 8552954 - DNA, 22 bp, Homo sapiens
agagaaggggtaaagagtcctg

SEQ ID NO: 8552955 - DNA, 22 bp, Homo sapiens
agagaaggggtaaagagtcctg

SEQ ID NO: 8552956 - DNA, 22 bp, Homo sapiens
aatgtgtagcatttaatgcagt

SEQ ID NO: 8552957 - DNA, 22 bp, Homo sapiens
aatgtgtagatgttgcattcct

SEQ ID NO: 8552958 - DNA, 22 bp, Homo sapiens
aatgtgtagcatttaatgcagt

SEQ ID NO: 8552959 - DNA, 22 bp, Homo sapiens
aatgtgtagggtgcctgttttt

SEQ ID NO: 8552960 - DNA, 21 bp, Homo sapiens
agagaagggattccaggccct

SEQ ID NO: 8552961 - DNA, 21 bp, Homo sapiens
agagaagggattccaggccct

SEQ ID NO: 8552962 - DNA, 21 bp, Homo sapiens
agagaagggattccaggccct

SEQ ID NO: 8552963 - DNA, 21 bp, Homo sapiens
agagaagggattccaggccct

SEQ ID NO: 8552964 - DNA, 21 bp, Homo sapiens
agagaagggattccaggccct

SEQ ID NO: 8552965 - DNA, 21 bp, Homo sapiens
agagaagggactcttccagtc

SEQ ID NO: 8552966 - DNA, 21 bp, Homo sapiens
agagaagggactcttccagtc

SEQ ID NO: 8552967 - DNA, 22 bp, Homo sapiens
agagaagggaagggattcaccc

SEQ ID NO: 8552968 - DNA, 19 bp, Homo sapiens
agagaaggatcctatggtt

SEQ ID NO: 8552969 - DNA, 19 bp, Homo sapiens
agagaaggatcctatggtt

SEQ ID NO: 8552970 - DNA, 22 bp, Homo sapiens
agagcaaatagagaagccagct

SEQ ID NO: 8552971 - DNA, 22 bp, Homo sapiens
agagcaaatagagaagccagct

SEQ ID NO: 8552972 - DNA, 22 bp, Homo sapiens
agagatttctactgcactcttt

SEQ ID NO: 8552973 - DNA, 22 bp, Homo sapiens
agagatttgtcaatgatttcca

SEQ ID NO: 8552974 - DNA, 22 bp, Homo sapiens
agagcaagtgacagaaacaggg

SEQ ID NO: 8552975 - DNA, 22 bp, Homo sapiens
agagcaattagcttaggtaaaa

SEQ ID NO: 8552976 - DNA, 21 bp, Homo sapiens
agagcaagttaaggcattaat

SEQ ID NO: 8552977 - DNA, 22 bp, Homo sapiens
agagatttacacatgccttttc

SEQ ID NO: 8552978 - DNA, 22 bp, Homo sapiens
agagatgaaaagggtactgagg

SEQ ID NO: 8552979 - DNA, 21 bp, Homo sapiens
aatgtgtgctatttatctttt

SEQ ID NO: 8552980 - DNA, 21 bp, Homo sapiens
aatgtgtgctatttatctttt

SEQ ID NO: 8552981 - DNA, 22 bp, Homo sapiens
aatgtgtgttcggggcccagag

SEQ ID NO: 8552982 - DNA, 22 bp, Homo sapiens
aatgtgtgtatttctaggcgag

SEQ ID NO: 8552983 - DNA, 22 bp, Homo sapiens
aatgtgtatactggcaattaag

SEQ ID NO: 8552984 - DNA, 22 bp, Homo sapiens
aatgtgtataagggagagctaa

SEQ ID NO: 8552985 - DNA, 22 bp, Homo sapiens
aatgtgtatactggcaattaag

SEQ ID NO: 8552986 - DNA, 22 bp, Homo sapiens
aatgtgtatactggcaattaag

SEQ ID NO: 8552987 - DNA, 22 bp, Homo sapiens
aatgtgtatatgaacatacagg

SEQ ID NO: 8552988 - DNA, 22 bp, Homo sapiens
aatgtgtatatgaacatacagg

SEQ ID NO: 8552989 - DNA, 22 bp, Homo sapiens
aatgtgtatgaggaagagagaa

SEQ ID NO: 8552990 - DNA, 22 bp, Homo sapiens
aatgtgtatgaggaagagagaa

SEQ ID NO: 8552991 - DNA, 22 bp, Homo sapiens
aatgtgtcatttcccacaggtg

SEQ ID NO: 8552992 - DNA, 22 bp, Homo sapiens
aatgtatgtgtatatcaaatca

SEQ ID NO: 8552993 - DNA, 23 bp, Homo sapiens
aatgtatgttagtatcttagaga

SEQ ID NO: 8552994 - DNA, 23 bp, Homo sapiens
aatgtatgttagtatcttagaga

SEQ ID NO: 8552995 - DNA, 22 bp, Homo sapiens
aatgtataatatttaatgcttt

SEQ ID NO: 8552996 - DNA, 20 bp, Homo sapiens
aatgtatattttatgccagg

SEQ ID NO: 8552997 - DNA, 22 bp, Homo sapiens
aatgtatgaaggttccagtttc

SEQ ID NO: 8552998 - DNA, 22 bp, Homo sapiens
aatgtatggattcatgtctgtg

SEQ ID NO: 8552999 - DNA, 22 bp, Homo sapiens
aatgtatgagcgtgaaagcact

SEQ ID NO: 8553000 - DNA, 22 bp, Homo sapiens
agacattatgctgagtgaaaga

SEQ ID NO: 8553001 - DNA, 22 bp, Homo sapiens
agacattatgctgagtgaaaga

SEQ ID NO: 8553002 - DNA, 22 bp, Homo sapiens
agacatgtggtataatcagggg

SEQ ID NO: 8553003 - DNA, 21 bp, Homo sapiens
agacatgtgaactaaaggtga

SEQ ID NO: 8553004 - DNA, 20 bp, Homo sapiens
agacatggtagtgattcagg

SEQ ID NO: 8553005 - DNA, 22 bp, Homo sapiens
agacattgttggcctatcctct

SEQ ID NO: 8553006 - DNA, 22 bp, Homo sapiens
aatgtataaccataggaaattt

SEQ ID NO: 8553007 - DNA, 22 bp, Homo sapiens
aatgtataatatttaatgcttt

SEQ ID NO: 8553008 - DNA, 22 bp, Homo sapiens
aatgtataatatttaatgcttt

SEQ ID NO: 8553009 - DNA, 22 bp, Homo sapiens
aatgctctctgccatagctaac

SEQ ID NO: 8553010 - DNA, 22 bp, Homo sapiens
aatgctattcattaagcctact

SEQ ID NO: 8553011 - DNA, 22 bp, Homo sapiens
aatgctcaaaatgtttcatcta

SEQ ID NO: 8553012 - DNA, 22 bp, Homo sapiens
aatgctagtgtgatatgtaagg

SEQ ID NO: 8553013 - DNA, 22 bp, Homo sapiens
aatgctatcggctctaagcatg

SEQ ID NO: 8553014 - DNA, 22 bp, Homo sapiens
aatgctacagaagtgatcttgg

SEQ ID NO: 8553015 - DNA, 22 bp, Homo sapiens
aatgctctgtctctgacagtgg

SEQ ID NO: 8553016 - DNA, 22 bp, Homo sapiens
aatgctctttgaatttgtcaga

SEQ ID NO: 8553017 - DNA, 22 bp, Homo sapiens
aatgccttggagagcctagagg

SEQ ID NO: 8553018 - DNA, 22 bp, Homo sapiens
aatgccttggagagcctagagg

SEQ ID NO: 8553019 - DNA, 22 bp, Homo sapiens
aatgcctttccactgggtatca

SEQ ID NO: 8553020 - DNA, 22 bp, Homo sapiens
aatgctaaaatggcactaaagt

SEQ ID NO: 8553021 - DNA, 22 bp, Homo sapiens
aatgccttgcctgctacaactt

SEQ ID NO: 8553022 - DNA, 22 bp, Homo sapiens
aatgccttggagagcctagagg

SEQ ID NO: 8553023 - DNA, 22 bp, Homo sapiens
aatgccttggagagcctagagg

SEQ ID NO: 8553024 - DNA, 22 bp, Homo sapiens
agacatgcttggaggagaagga

SEQ ID NO: 8553025 - DNA, 19 bp, Homo sapiens
agacatgagacacaggatg

SEQ ID NO: 8553026 - DNA, 22 bp, Homo sapiens
agacatgccaagaaacccagtg

SEQ ID NO: 8553027 - DNA, 19 bp, Homo sapiens
agacatgagacacaggatg

SEQ ID NO: 8553028 - DNA, 22 bp, Homo sapiens
agacatcttgcacacatatact

SEQ ID NO: 8553029 - DNA, 22 bp, Homo sapiens
aatgctgctctcataattatag

SEQ ID NO: 8553030 - DNA, 22 bp, Homo sapiens
aatgctgcaagaggtgaaaaga

SEQ ID NO: 8553031 - DNA, 22 bp, Homo sapiens
aatgctgagggatgagagaggc

SEQ ID NO: 8553032 - DNA, 22 bp, Homo sapiens
agacatcaatgatcagaggtag

SEQ ID NO: 8553033 - DNA, 22 bp, Homo sapiens
agacatcagcttgtgtgcaggg

SEQ ID NO: 8553034 - DNA, 22 bp, Homo sapiens
agacatcagcttgtgtgcaggg

SEQ ID NO: 8553035 - DNA, 22 bp, Homo sapiens
aattccacagctgcacagaggt

SEQ ID NO: 8553036 - DNA, 20 bp, Homo sapiens
aattccagcatgatatttat

SEQ ID NO: 8553037 - DNA, 22 bp, Homo sapiens
aattccagcctcagttctatta

SEQ ID NO: 8553038 - DNA, 22 bp, Homo sapiens
agaggaaggatgcatatccaaa

SEQ ID NO: 8553039 - DNA, 22 bp, Homo sapiens
agaggaaggatgcatatccaaa

SEQ ID NO: 8553040 - DNA, 22 bp, Homo sapiens
agaggaaggatgcatatccaaa

SEQ ID NO: 8553041 - DNA, 22 bp, Homo sapiens
agagctgggtggtggtgactca

SEQ ID NO: 8553042 - DNA, 22 bp, Homo sapiens
agagctgggtggtggtgactca

SEQ ID NO: 8553043 - DNA, 22 bp, Homo sapiens
aattccagctgattgactttcc

SEQ ID NO: 8553044 - DNA, 22 bp, Homo sapiens
agaggaagtaatcaggacctgc

SEQ ID NO: 8553045 - DNA, 22 bp, Homo sapiens
agaggaagtaatcaggacctgc

SEQ ID NO: 8553046 - DNA, 22 bp, Homo sapiens
agaggaagtaatcaggacctgc

SEQ ID NO: 8553047 - DNA, 22 bp, Homo sapiens
agaggaagtaatcaggacctgc

SEQ ID NO: 8553048 - DNA, 22 bp, Homo sapiens
agaggaagtaatcaggacctgc

SEQ ID NO: 8553049 - DNA, 21 bp, Homo sapiens
agaggaagtgattggtctggc

SEQ ID NO: 8553050 - DNA, 22 bp, Homo sapiens
agaggaagtaatcaggacctgc

SEQ ID NO: 8553051 - DNA, 22 bp, Homo sapiens
agaggaatgtatttccctgcaa

SEQ ID NO: 8553052 - DNA, 22 bp, Homo sapiens
agaggaatggagactaaacgct

SEQ ID NO: 8553053 - DNA, 22 bp, Homo sapiens
agaggaatctgtctagacacaa

SEQ ID NO: 8553054 - DNA, 21 bp, Homo sapiens
agaggaagtgattggtctggc

SEQ ID NO: 8553055 - DNA, 21 bp, Homo sapiens
agaggaagtgattggtctggc

SEQ ID NO: 8553056 - DNA, 21 bp, Homo sapiens
agaggaagtgattggtctggc

SEQ ID NO: 8553057 - DNA, 22 bp, Homo sapiens
agaggaatatgggtgcactaga

SEQ ID NO: 8553058 - DNA, 22 bp, Homo sapiens
agaggaataaatttctgtagtg

SEQ ID NO: 8553059 - DNA, 22 bp, Homo sapiens
agaggaggtggtgatgctttaa

SEQ ID NO: 8553060 - DNA, 22 bp, Homo sapiens
agaggaggtggtgatgctttaa

SEQ ID NO: 8553061 - DNA, 22 bp, Homo sapiens
agaggaggtggtgatgctttaa

SEQ ID NO: 8553062 - DNA, 22 bp, Homo sapiens
agaggaatttctggaaggaggc

SEQ ID NO: 8553063 - DNA, 22 bp, Homo sapiens
agaggacaaaatgagaagtgct

SEQ ID NO: 8553064 - DNA, 22 bp, Homo sapiens
agaggacaaaatgagaagtgct

SEQ ID NO: 8553065 - DNA, 22 bp, Homo sapiens
agaggaggtccttttctgatgt

SEQ ID NO: 8553066 - DNA, 22 bp, Homo sapiens
agaggaggtccttttctgatgt

SEQ ID NO: 8553067 - DNA, 22 bp, Homo sapiens
agaggatgattttaaggacact

SEQ ID NO: 8553068 - DNA, 22 bp, Homo sapiens
agaggatgattttaaggacact

SEQ ID NO: 8553069 - DNA, 22 bp, Homo sapiens
agaggatcatctagtttgactc

SEQ ID NO: 8553070 - DNA, 22 bp, Homo sapiens
agaggatctaagtgagtcctca

SEQ ID NO: 8553071 - DNA, 22 bp, Homo sapiens
agaggatcctaagaagatatga

SEQ ID NO: 8553072 - DNA, 22 bp, Homo sapiens
agaggatgttctaggcactcat

SEQ ID NO: 8553073 - DNA, 22 bp, Homo sapiens
agaggattcactgcagaagaca

SEQ ID NO: 8553074 - DNA, 23 bp, Homo sapiens
aatttcccctgtctctgatttgg

SEQ ID NO: 8553075 - DNA, 22 bp, Homo sapiens
aatttcctgggataaaaagcca

SEQ ID NO: 8553076 - DNA, 22 bp, Homo sapiens
aatttcacagtgaactttgagg

SEQ ID NO: 8553077 - DNA, 18 bp, Homo sapiens
aatttccatatgaattgc

SEQ ID NO: 8553078 - DNA, 22 bp, Homo sapiens
aatttccagatcagatgactca

SEQ ID NO: 8553079 - DNA, 22 bp, Homo sapiens
agagctgatttgattacagtgc

SEQ ID NO: 8553080 - DNA, 22 bp, Homo sapiens
agagctgaggatccagctgagc

SEQ ID NO: 8553081 - DNA, 22 bp, Homo sapiens
agagctgaggatccagctgagc

SEQ ID NO: 8553082 - DNA, 22 bp, Homo sapiens
agagctgaggatccagctgagc

SEQ ID NO: 8553083 - DNA, 22 bp, Homo sapiens
agagctgaggatccagctgagc

SEQ ID NO: 8553084 - DNA, 22 bp, Homo sapiens
agagctgagaatgtggcttcct

SEQ ID NO: 8553085 - DNA, 22 bp, Homo sapiens
agagctgagcaccaagcatggt

SEQ ID NO: 8553086 - DNA, 22 bp, Homo sapiens
agagctgagcaccaagcatggt

SEQ ID NO: 8553087 - DNA, 22 bp, Homo sapiens
agagctgccgagctggggccat

SEQ ID NO: 8553088 - DNA, 22 bp, Homo sapiens
agagctgcccacacagcagatt

SEQ ID NO: 8553089 - DNA, 22 bp, Homo sapiens
agagctgcccacacagcagatt

SEQ ID NO: 8553090 - DNA, 22 bp, Homo sapiens
agagctgcagggtggacccagg

SEQ ID NO: 8553091 - DNA, 22 bp, Homo sapiens
agagctgcagggtggacccagg

SEQ ID NO: 8553092 - DNA, 22 bp, Homo sapiens
agagctgcacctatgcagacct

SEQ ID NO: 8553093 - DNA, 22 bp, Homo sapiens
agagctgcaatttcatgtggtg

SEQ ID NO: 8553094 - DNA, 22 bp, Homo sapiens
agagctgcaatttcatgtggtg

SEQ ID NO: 8553095 - DNA, 22 bp, Homo sapiens
agagctgcacctatgcagacct

SEQ ID NO: 8553096 - DNA, 22 bp, Homo sapiens
aattcatccatgaacaattcca

SEQ ID NO: 8553097 - DNA, 22 bp, Homo sapiens
aattcatcattttatagctagt

SEQ ID NO: 8553098 - DNA, 22 bp, Homo sapiens
aattcattaagaaagagctaaa

SEQ ID NO: 8553099 - DNA, 22 bp, Homo sapiens
aattcattaagaaagagctaaa

SEQ ID NO: 8553100 - DNA, 22 bp, Homo sapiens
aattcattgccagaatctatga

SEQ ID NO: 8553101 - DNA, 22 bp, Homo sapiens
aattccaaatcaactagtctag

SEQ ID NO: 8553102 - DNA, 22 bp, Homo sapiens
aattccaaatgttttcaatcca

SEQ ID NO: 8553103 - DNA, 22 bp, Homo sapiens
agagctgctcagatgtcactgc

SEQ ID NO: 8553104 - DNA, 22 bp, Homo sapiens
aattcatagcaacaaagaccca

SEQ ID NO: 8553105 - DNA, 22 bp, Homo sapiens
aattcatagcaacaaagaccca

SEQ ID NO: 8553106 - DNA, 22 bp, Homo sapiens
aattcatatggatatgctagta

SEQ ID NO: 8553107 - DNA, 22 bp, Homo sapiens
aattaagagagagttgaagcaa

SEQ ID NO: 8553108 - DNA, 22 bp, Homo sapiens
aattaagagagagttgaagcaa

SEQ ID NO: 8553109 - DNA, 22 bp, Homo sapiens
aattaagtcacacacctaaacc

SEQ ID NO: 8553110 - DNA, 22 bp, Homo sapiens
aattaagaaaatgttttatgat

SEQ ID NO: 8553111 - DNA, 22 bp, Homo sapiens
aattaatggaaagtaaggaagg

SEQ ID NO: 8553112 - DNA, 22 bp, Homo sapiens
aattaatatttgtggaattaat

SEQ ID NO: 8553113 - DNA, 22 bp, Homo sapiens
agagcacagaagaataggtgct

SEQ ID NO: 8553114 - DNA, 22 bp, Homo sapiens
agagcacactgacgtcagtctg

SEQ ID NO: 8553115 - DNA, 22 bp, Homo sapiens
agagcacaaattttaaggaggc

SEQ ID NO: 8553116 - DNA, 22 bp, Homo sapiens
agagcacactgacgtcagtctg

SEQ ID NO: 8553117 - DNA, 22 bp, Homo sapiens
agagcacaaattagttggtctt

SEQ ID NO: 8553118 - DNA, 22 bp, Homo sapiens
agagcacaaattttaaggaggc

SEQ ID NO: 8553119 - DNA, 22 bp, Homo sapiens
agagcacagccaccatttacaa

SEQ ID NO: 8553120 - DNA, 22 bp, Homo sapiens
aattacaaatgtagactctcat

SEQ ID NO: 8553121 - DNA, 22 bp, Homo sapiens
agagcctggctcccagctaccg

SEQ ID NO: 8553122 - DNA, 22 bp, Homo sapiens
agagctgaattcaagtgctggc

SEQ ID NO: 8553123 - DNA, 22 bp, Homo sapiens
agagctgaattcaagtgctggc

SEQ ID NO: 8553124 - DNA, 22 bp, Homo sapiens
aattacagtcggagcagcactg

SEQ ID NO: 8553125 - DNA, 22 bp, Homo sapiens
aattacagtcggagcagcactg

SEQ ID NO: 8553126 - DNA, 21 bp, Homo sapiens
aattacagatggaattacaga

SEQ ID NO: 8553127 - DNA, 23 bp, Homo sapiens
aaatattcttttttagtaagtgc

SEQ ID NO: 8553128 - DNA, 23 bp, Homo sapiens
aaatattcttttttagtaagtgc

SEQ ID NO: 8553129 - DNA, 23 bp, Homo sapiens
aaatattcttttttagtaagtgc

SEQ ID NO: 8553130 - DNA, 22 bp, Homo sapiens
aaatattgttttggtaagcttc

SEQ ID NO: 8553131 - DNA, 22 bp, Homo sapiens
aaatattggtaggatgcttgtt

SEQ ID NO: 8553132 - DNA, 22 bp, Homo sapiens
aaatattggtaggatgcttgtt

SEQ ID NO: 8553133 - DNA, 22 bp, Homo sapiens
aaatatttgtctgaggcggttg

SEQ ID NO: 8553134 - DNA, 22 bp, Homo sapiens
aaatatttgtctgaggcggttg

SEQ ID NO: 8553135 - DNA, 22 bp, Homo sapiens
aaatatttgtctgaggcggttg

SEQ ID NO: 8553136 - DNA, 22 bp, Homo sapiens
aaatcaaaagacatgtgtttta

SEQ ID NO: 8553137 - DNA, 22 bp, Homo sapiens
aaatcaaaagacatgtgtttta

SEQ ID NO: 8553138 - DNA, 22 bp, Homo sapiens
aaatcaacttgtgacgttaggt

SEQ ID NO: 8553139 - DNA, 22 bp, Homo sapiens
aaatcaaaagacatgtgtttta

SEQ ID NO: 8553140 - DNA, 22 bp, Homo sapiens
aaatcactaagttatagtgtgg

SEQ ID NO: 8553141 - DNA, 22 bp, Homo sapiens
aaatcactgattaaagttagaa

SEQ ID NO: 8553142 - DNA, 17 bp, Homo sapiens
aaatcactgtcagttca

SEQ ID NO: 8553143 - DNA, 21 bp, Homo sapiens
aaatcactgtccaatcttggt

SEQ ID NO: 8553144 - DNA, 21 bp, Homo sapiens
aaatcactgtccaatcttggt

SEQ ID NO: 8553145 - DNA, 22 bp, Homo sapiens
aaatcactgttattgatcttaa

SEQ ID NO: 8553146 - DNA, 22 bp, Homo sapiens
aaatcagaaaatatggagagga

SEQ ID NO: 8553147 - DNA, 22 bp, Homo sapiens
aaatcacttaaatggcttattt

SEQ ID NO: 8553148 - DNA, 22 bp, Homo sapiens
aaatcacttaaatggcttattt

SEQ ID NO: 8553149 - DNA, 22 bp, Homo sapiens
aaatcaaggagggattatattt

SEQ ID NO: 8553150 - DNA, 22 bp, Homo sapiens
aaatcacagggtctctaagtat

SEQ ID NO: 8553151 - DNA, 22 bp, Homo sapiens
aaatcacagggtctctaagtat

SEQ ID NO: 8553152 - DNA, 22 bp, Homo sapiens
aaatcacagggtctctaagtat

SEQ ID NO: 8553153 - DNA, 22 bp, Homo sapiens
aaatcactaagttatagtgtgg

SEQ ID NO: 8553154 - DNA, 22 bp, Homo sapiens
aaatcactaagttatagtgtgg

SEQ ID NO: 8553155 - DNA, 22 bp, Homo sapiens
aaatcactaagttatagtgtgg

SEQ ID NO: 8553156 - DNA, 23 bp, Homo sapiens
aaatgacatatggtttctgaagg

SEQ ID NO: 8553157 - DNA, 22 bp, Homo sapiens
aaatgaacatcaagaatagcct

SEQ ID NO: 8553158 - DNA, 22 bp, Homo sapiens
aaatgaacagttgcattctctg

SEQ ID NO: 8553159 - DNA, 22 bp, Homo sapiens
aaatgaaatgagtgcctggagg

SEQ ID NO: 8553160 - DNA, 22 bp, Homo sapiens
aaatgaaatgagtgcctggagg

SEQ ID NO: 8553161 - DNA, 22 bp, Homo sapiens
aaatgaacagttgcattctctg

SEQ ID NO: 8553162 - DNA, 22 bp, Homo sapiens
aaatcagagtagaattgagcca

SEQ ID NO: 8553163 - DNA, 22 bp, Homo sapiens
aaatcagacttgaattttcatc

SEQ ID NO: 8553164 - DNA, 22 bp, Homo sapiens
aaatcagaggtcagctgtacca

SEQ ID NO: 8553165 - DNA, 19 bp, Homo sapiens
aaatcagaatctgcatttt

SEQ ID NO: 8553166 - DNA, 22 bp, Homo sapiens
aaatcagacacagtgaaagtta

SEQ ID NO: 8553167 - DNA, 19 bp, Homo sapiens
aaatcagaatctgcatttt

SEQ ID NO: 8553168 - DNA, 22 bp, Homo sapiens
aaatcagaaaatatggagagga

SEQ ID NO: 8553169 - DNA, 22 bp, Homo sapiens
aaatgatcatgtaatttcagaa

SEQ ID NO: 8553170 - DNA, 22 bp, Homo sapiens
aaatgatagtatggaactagga

SEQ ID NO: 8553171 - DNA, 22 bp, Homo sapiens
aaatgatagtatggaactagga

SEQ ID NO: 8553172 - DNA, 22 bp, Homo sapiens
aaatgatcatgtaatttcagaa

SEQ ID NO: 8553173 - DNA, 22 bp, Homo sapiens
aaatgactaatgatcctgggca

SEQ ID NO: 8553174 - DNA, 23 bp, Homo sapiens
aaatgacatatggtttctgaagg

SEQ ID NO: 8553175 - DNA, 23 bp, Homo sapiens
aaatgacatatggtttctgaagg

SEQ ID NO: 8553176 - DNA, 22 bp, Homo sapiens
aaatgaccagaatacaggcttc

SEQ ID NO: 8553177 - DNA, 22 bp, Homo sapiens
aaatgacattaggatcctgcat

SEQ ID NO: 8553178 - DNA, 22 bp, Homo sapiens
aaatgctgtagatcagtgagtt

SEQ ID NO: 8553179 - DNA, 22 bp, Homo sapiens
aaatgctgtaactgatattctg

SEQ ID NO: 8553180 - DNA, 22 bp, Homo sapiens
aaatgctgtaactgatattctg

SEQ ID NO: 8553181 - DNA, 22 bp, Homo sapiens
aaatgctgcagctagtgtgttt

SEQ ID NO: 8553182 - DNA, 22 bp, Homo sapiens
aaatgcttagaggtgttcaaat

SEQ ID NO: 8553183 - DNA, 22 bp, Homo sapiens
aaatgcttagaggtgttcaaat

SEQ ID NO: 8553184 - DNA, 22 bp, Homo sapiens
aaatgcttattagtgtcacaaa

SEQ ID NO: 8553185 - DNA, 22 bp, Homo sapiens
aaatgcttattagtgtcacaaa

SEQ ID NO: 8553186 - DNA, 22 bp, Homo sapiens
aaatgctgtgttttaacataga

SEQ ID NO: 8553187 - DNA, 22 bp, Homo sapiens
aaatgcttgctcttgattattt

SEQ ID NO: 8553188 - DNA, 22 bp, Homo sapiens
aaatgcttgtaaattttccatg

SEQ ID NO: 8553189 - DNA, 22 bp, Homo sapiens
aaatgcttgtaaattttccatg

SEQ ID NO: 8553190 - DNA, 22 bp, Homo sapiens
aaatgcaattgtatgtactcca

SEQ ID NO: 8553191 - DNA, 22 bp, Homo sapiens
aaatgcaagttcatattttgtt

SEQ ID NO: 8553192 - DNA, 22 bp, Homo sapiens
aaatgcaattgtatgtactcca

SEQ ID NO: 8553193 - DNA, 22 bp, Homo sapiens
aaatgcacaaagattttgcact

SEQ ID NO: 8553194 - DNA, 22 bp, Homo sapiens
aaatgcacaaagattttgcact

SEQ ID NO: 8553195 - DNA, 22 bp, Homo sapiens
aaatgcaattgtatgtactcca

SEQ ID NO: 8553196 - DNA, 22 bp, Homo sapiens
aaatgcacaaagtaagtgtaat

SEQ ID NO: 8553197 - DNA, 22 bp, Homo sapiens
aaatgcatttttaattagaccc

SEQ ID NO: 8553198 - DNA, 22 bp, Homo sapiens
aaatgcacagaggccagagagg

SEQ ID NO: 8553199 - DNA, 22 bp, Homo sapiens
aaatgcacaggagaaccaattc

SEQ ID NO: 8553200 - DNA, 22 bp, Homo sapiens
aaatgcacagaaaggatgtgga

SEQ ID NO: 8553201 - DNA, 22 bp, Homo sapiens
aaatgcacagaaaggatgtgga

SEQ ID NO: 8553202 - DNA, 22 bp, Homo sapiens
aaatgcacagagccttagagat

SEQ ID NO: 8553203 - DNA, 22 bp, Homo sapiens
aaatgcacaataaagtaaaggc

SEQ ID NO: 8553204 - DNA, 22 bp, Homo sapiens
aaatgcacacaccaggaaacta

SEQ ID NO: 8553205 - DNA, 22 bp, Homo sapiens
aaatgcacaataaagtaaaggc

SEQ ID NO: 8553206 - DNA, 22 bp, Homo sapiens
aaatgcaaggattttgttaggc

SEQ ID NO: 8553207 - DNA, 22 bp, Homo sapiens
aaatgcaacgggctttccttat

SEQ ID NO: 8553208 - DNA, 22 bp, Homo sapiens
aaatgattgtcaaagttctgtt

SEQ ID NO: 8553209 - DNA, 20 bp, Homo sapiens
aaatgatgggaataatctat

SEQ ID NO: 8553210 - DNA, 20 bp, Homo sapiens
aaatgatgggaataatctat

SEQ ID NO: 8553211 - DNA, 22 bp, Homo sapiens
aaatgatggaaatgaggctgaa

SEQ ID NO: 8553212 - DNA, 22 bp, Homo sapiens
aaatgatgttataagaccagga

SEQ ID NO: 8553213 - DNA, 22 bp, Homo sapiens
aagagagagtgcgctcacagaa

SEQ ID NO: 8553214 - DNA, 22 bp, Homo sapiens
aagagagagtgcgctcacagaa

SEQ ID NO: 8553215 - DNA, 22 bp, Homo sapiens
aagagagagcattcttctgtta

SEQ ID NO: 8553216 - DNA, 22 bp, Homo sapiens
aagagagacaataggtagcatt

SEQ ID NO: 8553217 - DNA, 22 bp, Homo sapiens
aagagagaagtctctctggttc

SEQ ID NO: 8553218 - DNA, 22 bp, Homo sapiens
aagagagaagtctctctggttc

SEQ ID NO: 8553219 - DNA, 22 bp, Homo sapiens
aaatatacggtccctaacagtc

SEQ ID NO: 8553220 - DNA, 22 bp, Homo sapiens
aaatatactagatgatgaccca

SEQ ID NO: 8553221 - DNA, 22 bp, Homo sapiens
aaatatactagatgatgaccca

SEQ ID NO: 8553222 - DNA, 22 bp, Homo sapiens
aaatatacggtccctaacagtc

SEQ ID NO: 8553223 - DNA, 22 bp, Homo sapiens
aaatatagcaattatgcctact

SEQ ID NO: 8553224 - DNA, 22 bp, Homo sapiens
aaatataccagttgcctgcatc

SEQ ID NO: 8553225 - DNA, 22 bp, Homo sapiens
aaatatacggtccctaacagtc

SEQ ID NO: 8553226 - DNA, 22 bp, Homo sapiens
aaatataccagttgcctgcatc

SEQ ID NO: 8553227 - DNA, 22 bp, Homo sapiens
aaatataccagttgcctgcatc

SEQ ID NO: 8553228 - DNA, 22 bp, Homo sapiens
aaatagtaaagtggtagccatc

SEQ ID NO: 8553229 - DNA, 22 bp, Homo sapiens
aagagagagttcctaggcaaaa

SEQ ID NO: 8553230 - DNA, 22 bp, Homo sapiens
aaatataatttctgcctcaata

SEQ ID NO: 8553231 - DNA, 22 bp, Homo sapiens
aagagttttctataatcttggc

SEQ ID NO: 8553232 - DNA, 22 bp, Homo sapiens
aagagttttctctgatggcatt

SEQ ID NO: 8553233 - DNA, 22 bp, Homo sapiens
aagataaactcttgatttctga

SEQ ID NO: 8553234 - DNA, 22 bp, Homo sapiens
aaatatgagatgttctctttcg

SEQ ID NO: 8553235 - DNA, 22 bp, Homo sapiens
aaatatgagagtaggagtttgg

SEQ ID NO: 8553236 - DNA, 22 bp, Homo sapiens
aaatatgagatgttctctttcg

SEQ ID NO: 8553237 - DNA, 22 bp, Homo sapiens
aagagttttagacaaactgatt

SEQ ID NO: 8553238 - DNA, 22 bp, Homo sapiens
aagagttttctataatcttggc

SEQ ID NO: 8553239 - DNA, 22 bp, Homo sapiens
aagagtttgtcagatctgcacg

SEQ ID NO: 8553240 - DNA, 22 bp, Homo sapiens
aagagttttagacaaactgatt

SEQ ID NO: 8553241 - DNA, 22 bp, Homo sapiens
aagagtttgggcaagtcataaa

SEQ ID NO: 8553242 - DNA, 22 bp, Homo sapiens
aagagtttctttattaaccttt

SEQ ID NO: 8553243 - DNA, 22 bp, Homo sapiens
aagagtttgacctgtgccatcc

SEQ ID NO: 8553244 - DNA, 22 bp, Homo sapiens
aagagtttgggcaagtcataaa

SEQ ID NO: 8553245 - DNA, 22 bp, Homo sapiens
aagagtttgtcagatctgcacg

SEQ ID NO: 8553246 - DNA, 19 bp, Homo sapiens
aaatatcagagagatgata

SEQ ID NO: 8553247 - DNA, 19 bp, Homo sapiens
aaatatcagagagatgata

SEQ ID NO: 8553248 - DNA, 22 bp, Homo sapiens
aagagtttctgattcagtaggt

SEQ ID NO: 8553249 - DNA, 22 bp, Homo sapiens
aagagtttctgggtcaaggatt

SEQ ID NO: 8553250 - DNA, 22 bp, Homo sapiens
aagagtttctttattaaccttt

SEQ ID NO: 8553251 - DNA, 22 bp, Homo sapiens
aagagtttctttattaaccttt

SEQ ID NO: 8553252 - DNA, 22 bp, Homo sapiens
aagagtttcttactggcatcta

SEQ ID NO: 8553253 - DNA, 22 bp, Homo sapiens
aaatatagtgacacttatagtc

SEQ ID NO: 8553254 - DNA, 22 bp, Homo sapiens
aaatatagtgacacttatagtc

SEQ ID NO: 8553255 - DNA, 19 bp, Homo sapiens
aaatatcagagagatgata

SEQ ID NO: 8553256 - DNA, 22 bp, Homo sapiens
aaatatagtgacacttatagtc

SEQ ID NO: 8553257 - DNA, 22 bp, Homo sapiens
aaatatagtaaatgcatagttc

SEQ ID NO: 8553258 - DNA, 22 bp, Homo sapiens
aagaagcaggtcacagacaggg

SEQ ID NO: 8553259 - DNA, 20 bp, Homo sapiens
aagaagccgggaaggcaggc

SEQ ID NO: 8553260 - DNA, 22 bp, Homo sapiens
aagaagcatggctgtagattcc

SEQ ID NO: 8553261 - DNA, 22 bp, Homo sapiens
aagaaggcttcagagcccagga

SEQ ID NO: 8553262 - DNA, 22 bp, Homo sapiens
aagaaggaagtgtggacatcac

SEQ ID NO: 8553263 - DNA, 22 bp, Homo sapiens
aagaagctgtagggattaactc

SEQ ID NO: 8553264 - DNA, 22 bp, Homo sapiens
aaagttgttgttcacaggttat

SEQ ID NO: 8553265 - DNA, 22 bp, Homo sapiens
aaagttgttcagtaagaaactc

SEQ ID NO: 8553266 - DNA, 22 bp, Homo sapiens
aaagttgtggtttgatgcagtt

SEQ ID NO: 8553267 - DNA, 22 bp, Homo sapiens
aaagttgtgaaaccgaacatgt

SEQ ID NO: 8553268 - DNA, 22 bp, Homo sapiens
aaagttgtaatggaagaaatgc

SEQ ID NO: 8553269 - DNA, 22 bp, Homo sapiens
aaagttggatttcatcctcatg

SEQ ID NO: 8553270 - DNA, 23 bp, Homo sapiens
aaagttgatttgcagtttaagag

SEQ ID NO: 8553271 - DNA, 22 bp, Homo sapiens
aaagttgaccgaaagattttga

SEQ ID NO: 8553272 - DNA, 19 bp, Homo sapiens
aaagttgagaaacaatgga

SEQ ID NO: 8553273 - DNA, 22 bp, Homo sapiens
aaagttgagttttatgtgttac

SEQ ID NO: 8553274 - DNA, 22 bp, Homo sapiens
aaagttgagttttatgtgttac

SEQ ID NO: 8553275 - DNA, 19 bp, Homo sapiens
aaatacagcagctgtttcc

SEQ ID NO: 8553276 - DNA, 22 bp, Homo sapiens
aagaagtggtccttttctttct

SEQ ID NO: 8553277 - DNA, 22 bp, Homo sapiens
aagaagtggttggaagaagcat

SEQ ID NO: 8553278 - DNA, 22 bp, Homo sapiens
aaatacaaaaattagccaggca

SEQ ID NO: 8553279 - DNA, 22 bp, Homo sapiens
aagaagtggttggaagaagcat

SEQ ID NO: 8553280 - DNA, 22 bp, Homo sapiens
aaatacagtggcagcagataat

SEQ ID NO: 8553281 - DNA, 22 bp, Homo sapiens
aaatacagtggcagcagataat

SEQ ID NO: 8553282 - DNA, 22 bp, Homo sapiens
aaatacagtggcagcagataat

SEQ ID NO: 8553283 - DNA, 22 bp, Homo sapiens
aaatacagtgtgtgttctttga

SEQ ID NO: 8553284 - DNA, 22 bp, Homo sapiens
aagagagaactcccttcgccag

SEQ ID NO: 8553285 - DNA, 22 bp, Homo sapiens
aaatacataaaggttgtaccag

SEQ ID NO: 8553286 - DNA, 22 bp, Homo sapiens
aaatacataaaggttgtaccag

SEQ ID NO: 8553287 - DNA, 22 bp, Homo sapiens
aaatacatacactgtacgtggc

SEQ ID NO: 8553288 - DNA, 22 bp, Homo sapiens
aaatacatacactgtacgtggc

SEQ ID NO: 8553289 - DNA, 22 bp, Homo sapiens
aaagttctctatggtgtaaaaa

SEQ ID NO: 8553290 - DNA, 22 bp, Homo sapiens
aaagttctcctggattgtgctg

SEQ ID NO: 8553291 - DNA, 22 bp, Homo sapiens
aaagttacacgactatttatgt

SEQ ID NO: 8553292 - DNA, 22 bp, Homo sapiens
aaagttctgggggagaagaacg

SEQ ID NO: 8553293 - DNA, 22 bp, Homo sapiens
aaagttctgggggagaagaacg

SEQ ID NO: 8553294 - DNA, 22 bp, Homo sapiens
aaagttctggagaaaataatga

SEQ ID NO: 8553295 - DNA, 22 bp, Homo sapiens
aaagttctgggggagaagaacg

SEQ ID NO: 8553296 - DNA, 22 bp, Homo sapiens
aacttgaaccacagaagctgcc

SEQ ID NO: 8553297 - DNA, 22 bp, Homo sapiens
aacttgaactgatgagtgttag

SEQ ID NO: 8553298 - DNA, 22 bp, Homo sapiens
aacttcttggtcctgagctgtt

SEQ ID NO: 8553299 - DNA, 22 bp, Homo sapiens
aacttctaatctgtacagtttt

SEQ ID NO: 8553300 - DNA, 22 bp, Homo sapiens
aacttctcagcctgcacctggc

SEQ ID NO: 8553301 - DNA, 22 bp, Homo sapiens
aacttccttctagttcatatgt

SEQ ID NO: 8553302 - DNA, 22 bp, Homo sapiens
aacttccttctagttcatatgt

SEQ ID NO: 8553303 - DNA, 20 bp, Homo sapiens
aaagtcttatggttaatttt

SEQ ID NO: 8553304 - DNA, 20 bp, Homo sapiens
aaagtctgtttatctctgga

SEQ ID NO: 8553305 - DNA, 20 bp, Homo sapiens
aaagtctgtttatctctgga

SEQ ID NO: 8553306 - DNA, 22 bp, Homo sapiens
aaagtcttaatgtaagtttagt

SEQ ID NO: 8553307 - DNA, 22 bp, Homo sapiens
aaagtctgaaagatgctaacat

SEQ ID NO: 8553308 - DNA, 22 bp, Homo sapiens
aaagtcctgactgcaggggatg

SEQ ID NO: 8553309 - DNA, 20 bp, Homo sapiens
aaagtcccttagtgggagca

SEQ ID NO: 8553310 - DNA, 22 bp, Homo sapiens
aaagtcctagcgatccacagaa

SEQ ID NO: 8553311 - DNA, 22 bp, Homo sapiens
aaagtctccactgggaaccaaa

SEQ ID NO: 8553312 - DNA, 22 bp, Homo sapiens
aaagtctcaggcaaaccaggac

SEQ ID NO: 8553313 - DNA, 22 bp, Homo sapiens
aaagtcctgttaactgttaaca

SEQ ID NO: 8553314 - DNA, 22 bp, Homo sapiens
aaagtcctgttaactgttaaca

SEQ ID NO: 8553315 - DNA, 22 bp, Homo sapiens
aaagtccttgcagtttcctctt

SEQ ID NO: 8553316 - DNA, 22 bp, Homo sapiens
aaagggaagttgcacatgttcc

SEQ ID NO: 8553317 - DNA, 22 bp, Homo sapiens
aaagggaatgtgtaggacatgt

SEQ ID NO: 8553318 - DNA, 22 bp, Homo sapiens
aaagggagcatggctgcaggga

SEQ ID NO: 8553319 - DNA, 22 bp, Homo sapiens
aaagggagcatggctgcaggga

SEQ ID NO: 8553320 - DNA, 22 bp, Homo sapiens
aaagggcagagttcactagaaa

SEQ ID NO: 8553321 - DNA, 22 bp, Homo sapiens
aaaggcttgtttgaggactggt

SEQ ID NO: 8553322 - DNA, 22 bp, Homo sapiens
aaaggctttaaaatgtacatat

SEQ ID NO: 8553323 - DNA, 22 bp, Homo sapiens
aaaggctatgagatagaagata

SEQ ID NO: 8553324 - DNA, 22 bp, Homo sapiens
aaaggctatgagatagaagata

SEQ ID NO: 8553325 - DNA, 22 bp, Homo sapiens
aaaggctatgagatagaagata

SEQ ID NO: 8553326 - DNA, 22 bp, Homo sapiens
aaaggctggaaactgaagataa

SEQ ID NO: 8553327 - DNA, 22 bp, Homo sapiens
aaaggctccttctcccatgacc

SEQ ID NO: 8553328 - DNA, 22 bp, Homo sapiens
aacatgatagtattttgaggtg

SEQ ID NO: 8553329 - DNA, 22 bp, Homo sapiens
aacatgaagttttctatagtga

SEQ ID NO: 8553330 - DNA, 22 bp, Homo sapiens
aacatgaagttttctatagtga

SEQ ID NO: 8553331 - DNA, 22 bp, Homo sapiens
aacatgatgacattgtaagctt

SEQ ID NO: 8553332 - DNA, 21 bp, Homo sapiens
aacatgatatgtgtatggatt

SEQ ID NO: 8553333 - DNA, 22 bp, Homo sapiens
aacatgatgtgaagcatgaact

SEQ ID NO: 8553334 - DNA, 22 bp, Homo sapiens
aacatgatgtattttcttgtct

SEQ ID NO: 8553335 - DNA, 22 bp, Homo sapiens
aaaggcatgcctccatttctat

SEQ ID NO: 8553336 - DNA, 22 bp, Homo sapiens
aaaggcatgattaattctgtgt

SEQ ID NO: 8553337 - DNA, 22 bp, Homo sapiens
aaaggcatgattaattctgtgt

SEQ ID NO: 8553338 - DNA, 22 bp, Homo sapiens
aacatgatttagtataatgcag

SEQ ID NO: 8553339 - DNA, 22 bp, Homo sapiens
aacatgatttagtataatgcag

SEQ ID NO: 8553340 - DNA, 22 bp, Homo sapiens
aacatgattggaaaatgctgtc

SEQ ID NO: 8553341 - DNA, 22 bp, Homo sapiens
aacatgattggaaaatgctgtc

SEQ ID NO: 8553342 - DNA, 22 bp, Homo sapiens
aacatgaaacccaaacagaata

SEQ ID NO: 8553343 - DNA, 22 bp, Homo sapiens
aaaggcagagtgctcagctggc

SEQ ID NO: 8553344 - DNA, 22 bp, Homo sapiens
aacatgaaagttgctaagtgca

SEQ ID NO: 8553345 - DNA, 22 bp, Homo sapiens
aacatgaaagttgctaagtgca

SEQ ID NO: 8553346 - DNA, 22 bp, Homo sapiens
aacatgaaggtaggatggtttt

SEQ ID NO: 8553347 - DNA, 23 bp, Homo sapiens
aaaggcacagcattgtctagcag

SEQ ID NO: 8553348 - DNA, 20 bp, Homo sapiens
aaaggcacagcaacagagct

SEQ ID NO: 8553349 - DNA, 20 bp, Homo sapiens
aaaggcacagcaacagagct

SEQ ID NO: 8553350 - DNA, 22 bp, Homo sapiens
aaaggcactagaagttaccttt

SEQ ID NO: 8553351 - DNA, 22 bp, Homo sapiens
aaaggcactgatcttatccagt

SEQ ID NO: 8553352 - DNA, 22 bp, Homo sapiens
aaaggcactggatagctgggga

SEQ ID NO: 8553353 - DNA, 22 bp, Homo sapiens
aaaggcactggatagctgggga

SEQ ID NO: 8553354 - DNA, 22 bp, Homo sapiens
aaaggattagagataccatgcc

SEQ ID NO: 8553355 - DNA, 22 bp, Homo sapiens
aaaggcacacactccttgttat

SEQ ID NO: 8553356 - DNA, 22 bp, Homo sapiens
aaaggcacaaattcagcatttt

SEQ ID NO: 8553357 - DNA, 22 bp, Homo sapiens
aaaggcacaaattcagcatttt

SEQ ID NO: 8553358 - DNA, 22 bp, Homo sapiens
aaaggcacagaagggaaaccaa

SEQ ID NO: 8553359 - DNA, 22 bp, Homo sapiens
aaaggcacagaagggaaaccaa

SEQ ID NO: 8553360 - DNA, 22 bp, Homo sapiens
aaaggcacacactccttgttat

SEQ ID NO: 8553361 - DNA, 22 bp, Homo sapiens
aaaggataaggttatcaatttt

SEQ ID NO: 8553362 - DNA, 22 bp, Homo sapiens
aaaggagttactcataaagctt

SEQ ID NO: 8553363 - DNA, 22 bp, Homo sapiens
aaaggataaggttatcaatttt

SEQ ID NO: 8553364 - DNA, 22 bp, Homo sapiens
aaaggataaggttatcaatttt

SEQ ID NO: 8553365 - DNA, 22 bp, Homo sapiens
aaaggatggctctgcatatttg

SEQ ID NO: 8553366 - DNA, 22 bp, Homo sapiens
aaaggaggccacatggctagga

SEQ ID NO: 8553367 - DNA, 21 bp, Homo sapiens
aaagcatcacgaacatttggg

SEQ ID NO: 8553368 - DNA, 22 bp, Homo sapiens
aaagcatgactcaagaattact

SEQ ID NO: 8553369 - DNA, 22 bp, Homo sapiens
aaagcatgactcaagaattact

SEQ ID NO: 8553370 - DNA, 22 bp, Homo sapiens
aaagcatgtgaatagaatatgg

SEQ ID NO: 8553371 - DNA, 22 bp, Homo sapiens
aaagcatggttaaagacagtgg

SEQ ID NO: 8553372 - DNA, 22 bp, Homo sapiens
aaagcatggttaaagacagtgg

SEQ ID NO: 8553373 - DNA, 22 bp, Homo sapiens
aaagcatgattagatagatgat

SEQ ID NO: 8553374 - DNA, 22 bp, Homo sapiens
aaagcatgctactttatatagg

SEQ ID NO: 8553375 - DNA, 22 bp, Homo sapiens
aaagcatggcatgaagaacatg

SEQ ID NO: 8553376 - DNA, 22 bp, Homo sapiens
aaagcatgctactttatatagg

SEQ ID NO: 8553377 - DNA, 20 bp, Homo sapiens
aaagcatttacttgtgattg

SEQ ID NO: 8553378 - DNA, 22 bp, Homo sapiens
aaagcatttcatgtctagaaag

SEQ ID NO: 8553379 - DNA, 22 bp, Homo sapiens
aaagcatttcatgtctagaaag

SEQ ID NO: 8553380 - DNA, 22 bp, Homo sapiens
aaagccaaatgaaagatggttc

SEQ ID NO: 8553381 - DNA, 22 bp, Homo sapiens
aaaggaagtgccactcttcttc

SEQ ID NO: 8553382 - DNA, 22 bp, Homo sapiens
aaagccacagttctatgtctgc

SEQ ID NO: 8553383 - DNA, 23 bp, Homo sapiens
aaagccaagtcagtctactggaa

SEQ ID NO: 8553384 - DNA, 22 bp, Homo sapiens
aaattgctgacacttgaccatt

SEQ ID NO: 8553385 - DNA, 22 bp, Homo sapiens
aaattgctctttaaaagtactg

SEQ ID NO: 8553386 - DNA, 22 bp, Homo sapiens
aaattgctgaccaagtatattc

SEQ ID NO: 8553387 - DNA, 22 bp, Homo sapiens
aaattgctgaccaagtatattc

SEQ ID NO: 8553388 - DNA, 22 bp, Homo sapiens
aaattccagaaactcagtatat
